United States Patent 9,050,297 (MODIFIED POLYNUCLEOTIDES ENCODING ARYL HYDROCARBON RECEPTOR NUCLEAR TRANSLOCATOR) - sequence listing, part 4

SEQ ID NO: 2923 - DNA, 5541 bp, Homo sapiens
cttcgatcgtccgattctcccagccgcaccacgggtgctcccacctgcggagaaccggagtctggcgatgccaaggcgcttctgggaattgtagttccgggcgggatgagggcagcacgcctggctccgctccttcttacgcatgcgcgactccgagctggccaaagaagttcgtcccctttgtgaggcccgggatgggaggtgcccggttcccccagggacagcttcaagcggtagggacagacatctgaggacccagcctcagggatgctgtccccgggcttccaggctccagcgccgtaggactgaggcagactccacggtgagaaagagacccgatctaacccaggcctttcatcagagcccaggagggaaggcaggaagtgggaccacgaggcccggggggcttctaactcgtctggccagggagatctgaattggggtgaagagcagaatctccagaacaaggaggaggtggtgatcatggagacagatttggctgaaatgcctgagaaaggagctctgtcttcccaggattctccccatttccaagagaagagcacagaagagggagaagtggctgctctgcgcctcacggccagatcccaggaaacagtgacattcaaggatgtggccatggactttacaccagaggagtgggggaagctggatcctgcacaaagggatgtgatgctggagaactataggaacctagtctcactttggcttccagtttccaaacctgagagctacaacttggagaatggaaaagaaccattgaagcttgagagaaaagcccccaaaagcagctattcagacatggagactagaccacagagcaaggattcaacttcagtgcaagatttttccaaagcagaatcatgcaaagttgcaataatagacagactgacacggaatagtgtctatgactctaacttggaagcagcccttgaatgtgaaaattggttagagaatcagcaaggaaatcaggagagacatttgagagaaatgttcactcacatgaattcactctctgaggaaacagaccataagcatgatgtatactggaaaagcttcaatcagaaatctgtccttatcactgaagacagagttcccaaaggatcttatgccttccatacacttgaaaaaagcttgaaacaaaaatcaaacttaatgaaaaagcagagaacttataaagagaaaaaacctcataaatgtaatgattgtggtgaactcttcacctaccattcagtgcttattcgacaccagagagtccatactggagagaaaccctatacctgcaatgaatgtgggaaatcttttagccacagagctaatttaactaaacaccagagaactcatactagaattctctttgaatgcagtgaatgcaagaaaaccttcacagaaagctcatcccttgcaacacatcagagaattcacgttggagagagaccttatgaatgcaatgaatgtgggaaaggttttaatcgaagtacacatcttgtgcagcatcagttgattcatactggagtgaagccttatgaatgtaatgaatgtgataaagcttttattcattcatcagcactcattaaacatcaaagaactcatactggagagaaaccttataaatgtcaagaatgtgggaaagcctttagccattgctcatccctaactaagcatcagagagttcatactggagaaaagccatatgaatgcagtgaatgtggaaaaacttttagtcagagcacacatcttgttcaacatcagagaattcacactggagagaaaccctatgagtgtaatgaatgtgggaaaaccttcagccggagctccaattttgctaaacatcaaagaattcatattggaaagaaaccgtacaaatgtagcgagtgtggaaaagccttcattcattcatcagctctcattcaacatcagagaactcataccggagagaaaccctttagatgtaatgagtgtgggaaaagctttaagtgcagttcatctctcatcagacatcaaagagttcacactgaagagcaaccctgaaaaattactgaatgtgaagaaatgtaagttggttttatcactgtattaaatacttgagtgtttaggtggaaggcgcatccataatatgcatgtgaggaccaattctgtatgcatctaatttcatttgcgtaatacatagttttgagccataagcaggttctttatgtccgttaatttgataattatgaaatctagccagcgatttcaaaattttaatctccaacgtcccaaatagctatctgtggaaattcaagaagtccctgagagtaggtagcagtacgaacattgtgaaatccagttttcccctctcttgtttatgtcagagctttgttgtaagcctctcactttgtaaggaaattcttattgggtaggttaggctgagggcttacatccttatcatcaggaagacacaatgttgttatttattactccttgagatctagatacacatatggtataattcatctagagtgtaatttcttttatattagccttaaaaaccaaaaatgctgggttcaaagtccttagaattcccttcctccctcaacaagctgctgtctatgttgatgaccataactgggatgtataatatttacagacaactctaagttacgttcacatggattatgtacatcattgatttttttttttttttttttttgagacagagtcttgctctgttgcccgggctggagtgcagtggcgcgatctcggctcactgcaacctccacctcccaggttcatgccattctcttgtctcagcctcccaagtagctgggactacaggcacctgccagtacgcctggctaattttttttgtatttttagtagagatggggtttcaccatgttagccaggatggtcttgatctcctgacctcgtgatctgcctgcctcggcctcccaaagtgctgggattacaggcatgagccaccatgcctggcatcatcattgatttatgtcattgttatccctctaccgcggagaccttctttcattttccatttccctgggagttcacgtgaagtagtgaatgggtcaaaatcttaacagtggttgttgatcaagtccttcctttcttatccttggcactgaataaatctttggttttccataatcaaagggtgagggagacttcttttgtctacattattcagctttctgaaagctatgctgtgtccatttgagaaaaagccccagggatattgaaggtctgagaagttgagtggttcagtgtgttattatatttagggtcccagtaaagaagaactgaagcaactgtgagacaccagggcatacttccctgtatgagtggaaaacaaggcacggaaaatagctcacaggatagtcctcaactgacttgcttgaggataagcagcttcccttcgtgaagaagttgccatttctctggccttcatatttatctactttttgttattgttgtctgtatcggttcaatctcacactgctataaagaaatgcctgagactgggtaacttataaagaaaaaaggtttaattggctcatggttccatgggctgtacaggaagtatgactggggaggtctcagggagcttttactcatggcaaaaggcaaagccagagcaggtatcttcacagggctagagcaagaggaaaagagagaggggaggtgctacacactttttatgcaaccaaatctcatgagaactctatcacgagacagcagtagggggacagtgctaaatcattcatgagaaactacctgcgtggtccagtcaccttgcaccaggccccacctcccacattggggattacaattaaacatgagatttgggtggggatacagatctaaactgtatcattactcaaaaaaaaaaaaaaaaagaaagaaaagaaaacacaggaaaaggaactcacctcttttatcatcttagtatttagtactaatggtttagagcaggaattgacaaactgtggcctggactcatggaccaactctggcccaccacctgtttctcagaagaaaattttattggaactcagccacacttactcatttacatgttgtccttgactgcctttgtgtccagtgtcagaactgagtagctgcagcggaggttgtgcctctgggctttaatatcacaaacagagcagcttataagcaacagaaacttacttctcacagttttggaggctgggaagtccaagatcaaggtgtcaacatatttagggtctagggaaggtctgcttcttggttaatagaaagcacctttcactgtgtcttcacatggtagaaggggagagctctggtatcttcagccccttataagggcactaatcccattcatgagagctccaccctcacgacctaatcacctccaaaaggccccatttcgtaataccgtcagttaagtttcattatatgactttgatggggatatagcccatagtaggttgtatgtccctgaaagcctaaaatatttactgtttggctctttacagaaaatattttcttggcccctgttccagagcattcatcaagtcagataaagggtttaaaccagtcagagaaactaggtggaatggaaaagtactgagagataattggggacagaaaaataaaagagatgggaaatgctgcatcaaaatactcctacctctaggatgttactatatattgttaggagaattcaagttattgaaacttgccaaattcttgagtgaagaggaattcatttgagagccaaaatttgactaaggaaagaagaccaacatgggctttccaaagttgagtttgaattctgccatccccactaagcagtcatgtgaccttggaaaaactccctactctgagtctcagtttctttatctgtattaggtttcaacaaagggaataaatcattggcttctcatgaggttgtcataaggattaaataagacaatgcatataaaagaactggcagacaataaatatagagtcccccactcctgcttggtgctctctttctctctccttctctacatagagaagtgccagagcatccgtcagtagaagttacttaaggttggctgtgtcttccacatcttttgtttacccatgaagaactgtgaccatcttgttctgtgtcttgtcataaagatgggacgtgacttctttctgctcttgcttccatctggtgctgttttctgcacagcctccttgagaccttccagaaccttcttttttcctacttcatatcacttaaccagtagctatctgggatggttccagaggctgaagtttgcagttgaataacattttaaatagtgttaagcgacttgggatctctggccctttgcgtttcagtatttgtcctttttatgcctgatgtttaacctgccacatgtttgtactgcaacatgaatcttggaaattttaatgttatgcatttcaaatgtttttggttatctgtaaactaaatgtgcccttattggctcacttgtcaataaagatgtttgtatatgtattgtc

SEQ ID NO: 2924 - DNA, 5616 bp, Homo sapiens
ggtgagttgcttgtggtgatgtcgctcgtctcggctcggcctcggcggtggttccccgggtcgttctgtgccgagtcggggctagagtgcgcgtttgttaaaggggcctcgagggcagaccatgagccctgtcccttctcactctggcctgatcctctcctcgggggacgcggttgtgccacgggcggggtggtcgcggggttctgggccagtgccccgagcgcggcagaatttgtccaaactcctgatgccccagcgtcacctcttccaggtgcccggttcccccagggacagcttcaagcggtagggacagacatctgaggacccagcctcagggatgctgtccccgggcttccaggctccagcgccgtaggactgaggcagactccacggtgagaaagagacccgatctaacccaggcctttcatcagagcccaggagggaaggcaggaagtgggaccacgaggcccggggggcttctaactcgtctggccagggagatctgaattggggtgaagagcagaatctccagaacaaggaggaggtggtgatcatggagacagatttggctgaaatgcctgagaaaggagctctgtcttcccaggattctccccatttccaagagaagagcacagaagagggagaagtggctgctctgcgcctcacggccagatcccaggaaacagtgacattcaaggatgtggccatggactttacaccagaggagtgggggaagctggatcctgcacaaagggatgtgatgctggagaactataggaacctagtctcactttggcttccagtttccaaacctgagagctacaacttggagaatggaaaagaaccattgaagcttgagagaaaagcccccaaaagcagctattcagacatggagactagaccacagagcaaggattcaacttcagtgcaagatttttccaaagcagaatcatgcaaagttgcaataatagacagactgacacggaatagtgtctatgactctaacttggaagcagcccttgaatgtgaaaattggttagagaatcagcaaggaaatcaggagagacatttgagagaaatgttcactcacatgaattcactctctgaggaaacagaccataagcatgatgtatactggaaaagcttcaatcagaaatctgtccttatcactgaagacagagttcccaaaggatcttatgccttccatacacttgaaaaaagcttgaaacaaaaatcaaacttaatgaaaaagcagagaacttataaagagaaaaaacctcataaatgtaatgattgtggtgaactcttcacctaccattcagtgcttattcgacaccagagagtccatactggagagaaaccctatacctgcaatgaatgtgggaaatcttttagccacagagctaatttaactaaacaccagagaactcatactagaattctctttgaatgcagtgaatgcaagaaaaccttcacagaaagctcatcccttgcaacacatcagagaattcacgttggagagagaccttatgaatgcaatgaatgtgggaaaggttttaatcgaagtacacatcttgtgcagcatcagttgattcatactggagtgaagccttatgaatgtaatgaatgtgataaagcttttattcattcatcagcactcattaaacatcaaagaactcatactggagagaaaccttataaatgtcaagaatgtgggaaagcctttagccattgctcatccctaactaagcatcagagagttcatactggagaaaagccatatgaatgcagtgaatgtggaaaaacttttagtcagagcacacatcttgttcaacatcagagaattcacactggagagaaaccctatgagtgtaatgaatgtgggaaaaccttcagccggagctccaattttgctaaacatcaaagaattcatattggaaagaaaccgtacaaatgtagcgagtgtggaaaagccttcattcattcatcagctctcattcaacatcagagaactcataccggagagaaaccctttagatgtaatgagtgtgggaaaagctttaagtgcagttcatctctcatcagacatcaaagagttcacactgaagagcaaccctgaaaaattactgaatgtgaagaaatgtaagttggttttatcactgtattaaatacttgagtgtttaggtggaaggcgcatccataatatgcatgtgaggaccaattctgtatgcatctaatttcatttgcgtaatacatagttttgagccataagcaggttctttatgtccgttaatttgataattatgaaatctagccagcgatttcaaaattttaatctccaacgtcccaaatagctatctgtggaaattcaagaagtccctgagagtaggtagcagtacgaacattgtgaaatccagttttcccctctcttgtttatgtcagagctttgttgtaagcctctcactttgtaaggaaattcttattgggtaggttaggctgagggcttacatccttatcatcaggaagacacaatgttgttatttattactccttgagatctagatacacatatggtataattcatctagagtgtaatttcttttatattagccttaaaaaccaaaaatgctgggttcaaagtccttagaattcccttcctccctcaacaagctgctgtctatgttgatgaccataactgggatgtataatatttacagacaactctaagttacgttcacatggattatgtacatcattgatttttttttttttttttttttgagacagagtcttgctctgttgcccgggctggagtgcagtggcgcgatctcggctcactgcaacctccacctcccaggttcatgccattctcttgtctcagcctcccaagtagctgggactacaggcacctgccagtacgcctggctaattttttttgtatttttagtagagatggggtttcaccatgttagccaggatggtcttgatctcctgacctcgtgatctgcctgcctcggcctcccaaagtgctgggattacaggcatgagccaccatgcctggcatcatcattgatttatgtcattgttatccctctaccgcggagaccttctttcattttccatttccctgggagttcacgtgaagtagtgaatgggtcaaaatcttaacagtggttgttgatcaagtccttcctttcttatccttggcactgaataaatctttggttttccataatcaaagggtgagggagacttcttttgtctacattattcagctttctgaaagctatgctgtgtccatttgagaaaaagccccagggatattgaaggtctgagaagttgagtggttcagtgtgttattatatttagggtcccagtaaagaagaactgaagcaactgtgagacaccagggcatacttccctgtatgagtggaaaacaaggcacggaaaatagctcacaggatagtcctcaactgacttgcttgaggataagcagcttcccttcgtgaagaagttgccatttctctggccttcatatttatctactttttgttattgttgtctgtatcggttcaatctcacactgctataaagaaatgcctgagactgggtaacttataaagaaaaaaggtttaattggctcatggttccatgggctgtacaggaagtatgactggggaggtctcagggagcttttactcatggcaaaaggcaaagccagagcaggtatcttcacagggctagagcaagaggaaaagagagaggggaggtgctacacactttttatgcaaccaaatctcatgagaactctatcacgagacagcagtagggggacagtgctaaatcattcatgagaaactacctgcgtggtccagtcaccttgcaccaggccccacctcccacattggggattacaattaaacatgagatttgggtggggatacagatctaaactgtatcattactcaaaaaaaaaaaaaaaaagaaagaaaagaaaacacaggaaaaggaactcacctcttttatcatcttagtatttagtactaatggtttagagcaggaattgacaaactgtggcctggactcatggaccaactctggcccaccacctgtttctcagaagaaaattttattggaactcagccacacttactcatttacatgttgtccttgactgcctttgtgtccagtgtcagaactgagtagctgcagcggaggttgtgcctctgggctttaatatcacaaacagagcagcttataagcaacagaaacttacttctcacagttttggaggctgggaagtccaagatcaaggtgtcaacatatttagggtctagggaaggtctgcttcttggttaatagaaagcacctttcactgtgtcttcacatggtagaaggggagagctctggtatcttcagccccttataagggcactaatcccattcatgagagctccaccctcacgacctaatcacctccaaaaggccccatttcgtaataccgtcagttaagtttcattatatgactttgatggggatatagcccatagtaggttgtatgtccctgaaagcctaaaatatttactgtttggctctttacagaaaatattttcttggcccctgttccagagcattcatcaagtcagataaagggtttaaaccagtcagagaaactaggtggaatggaaaagtactgagagataattggggacagaaaaataaaagagatgggaaatgctgcatcaaaatactcctacctctaggatgttactatatattgttaggagaattcaagttattgaaacttgccaaattcttgagtgaagaggaattcatttgagagccaaaatttgactaaggaaagaagaccaacatgggctttccaaagttgagtttgaattctgccatccccactaagcagtcatgtgaccttggaaaaactccctactctgagtctcagtttctttatctgtattaggtttcaacaaagggaataaatcattggcttctcatgaggttgtcataaggattaaataagacaatgcatataaaagaactggcagacaataaatatagagtcccccactcctgcttggtgctctctttctctctccttctctacatagagaagtgccagagcatccgtcagtagaagttacttaaggttggctgtgtcttccacatcttttgtttacccatgaagaactgtgaccatcttgttctgtgtcttgtcataaagatgggacgtgacttctttctgctcttgcttccatctggtgctgttttctgcacagcctccttgagaccttccagaaccttcttttttcctacttcatatcacttaaccagtagctatctgggatggttccagaggctgaagtttgcagttgaataacattttaaatagtgttaagcgacttgggatctctggccctttgcgtttcagtatttgtcctttttatgcctgatgtttaacctgccacatgtttgtactgcaacatgaatcttggaaattttaatgttatgcatttcaaatgtttttggttatctgtaaactaaatgtgcccttattggctcacttgtcaataaagatgtttgtatatgtattgtcagaaa

SEQ ID NO: 2925 - DNA, 5328 bp, Homo sapiens
cgcgactccgagctggccaaagaagttcgtcccctttgtgaggcccgggatgggaggctccagcgccgtaggactgaggcagactccacggtgagaaagagacccgatctaacccaggcctttcatcagagcccaggagggaaggcaggaagtgggaccacgaggcccggggggcttctaactcgtctggccagggagatctgaattggggtgaagagcagaatctccagaacaaggaggaggtggtgatcatggagacagatttggctgaaatgcctgagaaaggagttctgtcttcccaggattctccccatttccaagagaagagcacagaagagggagaagtggctgctctgcgcctcacggccagatcccaggcggcggcggcggcggcggcgcccgggagccggagccttcgcggcgtccacgtccctcccccgctgcaccccgccccggcgcgagaggagatcaaatccacttgctccttgaaggcatgcttttcactttcattaactcttacctattacagaactgcctttttgttgagcacagaaaacgaaggaaatttgcatttccaatgtccttcagacgtggagactagaccacagagcaaggattcaacttcagtgcaagatttttccaaagcagaatcatgcaaagttgcaataatagacagactgacacggaatagtgtctatgactctaacttggaagcagcccttgaatgtgaaaattggttagagaagcagcaaggaaatcaggagagacatttgagagaaatgttcactcacatgaattcactctctgaggaaacagaccatgagcatgatgtatactggaaaagcttcaatcagaaatctgtccttatcactgaagacagagttcccaaaggatcttatgccttccatacacttgaaaaaagcttgaaacaaaaatcaaacttaatgaaaaagcagagaacttataaagagaaaaaacctcataaatgtaatgattgtggtgaactcttcacctgccattcagtgcatattcaacaccagagagtccatactggagagaaaccctatacctgcaatgaatgtgggaaatcttttagccacagagctaatttaactaaacaccagagaactcatactagaattctctttgaatgccgtgaatgtaagaaaaccttcacagaaagctcatcccttgcaacacatcagagaattcacgttggagagagaccttatgaatgcaatgaatgtgggaaaggttttaatcgaagtacacatcttgtgcagcatcagttgattcatactggagtgaggccttatgaatgtaatgaatgtgataaagcttttattcattcatcagcactcattaaacatcaaagaactcatactggagagaaaccttataaatgtcaagaatgtgggaaagcctttagccattgctcatccctaactaagcatcagagagttcatactggagaaaagccatatgaatgcagtgaatgtggaaaaacttttagtcagagcacacatcttgttcaacatcagagaattcacactggagagaaaccctatgagtgtagtgaatgtgggaaaaccttcagccagagctccaattttgctaaacatcaaagaattcatattggaaagaaaccgtacaaatgtagtgagtgtggaaaagccttcattcattcatcagctcttattcaacatcagagaactcataccggagagaaaccctttagatgtaatgagtgtgggaaaagctttaagtgcagttcatctctcatcagacatcaaagagttcacactgaagagcaaccctgaaaaattactgaatgtgaagaaatgtaagttggttttatcactatattaaatacttgagtgtttaggtggaaggcccatccataatatgcatgtgaggaccaattctatatgcatctaatttcatttgtgtaatacatagttttgagccataggcaggttctttatgtccgttaatttgataattatgaaatctagccagcgatttcaaaattttaatctccaacctcccaaatagctatctgtggaaattcaagaagtccctgagagtgggtagcagtacaaacattgtgaaatccagttttcccctctcttgtttatgtcagagctttgttgtaagcctctcactttgtaaggaaattcttattgggtaggttaggctgagggcttacatccttatcatcaggaagacacaatgttgttatttattactccttgagatctagatacacatatggtataattcatctagagtgtcatttcttttatattagccttaaaaaccaaaaatgctgggttcaaagtccttagcattcccttcctccctcaacaagctgctgtctattttgatgaccataactaggatgtataatatttacagacaattctaatttatgttcacatggattatgtacatcattgatttttttttttttttttttttgagacagagtctcgctctgttgcccgggctggagtgcagtggcgtgatctcagctcactgcaacctccacctcccaggttcatgccattctcttgtctcagcctcctgagtagctgggactacaggcacctgccagtacgcctggctaattttttttgtatttttagtagagatggggtttcaccatgttagccaggatggtcttgatctcctgacctcgtgatctgcctgcctcggcctcccaaagtgctgggattacaggcgtgagccaccatgcctggcatcatcattgatttatgtcattgttatccctctaccgcggagaccttctttcattttccatttccctgggagttcacgtgaagtagtgaatgggtcaaaatcttaacagtggttgttgatcaagtccttcctttcttatccttggcactgaataaatctttggttttccataatcaaagggtgagggagacttcttttgtctacattattcagctttctgaaagctatgctgtgtccatttgagaaaaagccccagggatattgaaggtctgagaagttgagtggttcagtgtgttattatatttagggtcccagtaaagaagaactgaagcaactgtgagacaccagggcatacttccctgtatgagtggaaaacaaggtacggaaaatagctcacaggatagtcctcaactgacttgcttgaggataagcagcttcccttcatgaagaagttgccatttctctggccttcatatttacctactttttgttattgttatctgtatcggttcaatctcacactgctataaagaaatgcctgagactgggtaacttataaagaaaaaaggtttaattggctcatggttccatgggctgtacaggaagtatgactggggaggtctcagggagcttttactcatggcaaaaggcaaagccagagcaggtatcttcacagggctagagcaagaggaaaagagagaggggaggtgctacacactttttatgcaaccaaatctcatgagaactctatcacgagacagcagtagggggacagtgctaaatcattcatgagaaactacctgcgtggtccagtcaccttgcaccaggccccacctcccacattggggattacaattaaacatgagatttgggtggggatacagatctaaactgtatcattactcaaaaaaaaaaaaaaaagaaaaaagaaagaaaacacaggaaaaggaactcacctcttttatcatcttagtatttagtactaatggtttagagcaggagttgacaaactgtggcctggactcatggaccaactctggcccaccacctgtttctcagaagaaaattttattggaactcagccacacttactcatttacatgttgtccttgactgcctttgtgtccagtgtcagaactgagtagctgcagcggaggttgtgcctctgggctttaatatcacaaacagagcagcttataagcaacagaaacttacttctcacagttttggaggctgggaagtccaagatcaaggtgtcaacatatttagggtctagggaaggtctgcttcttggttaatagaaagcacctttcactgtgtcttcacatggtagaaggggagagctctggtatcttcaggcccttataagggcactaatcccattcatgagcgctccaccctcacgacctaatcacctccaaaaggccccatttcataataccatcaattaagtttcattatatgactttgatggggatatagcccatagtaggttctatgtccctgaaagcctaaaatatttactgtttggctctttacagaaaatattttcttggcccctgttccagagcattcatcaagaagtcagataaagggtttaaaccagtcagagaaagtaggtggaatggaaaagttgaacttactgagagataactggggacagaaaaataaaagaggtgggaaatgatgcatcaaaatactcctacctctaggatgttactatatattgtcaggagaattcaagttattgaaacttgccaaattcttgagtgaaaagaaattcatttgagggccaaaatttgactaaggaaagaagaccaacatgggctttccaaagttgagtttgaattctgccatccccactaagcagtcatgtgaccttggaaaaactccctactctgagtctcagtttctttatctgtattaggtttcaacaaagggaataaatcattggcttctcatgaggttgtcataaggattaaataagacaatgcatacaaaagaactggcagacaataaatatagagtcccccactcctgcttggtgctctctttctctctccttctctacatagagaagtgccagagcatccgtcagtagaagttacttaaggttggctgtgtcttccacatcttttgtttacccatgaagaactgtgaccatcttgttctgtggcttgtcataaagatgggacgtgacttctttctgctcttgcttccatctggtgctgttttctgcacagcctccttgagaccttccagaaccttcttttttcctacttcgtatcacttaaccagtagctatctgggatggttccagaggctgaagtttgcagttgaataacattttaaatagtgttaagcgacttgggatctctggccctttgcgtttcagtatttgtcctttttatgcctgatgtttaacctgccacatgtttgtactgcaacatgaatcttggaaattttaatgttatgcatttcaaatgtttttggttatctgtaaactaaatgtgcccttattggctcacttgtcaataaagatgtttgtatatgttttgtcagaaa

SEQ ID NO: 2926 - DNA, 3373 bp, Homo sapiens
cgccggggtttctgggccgggcttctcaggaccgggctggaacgtgcagctcctggccgggacactctgtgctttgcggggaagggaagtggcggagcccgaggatccgctgccgctcgggactgagcccgccacgcaggcgcctgtgccagcgtcgccattgttgcctgtggccttagggccgctccggctgcccgtcggccgggtcccagcgacaggtattgatgtccgggcgcagcgcgcgagtgtccgcgcgatcagtgacagcccgagcccgtccacgcgcgggctcccgtgctcgtggcttgcgggagggcaaagacggggtggaggctgctgtgggcccagtcccagcgttgcgcgtcgcacggtccccgactcccccgctgccctcgacctcgaccctgcggctgaagaggaggtctcttatccatccctgcaagttctgggctcagaatttgtcactaaggctgctaactctaccttgattctgttctgccctcggctgcagcagcctttgatatagtgtccttgtgactctagcatgagacttcaagcagttggctcactactggagaaataaaggatattgccagattgactctcctgtctgtagcaatgttagcctcaagcaagaggatgaacagttcttcacgttctcaaatccttctaaggtggaagtcagacaaggctcagagtggaccctacaatgttgagaaggaaatccttacttcaagattcttgcgtgacactgagacctgtcgacagaattttaggaattttccatacccagacctggctggtcctcgaaaggcattgagtcaactccgagagctctgccttaagtggctgagacctgagattcactcaaaggaacaaattttggagctgctggtgctggagcaattcctgaccatcctgcctggtgaggttaggacttgggtaaagtcccagtatccagagagcagcgaggaagcagtgactctggtggaggatttgactcagattctagaagaggaagctcctcaaaactctaccctttcccaagataccccagaggaagaccccagaggaaaacatgctttccagacaggatggctaaatgacttggtgaccaaagaatcgatgacattcaaagatgtggctgtagacatcacccaggaggactgggagttaatgcgtcctgtgcagaaggaattatacaagactgtgacgttacagaactattggaacatggtttctctgggacttacagtgtacagaccaactgtgattcccatattggaagaaccatggatggtgataaaagaaattttagaaggccctagtccagaatgggaaactaaagcccaagcatgtactccagtggaggatatgtctaaactcacaaaggaagaaacccataccatcaaattagaagactcatatgactacgatgatagactagagaggcgaggaaaaggtggcttctggaaaattcacactgatgaaagaggtttcagtttgaagtcagtcctttcacaagaatatgatcctacagaagaatgtcttagtaaatatgatatatatagaaataattttgaaaagcattcaaacctaattgtacagtttgatacccaattagataataaaacttctgtgtataatgaaggcagggcaaccttcaatcatgtctcatatggtattgtacataggaaaatacttcctggagagaagccttacaagtgtaatgtgtgtgggaaaaaatttaggaaatacccatccctcctgaaacaccaaagtacccatgccaaagagaaatcgtatgaatgtgaagaatgtgggaaagagtttaggcatatctcatcccttattgcacatcagagaatgcacactggagaaaaaccatatgaatgccaccagtgtggtaaagccttcagccagcgtgcacaccttactatacatcagagaattcatactggagagaaaccctataagtgtgatgactgtgggaaagacttcagtcagcgtgcacaccttaccatccatcaaaggacacatactggagagaaaccatataaatgcttggaatgtggtaaaaccttcagtcatagttcatcactgattaatcatcagagagttcatactggagaaaaaccttatatatgcaatgaatgtgggaagactttcagtcagagtacacaccttcttcagcatcaaaaaatacatactgggaagaaaccatataaatgcaatgaatgttggaaagtgtttagtcagagtacttaccttattcgacatcagagaattcattctggagagaagtgttataaatgtaatgaatgtggaaaagcctttgctcattcctcaacccttattcaacatcaaaccactcacactggagagaaatcctatatatgtaatatatgtgggaaagccttcagccagagtgcaaatcttactcaacatcatagaacacatactggagagaaaccatataaatgcagtgtgtgtgggaaagcattcagccagagtgtgcaccttactcaacatcagaggattcataatggagaaaaaccctttaaatgcaatatatgtgggaaagcatatagacaaggcgcaaatcttactcagcatcaaaggattcatactggagaaaaaccctataaatgtaatgaatgtgggaaagctttcatttattcctcatcacttaatcaacatcagagaactcatactggagagagaccctataaatgtaatgaatgtgataaggattttagccagagaacatgccttattcaacaccagagaattcacacaggagagaaaccctatgcatgtcgtatatgtggtaaaaccttcacccagagtacaaaccttattcagcatcaacgtgttcatacaggtgccaaacatcgtaattaatggataagggaaacttcaattcggttttacaactttgtttcaattttgttttgtgcattctatgtgtcagaacattcagaagaagtctgaagaagtgcaatatgttagatactcagcagaagtatcagaagtagtggtatggatataacctatttagatttaatgtgaaatttaagaaggaaacttgacttcttaaccttaatttgatatgattttaattcattacagaaagaaaccctgtgaagggtattcaaaaacataactcatcaactctctatttcaagtacacttatcctttggtatactcgggggattggttccaggaccacccatgtatacgaaaatctacccatactcaagttgcacggtcagcctggtggaacctgtgtatatgaaaagccctacatctatgcaggtttcccatccctgaataatgtgctttcaaactctgttcagttgaaaaaaaaaa

SEQ ID NO: 2927 - DNA, 3208 bp, Homo sapiens
gcagtgacgccgaggcgaggtcgcggctaagcagaggcgccggggtttctgggccgggcttctcaggaccgggctggaacgtgcagctcctggccgggacactctgtgctttgcggggaagggaagtggcggagcccgaggatccgctgccgctcgggactgagcccgccacgcaggcgcctgtgccagcgtcgccattgttgcctgtggccttagggccgctccggctgcccgtcggccgggtcccagcgacagggtctcttatccatccctgcaagttctgggctcagaatttgtcactaaggctgctaactctaccttgattctgttctgccctcggctgcagcagcctttgatatagtgtccttgtgactctagcatgagacttcaagcagttggctcactactggagaaataaaggatattgccagattgactctcctgtctgtagcaatgttagcctcaagcaagaggatgaacagttcttcacgttctcaaatccttctaaggtggaagtcagacaaggctcagagtggaccctacaatgttgagaaggaaatccttacttcaagattcttgcgtgacactgagacctgtcgacagaattttaggaattttccatacccagacctggctggtcctcgaaaggcattgagtcaactccgagagctctgccttaagtggctgagacctgagattcactcaaaggaacaaattttggagctgctggtgctggagcaattcctgaccatcctgcctggtgaggttaggacttgggtaaagtcccagtatccagagagcagcgaggaagcagtgactctggtggaggatttgactcagattctagaagaggaagctcctcaaaactctaccctttcccaagataccccagaggaagaccccagaggaaaacatgctttccagacaggatggctaaatgacttggtgaccaaagaatcgatgacattcaaagatgtggctgtagacatcacccaggaggactgggagttaatgcgtcctgtgcagaaggaattatacaagactgtgacgttacagaactattggaacatggtttctctgggacttacagtgtacagaccaactgtgattcccatattggaagaaccatggatggtgataaaagaaattttagaaggccctagtccagaatgggaaactaaagcccaagcatgtactccagtggaggatatgtctaaactcacaaaggaagaaacccataccatcaaattagaagactcatatgactacgatgatagactagagaggcgaggaaaaggtggcttctggaaaattcacactgatgaaagaggtttcagtttgaagtcagtcctttcacaagaatatgatcctacagaagaatgtcttagtaaatatgatatatatagaaataattttgaaaagcattcaaacctaattgtacagtttgatacccaattagataataaaacttctgtgtataatgaaggcagggcaaccttcaatcatgtctcatatggtattgtacataggaaaatacttcctggagagaagccttacaagtgtaatgtgtgtgggaaaaaatttaggaaatacccatccctcctgaaacaccaaagtacccatgccaaagagaaatcgtatgaatgtgaagaatgtgggaaagagtttaggcatatctcatcccttattgcacatcagagaatgcacactggagaaaaaccatatgaatgccaccagtgtggtaaagccttcagccagcgtgcacaccttactatacatcagagaattcatactggagagaaaccctataagtgtgatgactgtgggaaagacttcagtcagcgtgcacaccttaccatccatcaaaggacacatactggagagaaaccatataaatgcttggaatgtggtaaaaccttcagtcatagttcatcactgattaatcatcagagagttcatactggagaaaaaccttatatatgcaatgaatgtgggaagactttcagtcagagtacacaccttcttcagcatcaaaaaatacatactgggaagaaaccatataaatgcaatgaatgttggaaagtgtttagtcagagtacttaccttattcgacatcagagaattcattctggagagaagtgttataaatgtaatgaatgtggaaaagcctttgctcattcctcaacccttattcaacatcaaaccactcacactggagagaaatcctatatatgtaatatatgtgggaaagccttcagccagagtgcaaatcttactcaacatcatagaacacatactggagagaaaccatataaatgcagtgtgtgtgggaaagcattcagccagagtgtgcaccttactcaacatcagaggattcataatggagaaaaaccctttaaatgcaatatatgtgggaaagcatatagacaaggcgcaaatcttactcagcatcaaaggattcatactggagaaaaaccctataaatgtaatgaatgtgggaaagctttcatttattcctcatcacttaatcaacatcagagaactcatactggagagagaccctataaatgtaatgaatgtgataaggattttagccagagaacatgccttattcaacaccagagaattcacacaggagagaaaccctatgcatgtcgtatatgtggtaaaaccttcacccagagtacaaaccttattcagcatcaacgtgttcatacaggtgccaaacatcgtaattaatggataagggaaacttcaattcggttttacaactttgtttcaattttgttttgtgcattctatgtgtcagaacattcagaagaagtctgaagaagtgcaatatgttagatactcagcagaagtatcagaagtagtggtatggatataacctatttagatttaatgtgaaatttaagaaggaaacttgacttcttaaccttaatttgatatgattttaattcattacagaaagaaaccctgtgaagggtattcaaaaacataactcatcaactctctatttcaagtacacttatcctttggtatactcgggggattggttccaggaccacccatgtatacgaaaatctacccatactcaagttgcacggtcagcctggtggaacctgtgtatatgaaaagccctacatctatgcaggtttcccatccctgaataatgtgctttcaaactctgttcagttgaaaaaaaaaa

SEQ ID NO: 2928 - DNA, 663 bp, Homo sapiens
cgccggggtttctgggccgggcttctcaggaccgggctggaacgtgcagctcctggccgggacactctgtgctttgcggggaagggaagtggcggagcccgaggatccgctgccgctcgggactgagcccgccacgcaggcgcctgtgccagcgtcgccattgttgcctgtggccttagggccgctccggctgcccgtcggccgggtcccagcgacagcagctccatcccccaccaaccccaagcagatggcagttcccttacaagtctaaggatataggggaggaagacaagggtctcttatccatccctgcaagttctgggctcagaatttgtcactaaggctgctaactctaccttgattctgttctgccctcggctgcagcagcctttgatatagtgtccttgtgactctagcatgagacttcaagcagttggctcactactggagaaataaaggatattgccagattgactctcctgtctgtagcaatgttagcctcaagcaagaggatgaacagttcttcacgttctcaaatccttctaaggtggaagtcagacaaggctcagagtggaccctacaatgttgagaaggaaatccttacttcaagattcttgcgtgacactgagacctgtcgacagaattttaggaattttccatacc

SEQ ID NO: 2929 - DNA, 8287 bp, Homo sapiens
ggggtgtgaagatggcggacgaagaggccgagcaggagaggttgagttgcggcgaaggcggctgcgtcgcggagctgcagcgcctgggcgagcggctccaggagctggagctacagctgcgggagagccgggtaccggccgtggaagcggccaccgactactgtcagcagctgtgccagacactcctagaatatgcagagaaatggaaaacttcagaagatcctttacctttattggaggtatacacagtggctatccaaagttatgttaaagcccgaccttatcttacctctgaatgtgaaaatgtagccttggttctggaacgcttggcattaagctgtgttgaacttttactgtgtctgcctgttgagttatcagataaacagtgggaacaatttcagacactggtgcaggtagctcatgaaaagctgatggagaatggcagctgtgaattgcattttttagctactctagctcaagagactggggtgtggaaaaacccggtactgtgcactattctttcccaggaaccattggataaggataaagcttttgagggtcccatcttgttggatatgagaattaaacatctaatcaaaacaaatcagttaagtcaagcaactgctctagcaaagctgtgttctgaccatccagagattggcataaaaggtagttttaagcaaacttaccttgtctgtctttgtacatcatcaccaaatggaaagttaatcgaagagatttcagaagttgattgcaaagatgcactggaaatgatctgtaacttagaatctgagggtgatgaaaaaagcgctcttgttttatgtactgcgtttttgtcacgtcagctccaacaaggagatatgtactgcgcttgggaacttactctcttttggagtaaattacaacaaagagtagaaccatctatacaagtgtaccttgagaggtgtcgtcaactttctttgttaacgaaaacagtatatcacattttcttcctgattaaagttattaattcagagactgaaggggctggacttgctacctgtatagaactgtgtgtaaaggctcttcgcttggagtctacagaaaatactgaagtgaaaatatctatttgcaagaccatttcatgtttgttgcctgatgatctggaagttaaacgtgcttgtcaactgagtgaatttcttattgagcctacagtagatgcgtattatgctgtggaaatgttgtataatcagccagaccagaaatatgatgaagagaatcttccaataccaaattctttacgctgtgagctgttacttgtattgaaaactcaatggccctttgatccagaattctgggattggaaaaccttgaaacgacaatgtcttgcattaatgggagaagaagcatccattgtgtcttcaatagatgaactaaatgacagtgaagtatatgaaaaagtggtagactaccaagaagagagtaaagaaacttctatgaatgggctttctggtggagttggtgctaattctggccttcttaaagacattggtgatgaaaagcagaagaagagagagataaaacagttaagagagaggggatttatatctgctcggtttaggaattggcaagcctacatgcagtattgtgtgttgtgtgacaaagaattccttggtcacagaatagtacgacatgctcagaaacattacaaagatggaatttatagttgccccatatgtgcaaagaactttaattctaaagaaacttttgtccctcatgtcacactgcatgttaaacaatctagtaaagagagactagcagctatgaaaccattaagaagattgggaaggcctccaaagatcacaactaccaatgaaaatcagaagactaatactgtggctaaacaggagcagcgacctataaaaaagaatagtctctattcaacagattttatagtgtttaatgacaatgatggttcagatgatgagaatgatgacaaagataaatcctatgagccagaagtgattccagtccagaaaccagtacctgttaatgaatttaattgccctgtaactttttgtaaaaagggctttaagtactttaaaaatttaattgctcatgtgaaggggcataaagataatgaagacgccaagcgctttcttgaaatgcagagcaaaaaagttatttgccagtactgtaggcggcattttgtgagtgttactcatctcaatgatcacttacagatgcactgtggcagtaaaccatatatctgtatacagatgaaatgtaaagctggttttaatagttacgccgagcttttaacccaccgaaaggagcatcaagtctttagagcaaaatgtatgtttcctaaatgtggaagaattttttcggaagcttatttactatatgatcatgaagcacaacattataatacgtacacttgtaagttcacaggttgtggtaaagtttatcgttctcagggtgagctggaaaagcatctggatgatcacagtactcctcctgaaaaagtgctgcctcctgaagcccaacttaattcatctggagattccattcagccttctgaagtgaatcagaacacagcagagaatattgagaaagaaagatctatgcttccttcagaaaataacattgaaaacagcttactagcagatagaagtgatgcttgggataaaagcaaagcagaatcagctgtgaccaaacaagaccagatttctgcctctgagctcaggcaagctaatggaccattgtcaaatggtttggaaaaccctgctactactcctctacttcaatccagtgaagtagctgtgtccattaaggtgtctctcaatcaggggattgaggataactttggaaagcaagaaaactcaactgtggaaggcagtggtgaagcactggtcacagacttacatacgccagttgaagatacttgtaatgatttgtgtcatccaggtttccaggagagaaaagaacaagattgctttaatgatgcccatgttactcagaattctttagtaaattcagaaactctcaaaataggtgaccttaccccacaaaacttagaaagacaagtgaacaacttgatgaccttttctgtgcaaaatcaggcagcatttcaaaacaatttaccaacttccaaatttgaatgtggagataatgttaaaacatcatccaatctttataatttacctcttaagacattagaaagtattgcatttgttccaccgcagtccgacctaagtaattcattaggaactccatcagtgcctccaaaagctccagttcagaaattcagctgccaggtcgagggatgtactcgaacctataattcttcacagagtattgggaaacacatgaagacagcacaccctgaccaatatgctgcatttaaaatgcagcgcaaaagtaaaaaaggtcagaaagctaacaacttaaatacaccaaataatggaaagtttgtttattttttgccatcaccggtgaacagctcaaatccattttttacatcacagaccaaagccaatgggaatcctgcttgttcggcccagttgcagcatgtctcgccacccatttttccagctcatttagcaagtgtgtcaactccattgttgtcctcaatggaaagtgtcataaatccaaatataacttctcaggataaaaatgaacaaggtggtatgttatgttcccaaatggaaaatttacctagtactgccttgccagcacaaatggaagatctaaccaaaacagttctgcctttgaatattgacagtggctcagatcctttccttcctttacctgcagaaagtagttcaatgtctctcttcccttcaccagcagatagtgggactaattctgttttttcccaactggaaaataatacaaatcattattcctcacagattgaaggaaacactaattcctcctttctaaaggggggtaatggtgaaaatgcagtttttccttcacaagtgaatgttgcaaataacttcagtagcaccaatgcccaacagtctgcacctgaaaaagttaaaaaagaccgtgggcggggcccaaatgggaaggaaagaaaacctaagcacaacaaaagggctaaatggcctgcaattatcagagatgggaaatttatctgtagcaggtgttacagggcttttactaatcccagatcactgggtgggcacttatccaagcgatcttactgtaaaccactggatggagccgaaattgctcaagaacttctacagagtaatggacagccttctcttcttgccagcatgattctctccacaaatgcagtaaatttgcagcagccacaacaatctaccttcaatccagaagcatgttttaaagatccatcatttctacagcttcttgctgaaaatcgctcgccagcatttttaccaaatacatttcctcgatctggtgtgactaactttaataccagtgtcagtcaagaaggtagtgaaattattaaacaggctttggaaactgctggcattcccagtacatttgagggtgccgaaatgctttctcatgtttcaacaggttgtgtctctgatgcatcacaagtaaatgcaacggtgatgccaaatccaactgtaccacccctgttgcacactgtatgccatccaaacaccttgctgaccaaccagaataggacgtcaaactccaaaacttcctccattgaggaatgtagcagcttgcctgtttttccaacgaatgacttactactgaagactgttgaaaatggtttgtgctctagttcatttcctaattctggtgggccatcacaaaattttaccagtaacagttctcgtgtttctgttataagtggtcctcagaacacaagatccagtcatttaaataaaaagggaaacagtgcttctaagagaagaaagaaagttgctcctccactaattgcacctaacgcttcccaaaacttggtaacaagtgacttaacaacaatgggactcatagcaaagagtgttgaaatcccaactactaaccttcattcaaatgtaattccaacttgtgaacctcagagtttggtggaaaatctaacacagaaattaaataatgttaacaatcagttatttatgactgatgtaaaagagaatttcaaaaccagtcttgagtcccatacagtgttagcccctttaacattaaaaactgaaaatggtgattcccaaatgatggctttgaattcatgcacaacttcaataaattctgatttgcagatttctgaagacaatgttatacaaaactttgaaaagactcttgaaattattaaaactgctatgaattctcaaatacttgaggtaaaaagtggatctcagggtgctggtgaaacttcacaaaatgctcaaataaattataacattcagcttccttcagtaaacactgtgcaaaataacaaattacccgattcttctccgttttcctcctttataagtgtcatgccaacaaaaagtaacattcctcagtctgaagtatcacataaggaggatcaaatacaggaaattttagaaggcttacagaaattaaaattagaaaatgacctatccactccagcatcccaatgtgtactgataaatacatcagtgacactgactcccacgcctgttaaatcaactgcagatatcacagttattcagccagtttctgaaatgataaacattcaatttaatgacaaagttaataaaccctttgtgtgtcaaaaccaaggctgtaactacagtgctatgacaaaggatgcactatttaagcactatggtaaaattcatcaatacactccagaaatgattcttgaaattaagaagaatcaattgaaatttgctccctttaaatgtgtagtacctacatgtacaaaaacatttacaagaaattctaacctccgggcacactgtcagttggtgcatcattttacaactgaagaaatggtaaagttaaaaattaaaaggccttatggaagaaaatctcagagtgaaaatgtgccggcctcacgaagtacacaagtgaaaaaacagctagctatgacagaggaaaataaaaaggaatctcagcctgctttagaattgagagcagagacccaaaatacccacagtaatgtagcagtgatcccagaaaaacaacttgtagaaaaaaaaagtcctgacaaaacagaaagttctttacaagtgattacagttacttcagaacaatgtaatacaaatgcactcacaaacacacaaaccaaaggacggaagattaggaggcataaaaaagaaaaggaggagaaaaaacgaaagaagccagtttcccaatcccttgagtttccaacaagatacagtccttacagaccttatcgatgtgttcaccagggatgctttgctgcctttacgatacagcaaaacttgattctccattaccaggctgtacacaaatcagatctacctgcattttcagcagaggtcgaagaggaaagtgaagctggtaaagaaagtgaagaaactgaaactaaacaaactttgaaagaatttcgatgtcaggtaagtgactgttctcgaattttccaagcaattactggcctaatacaacactacatgaaacttcatgaaatgactcctgaagaaattgaaagtatgactgcttcagtggatgttgggaagtttccatgtgaccagttagagtgtaaatcttcatttactacatatttgaactatgttgttcatctagaggcagaccacgggattggactaagggcaagtaaaacagaagaagatggtgtatacaaatgtgattgtgaaggctgtgaccgtatatatgcaacccggtcgaatctcctccgacacatttttaataagcataatgacaaacataaggctcatttgattcgtccaagaagattaacaccaggccaggaaaatatgtcaagcaaggcaaaccaagaaaaatcaaagtctaaacatcgggggaccaagcacagcagatgtggaaaggaaggaataaaaatgcccaagaccaaacgaaagaaaaaaaataatttagaaaacaagaatgcaaagattgtgcagattgaagaaaataagccttattctctgaaacgtgggaagcatgtatattctataaaggctagaaatgatgccctgtctgagtgtacaagcagatttgtaacccagtatccatgtatgataaagggatgtacttcagttgttacaagtgaaagcaatataattagacattataagtgccataaattatctaaggcatttacatcacaacaccgaaatcttcttattgtattcaaacggtgttgcaactcacaagtaaaggaaacgtctgagcaagaaggtgctaagaatgatgtgaaagattctgacacgtgtgtatcagagagcaatgataattcaagaacaacagctacagtttcacaaaaggaagttgaaaaaaatgaaaaagatgaaatggatgaactaacagaattgtttattacaaaattaataaatgaagatagcacaagtgtagagacccaagctaatacttcttcaaatgtaagtaatgattttcaggaagataacctctgccagtcagaaagacaaaaagcaagtaatttgaagagagttaataaggaaaaaaatgtctcacaaaataaaaaaaggaaagttgaaaaagctgaaccagcatcagcagctgagttaagtagcgtgcgtaaagaagaagaaactgctgttgccattcaaaccattgaggagcatcctgcatcttttgactggagctcttttaagccaatgggatttgaagtatcatttctgaagtttcttgaggagtctgcagtgaagcagaagaaaaatactgacaaagaccatccgaatactggaaacaaaaaaggatcccattcaaattcaagaaaaaatattgataagactgctgtgactagtggaaatcatgtatgtccttgtaaagaaagcgaaacgtttgtacagtttgccaatccatcacagcttcagtgcagtgataatgtaaaaattgttttagacaagaatcttaaagattgcactgagcttgtcttaaagcaacttcaggaaatgaaacctaccgtcagtctgaaaaaacttgaagtacattcaaatgatccagatatgtctgttatgaaagatatcagtataggtaaagccacaggcagaggtcagtactgataattaatgtagtataaatacatcatttaccattttattttaaataggaagccatcaagcatgctagaattgtgaaactttcattatatttttttgttgttgacatgaattaacctggc

SEQ ID NO: 2930 - DNA, 10610 bp, Homo sapiens
atcacgtgacccaggtgcgtacgcgacggagcggggtgtgaagatggcggacgaagaggccgagcaggagaggttgagttgcggcgaaggcggctgcgtcgcggagctgcagcgcctgggcgagcggctccaggagctggagctacagctgcgggagagccgggtaccggccgtggaagcggccaccgactactgtcagcagctgtgccagacactcctagaatatgcagagaaatggaaaacttcagaagatcctttacctttattggaggtatacacagtggctatccaaagttatgttaaagcccgaccttatcttacctctgaatgtgaaaatgtagccttggttctggaacgcttggcattaagctgtgttgaacttttactgtgtctgcctgttgagttatcagataaacagtgggaacaatttcagacactggtgcaggtagctcatgaaaagctgatggagaatggcagctgtgaattgcattttttagctactctagctcaagagactggggtgtggaaaaacccggtactgtgcactattctttcccaggaaccattggataaggataaagtgaatgaatttttagcttttgagggtcccatcttgttggatatgagaattaaacatctaatcaaaacaaatcagttaagtcaagcaactgctctagcaaagctgtgttctgaccatccagagattggcataaaaggtagttttaagcaaacttaccttgtctgtctttgtacatcatcaccaaatggaaagttaatcgaagagatttcagaagttgattgcaaagatgcactggaaatgatctgtaacttagaatctgagggtgatgaaaaaagcgctcttgttttatgtactgcgtttttgtcacgtcagctccaacaaggagatatgtactgcgcttgggaacttactctcttttggagtaaattacaacaaagagtagaaccatctatacaagtgtaccttgagaggtgtcgtcaactttctttgttaacgaaaacagtatatcacattttcttcctgattaaagttattaattcagagactgaaggggctggacttgctacctgtatagaactgtgtgtaaaggctcttcgcttggagtctacagaaaatactgaagtgaaaatatctatttgcaagaccatttcatgtttgttgcctgatgatctggaagttaaacgtgcttgtcaactgagtgaatttcttattgagcctacagtagatgcgtattatgctgtggaaatgttgtataatcagccagaccagaaatatgatgaagagaatcttccaataccaaattctttacgctgtgagctgttacttgtattgaaaactcaatggccctttgatccagaattctgggattggaaaaccttgaaacgacaatgtcttgcattaatgggagaagaagcatccattgtgtcttcaatagatgaactaaatgacagtgaagtatatgaaaaagtggtagactaccaagaagagagtaaagaaacttctatgaatgggctttctggtggagttggtgctaattctggccttcttaaagacattggtgatgaaaagcagaagaagagagagataaaacagttaagagagaggggatttatatctgctcggtttaggaattggcaagcctacatgcagtattgtgtgttgtgtgacaaagaattccttggtcacagaatagtacgacatgctcagaaacattacaaagatggaatttatagttgccccatatgtgcaaagaactttaattctaaagaaacttttgtccctcatgtcacactgcatgttaaacaatctagtaaagagagactagcagctatgaaaccattaagaagattgggaaggcctccaaagatcacaactaccaatgaaaatcagaagactaatactgtggctaaacaggagcagcgacctataaaaaagaatagtctctattcaacagattttatagtgtttaatgacaatgatggttcagatgatgagaatgatgacaaagataaatcctatgagccagaagtgattccagtccagaaaccagtacctgttaatgaatttaattgccctgtaactttttgtaaaaagggctttaagtactttaaaaatttaattgctcatgtgaaggggcataaagataatgaagacgccaagcgctttcttgaaatgcagagcaaaaaagttatttgccagtactgtaggcggcattttgtgagtgttactcatctcaatgatcacttacagatgcactgtggcagtaaaccatatatctgtatacagatgaaatgtaaagctggttttaatagttacgccgagcttttaacccaccgaaaggagcatcaagtctttagagcaaaatgtatgtttcctaaatgtggaagaattttttcggaagcttatttactatatgatcatgaagcacaacattataatacgtacacttgtaagttcacaggttgtggtaaagtttatcgttctcagggtgagctggaaaagcatctggatgatcacagtactcctcctgaaaaagtgctgcctcctgaagcccaacttaattcatctggagattccattcagccttctgaagtgaatcagaacacagcagagaatattgagaaagaaagatctatgcttccttcagaaaataacattgaaaacagcttactagcagatagaagtgatgcttgggataaaagcaaagcagaatcagctgtgaccaaacaagaccagatttctgcctctgagctcaggcaagctaatggaccattgtcaaatggtttggaaaaccctgctactactcctctacttcaatccagtgaagtagctgtgtccattaaggtgtctctcaatcaggggattgaggataactttggaaagcaagaaaactcaactgtggaaggcagtggtgaagcactggtcacagacttacatacgccagttgaagatacttgtaatgatttgtgtcatccaggtttccaggagagaaaagaacaagattgctttaatgatgcccatgttactcagaattctttagtaaattcagaaactctcaaaataggtgaccttaccccacaaaacttagaaagacaagtgaacaacttgatgaccttttctgtgcaaaatcaggcagcatttcaaaacaatttaccaacttccaaatttgaatgtggagataatgttaaaacatcatccaatctttataatttacctcttaagacattagaaagtattgcatttgttccaccgcagtccgacctaagtaattcattaggaactccatcagtgcctccaaaagctccagttcagaaattcagctgccaggtcgagggatgtactcgaacctataattcttcacagagtattgggaaacacatgaagacagcacaccctgaccaatatgctgcatttaaaatgcagcgcaaaagtaaaaaaggtcagaaagctaacaacttaaatacaccaaataatggaaagtttgtttattttttgccatcaccggtgaacagctcaaatccattttttacatcacagaccaaagccaatgggaatcctgcttgttcggcccagttgcagcatgtctcgccacccatttttccagctcatttagcaagtgtgtcaactccattgttgtcctcaatggaaagtgtcataaatccaaatataacttctcaggataaaaatgaacaaggtggtatgttatgttcccaaatggaaaatttacctagtactgccttgccagcacaaatggaagatctaaccaaaacagttctgcctttgaatattgacagtggctcagatcctttccttcctttacctgcagaaagtagttcaatgtctctcttcccttcaccagcagatagtgggactaattctgttttttcccaactggaaaataatacaaatcattattcctcacagattgaaggaaacactaattcctcctttctaaaggggggtaatggtgaaaatgcagtttttccttcacaagtgaatgttgcaaataacttcagtagcaccaatgcccaacagtctgcacctgaaaaagttaaaaaagaccgtgggcggggcccaaatgggaaggaaagaaaacctaagcacaacaaaagggctaaatggcctgcaattatcagagatgggaaatttatctgtagcaggtgttacagggcttttactaatcccagatcactgggtgggcacttatccaagcgatcttactgtaaaccactggatggagccgaaattgctcaagaacttctacagagtaatggacagccttctcttcttgccagcatgattctctccacaaatgcagtaaatttgcagcagccacaacaatctaccttcaatccagaagcatgttttaaagatccatcatttctacagcttcttgctgaaaatcgctcgccagcatttttaccaaatacatttcctcgatctggtgtgactaactttaataccagtgtcagtcaagaaggtagtgaaattattaaacaggctttggaaactgctggcattcccagtacatttgagggtgccgaaatgctttctcatgtttcaacaggttgtgtctctgatgcatcacaagtaaatgcaacggtgatgccaaatccaactgtaccacccctgttgcacactgtatgccatccaaacaccttgctgaccaaccagaataggacgtcaaactccaaaacttcctccattgaggaatgtagcagcttgcctgtttttccaacgaatgacttactactgaagactgttgaaaatggtttgtgctctagttcatttcctaattctggtgggccatcacaaaattttaccagtaacagttctcgtgtttctgttataagtggtcctcagaacacaagatccagtcatttaaataaaaagggaaacagtgcttctaagagaagaaagaaagttgctcctccactaattgcacctaacgcttcccaaaacttggtaacaagtgacttaacaacaatgggactcatagcaaagagtgttgaaatcccaactactaaccttcattcaaatgtaattccaacttgtgaacctcagagtttggtggaaaatctaacacagaaattaaataatgttaacaatcagttatttatgactgatgtaaaagagaatttcaaaaccagtcttgagtcccatacagtgttagcccctttaacattaaaaactgaaaatggtgattcccaaatgatggctttgaattcatgcacaacttcaataaattctgatttgcagatttctgaagacaatgttatacaaaactttgaaaagactcttgaaattattaaaactgctatgaattctcaaatacttgaggtaaaaagtggatctcagggtgctggtgaaacttcacaaaatgctcaaataaattataacattcagcttccttcagtaaacactgtgcaaaataacaaattacccgattcttctccgttttcctcctttataagtgtcatgccaacaaaaagtaacattcctcagtctgaagtatcacataaggaggatcaaatacaggaaattttagaaggcttacagaaattaaaattagaaaatgacctatccactccagcatcccaatgtgtactgataaatacatcagtgacactgactcccacgcctgttaaatcaactgcagatatcacagttattcagccagtttctgaaatgataaacattcaatttaatgacaaagttaataaaccctttgtgtgtcaaaaccaaggctgtaactacagtgctatgacaaaggatgcactatttaagcactatggtaaaattcatcaatacactccagaaatgattcttgaaattaagaagaatcaattgaaatttgctccctttaaatgtgtagtacctacatgtacaaaaacatttacaagaaattctaacctccgggcacactgtcagttggtgcatcattttacaactgaagaaatggtaaagttaaaaattaaaaggccttatggaagaaaatctcagagtgaaaatgtgccggcctcacgaagtacacaagtgaaaaaacagctagctatgacagaggaaaataaaaaggaatctcagcctgctttagaattgagagcagagacccaaaatacccacagtaatgtagcagtgatcccagaaaaacaacttgtagaaaaaaaaagtcctgacaaaacagaaagttctttacaagtgattacagttacttcagaacaatgtaatacaaatgcactcacaaacacacaaaccaaaggacggaagattaggaggcataaaaaagaaaaggaggagaaaaaacgaaagaagccagtttcccaatcccttgagtttccaacaagatacagtccttacagaccttatcgatgtgttcaccagggatgctttgctgcctttacgatacagcaaaacttgattctccattaccaggctgtacacaaatcagatctacctgcattttcagcagaggtcgaagaggaaagtgaagctggtaaagaaagtgaagaaactgaaactaaacaaactttgaaagaatttcgatgtcaggtaagtgactgttctcgaattttccaagcaattactggcctaatacaacactacatgaaacttcatgaaatgactcctgaagaaattgaaagtatgactgcttcagtggatgttgggaagtttccatgtgaccagttagagtgtaaatcttcatttactacatatttgaactatgttgttcatctagaggcagaccacgggattggactaagggcaagtaaaacagaagaagatggtgtatacaaatgtgattgtgaaggctgtgaccgtatatatgcaacccggtcgaatctcctccgacacatttttaataagcataatgacaaacataaggctcatttgattcgtccaagaagattaacaccaggccaggaaaatatgtcaagcaaggcaaaccaagaaaaatcaaagtctaaacatcgggggaccaagcacagcagatgtggaaaggaaggaataaaaatgcccaagaccaaacgaaagaaaaaaaataatttagaaaacaagaatgcaaagattgtgcagattgaagaaaataagccttattctctgaaacgtgggaagcatgtatattctataaaggctagaaatgatgccctgtctgagtgtacaagcagatttgtaacccagtatccatgtatgataaagggatgtacttcagttgttacaagtgaaagcaatataattagacattataagtgccataaattatctaaggcatttacatcacaacaccgaaatcttcttattgtattcaaacggtgttgcaactcacaagtaaaggaaacgtctgagcaagaaggtgctaagaatgatgtgaaagattctgacacgtgtgtatcagagagcaatgataattcaagaacaacagctacagtttcacaaaaggaagttgaaaaaaatgaaaaagatgaaatggatgaactaacagaattgtttattacaaaattaataaatgaagatagcacaagtgtagagacccaagctaatacttcttcaaatgtaagtaatgattttcaggaagataacctctgccagtcagaaagacaaaaagcaagtaatttgaagagagttaataaggaaaaaaatgtctcacaaaataaaaaaaggaaagttgaaaaagctgaaccagcatcagcagctgagttaagtagcgtgcgtaaagaagaagaaactgctgttgccattcaaaccattgaggagcatcctgcatcttttgactggagctcttttaagccaatgggatttgaagtatcatttctgaagtttcttgaggagtctgcagtgaagcagaagaaaaatactgacaaagaccatccgaatactggaaacaaaaaaggatcccattcaaattcaagaaaaaatattgataagactgctgtgactagtggaaatcatgtatgtccttgtaaagaaagcgaaacgtttgtacagtttgccaatccatcacagcttcagtgcagtgataatgtaaaaattgttttagacaagaatcttaaagattgcactgagcttgtcttaaagcaacttcaggaaatgaaacctaccgtcagtctgaaaaaacttgaagtacattcaaatgatccagatatgtctgttatgaaagatatcagtataggtaaagccacaggcagaggtcagtactgataattaatgtagtataaatacatcatttaccattttattttaaataggaagccatcaagcatgctagaattgtgaaactttcattatatttttttgttgttgacatgaattaacctggccaaaaacaaaaaagaaaaaaaaaacatgacatttgtcatgtaaaacttttttttatccctatgggacttgaggaacagaatcagtacttcagttattgtaaatagtgagctaaacctcaaatttctatcacccagttgcccttttcatgaactaaacaattatctgtgtgattggtatgtttcaccaggtcactgctcatgtataacagtactctttatttgtagataccttttttgtatatatttattattgtaaatcatgtgctgccaccagcagtctgtaagtctaaactattaaatgacacatttatatttggaattttaatttttaactaagcgatcaagttttttaaattgttcttttattgttttaaattaagaactttttgaactaaaaccagaaactctgccatagttcattgatttttacatgaaacatttatttacaagatgatatcaagattacttttcacaaaataggcacattatatcaacactttgctctgctttgtaaatttgccatccaggattttggggtggtattcatgtgaaattaaagcagattctctagcagtttcctatagctacagtttttttttttcattgcttctaattggatatagttactatgagtccatgaaatacaatggaaatgtgaataaagaatttactacattgaagattttaaacatttggtattaaaaaaaaatcctttgtgaatgtgatagaaaactagtagtgtggagcagtgtaaatatttgaggtggtgatttgtgaagtagcccagtattgccttaaataaaatcacatttcatttcttgttttatacatgtgatcttataaagattttttgttttgttttgttttccattttctgagatttatagattggtgtatagctttaaactgtataaagttttgtggaaagatttttttaaacatttttataaatcttaaaattgatatcatcaaagtgagcccatcttgtgtttataaaatacaagagtccttaacatttataattacatagataaaacactttctataaggaagttggatgttttgattttactgtttatagatgttagattgtacagatttgtctgtatttctcaccatatctaatgatacttttttcattagattggtcttcaagaacagtattagttataattattttggttattcagtatatagttagctcttacagtttagctttattcaccatatttatactgtggattcacagcgagaggtagaggttattccaggagagttgatgaccttcatttaaagtccaactaaaatcagtagtagaaacataagaaaacatctttgcaatatttacttttgtttctgtttgccgtaaatagtaacattgtttttttttattttgtgtttgttataaaacagttgcattcacaatattattggcctgagatattgatgatattgtgatggtatgaaaatgtgtacattccctgtgcaacatcagatttgcaggaaaaatgaagcacttactgaaatcgctggtactctgaataaataagcatggtcaaggagtgaactattttcttttggaaatttctttttaatttttattattaaagtattttatttttagggccttttgggttttattgaatagttcatttcacctgtttaagacttactaccaataagcataaaacctgacacgttaaaatccctgccctttggtgagcccactgttatttattaaaataaaagttattttatgggtgattaatacatgggttttctttttcctaaattaacaataatttaaataactgagtaattttaatattaaatttttgttaacaactgaatgtttccatacagttttcttagaaattgacctagctcttaaaggtgggcacttggcaaaactgccctatatagcacagtagcaagtaggtttatttctgatcattgtaactatgagccactgttaagtgaaaatgccaatgtattggggcttttcttttgctcattagcttaagaaaatttataactagacatttctaattgttttacatgtcatggggaagagtttgccaacatttaatgaaatttttatattccaggtaatgtatactaaaggtaattatgagagtgggctttttagcatgaaacaaaaaaaatcaaactatggtaaaaagacatgaatttatagaatagcatgttggtaaattttgatacggaatgtaatgtctaagtattaaaaaatcataaaatatatttttttcatggta

SEQ ID NO: 2931 - DNA, 7449 bp, Homo sapiens
gtcaaattcaagatggatggaatcacagcggcagcggcggctgcggcgcgcgcgagccgagtgtgagcggaaaggggcccggcgtctgcctcgagactgaagaccgaagacatgaagtagaaacaatccaggaaggctttgggaagctatttgtgtgcgaggatcaaagtgataaactcaagccatggagggattactgcattacatcaaccctgcacacgccatttctctcctaagtgccctgaatgaggagcgtctcaaaggacagctgtgtgatgtgctgctgattgttggagaccaaaagttccgagctcataaaaacgtcttggctgccagcagcgaatactttcagagtttattcacaaataaggaaaatgagtcacaaactgtatttcagcttgacttctgtgagccagatgcttttgataatgttttaaactacatttattcttcctctctatttgttgagaagagcagccttgctgctgtgcaagaacttggctatagtcttgggatttcctttctgactaacatcgtttctaaaacacctcaagccccctttccaacgtgtcctaatagaaaaaaagtgtttgtagaagatgatgaaaacagttctcaaaagagaagtgtcattgtttgtcaaagtagaaacgaagcgcaaggaaaaactgttagtcaaaatcaacccgatgtaagccatacttcccggccctctcctagcattgcagtcaaggccaataccaataagccacatgtcccaaaaccaatagaaccacttcataatttgtcattaactgaaaagagttggccgaaagatagttctgtggtatatgcaaagtctcttgagcattctggatctttggatgatcctaatagaatcagtttggtgaaaagaaatgcagtgttgccttcaaagcctctgcaagacagagaagctatggatgataaaccaggtgtgagtggtcagcttccaaaaggaaaagctctagagctggctttgaagagaccacggccacctgttttgtctgtttgtagctcatcagagactccctatctattaaaagaaactaacaaaggaaatggtcaaggtgaagatagaaacttgttgtactattcaaagttaggcttagtgatcccatccagtggatctggttctggaaaccaaagcattgacaggagtggcccacttgttaagagtctcctcagacggtcattgtcgatggatagccaggttcctgtctattcaccttccatagatttgaaatcttcccagggatcatcttcggtgtccagtgatgcaccagggaatgtgttgtgtgctttatctcagaagtcatctttaaaagattgtagtgaaaaaacagccctagatgacaggcctcaagtgctacaaccgcatcgcctcaggtcctttagtgcttctcagtcaacagacagggagggagcttcccctgtgactgaggtgcgcataaagactgagcccagcagcccgctgtcggacccctcggacatcatccgcgtcactgtgggagatgcggcaacaacagcagctgcctcatcttcgtcggtcacaagagacctgtctctgaaaacagaagatgaccaaaaagacatgagcagactcccagcaaaaaggaggttccaagcggaccgaagattgccgtttaagaagttaaaggtgaatgagcacgggtctcctgtgtcagaagataattttgaggaaggctcaagccctactctccttgatgcagattttccagattctgatttgaataaagacgaatttggtgagttggaggggacgagaccaaacaaaaaatttaaatgcaaacattgccttaagatctttagatcaacagcaggtcttcaccgtcatgttaacatgtaccataacccagaaaagccctacgcttgtgacatctgtcacaagaggtttcacaccaacttcaaagtgtggacacactgtcagacccaacacggcatagtgaagaacccatcaccagcctctagttcacatgctgttttggatgaaaaattccaaagaaagctgattgacatagtgagagagagagaaattaagaaggccctgatcattaagttaaggcgcggcaagcctggttttcagggacagagtagctcccaagcacagcaagtcatcaagaggaacttgagatctcgagccaaaggagcttacatttgtacttactgcggaaaagcgtaccgctttctctctcaatttaagcagcatataaaaatgcatccaggagaaaaaccccttggagtaaataaagttgctaaaccaaaagagcatgctcctcttgcaagtccagtagaaaacaaggaggtttaccagtgccgcctctgtaatgctaagctctcttctctcctagagcaaggaagccacgagcggctgtgccggaacgcggccgtctgcccttactgcagcctcaggtttttctcgcccgagctgaagcaagaacacgagagcaagtgtgagtataagaagctgacctgcctcgagtgcatgcgcaccttcaagtcctctttcagcatctggcggcaccaggttgaagtccataatcagaacaacatggcacccaccgaaaacttttctttgcccgttttggaccacaatggtgatgtgactggttcttcaaggccccaatcccagcctgagcccaacaaagtaaaccacatcgtcaccacaaaagacgacaacgtgttcagtgattcttcagaacaagttaacttcgactcggaagattcctcttgtcttcccgaagaccttagtctttccaagcaactgaaaatccaagtcaaagaggagcctgtggaggaggctgaagaagaggcacccgaggccagcacagcccccaaagaagcgggtcctagcaaagaagccagcctgtggccctgcgagaagtgtgggaagatgttcacggtgcataagcagctggagcgtcaccaggagcttctgtgctctgtgaaaccatttatttgtcacgtgtgcaacaaagcttttcgcactaattttcgactctggagtcacttccaatcgcacatgtctcaggcttcagaggaatcggcacataaggaatctgaggtgtgccctgttcccacaaactctccctctccaccacctctgccaccgccaccaccactgcccaagatccagcctctggagcctgacagccccacaggcctgtccgaaaacccaactccagccacagaaaaactgtttgtgccccaagaatcagacacccttttttaccatgccccacccctttcagcaatcacatttaaaagacagtttatgtgtaaactttgccacaggacattcaagactgcatttagtctttggagtcacgaacaaacacacaattgaaagaccaacactttttacctatgggaggcagtccccagatttcaacctgaattgtgaaatgtgtcataagaaacaaaatattttttaaacaagaataataaaggttggagattgttacgcttgaaattaagttggaggcaaattgataattacttagtaatgtccttaactttagaaatacagcttttaaaatattgtggttctggaccttacaagaacaagatggtttgatttcattaatgttgaaattggattagtcttgattgtgtgcatggttcctcattccatggtgtcagtataatcatttaattgaggtttttggttttttattgattagtggaatactgtcgaagtattccttcttttaattattttagacacttgagttctagttaaatcttaaccatgttcttaagtccaaaataggaagaagtggagtagtttgcagtattgatttatatcttagactactttagcaataaaagataaatctcaactttaataagttatcctgacacttgataaaaataaatatttggtattttgtggtcatgtaaaacttctttttgtatgaaaattgtgagaaatttaaatcagcaatagtaacacttagatttttataaactaacaaaaacttgctctcagtcaatataataaatgatagttaaactctaaggaagacctgggaaatgaaaacaatttatggaagtcccctacagtcagtttataagggcttcagtagtgatagacattgttataaaaacttgtaccatgttacatgtacactgcaccacagtctaaattcagaccagcatttgaaggactgcacatatttcatttcctctgatttatgctgtcacaaattgaaaatctgagtgtagttaggacaaaaaacaaagctaaccatatggcactaattttgattttaacattagtgtaacaaataaggtcgggacatatatttacatagatcccagacactcaagaattagcacagctgatgtaaaattctaaattaccatttacttccagatagagcagaggagaaacacctcactgcagtttcaacatgctttccaagaacaatatatacgacatatacattttcctgcctctctcttgtgacaatttctgttagaatttgttgggggtctgatggttaaaatcatgggcaaggccattctctacatcattgcttaatatttcaaaaataggtattagagcactatcagtggtccaaaattagttttagctacttattttgctccatgggttttgggcttttcaaagaatactatgtataatttgtaattgaaagcctttcagtaggatatccaaagttcaatgtgtttcaaaagggaaaacttttacttgtgggggtgggagttagatgtattaaaaaaacgaaactacaaaatccttttaagaaagtaataccaatttagactctagtttgtgttacgaggtattctttcaaattttttttaaaagccaactactgtcattaagaaataattttagatttgtgctctagcagaaaataactctgtacccatcaatcttattgccaacattccataccagtggtaggaaagatattctcattttttttattgaaccagacatttttataaaatactgattgactttgtacattatggatattatatatgaaattttgccttgtattctttcacttgaaaaaactccaaaattccacaatattttagtagttaacttcctattctttcttaaatttgatggagaagggaaaataaattgcagttattgattcttgccatctttgttttcttaaagaaatctatgcattttaaggataaaactaaagcatatgggtttacatgaaacatcaggatggattattgtacattgaattcattccgcgtataatgtggtatttcttactctgtccatcttggtagctgtcacttcaaaagaagacagtttccctgagtaatcatcacctacatggccattagagtatctatcggtgataattccatgatacagagtatcttggcattataaattcagtatcccaggacctaaacctttatgctacattttcgaagattttttaaaaataatattgttaatcagtaaaaaaaaaaaatatttttgatctaaacataggttctgcatatctgttagattttaaaaatgactggtgttttgtcttcacatttttgtctaagcaaggaatataagatttcaaataaaattttgaaccaaaaacatttataatgccgttctggtttttctattactttttatactgtactttaaaagcattaggctgaaagagtttattttggtggtcaaaaaaaatatgcttccactcatgtaactattttaaatgttaagaagtaaaataatgaaagatatgttaattactttattcagtaaagttttttaagaatgtttatctcagccagtaggcaaatacttggtgtaaaacaagttggtcttaaattgttgcaactcattagctagtgaagatattcatgtaaatatattttaggattgtaattaattttgaaaatgtagaaagctctttattccatgtaagtatgcaggatgcctgcttttttatgcagttgtggaaagaatgtaaaatgttttaatatattctttgttaatctgagaacttgatactgaatcgtttatgtgggagaaggaaggagtaacataaaacatgtttttatcactcaaagtaagcaatggaggtaacaaatattgtgcattttaacagtaatatttgaagatttgtagaatattcacctttaaaactagttagtatgcatttataattttaccagaatatacaactaacaattcaacagtgatgttctttgcatttgtggggagatgtgtgatgttcttggttttctggtttggaatggaacgtttatagccttgcctgtaaaaatgtgccccagcacttaatgagtgaccgtttgaatccatatgtagtcccattggtgctaatgagagtagctgctgtgaaacaggaataaaatgtgtctgttcacggaggtgcggtgtggatgcacctacaaggccaactctctgatcagggtgagggagagatggaagaattaacagatctaaagttggcctttgttgtctcaaattgggtttgtacacacatgcatgcatgtgtgtatacaactgtaatctggaacttcaggaagtaaaattatttgaagtttcttagtaaaaagtaattaggtataattccaaatagatttctgtataaattgtatctaactggattacaagtcagtttgacaatttacgatgtctcagtgatgtttctgcaataattgtgaaatgcattattgatttaaataatgctgacacgtactctttaaaagtgttctttaacactgactactaaactttaagttttaaaaaataggttttcatttatggctttttgtggttttagcactttaagaagtttaattttttgtaatttttaatatgctctttcagtgtatctcagcgggtactccagcttgtggcattcccatgtgactggggagaagacaaaattggtgtttagattctggaggagaaaaaatgagttacaatgtcaggtgtttttaaaaattccttttagagacagtcttttgggaaccaaagtattttactgtaaatctttaaaataacagaattcagtgctctttcatttgttaatgctgtccagatttttcacacagttatactcagttaatactagttttcagaacattagtccaaggctatttcaagttttccattgaatatatgcttatggttaaaagaaaaacgaatggttttataattctgtgtattttgtcatatgccttagcagagtaagtcatttttccattttacttaggaataagctttttcgaactgaaaattcatggtaaaataggatttctatctaatgttaatccattgcttatttgtattcaattccattgtctacagtttgcttaaatgttgactaagaatgattggagtcaataaatttgtactgtattttgcttcga

SEQ ID NO: 2932 - DNA, 555 bp, Homo sapiens
tgggatgacgtcaaattcaagatggatggaatcacagcggcagcggcggctgcggcgcgcgcgagccgagtgtgagcggaaaggggcccggcgtctgcctcgagactgaagaccgaagacatgaagtagaaacaatccaggaaggctttgggaagctatttgtgtgcgaggatcaaagtgatctgaaaaatacactgaggagaaagtacacccggcaacaaagctcgccttatctgacagcagaagagcagagaaatcaaaagtttttgaggattcggtgtacacagccaccagccacaaacagtcttgctggattatctcgtgatcgtcagcagttgtgattttccccctttttacttacattcttgatggatggagcattttatatttttagataaactcaagccatggagggattactgcattacatcaaccctgcacacgccatttctctcctaagtgccctgaatgaggagcgtctcaaaggacagctgtgtgatgtgctgctgattgttggagaccaaaagttccgagctcataaaaacgtcttggctg

SEQ ID NO: 2933 - DNA, 5806 bp, Homo sapiens
tgggatgacgtcaaattcaagatggatggaatcacagcggcagcggcggctgcggcgcgcgcgagccgagtgtgagcggaaaggggcccggcgtctgcctcgagactgaagaccgaagacatgaagtagaaacaatccaggaaggctttgggaagctatttgtgtgcgaggatcaaagtgcagaagagcagagaaatcaaaagtttttgaggattcggtgtacacagccaccagccacaaacagtcttgctggattatctcgtgatcgtcagcagttgtgattttccccctttttacttacattcttgatggatggagcattttatatttttagataaactcaagccatggagggattactgcattacatcaaccctgcacacgccatttctctcctaagtgccctgaatgaggagcgtctcaaaggacagctgtgtgatgtgctgctgattgttggagaccaaaagttccgagctcataaaaacgtcttggctgccagcagcgaatactttcagagtttattcacaaataaggaaaatgagtcacaaactgtatttcagcttgacttctgtgagccagatgcttttgataatgttttaaactacatttattcttcctctctatttgttgagaagagcagccttgctgctgtgcaagaacttggctatagtcttgggatttcctttctgactaacatcgtttctaaaacacctcaagccccctttccaacgtgtcctaatagaaaaaaagtgtttgtagaagatgatgaaaacagttctcaaaagagaagtgtcattgtttgtcaaagtagaaacgaagcgcaaggaaaaactgttagtcaaaatcaacccgatgtaagccatacttcccggccctctcctagcattgcagtcaaggccaataccaataagccacatgtcccaaaaccaatagaaccacttcataatttgtcattaactgaaaagagttggccgaaagatagttctgtggtatatgcaaagtctcttgagcattctggatctttggatgatcctaatagaatcagtttggtgaaaagaaatgcagtgttgccttcaaagcctctgcaagacagagaagctatggatgataaaccaggtgtgagtggtcagcttccaaaaggaaaagctctagagctggctttgaagagaccacggccacctgttttgtctgtttgtagctcatcagagactccctatctattaaaagaaactaacaaaggaaatggtcaaggtgaagatagaaacttgttgtactattcaaagttaggcttagtgatcccatccagtggatctggttctggaaaccaaagcattgacaggagtggcccacttgttaagagtctcctcagacggtcattgtcgatggatagccaggttcctgtctattcaccttccatagatttgaaatcttcccagggatcatcttcggtgtccagtgatgcaccagggaatgtgttgtgtgctttatctcagaagtcatctttaaaagattgtagtgaaaaaacagccctagatgacaggcctcaagtgctacaaccgcatcgcctcaggtcctttagtgcttctcagtcaacagacagggagggagcttcccctgtgactgaggtgcgcataaagactgagcccagcagcccgctgtcggacccctcggacatcatccgcgtcactgtgggagatgcggcaacaacagcagctgcctcatcttcgtcggtcacaagagacctgtctctgaaaacagaagatgaccaaaaagacatgagcagactcccagcaaaaaggaggttccaagcggaccgaagattgccgtttaagaagttaaaggtgaatgagcacgggtctcctgtgtcagaagataattttgaggaaggctcaagccctactctccttgatgcagattttccagattctgatttgaataaagacgaatttggtgagttggaggggacgagaccaaacaaaaaatttaaatgcaaacattgccttaagatctttagatcaacagcaggtcttcaccgtcatgttaacatgtaccataacccagaaaagccctacgcttgtgacatctgtcacaagaggtttcacaccaacttcaaagtgtggacacactgtcagacccaacacggcatagtgaagaacccatcaccagcctctagttcacatgctgttttggatgaaaaattccaaagaaagctgattgacatagtgagagagagagaaattaagaaggccctgatcattaagttaaggcgcggcaagcctggttttcagggacagagtagctcccaagcacagcaagtcatcaagaggaacttgagatctcgagccaaaggagcttacatttgtacttactgcggaaaagcgtaccgctttctctctcaatttaagcagcatataaaaatgcatccaggagaaaaaccccttggagtaaataaagttgctaaaccaaaagagcatgctcctcttgcaagtccagtagaaaacaaggaggtttaccagtgccgcctctgtaatgctaagctctcttctctcctagagcaaggaagccacgagcggctgtgccggaacgcggccgtctgcccttactgcagcctcaggtttttctcgcccgagctgaagcaagaacacgagagcaagtgtgagtataagaagctgacctgcctcgagtgcatgcgcaccttcaagtcctctttcagcatctggcggcaccaggttgaagtccataatcagaacaacatggcacccaccgaaaacttttctttgcccgttttggaccacaatggtgatgtgactggttcttcaaggccccaatcccagcctgagcccaacaaagtaaaccacatcgtcaccacaaaagacgacaacgtgttcagtgattcttcagaacaagttaacttcgactcggaagattcctcttgtcttcccgaagaccttagtctttccaagcaactgaaaatccaagtcaaagaggagcctgtggaggaggctgaagaagaggcacccgaggccagcacagcccccaaagaagcgggtcctagcaaagaagccagcctgtggccctgcgagaagtgtgggaagatgttcacggtgcataagcagctggagcgtcaccaggagcttctgtgctctgtgaaaccatttatttgtcacgtgtgcaacaaagcttttcgcactaattttcgactctggagtcacttccaatcgcacatgtctcaggcttcagaggaatcggcacataaggaatctgaggtgtgccctgttcccacaaactctccctctccaccacctctgccaccgccaccaccactgcccaagatccagcctctggagcctgacagccccacaggcctgtccgaaaacccaactccagccacagaaaaactgtttgtgccccaagaatcagacacccttttttaccatgccccacccctttcagcaatcacatttaaaagacagtttatgtgtaaactttgccacaggacattcaagactgcatttagtctttggagtcacgaacaaacacacaattgaaagaccaacactttttacctatgggaggcagtccccagatttcaacctgaattgtgaaatgtgtcataagaaacaaaatattttttaaacaagaataataaaggttggagattgttacgcttgaaattaagttggaggcaaattgataattacttagtaatgtccttaactttagaaatacagcttttaaaatattgtggttctggaccttacaagaacaagatggtttgatttcattaatgttgaaattggattagtcttgattgtgtgcatggttcctcattccatggtgtcagtataatcatttaattgaggtttttggttttttattgattagtggaatactgtcgaagtattccttcttttaattattttagacacttgagttctagttaaatcttaaccatgttcttaagtccaaaataggaagaagtggagtagtttgcagtattgatttatatcttagactactttagcaataaaagataaatctcaactttaataagttatcctgacacttgataaaaataaatatttggtattttgtggtcatgtaaaacttctttttgtatgaaaattgtgagaaatttaaatcagcaatagtaacacttagatttttataaactaacaaaaacttgctctcagtcaatataataaatgatagttaaactctaaggaagacctgggaaatgaaaacaatttatggaagtcccctacagtcagtttataagggcttcagtagtgatagacattgttataaaaacttgtaccatgttacatgtacactgcaccacagtctaaattcagaccagcatttgaaggactgcacatatttcatttcctctgatttatgctgtcacaaattgaaaatctgagtgtagttaggacaaaaaacaaagctaaccatatggcactaattttgattttaacattagtgtaacaaataaggtcgggacatatatttacatagatcccagacactcaagaattagcacagctgatgtaaaattctaaattaccatttacttccagatagagcagaggagaaacacctcactgcagtttcaacatgctttccaagaacaatatatacgacatatacattttcctgcctctctcttgtgacaatttctgttagaatttgttgggggtctgatggttaaaatcatgggcaaggccattctctacatcattgcttaatatttcaaaaataggtattagagcactatcagtggtccaaaattagttttagctacttattttgctccatgggttttgggcttttcaaagaatactatgtataatttgtaattgaaagcctttcagtaggatatccaaagttcaatgtgtttcaaaagggaaaacttttacttgtgggggtgggagttagatgtattaaaaaaacgaaactacaaaatccttttaagaaagtaataccaatttagactctagtttgtgttacgaggtattctttcaaattttttttaaaagccaactactgtcattaagaaataattttagatttgtgctctagcagaaaataactctgtacccatcaatcttattgccaacattccataccagtggtaggaaagatattctcattttttttattgaaccagacatttttataaaatactgattgactttgtacattatggatattatatatgaaattttgccttgtattctttcacttgaaaaaactccaaaattccacaatattttagtagttaacttcctattctttcttaaatttgatggagaagggaaaataaattgcagttattgattcttgccatctttgttttcttaaagaaatctatgcattttaaggataaaactaaagcatatgggtttacatgaaacatcaggatggattattgtacattgaattcattccgcgtataatgtggtatttcttactctgtccatcttggtagctgtcacttcaaaagaagacagtttccctgagtaatcatcacctacatggccattagagtatctatcggtgataattccatgatacagagtatcttggcattataaattcagtatcccaggacctaaacctttatgctacattttcgaagattttttaaaaataatattgttaatcagtaaaaaaaaaaaatatttttgatctaaacataggttctgcatatctgttagattttaaaaatgactggtgttttgtcttcacatttttgtctaagcaaggaatataagatttcaaataaaattttgaaccaaaaaca

SEQ ID NO: 2934 - DNA, 6846 bp, Homo sapiens
gtcaaattcaagatggatggaatcacagcggcagcggcggctgcggcgcgcgcgagccgagtgtgagcggaaaggggcccggcgtctgcctcgagactgaagaccgaagacatgaagtagaaacaatccaggaaggctttgggaagctatttgtgtgcgaggatcaaagtgataaactcaagccatggagggattactgcattacatcaaccctgcacacgccatttctctcctaagtgccctgaatgaggagcgtctcaaaggacagctgtgtgatgtgctgctgattgttggagaccaaaagttccgagctcataaaaacgtcttggctgccagcagcgaatactttcagagtttattcacaaataaggaaaatgagtcacaaactgtatttcagcttgacttctgtgagccagatgcttttgataatgttttaaactacatttattcttcctctctatttgttgagaagagcagccttgctgctgtgcaagaacttggctatagtcttgggatttcctttctgactaacatcgtttctaaaacacctcaagccccctttccaacgtgtcctaatagaaaaaaagtgtttgtagaagatgatgaaaacagttctcaaaagagaagtgtcattgtttgtcaaagtagaaacgaagcgcaaggaaaaactgttagtcaaaatcaacccgatgtaagccatacttcccggccctctcctagcattgcagtcaaggccaataccaataagccacatgtcccaaaaccaatagaaccacttcataatttgtcattaactgaaaagagttggccgaaagatagttctgtggtatatgcaaagtctcttgagcattctggatctttggatgatcctaatagaatcagtttggtgaaaagaaatgcagtgttgccttcaaagcctctgcaagacagagaagctatggatgataaaccaggtgtgagtggtcagcttccaaaaggaaaagctctagagctggctttgaagagaccacggccacctgttttgtctgtttgtagctcatcagagactccctatctattaaaagaaactaacaaaggaaatggtcaaggtgaagatagaaacttgttgtactattcaaagttaggcttagtgatcccatccagtggatctggttctggaaaccaaagcattgacaggagtggcccacttgttaagagtctcctcagacggtcattgtcgatggatagccaggttcctgtctattcaccttccatagatttgaaatcttcccagggatcatcttcggtgtccagtgatgcaccagggaatgtgttgtgtgctttatctcagaagtcatctttaaaagattgtagtgaaaaaacagccctagatgacaggcctcaagtgctacaaccgcatcgcctcaggtcctttagtgcttctcagtcaacagacagggagggagcttcccctgtgactgaggtgcgcataaagactgagcccagcagcccgctgtcggacccctcggacatcatccgcgtcactgtgggagatgcggcaacaacagcagctgcctcatcttcgtcggtcacaagagacctgtctctgaaaacagaagatgaccaaaaagacatgagcagactcccagcaaaaaggaggttccaagcggaccgaagattgccgtttaagaagttaaaggtgaatgagcacgggtctcctgtgtcagaagataattttgaggaaggctcaagccctactctccttgatgcagattttccagattctgatttgaataaagacgaatttgagcaaggaagccacgagcggctgtgccggaacgcggccgtctgcccttactgcagcctcaggtttttctcgcccgagctgaagcaagaacacgagagcaagtgtgagtataagaagctgacctgcctcgagtgcatgcgcaccttcaagtcctctttcagcatctggcggcaccaggttgaagtccataatcagaacaacatggcacccaccgaaaacttttctttgcccgttttggaccacaatggtgatgtgactggttcttcaaggccccaatcccagcctgagcccaacaaagtaaaccacatcgtcaccacaaaagacgacaacgtgttcagtgattcttcagaacaagttaacttcgactcggaagattcctcttgtcttcccgaagaccttagtctttccaagcaactgaaaatccaagtcaaagaggagcctgtggaggaggctgaagaagaggcacccgaggccagcacagcccccaaagaagcgggtcctagcaaagaagccagcctgtggccctgcgagaagtgtgggaagatgttcacggtgcataagcagctggagcgtcaccaggagcttctgtgctctgtgaaaccatttatttgtcacgtgtgcaacaaagcttttcgcactaattttcgactctggagtcacttccaatcgcacatgtctcaggcttcagaggaatcggcacataaggaatctgaggtgtgccctgttcccacaaactctccctctccaccacctctgccaccgccaccaccactgcccaagatccagcctctggagcctgacagccccacaggcctgtccgaaaacccaactccagccacagaaaaactgtttgtgccccaagaatcagacacccttttttaccatgccccacccctttcagcaatcacatttaaaagacagtttatgtgtaaactttgccacaggacattcaagactgcatttagtctttggagtcacgaacaaacacacaattgaaagaccaacactttttacctatgggaggcagtccccagatttcaacctgaattgtgaaatgtgtcataagaaacaaaatattttttaaacaagaataataaaggttggagattgttacgcttgaaattaagttggaggcaaattgataattacttagtaatgtccttaactttagaaatacagcttttaaaatattgtggttctggaccttacaagaacaagatggtttgatttcattaatgttgaaattggattagtcttgattgtgtgcatggttcctcattccatggtgtcagtataatcatttaattgaggtttttggttttttattgattagtggaatactgtcgaagtattccttcttttaattattttagacacttgagttctagttaaatcttaaccatgttcttaagtccaaaataggaagaagtggagtagtttgcagtattgatttatatcttagactactttagcaataaaagataaatctcaactttaataagttatcctgacacttgataaaaataaatatttggtattttgtggtcatgtaaaacttctttttgtatgaaaattgtgagaaatttaaatcagcaatagtaacacttagatttttataaactaacaaaaacttgctctcagtcaatataataaatgatagttaaactctaaggaagacctgggaaatgaaaacaatttatggaagtcccctacagtcagtttataagggcttcagtagtgatagacattgttataaaaacttgtaccatgttacatgtacactgcaccacagtctaaattcagaccagcatttgaaggactgcacatatttcatttcctctgatttatgctgtcacaaattgaaaatctgagtgtagttaggacaaaaaacaaagctaaccatatggcactaattttgattttaacattagtgtaacaaataaggtcgggacatatatttacatagatcccagacactcaagaattagcacagctgatgtaaaattctaaattaccatttacttccagatagagcagaggagaaacacctcactgcagtttcaacatgctttccaagaacaatatatacgacatatacattttcctgcctctctcttgtgacaatttctgttagaatttgttgggggtctgatggttaaaatcatgggcaaggccattctctacatcattgcttaatatttcaaaaataggtattagagcactatcagtggtccaaaattagttttagctacttattttgctccatgggttttgggcttttcaaagaatactatgtataatttgtaattgaaagcctttcagtaggatatccaaagttcaatgtgtttcaaaagggaaaacttttacttgtgggggtgggagttagatgtattaaaaaaacgaaactacaaaatccttttaagaaagtaataccaatttagactctagtttgtgttacgaggtattctttcaaattttttttaaaagccaactactgtcattaagaaataattttagatttgtgctctagcagaaaataactctgtacccatcaatcttattgccaacattccataccagtggtaggaaagatattctcattttttttattgaaccagacatttttataaaatactgattgactttgtacattatggatattatatatgaaattttgccttgtattctttcacttgaaaaaactccaaaattccacaatattttagtagttaacttcctattctttcttaaatttgatggagaagggaaaataaattgcagttattgattcttgccatctttgttttcttaaagaaatctatgcattttaaggataaaactaaagcatatgggtttacatgaaacatcaggatggattattgtacattgaattcattccgcgtataatgtggtatttcttactctgtccatcttggtagctgtcacttcaaaagaagacagtttccctgagtaatcatcacctacatggccattagagtatctatcggtgataattccatgatacagagtatcttggcattataaattcagtatcccaggacctaaacctttatgctacattttcgaagattttttaaaaataatattgttaatcagtaaaaaaaaaaaatatttttgatctaaacataggttctgcatatctgttagattttaaaaatgactggtgttttgtcttcacatttttgtctaagcaaggaatataagatttcaaataaaattttgaaccaaaaacatttataatgccgttctggtttttctattactttttatactgtactttaaaagcattaggctgaaagagtttattttggtggtcaaaaaaaatatgcttccactcatgtaactattttaaatgttaagaagtaaaataatgaaagatatgttaattactttattcagtaaagttttttaagaatgtttatctcagccagtaggcaaatacttggtgtaaaacaagttggtcttaaattgttgcaactcattagctagtgaagatattcatgtaaatatattttaggattgtaattaattttgaaaatgtagaaagctctttattccatgtaagtatgcaggatgcctgcttttttatgcagttgtggaaagaatgtaaaatgttttaatatattctttgttaatctgagaacttgatactgaatcgtttatgtgggagaaggaaggagtaacataaaacatgtttttatcactcaaagtaagcaatggaggtaacaaatattgtgcattttaacagtaatatttgaagatttgtagaatattcacctttaaaactagttagtatgcatttataattttaccagaatatacaactaacaattcaacagtgatgttctttgcatttgtggggagatgtgtgatgttcttggttttctggtttggaatggaacgtttatagccttgcctgtaaaaatgtgccccagcacttaatgagtgaccgtttgaatccatatgtagtcccattggtgctaatgagagtagctgctgtgaaacaggaataaaatgtgtctgttcacggaggtgcggtgtggatgcacctacaaggccaactctctgatcagggtgagggagagatggaagaattaacagatctaaagttggcctttgttgtctcaaattgggtttgtacacacatgcatgcatgtgtgtatacaactgtaatctggaacttcaggaagtaaaattatttgaagtttcttagtaaaaagtaattaggtataattccaaatagatttctgtataaattgtatctaactggattacaagtcagtttgacaatttacgatgtctcagtgatgtttctgcaataattgtgaaatgcattattgatttaaataatgctgacacgtactctttaaaagtgttctttaacactgactactaaactttaagttttaaaaaataggttttcatttatggctttttgtggttttagcactttaagaagtttaattttttgtaatttttaatatgctctttcagtgtatctcagcgggtactccagcttgtggcattcccatgtgactggggagaagacaaaattggtgtttagattctggaggagaaaaaatgagttacaatgtcaggtgtttttaaaaattccttttagagacagtcttttgggaaccaaagtattttactgtaaatctttaaaataacagaattcagtgctctttcatttgttaatgctgtccagatttttcacacagttatactcagttaatactagttttcagaacattagtccaaggctatttcaagttttccattgaatatatgcttatggttaaaagaaaaacgaatggttttataattctgtgtattttgtcatatgccttagcagagtaagtcatttttccattttacttaggaataagctttttcgaactgaaaattcatggtaaaataggatttctatctaatgttaatccattgcttatttgtattcaattccattgtctacagtttgcttaaatgttgactaagaatgattggagtcaataaatttgtactgtattttgcttcga

SEQ ID NO: 2935 - DNA, 5608 bp, Homo sapiens
gcgatgacctcatccctggtgtgggatgacgtcaaattcaagatggatggaatcacagcggcagcggcggctgcggcgcgcgcgagccgagtgtgagcggaaaggggcccggcgtctgcctcgagactgaagaccgataaactcaagccatggagggattactgcattacatcaaccctgcacacgccatttctctcctaagtgccctgaatgaggagcgtctcaaaggacagctgtgtgatgtgctgctgattgttggagaccaaaagttccgagctcataaaaacgtcttggctgccagcagcgaatactttcagagtttattcacaaataaggaaaatgagtcacaaactgtatttcagcttgacttctgtgagccagatgcttttgataatgttttaaactacatttattcttcctctctatttgttgagaagagcagccttgctgctgtgcaagaacttggctatagtcttgggatttcctttctgactaacatcgtttctaaaacacctcaagccccctttccaacgtgtcctaatagaaaaaaagtgtttgtagaagatgatgaaaacagttctcaaaagagaagtgtcattgtttgtcaaagtagaaacgaagcgcaaggaaaaactgttagtcaaaatcaacccgatgtaagccatacttcccggccctctcctagcattgcagtcaaggccaataccaataagccacatgtcccaaaaccaatagaaccacttcataatttgtcattaactgaaaagagttggccgaaagatagttctgtggtatatgcaaagtctcttgagcattctggatctttggatgatcctaatagaatcagtttggtgaaaagaaatgcagtgttgccttcaaagcctctgcaagacagagaagctatggatgataaaccaggtgtgagtggtcagcttccaaaaggaaaagctctagagctggctttgaagagaccacggccacctgttttgtctgtttgtagctcatcagagactccctatctattaaaagaaactaacaaaggaaatggtcaaggtgaagatagaaacttgttgtactattcaaagttaggcttagtgatcccatccagtggatctggttctggaaaccaaagcattgacaggagtggcccacttgttaagagtctcctcagacggtcattgtcgatggatagccaggttcctgtctattcaccttccatagatttgaaatcttcccagggatcatcttcggtgtccagtgatgcaccagggaatgtgttgtgtgctttatctcagaagtcatctttaaaagattgtagtgaaaaaacagccctagatgacaggcctcaagtgctacaaccgcatcgcctcaggtcctttagtgcttctcagtcaacagacagggagggagcttcccctgtgactgaggtgcgcataaagactgagcccagcagcccgctgtcggacccctcggacatcatccgcgtcactgtgggagatgcggcaacaacagcagctgcctcatcttcgtcggtcacaagagacctgtctctgaaaacagaagatgaccaaaaagacatgagcagactcccagcaaaaaggaggttccaagcggaccgaagattgccgtttaagaagttaaaggtgaatgagcacgggtctcctgtgtcagaagataattttgaggaaggctcaagccctactctccttgatgcagattttccagattctgatttgaataaagacgaatttggtgagttggaggggacgagaccaaacaaaaaatttaaatgcaaacattgccttaagatctttagatcaacagcaggtcttcaccgtcatgttaacatgtaccataacccagaaaagccctacgcttgtgacatctgtcacaagaggtttcacaccaacttcaaagtgtggacacactgtcagacccaacacggcatagtgaagaacccatcaccagcctctagttcacatgctgttttggatgaaaaattccaaagaaagctgattgacatagtgagagagagagaaattaagaaggccctgatcattaagttaaggcgcggcaagcctggttttcagggacagagtagctcccaagcacagcaagtcatcaagaggaacttgagatctcgagccaaaggagcttacatttgtacttactgcggaaaagcgtaccgctttctctctcaatttaagcagcatataaaaatgcatccaggagaaaaaccccttggagtaaataaagttgctaaaccaaaagagcatgctcctcttgcaagtccagtagaaaacaaggaggtttaccagtgccgcctctgtaatgctaagctctcttctctcctagagcaaggaagccacgagcggctgtgccggaacgcggccgtctgcccttactgcagcctcaggtttttctcgcccgagctgaagcaagaacacgagagcaagtgtgagtataagaagctgacctgcctcgagtgcatgcgcaccttcaagtcctctttcagcatctggcggcaccaggttgaagtccataatcagaacaacatggcacccaccgaaaacttttctttgcccgttttggaccacaatggtgatgtgactggttcttcaaggccccaatcccagcctgagcccaacaaagtaaaccacatcgtcaccacaaaagacgacaacgtgttcagtgattcttcagaacaagttaacttcgactcggaagattcctcttgtcttcccgaagaccttagtctttccaagcaactgaaaatccaagtcaaagaggagcctgtggaggaggctgaagaagaggcacccgaggccagcacagcccccaaagaagcgggtcctagcaaagaagccagcctgtggccctgcgagaagtgtgggaagatgttcacggtgcataagcagctggagcgtcaccaggagcttctgtgctctgtgaaaccatttatttgtcacgtgtgcaacaaagcttttcgcactaattttcgactctggagtcacttccaatcgcacatgtctcaggcttcagaggaatcggcacataaggaatctgaggtgtgccctgttcccacaaactctccctctccaccacctctgccaccgccaccaccactgcccaagatccagcctctggagcctgacagccccacaggcctgtccgaaaacccaactccagccacagaaaaactgtttgtgccccaagaatcagacacccttttttaccatgccccacccctttcagcaatcacatttaaaagacagtttatgtgtaaactttgccacaggacattcaagactgcatttagtctttggagtcacgaacaaacacacaattgaaagaccaacactttttacctatgggaggcagtccccagatttcaacctgaattgtgaaatgtgtcataagaaacaaaatattttttaaacaagaataataaaggttggagattgttacgcttgaaattaagttggaggcaaattgataattacttagtaatgtccttaactttagaaatacagcttttaaaatattgtggttctggaccttacaagaacaagatggtttgatttcattaatgttgaaattggattagtcttgattgtgtgcatggttcctcattccatggtgtcagtataatcatttaattgaggtttttggttttttattgattagtggaatactgtcgaagtattccttcttttaattattttagacacttgagttctagttaaatcttaaccatgttcttaagtccaaaataggaagaagtggagtagtttgcagtattgatttatatcttagactactttagcaataaaagataaatctcaactttaataagttatcctgacacttgataaaaataaatatttggtattttgtggtcatgtaaaacttctttttgtatgaaaattgtgagaaatttaaatcagcaatagtaacacttagatttttataaactaacaaaaacttgctctcagtcaatataataaatgatagttaaactctaaggaagacctgggaaatgaaaacaatttatggaagtcccctacagtcagtttataagggcttcagtagtgatagacattgttataaaaacttgtaccatgttacatgtacactgcaccacagtctaaattcagaccagcatttgaaggactgcacatatttcatttcctctgatttatgctgtcacaaattgaaaatctgagtgtagttaggacaaaaaacaaagctaaccatatggcactaattttgattttaacattagtgtaacaaataaggtcgggacatatatttacatagatcccagacactcaagaattagcacagctgatgtaaaattctaaattaccatttacttccagatagagcagaggagaaacacctcactgcagtttcaacatgctttccaagaacaatatatacgacatatacattttcctgcctctctcttgtgacaatttctgttagaatttgttgggggtctgatggttaaaatcatgggcaaggccattctctacatcattgcttaatatttcaaaaataggtattagagcactatcagtggtccaaaattagttttagctacttattttgctccatgggttttgggcttttcaaagaatactatgtataatttgtaattgaaagcctttcagtaggatatccaaagttcaatgtgtttcaaaagggaaaacttttacttgtgggggtgggagttagatgtattaaaaaaacgaaactacaaaatccttttaagaaagtaataccaatttagactctagtttgtgttacgaggtattctttcaaattttttttaaaagccaactactgtcattaagaaataattttagatttgtgctctagcagaaaataactctgtacccatcaatcttattgccaacattccataccagtggtaggaaagatattctcattttttttattgaaccagacatttttataaaatactgattgactttgtacattatggatattatatatgaaattttgccttgtattctttcacttgaaaaaactccaaaattccacaatattttagtagttaacttcctattctttcttaaatttgatggagaagggaaaataaattgcagttattgattcttgccatctttgttttcttaaagaaatctatgcattttaaggataaaactaaagcatatgggtttacatgaaacatcaggatggattattgtacattgaattcattccgcgtataatgtggtatttcttactctgtccatcttggtagctgtcacttcaaaagaagacagtttccctgagtaatcatcacctacatggccattagagtatctatcggtgataattccatgatacagagtatcttggcattataaattcagtatcccaggacctaaacctttatgctacattttcgaagattttttaaaaataatattgttaatcagtaaaaaaaaaaaatatttttgatctaaacataggttctgcatatctgttagattttaaaaatgactggtgttttgtcttcacatttttgtctaagcaaggaatataagatttcaaataaaattttgaaccaaaaaca

SEQ ID NO: 2936 - DNA, 607 bp, Homo sapiens
aaacagatgtgggagcagggacgagagttgtggagtttaagtaccatgctggacctgaggatatactgtgatggaaccgttcagtaggtacctgagaggctggagcctcaagagtctaaacagagatacagatttgggaatcatcgtccagtagtgattaaagtcacaaggtctaatagaaaaagcaaagaatactgccacgttttggggctctgtaacggatgctggagaaataaagataaactcaagccatggagggattactgcattacatcaaccctgcacacgccatttctctcctaagtgccctgaatgaggagcgtctcaaaggacagctgtgtgatgtgctgctgattgttggagaccaaaagttccgagctcataaaaacgtcttggctgccagcagcgaatactttcagagtttattcacaaataaggaaaatgagtcacaaactgtatttcagcttgacttctgtgagccagatgcttttgataatgttttaaactacatttattcttcctctctatttgttgagaagagcagccttgctgctgtgcaagaacttggctatagtcttgggatttcctttctgactaacatcgtttc

SEQ ID NO: 2937 - DNA, 463 bp, Homo sapiens
gtcaaattcaagatggatggaatcacagcggcagcggcggctgcggcgcgcgcgagccgagtgtgagcggaaaggggcccggcgtctgcctcgagactgaagaccgagcccccgcagaccttgtctgggacttcccggcggtcccgcagagcatagcaccctccgccggccaggagccctgctgctcggccggcgaccgtctccccgcttggaggagcccccttccccccgtccgagaagacatgaagtagaaacaatccaggaaggctttgggaagctatttgtgtgcgaggatcaaagtgataaactcaagccatggagggattactgcattacatcaaccctgcacacgccatttctctcctaagtgccctgaatgaggagcgtctcaaaggacagctgtgtgatgtgctgctgattgttggagaccaaaagttccgagctcataaaaacgtcttggctg

SEQ ID NO: 2938 - DNA, 2582 bp, Homo sapiens
cttgtggactgcgccgggcatgctcggcggtgtgacggctcaggactgcatttcccagaggctgcagctatccggccaatgtagcctgaaactacatttctcagcggccactggaacgacctcaatctctgcctcctcgccagttcattgtggtcgttgacccggcagcgagctttggagttcatcgagggagaagtcagcgcccagctccgaggttggagcagccccgccgggcaacttgaatttctgcaaacgaacacagcaccgggagctctgcagacctgtgtcggcgcggaacccggactgagacatgccttttgaacttctcagatagaggaaccccagtgaagactgatcagttcttacaattctcaaagcatggcccataaatatgtgggtttgcagtatcacggatcagtgacatttgaggatgtggccatagccttctcccagcaggagtgggagagtctggactcttcccagaggggcttgtacagagatgtgatgttggagaactacaggaacttggtgtcaatgggacattcccgttctaaaccacatgtgatcgccttattggaacaatggaaagagcctgaagtgacagtgaggaaagatggaagaagatggtgcacagatttgcagttggaagatgatacaatcggctgtaaagaaatgcccacctctgaaaactgtccatcttttgctctacatcagaaaataagtagacagaaaccacgtgaatgtcaggaatatggaaagaccctttgtcaagactcaaagcctgttcaacatgaaagaatacatagtagtgaaaaacccaacagatgtaaagaatgtgggaagaactttagtaatggacatcaactcaccatacatcagagattgcatgttggtgagaaaccctataaatatgaaaaatgtgggaaggcctttatcagtggctcagcctttgttaagcatgggagaattcacactggtgagaagccactcaaatgtaagcaatgtggaaagactattagtggtagctatcaacttacagtacataagagtattcatactgggaagaaaccatatgagtgcggggaatgtgggaaagcttttctagtatatggaaagcttacccggcatcagagtactcacactggtgaaaaaccctttgggtgtgaggagtgtgggaaggccttcagtaccttttcatacctggttcaacatcagcgaattcataccagtgaaaaaccttacgaatgcaaagaatgtgggaaggcctttagcactagctcaccccttgctaagcatcagagaattcatactggcgagaaaccctatgaatgtaaggagtgtgggaagtccttcactgtgtatggacagcttactcgacatcagagtattcatactggtgagaaaccttttgaatgtaaggaatgtggaaaggcctttagacttagttccttccttcatgcacatcagcgaattcatgcagagataaagccctacggatgcaaggaatgcgggagaaccttcagtcgtgcctcatatcttgttcaacatggaagacttcacactggcgagaagccctatgaatgtaaggagtgtggcaaggcctttagtactggctcataccttgttcagcatcagaggatccatactggggagaaaccctatgaatgtaaggaatgtggcaaagcctttattagtcgccatcagcttaccgtacatcaaagggttcatactggagagaaaccctatgagtgtaaggaatgtggcaaggccttcagagtgcacgtacatctcacacagcatcggaaaattcatactgatgtaaagccctatgaatgtaaggaatgtggaaagacttttagtcgagcctcgtaccttgtacaacatagcagaatccatactggtaagaagccctatgagtgtaaggagtgtggcaaggccttcagttctggctcataccttgttcagcatcaaagaattcatactggggagaaaccctatgaatgtaacaaatgtgggaaagcctttactgtttatggacaacttattggacatcagagtgttcacactggtgagaaaccttttgaatgtaaggaatgcgggaaggcctttagacttaattcattccttactgaacatcagcgggtacacactggtgagaaaccctttaaatgcaaaaaatgtgggaagacctttagatacagttcagcccttaaagtgcatctgagaaaacatatgagtgttataccctaagagtctgaggagtgtgggaagtgcttcgtgtgtggctcaaacattgttgaacatcggggaatttatgctggtaggaaactttcaaatgtgaagaatattggcaggtctattctcatcttataattcataatataactcagaaaacataagaatattcctttgtcatttataggtttgtaataccaatatttatactggtggaccattcagaaaaagtgggaaacgttattacttaatggttacagcactgacagcatgaacttttatatgatgcatttattctaatgtgattgtatgaacaagtgaataaaaaaccttggacctcctaaacc

SEQ ID NO: 2939 - DNA, 942 bp, Homo sapiens
gagtgtgggaaggccttcagtaccttttcatacctggttcaacatcagcgaattcataccagtgaaaaaccttacgaatgcaaagaatgtgggaaggcctttagcactagctcaccccttgctaagcatcagagaattcatactggcgagaaaccctatgaatgtaaggagtgtgggaagtccttcactgtgtatggacagcttactcgacatcagagtattcatactggtgagaaaccttttgaatgtaaggaatgcgggagaaccttcagtcgtgcctcatatcttgttcaacatggaagacttcacactggcgagaagccctatgaatgtaaggagtgtggcaaggcctttagtactggctcataccttgttcagcatcagaggatccatactggggagaaaccctatgaatgtaaggaatgtggcaaagcctttattagtcgccatcagcttaccgtacatcaaagggttcatactggagagaaaccctatgagtgtaaggaatgtggcaaggccttcagagtgcacgtacatctcacacagcatcggaaaattcatactgatgtaaagccctatgaatgtaaggaatgtggaaagacttttagtcgagcctcgtaccttgtacaacatagcagaatccatactggtaagaagccctatgagtgtaaggagtgtggcaaggccttcagttctggctcataccttgttcagcatcaaagaattcatactggggagaaaccctatgaatgtaacaaatgtgggaaagcctttactgtttatggacaacttattggacatcagagtgttcacactggtgagaaaccttttgaatgtaaggaatgcgggaaggcctttagacttaattcattccttactgaacatcagcgggtacacactggtgagaaaccctttaaatgcaaaaaatgtgggaagaccttt

SEQ ID NO: 2940 - DNA, 2512 bp, Homo sapiens
cattgtggtcgttgacccggcagcgagctttggagttcatcgagggagaagtcagcgcccagctccgaggttggagcagccccgccgggcaacttgaatttctgcaaacgaacacagcaccgggagctctgcagacctgtgtcggcgcggaacccggactgagacatgccttttgaacttctcagatagaggaaccccagtgaagactgatcagttcttacaattctcaaagcatggcccataaatatgtgggtttgcagtatcacggatcagtgacatttgaggatgtggccatagccttctcccagcaggagtgggagagtctggactcttcccagaggggcttgtacagagatgtgatgttggagaactacaggaacttggtgtcaatgggacattcccgttctaaaccacatgtgatcgccttattggaacaatggaaagagcctgaagtgacagtgaggaaagatggaagaagatggtgcacaggataagaaagctccagtctacaaacaaaacatgccagaagatttttaggcgatgatgccacctgcacatggaaccaaaagatttgcagttggaagatgatacaatcggctgtaaagaaatgcccacctctgaaaactgtccatcttttgctctacatcagaaaataagtagacagaaaccacgtgaatgtcaggaatatggaaagaccctttgtcaagactcaaagcctgttcaacatgaaagaatacatagtagtgaaaaacccaacagatgtaaagaatgtgggaagaactttagtaatggacatcaactcaccatacatcagagattgcatgttggtgagaaaccctataaatatgaaaaatgtgggaaggcctttatcagtggctcagcctttgttaagcatgggagaattcacactggtgagaagccactcaaatgtaagcaatgtggaaagactattagtggtagctatcaacttacagtacataagagtattcatactgggaagaaaccatatgagtgcggggaatgtgggaaagcttttctagtatatggaaagcttacccggcatcagagtactcacactggtgaaaaaccctttgggtgtgaggagtgtgggaaggccttcagtaccttttcatacctggttcaacatcagcgaattcataccagtgaaaaaccttacgaatgcaaagaatgtgggaaggcctttagcactagctcaccccttgctaagcatcagagaattcatactggcgagaaaccctatgaatgtaaggagtgtgggaagtccttcactgtgtatggacagcttactcgacatcagagtattcatactggtgagaaaccttttgaatgtaaggaatgtggaaaggcctttagacttagttccttccttcatgcacatcagcgaattcatgcagagataaagccctacggatgcaaggaatgcgggagaaccttcagtcgtgcctcatatcttgttcaacatggaagacttcacactggcgagaagccctatgaatgtaaggagtgtggcaaggcctttagtactggctcataccttgttcagcatcagaggatccatactggggagaaaccctatgaatgtaaggaatgtggcaaagcctttattagtcgccatcagcttaccgtacatcaaagggttcatactggagagaaaccctatgagtgtaaggaatgtggcaaggccttcagagtgcacgtacatctcacacagcatcggaaaattcatactgatgtaaagccctatgaatgtaaggaatgtggaaagacttttagtcgagcctcgtaccttgtacaacatagcagaatccatactggtaagaagccctatgagtgtaaggagtgtggcaaggccttcagttctggctcataccttgttcagcatcaaagaattcatactggggagaaaccctatgaatgtaacaaatgtgggaaagcctttactgtttatggacaacttattggacatcagagtgttcacactggtgagaaaccttttgaatgtaaggaatgcgggaaggcctttagacttaattcattccttactgaacatcagcgggtacacactggtgagaaaccctttaaatgcaaaaaatgtgggaagacctttagatacagttcagcccttaaagtgcatctgagaaaacatatgagtgttataccctaagagtctgaggagtgtgggaagtgcttcgtgtgtggctcaaacattgttgaacatcggggaatttatgctggtaggaaactttcaaatgtgaagaatattggcaggtctattctcatcttataattcataatataactcagaaaacataagaatattcctttgtcatttataggtttgtaataccaatatttatactggtggaccattcagaaaaagtgggaaacgttattacttaatggttacagcactgacagcatgaacttttatatgatgcatttattctaatgtgattgtatgaacaagtgaataaaaaaccttggacctcct

SEQ ID NO: 2941 - DNA, 2651 bp, Homo sapiens
cttgtggactgcgccgggcatgctcggcggtgtgacggctcaggactgcatttcccagaggctgcagctatccggccaatgtagcctgaaactacatttctcagcggccactggaacgacctcaatctctgcctcctcgccagttcattgtggtcgttgacccggcagcgagctttggagttcatcgagggagaagtcagcgcccagctccgaggttggagcagccccgccgggcaacttgaatttctgcaaacgaacacagcaccgggagctctgcagacctgtgtcggcgcggaacccggactgagacatgcgtgagcgttgggtggaccgggcgaggatcccgggccggcgagtgcgggagcggcagggcagggaggcttttgaacttctcagatagaggaaccccagtgaagactgatcagttcttacaattctcaaagcatggcccataaatatgtgggtttgcagtatcacggatcagtgacatttgaggatgtggccatagccttctcccagcaggagtgggagagtctggactcttcccagaggggcttgtacagagatgtgatgttggagaactacaggaacttggtgtcaatggcaggacattcccgttctaaaccacatgtgatcgccttattggaacaatggaaagagcctgaagtgacagtgaggaaagatggaagaagatggtgcacagatttgcagttggaagatgatacaatcggctgtaaagaaatgcccacctctgaaaactgtccatcttttgctctacatcagaaaataagtagacagaaaccacgtgaatgtcaggaatatggaaagaccctttgtcaagactcaaagcctgttcaacatgaaagaatacatagtagtgaaaaacccaacagatgtaaagaatgtgggaagaactttagtaatggacatcaactcaccatacatcagagattgcatgttggtgagaaaccctataaatatgaaaaatgtgggaaggcctttatcagtggctcagcctttgttaagcatgggagaattcacactggtgagaagccactcaaatgtaagcaatgtggaaagactattagtggtagctatcaacttacagtacataagagtattcatactgggaagaaaccatatgagtgcggggaatgtgggaaagcttttctagtatatggaaagcttacccggcatcagagtactcacactggtgaaaaaccctttgggtgtgaggagtgtgggaaggccttcagtaccttttcatacctggttcaacatcagcgaattcataccagtgaaaaaccttacgaatgcaaagaatgtgggaaggcctttagcactagctcaccccttgctaagcatcagagaattcatactggcgagaaaccctatgaatgtaaggagtgtgggaagtccttcactgtgtatggacagcttactcgacatcagagtattcatactggtgagaaaccttttgaatgtaaggaatgtggaaaggcctttagacttagttccttccttcatgcacatcagcgaattcatgcagagataaagccctacggatgcaaggaatgcgggagaaccttcagtcgtgcctcatatcttgttcaacatggaagacttcacactggcgagaagccctatgaatgtaaggagtgtggcaaggcctttagtactggctcataccttgttcagcatcagaggatccatactggggagaaaccctatgaatgtaaggaatgtggcaaagcctttattagtcgccatcagcttaccgtacatcaaagggttcatactggagagaaaccctatgagtgtaaggaatgtggcaaggccttcagagtgcacgtacatctcacacagcatcggaaaattcatactgatgtaaagccctatgaatgtaaggaatgtggaaagacttttagtcgagcctcgtaccttgtacaacatagcagaatccatactggtaagaagccctatgagtgtaaggagtgtggcaaggccttcagttctggctcataccttgttcagcatcaaagaattcatactggggagaaaccctatgaatgtaacaaatgtgggaaagcctttactgtttatggacaacttattggacatcagagtgttcacactggtgagaaaccttttgaatgtaaggaatgcgggaaggcctttagacttaattcattccttactgaacatcagcgggtacacactggtgagaaaccctttaaatgcaaaaaatgtgggaagacctttagatacagttcagcccttaaagtgcatctgagaaaacatatgagtgttataccctaagagtctgaggagtgtgggaagtgcttcgtgtgtggctcaaacattgttgaacatcggggaatttatgctggtaggaaactttcaaatgtgaagaatattggcaggtctattctcatcttataattcataatataactcagaaaacataagaatattcctttgtcatttataggtttgtaataccaatatttatactggtggaccattcagaaaaagtgggaaacgttattacttaatggttacagcactgacagcatgaacttttatatgatgcatttattctaatgtgattgtatgaacaagtgaataaaaaaccttggacctcctaaacc

SEQ ID NO: 2942 - DNA, 2280 bp, Homo sapiens
agttcattgtggtcgttgacccggcagcgagctttggagttcatcgagggagaagtcagcgcccagctccgaggttggagcagccccgccgggcaacttgaatttctgcaaacgaacacagcaccgggagctctgcagacctgtgtcggcgcggaacccggactgagacatgccttttgaacttctcagatagaggaaccccagtgaagactgatcagttcttacaattctcaaagcatggcccataaatatgtgggtttgcagtatcacggatcagtgacatttgaggatgtggccatagccttctcccagcaggagtgggagagtctggactcttcccagaggggcttgtacagagatgtgatgttggagaactacaggaacttggtgtcaatgggacattcccgttctaaaccacatgtgatcgccttattggaacaatggaaagagcctgaagtgacagtgaggaaagatggaagaagatggtgcacagatttgcagttggaagatgatacaatcggctgtaaagaaatgcccacctctgaaaactgtccatcttttgctctacatcagaaaataagtagacagaaaccacgtgaatgtcaggaatatggaaagaccctttgtcaagactcaaagcctgttcaacatgaaagaatacatagtagtgaaaaacccaacagatgtaaagaatgtgggaagaactttagtaatggacatcaactcaccatacatcagagattgcatgttggtgagaaaccctataaatatgaaaaatgtgggaaggcctttatcagtggctcagcctttgttaagcatgggagaattcacactggtgagaagccactcaaatgtaagcaatgtggaaagactattagtggtagctatcaacttacagtacataagagtattcatactgggaagaaaccatatgagtgcggggaatgtgggaaagcttttctagtatatggaaagcttacccggcatcagagtactcacactggtgaaaaaccctttgggtgtgaggagtgtgggaaggccttcagtaccttttcatacctggttcaacatcagcgaattcataccagtgaaaaaccttacgaatgcaaagaatgtgggaaggcctttagcactagctcaccccttgctaagcatcagagaattcatactggcgagaaaccctatgaatgtaaggagtgtgggaagtccttcactgtgtatggacagcttactcgacatcagagtattcatactggtgagaaaccttttgaatgtaaggaatgtggaaaggcctttagacttagttccttccttcatgcacatcagcgaattcatgcagagataaagccctacggatgcaaggaatgcgggagaaccttcagtcgtgcctcatatcttgttcaacatggaagacttcacactggcgagaagccctatgaatgtaaggagtgtggcaaggcctttagtactggctcataccttgttcagcatcagaggatccatactggggagaaaccctatgaatgtaaggaatgtggcaaagcctttattagtcgccatcagcttaccgtacatcaaagggttcatactggagagaaaccctatgagtgtaaggaatgtggcaaggccttcagagtgcacgtacatctcacacagcatcggaaaattcatactgatgtaaagccctatgaatgtaaggaatgtggaaagacttttagtcgagcctcgtaccttgtacaacatagcagaatccatactggtaagaagccctatgagtgtaaggagtgtggcaaggccttcagttctggctcataccttgttcagcatcaaagaattcatactggggagaaaccctatgaatgtaacaaatgtgggaaagcctttactgtttatggacaacttattggacatcagagtgttcacactggtgagaaaccttttgaatgtaaggaatgcgggaaggcctttagacttaattcattccttactgaacatcagcgggtacacactggtgagaaaccctttaaatgcaaaaaatgtgggaagacctttagatacagttcagcccttaaagtgcatctgagaaaacatatgagtgttataccctaagagtctgaggagtgtgggaagtgcttcgtgtgtggctcaaacattgttgaacatcggggaatttatgctggtaggaaactttcaaatgtgaagaatattggcaggtctattctcatcttataattcataatataactcagaaaacataagaatattcctttgtcatttata

SEQ ID NO: 2943 - DNA, 4611 bp, Homo sapiens
tggggctgggagccgggcgccactgtggccgctgcttttctgagggaaaagagcgcggagtgggccaggttttgcaggccgggccaaggtggagaaaaggttcctgtggagcctcaggccggtgtgctttttttcccgggactgagcttctgcagccctgaggcctggaggcccgggcggtagtaactgtgccggaccaggttcgtgggtgcggcctgtggtgcagttggagaccgaggccccgcgcatcctcgtccgcgcttcagccacttaggctcggccgtagcgaaaaggcccaagagggaagtcagaggtggcggttagttggggccagggaagcgtggagggtgggttccaatcgagtcaagaaaagcctggggtgtcctgaactctgcctgcttccccagccctgccagtttccagagaaggcgcttgagaaggagaaacgaatcgctgctgctcttctaaaagccggttccctctctggtgtctgtggaccctgcttctgaagtacatgaaccttgaggaaaattgaccagttctagcagttctaaaatcatggctcgtgatttggtgatgttcagagatgtggctgtagacttttctcaggaagaatgggaatgcctgaactcatatcagaggaatttgtacagagatgtgatattagagaactatagcaacttggtgtcactggcaggatgttctatttctaagccagatgtgatcaccctattggaacaagggaaagagccctggatggttgtgagggatgagaaaagaagatggactctagatttggaatccagatatgacactaaaaagttatttcaaggaaaggatatttatgaaatgaacttatctcagtggaaggtaatggaaagaattaaaagctgtggacttgaagaacaagaaagtcctcatgaggtgtgtttcaggcaagtgacaaaaaccacctctgaaaaaatgcctacttacagaaaactcacatctcttcctctgtatcagaaaagtcataacagagagaaaccctacgaatgtggggaatgtgggaaggcttttagagtacgacaacaacttactttccatcaaagaattcatactggtgagaaaccctatgaatgtaaagaatgtggaaaagcctttagacagtgtgcccacctcagtcgacatcagagaattcatacttctgacaaactctatgaatgtaaaaaatgtggaaagatcttcacatgtggctcagaccttcgagtacatcagagaattcatattggtgagaagccgtatgaatgtaaagaatgtgggaaagcctttagagttagaggacaacttaatctccatcaaaggattcacacgggtgagaaaccctatgaatgtaaagaatgtgggaaggcctttaggcagtatgcacaccttactcgacatcagagactgaacattgctgagaagtgctatgagtgtaaggaatgtggtcaggcctttctgtgtagtacaggccttcgactacatcacaaacttcatactggagaaaaaccctatgaatgtaaggagtgtggaaaggcctttagagtgcggcagcaacttactctccatcagagaattcacactggtgagaagccttatgattgtaaggaatgtgggaagactttcagtcgtggctatcatctaactctccatcagagaatacatactggtgaaaagccctatgaatgtaaggaatgtcagaagttctttcgtcgttactcagaacttatttcacatcagggtattcacattggagagaaaccttatgaatgtaaggaatgtgggaaggcatttaggctgttctcacagcttactcaacatcagagtattcattttggtgagaaaccctttaagtgtaaggaatgtgagaagacttttagactgctttcacaacttacccaacatcaaagtattcatactggtgaaaagccctatgactgtaaggaatgtggaaaggcctttagacttcattcatcactgattcaacatcagagaattcattctggtgagaaaccatacaaatgtaaggaatgtaaaaaggcatttagacaacattcacatcttacttaccatcagcgaattcataatgtaacttaataattattagaactcttcctttgcgaattttatgttgagcataggaagtacattctagaggaaaggtttttgaacgtgggaatcccttttgcttcatgctcacaactaagcataggaagttttatttaaaggaaagaatatgttaatgaacatatagaagcctttcatcacctttgaaaccatgttaaactttaggaaattcatcctagaaaagaactttattacaggactgaatgtggaaaagcttttgatcttacctattattatctccatattcttccatctgtgtatatacacacgaaggttgctagggaaccacttcattctgaaaatgtgtaaatgaaaggaaagtcatttagtctgcatttcctgtaggaactgtatttcagggcaaccagaagttaaggaggtaaagttcttctttattagaaaattccaggctaatgaatgcagaaagaataatagaaaattatattagaaaaactattgtgtaacacataatgaaataatggatctaggcatgattctctgtacaggttgacaccattcagtgaaggttgtgaactttatagtgaatagatgagactgacaacgtctgaacccactcatcatctcaacttcacaaaaagcaagagagtaaaaattacgtgcctcctaatgtgctacagtaagatatacacatcttgccaaaaatattgaacctgaatttaagcctcaagagccaactcccagtttagagaaaattcaaggaatggaagagtaaattacatgacacaaaaaggagcaattaaatctaaaataagggtaattctacaagaggaatcacctggtttcccaaccaataaaatggcattttaagaaataaggtggaactcctaggtattgacagacttgagacatcagtcaaatgcaatgaaacagtggtttttacttagatcatgagttgaacaaacatgtaaaagaagagatacttaacaataattgggagaatggaatattgacaatattagataatattaagaaactttgttatgtgtgataatagcattgtggttatgtaaaagtgtatttgttagagataatttctgaagtctatacacaggagatgatatatctggaatgtccttttgttcatacaaaagaaaaatgaggatgaataacaagtttggcaaaatgatggtaacctaagtcttggatacatggtttttatttgttttgtttttgctattctacttttgtgtatttaaaattttccatgatgttcttttaaagatcaaattatccatgaaattatagccagtttaaaatgaattattttaaaaaaaatttctggctgggcccggtggctcatgcctgtaatcccagcactttgggaggccggtgggcagatcatgaggtcaggagttcgagaccagcctgaccatcatggtgaaacctcatctccactaaaaatacaaaaattagccaggcgtggtcacatgcgcctgtaatcccagctactcgggcagctgagacaggagaatcacttgaacccaggaggcagaggttgcagtgagccgagatcacgccattgcactccagcctgggcaacaagagcaaaactctatctcaaagaaaaaaagaaaatttctacatattaaaacttgtggatgttgccaaagctctacacattgggattggaatattaattacactataatgacgataatgtattcaggaagttaaaatgtaggtccacattttatttagttgacctctctatctctatattatagtacccatggtatgcaccttttttttttttttttttgagacggagtctcgctctttcgcccaggctggcgtgcagtggcacagtctcggctcactgcaagctctgcctcccgggttcaagccattctcctccctcagacttccgagtggctgggattacaggcgcccgccaccacaccaggttgatttttgtatttttagtagagatggggtttcaccatgttggccaagctggtctcaactcctgacctcaggtgatccacctgccttggcctcccaaggtgctgggattacaggcgtgagccaccatgcccgactctcacttcatatgtttaaagaatgagtaaaagaaagcaattactactgctaaatgtgggaaataatggactagacctgtactaatatatggtagtcactagcaacctgttgagcacttgaaattgagttattgagcactgaaatgtggctagtccaaattcaaatggtgtttttttgtaaaacacaagattctgaagacttagttattttaaaaaagttaagtatctcaatttttcatattgagtacatattgaaataatattttagatatattggttcaaataaaatacattaaaatgaataacacttttttgtttttaaaattgttataggaaaatttatatatgtagctcacgtatttctattgtcagcgctggcataaacaataaaaagtagacttgg

SEQ ID NO: 2944 - DNA, 3916 bp, Homo sapiens
gtggccgctgcttttctgagggaaaagagcgcggagtgggccaggttttgcaggccgggccaaggtggagaaaaggttcctgtggagcctcaggccggtgtgctttttttcccgggactgagcttctgcagccctgaggcctggaggcccgggcggtagtaactgtgccggaccaggttcgtgggtgcggcctgtggtgcagttggagaccgaggccccgcgcatcctcgtccgcgcttcagccacttaggctcggccgtagcgaaaaggcccaagagggaagtcagaggtgaacgccccaggatgaaggtcccctgcaaaacgctgggacctagatttggggtggcggttagttggggccagggaagcgtggagggtgggttccaatcgagtcaagaaaagcctggggtgtcctgaactctgcctgcttccccagccctgccagtttccagagaaggcgcttgagaaggagaaacgaatcgctgctgctcttctaaaagccggttccctctctggtgtctgtggaccctgcttctgaagtacatgaaccttgaggaaaattgaccagttctagcagttctaaaatcatggctcgtgatttggtgatgttcagagatgtggctgtagacttttctcaggaagaatgggaatgcctgaactcatatcagaggaatttgtacagagatgtgatattagagaactatagcaacttggtgtcactggcaggatgttctatttctaagccagatgtgatcaccctattggaacaagggaaagagccctggatggttgtgagggatgagaaaagaagatggactctagatttggaatccagatatgacactaaaaagttatttcaaggaaaggatatttatgaaatgaacttatctcagtggaaggtaatggaaagaattaaaagctgtggacttgaagaacaagaaagtcctcatgaggtgtgtttcaggcaagtgacaaaaaccacctctgaaaaaatgcctacttacagaaaactcacatctcttcctctgtatcagaaaagtcataacagagagaaaccctacgaatgtggggaatgtgggaaggcttttagagtacgacaacaacttactttccatcaaagaattcatactggtgagaaaccctatgaatgtaaagaatgtggaaaagcctttagacagtgtgcccacctcagtcgacatcagagaattcatacttctgacaaactctatgaatgtaaaaaatgtggaaagatcttcacatgtggctcagaccttcgagtacatcagagaattcatattggtgagaagccgtatgaatgtaaagaatgtgggaaagcctttagagttagaggacaacttaatctccatcaaaggattcacacgggtgagaaaccctatgaatgtaaagaatgtgggaaggcctttaggcagtatgcacaccttactcgacatcagagactgaacattgctgagaagtgctatgagtgtaaggaatgtggtcaggcctttctgtgtagtacaggccttcgactacatcacaaacttcatactggagaaaaaccctatgaatgtaaggagtgtggaaaggcctttagagtgcggcagcaacttactctccatcagagaattcacactggtgagaagccttatgattgtaaggaatgtgggaagactttcagtcgtggctatcatctaactctccatcagagaatacatactggtgaaaagccctatgaatgtaaggaatgtcagaagttctttcgtcgttactcagaacttatttcacatcagggtattcacattggagagaaaccttatgaatgtaaggaatgtgggaaggcatttaggctgttctcacagcttactcaacatcagagtattcattttggtgagaaaccctttaagtgtaaggaatgtgagaagacttttagactgctttcacaacttacccaacatcaaagtattcatactggtgaaaagccctatgactgtaaggaatgtggaaaggcctttagacttcattcatcactgattcaacatcagagaattcattctggtgagaaaccatacaaatgtaaggaatgtaaaaaggcatttagacaacattcacatcttacttaccatcagcgaattcataatgtaacttaataattattagaactcttcctttgcgaattttatgttgagcataggaagtacattctagaggaaaggtttttgaacgtgggaatcccttttgcttcatgctcacaactaagcataggaagttttatttaaaggaaagaatatgttaatgaacatatagaagcctttcatcacctttgaaaccatgttaaactttaggaaattcatcctagaaaagaactttattacaggactgaatgtggaaaagcttttgatcttacctattattatctccatattcttccatctgtgtatatacacacgaaggttgctagggaaccacttcattctgaaaatgtgtaaatgaaaggaaagtcatttagtctgcatttcctgtaggaactgtatttcagggcaaccagaagttaaggaggtaaagttcttctttattagaaaattccaggctaatgaatgcagaaagaataatagaaaattatattagaaaaactattgtgtaacacataatgaaataatggatctaggcatgattctctgtacaggttgacaccattcagtgaaggttgtgaactttatagtgaatagatgagactgacaacgtctgaacccactcatcatctcaacttcacaaaaagcaagagagtaaaaattacgtgcctcctaatgtgctacagtaagatatacacatcttgccaaaaatattgaacctgaatttaagcctcaagagccaactcccagtttagagaaaattcaaggaatggaagagtaaattacatgacacaaaaaggagcaattaaatctaaaataagggtaattctacaagaggaatcacctggtttcccaaccaataaaatggcattttaagaaataaggtggaactcctaggtattgacagacttgagacatcagtcaaatgcaatgaaacagtggtttttacttagatcatgagttgaacaaacatgtaaaagaagagatacttaacaataattgggagaatggaatattgacaatattagataatattaagaaactttgttatgtgtgataatagcattgtggttatgtaaaagtgtatttgttagagataatttctgaagtctatacacaggagatgatatatctggaatgtccttttgttcatacaaaagaaaaatgaggatgaataacaagtttggcaaaatgatggtaacctaagtcttggatacatggtttttatttgttttgtttttgctattctacttttgtgtatttaaaattttccatgatgttcttttaaagatcaaattatccatgaaattatagccagtttaaaatgaattattttaaaaaaaatttctggctgggattacaggcgtgagccaccatgcccgactctcacttcatatgtttaaagaatgagtaaaagaaagcaattactactgctaaatgtgggaaataatggactagacctgtactaatatatggtagtcactagcaacctgttgagcacttgaaattgagttattgagcactgaaatgtggctagtccaaattcaaatggtgtttttttgtaaaacacaagattctgaagacttagttattttaaaaaagttaagtatctcaatttttcatattgagtacatattgaaataatattttagatatattggttcaaataaaatacattaaaatgaataacacttttttgtttttaaaattgttataggaaaatttatatatgtagctcacgtatttctattgtcagcgctggcataaacaataaaaagtagacttgg

SEQ ID NO: 2945 - DNA, 1832 bp, Homo sapiens
gtattctggcgccgctgactcccagggctgggctatcctctgagtcggccctgccagtttccagagaaggcgcttgagaaggagaaacgaatcgctgctgctcttctaaaagccggttccctctctggtgtctgtggaccctgcttctgaagtacatgaaccttgaggaaaattgaccagttctagcagttctaaaatcatggctcgtgatttggtgatgttcagagatgtggctgtagacttttctcaggaagaatgggaatgcctgaactcatatcagaggaatttgtacagagatgtgatattagagaactatagcaacttggtgtcactgggatgttctatttctaagccagatgtgatcaccctattggaacaagggaaagagccctggatggttgtgagggatgagaaaagaagatggactctagatttggaatccagatatgacactaaaaagttatttcaaggaaaggatatttatgaaatgaacttatctcagtggaaggtaatggaaagaattaaaagctgtggacttgaagaacaagaaagtcctcatgaggtgtgtttcaggcaagtgacaaaaaccacctctgaaaaaatgcctacttacagaaaactcacatctcttcctctgtatcagaaaagtcataacagagagaaaccctacgaatgtggggaatgtgggaaggcttttagagtacgacaacaacttactttccatcaaagaattcatactggtgagaaaccctatgaatgtaaagaatgtggaaaagcctttagacagtgtgcccacctcagtcgacatcagagaattcatacttctgacaaactctatgaatgtaaaaaatgtggaaagatcttcacatgtggctcagaccttcgactacatcacaaacttcatactggagaaaaaccctatgaatgtaaggagtgtggaaaggcctttagagtgcggcagcaacttactctccatcagagaattcacactggtgagaagccttatgattgtaaggaatgtgggaagactttcagtcgtggctatcatctaactctccatcagagaatacatactggtgaaaagccctatgaatgtaaggaatgtcagaagttctttcgtcgttactcagaacttatttcacatcagggtattcacattggagagaaaccttatgaatgtaaggaatgtgggaaggcatttaggctgttctcacagcttactcaacatcagagtattcattttggtgagaaaccctttaagtgtaaggaatgtgagaagacttttagactgctttcacaacttacccaacatcaaagtattcatactggtgaaaagccctatgactgtaaggaatgtggaaaggcctttagacttcattcatcactgattcaacatcagagaattcattctggtgagaaaccatacaaatgtaaggaatgtaaaaaggcatttagacaacattcacatcttacttaccatcagcgaattcataatgtaacttaataattattagaactcttcctttgcgaattttatgttgagcataggaagtacattctagaggaaaggtttttgaacgtgggaatcccttttgcttcatgctcacaactaagcataggaagttttatttaaaggaaagaatatgttaatgaacatatagaagcctttcatcacctttgaaaccatgttaaactttaggaaattcatcctagaaaagaactttattacaggactgaatgtggaaaagcttttgatcttacctattattatctccatattcttccatctgtgtatatacacacgaaggttgctagggaaccacttcattctg

SEQ ID NO: 2946 - DNA, 4440 bp, Homo sapiens
acagccagcgtcagagtcaggcaccaccgcgcagccttctctgcggcaccatcctaatcccccgctagagaacggcacacgcgcacgcagcagccccgtgcacggaaacactactccgccagcggccaggcactcggtccaggtggcggttagttggggccagggaagcgtggagggtgggttccaatcgagtcaagaaaagcctggggtgtcctgaactctgcctgcttccccagccctgccagtttccagagaaggcgcttgagaaggagaaacgaatcgctgctgctcttctaaaagccggttccctctctggtgtctgtggaccctgcttctgaagtacatgaaccttgaggaaaattgaccagttctagcagttctaaaatcatggctcgtgatttggtgatgttcagagatgtggctgtagacttttctcaggaagaatgggaatgcctgaactcatatcagaggaatttgtacagagatgtgatattagagaactatagcaacttggtgtcactggcaggatgttctatttctaagccagatgtgatcaccctattggaacaagggaaagagccctggatggttgtgagggatgagaaaagaagatggactctagatttggaatccagatatgacactaaaaagttatttcaaggaaaggatatttatgaaatgaacttatctcagtggaaggtaatggaaagaattaaaagctgtggacttgaagaacaagaaagtcctcatgaggtgtgtttcaggcaagtgacaaaaaccacctctgaaaaaatgcctacttacagaaaactcacatctcttcctctgtatcagaaaagtcataacagagagaaaccctacgaatgtggggaatgtgggaaggcttttagagtacgacaacaacttactttccatcaaagaattcatactggtgagaaaccctatgaatgtaaagaatgtggaaaagcctttagacagtgtgcccacctcagtcgacatcagagaattcatacttctgacaaactctatgaatgtaaaaaatgtggaaagatcttcacatgtggctcagaccttcgagtacatcagagaattcatattggtgagaagccgtatgaatgtaaagaatgtgggaaagcctttagagttagaggacaacttaatctccatcaaaggattcacacgggtgagaaaccctatgaatgtaaagaatgtgggaaggcctttaggcagtatgcacaccttactcgacatcagagactgaacattgctgagaagtgctatgagtgtaaggaatgtggtcaggcctttctgtgtagtacaggccttcgactacatcacaaacttcatactggagaaaaaccctatgaatgtaaggagtgtggaaaggcctttagagtgcggcagcaacttactctccatcagagaattcacactggtgagaagccttatgattgtaaggaatgtgggaagactttcagtcgtggctatcatctaactctccatcagagaatacatactggtgaaaagccctatgaatgtaaggaatgtcagaagttctttcgtcgttactcagaacttatttcacatcagggtattcacattggagagaaaccttatgaatgtaaggaatgtgggaaggcatttaggctgttctcacagcttactcaacatcagagtattcattttggtgagaaaccctttaagtgtaaggaatgtgagaagacttttagactgctttcacaacttacccaacatcaaagtattcatactggtgaaaagccctatgactgtaaggaatgtggaaaggcctttagacttcattcatcactgattcaacatcagagaattcattctggtgagaaaccatacaaatgtaaggaatgtaaaaaggcatttagacaacattcacatcttacttaccatcagcgaattcataatgtaacttaataattattagaactcttcctttgcgaattttatgttgagcataggaagtacattctagaggaaaggtttttgaacgtgggaatcccttttgcttcatgctcacaactaagcataggaagttttatttaaaggaaagaatatgttaatgaacatatagaagcctttcatcacctttgaaaccatgttaaactttaggaaattcatcctagaaaagaactttattacaggactgaatgtggaaaagcttttgatcttacctattattatctccatattcttccatctgtgtatatacacacgaaggttgctagggaaccacttcattctgaaaatgtgtaaatgaaaggaaagtcatttagtctgcatttcctgtaggaactgtatttcagggcaaccagaagttaaggaggtaaagttcttctttattagaaaattccaggctaatgaatgcagaaagaataatagaaaattatattagaaaaactattgtgtaacacataatgaaataatggatctaggcatgattctctgtacaggttgacaccattcagtgaaggttgtgaactttatagtgaatagatgagactgacaacgtctgaacccactcatcatctcaacttcacaaaaagcaagagagtaaaaattacgtgcctcctaatgtgctacagtaagatatacacatcttgccaaaaatattgaacctgaatttaagcctcaagagccaactcccagtttagagaaaattcaaggaatggaagagtaaattacatgacacaaaaaggagcaattaaatctaaaataagggtaattctacaagaggaatcacctggtttcccaaccaataaaatggcattttaagaaataaggtggaactcctaggtattgacagacttgagacatcagtcaaatgcaatgaaacagtggtttttacttagatcatgagttgaacaaacatgtaaaagaagagatacttaacaataattgggagaatggaatattgacaatattagataatattaagaaactttgttatgtgtgataatagcattgtggttatgtaaaagtgtatttgttagagataatttctgaagtctatacacaggagatgatatatctggaatgtccttttgttcatacaaaagaaaaatgaggatgaataacaagtttggcaaaatgatggtaacctaagtcttggatacatggtttttatttgttttgtttttgctattctacttttgtgtatttaaaattttccatgatgttcttttaaagatcaaattatccatgaaattatagccagtttaaaatgaattattttaaaaaaaatttctggctgggcccggtggctcatgcctgtaatcccagcactttgggaggccggtgggcagatcatgaggtcaggagttcgagaccagcctgaccatcatggtgaaacctcatctccactaaaaatacaaaaattagccaggcgtggtcacatgcgcctgtaatcccagctactcgggcagctgagacaggagaatcacttgaacccaggaggcagaggttgcagtgagccgagatcacgccattgcactccagcctgggcaacaagagcaaaactctatctcaaagaaaaaaagaaaatttctacatattaaaacttgtggatgttgccaaagctctacacattgggattggaatattaattacactataatgacgataatgtattcaggaagttaaaatgtaggtccacattttatttagttgacctctctatctctatattatagtacccatggtatgcaccttttttttttttttttttgagacggagtctcgctctttcgcccaggctggcgtgcagtggcacagtctcggctcactgcaagctctgcctcccgggttcaagccattctcctccctcagacttccgagtggctgggattacaggcgcccgccaccacaccaggttgatttttgtatttttagtagagatggggtttcaccatgttggccaagctggtctcaactcctgacctcaggtgatccacctgccttggcctcccaaggtgctgggattacaggcgtgagccaccatgcccgactctcacttcatatgtttaaagaatgagtaaaagaaagcaattactactgctaaatgtgggaaataatggactagacctgtactaatatatggtagtcactagcaacctgttgagcacttgaaattgagttattgagcactgaaatgtggctagtccaaattcaaatggtgtttttttgtaaaacacaagattctgaagacttagttattttaaaaaagttaagtatctcaatttttcatattgagtacatattgaaataatattttagatatattggttcaaataaaatacattaaaatgaataacacttttttgtttttaaaattgttataggaaaatttatatatgtagctcacgtatttctattgtcagcgctggcataaacaataaaaagtagacttgg

SEQ ID NO: 2947 - DNA, 2730 bp, Homo sapiens
agcatccattcatatattcattcagtcagctaatttttaatccagcacatactattgcaagcgctgttttaggcgttgagaatacaactgtgaacaagacgacaaaaattcctgccctcatggagcctaagagcctagattttagcgaaggtagaaccaccgtaaacaatgtatatattaataagtaacttatgcaccatactggaaaattataaagtgctatagaggaaaagaagaattcatgtaaagcaagggaaacaagatgtgagatcacagcggtttagtgttgctaatgaaccccaaatccagggcagtgtttgacacattaagccaaacagtagcggcactgtgggtcaagaagggccctttggctggcaccaccaaaacatgtgttctccaaaggaggctggcatcaactggagccacttcacagcttgtttgagaactggatctgaccagtaggaagaaaccaggacagcagtggaagactgttaaagaaacctgagtaaaaagatgcaggaggttgtgctgttggatgagagttcaggaccaccaagccagctgctttggacccgccaggatacccagctccctcaggaaagcgctctattacctgctccatatcctgccttcactaaagatggaagccaaggaaacctgccgcaagcagatatcacactaatgagccaggcccaagagtcagtgacatttgaggatgtagctgtgaacttcactaacagggagtggcagtgtctgacctacgctcaaaggcatctctataaggatgtgatgttggaaaattatgggaacatggtatcacttggatttccatttcctaaacctcctttaatctctcatctggagcgagaagtagacccctgtgtgcaggatccacaggacagggagtccctaagctgctcctacccagtgtcagctgacaagatgtggcctgagaatgaaaaggcaagttcacaacaagagatttttgaaaatggagaagcctactggatgaaatttaacagtctcctaaaagttgattcccgggatcctaaggttagagaagtttgtgttcaggatgtcaaattagagaatcaatgggaaacatctataagggagaaactgagagaagagaaagaaggctctgaggaagtgacctgcaaaaaaggaaagaaccagaaagtgcttagtaaaaacttgaatccaaactcaaaacatagtcaatgtaataaagttcttatagcacagaaactccatgaatgtgccaggtgtggcaaaaacttcagttggcactcagatctaattctccatgagcaaattcattctggtgagaaaccccatgtgtgtaatgagtgtgggaaagcattcaagaccagaaatcagctttctatgcaccggataatccacacaggggagaaaccttttaattgcacccagtgtgggaaggctttcaacagtagatcagctctttgccgacataaaaaaacccacagtggggagaagcctcacgagtgcagggactgtgggaaggccttcaagaccaggaaccgtctctgtatgcatcagcttatccacaccggggagaagccttacaaatgtaactgctgtgggaaggccttccagtttaagcattcccttaccatccatggcagaatccacactggggagaagccatatgaatgtgaggagtgcgggaaggccttcagtgggagttcagacctcaccaaacacataagaatccacactggggaacgaccttatgagtgcagcaagtgtggaagggccttcagtcggagctcagacctaagcaaacacaaacgaatccatactcgggagaaacactatgggtgtccccagtgtggaaaagacttcagcatcaaggcagaactcaccaaacacagaaggatccacactgaagagaaacgttacaggtgtgaggagtgtgggaaagcctttcgtcataactgtaagcgcagggctcatgaacgagagcatacaggggagaagccctatcaatgcagggattgtgggaaaaccttccaagataagcactgccttaccatccatcagagaatccacactggagagaaaccttacaaatgtttagagtgtgggaaagctttcagtgggaagtcaaacttgaccaatcatcgaagaattcacactggagagaagcctcacaaatgtgaggtatgtggaatggccttccatcatagttcagtcctgaggcagcacaaaagaatccacactggtgagaagccatacacctgcagtgagtgtggcacgtccttccgtcagggctcagctctgattggacataagcgagttcatactggggagaaaccttatgaatgtgaggaatgtggaaaagcttttagagtgagctcaaatcttactggacataagaaaagaaaacatcaagtatggagtacccatgaacttgatgggagtaggaaatccctctctccagtgactgtttctcagacctcagtagtcagtattttgaccagtgcctgagtataacgattctggtgttactttctgtttttcctacctcttaggctggtccttctgtctcttatattagttattcctgatttcctgacccttaattgtgagattccccaaagacattgtcctttaccttcttattcactattttttcagtgagcacatttacttccaagagtttatcaatcacttcctaatattaataaacacttattagtgctt

SEQ ID NO: 2948 - DNA, 2700 bp, Homo sapiens
taatttttaatccagcacatactattgcaagcgctgttttaggcgttgagaatacaactgtgaacaagacgacaaaaattcctgccctcatggagcctaagagcctaaattttagcgaaggtagaaccaccgtaaacaatgtatatattaataagtaacttatgcaccatactggaaaattataaagtgctatagaggaaaagaagaattcatgtaaagcaagggaaacaagatgtgagatcacagcggtttagtgttgctaatgaaccccaaatccagggcagtgtttgacacattaagccaaacagtagcggcactgtgggtcaagaagggccctttggctggcaccaccaaaacatgtgttctccaaaggaggctggcatcaactggagccacttcacagcttgtttgagaactggatctgaccagtaggaagaaaccaggacagcagtggaagactgttaaagaaacctgagtaaaaagatgcaggaggttgtgctgttggatgagagttcaggaccaccaagccagctgctttggacccgccaggatacccagctccctcaggaaagcgctctattacctgctccatatcctgccttcactaaagatggaagccaaggaaacctgccgcaagcagatatcacactaatgagccaggcccaagagtcagtgacatttgaggatgtagctgtgaacttcactaacagggagtggcagtgtctgacctacgctcaaaggcatctctataaggatgtgatgttggaaaattatgggaacatggtatcacttggatttccatttcctaaacctcctttaatctctcatctggagcgagaagtagacccctgtgtgcaggatccacaggacagggagtccctaagctgctcctacccagtgtcagctgacaagatgtggcctgagaatgaaaaggcaagttcacaacaagagatttttgaaaatggagaagcctactggatgaaatttaacagtctcctaaaagttgattcccgggatcctaaggttagagaagtttgtgttcaggatgtcaaattagagaatcaatgggaaacatctataagggagaaactgagagaagagaaagaaggctctgaggaagtgacctgcaaaaaaggaaagaaccagaaagtgcttagtaaaaacttgaatccaaactcaaaacatagtcaatgtaataaagttcttatagcacagaaactccatgaatgtgccaggtgtggcaaaaacttcagttggcactcagatctaattctccatgagcaaattcattctggtgagaaaccccatgtgtgtaatgagtgtgggaaagcattcaagaccagaaatcagctttctatgcaccggataatccacacaggggagaaaccttttaattgcacccagtgtgggaaggctttcaacagtagatcagctctttgccgacataaaaaaacccacagtggggagaagcctcacgagtgcagggactgtgggaaggccttcaagaccaggaaccgtctctgtatgcatcagcttatccacaccggggagaagccttacaaatgtaactgctgtgggaaggccttccagtttaagcattcccttaccatccatggcagaatccacactggggagaagccatatgaatgtgaggagtgcgggaaggccttcagtgggagttcagacctcaccaaacacataagaatccacactggggaacgaccttatgagtgcagcaagtgtggaagggccttcagtcggagctcagacctaagcaaacacaaacgaatccatactcgggagaaacactatgggtgtccccagtgtggaaaagacttcagcatcaaggcagaactcaccaaacacagaaggatccacactgaagagaaacgttacaggtgtgaggagtgtgggaaagcctttcgtcataactgtaagcgcagggctcatgaacgagagcatacaggggagaagccctatcaatgcagggattgtgggaaaaccttccaagataagcactgccttaccatccatcagagaatccacactggagagaaaccttacaaatgtttagagtgtgggaaagctttcagtgggaagtcaaacttgaccaatcatcgaagaattcacactggagagaagcctcacaaatgtgaggtatgtggaatggccttccatcatagttcagtcctgaggcagcacaaaagaatccacactggtgagaagccatacacctgcagtgagtgtggcacgtccttccgtcagggctcagctctgattggacataagcgagttcatactggggagaaaccttatgaatgtgaggaatgtggaaaagcttttagagtgagctcaaatcttactggacataagaaaagaaaacatcaagtatggagtacccatgaacttgatgggagtaggaaatccctctctccagtgactgtttctcagacctcagtagtcagtattttgaccagtgcctgagtataacgattctggtgttactttctgtttttcctacctcttaggctggtccttctgtctcttatattagttattcctgatttcctgacccttaattgtgagattccccaaagacattgtcctttaccttcttattcactattttttcagtgagcacatttacttccaagagtttatcaatcacttcctaatattaataaacacttattagtgctt

SEQ ID NO: 2949 - DNA, 2730 bp, Homo sapiens; identical to SEQ ID NO: 2947

SEQ ID NO: 2950 - DNA, 2730 bp, Homo sapiens; identical to SEQ ID NO: 2947

SEQ ID NO: 2951 - DNA, 2730 bp, Homo sapiens; identical to SEQ ID NO: 2947

SEQ ID NO: 2952 - DNA, 2643 bp, Homo sapiens
agcatccattcatatattcattcagtcagctaatttttaatccagcacatactattgcaagcgctgttttaggcgttgagaatacaactgtgaacaagacgacaaaaattcctgccctcatggagcctaagagcctagattttagcgaaggtagaaccaccgtaaacaatgtatatattaataagtaacttatgcaccatactggaaaattataaagtgctatagaggaaaagaagaattcatgtaaagcaagggaaacaagatgtgagatcacagcggtttagtgttgctaatgaaccccaaatccagggcagtgtttgacacattaagccaaacagtagcggcactgtgggtcaagaagggccctttggctggcaccaccaaaacatgtgttctccaaaggaggctggcatcaactggagccacttcacagcttgtttgagaactggatctgaccagtaggaagaaaccaggacagcagtggaagactgttaaagaaacctgagtaaaaagatgcaggaggttgtgctgttggatgagagttcaggaccaccaagccagctgctttggacccgccaggatacccagctccctcaggaaagcgctctattacctgctccatatcctgccttcactaaagatggaagccaaggaaacctgccgcaagcagatatcacactaatgagccaggcccaagagtcagtgacatttgaggatgtagctgtgaacttcactaacagggagtggcagtgtctgacctacgctcaaaggcatctctataaggatgtgatgttggaaaattatgggaacatggtatcacttggatttccatttcctaaacctcctttaatctctcatctggagcgagaagtagacccctgtgtgcaggatccacaggacagggagtccctaagctgctcctacccagtgtcagctgacaagatgtggcctgagaatgaaaaggcaagttcacaacaagagatttttgaaaatggagaagcctactggatgaaatttaacagtctcctaaaagttgattcccgggatcctaaggttagagaagtttgtgttcaggatgtcaaattagagaatcaatgggaaacatctataagggagaaactgagagaagagaaagaaggctctgaggaagtgacctgcaaaaaaggaaagaaccagaaagtgcttagtaaaaacttgaatccaaactcaaaacatagtcaatgtaataaagttcttatagcacagaaactccatgaatgtgccaggtgtggcaaaaacttcagttggcactcagatctaattctccatgagcaaattcattctggtgagaaaccccatgtgtgtaatgagtgtgggaaagcattcaagaccagaaatcagctttctatgcaccggataatccacacaggggagaaaccttttaattgcacccagtgtgggaaggctttcaacagtagatcagctctttgccgacataaaaaaacccacagtggggagaagcctcacgagtgcagggactgtgggaaggccttcaagaccaggaaccgtctctgtatgcatcagcttatccacaccggggagaagccttacaaatgtaactgctgtgggaaggccttccagtttaagcattcccttaccatccatggcagaatccacactggggagaagccatatgaatgtgaggagtgcgggaaggccttcagtgggagttcagacctcaccaaacacataagaatccacactggggaacgaccttatgagtgcagcaagtgtggaagggccttcagtcggagctcagacctaagcaaacacaaacgaatccatactcgggagaaacactatgggtgtccccagtgtggaaaagacttcagcatcaaggcagaactcaccaaacacagaaggatccacactgaagagaaacgttacaggtgtgaggagtgtgggaaagcctttcgtcataactgtaagcgcagggctcatgaacgagagcatacaggggagaagccctatcaatgcagggattgtgggaaaaccttccaagataagcactgccttaccatccatcagagaatccacactggagagaaaccttacaaatgtttagagtgtgggaaagctttcagtgggaagtcaaacttgaccaatcatcgaagaattcacactggagagaagcctcacaaatgtgaggtatgtggaatggccttccatcatagttcagtcctgaggcagcacaaaagaatccacactggtgagaagccatacacctgcagtgagtgtggcacgtccttccgtcagggctcagctctgattggacataagcgagttcatactggggagaaaccttatgaatgtgaggaatgtggaaaagcttttagagtgagctcaaatcttactggacataagaaaagaaaacatcaagtatggagtacccatgaacttgatgggagtaggaaatccctctctccagtgactgtttctcagacctcagtagtcagtattttgaccagtgcctgagtataacgattctggtgttactttctgtttttcctacctcttaggctggtccttctgtctcttatattagttattcctgatttcctgacccttaattgtgagattccccaaagacattgtcctttacct

SEQ ID NO: 2953 - DNA, 2503 bp, Homo sapiens
atatttctgtttctcatttcttggggagagtaccggcgggaagcatccattcatatattcattcagtcagctaatttttaatccagcacatactattgcaagcgctgttttaggcgttgagaatacaactgtgaacaagacgacaaaaattcctgccctcatggagcctaagagcctagattttagcgaaggtagaaccaccgtaaacaatgtatatattaataagtaacttatgcaccatactggaaaattataaagtgctatagaggaaaagaagaattcatgtaaagcaaggaggctggcatcaactggagccacttcacagcttgtttgagaactggatctgaccagtaggaagaaaccaggacagcagtggaagactgttaaagaaacctgagtaaaaagatgcaggaggtaagaagaggagggtctgtgatacatcacaaggaggaagaaggagaagtgagtccaagagtcagtgacatttgaggatgtagctgtgaacttcactaacagggagtggcagtgtctgacctacgctcaaaggcatctctataaggatgtgatgttggaaaattatgggaacatggtatcacttggatttccatttcctaaacctcctttaatctctcatctggagcgagaagtagacccctgtgtgcaggatccacaggacagggagtccctaagctgctcctacccagtgtcagctgacaagatgtggcctgagaatgaaaaggcaagttcacaacaagagatttttgaaaatggagaagcctactggatgaaatttaacagtctcctaaaagttgattcccgggatcctaaggttagagaagtttgtgttcaggatgtcaaattagagaatcaatgggaaacatctataagggagaaactgagagaagagaaagaaggctctgaggaagtgacctgcaaaaaaggaaagaaccagaaagtgcttagtaaaaacttgaatccaaactcaaaacatagtcaatgtaataaagttcttatagcacagaaactccatgaatgtgccaggtgtggcaaaaacttcagttggcactcagatctaattctccatgagcaaattcattctggtgagaaaccccatgtgtgtaatgagtgtgggaaagcattcaagaccagaaatcagctttctatgcaccggataatccacacaggggagaaaccttttaattgcacccagtgtgggaaggctttcaacagtagatcagctctttgccgacataaaaaaacccacagtggggagaagcctcacgagtgcagggactgtgggaaggccttcaagaccaggaaccgtctctgtatgcatcagcttatccacaccggggagaagccttacaaatgtaactgctgtgggaaggccttccagtttaagcattcccttaccatccatggcagaatccacactggggagaagccatatgaatgtgaggagtgcgggaaggccttcagtgggagttcagacctcaccaaacacataagaatccacactggggaacgaccttatgagtgcagcaagtgtggaagggccttcagtcggagctcagacctaagcaaacacaaacgaatccatactcgggagaaacactatgggtgtccccagtgtggaaaagacttcagcatcaaggcagaactcaccaaacacagaaggatccacactgaagagaaacgttacaggtgtgaggagtgtgggaaagcctttcgtcataactgtaagcgcagggctcatgaacgagagcatacaggggagaagccctatcaatgcagggattgtgggaaaaccttccaagataagcactgccttaccatccatcagagaatccacactggagagaaaccttacaaatgtttagagtgtgggaaagctttcagtgggaagtcaaacttgaccaatcatcgaagaattcacactggagagaagcctcacaaatgtgaggtatgtggaatggccttccatcatagttcagtcctgaggcagcacaaaagaatccacactggtgagaagccatacacctgcagtgagtgtggcacgtccttccgtcagggctcagctctgattggacataagcgagttcatactggggagaaaccttatgaatgtgaggaatgtggaaaagcttttagagtgagctcaaatcttactggacataagaaaagaaaacatcaagtatggagtacccatgaacttgatgggagtaggaaatccctctctccagtgactgtttctcagacctcagtagtcagtattttgaccagtgcctgagtataacgattctggtgttactttctgtttttcctacctcttaggctggtccttctgtctcttatattagttattcctgatttcctgacccttaattgtgagattccccaaagacattgtcctttaccttcttattcactattttttcagtgagcacatttacttccaagagtttatcaatcacttcctaatattaataaacacttattagtg

SEQ ID NO: 2954 - DNA, 2503 bp, Homo sapiens; identical to SEQ ID NO: 2953

SEQ ID NO: 2955 - DNA, 2503 bp, Homo sapiens; identical to SEQ ID NO: 2953

SEQ ID NO: 2956 - DNA, 2503 bp, Homo sapiens; identical to SEQ ID NO: 2953

SEQ ID NO: 2957 - DNA, 2503 bp, Homo sapiens; identical to SEQ ID NO: 2953

SEQ ID NO: 2958 - DNA, 2503 bp, Homo sapiens
atatttctgtttctcatttcttggggagagtaccggcgggaagcatccattcatatattcattcagtcagctaatttttaatccagcacatactattgcaagcgctgttttaggcgttgagaatacaactgtgaacaagacgacaaaaattcctgccctcatggagcctaagagcctaaattttagcgaaggtagaaccaccgtaaacaatgtatatattaataagtaacttatgcaccatactggaaaattataaagtgctatagaggaaaagaagaattcatgtaaagcaaggaggctggcatcaactggagccacttcacagcttgtttgagaactggatctgaccagtaggaagaaaccaggacagcagtggaagactgttaaagaaacctgagtaaaaagatgcaggaggtaagaagaggagggtctgtgatacatcacaaggaggaagaaggagaagtgagtccaagagtcagtgacatttgaggatgtagctgtgaacttcactaacagggagtggcagtgtctgacctacgctcaaaggcatctctataaggatgtgatgttggaaaattatgggaacatggtatcacttggatttccatttcctaaacctcctttaatctctcatctggagcgagaagtagacccctgtgtgcaggatccacaggacagggagtccctaagctgctcctacccagtgtcagctgacaagatgtggcctgagaatgaaaaggcaagttcacaacaagagatttttgaaaatggagaagcctactggatgaaatttaacagtctcctaaaagttgattcccgggatcctaaggttagagaagtttgtgttcaggatgtcaaattagagaatcaatgggaaacatctataagggagaaactgagagaagagaaagaaggctctgaggaagtgacctgcaaaaaaggaaagaaccagaaagtgcttagtaaaaacttgaatccaaactcaaaacatagtcaatgtaataaagttcttatagcacagaaactccatgaatgtgccaggtgtggcaaaaacttcagttggcactcagatctaattctccatgagcaaattcattctggtgagaaaccccatgtgtgtaatgagtgtgggaaagcattcaagaccagaaatcagctttctatgcaccggataatccacacaggggagaaaccttttaattgcacccagtgtgggaaggctttcaacagtagatcagctctttgccgacataaaaaaacccacagtggggagaagcctcacgagtgcagggactgtgggaaggccttcaagaccaggaaccgtctctgtatgcatcagcttatccacaccggggagaagccttacaaatgtaactgctgtgggaaggccttccagtttaagcattcccttaccatccatggcagaatccacactggggagaagccatatgaatgtgaggagtgcgggaaggccttcagtgggagttcagacctcaccaaacacataagaatccacactggggaacgaccttatgagtgcagcaagtgtggaagggccttcagtcggagctcagacctaagcaaacacaaacgaatccatactcgggagaaacactatgggtgtccccagtgtggaaaagacttcagcatcaaggcagaactcaccaaacacagaaggatccacactgaagagaaacgttacaggtgtgaggagtgtgggaaagcctttcgtcataactgtaagcgcagggctcatgaacgagagcatacaggggagaagccctatcaatgcagggattgtgggaaaaccttccaagataagcactgccttaccatccatcagagaatccacactggagagaaaccttacaaatgtttagagtgtgggaaagctttcagtgggaagtcaaacttgaccaatcatcgaagaattcacactggagagaagcctcacaaatgtgaggtatgtggaatggccttccatcatagttcagtcctgaggcagcacaaaagaatccacactggtgagaagccatacacctgcagtgagtgtggcacgtccttccgtcagggctcagctctgattggacataagcgagttcatactggggagaaaccttatgaatgtgaggaatgtggaaaagcttttagagtgagctcaaatcttactggacataagaaaagaaaacatcaagtatggagtacccatgaacttgatgggagtaggaaatccctctctccagtgactgtttctcagacctcagtagtcagtattttgaccagtgcctgagtataacgattctggtgttactttctgtttttcctacctcttaggctggtccttctgtctcttatattagttattcctgatttcctgacccttaattgtgagattccccaaagacattgtcctttaccttcttattcactattttttcagtgagcacatttacttccaagagtttatcaatcacttcctaatattaataaacacttattagtg

SEQ ID NO: 2959 - DNA, 4220 bp, Homo sapiens
cacagcggacctacaggcgctcagagaagcccaccttccccctctctgtcccgagaaggcttagagtggtacctgcttgctcaagcaacctgctgcctccacccagagcagccgctcctctcctccctcccttccggaagatgctgaggatgacagcttttagcctgactcttacatttctttggcagagcagttagaggccagactgtcctgtgaaggcttctccttccttcttcctctgctcaggagaaaacttacaaacttttaaatgtaagaggcagatgagctgggaacctggaagtgggttgcatctgactctgaaagttcctccctctcgctggcattacctcatgctgccacaaagtgaacggatcactggggaaggcagagtctccccggcactgctgggaccctcccttgaagagcccccatgtcctgtaggcagagccttgtagtctgtccgcttggttactgactcgggctgtctgaccagcccctcttctgtgccttgtctgaggtccttgtccatctctgtgattgggcagcttctctctctggattgggtcacgtgaagcgggaaactgaagccattactctccaaaccctgtttcatcttcccaagcatgtcggaaagctggcaacagccgccacagacgcagccgcagcagccacagccaccgcagcctcagcaccatgcagagccaccgccagccctggcagagcacacgctgcctccgggcacggcggagaaccccctgggctgtgccgtctatggcatcctcctgcagccagaccccggcctgcagcccccacaacacgcacccctgcaggcagcaggagagccaggccccaaatgtggcgtgtgtggtcacgacctggcgcacctgtccagtccgcatgagcaccagtgtctggcgggccatgaccgctcattccagtgcacacagtgtctcaagatcttccaccaggccactgacctgctggagcaccagtgcgtgcaggctgagcagaagcccttcgtctgtggggtctgcaagatgggcttctcactactcacctcactggcacagcaccacagctcccacagtggcctggtgaagtgttccatctgtgaaaagacctacaagccagctgaggcagcggagccagccaccacagccgccccgtcgcttcccgcagcacccgcgccttccactgtcacccctgctgaacaggccgacaagccctacagctgccccatctgccaaaagcccttcaagcacctgtcggagctctctcggcatgagcggatccacaccggtgagaagccctacaagtgcacgctgtgtgacaaaagcttcagccagtcgtcgcacctggtgcaccacaagcgcacgcacagctccgagcggccctacaagtgcgcagtctgcgagaagaccttcaagcaccgctctcacctggtgcgccacatgtacgcgcactcgggcgagcaccacctgttccgctgcaacgtgtgcgagttgcatttcaaggagtcgtcggagctgctgcagcacccgtgcacgccaagtggggagcggcccttccgctgcggcgagtgccagaaggccttcaagcggccctcggacctgcggcagcatgagcgcacacacagcgccgagcggcccttcaagtgcgacctgtgccccatgggcttcaagcagcagtacgcactgatgcgccaccggcgcacacacaagaccgaggagcccttcaaatgcggcctatgtgagaagggctttgggcagcccagccacctgctctaccaccagcacgtgcacaccctcgagactctcttcaagtgccccgtgtgccagaaaggctttgaccaatctgccgagctgctgcggcacaagtgcctgcccggcgcggccgagcggcccttcaagtgccctgtgtgcaacaaggcctacaagcgcgcgtcggccctgcagaagcaccagctggcccactgtgcggcggcagagaagcccctgcgctgcacgctttgcgaacgccgcttcttctcctcttccgagttcgtgcagcaccgctgcgatccggcccgcgagaagccactcaagtgcccagactgcgagaaacgcttcaagtacgcgtcagacctgcagcggcaccggcgggtacacacaggcgagaagccctacaagtgccccaactgcgacaaggccttcaagcagcgggagcatctcaacaagcaccagggcgtgcacgcccgcgagcagcagttcaagtgtgtatggtgcggggagcgcttcctagacgtggccttgttgcaggagcacagcgcgcagcacagtgccgccgccgcggcagcggagggcgcctaccaggtagccgcctgcctgccctgactctgcggctgtggcccctaccagcctgacctgagtcggcgccgtgggcccagcaggcctcgcgcagcctagctcctcacagctgccttgcaccaagggccccacccagctcggtgttctgagacctcgggagtgaggacgcaggggtatgaggcagggagagggtgtgccgctcgtactcctggcaccagcgggcagtgcgggcggccagattgctgtggcccatcctgattccacaaacctctttcccatgacaagattcactttcttgagagccatcagcaccccccttatttccggggcactggagccaggctggaagtcaagtggcttctccctgccctaaggagggtgtgatgccagcccaaccttcccatatctttcaagctagcagccacataggttaggaaagcggaggctcatggtggggctggggccccagaggtgggctaggtgtaaggcatcagttgccgtgtgggggagaaggccagctttaagacgtaggcctggggactgggagggcagagggtgagtcacagccctctccgtctgctctagccaggggcgacgtgtccccaggtttctggcaggggagatgtgcagggtgggtcttggggctgggtctgcctggagaccagtgggcccagggggaagggggaagctgagaagttcgtgtgacaccctcagccaagggacagtgccatccttggggacaggaggaaaagcagcctgtctctgctaagggcaaatcctccggttttggaagcgcccctcccacctttgtagtgcagttcctaggtgtggtggggaatgtgccgtgctctcagcagacagaactgctggtgtgaaaggcagggattgtcagcccacctgaggctgggaggaagcaggaccaggcctaggatctccccagcagatgcaaacaagtgtcctcccctgaattgtgtgaaccaaagcgtcaggggcttggggcacagccccagtcagctcaacccagtcctgcttcagagccaagactaggccagggtggggacccccccagtaccctccctacatcaatgtggctgctggcctggaccccaggggtctggtacagccaagatgttctggacaacatccagctacttcaaaggccagagtgtcctttgggtcctcctagagtccccctaggtctctggctgcccatgaggctcatgaagcagagggtatcccagtcatagggagcagaaagagcaagtgggttaaggaagcctgtgggggacctggtggatggagttgaccaacatcgctgggtggctacggccctccttaggaagcccagaaggacctttattattaaaataatcattttgaaccctgctctatcccctgccctcttccagccccacccctccctggtcttgaaagaagactaatcagtgggcacaccaagggccctgaggggcagggagatgccaccatgcttctctgtcaccgtaagaaggctgaccagccacgcccacctcctctgtctgactgagttccttcctgtggccacagggaggggctggtccttcccctcggtgctggctctctgtcacaatgcctcaaaagacatggaacccaggcctacaaccgtcccaactgctaattcttttcctttcattttgctttctgaaagcagtttgttatactattcataacattgtagagtttaatttcatgtcattttggatcttatataaaaatgtgaggatttggatttttaaaaagaatgactccattttaggtagccacttttgatgttaatatatagtgagtccaatgtatgctttagaagtaaagacattgaccgtcacagaccactgc

SEQ ID NO: 2960 - DNA, 2374 bp, Homo sapiens
atgattgaaaggcctgaaacagatgtatcttccaagttcttatcaagaaaatgactgtgagggcaacgatgggtcaagaagaccagcggaaaactccctaggagagagccatagaaaatgtacacttcagaagagaaatgtaatcagagaactcaaaaaaggaaaatatataatgtatgccctcggaagggtaaaaagatttttattcatatgcatgagattattcagatagatggtcatatataccagtgccttgaatgcaagcaaaacttgtgtgaaaacttagctcttattatgtgtgagagaacccatactggggagaaaccttataaatgtgatatgtgtgagaaaacctttgtccaaagctcagatcttacttcacaccagaggatccacaattacgagaaaccttataaatgtagcaaatgtgagaagagcttttggcatcacttagtgctttcaggacatcagagaacacatgcaggtaaaaaattctatacatgtgacatttgtggcaagaattttggtcagagttctgatctgcttgtccaccagcgaagccatactggcgagaaaccatatctatgtagtgagtgtgacaaatgcttcagtagaagtacaaacctcataaggcatcgaagaactcacacaggtgagaaaccatttaagtgtctcgagtgtgaaaaagcttttagtgggaaatcagatcttattagccaccagagaactcacactggggaaaggccctacaaatgtaataagtgtgagaaaagttaccgacaccgttcagccttcattgtacataaaagagttcatactggggagaagccctataagtgtggtgcctgtgaaaaatgctttggccagaaatcagaccttatcgtgcaccagagagtccacacaggtgagaagccgtataaatgcctggaatgtatgagaagttttactcggagtgccaacctaattaggcaccaggcaactcacactcacacttttaaatgccttgaatatgaaaaaagctttaactgtagctcagatcttattgtacatcagagaattcacatggaagagaaaccacatcagtggtctgcgtgtgagagtggcttcctcctaggaatggactttgttgcccaacagaaaatgagaactcaaacagaggagctacactataaatacactgtatgtgataaaagcttccaccagagttcagcccttcttcaacatcagacagtacgcattggtgaaaaaccgtttgtctgtaatgtgagtgaaaaaggtcttgagcttagccctccccatgcgtcagaagcctcacagatgtcttgaccaggcgagaagctgtaataccaatattaaaaattatttatgtatcagagaactcattaagatgaggacaaatctcagactttgctcagagctcagaattcagtggggaccagagagcctgcaattggaaatatgagaaattctttgcccagagagctgccctaacagaacacttcatcctcactccaacgagaaatctacagatgcccagaggttttgaaaacttaccgtctgagctcaaatttgatcactcacaagaggattcatacaagtgggaaaccttagaaatgcactgagtgtgagagagctttctactaatgctcagcccttctcgttgtaagagaattcacaccggagaacaactttttaaatgccttcagtgtcagttgtgctgcagacagtatgaacatctcattggacctcagaaaacccaccctggggagaagccccagcaagtgtgaaaaaagcttctaacaaaactctgacttacccatcagagaagccatactggtgaaaaattgtatatttgtcttacgtatggcaaaagcattcattggagagccttacttgggtttgcacccaaaaaaaaaaacccaatctgaggaaagactgcaagtgtctgaatgaagagtgcttgtcaatgatcaactcttgtggtacatcagggaactcacataggtgaaaaaacccatacttaccttgagtctgagaaaacctttggtagaagctcctgtcttatcaggccccaaaaaacctgttctgcagtgagagatttaattgtgggtgagaatctatgtacatatgtatgagaagactgttctcatagttagttgactcatatggtagagaggactttacatgaaatcagtatgaaaatagttttttagatacccagaagcttgttctgggagaagctagggcgggtcagagtagacctgatgggtaactcaggtaaagatgcttttcttttatctgaactacttaatgattgctttacttttactttttaaaaaattcagaaatccaataaaggaaaggacggtaacct

SEQ ID NO: 2961 - DNA, 3000 bp, Homo sapiens
caggccacaccggtggtctgggctggggaccgcgggtcgggtccggtttccagggggttcctggtgctcgaggctggcggcgaggaaggaccagatggcctttgaggatgtggctgtgtacttctcccaggaggagtgggggctcctggacacagcccagagggccctgtaccgccgcgtgatgctagacaacttcgcacttgtggcctcgctgggactctccacctctcgacctcgtgtggtcatccaactggagcgtggcgaggagccctgggttcccagtggaacggacacaaccctgtccaggaccacctacaggaggcgcaaccctggttcctggagtttgacagaggatagagatgtttctggagaatggccacgagctttcccagataccccacctgggatgactactagcgtcttccctgttgccggtgcctgccacagtgtaaaaagcctgcagagacaacggggtgcctccccatctcgggagagaaaacccacgggggtgtcggtgatctactgggagaggctcctgctaggctcaggcagtgggcaagccagcgtcagcctgcgactgacctccccgcttaggcctcccgagggcgtccggcttagagaaaagacactcacagagcatgcgttgctggggaggcagcccaggacgcctgagcggcagaaaccatgtgcacaggaggtccctgggagaacctttgggagcgcccaggacctggaggctgccggcggtcggggacatcaccgaatgggtgcagtttggcaggagcctcatagactcctcggtggccaggagccctcgacctgggacgagctgggcgaggctcttcacgctggggagaagtccttcgaatgcagggcgtgcagcaaagtgttcgtgaagagctccgacctcctcaagcacctacgcacccacaccggggagcggccctacgagtgcgcccagtgcggcaaggccttcagccagacgtcgcacttgacgcagcaccagcgcatccacagcggcgagacgccctacgcgtgccccgtgtgcggcaaggccttccggcatagctcctcgctggtgcggcaccagcgcatccacacggccgagaagtccttccgctgctccgagtgcggcaaggccttcagccacggctccaacctcagccagcaccgcaagatccacgcgggtgggcgtccttatgcttgcgcacagtgtggccgccgcttctgccgcaactcgcacctgatccagcacgagcgtacgcacacaggcgagaagcccttcgtgtgcgcgctctgcggtgctgccttcagccagggctcctcgctctttaagcaccagcgcgtgcacacaggcgagaagcccttcgcctgcccacagtgcggccgcgcctttagccacagctccaacctcacccagcaccagctcctgcacacgggcgagcggcccttccgctgcgtggactgtggcaaggccttcgccaagggcgccgtgctgctcagccaccggcgcattcacacgggcgagaagcccttcgtgtgtacgcagtgtggccgcgccttccgtgagcgcccggccctcttccaccaccagaggatccataccggcgagaagaccgtccggcgatccagggccagcctgcacccccaggccaggtctgttgccggggcatcatcagaaggtgcgccagcgaaggaaaccgagcccactcccgcctcgggcccagccgccgtctcgcagccagcggaggtctgaggtcacaggttgcagccctggccttctgtgaatcccttccacagctaaagggcatatgtcctctgcagatccacagcagagaaaaagtcccgtgcttgctagtcagggacaagggaggccctttggctgtgatttcatttgcacgtggggacaggatttgccagttcacccacagatcacacctccatccccaaagaggtagcactgcagcaacatcagggggaggacgtggtggctgaactctagtggggccgagactattcagagccagtaggaggccgacagtcacagcactgcactgtggtgcggcttcatgtgatatgacagtggatgctaaggtgagagggatgcaggcatgggttgggggtggcccagagaaacttatgacagctgtacacaaactggccgctggagagatgcccgctgagggtattctcccctcaacccactgcctctgttcatccaagacttcctaggggccagcctagcagacaagagaccacaagggactggggatcagggtctgggctctgtcagccgccacctctgggaaagagaaaaggtttgggtccactgaacatcatgtttgtagacgctgacaggtggggtcctaatgagagccaacacatgctcactgccagctcctgtcctgagtactgggaagtttctcctgaagccctgtgagatggctctgtggctggtatcccgacttggaagatgaggaaactgaggcacacggcctggcctggcttcacacacatagccgactcaggagagggatgcccatgggggaacatgtgactctcagcattggaaggacagagctaggatgatggctttccggtggcactcgttcaggtttttgcccaagtctcagcttggccaaggcctgtcactgactggtttaccaaagtcgatgtgaggaggaggctttatacctgaggggatgatgttaacttcagacaagatggagctgctcacttttgccgggtttggtggccacttcacccccaaccctgtctcacccccattatccctcctcaattggaggctggacagagctgaataggaaagacttgctattgcctaaggctatgtgtgacaccctcctgaggacctccccaccccagtgtaatggcccttcatggcagggacagaaaggtggactgggggccatttgcttcctgtggccttcagcagaccaggccctgtccctacctggagcctcacctccaaggaaattc

SEQ ID NO: 2962 - DNA, 959 bp, Homo sapiens
gcgtcaggccacaccggtggtctgggctggggaccgcgggtcgggtccggtttccagggggttcctggtgctcgaggctggcggcgaggaaggaccagatggcctttgaggatgtggctgtgtacttctcccaggaggagtgggggctcctggacacagcccagagggccctgtaccgccgcgtgatgctagacaacttcgcacttgtggcctcgctgggactctccacctctcgacctcgtgtggtcatccaactggagcgtggcgaggagccctgggttcccagtggaacggacacaaccctgtccaggaccacctacaggaggcgcaaccctggttcctggagtttgacagaggatagagatgtttctggagaatggccacgagctttcccagataccccacctgggatgactactagcgtcttccctgttgccggtgcctgccacagtgtaaaaagcctgcagagacaacggggtgcctccccatctcgggagagaaaacccacgggggtgtcggtgatctactgggagaggctcctgctaggctcaggcagtgggcaagccagcgtcagcctgcgactgacctccccgcttaggcctcccgagggcgtccggcttagagaaaagacactcacagagcatgcgttgctggggaggcagcccaggacgcctgagcggcagaaaccatgtgcacaggaggtccctgggagaacctttgggagcgcccaggacctggaggctgccggcggtcggggacatcaccgaatgggtgcagtttggcaggagcctcatagactcctcggtggccaggagccctcgacctgggacgagctgggcgaggctcttcacgctggggagaagtccttcgaatgcagggcgtgcagcaaagtgttcgtgaagagctccgacctcctcaagcacctacgcacccgtgtgcggcaaggccttccggcatag

SEQ ID NO: 2963 - DNA, 2330 bp, Homo sapiens
ctactgggagaggctcctgctaggctcaggcagtgggcaagccagcgtcagcctgcgactgacctccccgcttaggcctcccgagggcgtccggcttagagaaaagacactcacagagcatgcgttgctggggaggcagcccaggacgcctgagcggcagaaaccatgtgcacaggaggtccctgggagaacctttgggagcgcccaggacctggaggctgccggcggtcggggacatcaccgaatgggtgcagtttggcaggagcctcatagactcctcggtggccaggagccctcgacctgggacgagctgggcgaggctcttcacgctggggagaagtccttcgaatgcagggcgtgcagcaaagtgttcgtgaagagctccgacctcctcaagcacctacgcacccacaccggggagcggccctacgagtgcgcccagtgcggcaaggccttcagccagacgtcgcacttgacgcagcaccagcgcatccacagcggcgagacgccctacgcgtgccccgtgtgcggcaaggccttccggcatagctcctcgctggtgcggcaccagcgcatccacacggccgagaagtccttccgctgctccgagtgcggcaaggccttcagccacggctccaacctcagccagcaccgcaagatccacgcgggtgggcgtccttatgcttgcgcacagtgtggccgccgcttctgccgcaactcgcacctgatccagcacgagcgtacgcacacaggcgagaagcccttcgtgtgcgcgctctgcggtgctgccttcagccagggctcctcgctctttaagcaccagcgcgtgcacacaggcgagaagcccttcgcctgcccacagtgcggccgcgcctttagccacagctccaacctcacccagcaccagctcctgcacacgggcgagcggcccttccgctgcgtggactgtggcaaggccttcgccaagggcgccgtgctgctcagccaccggcgcattcacacgggcgagaagcccttcgtgtgtacgcagtgtggccgcgccttccgtgagcgcccggccctcttccaccaccagaggatccataccggcgagaagaccgtccggcgatccagggccagcctgcacccccaggccaggtctgttgccggggcatcatcagaaggtgcgccagcgaaggaaaccgagcccactcccgcctcgggcccagccgccgtctcgcagccagcggaggtctgaggtcacagatcacacctccatccccaaagaggtagcactgcagcaacatcagggggaggacgtggtggctgaactctagtggggccgagactattcagagccagtaggaggccgacagtcacagcactgcactgtggtgcggcttcatgtgatatgacagtggatgctaaggtgagagggatgcaggcatgggttgggggtggcccagagaaacttatgacagctgtacacaaactggccgctggagagatgcccgctgagggtattctcccctcaacccactgcctctgttcatccaagacttcctaggggccagcctagcagacaagagaccacaagggactggggatcagggtctgggctctgtcagccgccacctctgggaaagagaaaaggtttgggtccactgaacatcatgtttgtagacgctgacaggtggggtcctaatgagagccaacacatgctcactgccagctcctgtcctgagtactgggaagtttctcctgaagccctgtgagatggctctgtggctggtatcccgacttggaagatgaggaaactgaggcacacggcctggcctggcttcacacacatagccgactcaggagagggatgcccatgggggaacatgtgactctcagcattggaaggacagagctaggatgatggctttccggtggcactcgttcaggtttttgcccaagtctcagcttggccaaggcctgtcactgactggtttaccaaagtcgatgtgaggaggaggctttatacctgaggggatgatgttaacttcagacaagatggagctgctcacttttgccgggtttggtggccacttcacccccaaccctgtctcacccccattatccctcctcaattggaggctggacagagctgaataggaaagacttgctattgcctaaggctatgtgtgacaccctcctgaggacctccccaccccagtgtaatggcccttcatggcagggacagaaaggtggactgggggccatttgcttcctgtggccttcagcagaccaggccctgtccctacctggagcctcacctccaaggaaattcatgttctccttaatgg

SEQ ID NO: 2964 - DNA, 3411 bp, Homo sapiens
cagagtgcgtcgtgggcgtccaggggactgtcgggccgcggcgggagccatgcgctctcccaccgtgcggcagcccaggaggctgcgcgctgggcgttccacgtccatgatggccggggagactgaggcgcggggcggccccgggacgctgctggcggggaaaggctgggtggtccacgcctttcttccctcccagctgcgggttccgctggcggcggtggcgctgacaagcccgcgtcggggaagcaggggagtccctgctcacacagaccgcgccctcacggagggaggccgcttcctagacctcgcctagtcgtctttcctctccctgccctgggggggttgcgggggtcagtgcaaactcctgcgtccagggcactggtgagctcccgagttcgggcagccagggggctgaggtcccgaaggaggctccgaggggagagtcctgcgtgtgcaaaacctgggaggggagccgaagcccaggaccagatggcctttgaggatgtggctgtgtacttctcccaggaggagtgggggctcctggacacagcccagagggccctgtaccgccgcgtgatgctagacaacttcgcacttgtggcctcgctgggactctccacctctcgacctcgtgtggtcatccaactggagcgtggcgaggagccctgggttcccagtggaacggacacaaccctgtccaggaccacctacaggaggcgcaaccctggttcctggagtttgacagaggatagagatgtttctggagaatggccacgagctttcccagataccccacctgggatgactactagcgtcttccctgttgccggtgcctgccacagtgtaaaaagcctgcagagacaacggggtgcctccccatctcgggagagaaaacccacgggggtgtcggtgatctactgggagaggctcctgctaggctcaggcagtgggcaagccagcgtcagcctgcgactgacctccccgcttaggcctcccgagggcgtccggcttagagaaaagacactcacagagcatgcgttgctggggaggcagcccaggacgcctgagcggcagaaaccatgtgcacaggaggtccctgggagaacctttgggagcgcccaggacctggaggctgccggcggtcggggacatcaccgaatgggtgcagtttggcaggagcctcatagactcctcggtggccaggagccctcgacctgggacgagctgggcgaggctcttcacgctggggagaagtccttcgaatgcagggcgtgcagcaaagtgttcgtgaagagctccgacctcctcaagcacctacgcacccacaccggggagcggccctacgagtgcgcccagtgcggcaaggccttcagccagacgtcgcacttgacgcagcaccagcgcatccacagcggcgagacgccctacgcgtgccccgtgtgcggcaaggccttccggcatagctcctcgctggtgcggcaccagcgcatccacacggccgagaagtccttccgctgctccgagtgcggcaaggccttcagccacggctccaacctcagccagcaccgcaagatccacgcgggtgggcgtccttatgcttgcgcacagtgtggccgccgcttctgccgcaactcgcacctgatccagcacgagcgtacgcacacaggcgagaagcccttcgtgtgcgcgctctgcggtgctgccttcagccagggctcctcgctctttaagcaccagcgcgtgcacacaggcgagaagcccttcgcctgcccacagtgcggccgcgcctttagccacagctccaacctcacccagcaccagctcctgcacacgggcgagcggcccttccgctgcgtggactgtggcaaggccttcgccaagggcgccgtgctgctcagccaccggcgcattcacacgggcgagaagcccttcgtgtgtacgcagtgtggccgcgccttccgtgagcgcccggccctcttccaccaccagaggatccataccggcgagaagaccgtccggcgatccagggccagcctgcacccccaggccaggtctgttgccggggcatcatcagaaggtgcgccagcgaaggaaaccgagcccactcccgcctcgggcccagccgccgtctcgcagccagcggaggtctgaggtcacaggttgcagccctggccttctgtgaatcccttccacagctaaagggcatatgtcctctgcagatccacagcagagaaaaagtcccgtgcttgctagtcagggacaagggaggccctttggctgtgatttcatttgcacgtggggacaggatttgccagttcacccacagatcacacctccatccccaaagaggtagcactgcagcaacatcagggggaggacgtggtggctgaactctagtggggccgagactattcagagccagtaggaggccgacagtcacagcactgcactgtggtgcggcttcatgtgatatgacagtggatgctaaggtgagagggatgcaggcatgggttgggggtggcccagagaaacttatgacagctgtacacaaactggccgctggagagatgcccgctgagggtattctcccctcaacccactgcctctgttcatccaagacttcctaggggccagcctagcagacaagagaccacaagggactggggatcagggtctgggctctgtcagccgccacctctgggaaagagaaaaggtttgggtccactgaacatcatgtttgtagacgctgacaggtggggtcctaatgagagccaacacatgctcactgccagctcctgtcctgagtactgggaagtttctcctgaagccctgtgagatggctctgtggctggtatcccgacttggaagatgaggaaactgaggcacacggcctggcctggcttcacacacatagccgactcaggagagggatgcccatgggggaacatgtgactctcagcattggaaggacagagctaggatgatggctttccggtggcactcgttcaggtttttgcccaagtctcagcttggccaaggcctgtcactgactggtttaccaaagtcgatgtgaggaggaggctttatacctgaggggatgatgttaacttcagacaagatggagctgctcacttttgccgggtttggtggccacttcacccccaaccctgtctcacccccattatccctcctcaattggaggctggacagagctgaataggaaagacttgctattgcctaaggctatgtgtgacaccctcctgaggacctccccaccccagtgtaatggcccttcatggcagggacagaaaggtggactgggggccatttgcttcctgtggccttcagcagaccaggccctgtccctacctggagcctcacctccaaggaaattcatgttctccttaatgg

SEQ ID NO: 2965 - DNA, 1602 bp, Homo sapiens
atgggagtgcccagtgtagtcagtgccatacctatcagggcagattgttcctccaaaccccagcccctcctgcagggccagcctcacctctacttttcccctaagcttttgtgccagctccggggttccttcttgcctgtccactcagcctgccctggtcctctcctaaccaggatgccccaggcaaccactgtttctctgcctttaggttcctggagtttgacagaggatagagatgtttctggagaatggccacgagctttcccagataccccacctgggatgactactagcgtcttccctgttgccggtgcctgccacagtgtaaaaagcctgcagagacaacggggtgcctccccatctcgggagagaaaacccacgggggtgtcggtgatctactgggagaggctcctgctaggctcaggcagtgggcaagccagcgtcagcctgcgactgacctccccgcttaggcctcccgagggcgtccggcttagagaaaagacactcacagagcatgcgttgctggggaggcagcccaggacgcctgagcggcagaaaccatgtgcacaggaggtccctgggagaacctttgggagcgcccaggacctggaggctgccggcggtcggggacatcaccgaatgggtgcagtttggcaggagcctcatagactcctcggtggccaggagccctcgacctgggacgagctgggcgaggctcttcacgctggggagaagtccttcgaatgcagggcgtgcagcaaagtgttcgtgaagagctccgacctcctcaagcacctacgcacccacaccggggagcggccctacgagtgcgcccagtgcggcaaggccttcagccagacgtcgcacttgacgcagcaccagcgcatccacagcggcgagacgccctacgcgtgccccgtgtgcggcaaggccttccggcatagctcctcgctggtgcggcaccagcgcatccacacggccgagaagtccttccgctgctccgagtgcggcaaggccttcagccacggctccaacctcagccagcaccgcaagatccacgcgggtgggcgtccttatgcttgcgcacagtgtggccgccgcttctgccgcaactcgcacctgatccagcacgagcgtacgcacacaggcgagaagcccttcgtgtgcgcgctctgcggtgctgccttcagccagggctcctcgctctttaagcaccagcgcgtgcacacaggcgagaagcccttcgcctgcccacagtgcggccgcgcctttagccacagctccaacctcacccagcaccagctcctgcacacgggcgagcggcccttccgctgcgtggactgtggcaaggccttcgccaagggcgccgtgctgctcagccaccggcgcattcacacgggcgagaagcccttcgtgtgtacgcagtgtggccgcgccttccgtgagcgcccggccctcttccaccaccagaggatccataccggcgagaagaccggcgatccagggccagcctgcacccccaggccaggtctgttgccggggcatcatcagaaggtgcgccagcgaaggaaaccgagcccactcccgcctcgggcccagccg

SEQ ID NO: 2966 - DNA, 2995 bp, Homo sapiens
acttccggcgttgggactgtcacttggctgctcgcgtcaggccacaccggtggtctgggctgtggcgcgcgggtcggggcccgaggcgggcggccaggaaggacctgatgaccttcgaggatgtggccgtgtacttctcccaggaggagtgggggctcctggacacagcgcagagggccctgtaccgccacgtgatgctggaaaacttcacacttgtgacctcacttggactctctacctcccgacctcgtgtggtcattcaacttgagcgtggcgaggagccctgggttcccagtggaaaggacatgaccctggccaggaacacctacgggaggctcaactctggttcctggagtttgacagaggatagagatgtttctggagaatggccacgagctttcccagataccccacctgggatgactactagcgtcttcccagttgccgatgcctgccacagtgtaaaaagcctgcagcgacaaccgggtgcctccccatctcaggagagaaaacccacgggggtgtcggtgatctactgggagaggctcctgctaggctcgcgcagtgaccaggccagcatcagcctgcgactgacctccccactcaggccccccaagagcagccggcccagggaaaagaccttcacagagtaccgggtgcctgggaggcagcccaggacgcctgagcggcagaagccatgtgcacaggaggtccctgggagagccttcgggaatgcctcggacctgaaggccgccagtggtggcagggatcgcagaatgggcgcagcttggcaggagcctcatagactcctcggtggccaggagccctcgacctgggacgagctgggcgaggctcttcacgctggggagaagtccttcgaatgcagggcgtgcagcaaagtgttcgtgaagagctccgacctcctcaagcacctacgcacccacaccggggagcggccctacgagtgcacccagtgcggcaaggccttcagccagacgtcgcacttgacgcagcaccagcgcatccacagcggcgagacgccctacgcgtgccccgtgtgcggcaaggccttccggcatagctcctcgctggtgcggcaccagcgcatccacacggccgagaagtccttccgctgctccgagtgcggcaaggccttcagccacggctccaacctcagccagcaccgcaagatccacgcgggtgggcgtccttatgcttgcgcacagtgtggccgccgcttctgccgcaactcgcacctgatccagcacgagcgtacgcacacaggcgagaagcccttcgtatgcgcgctctgcggtgctgccttcagccagggctcctcgctctttttgcaccagcgcgtgcacacaggcgagaagcccttcgcctgcgcccagtgcggccgctcctttagccgcagctccaacctcacccagcaccagctcctgcacacgggcgagcggcccttccgctgcgtggactgtggcaagggtttcgccaagggcgccgtgctgctcagccaccggcgcattcacacgggcgagaagcccttcgtgtgcacgcagtgtggccgcgccttccgtgagcgccctgccctcttgcaccaccagaggatccacaccacagagaagaccaatgccgcagcaccagactgcaccccggggccaggtttccttcagggacatcatcggaaggtgcgccggggagggaagccaagcccagtcctgaagccagcgaaggtctgaggtcacaggtcgcagcccaaccctttcttggccttctgtgaatcccttccacagctaaagggtccgagtgctcttcagatccacgatggggaaaagctctgtgcctgagagtcagggacgagggagaccctttggctgtggttccatttgcaggtggggacaggatttgccagtttagtcatagctcacacctccatcctcaaagaggtaacactgcagaaacatcagagggaggacatgtcagctggaactctggtggggctgaggctgtagttggggccataggacgccgacaaaggcagcgctgcatggtggtgctacttcatgtgttatgagagtggatgctgaggtgagggggatgcggacatggggtaggatgacctagagaaacttatgatgtctgcacacaaactggccgctagacggacgctgaggacattttccccctgaggcctctattcaaggcttcctgggggccatctcagcaaacaggagactacaggggactggggatcagggtgtggcctgtgagtgtcagcctcctcctcggaaaaagaaaagctttgggtcaactcagcatcatgtttgcagatgctgacagacgggatcctaatgagagtcaatgtgtgctcactgccagctcctgggctgtgctctggtcagccaggtgtgagggcctggcctggggtcacacagctgactcaggagaggaatgcccatggttctcagcattggaaggacaaacctaggatgatggctttccagtggcactcgttcaggttttcgtccaagtctcagcttggccaaggcctgtcgctcactcatttacaaaagtcgatgtgaggaggagcctttacacctgtggagacagtgatagctttggagcagataaggtggagctgctcatttttgctggatttggtggccgatccccgcccccacccccaccccctccatctcacctttcccttgttatgcctcctcaattggaggctggacagagagctgaataggaaggacttgccattacctaaggccatgtgtgacagcctcctgaggacctccccaacccagtgtgatgggcctgcatggcagagacaaaagggtagactgggggtcatttgcttcctgtggccttaagcctactaggccccatccttacctgagacctcacctccaagaaattaatggtcttttcaatggagaaaaaaaaagactagtatttgcaacttcaaatagatgtagtttccttt

SEQ ID NO: 2967 - DNA, 3770 bp, Homo sapiens
acaccggtggtctgggctgtggcgcgcgggtcggggcccgaggcgggcggccaggaaggacctgatgaccttcgaggatgtggccgtgtacttctcccaggaggagtgggggctcctggacacagcgcagagggccctgtaccgccacgtgatgctggaaaacttcacacttgtgacctcacttggactctctacctcccgacctcgtgtggtcattcaacttgagcgtggcgaggagccctgggttcccagtggaaaggacatgaccctggccaggaacacctacgggaggctcaactctggtgagtgggagctcaggtggggtgaactaaggaccaacctgtggccaagcccatgtccctgcttttctgactctggaaacacatcctcctctcctgcctcctacctgactcccttctcttccatcatcagcctctcctggaggctgctgccttagtaggtgcccttgaagggagagctccaagggcacaggagctgggttcacacagaagggcctaccttcagctgggctgtgtggccttgaaccctccacaactagcagccattattgataggtatttatttcgcccatcatttatctttgtattcatcaaatgtttcctgagggcttgtgggcattgtagacacagccttgaccaggacactcatggtcctgcctttgtggggctgatggtgctaggggagacgcagtgagtacgtaggattcaggagtgcagtcttgagcattggttggaggtcattgcaagagcaggtttgggagtgggtgcccaagacggggcaccaggggagaagggagtgagctatggaaagggagggggtggaacagccagtgtggagacgtgggtggcacgcagcagctgctgttttcctcagcttcacatcctgggtgtctgggggctgccgccttgatcatgggagtccccactgcagtcagtgccacacctgtcagggcagatgcttcctccaaaccccagcccctcctgcagagccagcctcacctcttctttttccctaagcttttgtcccggctcctgggctcccccttgcctgtccactcagcctgccctggtcctctcctaaccaggatgccccaggcaaccaccgtttctctgcgtttaggttcctggagtttgacagaggatagagatgtttctggagaatggccacgagctttcccagataccccacctgggatgactactagcgtcttcccagttgccgatgcctgccacagtgtaaaaagcctgcagcgacaaccgggtgcctccccatctcaggagagaaaacccacgggggtgtcggtgatctactgggagaggctcctgctaggctcgcgcagtgaccaggccagcatcagcctgcgactgacctccccactcaggccccccaagagcagccggcccagggaaaagaccttcacagagtaccgggtgcctgggaggcagcccaggacgcctgagcggcagaagccatgtgcacaggaggtccctgggagagccttcgggaatgcctcggacctgaaggccgccagtggtggcagggatcgcagaatgggcgcagcttggcaggagcctcatagactcctcggtggccaggagccctcgacctgggacgagctgggcgaggctcttcacgctggggagaagtccttcgaatgcagggcgtgcagcaaagtgttcgtgaagagctccgacctcctcaagcacctacgcacccacaccggggagcggccctacgagtgcacccagtgcggcaaggccttcagccagacgtcgcacttgacgcagcaccagcgcatccacagcggcgagacgccctacgcgtgccccgtgtgcggcaaggccttccggcatagctcctcgctggtgcggcaccagcgcatccacacggccgagaagtccttccgctgctccgagtgcggcaaggccttcagccacggctccaacctcagccagcaccgcaagatccacgcgggtgggcgtccttatgcttgcgcacagtgtggccgccgcttctgccgcaactcgcacctgatccagcacgagcgtacgcacacaggcgagaagcccttcgtatgcgcgctctgcggtgctgccttcagccagggctcctcgctctttttgcaccagcgcgtgcacacaggcgagaagcccttcgcctgcgcccagtgcggccgctcctttagccgcagctccaacctcacccagcaccagctcctgcacacgggcgagcggcccttccgctgcgtggactgtggcaagggtttcgccaagggcgccgtgctgctcagccaccggcgcattcacacgggcgagaagcccttcgtgtgcacgcagtgtggccgcgccttccgtgagcgccctgccctcttgcaccaccagaggatccacaccacagagaagaccaatgccgcagcaccagactgcaccccggggccaggtttccttcagggacatcatcggaaggtgcgccggggagggaagccaagcccagtcctgaagccagcgaaggtctgaggtcacaggtcgcagcccaaccctttcttggccttctgtgaatcccttccacagctaaagggtccgagtgctcttcagatccacgatggggaaaagctctgtgcctgagagtcagggacgagggagaccctttggctgtggttccatttgcaggtggggacaggatttgccagtttagtcatagctcacacctccatcctcaaagaggtaacactgcagaaacatcagagggaggacatgtcagctggaactctggtggggctgaggctgtagttggggccataggacgccgacaaaggcagcgctgcatggtggtgctacttcatgtgttatgagagtggatgctgaggtgagggggatgcggacatggggtaggatgacctagagaaacttatgatgtctgcacacaaactggccgctagacggacgctgaggacattttccccctgaggcctctattcaaggcttcctgggggccatctcagcaaacaggagactacaggggactggggatcagggtgtggcctgtgagtgtcagcctcctcctcggaaaaagaaaagctttgggtcaactcagcatcatgtttgcagatgctgacagacgggatcctaatgagagtcaatgtgtgctcactgccagctcctgggctgtgctctggtcagccaggtgtgagggcctggcctggggtcacacagctgactcaggagaggaatgcccatggttctcagcattggaaggacaaacctaggatgatggctttccagtggcactcgttcaggttttcgtccaagtctcagcttggccaaggcctgtcgctcactcatttacaaaagtcgatgtgaggaggagcctttacacctgtggagacagtgatagctttggagcagataaggtggagctgctcatttttgctggatttggtggccgatccccgcccccacccccaccccctccatctcacctttcccttgttatgcctcctcaattggaggctggacagagagctgaataggaaggacttgccattacctaaggccatgtgtgacagcctcctgaggacctccccaacccagtgtgatgggcctgcatggcagagacaaaagggtagactgggggtcatttgcttcctgtggccttaagcctactaggccccatccttacctgagacctcacctccaagaaattaatggtcttttcaatggagaaaaaaaaagactagtatttgcaacttc

SEQ ID NO: 2968 - DNA, 2368 bp, Homo sapiens
gcgttgggactgtcacttggctgctcgcgtcaggccacaccggtggtctgggctgtggcgcgcgggtcggggcccgaggcgggcggccaggaaggttcttggggctgcacccctatgacgactggtggggatcatccagtccctcaggctggatgagcagcctggaaatgtcaggacctgatgaccttcgaggatgtggccgtgtacttctcccaggaggagtgggggctcctggacacagcgcagagggccctgtaccgccacgtgatgctggaaaacttcacacttgtgacctcacttggactctctacctcccgacctcgtgtggtcattcaacttgagcgtggcgaggagccctgggttcccagtggaaaggacatgaccctggccaggaacacctacgggaggctcaactctggttcctggagtttgacagaggatagagatgtttctggagaatggccacgagctttcccagataccccacctgggatgactactagcgtcttcccagttgccgatgcctgccacagtgtaaaaagcctgcagcgacaaccgggtgcctccccatctcaggagagaaaacccacgggggtgtcggtgatctactgggagaggctcctgctaggctcgcgcagtgaccaggccagcatcagcctgcgactgacctccccactcaggccccccaagagcagccggcccagggaaaagaccttcacagagtaccgggtgcctgggaggcagcccaggacgcctgagcggcagaagccatgtgcacaggaggtccctgggagagccttcgggaatgcctcggacctgaaggccgccagtggtggcagggatcgcagaatgggcgcagcttggcaggagcctcatagactcctcggtggccaggagccctcgacctgggacgagctgggcgaggctcttcacgctggggagaagtccttcgaatgcagggcgtgcagcaaagtgttcgtgaagagctccgacctcctcaagcacctacgcacccacaccggggagcggccctacgagtgcacccagtgcggcaaggccttcagccagacgtcgcacttgacgcagcaccagcgcatccacagcggcgagacgccctacgcgtgccccgtgtgcggcaaggccttccggcatagctcctcgctggtgcggcaccagcgcatccacacggccgagaagtccttccgctgctccgagtgcggcaaggccttcagccacggctccaacctcagccagcaccgcaagatccacgcgggtgggcgtccttatgcttgcgcacagtgtggccgccgcttctgccgcaactcgcacctgatccagcacgagcgtacgcacacaggcgagaagcccttcgtatgcgcgctctgcggtgctgccttcagccagggctcctcgctctttttgcaccagcgcgtgcacacaggcgagaagcccttcgcctgcgcccagtgcggccgctcctttagccgcagctccaacctcacccagcaccagctcctgcacacgggcgagcggcccttccgctgcgtggactgtggcaagggtttcgccaagggcgccgtgctgctcagccaccggcgcattcacacgggcgagaagcccttcgtgtgcacgcagtgtggccgcgccttccgtgagcgccctgccctcttgcaccaccagaggatccacaccacagagaagaccaatgccgcagcaccagactgcaccccggggccaggtttccttcagggacatcatcggaaggtgcgccggggagggaagccaagcccagtcctgaagccagcgaaggtctgaggtcacaggtcgcagcccaaccctttcttggccttctgtgaatcccttccacagctaaagggtccgagtgctcttcagatccacgatggggaaaagctctgtgcctgagagtcagggacgagggagaccctttggctgtggttccatttgcaggtggggacaggatttgccagtttagtcatagctcacacctccatcctcaaagaggtaacactgcagaaacatcagagggaggacatgtcagctggaactctggtggggctgaggctgtagttggggccataggacgccgacaaaggcagcgctgcatggtggtgctacttcatgtgttatgagagtggatgctgaggtgagggggatgcggacatggggtaggatgacctagagaaacttatgatgtctgcacacaaactggccgctagacggacgctgaggacattttccccctgaggcctctattcaaggcttcctgggggccatctcagcaaacaggagactacaggggactggggatcagggtgtggcctgtgagtgtcagcctcctcctcggaaa

SEQ ID NO: 2969 - DNA, 2729 bp, Homo sapiens
cgctgtggcctgcggctcccgggctggtagcgcgccgctctcggtcgcgcggagtgatcgtgtggaatcgcgggtcgcggacgctcgccgccggccatagctcagcctagcgccgccaaggccgacggccctcagcctctgccatggacttcgaggacgattacacacactccgcctgcaggaatacttatcagggctttaatggaatggatcgtgattatggccctggatcttatggagggatggatcgtgactatggccatggatcctatgggggtcagagatccatggattcctacctaaaccagtcatatggcatggacaatcacagtggtggtggtgggggtagcaggtttggaccttatgagtcttacgactccaggtcttctctgggtgggcgagatctgtacagatctggctatggttttaatgaacccgaacaaagccgcttcggaggtagttatggtggtcgatttgagagctcctaccggaatagccttgactctttcggaggtagaaaccagggcgggtctagctgggaagcaccttactcccgttcaaaattgaggcctgggtttatggaggacagaggaagagagaattactcttcctacagcagtttttcttcaccccatatgaagcctgcacctgtaggctctcgggggagaggaacgcctgcttatcctgaaagtacgtttggaagcagaaactatgatgcttttggaggaccatcaacaggcagaggccgaggccgaggacatatgggtgattttggaagcattcatagacccggaattgttgttgactatcaaaacaaatccaccaatgtgacagttgctgctgcaagaggaataaagagaaaaatgatgcagccatttaataagcccagtggaacctttatcaagaaacccaaactagcaaaacctatggagaagataagcctcagcaaatcacccacaaaaactgatcctaaaaatgaagaggaagaaaagcggcgaattgaggctcggcgagagaaacaaaggcgcagaagagaaaaaaacagtgagaaatacggagatggatacagaatggcatttacatgttcattttgtaaatttcgaacatttgaagaaaaagatattgaactgcatctggaaagttcttcacatcaggaaacattagatcatatacagaaacaaactaaatttgataaagtagttatggagtttttgcatgagtgtatggtgaataaattcaagaaaacatctattcgtaagcaacagacaaataatcaaacagaagtagttaaaataattgaaaaagatgttatggaaggtgttactgtagatgatcacatgatgaaggtagagacagttcattgcagcgcttgcagtgtttatatccctgctttacatagttcagttcagcagcacttaaaatctcctgatcatatcaaagggaagcaggcttataaggaacaaataaaaagagagagtgtcttgactgctacaagcattttaaataatccaatagtgaaggcgcgatatgaacgttttgttaagggtgagaatccttttgaaattcaagaccattctcaggatcagcaaatagaaggagatgaggaggatgaagagaagattgatgaacctattgaagaagaggaggatgaagatgaggaagaagaagcagaggaagtgggggaagtagaggaagtggaagaagtagaggaagtgagagaaggaggaatagagggcgagggaaatatacagggagtaggggaaggaggggaagtaggggtagtgggagaagtagagggagtgggggaagtagaggaagtagaggaattagaggaagagacagcaaaggaagaacctgctgacttccctgttgagcaacctgaagaaaattaaatataaggtattagatttaaaaggagctttacatttcggttctaatgtaaaaaagggtaagaaatttaatagcttaaaatatgaattaacacccatgttgcatgcattccacatattaaaatttgttttatataatttctaaatgtttaacatttgtttaataaaatgaaggcaaaactattttagtttagtttttatagctaccagacttagatccgataaattgtttgtataatttttaagcttaatttttattactttattggtgttaaggataacaaatgtgtattgttagtatatctattctaatcattttatcttaaatgctgctcttgggagtgaatattcaagtgtgcatcaattttttgaatacttaccctggaagatataaactgggcaagtattttgtgctctgtgtatttttttactgcattagacattgaatagtaatttgcgttaagatacgcttaaaggctctttgtgaccatgtttccctttgtagcaataaaatgttttttacgaaaactttctccctggattagcagtttaaatgaaacagagttcatcaatgaaatgagtatttaaaataaaaatttgccttaatgtatcagttcagctcacaagtattttaagatgattgagaagacttgaattaaagaaaaaaaaattctcaatcatatttttaaaatataagactaaaattgtttttaaaacacatttcaaatagaagtgagtttgaactgaccttatttatactctttttaagtttgttccttttccctgtgcctgtgtcaaatcttcaagtcttgctgaaaatacatttgatacaaagttttc

SEQ ID NO: 2970 - DNA, 1538 bp, Homo sapiens
cgggctggtagcgcgccgctctcggtcgcgcggagtgatcgtgtggaatcgcgggtcgcggacgctcgccgccggccatagctcagcctagcgccgccaaggccgacggccctcagcctctgccatggacttcgaggacgattacacacactccgcctgcaggaatacttatcagggctttaatggaatggatcgtgattatggccctggatcttatggagggatggatcgtgactatggccatggatcctatgggggtcagagatccatggattcctacctaaaccagtcatatggcatggacaatcacagtggtggtggtgggggtagcaggtaaattgcttaatcatttggccaaataattagacaactataagattttggatatattattttaagtactctttaggcatgttatgatacttgaacttcactgtttgctattgaatcatcaccttaaatatttaaaggtgttaattaatgggtataaaatttaaatcagtattactggcagacgttattttaggaaaacaccagataactatatcatgtcaatataatagagtaagatacactttttagcagtgaacttttaaaaaattcttttacttttaacttcttgtcaatcaaagtatcctgaaaaatgatataaaaatgttattgaaaatattatttatgaagctttttcttaataattaaaaaaaatcttttctaatgtggggtgctatgtaaattagcaaagcagtctaactagaatggattttactgaaccagtctaacatttactttccaagaaacattcaggacatattcctttaattctaattttaaaggaagagcatattgcaataataaaaatatttttaaaattatgttcaggttatttattgacaggtactacttacaccaaagcacttgtgctctaggctagaagcattgtattaaagccatgaatactatacctttgactagtcgagattgtatttatattttcctgttactactgtataaagcttaaacctacttaaacaactacaagctttaaggttgaccatatttcaggagaaggggtgtctactttttgaggcacaaaggttcctgctgaatataagtaaaactagttagtagacatgtgaaacagtcatccttctgcataaattgaaggatccggattccttaatgatggactgaatgatgcttactttccttctttctgcttccagtgtaccactatggtttatagtaaagaaaaattaagaaagtgaacagttgcaactattttgcttatgtgatagatgttttgaaaaatgtagttggaaataggaataatttttatatggttactaggattcagaagtaaatctatttagtgatctgtaaataattgaagtaatgtaacacttaatgttttaatatgtcagttattgcccttttatattgtgaatgtaatgtgcataagctatatccgtagatgttattgttttatctcatgtgtaattgtgggcctttataaaattgtgttgtaagatatcaagcaa

SEQ ID NO: 2971 - DNA, 2440 bp, Homo sapiens
gctggtagcgcgccgctctcggtcgcgcggagtgatcgtgtggaatcgcgggtcgcggacgctcgccgccggccatagctcagcctagcgccgccaaggccgacggccctcagcctctgccatggacttcgaggacgattacacacactccgcctgcaggaatacttatcagggctttaatggaatggatcgtgattatggccctggatcttatggagggatggatcgtgactatggccatggatcctatgggggtcagagatccatggattcctacctaaaccagtcatatggcatggacaatcacagtggtggtggtgggggtagcagtttttcttcaccccatatgaagcctgcacctgtaggctctcgggggagaggaacgcctgcttatcctgaaagtacgtttggaagcagaaactatgatgcttttggaggaccatcaacaggcagaggccgaggccgaggacatatgggtgattttggaagcattcatagacccggaattgttgttgactatcaaaacaaatccaccaatgtgacagttgctgctgcaagaggaataaagagaaaaatgatgcagccatttaataagcccagtggaacctttatcaagaaacccaaactagcaaaacctatggagaagataagcctcagcaaatcacccacaaaaactgatcctaaaaatgaagaggaagaaaagcggcgaattgaggctcggcgagagaaacaaaggcgcagaagagaaaaaaacagtgagaaatacggagatggatacagaatggcatttacatgttcattttgtaaatttcgaacatttgaagaaaaagatattgaactgcatctggaaagttcttcacatcaggaaacattagatcatatacagaaacaaactaaatttgataaagtagttatggagtttttgcatgagtgtatggtgaataaattcaagaaaacatctattcgtaagcaacagacaaataatcaaacagaagtagttaaaataattgaaaaagatgttatggaaggtgttactgtagatgatcacatgatgaaggtagagacagttcattgcagcgcttgcagtgtttatatccctgctttacatagttcagttcagcagcacttaaaatctcctgatcatatcaaagggaagcaggcttataaggaacaaataaaaagagagagtgtcttgactgctacaagcattttaaataatccaatagtgaaggcgcgatatgaacgttttgttaagggtgagaatccttttgaaattcaagaccattctcaggatcagcaaatagaaggagatgaggaggatgaagagaagattgatgaacctattgaagaagaggaggatgaagatgaggaagaagaagcagaggaagtgggggaagtagaggaagtggaagaagtagaggaagtgagagaaggaggaatagagggcgagggaaatatacagggagtaggggaaggaggggaagtaggggtagtgggagaagtagagggagtgggggaagtagaggaagtagaggaattagaggaagagacagcaaaggaagaacctgctgacttccctgttgagcaacctgaagaaaattaaatataaggtattagatttaaaaggagctttacatttcggttctaatgtaaaaaagggtaagaaatttaatagcttaaaatatgaattaacacccatgttgcatgcattccacatattaaaatttgttttatataatttctaaatgtttaacatttgtttaataaaatgaaggcaaaactattttagtttagtttttatagctaccagacttagatccgataaattgtttgtataatttttaagcttaatttttattactttattggtgttaaggataacaaatgtgtattgttagtatatctattctaatcattttatcttaaatgctgctcttgggagtgaatattcaagtgtgcatcaattttttgaatacttaccctggaagatataaactgggcaagtattttgtgctctgtgtatttttttactgcattagacattgaatagtaatttgcgttaagatacgcttaaaggctctttgtgaccatgtttccctttgtagcaataaaatgttttttacgaaaactttctccctggattagcagtttaaatgaaacagagttcatcaatgaaatgagtatttaaaataaaaatttgccttaatgtatcagttcagctcacaagtattttaagatgattgagaagacttgaattaaagaaaaaaaaattctcaatcatatttttaaaatataagactaaaattgtttttaaaacacatttcaaatagaagtgagtttgaactgaccttatttatactctttttaagtttgttccttttccctgtgcctgtgtcaaatcttcaagtcttgctgaaaatacatttgatacaaagttttc

SEQ ID NO: 2972 - DNA, 2583 bp, Homo sapiens
atgatgttcaatagagattacacacactccgcctgcaggaatacttatcagggctttaatggaatggatcgtgattatggccctggatcttatggagggatggatcgtgactatggccatggatcctatgggggtcagagatccatggattcctacctaaaccagtcatatggcatggacaatcacagtggtggtggtgggggtagcaggtttggaccttatgagtcttacgactccaggtcttctctgggtgggcgagatctgtacagatctggctatggttttaatgaacccgaacaaagccgcttcggaggtagttatggtggtcgatttgagagctcctaccggaatagccttgactctttcggaggtagaaaccagggcgggtctagctgggaagcaccttactcccgttcaaaattgaggcctgggtttatggaggacagaggaagagagaattactcttcctacagcagtttttcttcaccccatatgaagcctgcacctgtaggctctcgggggagaggaacgcctgcttatcctgaaagtacgtttggaagcagaaactatgatgcttttggaggaccatcaacaggcagaggccgaggccgaggacatatgggtgattttggaagcattcatagacccggaattgttgttgactatcaaaacaaatccaccaatgtgacagttgctgctgcaagaggaataaagagaaaaatgatgcagccatttaataagcccagtggaacctttatcaagaaacccaaactagcaaaacctatggagaagataagcctcagcaaatcacccacaaaaactgatcctaaaaatgaagaggaagaaaagcggcgaattgaggctcggcgagagaaacaaaggcgcagaagagaaaaaaacagtgagaaatacggagatggatacagaatggcatttacatgttcattttgtaaatttcgaacatttgaagaaaaagatattgaactgcatctggaaagttcttcacatcaggaaacattagatcatatacagaaacaaactaaatttgataaagtagttatggagtttttgcatgagtgtatggtgaataaattcaagaaaacatctattcgtaagcaacagacaaataatcaaacagaagtagttaaaataattgaaaaagatgttatggaaggtgttactgtagatgatcacatgatgaaggtagagacagttcattgcagcgcttgcagtgtttatatccctgctttacatagttcagttcagcagcacttaaaatctcctgatcatatcaaagggaagcaggcttataaggaacaaataaaaagagagagtgtcttgactgctacaagcattttaaataatccaatagtgaaggcgcgatatgaacgttttgttaagggtgagaatccttttgaaattcaagaccattctcaggatcagcaaatagaaggagatgaggaggatgaagagaagattgatgaacctattgaagaagaggaggatgaagatgaggaagaagaagcagaggaagtgggggaagtagaggaagtggaagaagtagaggaagtgagagaaggaggaatagagggcgagggaaatatacagggagtaggggaaggaggggaagtaggggtagtgggagaagtagagggagtgggggaagtagaggaagtagaggaattagaggaagagacagcaaaggaagaacctgctgacttccctgttgagcaacctgaagaaaattaaatataaggtattagatttaaaaggagctttacatttcggttctaatgtaaaaaagggtaagaaatttaatagcttaaaatatgaattaacacccatgttgcatgcattccacatattaaaatttgttttatataatttctaaatgtttaacatttgtttaataaaatgaaggcaaaactattttagtttagtttttatagctaccagacttagatccgataaattgtttgtataatttttaagcttaatttttattactttattggtgttaaggataacaaatgtgtattgttagtatatctattctaatcattttatcttaaatgctgctcttgggagtgaatattcaagtgtgcatcaattttttgaatacttaccctggaagatataaactgggcaagtattttgtgctctgtgtatttttttactgcattagacattgaatagtaatttgcgttaagatacgcttaaaggctctttgtgaccatgtttccctttgtagcaataaaatgttttttacgaaaactttctccctggattagcagtttaaatgaaacagagttcatcaatgaaatgagtatttaaaataaaaatttgccttaatgtatcagttcagctcacaagtattttaagatgattgagaagacttgaattaaagaaaaaaaaattctcaatcatatttttaaaatataagactaaaattgtttttaaaacacatttcaaatagaagtgagtttgaactgaccttatttatactctttttaagtttgttccttttccctgtgcctgtgtcaaatcttcaagtcttgctgaaaatacatttgatacaaagtt

SEQ ID NO: 2973 - DNA, 1490 bp, Homo sapiens
gtgatcgtgtggaatcgcgggtcgcggacgctcgccgccggccatagctcagcctagcgccgccaaggccgacggccctcagcctctgccatggacttcgaggacgattacacacactccgcctgcaggaatacttatcagggctttaatggaatggatcgtgattatggccctggatcttatggaggtctgacattcaaggatatttatctaaaaattcttcttttgagtgccagtaaagcatatgggtgattttggaagcattcatagacccggaattgttgttgactatcaaaacaaatccaccaatgtgacagttgctgctgcaagaggaataaagagaaaaatgatgcagccatttaataagcccagtggaacctttatcaagaaacccaaactagcaaaacctatggagaagataagcctcagcaaatcacccacaaaaactgatcctaaaaatgaagaggaagaaaagcggcgaattgaggctcggcgagagaaacaaaggcgcagaagagaaaaaaacagtgagaaatacggagatggatacagaatggcatttacatgttcattttgtaaatttcgaacatttgaagaaaaagatattgaactgcatctggaaagttcttcacatcaggaaacattagatcatatacagaaacaaactaaatttgataaagtagttatggagtttttgcatgagtgtatggtgaataaattcaagaaaacatctattcgtaagcaacagacaaataatcaaacagaagtagttaaaataattgaaaaagatgttatggaaggtgttactgtagatgatcacatgatgaaggtagagacagttcattgcagcgcttgcagtgtttatatccctgctttacatagttcagttcagcagcacttaaaatctcctgatcatatcaaagggaagcaggcttataaggaacaaataaaaagagagagtgtcttgactgctacaagcattttaaataatccaatagtgaaggcgcgatatgaacgttttgttaagggtgagaatccttttgaaattcaagaccattctcaggatcagcaaatagaaggagatgaggaggatgaagagaagattgatgaacctattgaagaagaggaggatgaagatgaggaagaagaagcagaggaagtgggggaagtagaggaagtggaagaagtagaggaagtgagagaaggaggaatagagggcgagggaaatatacagggagtaggggaaggaggggaagtaggggtagtgggagaagtagagggagtgggggaagtagaggaagtagaggaattagaggaagagacagcaaaggaagaacctgctgacttccctgttgagcaacctgaagaaaattaaatataaggtattagatttaaaaggagctttacatttcggttctaatgtaaaaaagggtaagaaatttaatagcttaaaatatgaattaacacccatgttgcatgcattccacata

SEQ ID NO: 2974 - DNA, 3381 bp, Homo sapiens
ggtcttgctgtctcacccaggctggagtgcagtggcacgatcacagctcactgcagccttgagctcctgggctaccaagtagctgggacttcagagatggctggagccgtgtggatgggcataaatggctaatgtccagcaaccatcgatgtcaagtatccacacacctggcctgaatggatccctctgcctttcagagtttgggatatgagattgaaaatgacgactcggaattttcctgagagagaagtaccctgtgatgtagaagtggaaagattcacaagggaagttccctgcttgtccagtttaggtgatggttgggactgtgagaaccaggagggacacttgaggcaatcagctttaactctggagaaaccagggactcaggaagcaatttgtgaatatcctggttttggggagcatttgattgcaagctcagaccttccaccgtctcagagagttctggcaacaaatggtttccatgcacctgactcaaatgttagtggtctggattgtgaccccgccttacccagctatcctaaaagttatgcagataagagaactggtgacagtgatgcctgtggaaaaggcttcaaccattccatggaagttattcatggaagaaatccagtgagagagaagccctacaaataccctgaaagtgttaagtcttttaatcattttacctctcttggtcatcagaaaataatgaaaagaggcaagaaatcgtatgaaggtaagaattttgagaacatctttactctgagctcatcgcttaatgaaaaccagagaaatctccctggagagaaacaatatagatgtactgaatgtggcaaatgcttcaaacggaactcttctcttgttttgcatcaccgaactcacaccggagagaagccttatacttgtaatgagtgtggaaagtccttctccaagaactacaacctgattgtgcatcaaagaatccacacaggagagaagccctatgaatgcagtaaatgtgggaaagctttcagtgatggctcagctctgacacagcaccagagaattcacacaggcgagaaaccttatgaatgcctagagtgtggaaaaaccttcaaccgaaattcatccttaattttgcaccaaagaactcatacaggggaaaaaccatatagatgtaacgaatgtgggaaacccttcactgacatctcccaccttacagtgcatctcagaatccacaccggtgagaagccctatgagtgtagcaaatgtggaaaggctttccgggacggctcgtacctcacccagcatgagaggactcacactggagaaaagccctttgagtgtgcagagtgcgggaaatccttcaacagaaactctcacctcattgtgcatcaaaagatccattctggggagaaaccctatgaatgtaaagaatgtggcaagactttcatcgagagtgcgtacctcatcaggcatcagaggattcatactggcgagaagccctatggctgcaaccagtgtcagaaacttttcaggaatatcgctggcctcattaggcaccagaggactcatactggtgagaagccctatgagtgtaatcagtgtggcaaagccttcagggacagctcctgtctgaccaagcaccagagaattcacactaaggagaccccatatcagtgtccagaatgtgggaagtccttcaagcagaactctcacctggcagtacatcagagactccatagcagggagggtcccagccggtgtcctcagtgtggaaaaatgttccaaaagagctcatcccttgttcgacatcaaagagcacacctgggagagcaacccatggaaacataatggttgggggccacatgagtcttccagttcactctcactcctgtgtttaggaggcgtgtcttagatctgactcctctctggtcagtagaaaagaatcctttaagctatccagtgaattgatgaatgtgagacattgctgagccacactgttaagtctgctcattggggaactccagagacaacttaggatgagggcagaaaagtctttggggatgattcagtctgtaccagacatgacaacacacacactggaatgaaatgtgcaaacatgggggtgacaccacagagagaacctgtgaatgcattcagaacatgattggaatgaagagccctgtagtagggagtttccaccttgtacgtaagcaaacactgaatcaacttttttttttttttcggacagagtctcactgtgcagtggcatgatctccactcacagcaacctctgcctcccaggttcaagcagttctcctgcctcagcctccaaagtagctaggattacaggtgcctgccaccatgcctggctaattttttctatttttagtagagacagggtttcactgtgttggccaggctggtcttgaactcctgacctcatgatccgcccacctcagcctcccaaagtgttgggattacaggcatgagacactgcctggcctgaatcaaccttttttaagtgtaatcagaaagagaggctttggcaggggctcttactgtgttttctgtaacaacaaaggtgtacaatgagagagtccacacagtgctgtactgcacacaccacagaatgtgtgagattttcctgtttgaatgtatgtctgcattatactcctgcaataatgctgaggactcgttgcaggagggcaaactaggtgaataaattacctgtgaatgaacaatgaagtcgttcctcttaagactgaaacaagcaggccagatgtggtggctcacgcctgtaatcctagcactttgggaggccgaggcggccagatcacaaggttaggagttcaagaccagcctggccagcatggtgaaaccccatctctaccaaaaatacaggaaattatctgggcatagtagtgtgtgcctgtaatcccagctacttgggaagctgaggcaggagaattgcttgaacctgggaggtggaggttgcagtgagctaagatcgcaccactgcactccagcctgggtgacagagcgagactccatttcaaaaaaaaagactgaaacaagcttgtgctaagatggaaagggctgcttctaacagatgtggtttgttgctttagttgttgaagcaaaaatactgagttgttatgtttatgttatcaccccaccactacctccatggttgttcatttaggatgcttctaattcagccactgtgaaccattataaaggttttattgccatgttgaaaatgtttataatatggcaaaaaggggcatcaaatagaagatttactattattccagccatgtaaaaatatgtgcacatatggatgtatgttgaaagtggatgatggagaaataaaatgtggttttctttggggactgg

SEQ ID NO: 2975 - DNA, 3091 bp, Homo sapiens
atgcgcaatggagggtccggcgtccgccttggcgggtgggagtgatgacctgcactccccaaaccactgcgggatagaacggggccgagtgctctcaggggtggccgctaccggggcggcccgagacacggctgcgggttccagccaacaggcccggagtcgcggcctcggctccgccgtgggtgcacgggctagggctgcggggactcctgtgggctccgcgtctgcggctgggaggaatggggatcgtccccagatcccgccttccgggcagggcctccgctgcctgcgatcctgcccacagtccaaggatcctcctcgcctctcgcggactgcggtgtcagccgcccgagccgttccccggacacctggccagggtcttgctgtctcacccaggctggagtgcagtggcacgatcacagctcactgcagccttgagctcctgggctaccaagtagctgggacttcagagatggctggagccgtgtggatgggcataaatggctaatgtccagcaaccatcgatgtcaagtatccacacacctggcctgaatggatccctctgcctttcagagtttgggatatgagattgaaaatgacgactcggaattttcctgagagagaagtaccctgtgatgtagaagtggaaagattcacaagggaagttccctgcttgtccagtttaggtgatggttgggactgtgagaaccaggagggacacttgaggcaatcagctttaactctggagaaaccagggactcaggaagcaatttgtgaatatcctggttttggggagcatttgattgcaagctcagaccttccaccgtctcagagagttctggcaacaaatggtttccatgcacctgactcaaatgttagtggtctggattgtgaccccgccttacccagctatcctaaaagttatgcagataagagaactggtgacagtgatgcctgtggaaaaggcttcaaccattccatggaagttattcatggaagaaatccagtgagagagaagccctacaaataccctgaaagtgttaagtcttttaatcattttacctctcttggtcatcagaaaataatgaaaagaggcaagaaatcgtatgaaggtaagaattttgagaacatctttactctgagctcatcgcttaatgaaaaccagagaaatctccctggagagaaacaatatagatgtactgaatgtggcaaatgcttcaaacggaactcttctcttgttttgcatcaccgaactcacaccggagagaagccttatacttgtaatgagtgtggaaagtccttctccaagaactacaacctgattgtgcatcaaagaatccacacaggagagaagccctatgaatgcagtaaatgtgggaaagctttcagtgatggctcagctctgacacagcaccagagaattcacacaggcgagaaaccttatgaatgcctagagtgtggaaaaaccttcaaccgaaattcatccttaattttgcaccaaagaactcatacaggggaaaaaccatatagatgtaacgaatgtgggaaacccttcactgacatctcccaccttacagtgcatctcagaatccacaccggtgagaagccctatgagtgtagcaaatgtggaaaggctttccgggacggctcgtacctcacccagcatgagaggactcacactggagaaaagccctttgagtgtgcagagtgcgggaaatccttcaacagaaactctcacctcattgtgcatcaaaagatccattctggggagaaaccctatgaatgtaaagaatgtggcaagactttcatcgagagtgcgtacctcatcaggcatcagaggattcatactggcgagaagccctatggctgcaaccagtgtcagaaacttttcaggaatatcgctggcctcattaggcaccagaggactcatactggtgagaagccctatgagtgtaatcagtgtggcaaagccttcagggacagctcctgtctgaccaagcaccagagaattcacactaaggagaccccatatcagtgtccagaatgtgggaagtccttcaagcagaactctcacctggcagtacatcagagactccatagcagggagggtcccagccggtgtcctcagtgtggaaaaatgttccaaaagagctcatcccttgttcgacatcaaagagcacacctgggagagcaacccatggaaacataatggttgggggccacatgagtcttccagttcactctcactcctgtgtttaggaggcgtgtcttagatctgactcctctctggtcagtagaaaagaatcctttaagctatccagtgaattgatgaatgtgagacattgctgagccacactgttaagtctgctcattggggaactccagagacaacttaggatgagggcagaaaagtctttggggatgattcagtctgtaccagacatgacaacacacacactggaatgaaatgtgcaaacatgggggtgacaccacagagagaacctgtgaatgcattcagaacatgattggaatgaagagccctgtagtagggagtttccaccttgtacgtaagcaaacactgaatcaacttttttttttttttcggacagagtctcactgtgcagtggcatgatctccactcacagcaacctctgcctcccaggagaattgcttgaacctgggaggtggaggttgcagtgagctaagatcgcaccactgcactccagcctgggtgacagagcgagactccatttcaaaaaaaaagactgaaacaagcttgtgctaagatggaaagggctgcttctaacagatgtggtttgttgctttagttgttgaagcaaaaatactgagttgttatgtttatgttatcaccccaccactacctccatggttgttcatttaggatgcttctaattcagccactgtgaaccattataaaggttttattgccatgttgaaaatgtttataatatggcaaaaaggggcatcaaatagaagatttactattattccagccatgtaaaaatatgtgcacatatggatgtatgttgaaagtggatgatggagaaataaaatgtggttttctttgggg

SEQ ID NO: 2976 - DNA, 3410 bp, Homo sapiens
gaacatggctgccgccggccgccaaccggtcttgctgtctcacccaggctggagtgcagtggcacgatcacagctcactgcagccttgagctcctgggctaccaagtagctgggacttcagagatggctggagccgtgtggatgggcataaatggctaatgtccagcaaccatcgatgtcaagtatccacacacctggcctgaatggatccctctgcctttcagagtttgggatatgagattgaaaatgacgactcggaattttcctgagagagaagtaccctgtgatgtagaagtggaaagattcacaagggaagttccctgcttgtccagtttaggtgatggttgggactgtgagaaccaggagggacacttgaggcaatcagctttaactctggagaaaccagggactcaggaagcaatttgtgaatatcctggttttggggagcatttgattgcaagctcagaccttccaccgtctcagagagttctggcaacaaatggtttccatgcacctgactcaaatgttagtggtctggattgtgaccccgccttacccagctatcctaaaagttatgcagataagagaactggtgacagtgatgcctgtggaaaaggcttcaaccattccatggaagttattcatggaagaaatccagtgagagagaagccctacaaataccctgaaagtgttaagtcttttaatcattttacctctcttggtcatcagaaaataatgaaaagaggcaagaaatcgtatgaaggtaagaattttgagaacatctttactctgagctcatcgcttaatgaaaaccagagaaatctccctggagagaaacaatatagatgtactgaatgtggcaaatgcttcaaacggaactcttctcttgttttgcatcaccgaactcacaccggagagaagccttatacttgtaatgagtgtggaaagtccttctccaagaactacaacctgattgtgcatcaaagaatccacacaggagagaagccctatgaatgcagtaaatgtgggaaagctttcagtgatggctcagctctgacacagcaccagagaattcacacaggcgagaaaccttatgaatgcctagagtgtggaaaaaccttcaaccgaaattcatccttaattttgcaccaaagaactcatacaggggaaaaaccatatagatgtaacgaatgtgggaaacccttcactgacatctcccaccttacagtgcatctcagaatccacaccggtgagaagccctatgagtgtagcaaatgtggaaaggctttccgggacggctcgtacctcacccagcatgagaggactcacactggagaaaagccctttgagtgtgcagagtgcgggaaatccttcaacagaaactctcacctcattgtgcatcaaaagatccattctggggagaaaccctatgaatgtaaagaatgtggcaagactttcatcgagagtgcgtacctcatcaggcatcagaggattcatactggcgagaagccctatggctgcaaccagtgtcagaaacttttcaggaatatcgctggcctcattaggcaccagaggactcatactggtgagaagccctatgagtgtaatcagtgtggcaaagccttcagggacagctcctgtctgaccaagcaccagagaattcacactaaggagaccccatatcagtgtccagaatgtgggaagtccttcaagcagaactctcacctggcagtacatcagagactccatagcagggagggtcccagccggtgtcctcagtgtggaaaaatgttccaaaagagctcatcccttgttcgacatcaaagagcacacctgggagagcaacccatggaaacataatggttgggggccacatgagtcttccagttcactctcactcctgtgtttaggaggcgtgtcttagatctgactcctctctggtcagtagaaaagaatcctttaagctatccagtgaattgatgaatgtgagacattgctgagccacactgttaagtctgctcattggggaactccagagacaacttaggatgagggcagaaaagtctttggggatgattcagtctgtaccagacatgacaacacacacactggaatgaaatgtgcaaacatgggggtgacaccacagagagaacctgtgaatgcattcagaacatgattggaatgaagagccctgtagtagggagtttccaccttgtacgtaagcaaacactgaatcaacttttttttttttttcggacagagtctcactgtgcagtggcatgatctccactcacagcaacctctgcctcccaggttcaagcagttctcctgcctcagcctccaaagtagctaggattacaggtgcctgccaccatgcctggctaattttttctatttttagtagagacagggtttcactgtgttggccaggctggtcttgaactcctgacctcatgatccgcccacctcagcctcccaaagtgttgggattacaggcatgagacactgcctggcctgaatcaaccttttttaagtgtaatcagaaagagaggctttggcaggggctcttactgtgttttctgtaacaacaaaggtgtacaatgagagagtccacacagtgctgtactgcacacaccacagaatgtgtgagattttcctgtttgaatgtatgtctgcattatactcctgcaataatgctgaggactcgttgcaggagggcaaactaggtgaataaattacctgtgaatgaacaatgaagtcgttcctcttaagactgaaacaagcaggccagatgtggtggctcacgcctgtaatcctagcactttgggaggccgaggcggccagatcacaaggttaggagttcaagaccagcctggccagcatggtgaaaccccatctctaccaaaaatacaggaaattatctgggcatagtagtgtgtgcctgtaatcccagctacttgggaagctgaggcaggagaattgcttgaacctgggaggtggaggttgcagtgagctaagatcgcaccactgcactccagcctgggtgacagagcgagactccatttcaaaaaaaaagactgaaacaagcttgtgctaagatggaaagggctgcttctaacagatgtggtttgttgctttagttgttgaagcaaaaatactgagttgttatgtttatgttatcaccccaccactacctccatggttgttcatttaggatgcttctaattcagccactgtgaaccattataaaggttttattgccatgttgaaaatgtttataatatggcaaaaaggggcatcaaatagaagatttactattattccagccatgtaaaaatatgtgcacatatggatgtatgttgaaagtggatgatggagaaataaaatgtggttttctttggggactggaa

SEQ ID NO: 2977 - DNA, 2430 bp, Homo sapiens
cttccgggtgagggtcctgcagcccgtgaatccctggtcccgccgagacttggacctggtgcgaactggaggcgaagcgggtgcacccacaacctataggaagggctggcggcgagctctgagcactcgggcgtcggagggaacgctctgctttcaacactcttggccctttctcaagagaacatgaaaatgaaaaaatttcagataccagtttcattccaggacctgactgtgaacttcacccaagaggaatggcagcaactggaccctgctcagaggctcctgtacagggatgtgatgctggagaactacagcaacttggtctctgtggggtatcatgttagcaaaccagatgtgattttcaaattggagcaaggagaagagccatggatagtggaggaattctcaaatcagaactacccagacattgatgatgccttagagaagaacaaggaaatccaagataaacatttgacacaaactgtattcttcagcaacaaaacactgattacagaaagagagaatgtatttgggaaaacacttaatctgggcatgaatagtgttccctcaagaaaaatgccctataaatgtaatccaggaggaaacagtttgaaaactaattcagaagtaattgttgcaaagaaaagcaaagaaaacagaaagattcctgatggatacagtggatttgggaagcatgagaaaagtcatttgggaatgaaaaaatacagatacaatccaatgaggaaagccagcaatcaaaacgaaaatcttattctgcaccagaacattcagattttgaaacaaccgtttgactataataaatgtgggaaaaccttcttcaagagggcaattctcattacacaaaaggggagacagactgaaaggaaaccaaatgaatgtaatgaatgtaggaaaaccttttctaagagatctaccctcattgtacatcagagaattcatacaggggagaaaccgtatgtttgtagtgattgtaggaaaacttttcgtgtgaagacaagcctcactcgacaccgaagaattcatactggagagagaccctatgaatgcagtgaatgcaggaaaaccttcattgacaaatctgcccttattgtacaccagaaaattcatggaggggagaaatcctatgagtgtaatgaatgtggaaagaccttttttcggaagtcagccctggctgaacatttcaggtcacacacaggggagaagccttacgaatgcaaggaatgtggaaatgccttcagcaagaaatcgtatcttgttgtacatcaaagaactcacagaggagagaagccaaatgaatgtaaggaatgtgggaaaaccttcttctgtcagtcagcccttactgcgcatcagagaattcacacaggggaaaaaccctatgaatgtagtgaatgtgagaaaaccttcttttgtcaatctgccctcaatgtgcatcgaagaagtcatacaggagagaagccctatgaatgcagtcaatgtggaaaatttttatgtacgaaatcagccctcattgcacatcagataactcatagaggaaagaagtcttatgaatgtaatgaatgtgggaaatttttctgccataagtcaacactcactatacatcagagaacacacacaggagagaaacatggtgtgtttaataaatgtggtagaatctccattgtgaagtcaaactgcagtcagtgtaagagaatgaacacaaaggagaatctttatgagtgtagtgaacatgggcatgccgtcagcaaaaactcacacctcattgtacatcagagaactatatgggagagaccatatgaatgcaatgaatgtgggagaacctactgcaggaagtcagccctgactcaccatcagagaacacacacaggacagagaccctatgagtgtaatgaatgtgggaaaaccttctgtcagaagttctcctttgttgaacatcagcgaactcacactggggagaaaccatatgaatgtaatgaatgtgggaaatccttctgccataagtcagccttcagagtccatagaagaattcacacaggagagaaaccatatgaatgtaatcaatgtgggaaaacctaccgtcgcctgtggactctcactgaacatcagaaaatacacacaggagagaaaccttatgaatgtaacaaatgtgagaaaacatttcgccacaaatcaaactttcttttacatcagaaatcccacaaggaataagttccaacaaagtaataaattccaacaaagcaacaaatcaaataacttacacaatgctaaactgtgagtatgtatagaggagtaaaatcttataaatgtaatgaatatggaaaatttttctgccataagtcaaccctcaatgtaacatcagagaaatcatgtaggaaagaaataatttgtttaataaatgtattattcattgtg

SEQ ID NO: 2978 - DNA, 3479 bp, Homo sapiens
aggctcttccgggtgagggtcctgcagcccgtgaatccctggtcccgccgagacttggacctggtgcgaactggaggcgaagcgggtgcacccacaacctataggaagggctggcggcgagctctgagcactcgggcgtcggagggaacggtggggccgggcggagcgggcctcgggtctgcggagggtggacgcgcgctctccctgtctttggagggagggtttcctgtggtcgggaggcgaggcagccagggcaggattgggctcctgacctgcaggccacgggcgagctctctctagggccctgatttgcccgaagaaggcgcttggtgaaggtgaaaggtttacgcatccaagtagctagaacctctttccagaacttctgctgatgcacttagtcttgcagccattgattattatagctcagcaaagttcagttcaactttcggaagaaggatgtgagctggaatgggcagggtcaagatttgacaggaaaagacacttcactggaggtatctgcgagagtcctgggttggagggaaggagtactggttataaataaggaaatgatgtcttcatcacttcctaaacacatacatgtcattccctaccatctccaccctctgtttattcagagctgcaccaaccatgttcatcacctcacctgggatttactgagtttaccccttacagagctacacgataggggtaaaggaaagactaaaaaccaatttatcttatattaaaattacgacttagtaaatatttttttcagtaatgcagtttgctagtgacagatccaataactgaattctggtcctttgagtaccaggtcagggcttttgtcatctaccacatttacgttacctaccacaagaagtttcttagtaaaaggtcctcttgtgaaactgcagctaagggaaaccaaactgtcaaaaagacaaacaccttaaagcactttcattcattctctctggattctgtcatctcaagtggctaaacacattagtaggaaaacagctctgctttcaacactcttggccctttctcaagagaacatgaaaatgaaaaaatttcagagatggggttttgccgtgttgcccagactgatcttgagcttctgagctccagcgatcagcctacctcaacctctcagagtgctgggattataggtgtgcgccaccacacctggccatgtgtgttttcttacatctcctttcttacataaaagataccagtttcattccaggacctgactgtgaacttcacccaagaggaatggcagcaactggaccctgctcagaggctcctgtacagggatgtgatgctggagaactacagcaacttggtctctgtggggtatcatgttagcaaaccagatgtgattttcaaattggagcaaggagaagagccatggatagtggaggaattctcaaatcagaactacccagacattgatgatgccttagagaagaacaaggaaatccaagataaacatttgacacaaactgtattcttcagcaacaaaacactgattacagaaagagagaatgtatttgggaaaacacttaatctgggcatgaatagtgttccctcaagaaaaatgccctataaatgtaatccaggaggaaacagtttgaaaactaattcagaagtaattgttgcaaagaaaagcaaagaaaacagaaagattcctgatggatacagtggatttgggaagcatgagaaaagtcatttgggaatgaaaaaatacagatacaatccaatgaggaaagccagcaatcaaaacgaaaatcttattctgcaccagaacattcagattttgaaacaaccgtttgactataataaatgtgggaaaaccttcttcaagagggcaattctcattacacaaaaggggagacagactgaaaggaaaccaaatgaatgtaatgaatgtaggaaaaccttttctaagagatctaccctcattgtacatcagagaattcatacaggggagaaaccgtatgtttgtagtgattgtaggaaaacttttcgtgtgaagacaagcctcactcgacaccgaagaattcatactggagagagaccctatgaatgcagtgaatgcaggaaaaccttcattgacaaatctgcccttattgtacaccagaaaattcatggaggggagaaatcctatgagtgtaatgaatgtggaaagaccttttttcggaagtcagccctggctgaacatttcaggtcacacacaggggagaagccttacgaatgcaaggaatgtggaaatgccttcagcaagaaatcgtatcttgttgtacatcaaagaactcacagaggagagaagccaaatgaatgtaaggaatgtgggaaaaccttcttctgtcagtcagcccttactgcgcatcagagaattcacacaggggaaaaaccctatgaatgtagtgaatgtgagaaaaccttcttttgtcaatctgccctcaatgtgcatcgaagaagtcatacaggagagaagccctatgaatgcagtcaatgtggaaaatttttatgtacgaaatcagccctcattgcacatcagataactcatagaggaaagaagtcttatgaatgtaatgaatgtgggaaatttttctgccataagtcaacactcactatacatcagagaacacacacaggagagaaacatggtgtgtttaataaatgtggtagaatctccattgtgaagtcaaactgcagtcagtgtaagagaatgaacacaaaggagaatctttatgagtgtagtgaacatgggcatgccgtcagcaaaaactcacacctcattgtacatcagagaactatatgggagagaccatatgaatgcaatgaatgtgggagaacctactgcaggaagtcagccctgactcaccatcagagaacacacacaggacagagaccctatgagtgtaatgaatgtgggaaaaccttctgtcagaagttctcctttgttgaacatcagcgaactcacactggggagaaaccatatgaatgtaatgaatgtgggaaatccttctgccataagtcagccttcagagtccatagaagaattcacacaggagagaaaccatatgaatgtaatcaatgtgggaaaacctaccgtcgcctgtggactctcactgaacatcagaaaatacacacaggagagaaaccttatgaatgtaacaaatgtgagaaaacatttcgccacaaatcaaactttcttttacatcagaaatcccacaaggaataagttccaacaaagtaataaattccaacaaagcaacaaatcaaataacttacacaatgctaaactgtgagtatgtatagaggagtaaaatcttataaatgtaatgaatatggaaaatttttctgccataagtcaaccctcaatgtaacatcagagaaatcatgtaggaaagaaataatttgtttaataaatgtattattcattgtgaactatgaaaatattcaacagc

SEQ ID NO: 2979 - DNA, 3205 bp, Homo sapiens
agatccctgggcgtcagcgagccgtgagatgcgtggtccaccatcggtgacctcaccgcctcggttcgccctcagccgccccgattggccatctgcaagcttcccttctccgtggagagcaggaagacagtcatgggacctcagggagccaggagacaggctttcttggcatttggggatgtcactgtggatttcacccagaaggaatggaggctgctgagccctgctcagagggccctgtacagggaggtgacactggagaactacagccacctggtctcactaggaattctccattctaaaccagaactcatcaggcggctagagcaaggggaagtgccctggggagaagagagaagacgccggccaggcccctgtgcaggaatatatgcagaacatgtcctgcggcccaagaatcttggacttgcacatcagaggcaacagcaactacaattttctgatcaaagcttccagagtgacacagctgaaggtcaagagaaagaaaaaagcactaagcccatggcattttccagcccacccctaagacatgcagtaagctcaaggaggaggaacagtgtagtggaaatagagtctagtcaaggccagagggaaaatcctacagaaatagacaaagtattgaaaggaatagaaaattcaagatggggagcattcaagtgtgcagagcgtgggcaagacttcagccggaagatgatggtaatcatacacaaaaaagcacattccaggcagaaactttttacatgcagggagtgtcaccagggctttagagatgagtcagcattgctcttgcaccagaacacacacacaggagagaagtcctatgtgtgcagtgtgtgtgggcgaggcttcagcctcaaggccaacctcctcagacaccagaggacacactcaggagagaagccttttctgtgcaaggtgtgtggacgaggctataccagtaagtcatacctcactgtgcatgagagaacacacacaggagagaagccttatgaatgccaggagtgtgggcgaaggtttaacgataagtcctcatacaacaagcacttgaaggcgcattcaggggagaagccttttgtgtgcaaggagtgtgggcgaggctatactaataagtcatacttcgttgtgcacaagagaatacactcaggagagaagccttacagatgccaggagtgtggccgaggctttagcaataagtcacaccttatcacacaccagaggacacactcaggggagaagccctttgcgtgcaggcagtgtaagcaaagttttagcgtgaaaggaagtctcctcagacaccagagaacacactcaggggagaagccttttgtgtgcaaggattgtgagcgaagctttagccaaaagtcaactcttgtctaccaccagagaacacactcaggggagaaaccttttgtttgtagagaatgtgggcaaggatttattcagaagtcaacccttgtgaaacatcagatcacacactcagaggagaagccttttgtgtgcaaggactgtggacgaggctttatccaaaagtcaaccttcactttacaccagaggacacactcagaggagaagccttatggatgtcgggagtgtgggcgaaggtttcgggataagtcctcctataacaagcacctgagggcacacttgggtgagaaacgttttttctgcagggattgtgggcgaggctttaccttgaagccaaatctcaccatacatcagaggacacactcaggagagaagcccttcatgtgcaagcagtgtgagaaaagttttagtttgaaggcaaatcttcttagacatcagtggacacactcgggggaaaggccatttaattgcaaggattgcgggcgaggcttcatcctaaaatcaactctcctcttccaccagaagacacactcaggggagaagcctttcatctgtagtgaatgtgggcaaggatttatctggaagtcaaatcttgtgaaacaccagcttgcacattctggcaagcagccttttgtatgcaaggagtgtgggcgaggcttcaactggaagggaaatctcctcacacaccagaggacacactcaggggagaagcccttcgtgtgtaatgtgtgtgggcaaggcttcagctggaagagaagtctcaccagacaccactggcggatacactcaaaggagaagccttttgtttgccaggagtgtaagcgaggctataccagtaagtcagacctcactgtgcatgaaagaatacacacaggagagaggccttatgaatgccaagagtgtggacgaaagtttagcaataagtcatactacagtaagcacttaaagagacacttacgtgagaagcgtttttgtacagggagtgtgggtgaggcttcatcttgaagttatatctcaccatccatcagaggacacactcaggagagtaactttgctttgttacaagctttagttgaggctgcataacttgttcgtgaagatataacagaggcagacagaatccagagggctacagagaacctgaattcaacccatgtgtccccaagagattcagagaaaagaggtcaatgtttagggaacagagatgccagttgaggggagggcattacctgggctattggggaaatgtggtctctttcctactgagcacatattcttgttgtatttgtgccaggctgtgctttctaaggactgctcttagccagtgactgcagagcagggataccaaggcaggcctgttacactctccccaacctccttggactgcaaacaatctaggacacctccaccaaacctcctcttgcactttccctctggcttccctcccagccttccttggtttggatgttttgtcccctccttaatttatgttgaaactctacataaactgtttactgttgaaacagtgtaagtattaggaggtgggacctttgggaagtgattaagtcaagtcacgaagatagagctttgcgaatgggatcaggtgcccttatgaaaaggcttgatagagggagtttgtcctgtggcccttctattttctgctctgtgaggacacaatgctcctcccttccaaaagatgcagcatgaaggcatcatcttggaaacagacatgagccctcaacagacaactgcacctactgatgttttgatgttgaacttcccagcctccagaactctgggaaaataaagtcctctttataca

SEQ ID NO: 2980 - DNA, 3258 bp, Homo sapiens
aatttgttaaaggctttggtgttgtacagtactgaataactgccaatgccatctgcctgtggccttctcaagtttgtctgcacctgtggttatcctgacttcaaacccggggagacagaggctagaagaggcagacagctcttgtgtattctgtccagtgcaaagaacacctggaactctgagccctaaccttaaatgcaagacctcatctgcaggtgttcctcatccttttagcccctcagtgatgtaagcaacaaacgtcacccagctcctggggcacacttcactcccagatgagcttgtcctggatttgcagggagcctggctccctagaccttttggccagatccccacaggggaattgtgcaggtgcgccctccccagatccccagttggtattggaatcacaccaactgtcacacatggggagggcagctgcacccagccaccctctgacttctctcctcccacagattggccatctgcaagcttcccttctccgtggagagcaggaagacagtcatgggacctcagggagccaggagacaggctttcttggcatttggggatgtcactgtggatttcacccagaaggaatggaggctgctgagccctgctcagagggccctgtacagggaggtgacactggagaactacagccacctggtctcactaggaattctccattctaaaccagaactcatcaggcggctagagcaaggggaagtgccctggggagaagagagaagacgccggccaggcccctgtgcaggaatatatgcagaacatgtcctgcggcccaagaatcttggacttgcacatcagaggcaacagcaactacaattttctgatcaaagcttccagagtgacacagctgaaggtcaagagaaagaaaaaagcactaagcccatggcattttccagcccacccctaagacatgcagtaagctcaaggaggaggaacagtgtagtggaaatagagtctagtcaaggccagagggaaaatcctacagaaatagacaaagtattgaaaggaatagaaaattcaagatggggagcattcaagtgtgcagagcgtgggcaagacttcagccggaagatgatggtaatcatacacaaaaaagcacattccaggcagaaactttttacatgcagggagtgtcaccagggctttagagatgagtcagcattgctcttgcaccagaacacacacacaggagagaagtcctatgtgtgcagtgtgtgtgggcgaggcttcagcctcaaggccaacctcctcagacaccagaggacacactcaggagagaagccttttctgtgcaaggtgtgtggacgaggctataccagtaagtcatacctcactgtgcatgagagaacacacacaggagagaagccttatgaatgccaggagtgtgggcgaaggtttaacgataagtcctcatacaacaagcacttgaaggcgcattcaggggagaagccttttgtgtgcaaggagtgtgggcgaggctatactaataagtcatacttcgttgtgcacaagagaatacactcaggagagaagccttacagatgccaggagtgtggccgaggctttagcaataagtcacaccttatcacacaccagaggacacactcaggggagaagccctttgcgtgcaggcagtgtaagcaaagttttagcgtgaaaggaagtctcctcagacaccagagaacacactcaggggagaagccttttgtgtgcaaggattgtgagcgaagctttagccaaaagtcaactcttgtctaccaccagagaacacactcaggggagaaaccttttgtttgtagagaatgtgggcaaggatttattcagaagtcaacccttgtgaaacatcagatcacacactcagaggagaagccttttgtgtgcaaggactgtggacgaggctttatccaaaagtcaaccttcactttacaccagaggacacactcagaggagaagccttatggatgtcgggagtgtgggcgaaggtttcgggataagtcctcctataacaagcacctgagggcacacttgggtgagaaacgttttttctgcagggattgtgggcgaggctttaccttgaagccaaatctcaccatacatcagaggacacactcaggagagaagcccttcgtgtgtaatgtgtgtgggcaaggcttcagctggaagagaagtctcaccagacaccactggcggatacactcaaaggagaagccttttgtttgccaggagtgtaagcgaggctataccagtaagtcagacctcactgtgcatgaaagaatacacacaggagagaggccttatgaatgccaagagtgtggacgaaagtttagcaataagtcatactacagtaagcacttaaagagacacttacgtgagaagcgtttttgtacagggagtgtgggtgaggcttcatcttgaagttatatctcaccatccatcagaggacacactcaggagagtaactttgctttgttacaagctttagttgaggctgcataacttgttcgtgaagatataacagaggcagacagaatccagagggctacagagaacctgaattcaacccatgtgtccccaagagattcagagaaaagaggtcaatgtttagggaacagagatgccagttgaggggagggcattacctgggctattggggaaatgtggtctctttcctactgagcacatattcttgttgtatttgtgccaggctgtgctttctaaggactgctcttagccagtgactgcagagcagggataccaaggcaggcctgttacactctccccaacctccttggactgcaaacaatctaggacacctccaccaaacctcctcttgcactttccctctggcttccctcccagccttccttggtttggatgttttgtcccctccttaatttatgttgaaactctacataaactgtttactgttgaaacagtgtaagtattaggaggtgggacctttgggaagtgattaagtcaagtcacgaagatagagctttgcgaatgggatcaggtgcccttatgaaaaggcttgatagagggagtttgtcctgtggcccttctattttctgctctgtgaggacacaatgctcctcccttccaaaagatgcagcatgaaggcatcatcttggaaacagacatgagccctcaacagacaactgcacctactgatgttttgatgttgaacttcccagcctccagaactctgggaaaataaagtcctctttatac

SEQ ID NO: 2981 - DNA, 3613 bp, Homo sapiens
cacactccccatgctattaatttgttaaaggctttggtgttgtacagtactgaataactgccaatgccatctgcctgtggccttctcaagtttgtctgcacctgtggttatcctgacttcaaacccggggagacagaggctagaagaggcagacagctcttgtgtattctgtccagtgcaaagaacacctggaactctgagccctaaccttaaatgcaagacctcatctgcaggtgttcctcatccttttagcccctcagtgatgtaagcaacaaacgtcacccagctcctggggcacacttcactcccagatgagcttgtcctggatttgcagggagcctggctccctagaccttttggccagatccccacaggggaattgtgcaggtgcgccctccccagatccccagttggtattggaatcacaccaactgtcacacatggggagggcagctgcacccagccaccctctgacttctctcctcccacagattggccatctgcaagcttcccttctccgtggagagcaggaagacagtcatgggacctcagggagccaggagacaggctttcttggcatttggggatgtcactgtggatttcacccagaaggaatggaggctgctgagccctgctcagagggccctgtacagggaggtgacactggagaactacagccacctggtctcactaggaattctccattctaaaccagaactcatcaggcggctagagcaaggggaagtgccctggggagaagagagaagacgccggccaggcccctgtgcaggaatatatgcagaacatgtcctgcggcccaagaatcttggacttgcacatcagaggcaacagcaactacaattttctgatcaaagcttccagagtgacacagctgaaggtcaagagaaagaaaaaagcactaagcccatggcattttccagcccacccctaagacatgcagtaagctcaaggaggaggaacagtgtagtggaaatagagtctagtcaaggccagagggaaaatcctacagaaatagacaaagtattgaaaggaatagaaaattcaagatggggagcattcaagtgtgcagagcgtgggcaagacttcagccggaagatgatggtaatcatacacaaaaaagcacattccaggcagaaactttttacatgcagggagtgtcaccagggctttagagatgagtcagcattgctcttgcaccagaacacacacacaggagagaagtcctatgtgtgcagtgtgtgtgggcgaggcttcagcctcaaggccaacctcctcagacaccagaggacacactcaggagagaagccttttctgtgcaaggtgtgtggacgaggctataccagtaagtcatacctcactgtgcatgagagaacacacacaggagagaagccttatgaatgccaggagtgtgggcgaaggtttaacgataagtcctcatacaacaagcacttgaaggcgcattcaggggagaagccttttgtgtgcaaggagtgtgggcgaggctatactaataagtcatacttcgttgtgcacaagagaatacactcaggagagaagccttacagatgccaggagtgtggccgaggctttagcaataagtcacaccttatcacacaccagaggacacactcaggggagaagccctttgcgtgcaggcagtgtaagcaaagttttagcgtgaaaggaagtctcctcagacaccagagaacacactcaggggagaagccttttgtgtgcaaggattgtgagcgaagctttagccaaaagtcaactcttgtctaccaccagagaacacactcaggggagaaaccttttgtttgtagagaatgtgggcaaggatttattcagaagtcaacccttgtgaaacatcagatcacacactcagaggagaagccttttgtgtgcaaggactgtggacgaggctttatccaaaagtcaaccttcactttacaccagaggacacactcagaggagaagccttatggatgtcgggagtgtgggcgaaggtttcgggataagtcctcctataacaagcacctgagggcacacttgggtgagaaacgttttttctgcagggattgtgggcgaggctttaccttgaagccaaatctcaccatacatcagaggacacactcaggagagaagcccttcatgtgcaagcagtgtgagaaaagttttagtttgaaggcaaatcttcttagacatcagtggacacactcgggggaaaggccatttaattgcaaggattgcgggcgaggcttcatcctaaaatcaactctcctcttccaccagaagacacactcaggggagaagcctttcatctgtagtgaatgtgggcaaggatttatctggaagtcaaatcttgtgaaacaccagcttgcacattctggcaagcagccttttgtatgcaaggagtgtgggcgaggcttcaactggaagggaaatctcctcacacaccagaggacacactcaggggagaagcccttcgtgtgtaatgtgtgtgggcaaggcttcagctggaagagaagtctcaccagacaccactggcggatacactcaaaggagaagccttttgtttgccaggagtgtaagcgaggctataccagtaagtcagacctcactgtgcatgaaagaatacacacaggagagaggccttatgaatgccaagagtgtggacgaaagtttagcaataagtcatactacagtaagcacttaaagagacacttacgtgagaagcgtttttgtacagggagtgtgggtgaggcttcatcttgaagttatatctcaccatccatcagaggacacactcaggagagtaactttgctttgttacaagctttagttgaggctgcataacttgttcgtgaagatataacagaggcagacagaatccagagggctacagagaacctgaattcaacccatgtgtccccaagagattcagagaaaagaggtcaatgtttagggaacagagatgccagttgaggggagggcattacctgggctattggggaaatgtggtctctttcctactgagcacatattcttgttgtatttgtgccaggctgtgctttctaaggactgctcttagccagtgactgcagagcagggataccaaggcaggcctgttacactctccccaacctccttggactgcaaacaatctaggacacctccaccaaacctcctcttgcactttccctctggcttccctcccagccttccttggtttggatgttttgtcccctccttaatttatgttgaaactctacataaactgtttactgttgaaacagtgtaagtattaggaggtgggacctttgggaagtgattaagtcaagtcacgaagatagagctttgcgaatgggatcaggtgcccttatgaaaaggcttgatagagggagtttgtcctgtggcccttctattttctgctctgtgaggacacaatgctcctcccttccaaaagatgcagcatgaaggcatcatcttggaaacagacatgagccctcaacagacaactgcacctactgatgttttgatgttgaacttcccagcctccagaactctgggaaaataaagtcctctttataca

SEQ ID NO: 2982 - DNA, 2474 bp, Homo sapiens
tttagcccctcagtgatgtaagcaacaaacgtcacccagctcctggggcacacttcactcccagatgagcttgtcctggatttgcagggagcctggctccctagaccttttggccagatccccacaggggaattgtgcaggtgcgccctccccagatccccagttggtattggaatcacaccaactgtcacacatggggagggcagctgcacccagccaccctctgacttctctcctcccacagattggccatctgcaagcttcccttctccgtggagagcaggaagacagtcatgggacctcagggagccaggagacaggctttcttggcatttggggatgtcactgtggatttcacccagaaggaatggaggctgctgagccctgctcagagggccctgtacagggaggtgacactggagaactacagccacctggtctcactaggaatatatgcagaacatgtcctgcggcccaagaatcttggacttgcacatcagaggcaacagcaactacaattttctgatcaaagcttccagagtgacacagctgaaggtcaagagaaagaaaaaagcactaagcccatggcattttccagcccacccctaagacatgcagtaagctcaaggaggaggaacagtgtagtggaaatagagtctagtcaaggccagagggaaaatcctacagaaatagacaaagtattgaaaggaatagaaaattcaagatggggagcattcaagtgtgcagagcgtgggcaagacttcagccggaagatgatggtaatcatacacaaaaaagcacattccaggcagaaactttttacatgcagggagtgtcaccagggctttagagatgagtcagcattgctcttgcaccagaacacacacacaggagagaagtcctatgtgtgcagtgtgtgtgggcgaggcttcagcctcaaggccaacctcctcagacaccagaggacacactcaggagagaagccttttctgtgcaaggtgtgtggacgaggctataccagtaagtcatacctcactgtgcatgagagaacacacacaggagagaagccttatgaatgccaggagtgtgggcgaaggtttaacgataagtcctcatacaacaagcacttgaaggcgcattcaggggagaagccttttgtgtgcaaggagtgtgggcgaggctatactaataagtcatacttcgttgtgcacaagagaatacactcaggagagaagccttacagatgccaggagtgtggccgaggctttagcaataagtcacaccttatcacacaccagaggacacactcaggggagaagccctttgcgtgcaggcagtgtaagcaaagttttagcgtgaaaggaagtctcctcagacaccagagaacacactcaggggagaagccttttgtgtgcaaggattgtgagcgaagctttagccaaaagtcaactcttgtctaccaccagagaacacactcaggggagaaaccttttgtttgtagagaatgtgggcaaggatttattcagaagtcaacccttgtgaaacatcagatcacacactcagaggagaagccttttgtgtgcaaggactgtggacgaggctttatccaaaagtcaaccttcactttacaccagaggacacactcagaggagaagccttatggatgtcgggagtgtgggcgaaggtttcgggataagtcctcctataacaagcacctgagggcacacttgggtgagaaacgttttttctgcagggattgtgggcgaggctttaccttgaagccaaatctcaccatacatcagaggacacactcaggagagaagcccttcatgtgcaagcagtgtgagaaaagttttagtttgaaggcaaatcttcttagacatcagtggacacactcgggggaaaggccatttaattgcaaggattgcgggcgaggcttcatcctaaaatcaactctcctcttccaccagaagacacactcaggggagaagcctttcatctgtagtgaatgtgggcaaggatttatctggaagtcaaatcttgtgaaacaccagcttgcacattctggcaagcagccttttgtatgcaaggagtgtgggcgaggcttcaactggaagggaaatctcctcacacaccagaggacacactcaggggagaagcccttcgtgtgtaatgtgtgtgggcaaggcttcagctggaagagaagtctcaccagacaccactggcggatacactcaaaggagaagccttttgtttgccaggagtgtaagcgaggctataccagtaagtcagacctcactgtgcatgaaagaatacacacaggagagaggccttatgaatgccaagagtgtggacgaaagtttagcaataagtcatactacagtaagcacttaaagagacacttacgtgagaagcgtttttgtacagggagtgtgggtgaggcttcatcttgaagttatatctcaccatccatc

SEQ ID NO: 2983 - DNA, 3661 bp, Homo sapiens
acgtgctgtgggaatgggggattctgtgtcagagctggggggtcgggtccggtgagatggggatgcggatttagataatagggatgggaagttccgcgtgtgcggcggatataaggtcggtgtagacttggtcgttcaagtgaggcggggtccacactcggtggcccggtgactgggttatcgagtggagccagggcagcccagagatgctggggtcccgcgagcctaggttgggtttccagggctgggggctcggcggcggctcctgggcgccccctggcggccccgactcaaccgccacggctcccacaatgctcgcgtagccgggcttcggttcctgtggcggcgacggcggcggctccaagatggcgcaggcgatctttgaggccctggagggaatggacaatcagaccgttctggctgtccagtcattattggatggccaaggagcagtccctgatccgacaggccagagtgtcaatgcgccccctgctatccagccattggatgacgaggatgtatttctctgcgggaagtgtaagaagcaattcaactcgctgccagcgtttatgacccacaagcgggaacagtgccaggggaatgcccccgccctggccacagtctcactggccaccaacagcatctacccaccttcggcagcacccacagcggtccagcaggccccaactcctgccaatcgccagatctccacatacatcacagtgcccccgtccccactgatccagaccctggtgcaggggaacatcttggtgagcgatgatgtgctcatgtctgccatgtcagccttcacatccctggaccagcccatgccccagggccccccacctgtgcagagcagcctgaacatgcattccgtgcccagctacctcacccagcctccacctcctcctccacctcctccaccactgcccccaccgccaccacctcagcctccaccacctccaccccagagcctgggcccccctgggcgtcccaaccctggtgggaacggtgtggtggaggtgtacagtgctgctgcgcccctggctgggagtggaacggtggagatccaggcactggggatgcagccctacccacccctagaggtgccaaaccagtgtgtggagcctccagtatatcccacccccacagtgtacagccctggcaaacagggattcaaacccaaaggaccaaaccccgccgcccccatgaccagcgccaccgggggcacggtggccacctttgactctccagcaacgctgaagacccgacgagctaaagctgcagggaagccaaaggctcagaaactcaagtgctcatactgtgacaagtcattcaccaaaaactttgacctgcagcagcacatccgaagccacaccggtgagaagcccttccagtgcattgcatgtggccgtgcctttgcccagaagtctaatgttaagaaacacatgcagacccacaaggtgtggcctccaggacacagtggtggcaccgtgtctcgaaactctgtgaccgtacaggtcatggccctgaaccccagcaggcaggaggacgaggaaagcacagggttgggccagcccctgccgggtgcgccacagccccaggccttgtccacagctggtgaggaagagggggacaagccggagtccaagcaggtggtcctcatcgacagctcctacctgtgccaattctgccccagcaaattcagcacctacttccagctcaagtctcacatgacccagcataagaatgagcaggtgtacaagtgtgtggtcaaaagctgtgcccagacgttcccaaagctcgacacatttctggagcacatcaagagccaccaggaggagctgagctaccgctgccacctctgcggcaaggacttcccctcgctgtacgacctgggcgtgcaccagtactcccacagcctcctgccacagcacagccccaagaaggacaatgccgtctacaagtgtgtcaaatgtgtcaacaaatactccacccctgaggccctggagcaccacctgcagaccgccactcacaacttcccctgcccacactgccagaaggtgtttccttgtgaacgctacctgcggcgtcatctgcccacccacggcagcgggggcaggttcaagtgccaagtgtgcaagaagttcttccggcgggagcattatctcaaactgcatgctcacatccactcgggtgagaagccctacaaatgctcagtgtgcgagtctgcgttcaaccgcaaggacaaactgaagagacacatgttgatccacgagcccttcaagaaatacaaatgccctttctcgacgcacacaggctgcagtaaggagttcaaccggccggacaagctgaaggcccacatcctctcccactctggcatgaagctccacaaatgcgccctgtgcagcaagtccttcagccgccgtgcccacctcgccgagcatcagcgcgcccacacgggcaactacaagttccgctgtgctggctgcgccaagggcttttcccgccacaaatacctcaaagatcaccgctgtcgtctcggcccccaaaaggacaaggacctgcaaacccggcggcccccccagaggagggcagccccccgcagttgcggcagtggtgggcgcaaggtgctgacccccttgcctgacccgctggggctggaggagctgaaggacacaggggctgggctggtgcccgaggctgtccccggcaagccgcccttcgcagagccggacgcggtgctgtccatcgttgtgggtggtgcggtgggcgcggaaactgagctggtggtacctggacacgctgaggggctgggctccaacctggctctggcggagctgcaggctggggccgagggcccatgtgccatgctcgctgtgcccgtctacatccaggcctccgagtgacggacctgaggtgtctgtttcctgggcaggcctgatgctcctgtttgggtccagggcccctgggggcagaccggtgatccttaccagtggaagcgagccatcgagccattggcagaaatcctgctgaatgtcattcagaaacctcagcccatggtcgccctcctgtgcccctctcctgccggaaagccctgcaacattctagggttgggggcagggccatccacggtttctgggcagagccatggtggcaggagagagatggctgaagcctgagcagcccagagtcccgctggtctaggctggtggtcggggcccctgggagaggagacagggcattcctccccactctgtctccaggctgcctctgggtagcctctagtctgctgttcttcaggaggcctgccataaactcttcggagtttacgtgttgcaccttttcacagacggttccccacagcatcctcagacagctctgtgatgtagcttttaggaggcactcaggtgtcacggctagactgcagctatgagacagatctggcttcaaatccaagagttgccatgcacttgctgtgtgaccttgggcaagtcacttcacttctctgagccccgtgttcctcatctgtacaatggggcttacgatactactacctcatagggttgtcctggggatccagtatgatgaagtgcgccaggggcttggcatggtgcccggcacgcagaaagtgctcaataaatgtttttgtcataacgtg

SEQ ID NO: 2984 - DNA, 3682 bp, Homo sapiens
acgtgctgtgggaatgggggattctgtgtcagagctggggggtcgggtccggtgagatggggatgcggatttagataatagggatgggaagttccgcgtgtgcggcggatataaggtcggtgtagacttggtcgttcaagtgaggcggggtccacactcggtggcccggtgactgggttatcgagtggagccagggcagcccagagatgctggggtcccgcgagcctaggttgggtttccagggctgggggctcggcggcggctcctgggcgccccctggcggccccgactcaaccgccacggctcccacaatgctcgcgtagccgggcttcggttcctgtggcggcgacggcggcggctccaagatggcgcaggcgatctttgaggccctggagggaatggacaatcagaccgttctggctgtccagtcattattggatggccaaggagcagtccctgatccgacaggccagagtgtcaatgcgccccctgctatccagccattggatgacgaggatgtatttctctgcgggaagtgtaagaagcaattcaactcgctgccagcgtttatgacccacaagcgggaacagtgccaggggaatgcccccgccctggccacagtctcactggccaccaacagcatctacccaccttcggcagcacccacagcggtccagcaggccccaactcctgccaatcgccagatctccacatacatcacagtgcccccgtccccactgatccagaccctggtgcaggggaacatcttggtgagcgatgatgtgctcatgtctgccatgtcagccttcacatccctggaccagcccatgccccagggccccccacctgtgcagagcagcctgaacatgcattccgtgcccagctacctcacccagcctccacctcctcctccacctcctccaccactgcccccaccgccaccacctcagcctccaccacctccaccccagagcctgggcccccctgggcgtcccaaccctggtgggaacggtgtggtggaggtgtacagtgctgctgcgcccctggctgggagtggaacggtggagatccaggcactggggatgcagccctacccacccctagaggtgccaaaccagtgtgtggagcctccagtatatcccacccccacagtgtacagccctggcaaacagggattcaaacccaaaggaccaaaccccgccgcccccatgaccagcgccaccgggggcacggtggccacctttgactctccagcaacgctgaagacccgacgagctaaaggtgccaggggactcccggaagctgcagggaagccaaaggctcagaaactcaagtgctcatactgtgacaagtcattcaccaaaaactttgacctgcagcagcacatccgaagccacaccggtgagaagcccttccagtgcattgcatgtggccgtgcctttgcccagaagtctaatgttaagaaacacatgcagacccacaaggtgtggcctccaggacacagtggtggcaccgtgtctcgaaactctgtgaccgtacaggtcatggccctgaaccccagcaggcaggaggacgaggaaagcacagggttgggccagcccctgccgggtgcgccacagccccaggccttgtccacagctggtgaggaagagggggacaagccggagtccaagcaggtggtcctcatcgacagctcctacctgtgccaattctgccccagcaaattcagcacctacttccagctcaagtctcacatgacccagcataagaatgagcaggtgtacaagtgtgtggtcaaaagctgtgcccagacgttcccaaagctcgacacatttctggagcacatcaagagccaccaggaggagctgagctaccgctgccacctctgcggcaaggacttcccctcgctgtacgacctgggcgtgcaccagtactcccacagcctcctgccacagcacagccccaagaaggacaatgccgtctacaagtgtgtcaaatgtgtcaacaaatactccacccctgaggccctggagcaccacctgcagaccgccactcacaacttcccctgcccacactgccagaaggtgtttccttgtgaacgctacctgcggcgtcatctgcccacccacggcagcgggggcaggttcaagtgccaagtgtgcaagaagttcttccggcgggagcattatctcaaactgcatgctcacatccactcgggtgagaagccctacaaatgctcagtgtgcgagtctgcgttcaaccgcaaggacaaactgaagagacacatgttgatccacgagcccttcaagaaatacaaatgccctttctcgacgcacacaggctgcagtaaggagttcaaccggccggacaagctgaaggcccacatcctctcccactctggcatgaagctccacaaatgcgccctgtgcagcaagtccttcagccgccgtgcccacctcgccgagcatcagcgcgcccacacgggcaactacaagttccgctgtgctggctgcgccaagggcttttcccgccacaaatacctcaaagatcaccgctgtcgtctcggcccccaaaaggacaaggacctgcaaacccggcggcccccccagaggagggcagccccccgcagttgcggcagtggtgggcgcaaggtgctgacccccttgcctgacccgctggggctggaggagctgaaggacacaggggctgggctggtgcccgaggctgtccccggcaagccgcccttcgcagagccggacgcggtgctgtccatcgttgtgggtggtgcggtgggcgcggaaactgagctggtggtacctggacacgctgaggggctgggctccaacctggctctggcggagctgcaggctggggccgagggcccatgtgccatgctcgctgtgcccgtctacatccaggcctccgagtgacggacctgaggtgtctgtttcctgggcaggcctgatgctcctgtttgggtccagggcccctgggggcagaccggtgatccttaccagtggaagcgagccatcgagccattggcagaaatcctgctgaatgtcattcagaaacctcagcccatggtcgccctcctgtgcccctctcctgccggaaagccctgcaacattctagggttgggggcagggccatccacggtttctgggcagagccatggtggcaggagagagatggctgaagcctgagcagcccagagtcccgctggtctaggctggtggtcggggcccctgggagaggagacagggcattcctccccactctgtctccaggctgcctctgggtagcctctagtctgctgttcttcaggaggcctgccataaactcttcggagtttacgtgttgcaccttttcacagacggttccccacagcatcctcagacagctctgtgatgtagcttttaggaggcactcaggtgtcacggctagactgcagctatgagacagatctggcttcaaatccaagagttgccatgcacttgctgtgtgaccttgggcaagtcacttcacttctctgagccccgtgttcctcatctgtacaatggggcttacgatactactacctcatagggttgtcctggggatccagtatgatgaagtgcgccaggggcttggcatggtgcccggcacgcagaaagtgctcaataaatgtttttgtcataacgtg

SEQ ID NO: 2985 - DNA, 3632 bp, Homo sapiens
gtagtcttttttttgcagaatgggccaaggggacagagacttcactcgggagccagaacctgttttcaacatgggtattttaagaagagacggagaggctgtcactgcagtggtcactgtcctggaaaagtaaccgttgcacggcccagaagtggctctgtggcggccaatgggagccgaagcctgcgaggatgttgggaattgtagttctggcgtcggtcggtggccgagatcccgggcacgctggctctggtccaccttctccaatccctgcctgctgggagaggacgatctcttgagaaaggaaagacttctgtgctcccgagaacttcctatcaggtcctggctgcagggaaacaagctgggctttttataattaaggttggaagaagtcaccacaggcagcagaactccatcttgagatgaaataacatctacctggacctctggcagaatttcaaggcacacactgggctgactctggcgccatgatgttgccttatccttcagcactgggagatcaatactgggaagagattttgcttccaaagaatggggaaaatgtagagactatgaagaaattgacccaaaatcataaagcgaaaggcttgccttctaatgatactgactgcccccagaaaaaggagggaaaggcccaaatagtggtaccagttacattcagggatgtgactgtgatcttcacagaagcagaatggaagagactgagtccagagcagaggaatctatacaaagaagtgatgctggagaattacaggaatcttctctcattggcagaaccaaagccagaaatctacacttgttcctcctgccttctggccttctcctgtcagcagttcctcagtcaacatgtacttcagatcttcctgggcttatgtgcagaaaatcacttccatccagggaattctagcccagggcattggaaacagcaggggcagcagtattcccatgtaagctgttggtttgaaaatgcagaaggtcaggagagaggaggtggctccaaaccctggtctgcaaggacagaggagagagaaacctcaagggcattccccagcccactccaaagacagtcagcaagtcctagaaaaggcaacatggtggtagaaacagagcccagctcagcccaaagaccaaaccctgtgcagctagacaaaggcttgaaggaattagaaaccttgagatttggagcaatcaactgtagagagtatgaaccggaccataacctggaatcaaactttattacaaacccgaggaccctcttagggaagaagccctacatttgcagtgattgtgggcgaagctttaaagatagatcaaccctcatcagacaccatcgtatacactcgatggagaagccttatgtgtgcagtgagtgcgggcgaggttttagccagaagtccaacctcagcagacaccagagaacacattcagaagagaagccttatttgtgcagggagtgtgggcaaagctttagaagtaagtccatcctcaatagacatcagtggactcactcagaggagaagccctatgtttgcagcgagtgtgggcgaggctttagcgagaagtcatccttcatcagacaccagaggacacactccggtgagaaaccctatgtgtgcctggagtgtggacgaagcttttgtgataagtcaaccctcagaaaacaccagaggatacactcaggggagaagccttatgtttgcagggagtgtgggcgaggctttagccagaactcagatctcatcaaacaccagaggacacacttggatgagaagccttatgtttgcagggagtgtgggcgaggcttttgtgacaagtcaaccctcatcatacacgagcggacgcactctggagagaagccttatgtgtgtggtgagtgtggccgaggctttagtcggaaatcactcctccttgtccaccagaggacacactcaggggagaagcattatgtctgcagggagtgtaggcgaggttttagccagaagtcaaatctcatcagacaccagaggacgcactcaaatgagaagccttatatttgcagggaatgtgggcgaggcttttgtgacaagtcaaccctcattgtacatgagaggacacactcaggagagaagccttacgtgtgcagtgagtgtggccgaggctttagccggaaatcactcctccttgtccaccagaggacacactcaggggagaagcattatgtttgtagggagtgtgggcgaggctttagtcataagtcaaatctcatcagacaccagaggacacactgacgggagaaacctgtgtatgcaggggtcatgaacaagacctgagtgaccagtcaagcctcatgttaccccagagagacacatggggagtagaccctgtgtacacagattgtgagtgaagttccagagatgtgtcagcccttatcaggcatgggagggacacgttcaggagaggagccttatgagtatagagtacgggcaactgtagccatcagtcagccttgagcatgcacaaaaggacacacttaggagagaagtttatgtgtagggactgtgggaaggctttagcaataatcaacatttaccagacatccaatgacagcctcaggggaaagcacccttgtctggggagtgttggggagcatcagtaaaagaatggacactcaggcacagagtggccctcaggaaggaggtctttgtttgtaggatgtatgggcaaagcttttgtgatcacacaccacagggagaatctgcatgtggggacactgtggagctctgcccagatgaccttttcaggggtaacaccccagctgcttgagagaacagtgttgctgctggcagagatgcattccagagatgcactccgctctggaactcactctcagccacagggagctgcatgcaccacaggggcaatgcacctttgcaggggtaccttctggccccaacccttgactcaacggggacaactccagaaggtcattccagatccagagatccccatcgaactgaaggatcactgggttgcagacacattgcaggtcagcttcttcctctgcccagtcctgccctcactccccagtgaatcctcaattttctgtctcgttgtctgtccagataattgattctaagacatgttaggtatataaggagtgtagataaggcttcagccatgagtcaccccgcagtaagccccagagtatattgaatagaaattctgcatgtgtggggagaatggacaaggacttaggaaaaagtcctcatcaaagaacagcttttttgggacaagctttacatgggtggggagggaaaatgtgaaacacattagcaataagttaaacctcatcttgtactaaaggaggacacactcagggagaagacctctgtgggcagggcttgtgggtggagcttcatcccgatgtcactcctcaactgacttaggaggacagtcttgctaccccaagtcactacctcactcacctctgagggattttcaggaaatgtcttgactcccccatgtactctgtatgtgagcgaagatggcagtaactgttaaataagcattcttttctacttcttggaatcagatgaaataaaaaagcaggctttatttaagtaatcaaaaaa

SEQ ID NO: 2986 - DNA, 768 bp, Homo sapiens
gattcggggcaggggcaggcagtggggggacagcctggaaccagaacgcgaaacccagcctcacggtccaccttctccaatccctgcctgctgggagaggacgatctcttgagaaaggaaagacttctgtgctcccgagaacttcctatcagtagaaccacagtccctcttcggacatgctgttctcagaacaaaagaaatggtggaattatgcaatgcttagaaatggcatcgtcgctttcactcacattcattttccaaggtcctggctgcagggaaacaagctgggctttttataattaaggttggaagaagtcaccacaggcagcagaactccatcttgagatgaaataacatctacctggacctctggcagaatttcaaggcacacactgggctgactctggcgccatgatgttgccttatccttcagcactgggagatcaatactgggaagagattttgcttccaaagaatggggaaaatgtagagactatgaagaaattgacccaaaatcataaagcgaaaggcttgccttctaatgatactgactgcccccagaaaaaggagggaaaggcccaaatagtggtaccagttacattcagggatgtgactgtgatcttcacagaagcagaatggaagagactgagtccagagcagaggaatctatacaaagaagtgatgctggagaattacaggaatcttctctcattgggtcaggagatcgagaccatcctggccaacatagtgaaatcccatctctactaa

SEQ ID NO: 2987 - DNA, 642 bp, Homo sapiens
atcccgggcacgctggctctggtgagcgcggcctccgcggctccttggccccaggatgccctctctcgtggggaaaggagggtcgggaaaggccgagcgtaggtccaccttctccaatccctgcctgctgggagaggacgatctcttgagaaaggaaagacttctgtgctcccgagaacttcctatcaggtcctggctgcagggaaacaagctgggctttttataattaaggttggaagaagtcaccacaggcagcagaactccatcttgagatgaaataacatctacctggacctctggcagaatttcaaggcacacactgggctgactctggcgccatgatgttgccttatccttcagcactgggagatcaatactgggaagagattttgcttccaaagaatggggaaaatgtagagactatgaagaaattgacccaaaatcataaagcgaaaggcttgccttctaatgatactgactgcccccagaaaaaggagggaaaggcccaaatagtggtaccagttacattcagggatgtgactgtgatcttcacagaagcagaatggaagagactgagtccagagcagaggaatctatacaaagaagtgatgctggagaattacaggaatcttctctcattgg

SEQ ID NO: 2988 - DNA, 1028 bp, Homo sapiens
cctttctgaaaggcctccagatcctctgcgaaggccccctgggctcccccggcggggcccgcagctctcccccgcgctgaatctgaggaactgggcccggaagctcgcgagtctcggtcctggcggttcgggcgggcgccccctgttggccaagttgggacttgccattgcggcaaaacctgcgattcggggcaggggcaggcagtggggggacagcctggaaccagaacgcgaaacccagcctcacggtccaccttctccaatccctgcctgctgggagaggacgatctcttgagaaaggaaagacttctgtgctcccgagaacttcctatcagtagaaccacagtccctcttcggacatgctgttctcagaacaaaagaaatggtggaattatgcaatgcttagaaatggcatcgtcgctttcactcacattcattttccaaggtcctggctgcagggaaacaagctgggctttttataattaaggttggaagaagtcaccacaggcagcagaactccatcttgagatgaaataacatctacctggacctctggcagaatttcaaggcacacactgggctgactctggcgccatgatgttgccttatccttcagcactgggagatcaatactgggaagagattttgcttccaaagaatggggaaaatgtagagactatgaagaaattgacccaaaatcataaagcgaaaggcttgccttctaatgatactgactgcccccagaaaaaggagggaaaggcccaaatagtggtaccagttacattcagggatgtgactgtgatcttcacagaagcagaatggaagagactgagtccagagcagaggaatctatacaaagaagtgatgctggagaattacaggaatcttctctcattggcagaaccaaagccagaaatctacacttgttcctcctgccttctggccttctcctgtcagcagttcctcagtcaacatgtacttcagatcttcctgggcttatgtgcagaaaatcacttccatccagggaa

SEQ ID NO: 2989 - DNA, 533 bp, Homo sapiens
acggcattgaccctaccgttgtctgtgatgcccggattaagcaggatgccctagacttctctgaccttcctctccctgccctgcttggatagaggcctccgaacaggagtaaagaatggctgttgaacatccacaaggcacctgcaagactatgaatcaaagttgagaccaagaaattatttctgaaaaaggatatggaaaaccttacaaaacacagcattgagtgttcaagtttcagaggtgattgggaatgtaaaaaccagtttgagagaaaacagggatctcaggaaggacatttcagtgaaatgatatttactcctgaagacatgcccactttcagtatccagcatcagagaattcatactgatgagaaactccttgaatgtaaggaatgtgggaaggattttagttttgtatcagtccttgttcgacatcagcgaattcatactggtgagaaaccttatgaatgcaaagaatgtggcaaggcctttggtagtggtgcaaaccttgcttaccatcaaagaattcatact

SEQ ID NO: 2990 - DNA, 1382 bp, Homo sapiens
gttgaacatccacaaggcacctgcaagactatgaatcaaagttgagaccaagaaattatttctgaaaaaggatatggaaaaccttacaaaacacagcattgagtgttcaagtttcagaggtgattgggaatgtaaaaaccagtttgagagaaaacagggatctcaggaaggacatttcagtgaaatgatatttactcctgaagacatgcccactttcaattcatactggtgagaaaccttatgaatgcaaagcatgtggaatggcctttagcagtggttcggctcttactcggcatcagagaattcataccggtgagaaaccatatatatgtaatgaatgtggtaaggcctttagttttggatcagcccttactcgacatcaaagaattcatactggtgagaaaccttatgtatgtaaggaatgtgggaaggcttttaatagtggctcagatctcactcagcatcagagaattcacactggtgagaaaccctatgagtgtaaggagtgtgagaaagcctttagaagtggttcaaaacttattcagcatcaaagaatgcatactggagagaaaccttatgaatgtaaggaatgtgggaagacctttagtagtggttcagaccttactcaacatcacagaattcatactggtgagaaaccctatgaatgtaaggaatgtgggaaggcctttggtagtggctcaaaacttatccaacaccagctaatccatactggtgaaagaccctatgaatgtaaagaatgtggaaagtcctttagtagtggttcagctcttaatcggcaccagagaatacacactggtgagaaaccctatgaatgtaaggagtgtgggaaggctttttatagtggctcaagccttactcagcatcagagaattcatacaggtgagaaactttatgaatgtaagaactgtgggaaggcttatgggagggattcagagtttcagcaacataagaaaagtcataatggtaagaaactctgcgaattggaaactataaattgaaattatgtgctgaaggaaggactctaaacatatgacttaagaaaattcatagtggtgaaaatctctacaaatagaactaaggtacaaatgccttacttatgcttcacaggttagtcagtctaagaatatttatacaggaaaaaaatcaccccaaataaaataaatatttgaagatccttatctatattcattccttcattacttttggaaaattcttacttgtgaatgttaaaaatgaaaaaaaaatcatttattatattttgcctcaactttaaacattggaaaactcatttctgggttaatcctactatattttttcaatggtcttttttttttgtattatacagaattactgattcattg

SEQ ID NO: 2991 - DNA, 1971 bp, Homo sapiens
ggccttggggctttgtgagatagctagggtcgacttgtgtggattctagtagaacggagctgaccctatccgaacaggcccctgccctgcttggatagaggcctccgaacaggagtaaagaatggctgttgaacatccacaaggcacctgcaagactatgaatcaaagttgagaccaagaaattatttctgaaaaaggatatggaaaaccttacaaaacacagcattgagtgttcaagtttcagaggtgattgggaatgtaaaaaccagtttgagagaaaacagggatctcaggaaggacatttcagtgaaatgatatttactcctgaagacatgcccactttcagtatccagcatcagagaattcatactgatgagaaactccttgaatgtaaggaatgtgggaaggattttagttttgtatcagtccttgttcgacatcagcgaattcatactggtgagaaaccttatgaatgcaaagaatgtggcaaggcctttggtagtggtgcaaaccttgcttaccatcaaagaattcatactggtgagaagccttttgaatgtaaagaatgtgggaaggcctttggtagtggctcaaaccttactcaccatcagagaattcatactggtgagaaaccctatgagtgtaaggaatgtgggaaagcctttagttttggatcaggccttattcgacatcagatcattcacagtggtgagaagccttatgagtgtaaggaatgtgggaagtcctttagttttgaatcagcccttattcggcatcacagaattcacacaggtgagaaaccttatgaatgtatagattgtggtaaagcctttggcagtggttcaaaccttactcaacatcggcggattcatactggtgagaaaccttatgaatgcaaagcatgtggaatggcctttagcagtggttcggctcttactcggcatcagagaattcataccggtgagaaaccatatatatgtaatgaatgtggtaaggcctttagttttggatcagcccttactcgacatcaaagaattcatactggtgagaaaccttatgtatgtaaggaatgtgggaaggcttttaatagtggctcagatctcactcagcatcagagaattcacactggtgagaaaccctatgagtgtaaggagtgtgagaaagcctttagaagtggttcaaaacttattcagcatcaaagaatgcatactggagagaaaccttatgaatgtaaggaatgtgggaagacctttagtagtggttcagaccttactcaacatcacagaattcatactggtgagaaaccctatgaatgtaaggaatgtgggaaggcctttggtagtggctcaaaacttatccaacaccagctaatccatactggtgaaagaccctatgaatgtaaagaatgtggaaagtcctttagtagtggttcagctcttaatcggcaccagagaatacacactggtgagaaaccctatgaatgtaaggagtgtgggaaggctttttatagtggctcaagccttactcagcatcagagaattcatacaggtgagaaactttatgaatgtaagaactgtgggaaggcttatgggagggattcagagtttcagcaacataagaaaagtcataatggtaagaaactctgcgaattggaaactataaattgaaattatgtgctgaaggaaggactctaaacatatgacttaagaaaattcatagtggtgaaaatctctacaaatagaactaaggtacaaatgccttacttatgcttcacaggttagtcagtctaagaatatttatacaggaaaaaaatcaccccaaataaaataaatatttgaagatccttatctatattcattccttcattacttttggaaaattcttacttgtgaatgttaaaaatgaaaaaaaaatcatttattatattttgcctcaactttaaacattggaaaactcatttctgggttaatc

SEQ ID NO: 2992 - DNA, 3527 bp, Homo sapiens
tttaattgtgaccgggttgggcactgtgtttgcgagtgtgaggttcctggaccgcggttgtgactgtatgtccccttggggtgtgtgtgtgtgtgtttactaccatttgccgaactgtgtgtagtatgccttaattttgaggtttgtggctgcttccgtgtgtgtgtgtgcgcgcgcgttggtgatattgttgatggagggtgcgtgtgaatttgttgtcattgtgaccccaaggtgtatgtcactgggaatttgagagatgcccacggactctgtggttgtgtccgtgtctacccccgtggtgtgtatgagtgtgtgattgtgtgttgtgtttaggtttggggtgcctgtgacgtttatgtccctgcggtgtgagtgagtttgtgtgactatgtgtccgtatagccaatgtaggtatggggagtctttgtctttgtgacttcagccattggagacccctgtgagctcagggacaggttctgcccagaacggcattgaccctaccgttgtctgtgatgcccggattaagcaggatgccctagacttctctgaccttcctctgtaggtgatgggcagtaggggctgagcaaagataacttctgacatagtcaaaccaactccctctcagaagaacctgatgtttcctgactgctttctccttcctcagccctgccctgcttggatagaggcctccgaacaggagtaaagaatggctgttgaacatccacaaggcacctgcaagactatgaatcaaagttgagaccaagaaattatttctgaaaaaggatatggaaaaccttacaaaacacagcattgagtgttcaagtttcagaggtgattgggaatgtaaaaaccagtttgagagaaaacagggatctcaggaaggacatttcagtgaaatgatatttactcctgaagacatgcccactttcagtatccagcatcagagaattcatactgatgagaaactccttgaatgtaaggaatgtgggaaggattttagttttgtatcagtccttgttcgacatcagcgaattcatactggtgagaaaccttatgaatgcaaagaatgtggcaaggcctttggtagtggtgcaaaccttgcttaccatcaaagaattcatactggtgagaagccttttgaatgtaaagaatgtgggaaggcctttggtagtggctcaaaccttactcaccatcagagaattcatactggtgagaaaccctatgagtgtaaggaatgtgggaaagcctttagttttggatcaggccttattcgacatcagatcattcacagtggtgagaagccttatgagtgtaaggaatgtgggaagtcctttagttttgaatcagcccttattcggcatcacagaattcacacaggtgagaaaccttatgaatgtatagattgtggtaaagcctttggcagtggttcaaaccttactcaacatcggcggattcatactggtgagaaaccttatgaatgcaaagcatgtggaatggcctttagcagtggttcggctcttactcggcatcagagaattcataccggtgagaaaccatatatatgtaatgaatgtggtaaggcctttagttttggatcagcccttactcgacatcaaagaattcatactggtgagaaaccttatgtatgtaaggaatgtgggaaggcttttaatagtggctcagatctcactcagcatcagagaattcacactggtgagaaaccctatgagtgtaaggagtgtgagaaagcctttagaagtggttcaaaacttattcagcatcaaagaatgcatactggagagaaaccttatgaatgtaaggaatgtgggaagacctttagtagtggttcagaccttactcaacatcacagaattcatactggtgagaaaccctatgaatgtaaggaatgtgggaaggcctttggtagtggctcaaaacttatccaacaccagctaatccatactggtgaaagaccctatgaatgtaaagaatgtggaaagtcctttagtagtggttcagctcttaatcggcaccagagaatacacactggtgagaaaccctatgaatgtaaggagtgtgggaaggctttttatagtggctcaagccttactcagcatcagagaattcatacaggtgagaaactttatgaatgtaagaactgtgggaaggcttatgggagggattcagagtttcagcaacataagaaaagtcataatggtaagaaactctgcgaattggaaactataaattgaaattatgtgctgaaggaaggactctaaacatatgacttaagaaaattcatagtggtgaaaatctctacaaatagaactaaggtacaaatgccttacttatgcttcacaggttagtcagtctaagaatatttatacaggaaaaaaatcaccccaaataaaataaatatttgaagatccttatctatattcattccttcattacttttggaaaattcttacttgtgaatgttaaaaatgaaaaaaaaatcatttattatattttgcctcaactttaaacattggaaaactcatttctgggttaatcctactatattttttcaatggtcttttttttttgtattatacagaattactgattcattgaaaaattattttatttattgcaagtctaaatttatcctttttttctttcctgattatcctaacaccatttattcaataaccttgtccattttcatattttttttattgactatttgatggtaagttacatttttattcacataaagcttggatatcaggtcagtgtttttttgtttttgtttttgtttttgtttttttgagatggagtctcactgtcaccaggctggagtgcagtggtgcaatctcggttcactgcaacctccacctcccgagttcaagtgattttcctgcctcagctccccagtagctgggactacaggcgcccgccaccacgcccagctaattttttgtattttcattagagatggggtttcaccacgttggccaggatggtctcgatctcttgacctcgtgatccatctgcctcggcctcccaacgtgctggaattacaggcatgagccaccatgcctggcccagtgtttgttttttaaatttatatatatgtatctatgtctcatcctgtttatggtcaataactgttacttttaagtatcctttaatacctgtaccttttgttttagaagattgtttactttccttttataaaattatactctccattttagcaaaacagctttccctcatcataatgtagataaaaagaaaaaaaggatatggttacctgtaatcttaccaatcatagataatcactgtcaaacttttggagcaaatcctttaatactatctctcattgttttggaaacaaggtgtgattatgctatactataaccagcccttaatattttttgtctgtaaatatgttgttaccattttattggctttatagtattcacctgtctttatcaaaccccaattttgtcaaatattaaaaattttgccattataaa

SEQ ID NO: 2993 - DNA, 581 bp, Homo sapiens
atttgggcaagcggccttggggctttgtgagatagctagggtcgacttgtgtggattctagtagaacggagctgaccctatccgaacaggcccctgccctgcttggatagaggcctccgaacaggagtaaagaatggctgttgaacatccacaaggcacctgcaagacctctaacttcaccctggagttgagcagaaacatggcttgccttttccctcagatcagtcttggactccagacaaagggttggaactttgagccaataagcaggttactggtaacagtgcctgaggaaagacaaagctatgggtactatgaatcaaagttgagaccaagaaattatttctgaaaaaggatatggaaaaccttacaaaacacagcattgagtgttcaagtttcagaggtgattgggaatgtaaaaaccagtttgagagaaaacagggatctcaggaaggacatttcagtgaaatgatatttactcctgaagacatgcccactttcagtatccagcatcagagaattcatactgatgagaaactccttgaatgtaaggaatgtgggaaggattttagttttgtatc

SEQ ID NO: 2994 - DNA, 3120 bp, Homo sapiens
gggtgaaagaaagcttgccccagaggacttaaacaggcaagaaggacttggttaaagactattgcaatagtcaacttccaatacaacagcagctggagatttatagctaacgggctgggtgaaggagttaaaggatgctaaattactaagaggaagtgatgggcagtaggggctgagcaaagataacttctgacatagtcaaaccaactccctctcagaagaacctgatgtttcctgactgctttctccttcctcagccctgccctgcttggatagaggcctccgaacaggagtaaagaatggctgttgaacatccacaaggcacctgcaagactatgaatcaaagttgagaccaagaaattatttctgaaaaaggatatggaaaaccttacaaaacacagcattgagtgttcaagtttcagaggtgattgggaatgtaaaaaccagtttgagagaaaacagggatctcaggaaggacatttcagtgaaatgatatttactcctgaagacatgcccactttcagtatccagcatcagagaattcatactgatgagaaactccttgaatgtaaggaatgtgggaaggattttagttttgtatcagtccttgttcgacatcagcgaattcatactggtgagaaaccttatgaatgcaaagaatgtggcaaggcctttggtagtggtgcaaaccttgcttaccatcaaagaattcatactggtgagaagccttttgaatgtaaagaatgtgggaaggcctttggtagtggctcaaaccttactcaccatcagagaattcatactggtgagaaaccctatgagtgtaaggaatgtgggaaagcctttagttttggatcaggccttattcgacatcagatcattcacagtggtgagaagccttatgagtgtaaggaatgtgggaagtcctttagttttgaatcagcccttattcggcatcacagaattcacacaggtgagaaaccttatgaatgtatagattgtggtaaagcctttggcagtggttcaaaccttactcaacatcggcggattcatactggtgagaaaccttatgaatgcaaagcatgtggaatggcctttagcagtggttcggctcttactcggcatcagagaattcataccggtgagaaaccatatatatgtaatgaatgtggtaaggcctttagttttggatcagcccttactcgacatcaaagaattcatactggtgagaaaccttatgtatgtaaggaatgtgggaaggcttttaatagtggctcagatctcactcagcatcagagaattcacactggtgagaaaccctatgagtgtaaggagtgtgagaaagcctttagaagtggttcaaaacttattcagcatcaaagaatgcatactggagagaaaccttatgaatgtaaggaatgtgggaagacctttagtagtggttcagaccttactcaacatcacagaattcatactggtgagaaaccctatgaatgtaaggaatgtgggaaggcctttggtagtggctcaaaacttatccaacaccagctaatccatactggtgaaagaccctatgaatgtaaagaatgtggaaagtcctttagtagtggttcagctcttaatcggcaccagagaatacacactggtgagaaaccctatgaatgtaaggagtgtgggaaggctttttatagtggctcaagccttactcagcatcagagaattcatacaggtgagaaactttatgaatgtaagaactgtgggaaggcttatgggagggattcagagtttcagcaacataagaaaagtcataatggtaagaaactctgcgaattggaaactataaattgaaattatgtgctgaaggaaggactctaaacatatgacttaagaaaattcatagtggtgaaaatctctacaaatagaactaaggtacaaatgccttacttatgcttcacaggttagtcagtctaagaatatttatacaggaaaaaaatcaccccaaataaaataaatatttgaagatccttatctatattcattccttcattacttttggaaaattcttacttgtgaatgttaaaaatgaaaaaaaaatcatttattatattttgcctcaactttaaacattggaaaactcatttctgggttaatcctactatattttttcaatggtcttttttttttgtattatacagaattactgattcattgaaaaattattttatttattgcaagtctaaatttatcctttttttctttcctgattatcctaacaccatttattcaataaccttgtccattttcatattttttttattgactatttgatggtaagttacatttttattcacataaagcttggatatcaggtcagtgtttttttgtttttgtttttgtttttgtttttttgagatggagtctcactgtcaccaggctggagtgcagtggtgcaatctcggttcactgcaacctccacctcccgagttcaagtgattttcctgcctcagctccccagtagctgggactacaggcgcccgccaccacgcccagctaattttttgtattttcattagagatggggtttcaccacgttggccaggatggtctcgatctcttgacctcgtgatccatctgcctcggcctcccaacgtgctggaattacaggcatgagccaccatgcctggcccagtgtttgttttttaaatttatatatatgtatctatgtctcatcctgtttatggtcaataactgttacttttaagtatcctttaatacctgtaccttttgttttagaagattgtttactttccttttataaaattatactctccattttagcaaaacagctttccctcatcataatgtagataaaaagaaaaaaaggatatggttacctgtaatcttaccaatcatagataatcactgtcaaacttttggagcaaatcctttaatactatctctcattgttttggaaacaaggtgtgattatgctatactataaccagcccttaatattttttgtctgtaaatatgttgttaccattttattggctttatagtattcacctgtctttatcaaaccccaattttgtcaaatattaaaaattttgccattataaacac

SEQ ID NO: 2995 - DNA, 2349 bp, Homo sapiens
ggtttgcggggaagatggagtatcccgcgccggccacggtgcaggccgcggacggcggagcggccgggccttacagcagctcggagttgctggagggccaggagccggacggggtgcgctttgaccgcgagagggcgcgccgcctgtgggaagccgtgtccggtgcccagccggtgggtagagaggaagcgcagtttttcccacattcgaggactgtcatccctatactcgtcctgtcggagacctacagtctttgccatcccgtggagcacatgatccagaagaaccaatgtctcttcaccaacacccagtgtaaggtttgctgcgccttgcttatttctgagtcccagaagctggcacattaccagagcaaaaaacatgccaacaaagtgaagagatacctagcaatccatggaatggagacattaaagggggaaacgaagaagctagactcagatcagaagagcagcagaagcaaagacaagaaccagtgctgccccatctgtaacatgaccttttcctcccctgtcgtggcccagtcgcactacctggggaagacccacgcaaagaacttaaagctgaagcagcagtccactaaggtggaagccttgcaccagaatagagagatgatagacccagacaagttctgcagcctctgccatgcaactttcaacgaccctgtcatggctcaacaacattatgtgggcaagaaacacagaaaacaggagaccaagctcaaactaatggcacgctatgggcggctggcggaccctgctgtcactgactttccagctggaaagggctacccctgcaaaacatgtaagatagtgctgaactccatagaacagtaccaagctcatgtcagcggcttcaaacacaagaaccagtcaccaaaaacagtggcatcatccctgggccagattccaatgcaaaggcaacccattcagaaagactcaaccaccttggaagactagaggtgattctgcccagcatcccatattgggccagccatgagccagcttcccgtgactgctcagcccttggctccctcttgctcgttgttctcaccaggaaagtacacgggcctgaggcaggattgggccacagacagcctctcattggtccgggctaattcactcctgctgctcccctttggcaggggtcctgtaggtcatgacaggggaggcaagggtattgagagactcggggtctcgcggggtggtagtttggagggtggctttccccatttcccaacccctctgggccttaggtgctgaggcccctgccacctgtctttcctctaaaggtcagttttgggccagttcttgcaactaaagagcagagatctctctgggccctagacatttccagcaaaacctggaactttcatgccaaacctggggcagggcaggaaacagaggaaatggctgcaacatgggagcttggagctaatacgacactctgccttcccccagaaggtgcaggctttcctgagtcttagaccagatatggccagttgcgcaggtttctgccaactgtgaagtatcctcctggagcagtgacacaatcttggcggagcattgctacccccgctgccccctccacagttcctgaatggtgctaaggatctgcagcagttggcaacgagctggggctgggggcggcctccatgtccactgagatcataggacactccaatggggatgggacctttcccctcctccatcagaggtgctctgaccctaggttacacgggaaagtgccccacatgcaagtctccctgagggttctgcccctaaaggcagactgcctcatgcccgctagctgtgaggttcattgctaccctcggccctactagccctctcttcccccttgtgcagcggaccacttgcccagtttgctgtggtgctagccttccccatcatccaccgggtgatttctgggtcccagggaaagaaagagagagctgatgcaggtttctacagtgaggaacaggcgtttcccaggccccacacccagatttctctatctttgctgtgttttatggcctgggactgagtccacacggatagatttttccttgtaaccttgagacgagaattccaaggagtgtcaccatcagaggcttctcttcattgtgtcaaagaagcccctagctgctctcgtggcctccttcccccactccctatcccttcacctgtgaaatgcctttgctttgcatattgtgtgtggatgtgtgtgtgtgtgtgtgtgtgtttgtgtgtatgtgtgtgcttctgtgtgtgcctaatgctctgtctcttggtcactgaagcatccaaataaagaatttccctcatgggccagact

SEQ ID NO: 2996 - DNA, 2314 bp, Homo sapiens
aggcgcctgagaggctctctaccggtgagggtttgcggggaagatggagtatcccgcgccggccacggtgcaggccgcggacggcggagcggccgggccttacagcagctcggagttgctggagggccaggagccggacggggtgcgctttgaccgcgagagggcgcgccgcctgtgggaagccgtgtccggtgcccagccggtgggtagagaggaagtggagcacatgatccagaagaaccaatgtctcttcaccaacacccagtgtaaggtttgctgcgccttgcttatttctgagtcccagaagctggcacattaccagagcaaaaaacatgccaacaaagtgaagagatacctagcaatccatggaatggagacattaaagggggaaacgaagaagctagactcagatcagaagagcagcagaagcaaagacaagaaccagtgctgccccatctgtaacatgaccttttcctcccctgtcgtggcccagtcgcactacctggggaagacccacgcaaagaacttaaagctgaagcagcagtccactaaggtggaagccttgcaccagaatagagagatgatagacccagacaagttctgcagcctctgccatgcaactttcaacgaccctgtcatggctcaacaacattatgtgggcaagaaacacagaaaacaggagaccaagctcaaactaatggcacgctatgggcggctggcggaccctgctgtcactgactttccagctggaaagggctacccctgcaaaacatgtaagatagtgctgaactccatagaacagtaccaagctcatgtcagcggcttcaaacacaagaaccagtcaccaaaaacagtggcatcatccctgggccagattccaatgcaaaggcaacccattcagaaagactcaaccaccttggaagactagaggtgattctgcccagcatcccatattgggccagccatgagccagcttcccgtgactgctcagcccttggctccctcttgctcgttgttctcaccaggaaagtacacgggcctgaggcaggattgggccacagacagcctctcattggtccgggctaattcactcctgctgctcccctttggcaggggtcctgtaggtcatgacaggggaggcaagggtattgagagactcggggtctcgcggggtggtagtttggagggtggctttccccatttcccaacccctctgggccttaggtgctgaggcccctgccacctgtctttcctctaaaggtcagttttgggccagttcttgcaactaaagagcagagatctctctgggccctagacatttccagcaaaacctggaactttcatgccaaacctggggcagggcaggaaacagaggaaatggctgcaacatgggagcttggagctaatacgacactctgccttcccccagaaggtgcaggctttcctgagtcttagaccagatatggccagttgcgcaggtttctgccaactgtgaagtatcctcctggagcagtgacacaatcttggcggagcattgctacccccgctgccccctccacagttcctgaatggtgctaaggatctgcagcagttggcaacgagctggggctgggggcggcctccatgtccactgagatcataggacactccaatggggatgggacctttcccctcctccatcagaggtgctctgaccctaggttacacgggaaagtgccccacatgcaagtctccctgagggttctgcccctaaaggcagactgcctcatgcccgctagctgtgaggttcattgctaccctcggccctactagccctctcttcccccttgtgcagcggaccacttgcccagtttgctgtggtgctagccttccccatcatccaccgggtgatttctgggtcccagggaaagaaagagagagctgatgcaggtttctacagtgaggaacaggcgtttcccaggccccacacccagatttctctatctttgctgtgttttatggcctgggactgagtccacacggatagatttttccttgtaaccttgagacgagaattccaaggagtgtcaccatcagaggcttctcttcattgtgtcaaagaagcccctagctgctctcgtggcctccttcccccactccctatcccttcacctgtgaaatgcctttgctttgcatattgtgtgtggatgtgtgtgtgtgtgtgtgtgtgtttgtgtgtatgtgtgtgcttctgtgtgtgcctaatgctctgtctcttggtcactgaagcatccaaataaagaatttccctcatgggccagactacaacttaaca

SEQ ID NO: 2997 - DNA, 2774 bp, Homo sapiens
gaagatggagtatcccgcgccggccacggtgcaggccgcggacggcggagcggccgggccttacagcagctcggagttgctggagggccaggagccggacggggtgcgctttgaccgcgagagggcgcgccgcctgtgggaagccgtgtccggtgcccagccggtgggtagagaggaagcgcagtttttcccacattcgaggactgtcatccctatactcgtcctgtcggagacctacagtctttgccatcccgtggagcacatgatccagaagaaccaatgtctcttcaccaacacccagtgtaaggtttgctgcgccttgcttatttctgagtcccagaagctggcacattaccagagcaaaaaacatgccaacaaagtgaagagatacctagcaatccatggaatggagacattaaagggggaaacgaagaagctagactcagatcagaagagcagcagaagcaaagacaagaaccagtgctgccccatctgtaacatgaccttttcctcccctgtcgtggcccagtcgcactacctggggaagacccacgcaaagaacttaaagctgaagcagcagtccactaaggtggaagccttgcaccagaatagagagatgatagacccagacaagttctgcagcctctgccatgcaactttcaacgaccctgtcatggctcaacaacattatgtgggcaagaaacacagaaaacaggagaccaagctcaaactaatggcacgctatgggcggctggcggaccctgctgtcactgactttccagctggaaagggctacccctgcaaaacatgtaagatagtgctgaactccatagaacagtaccaagctcatgtcagcggcttcaaacacaagaaccagtcaccaaaaacagtggcatcatccctgggccagattccaatgcaaaggcaacccattcagaaagactcaaccaccttggaagactagagctaggggtggccgtgtcacagtctggccaaggaaatgaaattgggagttgctgtgtggaaactcaactctctggaacttcttccttcctcctgcctctgcacaaatgtgacggcagcagctgaagccaacatcttgcgaccatgagagaaaaacctggagaacggacgagtcctcaaccctgacttcagaccaacctacacccacctctggacgtggggctaagtgagagatggatacactgtttcatttaggccctgctcacttaggtttctgttattcacaccccaacgaaaccctccatggtccagggcaccgggcaaagtacagaagggcacgagtttacttcccgcttccctggagaccaccaaccctctcacccttccagcccagcctctgccacttcccagctgtcggtcctcctccaaacagacgtgcatgccaacacccggtgggtgtgaggcttgtaggcccaagtctagagaggctgagtctggcaaagcctgaaagcccctgtcctagcaagccaggccacaggtctagagtatccgagaccagtgaataaggggacggggggtgctactgaggctgtgagaagccccaggaccagcccagggtagttagaactgagtgaggttagccgggactaacctcactcagatccctcctccccagttcccctccatccactttggtttggaagcctccccagagctctcccaggctgtcatcagctctaaactctctgcctccacaaaaatgccctgggcaacctgtaactcacagccctgctgtcttcagagtataaactggagacagatgtacccagaattgaggacgggtgggaaatgaggagaaatgaaggctgaggaggggtcattctcacagtccctccctttcggtcacaggagggtgttgcccatgcttttgggtgggtcccaggcccatagctgcaaatattcatattggctactcttcagtgagcaaggggtatatgccaggcactggcattgtgcttgacatacatcatcatactgagtcctcacggaagatgtattattcccatttcacagaagatgaaactgaggcttgaggttaagtgatttgtccgtgaccacaaagagttttcgggactcaaacccagatctgtcactgggcaaggtggctcacacctataatcccagccctttgggagactgaggccagcagatctcctgtggccaggagttcaagcctggccaacaatggcaaaaccccgtctctaccaaaaatacaaaaattagctgggcgtggtggcacacacccgtaatcccagctactcaggtggctgaggcaggagaatcacttgaacccaggaggtggtggttgcagtgagcctagatcgtgccactgcattccagcctgagcgacagagtaagactctgtctccaaaaaaaacccagatctgtccgactctgacacccaacctttaatcactcactttctgtcaatgtcacctccgttttgaccagccaagctagacctccctggagcctgtggagaagccaaggtagaaaagggttggaaaagaatgataaaataggccaggtgcggtggctcaagcctgtactcccagcacttttggaggccgagacaggcagattgcttgagcccaggagttcaagaccagcctgggcaacataatgagaccctgtttcaacttaaaaaaaagaaatggtaatgaacaattgtcaattctgagcagctgggtatggtatgaccctgtgtactttttctgtattttaaaatgttctcaaaataaaacttgttt

SEQ ID NO: 2998 - DNA, 1191 bp, Homo sapiens
gagaggctctctaccggtgagggtttgcggggaagatggagtatcccgcgccggccacggtgcaggccgcggacggcggagcggccgggccttacagcagctcggagttgctggagggccaggagccggacggggtgcgctttgaccgcgagagggcgcgccgcctgtgggaagccgtgtccggtgcccagccggtgggtagagaggaagtggagcacatgatccagaagaaccaatgtctcttcaccaacacccagtgtaaggtttgctgcgccttgcttatttctgagtcccagaagctggcacattaccagagcagcagaagcaaagacaagaaccagtgctgccccatctgtaacatgaccttttcctcccctgtcgtggcccagtcgcactacctggggaagacccacgcaaagaacttaaagctgaagcagcagtccactaaggtggaagccttgcaccagaatagagagatgatagacccagacaagttctgcagcctctgccatgcaactttcaacgaccctgtcatggctcaacaacattatgtgggcaagaaacacagaaaacaggagaccaagctcaaactaatggcacgctatgggcggctggcggaccctgctgtcactgactttccagctggaaagggctacccctgcaaaacatgtaagatagtgctgaactccatagaacagtaccaagctcatgtcagcggcttcaaacacaagaaccagtcaccaaaaacagtggcatcatccctgggccagattccaatgcaaaggcaacccattcagaaagactcaaccaccttggaagactagaggtgattctgcccagcatcccatattgggccagccatgagccagcttcccgtgactgctcagcccttggctccctcttgctcgttgttctcaccaggaaagtacacgggcctgaggcaggattgggccacagacagcctctcattggtccgggctaattcactcctgctgctcccctttggcaggggtcctgtaggtcatgacaggggaggcaagggtattgagagactcggggtctcgcggggtggtagtttggagggtggctttccccatttcccaacccctctgggccttaggtgctgaggcccctgccacctgtctttcctctaaaggtcagttttgggccagttcttgcaactaaagagca

SEQ ID NO: 2999 - DNA, 1276 bp, Homo sapiens
aggcgcctgagaggctctctaccggtgagggtttgcggggaagatggagtatcccgcgccggccacggtgcaggccgcggacggcggagcggccgggccttacagcagctcggagttgctggagggccaggagccggacggggtgcgctttgaccgcgagagggcgcgccgcctgtgggaagccgtgtccggtgcccagccggtgggtagagaggaagctctgtcaaaacgccttacaaatcctttccttgtggcctccaccttagccttgcaccagaatagagagatgatagacccagacaagttctgcagcctctgccatgcaactttcaacgaccctgtcatggctcaacaacattatgtgggcaagaaacacagaaaacaggagaccaagctcaaactaatggcacgctatgggcggctggcggaccctgctgtcactgactttccagctggaaagggctacccctgcaaaacatgtaagatagtgctgaactccatagaacagtaccaagctcatgtcagcggcttcaaacacaagaaccagtcaccaaaaacagtggcatcatccctgggccagattccaatgcaaaggcaacccattcagaaagactcaaccaccttggaagactagaggtgattctgcccagcatcccatattgggccagccatgagccagcttcccgtgactgctcagcccttggctccctcttgctcgttgttctcaccaggaaagtacacgggcctgaggcaggattgggccacagacagcctctcattggtccgggctaattcactcctgctgctcccctttggcaggggtcctgtaggtcatgacaggggaggcaagggtattgagagactcggggtctcgcggggtggtagtttggagggtggctttccccatttcccaacccctctgggccttaggtgctgaggcccctgccacctgtctttcctctaaaggtcagttttgggccagttcttgcaactaaagagcagagatctctctgggccctagacatttccagcaaaacctggaactttcatgccaaacctggggcagggcaggaaacagaggaaatggctgcaacatgggagcttggagctaatacgacactctgccttcccccagaaggtgcaggctttcctgagtcttagaccagatatggccagttgcgcaggtttctgccaactgtgaagtatcctcctggagcagtgacacaatcttggcggagcattgctacccccgctgccccctccacagttcctgaat

SEQ ID NO: 3000 - DNA, 2306 bp, Homo sapiens
ggggaagatggagtatcccgcgccggccacggtgcaggccgcggacggcggagcggccgggccttacagcagctcggagttgctggagggccaggagccggacggggtgcgctttgaccgcgagagggcgcgccgcctgtgggaagccgtgtccggtgcccagccggtgggtagagaggaagtggagcacatgatccagaagaaccaatgtctcttcaccaacacccagtgtaaggtttgctgcgccttgcttatttctgagtcccagaagctggcacattaccagagcaaaaaacatgccaacaaagtgaagagatacctagcaatccatggaatggagacattaaagggggaaacgaagaagctagactcagatcagaagagcagcagaagcaaagacaagaaccagtgctgccccatctgtaacatgaccttttcctcccctgtcgtggcccagtcgcactacctggggaagacccacgcaaagaacttaaagctgaagcagcagtccactaaggtggaagctctgtcaaaacgccttacaaatcctttccttgtggcctccaccttagccttgcaccagaatagagagatgatagacccagacaagttctgcagcctctgccatgcaactttcaacgaccctgtcatggctcaacaacattatgtgggcaagaaacacagaaaacaggagaccaagctcaaactaatggcacgctatgggcggctggcggaccctgctgtcactgactttccagctggaaagggctacccctgcaaaacatgtaagatagtgctgaactccatagaacagtaccaagctcatgtcagcggcttcaaacacaagaaccagtcaccaaaaacagtggcatcatccctgggccagattccaatgcaaaggcaacccattcagaaagactcaaccaccttggaagactagaggtgattctgcccagcatcccatattgggccagccatgagccagcttcccgtgactgctcagcccttggctccctcttgctcgttgttctcaccaggaaagtacacgggcctgaggcaggattgggccacagacagcctctcattggtccgggctaattcactcctgctgctcccctttggcaggggtcctgtaggtcatgacaggggaggcaagggtattgagagactcggggtctcgcggggtggtagtttggagggtggctttccccatttcccaacccctctgggccttaggtgctgaggcccctgccacctgtctttcctctaaaggtcagttttgggccagttcttgcaactaaagagcagagatctctctgggccctagacatttccagcaaaacctggaactttcatgccaaacctggggcagggcaggaaacagaggaaatggctgcaacatgggagcttggagctaatacgacactctgccttcccccagaaggtgcaggctttcctgagtcttagaccagatatggccagttgcgcaggtttctgccaactgtgaagtatcctcctggagcagtgacacaatcttggcggagcattgctacccccgctgccccctccacagttcctgaatggtgctaaggatctgcagcagttggcaacgagctggggctgggggcggcctccatgtccactgagatcataggacactccaatggggatgggacctttcccctcctccatcagaggtgctctgaccctaggttacacgggaaagtgccccacatgcaagtctccctgagggttctgcccctaaaggcagactgcctcatgcccgctagctgtgaggttcattgctaccctcggccctactagccctctcttcccccttgtgcagcggaccacttgcccagtttgctgtggtgctagccttccccatcatccaccgggtgatttctgggtcccagggaaagaaagagagagctgatgcaggtttctacagtgaggaacaggcgtttcccaggccccacacccagatttctctatctttgctgtgttttatggcctgggactgagtccacacggatagatttttccttgtaaccttgagacgagaattccaaggagtgtcaccatcagaggcttctcttcattgtgtcaaagaagcccctagctgctctcgtggcctccttcccccactccctatcccttcacctgtgaaatgcctttgctttgcatattgtgtgtggatgtgtgtgtgtgtgtgtgtgtgtttgtgtgtatgtgtgtgcttctgtgtgtgcctaatgctctgtctcttggtcactgaagcatccaaataaagaatttccctcatg

SEQ ID NO: 3001 - DNA, 1575 bp, Homo sapiens
aggcgcctgagaggctctctaccggtgagggtttgcggggaagatggagtatcccgcgccggccacggtgcaggccgcggacggcggagcggccgggccttacagcagctcggagttgctggagggccaggagccggacggggtgcgctttgaccgcgagagggcgcgccgcctgtgggaagccgtgtccggtgcccagccggtgggtagagaggaagctggaaagggctacccctgcaaaacatgtaagatagtgctgaactccatagaacagtaccaagctcatgtcagcggcttcaaacacaagaaccagtcaccaaaaacagtggcatcatccctgggccagattccaatgcaaaggcaacccattcagaaagactcaaccaccttggaagactagagctaggggtggccgtgtcacagtctggccaaggaaatgaaattgggagttgctgtgtggaaactcaactctctggaacttcttccttcctcctgcctctgcacaaatgtgacggcagcagctgaagccaacatcttgcgaccatgagagaaaaacctggagaacggacgagtcctcaaccctgacttcagaccaacctacacccacctctggacgtggggctaagtgagagatggatacactgtttcatttaggccctgctcacttaggtttctgttattcacaccccaacgaaaccctccatggtccagggcaccgggcaaagtacagaagggcacgagtttacttcccgcttccctggagaccaccaaccctctcacccttccagcccagcctctgccacttcccagctgtcggtcctcctccaaacagacgtgcatgccaacacccggtgggtgtgaggcttgtaggcccaagtctagagaggctgagtctggcaaagcctgaaagcccctgtcctagcaagccaggccacaggtctagagtatccgagaccagtgaataaggggacggggggtgctactgaggctgtgagaagccccaggaccagcccagggtagttagaactgagtgaggttagccgggactaacctcactcagatccctcctccccagttcccctccatccactttggtttggaagcctccccagagctctcccaggctgtcatcagctctaaactctctgcctccacaaaaatgccctgggcaacctgtaactcacagccctgctgtcttcagagtataaactggagacagatgtacccagaattgaggacgggtgggaaatgaggagaaatgaaggctgaggaggggtcattctcacagtccctccctttcggtcacaggagggtgttgcccatgcttttgggtgggtcccaggcccatagctgcaaatattcatattggctactcttcagtgagcaaggggtatatgccaggcactggcattgtgcttgacatacatcatcatactgagtcctcacggaagatgtattattcccatttcacagaagatgaaactgaggcttgaggttaagtgatttgtccgtgaccacaaagagttttcgggactcaaacccagatctgtcactgggcaaggtggctcacaccta

SEQ ID NO: 3002 - DNA, 4230 bp, Homo sapiens
acgcgcagttttctgcagttccggaagcggatcgtgttgggtgcgggtgacgccgccgagcgaagaacccttgaagaagaggaagaggaaagaaagacaagtcaggcatggctctcacccagggacaggtgacattcagggatgtggctatagaattctctcaggaggagtggacatgcctggaccccgctcagaggactttgtacagggacgtgatgttggagaattataggaacctggcctccctgggaatctcttgttttgacctcagtattatctctatgttggagcaagggaaggagcctttcactttggagagccaagtacaaatagcaggaaacccagatggatgggaatggatcaaagctgtgatcacagctctctcttccgaatttgtaatgaaagatttactacacaaagggaagagtaatacaggagaagtattccaaacagtgatgttggaaagacaggaaagccaagacattgaaggatgttccttcagggaagtccagaaaaatacacatggccttgagtatcaatgcagagatgctgaaggaaattacaaaggagtgcttttgacccaagaaggcaatctcactcatggaagagatgaacatgataaaagagatgcaagaaacaagcttattaaaaatcagcttggattaagccttcagtcacatctgcctgaactgcagctttttcaatatgaagggaaaatttatgaatgtaatcaggttgagaagtctttcaacaataattcctcagtttcaccacctcaacaaatgccttataatgtcaaaacccacatttctaagaaatatctcaaagattttatctcttctttattactcacacaggggcaaaaagcaaataattggggaagcccttacaaatctaatggatgtggcatggtctttcctcaaaattcacaccttgcaagtcatcagagaagtcatactaaagagaaaccttacaaatgttatgagtgtggcaaagcctttagaacacgttcaaacctaactacccatcaggtgatccatactggcgaaaaacgttacaaatgtaatgagtgtggtaaggtctttagtcgaaattcacaactctcacaacatcagaaaattcacactggagagaaaccttataaatgtaacgaatgtggcaaggtcttcactcagaattcacaccttgtaagacatcgaggaattcatactggagagaaaccttacaagtgtaatgagtgtgggaaagcctttagagctcgttcaagcttagctatccatcaggcaacccacagtggagaaaaaccttacaaatgtaatgaatgtggcaaggtcttcactcaaaattcacaccttacaaatcactggagaattcacactggagagaaaccttacaagtgtaatgagtgcggcaaagcctttggtgttcgttcaagcctagctattcatctggtaattcacaccggagaaaagccttacaaatgtcatgaatgcggcaaggtctttaggcgtaattcacaccttgcaaggcatcagctaattcatactggagagaaaccttataagtgtaatgagtgtggcaaagcctttagagcacattcaaacctaactacccatcaggtcatccatactggagaaaagccttacaaatgtaatgaatgtggcaaggtcttcactcaaaattcacaccttgcaaatcatcaaagaattcatactggagtgaagccttatatgtgtaatgagtgcggcaaagccttcagtgtgtattcaagcctaactacccatcaggtcatccatactggagaaaaaccttacaaatgtaatgagtgtggcaaggtcttcactcagaattcacaccttgcaagacatcggggaattcatactggagagaaaccttataaatgtaatgaatgtggcaaggtctttaggcataattcatacctttcaaggcatcagcgaattcatactggagagaaaccttacaagtataatgagtatggcaaagcctttagtgaacattcaaacctaactacccatcaggtcatccatactggtgaaaaaccttacaaatgtaatgagtgtggcaaggtcttcactcagaattcacaccttgcaagacatcggagagttcatactggaggtaaaccttaccagtgtaatgaatgtggcaaagcctttagtcaaacatcaaagcttgcaaggcatcagagagttcatactggagagaaaccatatgagtgtaatcagtgtgggaaagcctttagtgtccgttcaagcctaactacccatcaggcaatccatactggaaaaaaaccttacaaatgcaatgagtgtgggaaggtcttcactcagaattcacaccttgcaagacatcggggaattcatactggagagaaaccttacaagtgtaatgagtgtggcaaagcctttagtcaaacttcaaaacttgcaaggcatcagagaattcataccggagagaaaccatatgagtgtgggaaaccctttagtatctgttcaagcctaactacccatcagacaatccatactggtgggaaaccttacaaatgtaacgtgtggaaagttctaaagtcagagttcaaaccttgcaagccatcacagaattcatagtggagagaaaccttacaaatgaaggtggtaacttttgcagttagaattcattcctttgacaacgtcagagaatttatgcctgagagattccttgaaaatgcaatgactggctgggtgcagtggctcatgcctgtaatcccaacactttgggagtccgaggcaggtggatcacctgaggtcaggagttcaagaccagcctgaccaacatggcgaaaccccatttctactaaaagtacacaattagctaggcctggtggcgtgcgcctgtaatcccagctatataggaggctgaggcaggagaatcacttgaacccaggaggcggaggttgcagtgagccaagatcgtgccaatgcactccatcctgggcaaaaagagcaaaactccatcttaaaggaaaaaaaaaaaatgcaatgactgtggcaaactcctcatgagttcaagtattaatagacatccaagagtccataataatgagaaatcacataaatgtactgtgtgtgacagaggctttattcaggcctcacagctttgcaggcattaaaatctacgtatttgatggaaccacacaaatgtaatgtgtaagagcatcctgaagctcttactctaagactgtaactgtaggtgaggattcatacaaagagtgactcagtctctagttctttgattcacttttaaaatgataaactgcacaataattacacgttccaatatggtaaaacttaagacattatatatttcaaaggtcaaaggacatttggaaatggctacttaccttcaggttataaaatcttttattccattgtttgaggtttctcaaaaaggctactgtttgtgactttcaacctgaactatggatctgtggctattttgcatccttaagcacctttcgtggtgcctatctgggaaagaaccacagtatggaaaggcttacttcattacatgaggatcatttttatccatgtttattgaagaaggaggactctgccttgtaaaattaaatattctctcaattgagagaccatggttttggggcagaaaataatgtaaaactatgatatcaatcatcatactgattgtgttcagggtgcttttctgagagaaagacaccatgggttttagggaagtaaggctctacctgcattgagcaggccaagacctcaggacactggaatttttatgagaggagagtaataagttattagtgactgattatgtgatgggaatagtgcaggggaaatggttgccactttctctactgaatggcaatagctgttttatagcagagattgatgaaaaataggcttatttttgaaattgaagaggtaacagttattagagtggagagcttggtcagaaaaaccagaataccatggttttttttgttttgttttgtttttagtagaattcacactaattgctggaattacattttgctacagttttattaagaatgtgtcacagacataatgttttgctaaaaaaaattcaacgttttcttataactataaacaaatcacattctttgtaccaacatcattttatcctacctcagtaggatacttcatagcagataataacaatacactcagtcttttaggttgg

SEQ ID NO: 3003 - DNA, 279 bp, Homo sapiens
agtcgaaattcacaactctcacaacatcagaaaattcacactggagagaaaccttataaatgtaacgaatgtggcaaggtcttcactcagaattcacaccttgtaagacatcgaggaattcatactggagagaaaccttacaagtgtaatgagtgtgggaaaccctttagtatctgttcaagcctaactacccatcagacaatccatactggtgggaaaccttacaaatgtaacgtgtggaaagttctaaagtcagagttcaaaccttgcaagccatca

SEQ ID NO: 3004 - DNA, 4553 bp, Homo sapiens
tttctgcagttccggaagcggatcgtgttgggtgcgggtgacgccgccgagcgtgagtgtccctcagtatggattaaacttgcgaaccgccgtgccccgtttccgcagccagttcccgggctcgctacagacctttttttttttctttttttttttttttggtgagacggagatttactcttgttgtccaggctggagtgcaatggcgcgatttcggctcaccgcatcctccgcctcccaggttcaagcgattctcctgcctcagcctcccgagtagctgggattacaggcatgtgccaccacgcccggctaattttgtatttttagtagagacggggtttcaccgtgttgcccaggctgatctcgaactcctgacctcaggaagaacccttgaagaagaggaagaggaaagaaagacaagtcaggcatggctctcacccagggacaggtgacattcagggatgtggctatagaattctctcaggaggagtggacatgcctggaccccgctcagaggactttgtacagggacgtgatgttggagaattataggaacctggcctccctggcaggaatctcttgttttgacctcagtattatctctatgttggagcaagggaaggagcctttcactttggagagccaagtacaaatagcaggaaacccagatggatgggaatggatcaaagctgtgatcacagctctctcttccgaatttgtaatgaaagatttactacacaaagggaagagtaatacaggagaagtattccaaacagtgatgttggaaagacaggaaagccaagacattgaaggatgttccttcagggaagtccagaaaaatacacatggccttgagtatcaatgcagagatgctgaaggaaattacaaaggagtgcttttgacccaagaaggcaatctcactcatggaagagatgaacatgataaaagagatgcaagaaacaagcttattaaaaatcagcttggattaagccttcagtcacatctgcctgaactgcagctttttcaatatgaagggaaaatttatgaatgtaatcaggttgagaagtctttcaacaataattcctcagtttcaccacctcaacaaatgccttataatgtcaaaacccacatttctaagaaatatctcaaagattttatctcttctttattactcacacaggggcaaaaagcaaataattggggaagcccttacaaatctaatggatgtggcatggtctttcctcaaaattcacaccttgcaagtcatcagagaagtcatactaaagagaaaccttacaaatgttatgagtgtggcaaagcctttagaacacgttcaaacctaactacccatcaggtgatccatactggcgaaaaacgttacaaatgtaatgagtgtggtaaggtctttagtcgaaattcacaactctcacaacatcagaaaattcacactggagagaaaccttataaatgtaacgaatgtggcaaggtcttcactcagaattcacaccttgtaagacatcgaggaattcatactggagagaaaccttacaagtgtaatgagtgtgggaaagcctttagagctcgttcaagcttagctatccatcaggcaacccacagtggagaaaaaccttacaaatgtaatgaatgtggcaaggtcttcactcaaaattcacaccttacaaatcactggagaattcacactggagagaaaccttacaagtgtaatgagtgcggcaaagcctttggtgttcgttcaagcctagctattcatctggtaattcacaccggagaaaagccttacaaatgtcatgaatgcggcaaggtctttaggcgtaattcacaccttgcaaggcatcagctaattcatactggagagaaaccttataagtgtaatgagtgtggcaaagcctttagagcacattcaaacctaactacccatcaggtcatccatactggagaaaagccttacaaatgtaatgaatgtggcaaggtcttcactcaaaattcacaccttgcaaatcatcaaagaattcatactggagtgaagccttatatgtgtaatgagtgcggcaaagccttcagtgtgtattcaagcctaactacccatcaggtcatccatactggagaaaaaccttacaaatgtaatgagtgtggcaaggtcttcactcagaattcacaccttgcaagacatcggggaattcatactggagagaaaccttataaatgtaatgaatgtggcaaggtctttaggcataattcatacctttcaaggcatcagcgaattcatactggagagaaaccttacaagtataatgagtatggcaaagcctttagtgaacattcaaacctaactacccatcaggtcatccatactggtgaaaaaccttacaaatgtaatgagtgtggcaaggtcttcactcagaattcacaccttgcaagacatcggagagttcatactggaggtaaaccttaccagtgtaatgaatgtggcaaagcctttagtcaaacatcaaagcttgcaaggcatcagagagttcatactggagagaaaccatatgagtgtaatcagtgtgggaaagcctttagtgtccgttcaagcctaactacccatcaggcaatccatactggaaaaaaaccttacaaatgcaatgagtgtgggaaggtcttcactcagaattcacaccttgcaagacatcggggaattcatactggagagaaaccttacaagtgtaatgagtgtggcaaagcctttagtcaaacttcaaaacttgcaaggcatcagagaattcataccggagagaaaccatatgagtgtgggaaaccctttagtatctgttcaagcctaactacccatcagacaatccatactggtgggaaaccttacaaatgtaacgtgtggaaagttctaaagtcagagttcaaaccttgcaagccatcacagaattcatagtggagagaaaccttacaaatgaaggtggtaacttttgcagttagaattcattcctttgacaacgtcagagaatttatgcctgagagattccttgaaaatgcaatgactggctgggtgcagtggctcatgcctgtaatcccaacactttgggagtccgaggcaggtggatcacctgaggtcaggagttcaagaccagcctgaccaacatggcgaaaccccatttctactaaaagtacacaattagctaggcctggtggcgtgcgcctgtaatcccagctatataggaggctgaggcaggagaatcacttgaacccaggaggcggaggttgcagtgagccaagatcgtgccaatgcactccatcctgggcaaaaagagcaaaactccatcttaaaggaaaaaaaaaaaatgcaatgactgtggcaaactcctcatgagttcaagtattaatagacatccaagagtccataataatgagaaatcacataaatgtactgtgtgtgacagaggctttattcaggcctcacagctttgcaggcattaaaatctacgtatttgatggaaccacacaaatgtaatgtgtaagagcatcctgaagctcttactctaagactgtaactgtaggtgaggattcatacaaagagtgactcagtctctagttctttgattcacttttaaaatgataaactgcacaataattacacgttccaatatggtaaaacttaagacattatatatttcaaaggtcaaaggacatttggaaatggctacttaccttcaggttataaaatcttttattccattgtttgaggtttctcaaaaaggctactgtttgtgactttcaacctgaactatggatctgtggctattttgcatccttaagcacctttcgtggtgcctatctgggaaagaaccacagtatggaaaggcttacttcattacatgaggatcatttttatccatgtttattgaagaaggaggactctgccttgtaaaattaaatattctctcaattgagagaccatggttttggggcagaaaataatgtaaaactatgatatcaatcatcatactgattgtgttcagggtgcttttctgagagaaagacaccatgggttttagggaagtaaggctctacctgcattgagcaggccaagacctcaggacactggaatttttatgagaggagagtaataagttattagtgactgattatgtgatgggaatagtgcaggggaaatggttgccactttctctactgaatggcaatagctgttttatagcagagattgatgaaaaataggcttatttttgaaattgaagaggtaacagttattagagtggagagcttggtcagaaaaaccagaataccatggttttttttgttttgttttgtttttagtagaattcacactaattgctggaattacattttgctacagttttattaagaatgtgtcacagacataatgttttgctaaaaaaaattcaacgttttcttataactataaacaaatcacattctttgtaccaacatcattttatcctacctcagtaggatacttcatagcagataataacaatacactcagtcttttaggttgg

SEQ ID NO: 3005 - DNA, 2340 bp, Homo sapiens
agcagtttacggaagtgtaacgttgaggcccttcttgtgtatctggagaaaatagaggttctgactcctcaggagcaaaaaacataacctgaagagggaggaagtggatttggggttcaccatttcttggggcacacttgattgaaaactgagacttctgaagagaaggccagaagatacaaagacagaccatcccagttgaatgctgtcttccaagaacagaagaaaatgatccaggcccaggaatccataacactggaggatgtggctgtggacttcacttgggaggagtggcaactcctgggcgctgctcagaaggacctgtaccgggatgtgatgttggagaactacagcaacctggtggcagtggggtatcaagccagcaaaccggatgcactcttcaagttggaacaaggagaacaactgtggacaattgaagatggaatccacagtggagcctgttcagacatatggaaagttgatcatgtgctggagcgcttgcagagtgaaagcctggtgaacagaaggaaaccatgtcatgaacatgatgcatttgaaaatattgttcattgcagcaaaagtcagtttctgttagggcaaaatcatgatatatttgacttacgtggaaaaagtttgaaatccaatttaactttagttaaccagagcaaaggctatgaaataaagaactctgttgagtttactggaaatggggactcctttcttcatgctaaccatgaacgacttcatactgcaattaaattccctgcaagtcaaaaactcatcagcactaagtcccaattcatcagtcccaagcatcagaaaacacgaaaattagagaagcatcatgtgtgcagtgaatgtgggaaagccttcatcaagaagtcttggctaactgatcaccaggtaatgcatacaggagagaaaccccacagatgtagtctatgtgagaaagccttctccagaaagttcatgcttactgaacatcagcgaactcatacaggagaaaaaccttatgaatgccctgaatgtggcaaagcctttctcaagaaatcacggctcaacatacatcagaaaacacataccggagagaaaccctatatatgcagtgaatgtggaaaaggcttcatccagaaaggaaatctcattgtacaccagcgaattcatacaggtgagaaaccttatatatgcaatgaatgtggaaaaggcttcattcagaagacgtgtctcatagcacatcagagatttcacacaggaaagacgccctttgtgtgcagtgaatgtggaaaatcctgttctcagaaatcaggtctcattaaacatcaaagaattcacacaggagagaaaccctttgaatgtagtgaatgtgggaaagcctttagcacaaagcaaaagctcattgtccatcaaaggactcatacaggagagagaccctatggctgtaacgagtgtgggaaagcgtttgcgtatatgtcgtgtctggttaagcataagagaatacacacaagggagaaacaagaggcagccaaggtggaaaatcctcctgcagagaggcacagctcattacacaccagtgatgtcatgcaggagaaaaactctgctaacggggcgactacacaagtgccttctgtggcccctcagacatcattaaacatcagcggcctcctcgcaaacaggaacgtagtccttgtgggacagccagtggtcagatgtgcagcctcaggagataacagaggatttgcacaggacagaaaccttgtgaatgcagtgaatgtggttgtgccttccgtgatcaattatgtcttattttatgttacagaaaacccataggaagaaaactcagatctatgtggaaaagggttgagcaaaaatttgtagttcattatgtggccgaaaagcatacactgagagaacatgtataaggctgagatagcctgataaactcatcctattaaaatgtatgctgtgatacacaggcaaatttgatgttaacctaagcacatacacagcaattgctcgactgtgtcaattaaatgagtaaaggaagcccaagtacttttaagtggaggaaatgaagtactgtgaatttttaaaacagatgagataattggtgtcgggagtgttgcagtgactgaaaagcttcataaggggcagttggtgggaaagggctaatactgtaatggtggaatgtgggacacatatgtgtcaattcagtttccttagaccagtgccagtgtggaggattaattgaaaaccaggaccataaactttcagaactttgtattatgcagagggatctgtgaaactagtcaatttgtttcattaaacaaatattttaaaatt

SEQ ID NO: 3006 - DNA, 2484 bp, Homo sapiens
ccggcgcgccgcggggtgagcggcgccgggcctgaggtcgcccagacgccgtcggggcggagccgggtcgcgaggctgcatcccggccggcggttccggagcctcgcggctggggaggcgcggcccgggacgctcgagcttagggagatctgccttctggagactgcgccgtcctcccgggagagccagaaagaggacatggctgctgggcagcgggaagcgaggccccaggtgtcactgacgtttgaggatgtggctgtgctgtttacccgagatgagtggagaaagctggccccttctcagagaaacttgtaccgggatgtgatgctggagaactataggaacctggtctcactggggctcccatttaccaaaccaaaagtgatctccctgttgcagcaaggagaagatccctgggaggtggagaaagacggttctggcgtctcctctctaggatcgaagagcagtcataaaaccacaaagtcaacgcaaacacaagactcttcatttcagggactgatactgaaaagatccaacaggaatgtaccttgggatttgaaattagaaaagccttacatatatgaaggcagattagagaaaaagcaggataaaaagggaagttttcagatagtttcagccacccacaaaaaaatccccactatagaaagaagccataaaaatactgaattgagccaaaacttcagcccaaagtcagtgcttattaggcaacagatacttcccagagaaaaaacaccaccaaaatgtgaaatacaaggaaacagcctcaaacagaattcacaattacttaatcaaccaaaaattacagcagataaacgctataaatgtagtctgtgtgaaaaaaccttcattaacacttcatcccttcgtaaacatgagaaaaaccatagtggagagaaactatttaagtgtaaagaatgttcaaaagcctttagccaaagttcagctcttattcaacatcaaataacgcatactggagagaaaccctacatatgtaaagaatgtgggaaagcctttactctcagtacatccctttataaacatctaagaacccatactgtggagaaatcctacagatgtaaagaatgtggtaaatccttcagccgaaggtcaggcctttttatacatcaaaaaattcatgctgaagaaaacccttgtaagtataatccgggtaggaaggcatctagttgcagcacatccctttctggatgtcaaagaattcattctagaaagaagtcctacttatgtaatgaatgtggcaacacctttaagtctagctcatcccttcgttatcatcagagaattcacactggagagaagccttttaaatgtagtgaatgtgggagagccttcagccagagtgcctctcttattcaacatgaaagaattcacaccggagaaaagccctatagatgcaatgaatgtgggaaaggctttacttctatttcacgacttaatagacaccgaatcattcatactggagagaagttttataattgtaatgaatgtggtaaagccttaagctcccactcaacacttattattcacgagcgaattcatactggagaaaaaccatgtaaatgtaaagtatgtggaaaagccttcagacagagttcagctctcattcaacatcagagaatgcatactggagaaagaccctataaatgtaacgagtgtgggaaaacattcaggtgtaactcatcacttagtaatcaccagagaattcatactggagagaaaccatatcgatgtgaggaatgtgggatatcttttggccaaagttcagctcttattcagcatcgaaggattcatacaggagaaaaaccctttaaatgtaatacatgtggaaaaacttttagacaaagctcatcacgtattgcacatcagagaattcatactggagagaaaccctatgaatgtaatacatgtgggaaacttttcaaccataggtcatcccttactaatcattataaaattcatatcgaagaggacccctagaaagtagatttgtatgtgtgaaagccttaaaccaaagctcatcgaagaatacatccttgagagagatgtaataaatgtaatggatgtgaaaaaaactgtaataatttagccctcattaggtatttaattccatggataaacctcagctatataatagatatgaggaaagtgtttgtgcctgtcagacacttaaaaaaataacctgagatgaagaatttacaattgaagacattgactttagccatttgtgaaatgggtttgctttttcccttttcctacagacgtatatgctagatgtcacgtgatcatcagaaacagatatccgagtgggtggggaggtgtgctttagatttctcattagaagaccaccaaactggtaatatttttatagcattttaatagcttgatcaaattgtacctttttagagaaaaggaccaaaataaaagaaaaatgaattatgaactacc

SEQ ID NO: 3007 - DNA, 766 bp, Homo sapiens
gtgcagtgggtgctggcagtgccagctggcgccgaggaactcagcggcgtggggcgagccctggccctggtgggctcagcgggtcgctgctgccactgcggctccagcgtcccctccgtaagccccaagcctgtggggcctgggcctggccgggcggcccagcgctgctctggtccgcgggctcctggctcctcccgaatccctgtgagggcgcgcggggtccttctcagcgggagtcggggttttagagctgcggattccagggctggaaagcagaaggggttcttcctggctccctttttcttctcagatctgccttctggagactgcgccgtcctcccgggagagccagaaagaggacatggctgctgggcagcgggaagcgaggccccaggtgtcactgacgtttgaggatgtggctgtgctgtttacccgagatgagtggagaaagctggccccttctcagagaaacttgtaccgggatgtgatgctggagaactataggaacctggtctcactggggctcccatttaccaaaccaaaagtgatctccctgttgcagcaaggagaagatccctgggaggtggagaaagacggttctggcgtctcctctctaggatcgaagagcagtcataaaaccacaaagtcaacgcaaacacaagactcttcatttcagggactgatactgaaaagatccaacaggaatgtaccttgggatttgaaattagaaaagccttacatatatgaaggcagattagagaaaaag

SEQ ID NO: 3008 - DNA, 2802 bp, Homo sapiens
agcggccgccttgctcctctaggtcccaggcgctctgcggagctttcgctgcccggtgagcggcgccgggcttgaggtcgcccagacgtcggaggagccgggtcacgaggctggagcttcctgcttgcagagtgcggcggggaggcgcggcccgggaacgcgggatcctggggagatctgccttctggagactgcgccgtcctcccgggagagccagaaagaggacatggctgctgggcagcgggaagcgaggccccaggtgtcactgacattcgaggacgtggctgtgctctttacctgggatgagtggagaaagctggctccttctcagagaaacttgtaccgggatgtgatgctggagaactataggaacctggtctcactgggactctcatttaccaaaccaaaagtcatctccctgttgcagcaaggagaagatccctgggaggtggagaaagacagttctggtgtctcctctctaggatgtaagagcacacctaaaatgacaaagtcaactcaaactcaggattcatttcaggagcagataaggaaaagattgaaaagggatgaaccctggaacttcatatcagaaagatcctgcatatatgaagagaaattaaagaaacagcaggacaaaaatgaaaatttacaaataatttcagttgcccatacaaaaatccttactgtagatagaagccataaaaatgttgaatttggccaaaacttctacctgaaatcagtcttcattaagcaacagagatttgctaaagaaaaaactccatcaaaatgtgaaatacaaagaaatagtttcaagcagaattcaaatttacttaaccaatcaaaaatcaaaacagcagagaaacgctataaatgcagtacatgtgaaaaagccttcattcacaattcatcccttcgtaaacatcagaaaaaccacactggagaaaaattatttaaatgtaaagaatgtttaaaagctttcagccaaagttctgctcttattcaacatcaaagaactcatacaggagagaaaccctatatatgtaaagaatgtgggaaagccttcagccatagtgcatccctttgtaagcatttaaggacccatactgtggagaaatgctatagatgtaaagaatgtggtaaatccttcagtcgaaggtctgggctttttatacatcaaaaaatccatgctcaagaaaatccccataaatacaatccaggcaggaaggcatccagttacagcacttccctttctggaagtcagaaaattcatctcagaaagaagtcctacttatgtaatgaatgtggcaacacctttaagtctagctcatcccttcgttatcatcagagaattcacactggagagaagccttttaaatgtagtgaatgtgggagagccttcagccagagtgcctctcttattcaacatgaaagaattcacaccggagaaaagccctatagatgcaatgaatgtgggaaaggctttacttctatttcacgacttaatagacaccgaataattcatactggagagaaattgtataattgtaatgaatgtggtaaagccttaagctcccactcaacacttattattcatgagcgaattcatactggagaaaaaccatgtaaatgtaaagtatgtggaaaagccttcagacagagttccgctctcattcaacatcagagaatgcatactggagaaagaccctataagtgtaacgaatgtgacaaaacattcaggtgtaactcatcgcttagtaatcaccagagaattcatactggagagaaaccatatcgatgtttagaatgtgggatgtcttttggccaaagtgcagctcttatacaacatcagaggattcatacaggagaaaaaccctttaaatgtaatacatgtggaaaaacttttagacaaagctcatcacttattgcacatcaaagaattcatactggagagaaaccctatgaatgtaatgcatgtgggaaactctttagccagaggtcatcccttactaatcattataaaattcacattgaagaggactccttaaaagccgatttgcatgtgtgaaagccttaaaccaaaactcatcagagaatacatgcttgagagtgatttattaaatataatgaatatgagaaaactcttagttctcatcagatactaagttttaagaataaactttagctatgtaataacttatgggaaaagcttttatacttgtcactcactttttaaaatatcccgagacagttcactgttgcagacattgaaattggccatttgtaagataaaaggtatgtttataaaatctctttatataatatatgctatctatgacatgcaaaaaagaaaagtctgggtgctgaggtgctgaatttttcattagaaaaacatttgtataaactactattatataaatataagcatatttattacagcaaacattttaatagcaaacaaaacaattgatcttaaaaatatatgcaatatatacttacctggcagggaagattaccatgatcacgaaggtggttttcccagggcaaggcttatccattgcactccagatgtgctgaccccttcaatttcccaaaatgtggaaaactcaactgcataatttatggtagtgggggactacattcgcactttctcctgaaatatatatatatatgcagtattagagcaaaggaccaataagagataaaaactaactgaactacctcttagtgcctggaatttaccttttcctgacttactgtcaaacttcgtgcatggcttttattaaaaaagaaaaaatctgttct

SEQ ID NO: 3009 - DNA, 763 bp, Homo sapiens
gtgcagtgggtgctggcagtgccagctggcgccgaggaactcagcggcgtggggcgagccctggccctggtgggctcagcgggtcgctgctgccactgcgggtccagcgtcccctccgtaagccccaagcctgtggggcctgggcctggccgggcggcccagcgctgctctggtccgcgggctcctggctcctcccgaatccctgtgagggcgcgcggggtccttctcagcgggagtcggggttttagagctgcggattccagggctggaaagcagaaggggttcttcctggctccctttttcttctcagatctgccttctggagactgcgccgtcctcccgggagagccagaaagaggacatggctgctgggcagcgggaagcgaggccccaggtgtcactgacattcgaggacgtggctgtgctctttacctgggatgagtggagaaagctggctccttctcagagaaacttgtaccgggatgtgatgctggagaactataggaacctggtctcactgggactctcatttaccaaaccaaaagtcatctccctgttgcagcaaggagaagatccctgggaggtggagaaagacagttctggtgtctcctctctaggatgtaagagcacacctaaaatgacaaagtcaactcaaactcaggattcatttcaggagcagataaggaaaagattgaaaagggatgaaccctggaacttcatatcagaaagatcctgcatatatgaagagaaattaaagaaacag

SEQ ID NO: 3010 - DNA, 5411 bp, Homo sapiens
ctttcgggggttctcctggcttgggccatccaggcttggctaggattgccggcctggggttgaggcgctcgcagtggtctcttccgggccggggtggatccgggcctctccagcgagtgggcggcgtgcagcctcgtctgggcttctgggaccagccctacgcggctcgggccccttggccactgggtcccggggcgccgtccgcgagcggcctggactgccggagacccgcgggagggagcgcctcgccagacccaccgtgtccacactctgctctccctgggcaggaagactgaggaggaagggatggctgtggatctgctgtctgctcaggagcctgtgacattcagggatgtggccgtgttcttcagccaggacgagtggttgcacctggactctgcccagagggccttgtaccgggaggtgatgctggagaactacagcagcctggtctcactggggattccattttcaatgccaaagttgattcatcagttgcagcaaggagaagatccctgcatggtggaaagagaagtcccttcagatacccgtctaggtttcaagacttggcttgaaacagaagcattgcctcatagacaggacatttttatagaagaaacatctcagggaatggtaaagaaagaatccattaaggatggtcactgggacattaactttgaagaagctgtggaatttgagagcgagatagaagaagagcaagagaagaaacctcttagacaaatgatagattcgcatgagaaaaccatcagtgaagatggaaaccatacaagtcttgaattggggaaaagcttatttacaaatacagctcttgtcacacaacagagtgttcctatagaaaggatacccaatatgtattatacatttgggaaagattttaaacagaattttgatctcatgaaatgcttccagatttacccaggaggaaaacctcacatctgtaatgaatgtgggaagagcttcaagcagaatctgcatcttattgaacatcagagaattcatacaggtgagaaaccctacaaatgtaatgagtgtgaaaaaaccttcagccacagatcatcccttctttctcatcagagaattcatactggagagaaaccttacaagtgtaatgaatgtgagaaggcatttagcaacagttcaacccttatcaaacatctgagagtgcatactggagagaaaccgtatcgatgtagggaatgtggtaaagcctttagccagtgttcaaccctcactgtacatcagagaattcatactggagagaaactctataaatgcggcgaatgtgagaaggccttcaactgtagagcaaaacttcacaggcatcaaagaatccatacaggtgagaaaccctataaatgtagtgagtgtgggaagggatacagccagtttacatctctagctgaacatcagaggtttcatactggagaacaactgtatacatgcttggaatgtgggagaaccttcacacgtattgtaacccttatcgaacatcagcgaattcacactggacaaaaaccttatcagtgcaacgaatgtgagaaagccttcaaccagtattcatcctttaatgaacatcggaaaattcatactggggaaaaactttatacatgtgaggaatgtgggaaagcctttggttgcaaatctaacctttataggcatcagagaattcatactggagagaaaccgtatcagtgtaatcagtgtggaaaggccttcagccagtattcatttttaaccgaacatgagaggatccacactggagagaaactgtataaatgtatggaatgtgggaaagcctacagttacagatcaaacctttgtagacacaaaaaagttcacacgaaagagaaactctataagtggaaggaatatgggaaacctttcatctgcagctcctcacttacccagtatcagagattttttaaaggagataaagcctatgaggtttagttcatctctcaaataatccaagacttctcactggggaataagggaataataaatagggtacaaactcctaatagatttgtcttttttacttctcctgaaggaaatatgttagttgccactaagtcatgataaaattgatcagtgagactatgaagagcactgacttgttaaattttaaaagaaccataaattctaaggtatctaaaaacctatgagtatttaattcatagaaaaaatgtaaaaggtctttttaaaaatcatgaaaaatagttgaatatacattttgtttctctcataagaccatattccctttaaaagagtaagcttcaatatgtgaattttcttttaaaaacagtcactgagttaataatgtaaataagtgtgtggccttctttaaaatagctggctaacataggaggcacttcttttcataaagagaagctaaacataaaaaggaattttaaatttaactcttcacatggaaataataaagctctttatatgagctgtcccaccagcaacttatatatgtaaacatacatatatacacatatgcatgtgtgtgtgtaaacataaaagtcctttattattaaaaaatgtagttttattgatttagaatttagttcttaaaatcttgcccaaaggtagactctctttcttttactttcttccattatttcttaaattgatgtggttttatataactgaacagagtactattacagtaccgtagaaggcggattaactgaagcagctggaaagactgtcaagcacatactttgttatctgttgcagaagggatgtatttggcagaatctcaggctgcatgtctggtagctcattagagccaggagagattttagtttaattatagcctttcattgtactaacgaaggatttgaacttagtgaacagagtcaagactagaatctaggtctttggttctggtgttttgtgatcattataggctcgtttccaacctgaggtcccaagagtactatttgttttgtagcctggttagacatagttgcagtaatttaaagttactgtgttatctttaagggcttcctctcaccttaatcttaataattgactcacaactatattcttttttcttatgagtccctaattatgcctgcttttgttataattgtacttaaatccttaaagctagctgaggtccagatagtgtaattgcttttggaggcttcacatataaggttgccttcttattacacatattttaggaattaattattttatggaaagttatatatgaagagtttattattaagcattcctttcatcagtttaaatgtttaattcctcccaggcgtttttcctccaattttatatttgatttttcattcaattcacagttggtatcattaaaaaaaattctaatacaattagctagaccttctgagaaaaatgttagaattaaactcaagcagtcagtatagtatatttcttaaccgactggttttagcttatcagaaagtaattattttatgtatttaaatacatttacaaagaaaatgaggcttttaaacagacctcactatttaacattgtacccagtagtggtgagcatgcttagtacccaaattttggtttctaaatgccattccccactaaaaggaaccagggttccttggagaaatggctgattccatgtttggagcaggggaagtgggtggtgtggctaaaatactttttattaagaaaataaaataaaaagcaagatagtatttgaagactaatggggtaatgtcagaagggaacaggcgccaagttgaaggtattctcactggccaaatttaggacaacttagaataatcactcttactggtgataatactaagaaggaaaagaagttcataatgatgaaagtagagaaaaaagaaaactctatacaattatttgaagaatgtcttcttttaaatgtacatggaatgatagatttggaaaaattaccattttacaacccttaatgtaattaaatctggcaaaaatcgatggtaaaacccattaagtggaaaaaattttaaggaactttgtttacaaggtgtcagaacatcacagatatctattgcaaaagaattgcctttacagtgagatttggctatcaaactgcatttcactacttctggaataagccagcattatgtggctcttgatgggatgcggtatgaagcatgtgtgatcatccttgatgtactgccgaaaatgtttacctcaaatttaattaaatcttttgtctagacttatcttcctgtttaaagaaatacaggaatagaggaacaagttgaattacacagtatggaaataaatagacaagtccagagttggtataggacaactggacttttttttatatatttattttaaaatggttttcttaaatttatttttttaaacataacacgaggaagctgttaaaactggtgtaatagctcaaaagaactaagtattccagatttcgggagggatgaagagggagatattcagaaaccttcaccagattcctcccaacttgatcatagtggattaatgacgtgctttgtggatgtggttagtcaatgacaccagcttgacggatctttctttctgcaccaaaccccattgagttatctggtccccttggctgacgaagagccattaggcgaggatcactggcatcatccagggtgatgttcttcaagcgactgaccaaccgatcaggtcgaggagctgcaacagccttggggccctcacagactcgccaaacattccaggcactgcacttgccagtgcgctgatgaagaatcacggagaactccacctcatctcctgcctggagctcaaggccatcctcaacttctttcatatggaaaaagagcttcttgctatcccctacttcatagttaatgaagccaaactgatcttgcacacattccactggccctacgcaggggtgtgatgttgtaagccatagtttgtgcattttggccctggtctggacttttcaaaaagcaaatgtagtaaaacaaaaagtggtctctgctagattaagacaagagacataaccaaatggaaagtgtgatcctttattagcttctgattcataaaaaaacctataagagacatttggggggatatttggggaaataggaagatggaatgggtagtagataatgtggtatatttgatttttctagaagtgataattgagttacgtaggataatgttctaattcttaggagatgcatgcagaagttttttttttaagttttgaaaagtcatgatgttgacagcatattttcaaataaatatgtacaaaatcagtcaattgttttttgtggtggatctatatgtggtggatgttcattggtcatttaaaacatttttctatgtgtgtcaatttttaataaaaatgcaaaaagtgattggataaagaa

SEQ ID NO: 3011 - DNA, 1954 bp, Homo sapiens
ggagcgcctggcggggccgctgggccgagggggccgccggcggggctggcgggcggggggcttcctgcgggcccggggggagccggcggccggcgcgggcgcggcgggccgggcaggggcgaggggcgccgggtcttgccccagaagctgcgggcacatccacgcctgaaatgcggcgctcagtcctggtcaggaacccaggccacaaaggcctgagacccgtttatgaagagctcgactctgactccgaggacctagaccccaatcctgaagatctggacccggtttctgaagacccagagcctgatcctgaagacctcaacactgtcccggaagacgtggaccccagctatgaagatctggagcccgtctcggaggatctggaccccgacgccgaagctccgggctcggaaccccaagatcccgaccccatgtcttcgagtttcgacctcgatccagatgtgattggccccgtacccctgattctcgatcctaacagcgacaccctcagccccggcgatccaaaagtggaccccatctcctctggcctcactgccaccccccaggtcttggccaccagccccgcggtgctccccgcccccgccagcccgccccggcccttctcctgcccggattgcgggcgagccttccgccgcagctccgggctgagccagcatcgccgcacgcacagcggcgagaagccgtaccgctgccccgactgcgggaagtccttcagccacggtgccaccctggctcagcaccgtggcatccacactggggcgcggccgtaccagtgcgcggcctgcggcaaggccttcggctggcgctccacgctgctgaaacatcgcagcagccacagcggggagaagccgcaccactgcccggtgtgtggcaaggccttcgggcacggctcgctcctggcacagcacctgcgcacgcacggcggcccgcggccccacaagtgcccggtgtgcgccaagggcttcggccagggctctgcgctgctcaaacacctgcgcacgcacacgggcgagcggccctacccgtgtccgcagtgcggcaaggccttcgggcagagctcggcgctgctgcagcaccagcgcacacacacggccgagcgcccctaccgctgcccccactgcggcaaagccttcgggcagagctccaacttgcaacaccacctgcgcatccacacgggcgagcggccctacgcctgcccgcactgctccaaggccttcggccagagctcagcgctgctccagcacctgcacgtgcattcgggcgagcgtccctatcgctgtcagctctgcgggaaggccttcggccaggcctccagcctcaccaagcacaaacgggtgcatgagggtgcagccgctgctgcagctgccgcggccgctgcagctgcagcagcggccgccggcctgggcctcgggcctggcctaagccctgcatccatgatgaggccggggcaggtctccctcctgggtcctgatgctgtttctgtgctcggctctggcttgggcctcagccctggcaccagctctggccgcaaccctgaccctggctctgggccgggcactctgccggatcccagctccaaacccctccccggctccagatccacccccagccctactcctgtggaatcttctgacccaaaggctgggcacgacgctggtcccgaccttgtgcccagcccagaccttgatcctgtgcccagcccagaccctgatcctgtgcccagccctgatcccaaccctgtgtcctgccctgacccctgttctcccactcgtggcactgtcagcccagccctccctaccggcgagagtccagagtgggtacaggagcaaggggcactgctggggcctgatggctgaaggagacgccggcatcctcgggggcctggggaagttgtgtgttgtgcagtcagtaaaatcctcccactgcctccggg

SEQ ID NO: 3012 - DNA, 1824 bp, Homo sapiens
caggtcttgccccagaagctgcgggcacatccacgcctgaaatgcggcgctcagtcctggtcaggaacccaggccacaaaggcctgagacccgtttatgaagagctcgactctgactccgaggacctagaccccaatcctgaagatctggacccggtttctgaagacccagagcctgatcctgaagacctcaacactgtcccggaagacgtggaccccagctatgaagatctggagcccgtctcggaggatctggaccccgacgccgaagctccgggctcggaaccccaagatcccgaccccatgtcttcgagtttcgacctcgatccagatgtgattggccccgtacccctgattctcgatcctaacagcgacaccctcagccccggcgatccaaaagtggaccccatctcctctggcctcactgccaccccccaggtcttggccaccagccccgcggtgctccccgcccccgccagcccgccccggcccttctcctgcccggattgcgggcgagccttccgccgcagctccgggctgagccagcatcgccgcacgcacagcggcgagaagccgtaccgctgccccgactgcgggaagtccttcagccacggtgccaccctggctcagcaccgtggcatccacactggggcgcggccgtaccagtgcgcggcctgcggcaaggccttcggctggcgctccacgctgctgaaacatcgcagcagccacagcggggagaagccgcaccactgcccggtgtgtggcaaggccttcgggcacggctcgctcctggcacagcacctgcgcacgcacggcggcccgcggccccacaagtgcccggtgtgcgccaagggcttcggccagggctctgcgctgctcaaacacctgcgcacgcacacgggcgagcggccctacccgtgtccgcagtgcggcaaggccttcgggcagagctcggcgctgctgcagcaccagcgcacacacacggccgagcgcccctaccgctgcccccactgcggcaaagccttcgggcagagctccaacttgcaacaccacctgcgcatccacacgggcgagcggccctacgcctgcccgcactgctccaaggccttcggccagagctcagcgctgctccagcacctgcacgtgcattcgggcgagcgtccctatcgctgtcagctctgcgggaaggccttcggccaggcctccagcctcaccaagcacaaacgggtgcatgagggtgcagccgctgctgcagctgccgcggccgctgcagctgcagcagcggccgccggcctgggcctcgggcctggcctaagccctgcatccatgatgaggccggggcaggtctccctcctgggtcctgatgctgtttctgtgctcggctctggcttgggcctcagccctggcaccagctctggccgcaaccctgaccctggctctgggccgggcactctgccggatcccagctccaaacccctccccggctccagatccacccccagccctactcctgtggaatcttctgacccaaaggctgggcacgacgctggtcccgaccttgtgcccagcccagaccttgatcctgtgcccagcccagaccctgatcctgtgcccagccctgatcccaaccctgtgtcctgccctgacccctgttctcccactcgtggcactgtcagcccagccctccctaccggcgagagtccagagtgggtacaggagcaaggggcactgctggggcctgatggctgaaggagacgccggcatcctcgggggcctggggaagttgtgtgttgtgcagtcagtaaaatcctcccactgcctccgg

SEQ ID NO: 3013 - DNA, 1954 bp, Homo sapiens; identical to SEQ ID NO: 3011

SEQ ID NO: 3014 - DNA, 2936 bp, Homo sapiens
atgagtagaagttcaccaagtgggaaaggacactctaggatggccgagcctcgatttaacaacccctacttctggccccctcctcccaccatgcccagccagctggacaacctggttctgattaacaagatcaaggagcagctgatggccgagaagatcaggccgcctcacctgccgcccacgtcggcctcgtcgcagcagccgttgctagtgccgccggcacccgccgagagcagccaggccgtcatgtcgctgcccaagctgcagcaggtgccggggctgcatccacaggcggtgccgcagcccgacgtggcgctgcacgcacggccggccaccagcaccgtcacaggtctggggctgtccacccggaccccgtctgtgagcacttctgagtcaagcgcgggcgcgggcacgggcacgggtaccagcaccccgtccacacccaccaccaccagccagagccgcctcatcgcctcgtcccccaccctcatctcagggatcaccagcccccctctcctggactccatcaagacaatccagggccacggcctgcttggcccccccaagtccgaacgcggccgcaaaaagatcaaggcggagaacccggggggtccgcctgtccttgtagtcccctatcccatcctggcctcgggcgagactgccaaggagggcaagacgtacaggtgtaaggtatgcccactgacctttttcaccaagtcagagatgcagatccactccaagtcgcacacagaggccaagccccacaagtgcccgcactgctccaagtcctttgccaacgcctcctacctggcccagcacctgcgcatccacctgggcgtcaagccctaccactgctcctactgtgataagtccttccggcagctctcccacctccagcagcacaccagaatccacacaggcgacagaccctacaagtgcccacatcctggctgcgagaaggctttcactcagctctccaacctccagtctcaccagcgccagcacaacaaggacaagccctacaagtgtcccaactgctaccgggcctattcggactccgcttctttgcagatccacctctcggcccacgccatcaagcacgccaaggcctactgctgcagcatgtgtgggcgggcctacacctcggagacctacctgatgaagcacatgtccaaacacacggtggtggagcacctggtgagccatcactcgccccagaggacggagtcccccggcatcccggtgcgaatctctctcatctgagcccactggaggcgccgccccacccggcccactggcagacacagacccaggcagcaccaggccccagctccctccgggggccctccaggaaccaccaagctctctcacgaccttcccaatcttccagaaagcttggtccgcagaagccctgcctggtccagtccgggggcggccaggccaactgcaagattctggactgttttggtggcatccaaagacgatctcagagcactttgaacctctctgttgagttttctttttgttccccacccttcacttgcttcactgtttttttttttttcgttttttttttttaagtttgttttggaaataacagaaaagatatttattggccaggaagttggtgctgctaagaccgagaaatttaaagaatcggacagatggacgcagagaaccagagggcaatgtgggaccttctcttgccatggcctcaggtcttgagggaaggctcgggcctaggtttctggactgcaaaggggacccccaggtgggaggggcaggaagcagccggagtgagcccttcgcccctgagtgcctggctcgcacctctcgagctgtgccctgggcatcactgagcagaggggtgcggcagcttcaggaggcagaaacgagaggggtgggagatccacaggaccaaagggtgcagtgatgggctgggtggcgggcccagggaaatggggtggggatgggctgggtaagacctggccctcccctgctgccctgaagaccaccccagtctacctcggtgctggccaggaaacctttcggctacctctcccaccatcccagactgtgggcagggggatggggagggagtgggcctggatctgggacctccctccagaatttcctccagatgggggcagtgcccagggaggggttatttgtcttccctgccatggagtgggaatccccagccgaggccctaggcccctcagcagggaagggatccccggggaggcaggtcccaggagcagaccctgcccccagcccccacagacacaccccaatctgaaagccatgcgtgtcggtgtatataggaaccatgtacagagcccagagaagccccctacatccccccgggaaaaaaaagaaaactagacagaaactcatctatatattctgtatctggagttccgttttgaatattaactgtgttatttttatacactttttaagccttaactcgccattgatttaccagtttaacgtttcctggggtttctttgcccatggggttctctgcccccacccccggccctttgtttgacttgcgtcgtctgatactcagtattgtagctttttgtccgcatgttactccctgtaaatacgctgttatacatactgttaacacccctttgctttttctatgggacctccaggccaccatatttagaactagttaccttattaaaaaagaaaaaacagtctgttggcttctcagtctgcatcttggaggcagggaggtgagggcaggtgcccctcagacacttcaggaaggtagtttgcattctatttaaaaaagggagtggggagcaaatgaaaatcaaatgtggggggaaaacactaaagggggcaagaaacaaaggaattacaaaccctctgctctttgtatttctctgttgtgaagaataaactgtacctgcacccgg

SEQ ID NO: 3015 - DNA, 3106 bp, Homo sapiens
gccggagccccagcccggccctgctcgggccgccgggcgcggggctgcggccgcgtcccggaggcgccgccagcacagccaggtgctgttgggaacacagaggaagtgactggctgggggttcagggaaagctccgtagaagagggaacacttgagctgggtcttgaaggatgagtagaagttcaccaagtgggaaaggacactctaggatggccgagcctcgatttaacaacccctacttctggccccctcctcccaccatgcccagccagctggacaacctggttctgattaacaagatcaaggagcagctgatggccgagaagatcaggccgcctcacctgccgcccacgtcggcctcgtcgcagcagccgttgctagtgccgccggcacccgccgagagcagccaggccgtcatgtcgctgcccaagctgcagcaggtgccggggctgcatccacaggcggtgccgcagcccgacgtggcgctgcacgcacggccggccaccagcaccgtcacaggtctggggctgtccacccggaccccgtctgtgagcacttctgagtcaagcgcgggcgcgggcacgggcacgggtaccagcaccccgtccacacccaccaccaccagccagagccgcctcatcgcctcgtcccccaccctcatctcagggatcaccagcccccctctcctggactccatcaagacaatccagggccacggcctgcttggcccccccaagtccgaacgcggccgcaaaaagatcaaggcggagaacccggggggtccgcctgtccttgtagtcccctatcccatcctggcctcgggcgagactgccaaggagggcaagacgtacaggtgtaaggtatgcccactgacctttttcaccaagtcagagatgcagatccactccaagtcgcacacagaggccaagccccacaagtgcccgcactgctccaagtcctttgccaacgcctcctacctggcccagcacctgcgcatccacctgggcgtcaagccctaccactgctcctactgtgataagtccttccggcagctctcccacctccagcagcacaccagaatccacacaggcgacagaccctacaagtgcccacatcctggctgcgagaaggctttcactcagctctccaacctccagtctcaccagcgccagcacaacaaggacaagccctacaagtgtcccaactgctaccgggcctattcggactccgcttctttgcagatccacctctcggcccacgccatcaagcacgccaaggcctactgctgcagcatgtgtgggcgggcctacacctcggagacctacctgatgaagcacatgtccaaacacacggtggtggagcacctggtgagccatcactcgccccagaggacggagtcccccggcatcccggtgcgaatctctctcatctgagcccactggaggcgccgccccacccggcccactggcagacacagacccaggcagcaccaggccccagctccctccgggggccctccaggaaccaccaagctctctcacgaccttcccaatcttccagaaagcttggtccgcagaagccctgcctggtccagtccgggggcggccaggccaactgcaagattctggactgttttggtggcatccaaagacgatctcagagcactttgaacctctctgttgagttttctttttgttccccacccttcacttgcttcactgtttttttttttttcgttttttttttttaagtttgttttggaaataacagaaaagatatttattggccaggaagttggtgctgctaagaccgagaaatttaaagaatcggacagatggacgcagagaaccagagggcaatgtgggaccttctcttgccatggcctcaggtcttgagggaaggctcgggcctaggtttctggactgcaaaggggacccccaggtgggaggggcaggaagcagccggagtgagcccttcgcccctgagtgcctggctcgcacctctcgagctgtgccctgggcatcactgagcagaggggtgcggcagcttcaggaggcagaaacgagaggggtgggagatccacaggaccaaagggtgcagtgatgggctgggtggcgggcccagggaaatggggtggggatgggctgggtaagacctggccctcccctgctgccctgaagaccaccccagtctacctcggtgctggccaggaaacctttcggctacctctcccaccatcccagactgtgggcagggggatggggagggagtgggcctggatctgggacctccctccagaatttcctccagatgggggcagtgcccagggaggggttatttgtcttccctgccatggagtgggaatccccagccgaggccctaggcccctcagcagggaagggatccccggggaggcaggtcccaggagcagaccctgcccccagcccccacagacacaccccaatctgaaagccatgcgtgtcggtgtatataggaaccatgtacagagcccagagaagccccctacatccccccgggaaaaaaaagaaaactagacagaaactcatctatatattctgtatctggagttccgttttgaatattaactgtgttatttttatacactttttaagccttaactcgccattgatttaccagtttaacgtttcctggggtttctttgcccatggggttctctgcccccacccccggccctttgtttgacttgcgtcgtctgatactcagtattgtagctttttgtccgcatgttactccctgtaaatacgctgttatacatactgttaacacccctttgctttttctatgggacctccaggccaccatatttagaactagttaccttattaaaaaagaaaaaacagtctgttggcttctcagtctgcatcttggaggcagggaggtgagggcaggtgcccctcagacacttcaggaaggtagtttgcattctatttaaaaaagggagtggggagcaaatgaaaatcaaatgtggggggaaaacactaaagggggcaagaaacaaaggaattacaaaccctctgctctttgtatttctctgttgtgaagaataaactgtacctgcacccgg

SEQ ID NO: 3016 - DNA, 3830 bp, Homo sapiens
ataccagaggctgcaggctcaggagagcctgcctgtctggaacaccgtttgtttggacaggacaggccactaaggcgtttcatctctttaaagctcccagggcagagaacatatttgaggaattccttttttcaaagattttttttttttgccccttccaacattttgtttaagagaaaatgagatgtctatcttctgtttccttattttttttcaggaaagcaaagggttgttgacttcctccctctcccctcccttccttccttcttcccgaaggtactcatctgagaaaaagagaacgaagtattgttcctgttctctttcttaagtcattcgaaacactgtccctgcgagttctttaagttccctgcaatctgtacacaagagaaagagggagagagagagggagagagacagagagagcagggatcaggtaaaggagtggggctgctgcagccattcagacctcaggagctggaaaattgccaaggatgcagaaggaaatgaagatgatcaaagacgaggatgtgcatttcgacttggctgtgaagaagaccccctcctttccccactgcctgcagccagtggcttctcggggaaaggctccccaaagacaccccttcccggaagctctccgagggccattttcccagtttcggtatgaacctcccccaggagacctagatgggttccccggggtcttcgaaggagcagggtctaggaaacggaagagcatgcccacaaagatgccctataaccaccctgcagaagaagtcaccctcgccctccactcagaggagaacaaaaaccacggccttcccaacctccctttgctgttcccgcagcccccgcgccccaagtatgactctcagatgatcgacctgtgcaacgtgggcttccaattctaccgcagcctggaacactttgggggcaagcccgtcaagcaggaacccattaagcccagcgccgtgtggccccagccaacgcccactccattcctgcccacgccctacccctactaccccaaagtccacccgggcctcatgttccccttcttcgtgccctcgtcctcgcccttccccttcagccggcacaccttcctgcccaagcagcccccggaacctctgctgccccggaaagccgagccccaggagagcgaggagaccaagcagaaggtggagagggtggacgtgaacgtgcagatcgatgacagctactacgtggacgtgggcggctcgcagaagcgctggcagtgccccacctgcgagaagtcctacacctccaagtacaacctggtcacccacatcctgggccacagtgggatcaagccgcacgcgtgcacgcactgcgggaagctcttcaagcagctcagccacctgcatacccacatgctgacccaccagggcacgcggccccacaagtgccaggtgtgccacaaggccttcacccagaccagccacctgaagcgccacatgatgcagcacagcgaggtgaagccgcacaactgccgcgtgtgcggccgcggctttgcctaccccagcgagctcaaggcccacgaagccaagcacgccagtgggcgcgagaacatctgtgtggagtgcggcctcgacttccccaccttggcccagctgaagagacacctcaccacgcaccggggccccatccagtacaactgctccgagtgcgacaagaccttccagtacccgagccagctgcagaaccacatgatgaagcacaaggacatccggccctacatctgctcagagtgtggcatggagtttgtgcagccgcaccacctcaagcagcactccctcacccacaagggtgtgaaggagcataagtgtgggatttgtgggcgggagttcaccctgctggccaacatgaagcgacacgtgctgatccacaccaacatccgcgcctaccagtgtcacctctgctacaagagcttcgtgcagaagcagaccctcaaggcacacatgatcgtccactctgacgtgaagcctttcaaatgcaagctttgtgggaaggaattcaaccggatgcacaacctgatgggccacatgcacctgcactcagacagcaaacccttcaagtgcctctattgcccaagcaaattcaccctgaaggggaacctgacacgccacatgaaagtcaagcatggagtcatggagcggggccttcattcccaaggtctgggaagggggagaatcgccctggcacagacagccggtgtcctgaggagtctggagcaggaggagccctttgacctctctcagaagcgccgggccaaggtgccggtgttccagtcagacggggagagtgcccagggcagccactgccacgaggaggaagaggaggataactgctacgaggtggagccctacagccctggcctggccccccagagccagcagctctgcacacccgaggatctgtccaccaagtcggagcacgcccccgaggtgctggaggaagcctgcaaggaggagaaggaggatgcatccaagggagaatgggagaagaggagcaagggtgaccttggggcagagggcggccaggagagagactgtgccggcagagatgagtgtctcagtctcagggcttttcagagtacccggcggggcccctctttttctgattacttatacttcaagcacagagatgagagtttgaaagaattactggagaggaaaatggaaaaacaagcagtgcttttaggtatctaagtggacagttttaaaattacatttggaaaatgagaaggaggcagttcaaatatagctttctgcatgaactgtcattttctggagactggcgaatagtaccaatctctacaaatggcttagactaaatgagcagggatgtaggtaatggaaagccttctcaggtcattcacggggcccttgatacccttcacacatgtgcagggtcttcatcagtggcgttttatgcattgccagtataataaactgtgagtattcttccagatatctaattgtaagctgatgctgaggtgcttttagaaattctactttcctttgattcatatgcaatacatggtaaatttctaattgcaaaaatatggtgcttgaggtgtcaccttattaataactatttaggtgaatttgtgaaggttataatattttccatatagatgaaaatattagtcgtcatatatataaaaatagcctttattctataaccaaaaatgtcagaaatggcacaggaggatgagctattgaagagaatgctctccagtagttgctgcagatataaggtaaaatttcaggagaagaataattttgactaagggaaactggtgacctagaatacttagattctcttgttctgtgtcggctgtcttcatcagattgagcatttggagcattatttttcagatgatatgatgatgtttggggccctggctcctcagacaaaccctcacttctcgagcacggctccctcctggagaccattgctgtcttgctctgaggcctcatgccccataagacagatgcaggggccgggcgcagaggctcacgcctgtaatcccagcactttgggaggccgaggcaggcagatcacttgaggtcaggagtttgagaccaacctggccaacgtggcaaaaccccttctctactaaaaatacaaaaattagccaggcatgatggcaggagcctgtagttccagctactcgggaggctgaagcaggagaatcgtttgaacccaggcagtggagattgcagtgagctgagctgagatcacgctactgcactacagcctgggtgacagagtgagactctgcctcaaaaaaaaaaaaaaaaaaaaaa

SEQ ID NO: 3017 - DNA, 2693 bp, Homo sapiens
ctggtctcgaactcccgacctctggtgatctgcccgcctcggcctcccaaagtgctgggattaaaggcgtgagccaccgtgcccagcctaattcttcaattcttaataaacaatttatactgaagagaaaccctacaaacgtgaagaatgttgcaaagcttttaacgtcctcaaaccttactgaacataagataattcataatggaaactagccctacaaatatgaagaatgtggcaaacactgtaaccatttctcacatcttaccacacattaagataattcatactgaagagaaacccgacaaatgtgaagaatgtaacaaagtctttaactggtcttcaactcatactaaatataagagaattcatacagaagataaattttataaatatgaagaatgtgacaaaagctttaaaaacatttcaacccttattacacataagataatttatgttgtagagaaattctacaaatgtgaagaatgtggcaaagttttttttttttttttgaaatggagtctcactctgtcgcccaaattggagtgcaatggtgcaatctcagttcattgcaacctccgcctcctgggttcaagcgattctctggcctcaacctcccaagcagctgggattgcaggcgcctgccaccacgcccagctaatttttgtatttttagtagagacggggtttcaccattttgaccaggctggttttgaactcctgacctcaagtgatccacccgccttggcctcccaaagtgccccaaagtgctgggattacaagcatgagccattgagcccggtcgaatgtggcaaagtttttaataagttatcaaatcatactggagagaagctctacaaacctaaaagacatgacagtgctcttgagaacaccttaaacttttctaaacataaaagaaatcatagtgtcaagaagccctagatgtgagtcatgtcacaaagcctttaaatggttgtcacacttgagtataagctaatttatcctagagaaaactatgaagaatgtggcaaaatatttaaccaatactcacaccttatcgcataggaaagcatttatacttgaaaaaaaatgtacacctatgaagaatgtggaaaagccattaatatctgctcacatcttaacatcacagagtttatacttaaaacaaatattaaaaatgcaattactgtgagaatatcttttagaaaatataaaccttagaatggtgaagagtatttcttttgatgacaaacattacaaatataaagacggttgtagtactatatttgtatcacagatcttattgtgcatattttgtgctagagaaaaaccctaaagttgctcaaactttgttcaatatcagggaatgtataatagagaaaaaaacctgcaaatgtaataaatttggaaaaaagtttataaactacagcttagaaaacagagtaagttttttttgtagatgcagtaaatatgaaaaatattcaatccaaaattaactctgtaaatgtcagagaattcacagtagaaatgataaggcactggcacttcagactacactaaatcagagtgttgagtaaaaaaaataatttcaatctaaaatttagataagttatttgcatataacttaaaaaagaggaggtgattttttggagaattataattacatttgaagtatactttttgtatacttcaaatatcaaaaaaattaacatcacaatattgaaaaaaattacagactctgaaaagcaaataaggatgtaattcaactctcaagttacttcatgctcttcattcctactttatttacatgtgaaagcatgcgatcaattgttgctgcatcagagatatgaaagattcttttttattagatgggcattatttatgacctttttcataaaagagaaaggatattaaaatataaaatgcatgataaaaatctaaatggagaggctttttgtggttaacttaaaatattgagtgatgtatgaggtaggtgttctgaggaatatatttttgtgcattatagtgagaaaaacattttaaaattttagttaaaattaaaattaaattagtgatgtattatattagttgtgcttttatgtaatgtagtacattcataaatttttagattatatgtaaacttaattttttaaacattttttgacatgttaagtctgttgtacattcaatgaagtgttattatgccactcgctttaacctatcccaccttactcaagggtgtaggtaagagatggcaacagtttactatttggtaagagtggaataacatctctagtaatctctttttttcagtggctttaacctgcaaataaattaaagaatattgttctcgtaggttacatttttatacttttaatcttatttaaacttctttttttttttgccttgacaaatttaaacttatttttcttaacttttatgggtacatagtgtgtagatatatttctgccatatatagcatattttgataccagcataaaatatgtaataatcacgtcagggtaaatgagggattcttcaccttcaacatttattccttgaattacaagcaatccaaatctacacttttagtcactttgaaatataaaactaaattgttatctttattatagcgtcatttttgtggtcataataaaaatcatataggaatgtaaataaaatctatacatatctgg

SEQ ID NO: 3018 - DNA, 7027 bp, Homo sapiens
ggagatgtagtgtgcacttttcggcccccgtcgcgggagccgcttcgggccttctgggcatgtctgccatatggctccaggtttgtttttctccccggcactctgacggggagggctcccggcatctcctggcgtccgggtagaggacgcggagggtcgcagcttcattgcctgatgtcttcgggaagtattttgaagtcatcgtggctgtggattggggaatttcttgtttccactgacctgtgaggccgcgcacgcggagggaggcaccccaggccctccggcactgtccagcctcgcctgtgtccccattagcaccagtgggcattttcagagggtccagctcatggctcaagtgacaggaagatgtaggagctttctgtcttgaatgaggattcgaaccaaagggcttaggcccagctgtcttggagcaaagcagctgttgtgggacccccacaggctgggagctttgtgcccattcagatgtgggggcagaagagggcaaggccgaaggagcagacagcaccgcttcttggggagttgtgaaggcatcatgcggagggaagagcttagcagccaagtggaggacagcaccctccatgcctggattcgttactcgctcgttctagatgctgagctgctggcgcactgcagcacaactagagatgtacggatgcccccatcttgatcttacagaatcagaggtacagccgcgagaaaggtctagtcaagaacagacagagtcgcttgaggactcaggagggtgtttgctgcgttgacaacagactacaccctcacagtttgctctgctcttccaacaccagtggaagatgatcacatcccagggatcagtgtcgtttagggatgtgactgtgggcttcactcaagaggagtggcagcatctggaccctgctcagaggaccctgtacagggatgtgatgctggagaactacagccaccttgtctcagtagggtattgcattcctaaaccagaagtgattctcaagttggagaaaggcgaggagccatggatattagaggaaaaatttccaagccagagtcatctggaattaattaataccagtagaaactattcaataatgaagttcaatgagtttaacaaaggtggaaaatgtttctgtgatgaaaagcatgaaataattcattctgaagaggaaccttctgaatataataaaaatgggaacagcttctggctgaatgaagacctcatttggcatcagaaaattaaaaattgggaacaatcttttgaatacaatgaatgtgggaaagctttccctgagaattcactcttccttgtacataagagaggttacacaggacagaaaacctgcaaatatactgaacatgggaaaacctgtgatatgtcatttttcatcactcatcagcaaacacatccaagagaaaaccactatggtaatgaatgtggagaaaatatctttgaggaatccattctccttgaacatcagagtgtttacccattcagccagaagttaaatctcactccaattcagagaacccactcaattaacaatattattgaatataatgagtgtggaacatttttcagtgaaaaattagtccttcatttacaacagagaacacatacaggagaaaaaccttatgaatgtcatgaatgtggaaaaaccttcacccagaagtcagcccacacaagacatcagagaacacacacagggggaaaaccctatgaatgtcatgaatgtgggaagaccttctataagaattcagacctcattaaacatcaaagaattcatacaggggagagaccttatggatgtcatgaatgtgggaaatccttcagtgaaaagtcaacccttactcaacatcaaagaacgcacacaggggagaaaccatatgaatgtcatgaatgtgggaaaaccttctcatttaagtcagtccttactgtgcatcagaaaacacacacaggggagaagccctatgaatgctatgcatgtgggaaagcctttctcagaaaatcagacctcattaaacatcaaagaatacacacaggtgaaaaaccttatgaatgtaatgaatgtgggaagtcattctctgagaagtcaacccttactaaacatctaagaactcacacaggtgagaaaccttatgaatgtattcagtgtggaaaatttttctgctactactccggtttcacagaacatctgagaagacacacaggggagaaaccttttggatgtaatgaatgtgggaaaaccttccgtcagaagtcagccctaattgttcaccagagaactcatataagacagaaaccctatggatgtaatcaatgtggaaaatcattctgtgtgaagtcaaaactcattgcacatcatagaacacacacaggggagaaaccctatgaatgtaatgtttgtggaaaatcattctatgttaagtcaaaactaactgtacatcagagaatacacttggggagaaaccctataaatgtagtaaacgagggaaattactctgggtgaagtcagaactttgtagaacacagaacataaagggtgagagaaatctgttaatataatgataatgagaacacctttgccctgaagtcagttctcacagtatagaagagaacttaaagagggaaaaaacaatatgaagatagggaatgcaggaaaacattattctggaatttggaccatacactatgttacaaaactaaaagtggaaaaaacttattggtgaatgaatataggaaacattttgcccaatgccactcttcattaaacatcagagaattcacacggggtgaaacctgggtcagcatccctaggttgagaagggatgcatttttctgctactactacagtttcacagaatacctgagaagacacacttggagaaaccttttgggtgtaatgaatgtgggaaaacctttcatcagaagtcagctctaattgttcaccacagaactcatataagacagaaaccctatgggtgtaatgaatgtggaaaatcattctgtgtgaagtcaagaggccagagaaaatgcacaaactgtaggaaactataggaaagcatttactatgaggttatattttatggagtatatgtaataagaagtagcttctcagtgaacatcagatagtagagaaagtatttttaactgtatccaatgtgtggatgttttaagttaaaatctaaatttaatatagaacagaggtgttgagttgcaggatatctagcaatttaagaaaatgtggaaaaaatatttttattgagaaatagcattttactttgttaatatctagtttagttcattgtcaagactgctattttctaagagacttctaaagacgccactcaagccaatggctataagtagttcaaaggtttattgcttagccatatgaaaaataagggaagattttttagcaaggggacccacaaacaagagtgctcttgtatgtccagaagaaagagaaagaccatcaatcaggggccatagtacaggagcccaccagcaggatttttgaataatcctagggcagactaaattcagacgacccatctcagaatggtggatcaaagcagcaagtcaatttgccttgtatgcaacttatgaggattagtagaagagagtgggtccagatttctggtggtttctgccctgcagatgtctaacacataagccaggacattctgctgtgagtgacttattgtacccaactctatttctctccatactgaaacatgtctttcataggtgatacaactttttaaaatgtatgtgtagatataacttaaatatggagctttcaaaaagcacaaataggctggacatggtggctcatgcctgtaatcccagtactttgggaggctgaggtgggcaaatcacctgaggtcaggagttccagaccagcctggccaacatgatgaaaccctgtctctactaaaaatacaaaaattagccgggcatggtggtgcacatcggtagtcctggctactagagaggttgaggtgggaggatcacttgaacctgggaggtgggggtttcagtgagctgagatcatgccactgcactccagcctgagtgacagagagagattcaaaaaacaaaaaaaaagcaaaaatatactttgctattgggtaaggtatagtagttggcagcagaatggacccattgaggataactataaaattacagaaaatatttaaatgcaacttattgctatagaagcaaagaggactaaagggcaaaattctagagagtggtaaatctcagaaagcacaagcataaaatgcagctctgggggccctttccacttctggctatagggaagaacctgaatactgaacttgattcaggcagaggaccataacctgggggtcaggggaaggcatgggggggaccagaaaccagaagaacaatcaagactgcaatgaaaaaaatggatacattaggagcttcaaacacatataatttctcaagaaatttccagatgtctcatgctgcatagggcaggagcctgaaaagctaatttgagaagataataagtaggatttttgttttgttttgcattttgcagtacaaaggagaaatgattagaacttaggaagtgccagtgggttggtgaacatgccatcagtaaaagccctggaaacaaggtcatactagagattggttgtgccttgtcacaactgcaaacaatacctgagtggagtattcaaaaacttgcttagaaagaaaactctaggaacagatggcttcactgaagttattccaaatatttaagaaataataccaggcttttataaacttttctagaagaaaaaagatggaacttttccaattcagtttttgaggccagtacaaccttgataacaaaacctaaaaaaaaaacaacaaaaaaacccataaagctatagaccaaagtctcatagatttagatgcaaaatcctaaaattgaaaaaaacatctagccatatccataaactatatcatcaccaagagatgtttattagggcaatcaaaagatttattattttaaaaaaatcagtgtggacttccattcctctttcttttgattcccccctttgacttttcatgtatctctcctgccttccttccccagagtggaggagttagacttgcctcgtgggatgagaggagttgtggctttgtgtctgctggcaccaagagggctgagggtgaggtgtggaagggacagggggaggagatgggcagcattgttgagagattggtaacactgagcaaataaatatgttgagaatgatgacagcaagatttctccattagagaaggtatttataaaaataggaatgaggagagctagaaaacctggagtgtggcattagaatagaactcatatcttttaaatatataggaacaaataaataaattgttgtgtgtgcacatatgcatatattttgtgttcattctactgagaggacctaaacacaatgacacctcagtaacagtaagcacaccaactgccaagttattagttcctaaatactatccacaaaaaaggggaacagggatgattcctagtcagagattgggagaaatacaagatgagcctgaatcatctcatgtacctgacagtaagaaaatactctggctggtctcagtggctcatgtctgtaattctagcatgttagaaggtcaaggtgggtgggttgcttgagctcaggagtttgagaccagcctgggcaacatggcacaattgtctctacaaaaaatacaaaaattagccaggcatggtggcatgcacctgtagtccgaggtactcaggaggcagagacgtgggaggatcgcttgagcctgggagattgaggctgcactgagctgtgatcgtgccactgtactctagcctggaagacagagtgagaccccatctcaggaaaaaagaaaaaaaaaaagatgtcattcagcaggttaatggataaactgtggaacatccagaaaactttaacattcttcaaagaaatagaaaacacaatcctaaaatttatatgggaaccacaaaagacttagaatagtcagctatcctgagcaaaaggaatcaaactggaggaatcatattacctgacttccaattattcaacagagctacagtaaccaaaacagcatgatactggcataacaacagacacataggaacagtatagacaacccagaaacaaattcatacatctatggtgaccacttttgacaaaggaatgaagaacatacactggggaaaagataatgtctttaataaatggtgctgggaaaactggatatccatatgcagaagaatgaaactagacccccatctcttagcatatacaaaaatcaaaattaattaaaaagttaaatctaagacctcaaactatgaaacagctaaaagaaaacatcggggaatctctccaggacattggagtgggcaaagatttcttgtgtaatacctgacaaacaggcaaccaaagcaaaagtggacaaatgggatcacatcaagttaaaaatcttctgcattgcaaaggaaataacaaagtgaagagacaacccatagaatgtgagataatatttgcaaactatccatctgtattaggccatttttgaagtactacaaagaaatacttgagactgagtaatttataaagaagaggtttaattggctcacggttttgcaggctgtacaggaagcatggtgctaacatctgatcagcttgtagggaggcatcaggaagtttccaaccatggtggaaggcaaaaggggaataagtatctcacatggcaggtgcagggcaaagagaggggggaagggaagtgccacacaaccagatcttgtgagtactcagattttgtgaggggtgcttgaggtcatggatacccatttaccctgatgtgtttatacacatttcatacctgtattaaaatatctcatgtaccccataaacatatacacctactttgtacccacaaaaatttaaaaataaagttaatttcaatgtttaaagacttgttatt

SEQ ID NO: 3019 - DNA, 5777 bp, Homo sapiens
gtgcacttttcggcccccgtcgcgggagccgcttcgggccttctgggcatgtctgccatatggctccaggtttgtttttctccccggcactctgacggggagggctcccggcatctcctggcgtccgggtagaggacgcggaggatgctgagctgctggcgcactgcagcacaactagagatgtacggatgcccccatcttgatcttacagaatcagaggtacagccgcgagaaaggtctagtcaagaacagacagagtcgcttgaggactcaggagggtgtttgctgcgttgacaacagactacaccctcacagtttgctctgctcttccaacaccagtggaagatgatcacatcccagggatcagtgtcgtttagggatgtgactgtgggcttcactcaagaggagtggcagcatctggaccctgctcagaggaccctgtacagggatgtgatgctggagaactacagccaccttgtctcagtagggtattgcattcctaaaccagaagtgattctcaagttggagaaaggcgaggagccatggatattagaggaaaaatttccaagccagagtcatctggaattaattaataccagtagaaactattcaataatgaagttcaatgagtttaacaaaggtggaaaatgtttctgtgatgaaaagcatgaaataattcattctgaagaggaaccttctgaatataataaaaatgggaacagcttctggctgaatgaagacctcatttggcatcagaaaattaaaaattgggaacaatcttttgaatacaatgaatgtgggaaagctttccctgagaattcactcttccttgtacataagagaggttacacaggacagaaaacctgcaaatatactgaacatgggaaaacctgtgatatgtcatttttcatcactcatcagcaaacacatccaagagaaaaccactatggtaatgaatgtggagaaaatatctttgaggaatccattctccttgaacatcagagtgtttacccattcagccagaagttaaatctcactccaattcagagaacccactcaattaacaatattattgaatataatgagtgtggaacatttttcagtgaaaaattagtccttcatttacaacagagaacacatacaggagaaaaaccttatgaatgtcatgaatgtggaaaaaccttcacccagaagtcagcccacacaagacatcagagaacacacacagggggaaaaccctatgaatgtcatgaatgtgggaagaccttctataagaattcagacctcattaaacatcaaagaattcatacaggggagagaccttatggatgtcatgaatgtgggaaatccttcagtgaaaagtcaacccttactcaacatcaaagaacgcacacaggggagaaaccatatgaatgtcatgaatgtgggaaaaccttctcatttaagtcagtccttactgtgcatcagaaaacacacacaggggagaagccctatgaatgctatgcatgtgggaaagcctttctcagaaaatcagacctcattaaacatcaaagaatacacacaggtgaaaaaccttatgaatgtaatgaatgtgggaagtcattctctgagaagtcaacccttactaaacatctaagaactcacacaggtgagaaaccttatgaatgtattcagtgtggaaaatttttctgctactactccggtttcacagaacatctgagaagacacacaggggagaaaccttttggatgtaatgaatgtgggaaaaccttccgtcagaagtcagccctaattgttcaccagagaactcatataagacagaaaccctatggatgtaatcaatgtggaaaatcattctgtgtgaagtcaaaactcattgcacatcatagaacacacacaggggagaaaccctatgaatgtaatgtttgtggaaaatcattctatgttaagtcaaaactaactgtacatcagagaatacacttggggagaaaccctataaatgtagtaaacgagggaaattactctgggtgaagtcagaactttgtagaacacagaacataaagggtgagagaaatctgttaatataatgataatgagaacacctttgccctgaagtcagttctcacagtatagaagagaacttaaagagggaaaaaacaatatgaagatagggaatgcaggaaaacattattctggaatttggaccatacactatgttacaaaactaaaagtggaaaaaacttattggtgaatgaatataggaaacattttgcccaatgccactcttcattaaacatcagagaattcacacggggtgaaacctgggtcagcatccctaggttgagaagggatgcatttttctgctactactacagtttcacagaatacctgagaagacacacttggagaaaccttttgggtgtaatgaatgtgggaaaacctttcatcagaagtcagctctaattgttcaccacagaactcatataagacagaaaccctatgggtgtaatgaatgtggaaaatcattctgtgtgaagtcaagaggccagagaaaatgcacaaactgtaggaaactataggaaagcatttactatgaggttatattttatggagtatatgtaataagaagtagcttctcagtgaacatcagatagtagagaaagtatttttaactgtatccaatgtgtggatgttttaagttaaaatctaaatttaatatagaacagaggtgttgagttgcaggatatctagcaatttaagaaaatgtggaaaaaatatttttattgagaaatagcattttactttgttaatatctagtttagttcattgtcaagactgctattttctaagagacttctaaagacgccactcaagccaatggctataagtagttcaaaggtttattgcttagccatatgaaaaataagggaagattttttagcaaggggacccacaaacaagagtgctcttgtatgtccagaagaaagagaaagaccatcaatcaggggccatagtacaggagcccaccagcaggatttttgaataatcctagggcagactaaattcagacgacccatctcagaatggtggatcaaagcagcaagtcaatttgccttgtatgcaacttatgaggattagtagaagagagtgggtccagatttctggtggtttctgccctgcagatgtctaacacataagccaggacattctgctgtgagtgacttattgtacccaactctatttctctccatactgaaacatgtctttcataggtgatacaactttttaaaatgtatgtgtagatataacttaaatatggagctttcaaaaagcacaaataggctggacatggtggctcatgcctgtaatcccagtactttgggaggctgaggtgggcaaatcacctgaggtcaggagttccagaccagcctggccaacatgatgaaaccctgtctctactaaaaatacaaaaattagccgggcatggtggtgcacatcggtagtcctggctactagagaggttgaggtgggaggatcacttgaacctgggaggtgggggtttcagtgagctgagatcatgccactgcactccagcctgagtgacagagagagattcaaaaaacaaaaaaaaagcaaaaatatactttgctattgggtaaggtatagtagttggcagcagaatggacccattgaggataactataaaattacagaaaatatttaaatgcaacttattgctatagaagcaaagaggactaaagggcaaaattctagagagtggtaaatctcagaaagcacaagcataaaatgcagctctgggggccctttccacttctggctatagggaagaacctgaatactgaacttgattcaggcagaggaccataacctgggggtcaggggaaggcatgggggggaccagaaaccagaagaacaatcaagactgcaatgaaaaaaatggatacattaggagcttcaaacacatataatttctcaagaaatttccagatgtctcatgctgcatagggcaggagcctgaaaagctaatttgagaagataataagtaggatttttgttttgttttgcattttgcagtacaaaggagaaatgattagaacttaggaagtgccagtgggttggtgaacatgccatcagtaaaagccctggaaacaaggtcatactagagattggttgtgccttgtcacaactgcaaacaatacctgagtggagtattcaaaaacttgcttagaaagaaaactctaggaacagatggcttcactgaagttattccaaatatttaagaaataataccaggcttttataaacttttctagaagaaaaaagatggaacttttccaattcagtttttgaggccagtacaaccttgataacaaaacctaaaaaaaaaacaacaaaaaaacccataaagctatagaccaaagtctcatagatttagatgcaaaatcctaaaattgaaaaaaacatctagccatatccataaactatatcatcaccaagagatgtttattagggcaatcaaaagatttattattttaaaaaaatcagtgtggacttccattcctctttcttttgattcccccctttgacttttcatgtatctctcctgccttccttccccagagtggaggagttagacttgcctcgtgggatgagaggagttgtggctttgtgtctgctggcaccaagagggctgagggtgaggtgtggaagggacagggggaggagatgggcagcattgttgagagattggtaacactgagcaaataaatatgttgagaatgatgacagcaagatttctccattagagaaggtatttataaaaataggaatgaggagagctagaaaacctggagtgtggcattagaatagaactcatatcttttaaatatataggaacaaataaataaattgttgtgtgtgcacatatgcatatattttgtgttcattctactgagaggacctaaacacaatgacacctcagtaacagtaagcacaccaactgccaagttattagttcctaaatactatccacaaaaaaggggaacagggatgattcctagtcagagattgggagaaatacaagatgagcctgaatcatctcatgtacctgacagtaagaaaatactctggctggtctcagtggctcatgtctgtaattctagcatgttagaaggtcaaggtgggtgggttgcttgagctcaggagtttgagaccagcctgggcaacatggcacaattgtctctacaaaaaatacaaaaattagccaggcatggtggcatgcacctgtagtccgaggtactcaggaggcagagacgtgggaggatcgcttgagcctgggagattgaggctgcactgagctgtgatcgtgccactgtactctagcctggaagacagagtgagaccccatctcaggaaaaaagaaaaaaaaaaagatgtcattcagcaggttaatggataaactgtggaacatccagaaaactttaacattcttcaaagaaatagaaaacacaatcctaaaatttatatgggaaccacaaaagacttagaatagtcagctatcctgagcaaaaggaatcaaactggaggaatcatattacctgacttccaattattcaacagagctacagtaaccaaaacagcatgatactggcataacaacagacacataggaacagtatagacaacccagaaacaaattcatacatctatggtgaccacttttgacaaaggaatgaagaacatacactggggaaaag

SEQ ID NO: 3020 - DNA, 4498 bp, Homo sapiens
acagtggtgaatttctcctgtgtgttcctgtgtggatcccgacactcttctcgctttaagagagcctcccgcgcccctcactccgccccttcccaagtctctgggctcgtcaaagcttcccgagagccatggttggtccaggcaggcagtcggagcacctcgtggagcggctgctaacccagggtggggtggggtggggtggaggggtctgcttgtagtactctcagtcctgatgtcacaggcgcggcaaggacatcgcaaggaggagtcggattacagtaaggatgggcagtgcagcaggcagcccgagcgcactctccagccgccggggatcttagccctggaaaggcagcctgcaaggcgctcatcccgcggaggaggcacgctctcggcgctcactgctctccacgccggggacatttccaccgaatgtagcatgaaagggctctgctctacgtgccagccttgggtgagagctgatgctgaagacaccgcggtgggattccagctgtctgattaatgagaaacataatgtattttggtggtacatgccagagtcctgctctcccggcccttgtccgtccaccagcccctcctttgcaaccatcgctggatattaaaccatttcttccctttcctcttgacactgcagctgcagtcaacctcttccccaatttcaatgcgatggacccgattcagaaagctgtaataaaccatacattcggggttcctcttccccaccgaagaaagcaaatcatatcatgcaacatttgccagttgagatttaattctgatagccaggctgcggcccactacaaaggcacgaaacatgccaagaagctcaaagcactggaagccatgaaaaataagcagaaatctgtaactgccaaggacagcgcaaagactaccttcacctccatcactaccaataccatcaataccagctctgacaaaacagacggtactgcagggacaccagcaatatcaacgacgacaactgtggaaatccgcaaaagcagtgttatgacaactgagatcacctctaaagtggaaaaaagcccaacgacagccactggcaatagctcatgtccttctactgagaccgaggaagaaaaggcaaaacggcttctttactgttcgctatgcaaggttgctgtcaactctgcctcgcagctggaggcgcacaacagtggtactaagcacaaaaccatgttagaagcccggaatggaagtggcactatcaaagcctttcctagggcaggagtgaaaggcaaaggacctgttaataaaggaaacacaggcctccaaaataaaacatttcactgtgaaatctgtgatgtgcacgtcaactcggaaacgcaacttaaacagcacattagcagtagaaggcacaaagacagagctgctgggaagcccccgaaacctaaatacagtccttacaacaaactacagaagacagcacatccactgggggtaaaattagtattttcaaaagaaccttcaaagccattggctccacgaattctaccaaatcctctagcagctgcagcagccgcagcagcagtggcagtgagttcccccttcagtcttcgaactgctccagcagcaacactgttccagacttccgcgcttcctccggcactcctgcggccagctcctggacccattcggaccgcccacactcctgtgctgtttgctccttactaaattccaaataggagtaattgtactgcaataatttttcaaaaaacaaaaaacaaaacaaacaaaagagaactatgcagtgtttatttatagtttaaagtatatctgaagagccaggacttttgatagtgaattgaaaaggttataaaaaagtgggggaggtttgggggtgggagggagggagtggtattttctccaaattaaagcattcctcttgaacgctgattgttttagaagtgatctccagcattgatttgtagtggtatctagaccttctgaagcctctgtgactgtgcttttgggcacctatttccctctgcattgtctgtcctgctttatgaaacaactatacattgtctaagggcattaactggttccaatgtatataaaataatttactctgtagattaaaatcgtacaaaaaaaaaggaaaaaaacaaaaacaaaagcaacactgtgaatagtactacccgtgctggtcctcttgctatgacggcaattactgggtatttatcccaacaaaagtagatacagtagatgtcttgtaaaacaatagtgctgtgtctcaatctatgccactaggttttaaagaattgcaaaggtagaatgaacaactatttcataccaataagcagtcaaaaaataaacatacaccggatggtgtcatggaggtctccctggtcagcattctcccctcctgtctagcttgaagatataacagggctaagcttagagatgggggaggcattaataaaggtgatttcttataaagtagtaacttcccaccctgaagatatattgctggaaacagggaagtgtttataatgaacctatatctgaaagcagagaaacccatgcatcatgagtgttaagaaagaaatcaatacaactcttctatttcaaggatgaagaatcataacctagaatgataatgcaaagtaaagatctttcatttagtacatatccagtaaaaacggagaatgttgcatctctgcagtatcccctttatatcataccagtagggttgtttcttaggcaaaggtttctgctttaagtatgatggtagaattaagcattagctatttttatgggtttttcttgttttttagattacctgctgacatgatataaacaattaatatatatttaaatgttaataacaacaggaaatatgaatctgagttaattgcacaccaatgacatagtgttaaaaaatactggtaagttccactcgacaattatttctccagtggagttgtgaaatactgagagcctttgatattcaccatcaggctgaaagaagttgatgttttacctttaaaacaagatttatcaggggtatatataaatatatgtatattgtatatatgttagaaagattaagagaataagttataaaaagaaaaaatctatataaaataattatataaccatccagtgttacatgttatcattaaattggtaacaaatggcataaaaatagctgtgcctttaatttgtgataaaggctatttgctttttcccatagaaagctgacatatacctatcaaaatggtggggtttgatgcagccagtctgttgcattaataagagcaatgacactgaaacttagaataatgacaaaacatacatgatttaggtttagagaaaaaactatttttgaaaaggttttctaaagactatttaaaaatatagggaaggattgggtgtggccttcctgaaactgctctcaaagtgttgtaacccttggagaggtataaagaatcaagaggaaaccatttgagacataggtatttagcatttatcattttatatttaagaaacaccatagcgtgcttggtgctcaacattaaacatggttttttggagttcttctccaccatctagctatagaaatttgtcatataaatgaatctttaaagcagttggctttatatatcctttgttaaccaaccaaaacaaaaacaaaaaaaaagaaggaaagaaggaaggaaggaaggaagaatggaaggaaggaaggaagaaaggagggaaggaaggaaggaaaggagatggggaagggaagaaaaggaaggaaggaagaaaggaagataatgtgttccatcagtattctggtagaaagaatttcaaaccatgcttctctggttaaatatattgattagcattaaaatttgttttgaaagtatctggtgattttgcatttaccagcatctctattctctagttttagcaagtgtttcctttttcacctacagaccctggtagttcagccaggtggatagttgcccataagtctgttgtttggggctctgtctgtatcccatgtgaccagcttctaaccattttgaactttagtttcccttttctgctatgtcaaatattttgattttccataatcatcctgagtccctatccaacaacctttacaactgatacagcctcactttctgttagataacttagtgttaattaaagcagtctcactaaaacgtgcttttgctgttctttcccattttcaccaaagtgaatgagccagtccactaaaaatcagggcctatgggatacacagtgtcctgggtcacaaggcattactgtctttaatgatttgctgggaacaaacgaatcagccatattttctccatcagccatataagaaatctcagaaatacctggatcccttctgcctcacttcgctatggaaccatttttgtttaaatggtcttttaaattggagttgtaagcatcagttgtcttttattcactacctaataaaggatgaagcctaaccacagaa

SEQ ID NO: 3021 - DNA, 4079 bp, Homo sapiens
agcgcagagctgcgaccgctgctgatacgttgctcagtctcagtgtggtctctgttttgcaactggtcgtccgcgtcaggagacttaggtccaggcgactgcccagacaatgactggtcccgcataccgagcagagcatgatcagcagcagtctgagtggaagagtgcctgtgatcttagggaacctgatgggcgttggagcagcggttcgacgcatgggtttctctttaatccttccgacttccccaagcccagcgcactcaggttccgctccaagtgcgggacccgcccggggtgtgtcgggggtactcggccggaggcggccggtgagtgaggcttacagggccccgggaccaaggaaccccagcatgttaattgaacttgatcacccagttgaaggaagaataatagtagatgttggatcttcaggaagctgaagagggcagtgcccagaaatacctgtcttgatagggggatttgagctgaaccaaagcatcaacaccaatcagactgtttccgaagaactagagttttctgggtcagcaatggaaagcctcagagggaatactgctcagggtcctacaaatgaagaagactataaaaacgaaggccaattatcaaggcaaacaaaatgtcctgcacagaagaaatcctcttttgagaacacagtggtcagaaaagtgtcagtgacactcaaagaaattttcacaggggaggaaggccctgaatccagtgaatttagtctaagcccaaaccttgacgcacaacagaaaattccaaagggacatggatccccaatatctaggaaaaactccaaagataattcagacttaattaaacaccaaagacttttctcacaaagaaaaccttgtaaatgcaatgaatgtgaaaaagcctttagttaccaatcagaccttcttgtacacagtagaattcatggtggagaaaagccttttgaatgcaacaaatgtgggaaatctttcagccgaagtacacaccttattgaacatcaaagaactcacactggagagaaaccttatgaatgcaatgaatgtggaaaagcttttagccggagcacacatcttagtctacatcagagaatccatactggagaaaaaccatatgaatgtagtgaatgtggaaaagcctttagccgaagcactaaccttagtcagcatcagcgaactcatactcaagaaaggccttacaaatgtaatgaatgtgggaaagccttcggtgaccgttcaaccataattcagcatcaacgaatacacactggagagaatccctatgaatgcagtaaatgtggaaaagctttcagttggatctcatcgcttactgaacatcagagaacacacactggggagaacccctatgagtgcagtgaatgtgggaaagtgttcagtcgaagctcgtctcttacagaacatcagagaatccacagtggagaaaagcctcacgagtgtagagtgtgtggaaagggcttcagtcgaagctcatcccttattattcatcagagaactcataccggggagaagccgtacaaatgtaatgactgtggaaaagccttctgtcagagttcaactctgatcagacatcagcaccttcatactaaagagtaatatctgagcttttattaatgttagcataagaacacatatacctaacctcccaccactgaaatatatatatttcaagtatatatatacttgttctaattttcttttattagatacctatacccgttttaagctttcattcgttctttccatccatctatccttctttcgtctcccctcccttcttccctccttccctccttcctactttttctccctctccctgttctttctttctcttttctcaaataagttcacaataaaacaaagggatgactcaaaaaacataacatatgaaatctaatattctgaagggctccaactttagagtataaagctatctgacaccttgtagtttctctgctaatctattccttcaagcgtgggtccccgaaccaccaggttctcctctgttttctaaccacatcagcccctgcacatgaagagaaaatcctgtgtgtgtgtcttcatacttgctggctctagtaccagaagagagggatctggcttcagagcaggactgaaaacttctcaccagtctggggataatagtgttgaggcaaattcattctcttgacttgcaaaaacagatttttctcatcttcctccttctctcaccttttttgcagtagcatttttcctcaaagtacaactcatttttttactaacgcctaactaatcctagtgttattttatcatatttttaccaagaatgttctaaaaatcttggagacgttcctccatgatcttgggaaaaaaagttgccaaatgctgtgctgttttttttgtttgtttttaattttctttcatttacagatttcatgaaacttatattctgtggctttgaccctcaccaatcttggaagattgatctctcaaggacaaacccagtgcctatttctcagtcctttttctacttgacatttgcagaattggcactttttgccactgttatgccttaaatcttgagcttctttcaggatccatgattctgtgctgatctacacttttcctacctctcagcatttctttgattgtcaatgatcagctctgtgatttggggcaagggttaggccagaattatctcattttatcaagttataaaacttgaggtagtgcaactagattatacacttcttgaagacagaaatcttggtttgtttgttgttttatttttgagagaaggtcttgctgtgttgcccaggctggagtgcaatggcacaatcatagctcactgtagccttgaacttctgggctcctgccacagcctcctgagtagctagggctgcaagtgtgtaccaccacacccacaattttaaagtttttttgtggagacaggatctcactatattggcaaggctggcctccatctcctgaactcaaacaattctcccacctcggcttccgaaaacactgacattacaggtgtgagccaccacacctgccagaaatcttgtttttgattgatataaaacatcacaaagtactgagtagacactaaatgctctgtaattattgctcactgattcctctttatctgtaatcaatcaacttgactttatttgatatggattaataattgatttctttctctctttctactgctgcttccaagttcttggtaccttgtgcctagattactaaattgatcactgttgactcactaccattatctagctccttactaaactactactttgttaaaaaaaaatagtcgtttcccagtgacctctgccccaaatgtaaacttctttaacctaaaggtctttcatagtttgatctacttacttacttcctttctcttctcaaagataatacatgcgggcaggcctgttttgtccctactataccctcttctcacacttttcttcttttcaaactgttccttggcacttctacatgtcctactttcttcgttgtattccagaaaccctatccacccttttttaaaggccatgctcatatcctggctctgtgacactttcagtcccctgccttcttagaaatcctttgtagtgatggtttgcattattctcctgtattagacaccttctttactgttttctggttctttcacaagtacttttttacataagctgttttgaagttgtaaatcatcctaaatcttttataagcctcatataatacatagtacaatgccagcctggactctagttttaatctaaatacatagggtttaatttagcagcataatctttttagtcttttgaatgatgaggtaacctcataggtattttggcccattttgtttttccttgaattacatatataactgactatttagactgactcctttagatctcctgggatgctgacctcttggctttccaattcatgagactattgtaaagaataagtgagttcattcatgtaaagtagtaaaacagtgcctgacaaaagtaaatgctcaataaattctaattgttatgattctagtga

SEQ ID NO: 3022 - DNA, 749 bp, Homo sapiens
aagtgcgggacccgcccggggtgtgtcgggggtactcggccggaggcggccggtgagtgaggcttacagggccccgggaccaaggttcataggtggaagaaattcatctccagatgagactttggacttggacttgggacttttgagttaatgccagaatgatgaaccccagcatgttaattgaacttgatcacccagttgaaggaagaataatagtagatgttggatcttcaggaagctgaagagggcagtgcccagaaatacctgtcttgatagggggatttgagctgaaccaaagcatcaacaccaatcagactgtttccgaagaactagagttttctgggtcagcaatggaaagcctcagagggaatactgctcagggtcctacaaatgaagaagactataaaaacgaaggccaattatcaaggcaaacaaaatgtcctgcacagaagaaatcctcttttgagaacacagtggtcagaaaagtgtcagtgacactcaaagaaattttcacaggggaggaaggccctgaatccagtgaatttagtctaagcccaaaccttgacgcacaacagaaaattccaaagggacatggatccccaatatctaggaaaaactccaaagataattcagacttaattaaacaccaaagacttttctcacaaagaaaaccttgtaaatgcaatgaatgtgaaaaagcctttagttaccaatcagaccttcttgtacacagtagaattcatggtgga

SEQ ID NO: 3023 - DNA, 2179 bp, Homo sapiens
gcttccggcacgggatgttttcggttgtttgaccgagagagttgtaggcgcaaagctgaggaaaggagagtgtggagaggggcctggtgtggtggggcccggtgtttgggaccggagggtgttgacggctgatgagttccttgggtttgctctttcttcacctgaaaagaagactccaggaagggcagcacatgccggagaaagatgaattccagcttgaccgcccagaggcgcggcagtgacgccgagttgggaccctgggtgatggctgcgaggtccaaggacgcggcgccgtcccaacgcgacggacttttgcccgtgaaagtggaggaagactcacccggaagttgggagcccaactatcccgcggcttcgccggaccccgaaacttctcgactgcactttaggcagctgcgttaccaggaggtggctggaccggaagaggcgctgagccggctccgagaactctgtcgtcggtggctgagacccgagctgctctccaaggagcagatcctggagctgctggtgctggagcagttcctcaccatcctgcccgaggagcttcaagcctgggtgcgagagcactgcccagagagcggggaggaggcggtggccgtggtgcgggctctgcagcgagcgctcgatggaacctcatcccaggggatggtgactttcgaggacacggctgtgtctctaacctgggaggagtgggagcgcctggacccagcacggagggacttctgcagagagagtgcgcagaaggattccgggagcacagttccgccgagtttggaaagcagagtggagaacaaagagttgattccaatgcaacaaattttagaagaagcggagccacaggggcaactacaagaagcgttccaggggaagcgccccctgttttctaagtgtggcagtacccatgaggacagggtggaaaagcagtccggagaccccttgcccctgaaacttgaaaattctcctgaagcagaaggactcaacagcatctcagatgtcaataagaatggttccatagaaggggaagactctaaaaataatgaattgcagaacagtgccaggtgttccaaccttgttctatgtcagcacatcccgaaagcagagaggcccactgacagtgaggaacacgggaacaagtgcaagcaaagtttccacatggtgacgtggcacgtgctgaaacctcacaagtctgacagtggagacagtttccatcattccagcctttttgagacccagaggcagctccatgaagaaagaccttataaatgtggtaactgtgggaagagtttcaaacaacgctctgacctctttagacaccagagaatccacacaggtgagaaaccctatggctgccaagaatgtgggaaaagcttcagccagagtgctgccctgaccaagcaccagaggacacacacaggcgagaagccgtacacctgtctgaaatgtggggagcgcttcaggcagaattcacacctaaatcgtcatcaaagtacccacagtagagacaaacattttaaatgtgaggaatgcggggaaacctgtcatatttccaacctttttagacatcagagactacataaaggggaaagaccctataagtgtgaagaatgcgagaagagcttcaaacagcgctctgacctctttaaacaccacagaatccacactggggagaagccctatggatgttccgtctgtgggaaacgcttcaatcagagtgcaaccctcattaaacaccagagaattcacactggggaaaagccttacaaatgtcttgaatgtggggaaagatttagacaaagtacacaccttatccgacaccaaagaattcatcaaaataaagtgctgtcggctgggcgtggtggctcacgcctataatcccagcactttgggaggccaaggcaggcagatcatttgagatcaggagtttgaaaccagcctggccaacatggtaaaatcctgtctctactaaaaatacaaaaatgagccgggcatggtggtgcatgcctgtaagcccagctattcgggaggctgaggtaggagaatcacttgaacccaggaggcggaagttgcagtgagctgagatcatgccactgcactccagcctgggcaacagagcgagactccatctcaaaaaagaaataaagtgctgtcattttgatatgtt

SEQ ID NO: 3024 - DNA, 2017 bp, Homo sapiens
cgagagagttgtaggcgcaaagctgaggaaaggagagtgtggagaggggcctggtgtggtggggcccggtgtttgggaccggagggtgttgacggctgatgagttccttgggtttgctctttcttcacctgaaaagaagactccaggaagggcagcacatgccggagaaagatgaattccagcttgaccgcccagaggcgcggcagtgacgccgagttgggaccctgggtgatggctgcgaggtccaaggacgcggcgccgtcccaacgcgacggacttttgcccgtgaaagtggaggaagactcacccggaagttgggagcccaactatcccgcggcttcgccggaccccgaaacttctcgactgcactttaggcagctgcgttaccaggaggtggctggaccggaagaggcgctgagccggctccgagaactctgtcgtcggtggctgagacccgagctgctctccaaggagcagatcctggagctgctggtgctggagcagttcctcaccatcctgcccgaggagcttcaagcctgggtgcgagagcactgcccagagagcggggaggaggcggtggccgtggtgcgggctctgcagcgagcgctcgatggaacctcatcccaggtttggaaagcagagtggagaacaaagagttgattccaatgcaacaaattttagaagaagcggagccacaggggcaactacaagaagcgttccaggggaagcgccccctgttttctaagtgtggcagtacccatgaggacagggtggaaaagcagtccggagaccccttgcccctgaaacttgaaaattctcctgaagcagaaggactcaacagcatctcagatgtcaataagaatggttccatagaaggggaagactctaaaaataatgaattgcagaacagtgccaggtgttccaaccttgttctatgtcagcacatcccgaaagcagagaggcccactgacagtgaggaacacgggaacaagtgcaagcaaagtttccacatggtgacgtggcacgtgctgaaacctcacaagtctgacagtggagacagtttccatcattccagcctttttgagacccagaggcagctccatgaagaaagaccttataaatgtggtaactgtgggaagagtttcaaacaacgctctgacctctttagacaccagagaatccacacaggtgagaaaccctatggctgccaagaatgtgggaaaagcttcagccagagtgctgccctgaccaagcaccagaggacacacacaggcgagaagccgtacacctgtctgaaatgtggggagcgcttcaggcagaattcacacctaaatcgtcatcaaagtacccacagtagagacaaacattttaaatgtgaggaatgcggggaaacctgtcatatttccaacctttttagacatcagagactacataaaggggaaagaccctataagtgtgaagaatgcgagaagagcttcaaacagcgctctgacctctttaaacaccacagaatccacactggggagaagccctatggatgttccgtctgtgggaaacgcttcaatcagagtgcaaccctcattaaacaccagagaattcacactggggaaaagccttacaaatgtcttgaatgtggggaaagatttagacaaagtacacaccttatccgacaccaaagaattcatcaaaataaagtgctgtcggctgggcgtggtggctcacgcctataatcccagcactttgggaggccaaggcaggcagatcatttgagatcaggagtttgaaaccagcctggccaacatggtaaaatcctgtctctactaaaaatacaaaaatgagccgggcatggtggtgcatgcctgtaagcccagctattcgggaggctgaggtaggagaatcacttgaacccaggaggcggaagttgcagtgagctgagatcatgccactgcactccagcctgggcaacagagcgagactccatctcaaaaaagaaataaagtgctgtcattttgatatg

SEQ ID NO: 3025 - DNA, 5251 bp, Homo sapiens
gacggagttttgctcttattgcccaggctggaatgcaatgatgcgatctcggctcactgaaacctcggtctcctgggttcaagcgattgtcctgcctcagcctctgagtagctgagattacagacatctgaatgggactccgagtgccttacatccctgcagccccttcctcttcctacacccccagcagcaaatgaggcacacctgcagacagcagctatctctctgtggacagtggtggccgccgtgcaggctatagagaggaaggtggagatccacagccggcgactcctacacctggaaggtcggacagggacagcagagaagaaactagccagctgtgaaaagacagttaccgagcttgggaaccagctggagggcaagtgggccgtgctgggaaccctgctgcaggagtacgggctgctgcagaggcggctggagaacttggagaacctgctgcgcaacaggaacttctggatcctgcggctccctccaggtattaagggagatatcccaaaggtgcctgtggcatttgatgatgtctccatctacttttccactccagagtgggaaaaattagaagaatggcaaaaggaactttacaagaatatcatgaagggcaactacgagtctctcatctccatggattatgctataaatcaacctgatgtcttatctcagattcaaccagaaggggaacataatacagaggaccaggcagggccagaggaaagtgagattcccacagaccccagtgaagagcctggtatttcaacatcagatattctgtcttggattaaacaagaagaagagcctcaggttggggccccaccggagtccaaggagagtgacgtgtacaaaagcacttatgctgatgaagagcttgtcatcaaagctgaaggccttgctagatcctcgttgtgccctgaggttccagtccctttctcttctccaccagcagcagcaaaggatgctttttcagatgtggctttcaaaagccagcagtctacatccatgacaccttttggacgtccagccactgacctgcctgaagcctctgagggacaagtgacttttactcagttgggtagctatcccctcccacctccagttggcgagcaggtgttctcatgccaccactgtggcaagaatctcagccaagacatgttgctgacccaccaatgtagccatgctactgagcaccccttaccctgtgcccagtgccctaagcactttactccacaggcggacctcagcagcacctcccaggaccatgccagcgagacaccccccacctgcccacactgtgccaggacttttactcacccatcaagacttacctaccatcttcgggtccataacagcactgagcgtcctttcccctgtcctgattgccccaagcgctttgctgaccaggctcgactcaccagccaccggagagctcatgcaagcgaaaggcccttccgctgtgcccagtgcggcaggagcttcagcttgaaaatcagcctcctgctccaccagcggggtcatgcacaagagcgccctttctcctgccctcagtgtggcattgacttcaacggccactcggccctgatccgccaccagatgatccacacaggcgagcgtccttacccctgcactgactgcagtaagagcttcatgcgcaaggagcacctgctgaaccaccggcggctgcacacaggcgagcggcccttcagttgtcctcactgtggcaagagcttcatccgcaagcaccacctaatgaaacaccagcgcatccacaccggggagcggccctacccctgctcctactgtggcaggagcttccgctacaaacagacactcaaggaccacctccgttcaggccacaatggaggctgtgggggtgatagtgacccatcaggtcagccacccaacccaccaggtcccctcataactgggcttgaaacttctggcctgggtgtcaacactgaaggtctagagaccaaccagtggtatggggaagggagtggagggggagttttgtaaatccaaatctctgtggcttcatgcttgtatatgctcacagcagggcacaaaatccaagagaaggtctgtgagccccatccaacacccacagtaattattatctggcacatcaatgaatttggggtcctatacacttgactagagacatgcttgtgttttggaatttcacacccttacaagaataccacattttgaaacccagaaagacctggaaaggagcccagcatgtccatcttttcaaagatacaacaaaagcagaagttacaagaatattgcggagaggttggaaagcaggatttaacctctagttctcttgttctcagagaacagcaggttgatagtagattatgtctctaggtagagacagatacatgagaagagcctccaaaactggaagcccatcataaggcatgagaatgtttaactataaagccttttattagttctttgatagctaagatggttgttggagaaagtgcttaagccactgtttatgttgctgcctcctctctcaaaaccagccaagatctgttcacacacctctgtggctgtctttccctgaaacatggtaactcaagactgcctgcctaggtttcttagattaattattcacataaattttgtttaatattggttgaacaagaaatctgactttaaaagattattaaggagaatattccttaactatactggcttgatttgaaacaggctcttattgccatttaaactgccagaaatctttgccaaggtcctggttaaaaaaattggaaacggttttcttagccccagctttaaaagctagagatctcagagaaatagctggcttaacaatgacagaacagcttaaaatttgtgcctacaccatgttctgagagtcgttcacatcaaattcttatcttttccaagccagtaagttggcttctccattcctggtgtctgatattcttgacaatcatcagcaacaaagatcacagcactttccagaagcatggagcttcagaaagtgccagtgaactcttggtcctcagtagtgagatgataacagtgttataatgcagcttccttgagccatcagagagagtgtatgttcaccctatctggctgtatcccattggcagtggacagattgaggaaattcctagatcactgagagctaagcaccatgcatagacaacagtttgttcttgcctgtgttgcttttagggactttgactaccacatgttcttttcttggggtgatttaatcacctgggagcatctgagtctgctcctaagtggctttgcaactgggcctaagttctgtttcctttatggatctcaaattttcatctgcacaatgaggctgttgaaaggaaaaaaagtgagcctctaggaattattcaaaaaaagtctgtgatacattccttttcctgccaaagttctgtctctgtctttggcttctgtccaggcaaagctaaataagacagcaaagtcaaagcagataaattcttgttgaaacttgactaaaatttatttgatttgttgttttactcccacttggaatcctgaggtagaagacagaatgcagaagtcttacatcttgggcaggaaactggtttattcctatactcttgtttcctctgcttcttcctgaggtctagaacaaggtctggaaatgtttagacaggatattttcttgatgaagtgataaggaaaggacccatttttttgctcatcacctagcccatccttcactctctctagttatgcataacaacactagaagaaggtgttagcccagctaactttgcttctgggaaggctatgtctgaacatgttgctctgtaggataatcacacttagaaaacatctgctccatgacattcacaataccagggaccatgggagacacaagaaatgtgtgtctgctgtcataacttacagtgaaaaagcccaataatacagaacaagacatgatgggcaataccctagcatattgggattaagagctttctagccagaatctggacctataccatgggaaaatttaggggtgctgggaatcccaaagccaaggttctggcttcattggcaacccactaggaacttgaatgtgagattcagctctagtttgcaccttgatttccccagtgaaaagggagaagagccaaagtattgtctaggtgctgagttcccttttctgagtggatttcaagcatttgccagggtatgctggaggagggactcctaaagtaggtgagatgtgggactaggtaacactttaaatacttttttactcaaagatttgccaagaacacagcttattagtgaaagagacctgtggattgaaatggctgcagatagatcccgcagtcccttctgaaaggaactgtgtagccagcagggacctaaactttggcaaaaagtgaacacaattcaaatacgaatgaaggaagagccctcagatggaacgaaaggcgatgtgcaaggccatcccagagagacggaagcaggtgcgatactaagcctcagcccaagaataaaagagagttcaactgttactcttttctttcatcaatcccctatcagttagaactgcaggccagttccaaagagtgtttgcttaagattcaaaagtgggtaagtaaaatggatcagtgggaaggataaggtgtccaacagaaagtgtggaggagaaactcttggcctatcaagtgctcctgagagaaaccatgcaatttaacacttcagttaaagaaatacatgagaactgcttgtcatgaccagacaagataggaaaggggaaaccccagaaacgtgctcttcatctgtcagccttttggaccaagaagctgtcactatcacacataagcaccattcccttagagtggatccaggtgttgactataaccagatttactctttgcttactaggttttccattgtcaccattggatgaacctctggtttagccacagttgtgaaaataaatggaagttggttgattgtctagaaagtgcaagaagatggccctgctccttttctgctgaacatttagtattggaaactcctacttcccttttcattaataatgtgtgcaagtttcctattagcggggaaggtgtggggctctgctgggcttctcttgagcatatctgagaagtgatgttcatgtctatctcaaccaggaccagaccctgtgacttactcggtaataacagtccacacaagcctcgttgatatt

SEQ ID NO: 3026 - DNA, 5427 bp, Homo sapiens
aaagcgccagctgaggggccgctgcgggtggagtgcggcggagtcggcctcgcgaccccagcttgatccgccgcctgctgcaccgcgcctccgccgcgttcctgcgcgtcccgagccccgacggccgcgtgagtcccgtccgtgcggggaaggcagggccgggtcggcgccgcctgtggagaggacccggcggccgggcctgcttggagccgggcgcggtggcagcggcggcagcggcggcgacttccgaggcccgggctagacagcgcagggccatggctgaggcggccccggccccgacatctgaatgggactccgagtgccttacatccctgcagccccttcctcttcctacacccccagcagcaaatgaggcacacctgcagacagcagctatctctctgtggacagtggtggccgccgtgcaggctatagagaggaaggtggagatccacagccggcgactcctacacctggaaggtcggacagggacagcagagaagaaactagccagctgtgaaaagacagttaccgagcttgggaaccagctggagggcaagtgggccgtgctgggaaccctgctgcaggagtacgggctgctgcagaggcggctggagaacttggagaacctgctgcgcaacaggaacttctggatcctgcggctccctccaggtattaagggagatatcccaaaggtgcctgtggcatttgatgatgtctccatctacttttccactccagagtgggaaaaattagaagaatggcaaaaggaactttacaagaatatcatgaagggcaactacgagtctctcatctccatggattatgctataaatcaacctgatgtcttatctcagattcaaccagaaggggaacataatacagaggaccaggcagggccagaggaaagtgagattcccacagaccccagtgaagagcctggtatttcaacatcagatattctgtcttggattaaacaagaagaagagcctcaggttggggccccaccggagtccaaggagagtgacgtgtacaaaagcacttatgctgatgaagagcttgtcatcaaagctgaaggccttgctagatcctcgttgtgccctgaggttccagtccctttctcttctccaccagcagcagcaaaggatgctttttcagatgtggctttcaaaagccagcagtctacatccatgacaccttttggacgtccagccactgacctgcctgaagcctctgagggacaagtgacttttactcagttgggtagctatcccctcccacctccagttggcgagcaggtgttctcatgccaccactgtggcaagaatctcagccaagacatgttgctgacccaccaatgtagccatgctactgagcaccccttaccctgtgcccagtgccctaagcactttactccacaggcggacctcagcagcacctcccaggaccatgccagcgagacaccccccacctgcccacactgtgccaggacttttactcacccatcaagacttacctaccatcttcgggtccataacagcactgagcgtcctttcccctgtcctgattgccccaagcgctttgctgaccaggctcgactcaccagccaccggagagctcatgcaagcgaaaggcccttccgctgtgcccagtgcggcaggagcttcagcttgaaaatcagcctcctgctccaccagcggggtcatgcacaagagcgccctttctcctgccctcagtgtggcattgacttcaacggccactcggccctgatccgccaccagatgatccacacaggcgagcgtccttacccctgcactgactgcagtaagagcttcatgcgcaaggagcacctgctgaaccaccggcggctgcacacaggcgagcggcccttcagttgtcctcactgtggcaagagcttcatccgcaagcaccacctaatgaaacaccagcgcatccacaccggggagcggccctacccctgctcctactgtggcaggagcttccgctacaaacagacactcaaggaccacctccgttcaggccacaatggaggctgtgggggtgatagtgacccatcaggtcagccacccaacccaccaggtcccctcataactgggcttgaaacttctggcctgggtgtcaacactgaaggtctagagaccaaccagtggtatggggaagggagtggagggggagttttgtaaatccaaatctctgtggcttcatgcttgtatatgctcacagcagggcacaaaatccaagagaaggtctgtgagccccatccaacacccacagtaattattatctggcacatcaatgaatttggggtcctatacacttgactagagacatgcttgtgttttggaatttcacacccttacaagaataccacattttgaaacccagaaagacctggaaaggagcccagcatgtccatcttttcaaagatacaacaaaagcagaagttacaagaatattgcggagaggttggaaagcaggatttaacctctagttctcttgttctcagagaacagcaggttgatagtagattatgtctctaggtagagacagatacatgagaagagcctccaaaactggaagcccatcataaggcatgagaatgtttaactataaagccttttattagttctttgatagctaagatggttgttggagaaagtgcttaagccactgtttatgttgctgcctcctctctcaaaaccagccaagatctgttcacacacctctgtggctgtctttccctgaaacatggtaactcaagactgcctgcctaggtttcttagattaattattcacataaattttgtttaatattggttgaacaagaaatctgactttaaaagattattaaggagaatattccttaactatactggcttgatttgaaacaggctcttattgccatttaaactgccagaaatctttgccaaggtcctggttaaaaaaattggaaacggttttcttagccccagctttaaaagctagagatctcagagaaatagctggcttaacaatgacagaacagcttaaaatttgtgcctacaccatgttctgagagtcgttcacatcaaattcttatcttttccaagccagtaagttggcttctccattcctggtgtctgatattcttgacaatcatcagcaacaaagatcacagcactttccagaagcatggagcttcagaaagtgccagtgaactcttggtcctcagtagtgagatgataacagtgttataatgcagcttccttgagccatcagagagagtgtatgttcaccctatctggctgtatcccattggcagtggacagattgaggaaattcctagatcactgagagctaagcaccatgcatagacaacagtttgttcttgcctgtgttgcttttagggactttgactaccacatgttcttttcttggggtgatttaatcacctgggagcatctgagtctgctcctaagtggctttgcaactgggcctaagttctgtttcctttatggatctcaaattttcatctgcacaatgaggctgttgaaaggaaaaaaagtgagcctctaggaattattcaaaaaaagtctgtgatacattccttttcctgccaaagttctgtctctgtctttggcttctgtccaggcaaagctaaataagacagcaaagtcaaagcagataaattcttgttgaaacttgactaaaatttatttgatttgttgttttactcccacttggaatcctgaggtagaagacagaatgcagaagtcttacatcttgggcaggaaactggtttattcctatactcttgtttcctctgcttcttcctgaggtctagaacaaggtctggaaatgtttagacaggatattttcttgatgaagtgataaggaaaggacccatttttttgctcatcacctagcccatccttcactctctctagttatgcataacaacactagaagaaggtgttagcccagctaactttgcttctgggaaggctatgtctgaacatgttgctctgtaggataatcacacttagaaaacatctgctccatgacattcacaataccagggaccatgggagacacaagaaatgtgtgtctgctgtcataacttacagtgaaaaagcccaataatacagaacaagacatgatgggcaataccctagcatattgggattaagagctttctagccagaatctggacctataccatgggaaaatttaggggtgctgggaatcccaaagccaaggttctggcttcattggcaacccactaggaacttgaatgtgagattcagctctagtttgcaccttgatttccccagtgaaaagggagaagagccaaagtattgtctaggtgctgagttcccttttctgagtggatttcaagcatttgccagggtatgctggaggagggactcctaaagtaggtgagatgtgggactaggtaacactttaaatacttttttactcaaagatttgccaagaacacagcttattagtgaaagagacctgtggattgaaatggctgcagatagatcccgcagtcccttctgaaaggaactgtgtagccagcagggacctaaactttggcaaaaagtgaacacaattcaaatacgaatgaaggaagagccctcagatggaacgaaaggcgatgtgcaaggccatcccagagagacggaagcaggtgcgatactaagcctcagcccaagaataaaagagagttcaactgttactcttttctttcatcaatcccctatcagttagaactgcaggccagttccaaagagtgtttgcttaagattcaaaagtgggtaagtaaaatggatcagtgggaaggataaggtgtccaacagaaagtgtggaggagaaactcttggcctatcaagtgctcctgagagaaaccatgcaatttaacacttcagttaaagaaatacatgagaactgcttgtcatgaccagacaagataggaaaggggaaaccccagaaacgtgctcttcatctgtcagccttttggaccaagaagctgtcactatcacacataagcaccattcccttagagtggatccaggtgttgactataaccagatttactctttgcttactaggttttccattgtcaccattggatgaacctctggtttagccacagttgtgaaaataaatggaagttggttgattgtctagaaagtgcaagaagatggccctgctccttttctgctgaacatttagtattggaaactcctacttcccttttcattaataatgtgtgcaagtttcctattagcggggaaggtgtggggctctgctgggcttctcttgagcatatctgagaagtgatgttcatgtctatctcaaccaggaccagaccctgtgacttactcggtaataacagtccacacaagcctcgttgatatt

SEQ ID NO: 3027 - DNA, 5268 bp, Homo sapiens
tcggtcctcagaggaggggcccgggcaccctccgtgcgggccgcagcacgccggtctttgagggacccttggactcccggatctgcatgcgagggatgcggtcgaagacgagatgagggagctgacgggaggggaaacggaggggcaggtgaacatggagagagcaggaacagggagagagtagggacagcgactgggagacgcgctccacagaaacccggactgagaggcagcgagaggacgtagtcttgctctgttgcctaggctggagtagagtggtgtgatcttggctcactgcaacctccgcctcccaggttcaagcgattctcctgcctcagcctcccaagtagttgggattacagacatctgaatgggactccgagtgccttacatccctgcagccccttcctcttcctacacccccagcagcaaatgaggcacacctgcagacagcagctatctctctgtggacagtggtggccgccgtgcaggctatagagaggaaggtggagatccacagccggcgactcctacacctggaaggtcggacagggacagcagagaagaaactagccagctgtgaaaagacagttaccgagcttgggaaccagctggagggcaagtgggccgtgctgggaaccctgctgcaggagtacgggctgctgcagaggcggctggagaacttggagaacctgctgcgcaacaggaacttctggatcctgcggctccctccaggtattaagggagatatcccaaaggtgcctgtggcatttgatgatgtctccatctacttttccactccagagtgggaaaaattagaagaatggcaaaaggaactttacaagaatatcatgaagggcaactacgagtctctcatctccatggattatgctataaatcaacctgatgtcttatctcagattcaaccagaaggggaacataatacagaggaccaggcagggccagaggaaagtgagattcccacagaccccagtgaagagcctggtatttcaacatcagatattctgtcttggattaaacaagaagaagagcctcaggttggggccccaccggagtccaaggagagtgacgtgtacaaaagcacttatgctgatgaagagcttgtcatcaaagctgaaggccttgctagatcctcgttgtgccctgaggttccagtccctttctcttctccaccagcagcagcaaaggatgctttttcagatgtggctttcaaaagccagcagtctacatccatgacaccttttggacgtccagccactgacctgcctgaagcctctgagggacaagtgacttttactcagttgggtagctatcccctcccacctccagttggcgagcaggtgttctcatgccaccactgtggcaagaatctcagccaagacatgttgctgacccaccaatgtagccatgctactgagcaccccttaccctgtgcccagtgccctaagcactttactccacaggcggacctcagcagcacctcccaggaccatgccagcgagacaccccccacctgcccacactgtgccaggacttttactcacccatcaagacttacctaccatcttcgggtccataacagcactgagcgtcctttcccctgtcctgattgccccaagcgctttgctgaccaggctcgactcaccagccaccggagagctcatgcaagcgaaaggcccttccgctgtgcccagtgcggcaggagcttcagcttgaaaatcagcctcctgctccaccagcggggtcatgcacaagagcgccctttctcctgccctcagtgtggcattgacttcaacggccactcggccctgatccgccaccagatgatccacacaggcgagcgtccttacccctgcactgactgcagtaagagcttcatgcgcaaggagcacctgctgaaccaccggcggctgcacacaggcgagcggcccttcagttgtcctcactgtggcaagagcttcatccgcaagcaccacctaatgaaacaccagcgcatccacaccggggagcggccctacccctgctcctactgtggcaggagcttccgctacaaacagacactcaaggaccacctccgttcaggccacaatggaggctgtgggggtgatagtgacccatcaggtcagccacccaacccaccaggtcccctcataactgggcttgaaacttctggcctgggtgtcaacactgaaggtctagagaccaaccagtggtatggggaagggagtggagggggagttttgtaaatccaaatctctgtggcttcatgcttgtatatgctcacagcagggcacaaaatccaagagaaggtctgtgagccccatccaacacccacagtaattattatctggcacatcaatgaatttggggtcctatacacttgactagagacatgcttgtgttttggaatttcacacccttacaagaataccacattttgaaacccagaaagacctggaaaggagcccagcatgtccatcttttcaaagatacaacaaaagcagaagttacaagaatattgcggagaggttggaaagcaggatttaacctctagttctcttgttctcagagaacagcaggttgatagtagattatgtctctaggtagagacagatacatgagaagagcctccaaaactggaagcccatcataaggcatgagaatgtttaactataaagccttttattagttctttgatagctaagatggttgttggagaaagtgcttaagccactgtttatgttgctgcctcctctctcaaaaccagccaagatctgttcacacacctctgtggctgtctttccctgaaacatggtaactcaagactgcctgcctaggtttcttagattaattattcacataaattttgtttaatattggttgaacaagaaatctgactttaaaagattattaaggagaatattccttaactatactggcttgatttgaaacaggctcttattgccatttaaactgccagaaatctttgccaaggtcctggttaaaaaaattggaaacggttttcttagccccagctttaaaagctagagatctcagagaaatagctggcttaacaatgacagaacagcttaaaatttgtgcctacaccatgttctgagagtcgttcacatcaaattcttatcttttccaagccagtaagttggcttctccattcctggtgtctgatattcttgacaatcatcagcaacaaagatcacagcactttccagaagcatggagcttcagaaagtgccagtgaactcttggtcctcagtagtgagatgataacagtgttataatgcagcttccttgagccatcagagagagtgtatgttcaccctatctggctgtatcccattggcagtggacagattgaggaaattcctagatcactgagagctaagcaccatgcatagacaacagtttgttcttgcctgtgttgcttttagggactttgactaccacatgttcttttcttggggtgatttaatcacctgggagcatctgagtctgctcctaagtggctttgcaactgggcctaagttctgtttcctttatggatctcaaattttcatctgcacaatgaggctgttgaaaggaaaaaaagtgagcctctaggaattattcaaaaaaagtctgtgatacattccttttcctgccaaagttctgtctctgtctttggcttctgtccaggcaaagctaaataagacagcaaagtcaaagcagataaattcttgttgaaacttgactaaaatttatttgatttgttgttttactcccacttggaatcctgaggtagaagacagaatgcagaagtcttacatcttgggcaggaaactggtttattcctatactcttgtttcctctgcttcttcctgaggtctagaacaaggtctggaaatgtttagacaggatattttcttgatgaagtgataaggaaaggacccatttttttgctcatcacctagcccatccttcactctctctagttatgcataacaacactagaagaaggtgttagcccagctaactttgcttctgggaaggctatgtctgaacatgttgctctgtaggataatcacacttagaaaacatctgctccatgacattcacaataccagggaccatgggagacacaagaaatgtgtgtctgctgtcataacttacagtgaaaaagcccaataatacagaacaagacatgatgggcaataccctagcatattgggattaagagctttctagccagaatctggacctataccatgggaaaatttaggggtgctgggaatcccaaagccaaggttctggcttcattggcaacccactaggaacttgaatgtgagattcagctctagtttgcaccttgatttccccagtgaaaagggagaagagccaaagtattgtctaggtgctgagttcccttttctgagtggatttcaagcatttgccagggtatgctggaggagggactcctaaagtaggtgagatgtgggactaggtaacactttaaatacttttttactcaaagatttgccaagaacacagcttattagtgaaagagacctgtggattgaaatggctgcagatagatcccgcagtcccttctgaaaggaactgtgtagccagcagggacctaaactttggcaaaaagtgaacacaattcaaatacgaatgaaggaagagccctcagatggaacgaaaggcgatgtgcaaggccatcccagagagacggaagcaggtgcgatactaagcctcagcccaagaataaaagagagttcaactgttactcttttctttcatcaatcccctatcagttagaactgcaggccagttccaaagagtgtttgcttaagattcaaaagtgggtaagtaaaatggatcagtgggaaggataaggtgtccaacagaaagtgtggaggagaaactcttggcctatcaagtgctcctgagagaaaccatgcaatttaacacttcagttaaagaaatacatgagaactgcttgtcatgaccagacaagataggaaaggggaaaccccagaaacgtgctcttcatctgtcagccttttggaccaagaagctgtcactatcacacataagcaccattcccttagagtggatccaggtgttgactataaccagatttactctttgcttactaggttttccattgtcaccattggatgaacctctggtttagccacagttgtgaaaataaatggaagttggttgattgtctagaaagtgcaa

SEQ ID NO: 3028 - DNA, 2860 bp, Homo sapiens
agctgaggggccgctgcgggtggagtgcggcggagtcggcctcgcgaccccagcttgatccgccgcctgctgcaccgcgcctccgccgcgttcctgcgcgtcccgagccccgacggccgcgtgagtcccgtccgtgcggggaaggcagggccgggtcggcgccgcctgtggagaggacccggcggccgggcctgcttggagccgggcgcggtggcagcggcggcagcggcggcgacttccgaggcccgggctagacagcgcagggccatggctgaggcggccccggccccgacatctgaatgggactccgagtgccttacatccctgcagccccttcctcttcctacacccccagcagcaaatgaggcacacctgcagacagcagctatctctctgtggacagtggtggccgccgtgcaggctatagagaggaaggtggagatccacagccggcgactcctacacctggaaggtcggacagggacagcagagaagaaactagccagctgtgaaaagacagttaccgagcttgggaaccagctggagggcaagtgggccgtgctgggaaccctgctgcaggagtacgggctgctgcagaggcggctggagaacttggagaacctgctgcgcaacaggaacttctggatcctgcggctccctccaggtattaagggagatatcccaaaggtgcctgtggcatttgatgatgtctccatctacttttccactccagagtgggaaaaattagaagaatggcaaaaggaactttacaagaatatcatgaagggcaactacgagtctctcatctccatggattatgctataaatcaacctgatgtcttatctcagattcaaccagaaggggaacataatacagaggaccaggcagggccagaggaaagtgagattcccacagaccccagtgaagagcctggtatttcaacatcagatattctgtcttggattaaacaagaagaagagcctcaggttggggccccaccggagtccaaggagagtgacgtgtacaaaagcacttatgctgatgaagagcttgtcatcaaagctgaaggccttgctagatcctcgttgtgccctgaggttccagtccctttctcttctccaccagcagcagcaaaggatgctttttcagatgtggctttcaaaagccagcagtctacatccatgacaccttttggacgtccagccactgacctgcctgaagcctctgagggacaagtgacttttactcagttgggtagctatcccctcccacctccagttggcgagcaggtgttctcatgccaccactgtggcaagaatctcagccaagacatgttgctgacccaccaatgtagccatgctactgagcaccccttaccctgtgcccagtgccctaagcactttactccacaggcggacctcagcagcacctcccaggaccatgccagcgagacaccccccacctgcccacactgtgccaggacttttactcacccatcaagacttacctaccatcttcgggtccataacagcactgagcgtcctttcccctgtcctgattgccccaagcgctttgctgaccaggctcgactcaccagccaccggagagctcatgcaagcgaaaggcccttccgctgtgcccagtgcggcaggagcttcagcttgaaaatcagcctcctgctccaccagcggggtcatgcacaagagcgccctttctcctgccctcagtgtggcattgacttcaacggccactcggccctgatccgccaccagatgatccacacaggcgagcgtccttacccctgcactgactgcagtaagagcttcatgcgcaaggagcacctgctgaaccaccggcggctgcacacaggcgagcggcccttcagttgtcctcactgtggcaagagcttcatccgcaagcaccacctaatgaaacaccagcgcatccacaccggggagcggccctacccctgctcctactgtggcaggagcttccgctacaaacagacactcaaggaccacctccgttcaggccacaatggaggctgtgggggtgatagtgacccatcaggtcagccacccaacccaccaggtcccctcataactgggcttgaaacttctggcctgggtgtcaacactgaaggtctagagaccaaccagtggtatggggaagggagtggagggggagttttgtaaatccaaatctctgtggcttcatgcttgtatatgctcacagcagggcacaaaatccaagagaaggtctgtgagccccatccaacacccacagtaattattatctggcacatcaatgaatttggggtcctatacacttgactagagacatgcttgtgttttggaatttcacacccttacaagaataccacattttgaaacccagaaagacctggaaaggagcccagcatgtccatcttttcaaagatacaacaaaagcagaagttacaagaatattgcggagaggttggaaagcaggatttaacctctagttctcttgttctcagagaacagcaggttgatagtagattatgtctctaggtagagacagatacatgagaagagcctccaaaactggaagcccatcataaggcatgagaatgtttaactataaagccttttattagttctttgatagctaagatggttgttggagaaagtgcttaagccactgtttatgttgctgcctcctctctcaaaaccagccaagatctgttcacacacctctgtggctgtctttccctgaaacatggtaactcaagactgcctgcctaggtttcttagattaattattcacataaattttgtttaatattggttgaacaagaaatctgactttaaaagatta

SEQ ID NO: 3029 - DNA, 2121 bp, Homo sapiens
ggccgcgggagcgttcgtcaccagcaatctgagcggtggcgcgggcggcatttaagtgtgcggaggcgcattcccgccgcgctgcgtgacgcctgggctcccggcaccggactcgggacacgcgggaggccctcccgaaatagctgccgaatgaatgacatctgaatgggactccgagtgccttacatccctgcagccccttcctcttcctacacccccagcagcaaatgaggcacacctgcagacagcagctatctctctgtggacagtggtggccgccgtgcaggctatagagaggaaggtggagatccacagccggcgactcctacacctggaaggtcggacagggacagcagagaagaaactagccagctgtgaaaagacagttaccgagcttgggaaccagctggagggcaagtgggccgtgctgggaaccctgctgcaggagtacgggctgctgcagaggcggctggagaacttggagaacctgctgcgcaacaggaacttctggatcctgcggctccctccaggtgcctgtggcatttgatgatgtctccatctacttttccactccagagtgggaaaaattagaagaatggcaaaaggaactttacaagaatatcatgaagggcaactacgagtctctcatctccatggattatgctataaatcaacctgatgtcttatctcagattcaaccagaaggggaacataatacagaggaccaggcagggccagaggaaagtgagattcccacagaccccagtgaagagcctggtatttcaacatcagatattctgtcttggattaaacaagaagaagagcctcaggttggggccccaccggagtccaaggagagtgacgtgtacaaaagcacttatgctgatgaagagcttgtcatcaaagctgaaggccttgctagatcctcgttgtgccctgaggttccagtccctttctcttctccaccagcagcagcaaaggatgctttttcagatgtggctttcaaaagccagcagtctacatccatgacaccttttggacgtccagccactgacctgcctgaagcctctgagggacaagtgacttttactcagttgggtagctatcccctcccacctccagttggcgagcaggtgttctcatgccaccactgtggcaagaatctcagccaagacatgttgctgacccaccaatgtagccatgctactgagcaccccttaccctgtgcccagtgccctaagcactttactccacaggcggacctcagcagcacctcccaggaccatgccagcgagacaccccccacctgcccacactgtgccaggacttttactcacccatcaagacttacctaccatcttcgggtccataacagcactgagcgtcctttcccctgtcctgattgccccaagcgctttgctgaccaggctcgactcaccagccaccggagagctcatgcaagcgaaaggcccttccgctgtgcccagtgcggcaggagcttcagcttgaaaatcagcctcctgctccaccagcggggtcatgcacaagagcgccctttctcctgccctcagtgtggcattgacttcaacggccactcggccctgatccgccaccagatgatccacacaggcgagcgtccttacccctgcactgactgcagtaagagcttcatgcgcaaggagcacctgctgaaccaccggcggctgcacacaggcgagcggcccttcagttgtcctcactgtggcaagagcttcatccgcaagcaccacctaatgaaacaccagcgcatccacaccggggagcggccctacccctgctcctactgtggcaggagcttccgctacaaacagacactcaaggaccacctccgttcaggccacaatggaggctgtgggggtgatagtgacccatcaggtcagccacccaacccaccaggtcccctcataactgggcttgaaacttctggcctgggtgtcaacactgaaggtctagagaccaaccagtggtatggggaagggagtggagggggagttttgtaaatccaaatctctgtggcttcatgcttgtatatgctcacagcagggcacaaaatccaagagaaggtctgtgagccccatccaa

SEQ ID NO: 3030 - DNA, 2232 bp, Homo sapiens
gcctgcacgcagccccgtagaatgagaaggggacggtcaggccgcggggaaagcactgatcgcatttgccacccaagaggtctttggtcacctctaggagagcaattgtactgggcacgcttactaatctgcttacaggaatggagaaagaatgattggactgattcaaggccggaggttagctgagcagacatctgaatgggactccgagtgccttacatccctgcagccccttcctcttcctacacccccagcagcaaatgaggcacacctgcagacagcagctatctctctgtggacagtggtggccgccgtgcaggctatagagaggaaggtggagatccacagccggcgactcctacacctggaaggtcggacagggacagcagagaagaaactagccagctgtgaaaagacagttaccgagcttgggaaccagctggagggcaagtgggccgtgctgggaaccctgctgcaggagtacgggctgctgcagaggcggctggagaacttggagaacctgctgcgcaacaggaacttctggatcctgcggctccctccaggtattaagggagatatcccaaaggtgcctgtggcatttgatgatgtctccatctacttttccactccagagtgggaaaaattagaagaatggcaaaaggaactttacaagaatatcatgaagggcaactacgagtctctcatctccatggattatgctataaatcaacctgatgtcttatctcagattcaaccagaaggggaacataatacagaggaccaggcagggccagaggaaagtgagattcccacagaccccagtgaagagcctggtatttcaacatcagatattctgtcttggattaaacaagaagaagagcctcaggttggggccccaccggagtccaaggagagtgacgtgtacaaaagcacttatgctgatgaagagcttgtcatcaaagctgaaggccttgctagatcctcgttgtgccctgaggttccagtccctttctcttctccaccagcagcagcaaaggatgctttttcagatgtggctttcaaaagccagcagtctacatccatgacaccttttggacgtccagccactgacctgcctgaagcctctgagggacaagtgacttttactcagttgggtagctatcccctcccacctccagttggcgagcaggtgttctcatgccaccactgtggcaagaatctcagccaagacatgttgctgacccaccaatgtagccatgctactgagcaccccttaccctgtgcccagtgccctaagcactttactccacaggcggacctcagcagcacctcccaggaccatgccagcgagacaccccccacctgcccacactgtgccaggacttttactcacccatcaagacttacctaccatcttcgggtccataacagcactgagcgtcctttcccctgtcctgattgccccaagcgctttgctgaccaggctcgactcaccagccaccggagagctcatgcaagcgaaaggcccttccgctgtgcccagtgcggcaggagcttcagcttgaaaatcagcctcctgctccaccagcggggtcatgcacaagagcgccctttctcctgccctcagtgtggcattgacttcaacggccactcggccctgatccgccaccagatgatccacacaggcgagcgtccttacccctgcactgactgcagtaagagcttcatgcgcaaggagcacctgctgaaccaccggcggctgcacacaggcgagcggcccttcagttgtcctcactgtggcaagagcttcatccgcaagcaccacctaatgaaacaccagcgcatccacaccggggagcggccctacccctgctcctactgtggcaggagcttccgctacaaacagacactcaaggaccacctccgttcaggccacaatggaggctgtgggggtgatagtgacccatcaggtcagccacccaacccaccaggtcccctcataactgggcttgaaacttctggcctgggtgtcaacactgaaggtctagagaccaaccagtggtatggggaagggagtggagggggagttttgtaaatccaaatctctgtggcttcatgcttgtatatgctcacagcagggcacaaaatccaagagaaggtctgtgagccccatccaacacccacagtaattattatctggcacatcaatgaatttggggtcctatacacttg

SEQ ID NO: 3031 - DNA, 2222 bp, Homo sapiens
agccccgtagaatgagaaggggacggtcaggccgcggggaaagcactgatcgcatttgccacccaagaggtctttggtcacctctaggagagcaattgtactgggcacgcttactaatctgcttacaggaatggagaaagaatgattggactgattcaaggccggaggttagctgagcagacatctgaatgggactccgagtgccttacatccctgcagccccttcctcttcctacacccccagcagcaaatgaggcacacctgcagacagcagctatctctctgtggacagtggtggccgccgtgcaggctatagagaggaaggtggagatccacagccggcgactcctacacctggaaggtcggacagggacagcagagaagaaactagccagctgtgaaaagacagttaccgagcttgggaaccagctggagggcaagtgggccgtgctgggaaccctgctgcaggagtacgggctgctgcagaggcggctggagaacttggagaacctgctgcgcaacaggaacttctggatcctgcggctccctccaggtattaagggagatatcccaaaggtgcctgtggcatttgatgatgtctccatctacttttccactccagagtgggaaaaattagaagaatggcaaaaggaactttacaagaatatcatgaagggcaactacgagtctctcatctccatggattatgctataaatcaacctgatgtcttatctcagattcaaccagaaggggaacataatacagaggaccaggcagggccagaggaaagtgagattcccacagaccccagtgaagagcctggtatttcaacatcagatattctgtcttggattaaacaagaagaagagcctcaggttggggccccaccggagtccaaggagagtgacgtgtacaaaagcacttatgctgatgaagagcttgtcatcaaagctgaaggccttgctagatcctcgttgtgccctgaggttccagtccctttctcttctccaccagcagcagcaaaggatgctttttcagatgtggctttcaaaagccagcagtctacatccatgacaccttttggacgtccagccactgacctgcctgaagcctctgagggacaagtgacttttactcagttgggtagctatcccctcccacctccagttggcgagcaggtgttctcatgccaccactgtggcaagaatctcagccaagacatgttgctgacccaccaatgtagccatgctactgagcaccccttaccctgtgcccagtgccctaagcactttactccacaggcggacctcagcagcacctcccaggaccatgccagcgagacaccccccacctgcccacactgtgccaggacttttactcacccatcaagacttacctaccatcttcgggtccataacagcactgagcgtcctttcccctgtcctgattgccccaagcgctttgctgaccaggctcgactcaccagccaccggagagctcatgcaagcgaaaggcccttccgctgtgcccagtgcggcaggagcttcagcttgaaaatcagcctcctgctccaccagcggggtcatgcacaagagcgccctttctcctgccctcagtgtggcattgacttcaacggccactcggccctgatccgccaccagatgatccacacaggcgagcgtccttacccctgcactgactgcagtaagagcttcatgcgcaaggagcacctgctgaaccaccggcggctgcacacaggcgagcggcccttcagttgtcctcactgtggcaagagcttcatccgcaagcaccacctaatgaaacaccagcgcatccacaccggggagcggccctacccctgctcctactgtggcaggagcttccgctacaaacagacactcaaggaccacctccgttcaggccacaatggaggctgtgggggtgatagtgacccatcaggtcagccacccaacccaccaggtcccctcataactgggcttgaaacttctggcctgggtgtcaacactgaaggtctagagaccaaccagtggtatggggaagggagtggagggggagttttgtaaatccaaatctctgtggcttcatgcttgtatatgctcacagcagggcacaaaatccaagagaaggtctgtgagccccatccaacacccacagtaattattatctggcacatcaatgaatttggggtcctatacacttg

SEQ ID NO: 3032 - DNA, 8008 bp, Homo sapiens
acaggttatgagtgccagtgagccgccttagatagaagcatcgtcagcactttattaatgatggatagtgagaataaacccgaaaatgatgaggatgaaaagataaacaaagaagcacaagacttgacaaagctttcatcccataatgaagacggtgggcctgtatctgatgtgatagcaagtttccctgagaattctatgggcaaaagaggtttttcagaatcatcgaactctgatagtgttgttataggagaagacagaaataaacatgcttccaaacgcaggaaattagatgaggcagagccccttaaatctggaaagcaaggtatttgtagattagaaacttctgagagctcagtcacagaagggggtattgcattagatgaaacagggaaggagacctttctgagtgactgcacagttggaggcacatgtctcccaaatgccctctccccttcttgcaattttagcactattgatgttgtttctctgaaaacagacactgaaaaaacatctgctcaggaaatggtttcccttgatctggaaagagaatctcctttccccccgaaagaaattagtgttagttgtaccattgggaatgtagatacagttctcaaatgcagcatctgtgggcatttgttttcttcttgctctgacttggaaaaacatgctgagtctcacatgcagcagcctaaggaacatacctgttgtcactgcagccacaaagcagagagcagctcagcactacatatgcatatcaaacaagcacatgggccacagaaggtcttttcctgtgatctttgtggttttcagtgttcagaagaaaacttgttgaatgcacattatcttggcaaaacacatctccgtcgtcagaatctggctgctcgtggaggatttgtacagatcttaacaaaacaaccttttcctaaaaaatcacgtacaatggcaacaaaaaatgttcactcaaaaccaagaacttctaaatcaatagcaaagaatagtgattcaaaaggattacgaaatgtgggaagcacgtttaaagatttcagaggaagtatttctaaacaaagtggtagtagcagtgagcttcttgttgaaatgatgccttccagaaatactttgtcacaggaagtagagattgttgaagaacatgttacttcccttggtctagctcagaatcctgaaaaccagagtagaaagctagacaccttagtaacctcagagggtctcttagagaaattggaatctacaaaaaatacccttcaggcagcacacggtaacagtgtaacctcgaggccaagacctgagcgaaatattctcgtgttgggtaatagctttcgtcgacgaagcagcactttcaccttgaagggccaggcaaagaaaaggtttaatcttttaggaattaaaagaggtacaagtgaaactcagaggatgtatatgaaacacttgagaacacagatgaaaacacacgatgcagaatcagtgctgaaacacctggaagcgtgcagcagtgtgcagagagtgtgtgtgactacctcagaaacccaggaggcagagcagggccaggggagtgcccgtcctccggactccgggctgcattccctgacagtgaagccagcttctggctctcagacgttgtgtgcttgtacagactgtgggcaagtagctacaaataggacagatttggaaatccatgtgaaaaggtgccatgccagagagatgaaattttactgccgtacttgtgacttctctagtatgtcaagaagggacttagatgaacatttgcacagtaaccagcatcagcaaactgcttctgtcctgagttgtcagtgttgttcatttatatccttggatgaaataaatcttagagaccacatgaaggaaaagcacaatatgcattttctttgcaccccttgtaatctgttctttttgtctgaaaaagatgtggaagaacacaaagccaccgagaagcatattaattcattggttcaaccaaagactttgcaatcatctaacagtgatttggttttacagactttacctttgagtactttagaatcagaaaacgcaaaagagtctatggatgactcaggaaaagcatctcaggaagaacctctgaagtccagggtaagccatggtaatgaagtgaggcattccagtaagcctcagtttcagtgtaagaagtgtttttataaaacaagatcttctactgttctcacgagacatataaagcttcggcatggtcaagactatcattttctttgtaaagcttgtaatctttattcattgagcaaagaaggaatggagaaacacattaaaagaagcaagcatcttgaaaatgctaagaaaaataatattggcttaagctttgaagaatgtattgaaagggtatgtataggtgcaaatgataaaaaagaagagtttgatgtttccggaaatggaaggattgaaggccatataggtgtgcaattacaagagcattcctatcttgagaagggcatgctggcgtctgaggaactgtcacagtctggtggtagcaccaaagatgatgaattagcttcaaccactactccaaagagagggagacctaaaggtaacatctcacggacgtgttcacactgtggccttttggcctctagtattacaaacttgactgttcacattagacgaaaacacagtcaccagtatagttatttatgcaaagtgtgtaagtattacactgtaactaagggagatatggaacgtcattgtgccaccaagaaacataaaggacgggtagaaatagaagcaagtggaaaacacagttcagatatcattgttggccctgaagggggtagccttgaagctggtaaaaagaatgctggctcagcagtgaccatgtcagatgaacatgctaacaaaccagctgagtcacccacctccgttttagagaagccagatcgtggaaactcaattgaagctgaagttgaaaatgtatttcattctctagatggagaagttaacagccatcttcttgataaaaaggagcaaatatcttcagagccagaggacttcgcccagccgggggatgtgtactcccagagagatgttacaggcacaggtgagaataagtgtttgcactgtgagtttagtgctcactcctctgcttctctagagctgcatgtaaaacggaaacatacaaaagagtttgagttttattgcatggcatgcgattactacgcggtgactcgtcgcgagatgaccaggcatgcagcaacagagaagcacaaaatgaaaaggcagtcttatctcaactctgctaatgtagaagctggttctgcagacatgtccaaaaacatcattatgcctgaagaagagcatcaacaaaattctgaggaatttcaaataatttcaggtcaaccatctgatactcttaaatctagaaatgctgcagattgctctattttaaatgagaatactaatttagatatgtctaaagtgctctgcgctgctgactctgtagaagttgagactgaagaagaatctaatttcaatgaagaccattccttttgtgagactttccaacaggctcctgtcaaggataaagttaggaaacctgaggagatgatgtcacttactatgtcctcaaactatggctccccaagcagatttcaaaatgaaaattcaggaagctctgccttaaattgtgagacagcaaagaaaaaccatgagatatcgaatgatgcaggtgagctgcgtgtccattgtgagggtgaaggaggaaacgcaggagacggtggaggtgttgtcccccacagacacctgtgccctgtgacgctcgatggggagcgctcggctgaaagccctgtgctcgttgtgacaagaataaccagagaacagggaaatctggagagcgggggtcagaacagagttgcacgtgggcatggtttggaagacttgaaaggtgtccaagaagatcccgttctggggaataaggaaattctgatgaattcacaacatgaaacagaatttattttggaggaggatggcccagcttctgatagcacagttgaaagtagtgatgtctatgaaactataattagtattgatgataaagggcaggccatgtacagttttggtcgatttgactcctccataataagaataaagaaccctgaagatggtgagttgatagaccagtctgaagagggcttgatagcaacgggagtgagaattagtgagctgcccttgaaagactgtgctcaaggtgtgaaaaagaagaaatctgagggcagttccattggtgagtctacacgaattcgctgtgatgattgtggcttcttagcagatggactgagtggactgaatgttcacatagccatgaagcatcctacaaaagagaagcacttccattgtttactctgtggaaagtcgttctataccgaaagcaaccttcaccagcatctggctagtgccggccacatgagaaatgagcaggccagtgtggaggagcttccggagggaggggccacctttaaatgtgtcaagtgcacagagccctttgattctgaacagaatttatttttacatattaaaggacagcatgaggaattgctgcgggaggtgaataagtatatagtggaagacactgagcaaatcaaccgcgagagggaggaaaaccagggaaacgtctgcaagtattgtgggaagatgtgtcgaagcagcaactcgatggccttcctggcacacattcgcactcacacaggatcaaaaccattcaagtgcaagatatgccattttgcaacagctcagcttggagatgccagaaaccatgtgaaaaggcaccttgggatgagggaatacaagtgtcatgtctgtggggttgcttttgtaatgaagaagcacttaaatactcatctactaggcaagcatggagttggcaccccaaaagaaaggaaatttacatgccacttatgtgatagaagtttcacagagaagtgggccctgaacaaccacatgaaactccacacgggagaaaagccgtttaaatgtacctggcccacgtgccattactcattcctcacagcctccgcaatgaaagaccactacaggacgcacacaggcgagaagtcgtttctgtgtgacctctgcggctttgccggcgggacccgccacgccctcaccaagcatcgcagacagcacacaggagaaaaacctttcaagtgcgatgagtgtaactttgcctccacaactcagtcccatttgactcggcataaacgtgtccacactggagaaaagccctacagatgcccctggtgtgactacaggtcaaactgtgctgaaaatatccgcaaacacattctgcatactggcaaacatgaaggagtcaagatgtacaactgtcccaagtgtgactacgggaccaacgtcccggtggagttccggaaccatttgaaggaacagcatcctgacatcgaaaacccggacctcgcttacctgcatgctggcattgtttccaagtcgtacgagtgccgtctaaagggacaaggagccaccttcgtggagacagacagccccttcaccgcggcggccttggcagaagagcccctcgtcaaggagaagcccctcagaagcagcaggaggccagcgccgccccctgagcaggtgcagcaggtcatcatcttccagggctacgacggggagtttgccctggacccctcggtggaggagacggccgccgccacgctgcagacgctggccatggccggccaggtggcccgggtggtgcatatcacggaggatggccaggtcatcgccacgagtcagagcggggcacatgtaggcagcgtggtgcccggacccatcctccccgagcagctggctgatggagccacccaggtggtcgtcgtggggggctccatggaaggccacggcatggatgagtccctcagtccaggtggcgctgtgatacaacaggtgaccaagcaggagattttaaacctctcggaggctggagtcgctccccccgaggcatcctcagccctggatgcattgctctgtgcggtcactgaattaggggaggtggagggcagggctgggctcgaggagcaaggcaggcccggcgccaaagacgtgctgatccagctgcccgggcaggaggtctcccatgtggctgccgaccccgaggcccccgagatccagatgttcccacaggcccaggagagcccggccgccgtggaggtgctcacccaggtggtccatccctcagcagccatggcctctcaggagcgggcacaggtggccttcaagaagatggtccagggcgtcctccagtttgctgtgtgtgacacggccgcggccggccagttggtcaaggacggtgtcacccaggtggtggtgagcgaagagggtgccgtccacatggtcgccggggagggtgcccagatcatcatgcaggaggcgcagggcgagcacatggatctggtggagtccgacggggagatctcgcagatcatcgtgacggaggagctggtccaggccatggtgcaggagtccagtggcggcttctccgagggcaccacgcactacatcctgacagagctgcccccaggggtgcaggacgagccgggcctgtactcccacaccgtgctggagactgcggactcgcaggaactcctgcaggccggggccacgctaggcacagaggccggggccccaagcagggcagagcagctggccagcgtggtcatctacacccaggagggctcctcggccgcggcggcaattcagagccaaagagaaagcagcgaactccaggaagcatgagacgcgcggcacctttactcagcacagggcaggtgtgggaaggtccagcttcggtgggggaccgtgttccctgagcttcatctgaaaccttcaaaaccatgaggacaaggctcccgtgagctctgagcatgccctcccagcgagagtcacactggccaccagccaggcgcccacagagggtaccgtgggctgggcctcggggagcaggctgccaagtgcaggggagggccgggcgcaggccgcacagggagctccggtccactgggggcccttcgatcagtggcctcccgcttcgtcctggccgctgtgctgaagagaagccaagtgttgttggtgtttttctctcccaagtgttttcccatttcagttatcagaaggtcatggccgtggggaaagtggtgaagatacccctcctggcttggggtgcacctgcttgtgcagtcagcatgtagctgcctttccatttcattctctactgggctaaaaattgcagctacaagtgttaccatcttgaagcagtccacttccattcaattttttttttttaattttagaataacagtgtccccataccaaaggaagcctgctagctcatttcatgtataaatttcccatcttcaaacagtttaggtgtatttgttgctctggtcacattctgcataaaagaaatcctcttaagcctatggttaagaaaagccttgaagtttatattcagttaaaatatatgtcggtggagatagccagtgcttctaattttgacttagtttcatacagtaaagcctaaatgtgaaacgcacacgctggaagatattgttcctatcaatattttgctttttataacaagggtttgttcatattgatgccatttttgcaggatttcttcgtgatttctgtccatatgaaaatgctgacattaaacattaacacatggagaccgtgccctgtggccctgccgtggctgccagcatggtctgtgtttccttgtggattcacctgtggccctgctgtggccaccagcatggtctgtgtcctcgtggattcactgcagctgtcggatgcgagtttctgtcataatcatttgtttcctgatacaattgttcttattcttttccaaaactgtaaaataatctcctccctcaaatgcaaaggttgtttttgttctgtttctgttttctttgaaataaaattataacgttaaaagatc

SEQ ID NO: 3033 - DNA, 5595 bp, Homo sapiens
acaggttatgagtgccagtgagccgccttagatagaagcatcgtcagcactttattaatgatggatagtgagaataaacccgaaaatgatgaggatgaaaagataaacaaagaagcacaagacttgacaaagctttcatcccataatgaagacggtgggcctgtatctgatgtgatagcaagtttccctgagaattctatgggcaaaagaggtttttcagaatcatcgaactctgatagtgttgttataggagaagacagaaataaacatgcttccaaacgcaggaaattagatgaggcagagccccttaaatctggaaagcaaggtatttgtagattagaaacttctgagagctcagtcacagaagggggtattgcattagatgaaacagggaaggagacctttctgagtgactgcacagttggaggcacatgtctcccaaatgccctctccccttcttgcaattttagcactattgatgttgtttctctgaaaacagacactgaaaaaacatctgctcaggaaatggtttcccttgatctggaaagagaatctcctttccccccgaaagaaattagtgttagttgtaccattgggaatgtagatacagttctcaaatgcagcatctgtgggcatttgttttcttcttgctctgacttggaaaaacatgctgagtctcacatgcagcagcctaaggaacatacctgttgtcactgcagccacaaagcagagagcagctcagcactacatatgcatatcaaacaagcacatgggccacagaaggtcttttcctgtgatctttgtggttttcagtgttcagaagaaaacttgttgaatgcacattatcttggcaaaacacatctccgtcgtcagaatctggctgctcgtggaggatttgtacagatcttaacaaaacaaccttttcctaaaaaatcacgtacaatggcaacaaaaaatgttcactcaaaaccaagaacttctaaatcaatagcaaagaatagtgattcaaaaggattacgaaatgtgggaagcacgtttaaagatttcagaggaagtatttctaaacaaagtggtagtagcagtgagcttcttgttgaaatgatgccttccagaaatactttgtcacaggaagtagagattgttgaagaacatgttacttcccttggtctagctcagaatcctgaaaaccagagtagaaagctagacaccttagtaacctcagagggtctcttagagaaattggaatctacaaaaaatacccttcaggcagcacacggtaacagtgtaacctcgaggccaagacctgagcgaaatattctcgtgttgggtaatagctttcgtcgacgaagcagcactttcaccttgaagggccaggcaaagaaaaggtttaatcttttaggaattaaaagaggtacaagtgaaactcagaggatgtatatgaaacacttgagaacacagatgaaaacacacgatgcagaatcagtgctgaaacacctggaagcgtgcagcagtgtgcagagagtgtgtgtgactacctcagaaacccaggaggcagagcagggccaggggagtgcccgtcctccggactccgggctgcattccctgacagtgaagccagcttctggctctcagacgttgtgtgcttgtacagactgtgggcaagtagctacaaataggacagatttggaaatccatgtgaaaaggtgccatgccagagagatgaaattttactgccgtacttgtgacttctctagtatgtcaagaagggacttagatgaacatttgcacagtaaccagcatcagcaaactgcttctgtcctgagttgtcagtgttgttcatttatatccttggatgaaataaatcttagagaccacatgaaggaaaagcacaatatgcattttctttgcaccccttgtaatctgttctttttgtctgaaaaagatgtggaagaacacaaagccaccgagaagcatattaattcattggttcaaccaaagactttgcaatcatctaacagtgatttggttttacagactttacctttgagtactttagaatcagaaaacgcaaaagagtctatggatgactcaggaaaagcatctcaggaagaacctctgaagtccagggtaagccatggtaatgaagtgaggcattccagtaagcctcagtttcagtgtaagaagtgtttttataaaacaagatcttctactgttctcacgagacatataaagcttcggcatggtcaagactatcattttctttgtaaagcttgtaatctttattcattgagcaaagaaggaatggagaaacacattaaaagaagcaagcatcttgaaaatgctaagaaaaataatattggcttaagctttgaagaatgtattgaaagggtatgtataggtgcaaatgataaaaaagaagagtttgatgtttccggaaatggaaggattgaaggccatataggtgtgcaattacaagagcattcctatcttgagaagggcatgctggcgtctgaggaactgtcacagtctggtggtagcaccaaagatgatgaattagcttcaaccactactccaaagagagggagacctaaaggtaacatctcacggacgtgttcacactgtggccttttggcctctagtattacaaacttgactgttcacattagacgaaaacacagtcaccagtatagttatttatgcaaagtgtgtaagtattacactgtaactaagggagatatggaacgtcattgtgccaccaagaaacataaaggacgggtagaaatagaagcaagtggaaaacacagttcagatatcattgttggccctgaagggggtagccttgaagctggtaaaaagaatgctggctcagcagtgaccatgtcagatgaacatgctaacaaaccagctgagtcacccacctccgttttagagaagccagatcgtggaaactcaattgaagctgaagttgaaaatgtatttcattctctagatggagaagttaacagccatcttcttgataaaaaggagcaaatatcttcagagccagaggacttcgcccagccgggggatgtgtactcccagagagatgttacaggcacaggtgagaataagtgtttgcactgtgagtttagtgctcactcctctgcttctctagagctgcatgtaaaacggaaacatacaaaagagtttgagttttattgcatggcatgcgattactacgcggtgactcgtcgcgagatgaccaggcatgcagcaacagagaagcacaaaatgaaaaggcagtcttatctcaactctgctaatgtagaagctggttctgcagacatgtccaaaaacatcattatgcctgaagaagagcatcaacaaaattctgaggaatttcaaataatttcaggtcaaccatctgatactcttaaatctagaaatgctgcagattgctctattttaaatgagaatactaatttagatatgtctaaagtgctctgcgctgctgactctgtagaagttgagactgaagaagaatctaatttcaatgaagaccattccttttgtgagactttccaacaggctcctgtcaaggataaagttaggaaacctgaggagatgatgtcacttactatgtcctcaaactatggctccccaagcagatttcaaaatgaaaattcaggaagctctgccttaaattgtgagacagcaaagaaaaaccatgagatatcgaatgatgcaggtgagctgcgtgtccattgtgagggtgaaggaggaaacgcaggagacggtggaggtgttgtcccccacagacacctgtgccctgtgacgctcgatggggagcgctcggctgaaagccctgtgctcgttgtgacaagaataaccagagaacagggaaatctggagagcgggggtcagaacagagttgcacgtgggcatggtttggaagacttgaaaggtgtccaagaagatcccgttctggggaataaggaaattctgatgaattcacaacatgaaacagaatttattttggaggaggatggcccagcttctgatagcacagttgaaagtagtgatgtctatgaaactataattagtattgatgataaagggcaggccatgtacagttttggtcgatttgactcctccataataagaataaagaaccctgaagatggtgagttgatagaccagtctgaagagggcttgatagcaacgggagtgagaattagtgagctgcccttgaaagactgtgctcaaggtgtgaaaaagaagaaatctgagggcagttccattggtgagtctacacgaattcgctgtgatgattgtggcttcttagcagatggactgagtggactgaatgttcacatagccatgaagcatcctacaaaagagaagcacttccattgtttactctgtggaaagtcgttctataccgaaagcaaccttcaccagcatctggctagtgccggccacatgagaaatgagcaggccagtgtggaggagcttccggagggaggggccacctttaaatgtgtcaagtgcacagagccctttgattctgaacagaatttatttttacatattaaaggacagcatgaggaattgctgcgggaggtgaataagtatatagtggaagacactgagcaaatcaaccgcgagagggaggaaaaccagggaaacgtctgcaagtattgtgggaagatgtgtcgaagcagcaactcgatggccttcctggcacacattcgcactcacacaggatcaaaaccattcaagtgcaagatatgccattttgcaacagctcagcttggagatgccagaaaccatgtgaaaaggcaccttgggatgagggaatacaagtgtcatgtctgtggggttgcttttgtaatgaagaagcacttaaatactcatctactaggcaagcatggagttggcaccccaaaagaaagagtaaaggttgcatatcgaaagatcgggacgttgccaggaatacagaacaacaggaacgcgtcgagtgcctctgaagcccaaagtctttgtgagcacttttcataactgatgggacctgcagtgggaggattggctgaggacttattttggttgaagttagacatatttcattgtctttttttttttccttttatctgtgtacttctttgcatacttgaattcatttgtgtgatgtaaatcatcacacaaatgtaggctagtctagtgattttctggaaggaactgttattttaaaaattgagtactcagttttataaaattgtcatcatcaatgagttaaaaaaaaaaaaacccttaatgattcagggtttatttaaagctgactgtccaatcaaagtttttgtaagcatgccatgtgacaaatgcctggcatattcagtaaggaacatattaattattctaattaacacatgacttcagagaagtctttcgttaatcagcacatggatcttggttatttgtacccttttgggaaaatttcacactcagatgcaaaaataccaggctaaatacattgctttgtttgtatgtggagaggatattcatcacaatggtactatacatctaagaaaacagaaagtaattaaaatgctgattact

SEQ ID NO: 3034 - DNA, 5794 bp, Homo sapiens
atgatggatagtgagaataaacccgaaaatgatgaggatgaaaagataaacaaagaagcacaagacttgacaaagctttcatcccataatgaagacggtgggcctgtatctgatgtgatagcaagtttccctgagaattctatgggcaaaagaggtttttcagaatcatcgaactctgatagtgttgttataggagaagacagaaataaacatgcttccaaacgcaggaaattagatgaggcagagccccttaaatctggaaagcaaggtatttgtagattagaaacttctgagagctcagtcacagaagggggtattgcattagatgaaacagggaaggagacctttctgagtgactgcacagttggaggcacatgtctcccaaatgccctctccccttcttgcaattttagcactattgatgttgtttctctgaaaacagacactgaaaaaacatctgctcaggaaatggtttcccttgatctggaaagagaatctcctttccccccgaaagaaattagtgttagttgtaccattgggaatgtagatacagttctcaaatgcagcatctgtgggcatttgttttcttcttgctctgacttggaaaaacatgctgagtctcacatgcagcagcctaaggaacatacctgttgtcactgcagccacaaagcagagagcagctcagcactacatatgcatatcaaacaagcacatgggccacagaaggtcttttcctgtgatctttgtggttttcagtgttcagaagaaaacttgttgaatgcacattatcttggcaaaacacatctccgtcgtcagaatctggctgctcgtggaggatttgtacagatcttaacaaaacaaccttttcctaaaaaatcacgtacaatggcaacaaaaaatgttcactcaaaaccaagaacttctaaatcaatagcaaagaatagtgattcaaaaggattacgaaatgtgggaagcacgtttaaagatttcagaggaagtatttctaaacaaagtggtagtagcagtgagcttcttgttgaaatgatgccttccagaaatactttgtcacaggaagtagagattgttgaagaacatgttacttcccttggtctagctcagaatcctgaaaaccagagtagaaagctagacaccttagtaacctcagagggtctcttagagaaattggaatctacaaaaaatacccttcaggcagcacacggtaacagtgtaacctcgaggccaagacctgagcgaaatattctcgtgttgggtaatagctttcgtcgacgaagcagcactttcaccttgaagggccaggcaaagaaaaggtttaatcttttaggaattaaaagaggtacaagtgaaactcagaggatgtatatgaaacacttgagaacacagatgaaaacacacgatgcagaatcagtgctgaaacacctggaagcgtgcagcagtgtgcagagagtgtgtgtgactacctcagaaacccaggaggcagagcagggccaggggagtgcccgtcctccggactccgggctgcattccctgacagtgaagccagcttctggctctcagacgttgtgtgcttgtacagactgtgggcaagtagctacaaataggacagatttggaaatccatgtgaaaaggtgccatgccagagagatgaaattttactgccgtacttgtgacttctctagtatgtcaagaagggacttagatgaacatttgcacagtaaccagcatcagcaaactgcttctgtcctgagttgtcagtgttgttcatttatatccttggatgaaataaatcttagagaccacatgaaggaaaagcacaatatgcattttctttgcaccccttgtaatctgttctttttgtctgaaaaagatgtggaagaacacaaagccaccgagaagcatattaattcattggttcaaccaaagactttgcaatcatctaacagtgatttggttttacagactttacctttgagtactttagaatcagaaaacgcaaaagagtctatggatgactcaggaaaagcatctcaggaagaacctctgaagtccagggtaagccatggtaatgaagtgaggcattccagtaagcctcagtttcagtgtaagaagtgtttttataaaacaagatcttctactgttctcacgagacatataaagcttcggcatggtcaagactatcattttctttgtaaagcttgtaatctttattcattgagcaaagaaggaatggagaaacacattaaaagaagcaagcatcttgaaaatgctaagaaaaataatattggcttaagctttgaagaatgtattgaaagggtatgtataggtgcaaatgataaaaaagaagagtttgatgtttccggaaatggaaggattgaaggccatataggtgtgcaattacaagagcattcctatcttgagaagggcatgctggcgtctgaggaactgtcacagtctggtggtagcaccaaagatgatgaattagcttcaaccactactccaaagagagggagacctaaaggtaacatctcacggacgtgttcacactgtggccttttggcctctagtattacaaacttgactgttcacattagacgaaaacacagtcaccagtatagttatttatgcaaagtgtgtaagtattacactgtaactaagggagatatggaacgtcattgtgccaccaagaaacataaaggacgggtagaaatagaagcaagtggaaaacacagttcagatatcattgttggccctgaagggggtagccttgaagctggtaaaaagaatgctggctcagcagtgaccatgtcagatgaacatgctaacaaaccagctgagtcacccacctccgttttagagaagccagatcgtggaaactcaattgaagctgaagttgaaaatgtatttcattctctagatggagaagttaacagccatcttcttgataaaaaggagcaaatatcttcagagccagaggacttcgcccagccgggggatgtgtactcccagagagatgttacaggcacaggtgagaataagtgtttgcactgtgagtttagtgctcactcctctgcttctctagagctgcatgtaaaacggaaacatacaaaagagtttgagttttattgcatggcatgcgattactacgcggtgactcgtcgcgagatgaccaggcatgcagcaacagagaagcacaaaatgaaaaggcagtcttatctcaactctgctaatgtagaagctggttctgcagacatgtccaaaaacatcattatgcctgaagaagagcatcaacaaaattctgaggaatttcaaataatttcaggtcaaccatctgatactcttaaatctagaaatgctgcagattgctctattttaaatgagaatactaatttagatatgtctaaagtgctctgcgctgctgactctgtagaagttgagactgaagaagaatctaatttcaatgaagaccattccttttgtgagactttccaacaggctcctgtcaaggataaagttaggaaacctgaggagatgatgtcacttactatgtcctcaaactatggctccccaagcagatttcaaaatgaaaattcaggaagctctgccttaaattgtgagacagcaaagaaaaaccatgagatatcgaatgatgcaggtgagctgcgtgtccattgtgagggtgaaggaggaaacgcaggagacggtggaggtgttgtcccccacagacacctgtgccctgtgacgctcgatggggagcgctcggctgaaagccctgtgctcgttgtgacaagaataaccagagaacagggaaatctggagagcgggggtcagaacagagttgcacgtgggcatggtttggaagacttgaaaggtgtccaagaagatcccgttctggggaataaggaaattctgatgaattcacaacatgaaacagaatttattttggaggaggatggcccagcttctgatagcacagttgaaagtagtgatgtctatgaaactataattagtattgatgataaagggcaggccatgtacagttttggtcgatttgactcctccataataagaataaagaaccctgaagatggtgagttgatagaccagtctgaagagggcttgatagcaacgggagtgagaattagtgagctgcccttgaaagactgtgctcaaggtgtgaaaaagaagaaatctgagggcagttccattggtgagtctacacgaattcgctgtgatgattgtggcttcttagcagatggactgagtggactgaatgttcacatagccatgaagcatcctacaaaagagaagcacttccattgtttactctgtggaaagtcgttctataccgaaagcaaccttcaccagcatctggctagtgccggccacatgagaaatgagcaggccagtgtggaggagcttccggagggaggggccacctttaaatgtgtcaagtgcacagagccctttgattctgaacagaatttatttttacatattaaaggacagcatgaggaattgctgcgggaggtgaataagtatatagtggaagacactgagcaaatcaaccgcgagagggaggaaaaccagggaaacgtctgcaagtattgtgggaagatgtgtcgaagcagcaactcgatggccttcctggcacacattcgcactcacacaggatcaaaaccattcaagtgcaagatatgccattttgcaacagctcagcttggagatgccagaaaccatgtgaaaaggcaccttgggatgagggaatacaagtgtcatgtctgtggggttgcttttgtaatgaagaagcacttaaatactcatctactaggcaagcatggagttggcaccccaaaagaaaggaaatttacatgccacttatgtgatagaagtttcacagagaagtgggccctgaacaaccacatgaaactccacacgggagaaaagccgtttaaatgtacctggcccacgtgccattactcattcctcacagcctccgcaatgaaagaccactacaggacgcacacaggcgagaagtcgtttctgtgtgacctctgcggctttgccggcgggacccgccacgccctcaccaagcatcgcagacagcacacaggagaaaaacctttcaagtgcgatgagtgtaactttgcctccacaactcagtcccatttgactcggcataaacgtgtccacactggagaaaagccctacagatgcccctggtgtgactacaggtcaaactgtgctgaaaatatccgcaaacacattctgcatactggcaaacatgaaggagtcaagatgtacaactgtcccaagtgtgactacgggaccaacgtcccggtggagttccggaaccatttgaaggaacagcatcctgacatcgaaaacccggacctcgcttacctgcatgctggtaagggacagaaactgtgaaaacttgtttctaacaggatttcatgtgatcacagcagttataatgctatttgtacattaccatgatttattgtaatggagtagagtatgtgatagtatctgcttcaagacctatagaaaagtacattccagtttgatcccactcaactatgaaaacaggacttttcaactgtattttatcaaaaaaggaaatctgacagagtaattatttgatgactgtaaagttaataatagtaaatatttaaagcatagttgacctgaaatgagagtagttgttaaatcttcatatgttgactaattgctaaaattttaattttttttcttaaaaaatgcttgtgatttgaaa

SEQ ID NO: 3035 - DNA, 5662 bp, Homo sapiens
aaagggaagacggtgagccggaggagtcagtcagaggggcgagcaggagcgattccgtcgccaaacaggttatgagtgccagtgagccgccttagatagaagcatcgtcagcactttattaatgatggatagtgagaataaacccgaaaatgatgaggatgaaaagataaacaaagaagcacaagacttgacaaagctttcatcccataatgaagacggtgggcctgtatctgatgtgatagcaagtttccctgagaattctatgggcaaaagaggtttttcagaatcatcgaactctgatagtgttgttataggagaagacagaaataaacatgcttccaaacgcaggaaattagatgaggcagagccccttaaatctggaaagcaaggtatttgtagattagaaacttctgagagctcagtcacagaagggggtattgcattagatgaaacagggaaggagacctttctgagtgactgcacagttggaggcacatgtctcccaaatgccctctccccttcttgcaattttagcactattgatgttgtttctctgaaaacagacactgaaaaaacatctgctcaggaaatggtttcccttgatctggaaagagaatctcctttccccccgaaagaaattagtgttagttgtaccattgggaatgtagatacagttctcaaatgcagcatctgtgggcatttgttttcttcttgctctgacttggaaaaacatgctgagtctcacatgcagcagcctaaggaacatacctgttgtcactgcagccacaaagcagagagcagctcagcactacatatgcatatcaaacaagcacatgggccacagaaggtcttttcctgtgatctttgtggttttcagtgttcagaagaaaacttgttgaatgcacattatcttggcaaaacacatctccgtcgtcagaatctggctgctcgtggaggatttgtacagatcttaacaaaacaaccttttcctaaaaaatcacgtacaatggcaacaaaaaatgttcactcaaaaccaagaacttctaaatcaatagcaaagaatagtgattcaaaaggattacgaaatgtgggaagcacgtttaaagatttcagaggaagtatttctaaacaaagtggtagtagcagtgagcttcttgttgaaatgatgccttccagaaatactttgtcacaggaagtagagattgttgaagaacatgttacttcccttggtctagctcagaatcctgaaaaccagagtagaaagctagacaccttagtaacctcagagggtctcttagagaaattggaatctacaaaaaatacccttcaggcagcacacggtaacagtgtaacctcgaggccaagacctgagcgaaatattctcgtgttgggtaatagctttcgtcgacgaagcagcactttcaccttgaagggccaggcaaagaaaaggtttaatcttttaggaattaaaagaggtacaagtgaaactcagaggatgtatatgaaacacttgagaacacagatgaaaacacacgatgcagaatcagtgctgaaacacctggaagcgtgcagcagtgtgcagagagtgtgtgtgactacctcagaaacccaggaggcagagcagggccaggggagtgcccgtcctccggactccgggctgcattccctgacagtgaagccagcttctggctctcagacgttgtgtgcttgtacagactgtgggcaagtagctacaaataggacagatttggaaatccatgtgaaaaggtgccatgccagagagatgaaattttactgccgtacttgtgacttctctagtatgtcaagaagggacttagatgaacatttgcacagtaaccagcatcagcaaactgcttctgtcctgagttgtcagtgttgttcatttatatccttggatgaaataaatcttagagaccacatgaaggaaaagcacaatatgcattttctttgcaccccttgtaatctgttctttttgtctgaaaaagatgtggaagaacacaaagccaccgagaagcatattaattcattggttcaaccaaagactttgcaatcatctaacagtgatttggttttacagactttacctttgagtactttagaatcagaaaacgcaaaagagtctatggatgactcaggaaaagcatctcaggaagaacctctgaagtccagggtaagccatggtaatgaagtgaggcattccagtaagcctcagtttcagtgtaagaagtgtttttataaaacaagatcttctactgttctcacgagacatataaagcttcggcatggtcaagactatcattttctttgtaaagcttgtaatctttattcattgagcaaagaaggaatggagaaacacattaaaagaagcaagcatcttgaaaatgctaagaaaaataatattggcttaagctttgaagaatgtattgaaagggtatgtataggtgcaaatgataaaaaagaagagtttgatgtttccggaaatggaaggattgaaggccatataggtgtgcaattacaagagcattcctatcttgagaagggcatgctggcgtctgaggaactgtcacagtctggtggtagcaccaaagatgatgaattagcttcaaccactactccaaagagagggagacctaaaggtaacatctcacggacgtgttcacactgtggccttttggcctctagtattacaaacttgactgttcacattagacgaaaacacagtcaccagtatagttatttatgcaaagtgtgtaagtattacactgtaactaagggagatatggaacgtcattgtgccaccaagaaacataaaggacgggtagaaatagaagcaagtggaaaacacagttcagatatcattgttggccctgaagggggtagccttgaagctggtaaaaagaatgctggctcagcagtgaccatgtcagatgaacatgctaacaaaccagctgagtcacccacctccgttttagagaagccagatcgtggaaactcaattgaagctgaagttgaaaatgtatttcattctctagatggagaagttaacagccatcttcttgataaaaaggagcaaatatcttcagagccagaggacttcgcccagccgggggatgtgtactcccagagagatgttacaggcacaggtgagaataagtgtttgcactgtgagtttagtgctcactcctctgcttctctagagctgcatgtaaaacggaaacatacaaaagagtttgagttttattgcatggcatgcgattactacgcggtgactcgtcgcgagatgaccaggcatgcagcaacagagaagcacaaaatgaaaaggcagtcttatctcaactctgctaatgtagaagctggttctgcagacatgtccaaaaacatcattatgcctgaagaagagcatcaacaaaattctgaggaatttcaaataatttcaggtcaaccatctgatactcttaaatctagaaatgctgcagattgctctattttaaatgagaatactaatttagatatgtctaaagtgctctgcgctgctgactctgtagaagttgagactgaagaagaatctaatttcaatgaagaccattccttttgtgagactttccaacaggctcctgtcaaggataaagttaggaaacctgaggagatgatgtcacttactatgtcctcaaactatggctccccaagcagatttcaaaatgaaaattcaggaagctctgccttaaattgtgagacagcaaagaaaaaccatgagatatcgaatgatgcaggtgagctgcgtgtccattgtgagggtgaaggaggaaacgcaggagacggtggaggtgttgtcccccacagacacctgtgccctgtgacgctcgatggggagcgctcggctgaaagccctgtgctcgttgtgacaagaataaccagagaacagggaaatctggagagcgggggtcagaacagagttgcacgtgggcatggtttggaagacttgaaaggtgtccaagaagatcccgttctggggaataaggaaattctgatgaattcacaacatgaaacagaatttattttggaggaggatggcccagcttctgatagcacagttgaaagtagtgatgtctatgaaactataattagtattgatgataaagggcaggccatgtacagttttggtcgatttgactcctccataataagaataaagaaccctgaagatggtgagttgatagaccagtctgaagagggcttgatagcaacgggagtgagaattagtgagctgcccttgaaagactgtgctcaaggtgtgaaaaagaagaaatctgagggcagttccattggtgagtctacacgaattcgctgtgatgattgtggcttcttagcagatggactgagtggactgaatgttcacatagccatgaagcatcctacaaaagagaagcacttccattgtttactctgtggaaagtcgttctataccgaaagcaaccttcaccagcatctggctagtgccggccacatgagaaatgagcaggccagtgtggaggagcttccggagggaggggccacctttaaatgtgtcaagtgcacagagccctttgattctgaacagaatttatttttacatattaaaggacagcatgaggaattgctgcgggaggtgaataagtatatagtggaagacactgagcaaatcaaccgcgagagggaggaaaaccagggaaacgtctgcaagtattgtgggaagatgtgtcgaagcagcaactcgatggccttcctggcacacattcgcactcacacaggatcaaaaccattcaagtgcaagatatgccattttgcaacagctcagcttggagatgccagaaaccatgtgaaaaggcaccttgggatgagggaatacaagtgtcatgtctgtggggttgcttttgtaatgaagaagcacttaaatactcatctactaggcaagcatggagttggcaccccaaaagaaagagtaaaggttgcatatcgaaagatcgggacgttgccaggaatacagaacaacaggaacgcgtcgagtgcctctgaagcccaaagtctttgtgagcacttttcataactgatgggacctgcagtgggaggattggctgaggacttattttggttgaagttagacatatttcattgtctttttttttttccttttatctgtgtacttctttgcatacttgaattcatttgtgtgatgtaaatcatcacacaaatgtaggctagtctagtgattttctggaaggaactgttattttaaaaattgagtactcagttttataaaattgtcatcatcaatgagttaaaaaaaaaaaaacccttaatgattcagggtttatttaaagctgactgtccaatcaaagtttttgtaagcatgccatgtgacaaatgcctggcatattcagtaaggaacatattaattattctaattaacacatgacttcagagaagtctttcgttaatcagcacatggatcttggttatttgtacccttttgggaaaatttcacactcagatgcaaaaataccaggctaaatacattgctttgtttgtatgtggagaggatattcatcacaatggtactatacatctaagaaaacagaaagtaattaaaatgctgattactata

SEQ ID NO: 3036 - DNA, 2442 bp, Homo sapiens
gctttcccagctagtcgaatcactggtgcacctccggaatccgaggttcgcattgctctcggacagagttctgcctccccagtactcccaaactcccagtcctgtgcaccaatgaggtccagctctgaggcttctttcctgagaaaaaaatttggaagtccgtgactgtttcctggaggagctgagaagaggaagctcacttccggcgtagggaggctttctgacccggaatggaggaggcggaggagctgctcttggaggggaagaaggcgctgcaactcgcccgcgagccgcgcctgggcctggacttaggatggaacccttccggagaaggctgtacgcagggcctcaaagacgtcccacccgagccgacccgagacatcctcgctttaaagagccttccccggggcttggcccttggcccctcactcgccaaggaacagcgcttgggggtctggtgtgtcggggaccccctgcagcccggcctgctgtgggggccgctggaagaggagtctgcctccaaggagaagggcgagggagtaaagccacggcaggaggagaacctgtcattaggcccatggggagacgtgtgtgcctgtgagcagagttctggctggactagcttggtacaacggggcaggctggagagtgagggaaatgtggccccagtgcggatcagcgagaggcttcatctgcaagtgtaccagctggtgctgccaggctctgaactgctgctgtggccccagccttcctctgagggcccaagtctcacccagcctgggctggacaaagaggcagctgtagcagtggtgacagaagtggagtctgctgtacagcaggaagtggcctcccctggggaggatgcagcagaaccttgcatagatcctggttcccagtcaccctctggcatccaggcagagaatatggtgagccctggacttaagttcccaacccaggaccgaatttccaaggatagccagccacttggcccattgcttcaggatggcgacgtggatgaggaatgcccggcccaggcacagatgccacctgaacttcagagcaattcggctacccagcaggacccagatggcagtggagccagtttctcatcttctgccaggggcacccagccgcatggctacctggccaagaagttacacagccccagtgatcagtgcccacccagagcaaagaccccagagcctggagcccagcagtctggcttccctacactctcgcggagccctcctggcccagcaggaagctccccaaagcaggggcgacggtaccggtgtggagagtgtggcaaggcattcctacagctgtgccacctaaagaagcacgcatttgtgcacacgggccacaagccctttctttgcactgagtgtggcaagagctatagctcagaggagagcttcaaagcccatatgctgggccaccgtggggtgcggcccttcccctgtccacaatgcgacaaggcctatggcacccagcgagacctcaaagagcaccaggtggtacattcaggtgcccggccctttgcttgtgaccagtgtggcaaggcctttgcccgccggccctccctgcggctgcatcgcaagacccaccaggtgccagctgcccctgccccttgcccatgccctgtgtgtgggcggcccctggccaaccagggctccctgcggaaccatatgaggctccatacaggagaaaagcctttcctgtgcccgcactgtggccgggcgtttcgtcagcggggcaacctgcgtgggcatttgcggctccacaccggggagcgtccttaccgctgcccacactgtgccgatgccttcccccagctgcctgaactgcggcgccatctcatctcacacaccggggaggcccacttgtgcccggtgtgtggcaaggccctccgagacccacacacgctccgagctcacgagcgcctgcactccggagagaggccctttccctgtccccagtgtggccgtgcttacacgctggccaccaagctgcggcgccacctcaaatctcacttggaggacaagccctaccgctgccccacctgtggcatgggctacaccctcccgcagagcctcaggcggcatcagctcagtcaccggcctgaggcaccctgcagcccaccctctgtgccttctgctgcttctgagcccactgtggtgctcctgcaggctgagccacaactgctggacacacacagagaggaggaagtctcccccgccagggatgttgttgaggtcaccatttcagaaagccaggagaagtgctttgtggtgccagaggagccagatgccgcccccagcctggtgctaatccataaggacatgggcctcggcgcctgggcagaggtggtggaggtggagatgggcacctgacagctttgccttttgctgacacagctccataaagactcgtgctttctca

SEQ ID NO: 3037 - DNA, 4797 bp, Homo sapiens
agcgggcgggcatttcctgccggtgcctagggccgacggggacgctggcactggtggggagctgttggggggtcccgcatctagggctctcctttcctgcctccggcccccgcgaggggcgcgcgcctctccccgccctccagcagtcctggtagggcccgggcgcgtccgcgctctgcagcgggaggtcctcgtcgcctctcgtctccagccagcaccaagaggatggtggcccttggcctcctggtgcagagcatcagtcccacgctgggagtgtggagaggtgcgtgggaagcaagccattgaggaagtggggccaacagagaggtcagcagccccttagccctcacgcttccaaggaacagaatgatggagaagcctgcaggcagaaaaaagaagacgccgaccccaagggaggaggcagacgtgcagaagagtgcgctcagagaggagaaggtgtccggggacagaaagccacctgagaggcccactgtgcccaggaagccccgcacagagccctgcctgagtcctgaagacgaagagcacgtctttgatgccttcgacgcttcatttaaagatgactttgagggggttcccgtgttcattccttttcagaggaagaaaccctatgagtgcagtgagtgtgggcggatctttaagcacaagacagaccacattcgccatcagagggtccacactggagagaagcccttcaagtgtgcgcagtgcgggaaggccttccggcacagctctgacgtcaccaaacaccagaggactcacacgggagagaagcccttcaaatgcggggagtgcgggaaagcctttaactgcggctccaatctcctgaaacatcagaagacgcacaccggggagaagccctacgaatgcacgcactgtgggaaagcctttgcctacagctcctgtctcatccgccatcagaaacgccaccctcggaagaagccctgagccggggccatctgcggactcgggccctgcggtgcgagcctcgccggacacctgctccgtggctccctcgtgtcccgcgtctgatgggggcgcagggccgtgcgcactgtgttccgtgccctggggacccccggaaaagcagcccagtcagatgtgggaacgtgccagcgagggagagacctttccactgcagagagtctctctgatcaagacaccgcagtgatggagaagccaccagaggctccttgcagccacagagcattttccaagttcccgatggcgaacggggctcagcaccagagaccagggagtattcactgccatccattggacgtgtttgggtcacctcagagcacccagcaggagaggctcctggtgtagtgggcagcccagcacttcccgctgctgcctgcctgtgatgtccactctgcttaagcctttcatctgccgctgaaggccccagtctggactctctgccctctgggtccccgagctctgcagcgagccctgggaccactcatccctgcccagccagcttcagtgcccggggccgcttgtccctgcccggcctctgtgccccaactgtgcttggtcctctggcttctctcctcctgctggagtgccagtccctgagctcagacccccgtccccggaactgggccacaccacgtgccctcttggcccagccttcctcccagagaggcggcctgacttacctggatggacttgggacaaaggttcctcaggaccttggacaccaccacctgctgagcttcccgtcccagccatgcagtggggcccctggggtgccctcggcagcttcggtccagcctgcatctgcccctcggccttccgacgtgggcggtgggccccagccccacagaccagcccagcattcaggctggtagagcagatcacccccaaagcaagaagttccagatgaaatatgcataagaagcagcctcaaaactaacaaaaaagattcgcacattcctcagttagaggaggagcagagatgaagaaaaggagaagaaaagcgctggaaagagaagaaaaggaacctccttctgtgcagcaggctcctggcccagggagtgtggtgtgcggcagagtgcgtgcagggaagcagcctctgaaatcgtgcagggaagcaccctgtgaaatcgtgcagggaagcaccctgtgaaatcgtgcagggaagcaccctgtgaagtcgtgcagggaagcaccctctgaaatcgtgcagggaagcaccctctgaaatcgtgcagggaagcaccctgtgaagtcgtgcagggaagcaccttctgaaatcgtgcagggaagcaccctctgaaatcgtgcagggaagcaccctctgaaatgcctagaaatagctgccgggctttcacttggttcccaaatttcttcaaaggtcaaaaccatcacagtgggcaactttacaccccagtgttcactgtcctcaggccactgcagagccatcctagtggggcagtgggcgcggggcgggggctcctgactccggtgaggtcaccctggaggggagtcccaggaatcagcctgatgttcagaatgccttcctggcatctcagaagtgtactgggggagacgtgaggacctttcagccaagtgtcagcgttcttattgcaggagaacattaaagccacaacccagaaacttctcaggagcatggcgcacccacaccagccccgggctccgcctggacagcacctcctgggccgccctgaccagcagacaccatccttccagcctctcttggccacccggaccagcgggcaccaccctcccagcctcacgcggccaccctgaccagcaggcaccatccttccagccttgctcagtcaccctgacccagagggctgccctgaccagcgggcaccatcctcccagccccactcagctgccctgaccagcgggcaccatcctcccagcctcactcggccagccgagctctgtaggcctcagagtgcagagaacctcaaatgttgtgactttgctctgctgcagggacctgccatggagtgtcccttgtgcgagcattttgagagctatgccagcatccatccctgcaggtcccatccctgagccatttctcaggagagcaggaagggagcagggagaggggtgctcccagccagccccggaaccagaggtctggggacgcagccgaccagccctccttgtctgggcctctgtttcctcttcgacacagggaagcagggaggggccgatcagcgacttaggcctgttggctgtggtggggtccacctgcgtttctggggagcccacggaccctggggtgtacctgggtttcattcccagtgacctctcctattggtccccatttggggcgctgagatgtgatcgtttctttcctgagaatgagctgaggtaaaaacatgctggggaggaagatgggccctgggggcagcgagctgcgcctctgcaccgggagaaaggccgtgtccccagagctgaggcggtggtgggcagggctcctgagaagccggggcagggcagggtgtctctgaggtcaatgaggaacagctgaggtccagggacgcaggaaggatggggtgaactccgggatggggccggcagggagcctcacgcttacagagcctggtgttggcactctcctggcttcctccgcaaacctagccacgtggtcagggagcccgggcctagcagacggcccccaccttgacagaatccccagggtcgtgcgtggcggtgggggcgacttcacagccgagaccgggcctaacgctgctgtctcgcagtcacccctgcaggccgctcagggcagggctctggcctgacgggggttcctggacacgcctctgagccggcagcccctacccgcacccgtgcaccttccacgcccgtctccagcagcccctgcccccacccgcacccctgcacctgccacgcctgtctccggcagcccctgcccgcacccgcacccctgcacctgccacgcccgtctccggcagcacctgccacgcccgtctccggcagcacctgccacgcccgtctccggcagcacctgccacgcccgtctccggcagcccctgcccgcacccgcacccctgcacctgccacgcccgtctccggcagcccctgcctgcacccgcacccctcacggctgtctccggcagcccctgcccgcgcccgcacctctgcacctcccacgcccctctccggcagcccctgcccacacccgcacccctgcacctcccacgcccgtcttgccctggggcccaggtgcaggtctgtgaggagggcagccccgtgctcccgtggccaccgctcagccaaatggattcagcgagggtttttagtgtttgtgcctgtgtccccgtgtgcctgtttcctggtgaggctggatgcctggcatgtctgaacactcacattccccaggcatgcatgtgcagccgccgccgccacccatgtactgtggcgctgacccctcctgtaacagctgtggtcttggcctctcgtgttggtggcagatgtcccatttcccagttactttctgttgtccaaaagtttaactgtcctgccagccaaagctgctgagcattactctgatagaccatcagtccttggtaagtgtcctgtgcatctgggataagcatccgtttgttttcagctgcgctttctgtgacttgctctgcgtgagtcctcggtccacgtgggccgttgcgctggttcccagcctgcccgacacactcactgcgacgcctcccttgcctactgcttgctggcttctgtgttctctgcagtaaacattgatttctgactcga

SEQ ID NO: 3038 - DNA, 3284 bp, Homo sapiens
gggggcggagtcggctggggatggagccgctcgggccgagccctccaccgcccaccatcaccgagtccggcccaggctcctagcgcggccgccggaaggggcgggtcagcgggcgggcatttcctgccggtgcctagggccgacggggacgctggcactggtggggagctgttggggggtcccgcatctagggctctcctttcctgcctccggcccccgcgaggggcgcgcgcctctccccgccctccagcagtcctggtagggcccgggcgcgtccgcgctctgcagcgggaggtcctcgtcgcctctcgtctccagccaggtactcactgggctcctgcctgccgcctccggcccaggacgcgcagcgtcggtatgggccccgccgcctccccgcaccccggcgctccagggatgtggcaagacccggctttgagcacctcccgggcgccggccccgaggccgacctagctctgcacgtgggccgcggggctctgccgttgaaaggagagcctctaactaggagcacgcacgggaccctggcgggcccctccgcctggctcagatgcctggcatctcaggccttggcacagctagcaggcccctggcaggccgtggacccagcaggctgttttagtgcagattgcccctgaatctcaagcccactaatgttccagtctctccatgagacccagatccctgaaagtagtggagggaggcgccagggtgagtgaggttttctaggcagcccttaccgcccacggatacccagagcttcatattacaagtgaagggtcctccgcccagagaggcgacggagctacgctggagttgcacgacagaaccagaaccccagtctttaggggtgtggcaagcgtgggttgcgctgtttgtaactagctaatcactcctgtctacaggcctgtgagcaccaagaggatggtggcccttggcctcctggtgcagagcatcagtcccacgctgggagtgtggagaggtgcgtgggaagcaagccattgaggaagtggggccaacagagaggtcagcagccccttagccctcacgcttccaaggaacagaatgatggagaagcctgcaggcagaaaaaagaagacgccgaccccaagggaggaggcagacgtgcagaagagtgcgctcagagaggagaaggtgtccggggacagaaagccacctgagaggcccactgtgcccaggaagccccgcacagagccctgcctgagtcctgaagacgaagagcacgtctttgatgccttcgacgcttcatttaaagatgactttgagggggttcccgtgttcattccttttcagaggaagaaaccctatgagtgcagtgagtgtgggcggatctttaagcacaagacagaccacattcgccatcagagggtccacactggagagaagcccttcaagtgtgcgcagtgcgggaaggccttccggcacagctctgacgtcaccaaacaccagaggactcacacgggagagaagcccttcaaatgcggggagtgcgggaaagcctttaactgcggctccaatctcctgaaacatcagaagacgcacaccggggagaagccctacgaatgcacgcactgtgggaaagcctttgcctacagctcctgtctcatccgccatcagaaacgccaccctcggaagaagccctgagccggggccatctgcggactcgggccctgcggtgcgagcctcgccggacacctgctccgtggctccctcgtgtcccgcgtctgatgggggcgcagggccgtgcgcactgtgttccgtgccctggggacccccggaaaagcagcccagtcagatgtgggaacgtgccagcgagggagagacctttccactgcagagagtctctctgatcaagacaccgcagtgatggagaagccaccagaggctccttgcagccacagagcattttccaagttcccgatggcgaacggggctcagcaccagagaccagggagtattcactgccatccattggacgtgtttgggtcacctcagagcacccagcaggagaggctcctggtgtagtgggcagcccagcacttcccgctgctgcctgcctgtgatgtccactctgcttaagcctttcatctgccgctgaaggccccagtctggactctctgccctctgggtccccgagctctgcagcgagccctgggaccactcatccctgcccagccagcttcagtgcccggggccgcttgtccctgcccggcctctgtgccccaactgtgcttggtcctctggcttctctcctcctgctggagtgccagtccctgagctcagacccccgtccccggaactgggccacaccacgtgccctcttggcccagccttcctcccagagaggcggcctgacttacctggatggacttgggacaaaggttcctcaggaccttggacaccaccacctgctgagcttcccgtcccagccatgcagtggggcccctggggtgccctcggcagcttcggtccagcctgcatctgcccctcggccttccgacgtgggcggtgggccccagccccacagaccagcccagcattcagggcaggacatcctggtgggccccctggcccggatctccttatgcagccgttcccggtatgtcctgaggctggacggcctcagccagctgtcaccaggagaggaatactcgcactcccagaaatggacatatcaggaggtgaattgttcagaagcaggcatcagagcacgtgtgacgtgtgatcctggatcggaagagttgctttgaaggactttgctgggacgtttggccgacctggattgtagactccaggcacagtcaactgcaggcacagtcaactgcaggcacagtcagcaccagcgcagcagggacggggcggtcctcactgacgtcctcctactgcagatgcacactgaggctcttggccgcagagcgtggcgtctgcagttcatgccaacggtgtgtgcacgtccccggagagtgacagaggagagtggctaaatgtcagtcatggggaatctagagcacaggtgggcacgcttctccgatgaagggtcaggcaggaaatattcttggcactgcagccatacagcctgtgcctcagcacccacgggggaccacagaaggttggggaccactgctttaaacaactagctctcccgtgaagagcaggtccccaccctgctgtgtagggcaacagcagatgtcaatggcatatgaatgaacgagcgtggctgtgccaataaaactttatttacaaacgta

SEQ ID NO: 3039 - DNA, 2897 bp, Homo sapiens
gggaggtcctcgtcgcctctcgtctccagccaggtactcactgggctcctgcctgccgcctccggcccaggacgcgcagcgtcggtatgggccccgccgcctccccgcaccccggcgctccagggatgtggcaagacccggctttgagcacctcccgggcgccggccccgaggccgacctagctctgcacgtgggccgcggggctctgccgttgaaaggagagcctctaactaggagcacgcacgggaccctggcgggcccctccgcctggctcagatgcctggcatctcaggccttggcacagctagcaggcccctggcaggccgtggacccagcaggctgttttagtgcagattgcccctgaatctcaagcccactaatgttccagtctctccatgagacccagatccctgaaagtagtggagggaggcgccagggtgagtgaggttttctaggcagcccttaccgcccacggatacccagagcttcatattacaagtgaagggtcctccgcccagagaggcgacggagctacgctggagttgcacgacagaaccagaaccccagtctttaggggtgtggcaagcgtgggttgcgctgtttgtaactagctaatcactcctgtctacaggcctgtgagcaccaagaggatggtggcccttggcctcctggtgcagagcatcagtcccacgctgggagtgtggagaggtgcgtgggaagcaagccattgaggaagtggggccaacagagaggtcagcagccccttagccctcacgcttccaaggaacagaatgatggagaagcctgcaggcagaaaaaagaagacgccgaccccaagggaggaggcagacgtgcagaagagtgcgctcagagaggagaaggtgtccggggacagaaagccacctgagaggcccactgtgcccaggaagccccgcacagagccctgcctgagtcctgaagacgaagagcacgtctttgatgccttcgacgcttcatttaaagatgactttgagggggttcccgtgttcattccttttcagaggaagaaaccctatgagtgcagtgagtgtgggcggatctttaagcacaagacagaccacattcgccatcagagggtccacactggagagaagcccttcaagtgtgcgcagtgcgggaaggccttccggcacagctctgacgtcaccaaacaccagaggactcacacgggagagaagcccttcaaatgcggggagtgcgggaaagcctttaactgcggctccaatctcctgaaacatcagaagacgcacaccggggagaagccctacgaatgcacgcactgtgggaaagcctttgcctacagctcctgtctcatccgccatcagaaacgccaccctcggaagaagccctgagccggggccatctgcggactcgggccctgcggtgcgagcctcgccggacacctgctccgtggctccctcgtgtcccgcgtctgatgggggcgcagggccgtgcgcactgtgttccgtgccctggggacccccggaaaagcagcccagtcagatgtgggaacgtgccagcgagggagagacctttccactgcagagagtctctctgatcaagacaccgcagtgatggagaagccaccagaggctccttgcagccacagagcattttccaagttcccgatggcgaacggggctcagcaccagagaccagggagtattcactgccatccattggacgtgtttgggtcacctcagagcacccagcaggagaggctcctggtgtagtgggcagcccagcacttcccgctgctgcctgcctgtgatgtccactctgcttaagcctttcatctgccgctgaaggccccagtctggactctctgccctctgggtccccgagctctgcagcgagccctgggaccactcatccctgcccagccagcttcagtgcccggggccgcttgtccctgcccggcctctgtgccccaactgtgcttggtcctctggcttctctcctcctgctggagtgccagtccctgagctcagacccccgtccccggaactgggccacaccacgtgccctcttggcccagccttcctcccagagaggcggcctgacttacctggatggacttgggacaaaggttcctcaggaccttggacaccaccacctgctgagcttcccgtcccagccatgcagtggggcccctggggtgccctcggcagcttcggtccagcctgcatctgcccctcggccttccgacgtgggcggtgggccccagccccacagaccagcccagcattcaggctcccctggctccagccctaaggtgctctcccagccgtccgacctggatctccaagacgtagaggaagtggagatcggcagagacaccttctggcccgactccgagcccaagccggagcaggctccacgctctcctggctctcaggcccctgacgagggggcgggcggggcgctgcgcagcctcctgaggagccttccccgcagggcccggtgcagcgccggcttcgggcctgaatccagcgcggagcggccggcgggccagccgcctggggccgtcccttgcgcccagccgcggggcgcctggcgcgtgacgctcgtgcagcaagcagcggccgggcccgagggtgcgcccgagcgggctgccgagctgggagtcaacttcggtcggagccggcagggcagcgcgcggggggccaagccgcacaggtgcgaggcctgcggcaagagtttcaagtataactcgctgctcctgaagcaccagcgcatccacacgggcgagaagccctacgcctgccacgagtgcggcaagcgcttccgcggctggtcgggcttcatccagcaccaccgcatccacacgggcgagaagccctacgagtgcggccagt

SEQ ID NO: 3040 - DNA, 2293 bp, Homo sapiens
gccaaacttcctgtcccgcgctcgagctgcttccggcgggagccggaagacgctgtgtgtggacggaattcgggaccgactgacggccggccggcttcccggaactggaaggttacattgattacccacctagtacaacatcttacgggaagagcatagtatttcctagaggaatatgaacataacaggaaggtatcattggctctgaattaaatttgaacttgtcccctgaatagctacaggttttggaagctgaatcaatgttatcagatgagttagaatccaaaccagagctcctggtacagtttgttcagaatacgtccatcccattgggacaggggcttgtagaatcagaagctaaagatattacttgcttgtccctccttcccgtgactgaagcctcagaatgcagtcggctaatgttaccagatgatactacaaatcattctaactcctccaaggaggtcccttcctcagctgttttgagaagccttcgggtgaatgtgggtccagacggagaggagacgagagctcagactgtacagaaatccccggagtttttgtccacttcagagtcttctagcttgttgcaagatctacagccaagtgatagcacttcttttattcttcttaacctaacaagagcaggtctgggctcttcagctgagcacttagtgtttgtacaggatgaggcagaagattcagggaatgatttcctctccagtgagagcacagacagtagcattccatggttcctccgggttcaggagttggcccatgacagtttgattgctgctactcgtgcacaactggcaaagaatgcaaaaaccagcagcaatggagaaaatgtccaccttggttctggtgatgggcagtcaaaagattctgggccccttcctcaagtggaaaagaagctcaagtgtacagttgaaggttgtgaccggacatttgtatggccagctcactttaaataccacctcaagactcatcgaaatgaccgctccttcatctgtcctgcagaaggttgtgggaaaagcttctatgtgctgcagaggctgaaggtgcacatgaggacccacaatggagagaagccctttatgtgccatgagtctggctgtggtaagcagtttactacagctggaaacctgaagaaccaccggcgcatccacacaggagagaaacctttcctttgtgaagcccaaggatgtggccgttcctttgctgagtattctagcctccgaaaacatctggtggttcactcaggagagaagcctcatcagtgccaagtctgtgggaagaccttctctcagagtggaagcaggaatgtgcatatgagaaagcatcacctgcagctgggagcagctgggagtcaagagcaggagcaaactgaggtgcttgctgaaggatccccacgttccctgtcttcagtgcctgatgtgacacatcacctggtgaccatgcagtcagggaggcaatcatatgaagtttctgtcttaactgcagtaaatccacaagagttactaaaccaaggagatttaactgaaagacggacatgagcgtgggtgctgactcctggaagagcaactctatctgatctcaaaatgcgtatactgggaacaggatgccttagcccacaacagaaccagaatgaatctttgaaggcacaagactctgcttttgccactcttcctctttcctggtatagaagatggatgtaggagagcttcttttctaactaccatctgatcagacaaggaatgaagcaatgactgtgggctgggaaactgtacctacctctcttcccactgcaaatttctgggatagaccaaaagtgaatttgattatgtgttggctgaagttcttcattctgactgttgaggggaggttttcctttgaagagttttcatcccagactcagctgtcttttcacatggatgaaataattcctgctaccaacaacagagcttcaccaggaagttgagttttcaagatgccttgttgctttgaagaagggagtgatgtcaattctcttgttacattctccctttagcaacctgagtaagagactctctgccactgggctgcaaaaaaataaattacttgaatctccccttggcccaggctgaggtactatcttgtcctatacacttctacttggtcactttgctttcttcgttaatggaacatacagtagcatgttaagagggatttcatgtttttgtttttttaaagttaaaaattacatgatgcagagattcaggttttcctttaaataaacaaaacagcccagtca

SEQ ID NO: 3041 - DNA, 2193 bp, Homo sapiens
aggttacattgattacccacctagtacaacatcttacgggaagagcatagtatttcctagaggaatatgaacataacaggaagctcctggtacagtttgttcagaatacgtccatcccattgggacaggggcttgtagaatcagaagctaaagatattacttgcttgtccctccttcccgtgactgaagcctcagaatgcagtcggctaatgttaccagatgatactacaaatcattctaactcctccaaggaggtcccttcctcagctgttttgagaagccttcgggtgaatgtgggtccagacggagaggagacgagagctcagactgtacagaaatccccggagtttttgtccacttcagagtcttctagcttgttgcaagatctacagccaagtgatagcacttcttttattcttcttaacctaacaagagcaggtctgggctcttcagctgagcacttagtgtttgtacaggatgaggcagaagattcagggaatgatttcctctccagtgagagcacagacagtagcattccatggttcctccgggttcaggagttggcccatgacagtttgattgctgctactcgtgcacaactggcaaagaatgcaaaaaccagcagcaatggagaaaatgtccaccttggttctggtgatgggcagtcaaaagattctgggccccttcctcaagtggaaaagaagctcaagtgtacagttgaaggttgtgaccggacatttgtatggccagctcactttaaataccacctcaagactcatcgaaatgaccgctccttcatctgtcctgcagaaggttgtgggaaaagcttctatgtgctgcagaggctgaaggtgcacatgaggacccacaatggagagaagccctttatgtgccatgagtctggctgtggtaagcagtttactacagctggaaacctgaagaaccaccggcgcatccacacaggagagaaacctttcctttgtgaagcccaaggatgtggccgttcctttgctgagtattctagcctccgaaaacatctggtggttcactcaggagagaagcctcatcagtgccaagtctgtgggaagaccttctctcagagtggaagcaggaatgtgcatatgagaaagcatcacctgcagctgggagcagctgggagtcaagagcaggagcaaactgctgagccactaatgggcagtagtttgcttgaagaggcttcagtacccagtaaaaacctggtgtctatgaattcccagcccagccttggtggagagtccttgaacctaccaaataccaattctatcctgggagttgatgatgaggtgcttgctgaaggatccccacgttccctgtcttcagtgcctgatgtgacacatcacctggtgaccatgcagtcagggaggcaatcatatgaagtttctgtcttaactgcagtaaatccacaagagttactaaaccaaggagatttaactgaaagacggacatgagcgtgggtgctgactcctggaagagcaactctatctgatctcaaaatgcgtatactgggaacaggatgccttagcccacaacagaaccagaatgaatctttgaaggcacaagactctgcttttgccactcttcctctttcctggtatagaagatggatgtaggagagcttcttttctaactaccatctgatcagacaaggaatgaagcaatgactgtgggctgggaaactgtacctacctctcttcccactgcaaatttctgggatagaccaaaagtgaatttgattatgtgttggctgaagttcttcattctgactgttgaggggaggttttcctttgaagagttttcatcccagactcagctgtcttttcacatggatgaaataattcctgctaccaacaacagagcttcaccaggaagttgagttttcaagatgccttgttgctttgaagaagggagtgatgtcaattctcttgttacattctccctttagcaacctgagtaagagactctctgccactgggctgcaaaaaaataaattacttgaatctccccttggcccaggctgaggtactatcttgtcctatacacttctacttggtcactttgctttcttcgttaatggaacatacagtagcatgttaagagggatttcatgtttttgtttttttaaagttaaaaattacatgatgcagagattcaggt

SEQ ID NO: 3042 - DNA, 2076 bp, Homo sapiens
aattcgggaccgactgacggccggccggcttcccggaactggaaggttacattgattacccacctagtacaacatcttacgggaagagcatagtatttcctagaggaatatgaacataacaggaaggtatcattggctctgaattaaatttgaacttgtcccctgaatagctacaggttttggaagctgaatcaatgttatcagatgagttagaatccaaaccagagctcctggtacagtttgttcagaatacgtccatcccattgggacaggggcttgtagaatcagaagctaaagatattacttgcttgtccctccttcccgtgactgaagcctcagaatgcagtcggctaatgttaccagaacctgttccatggagagaagaggatggaaagtcaggctgcagtgacttgaatgatactacaaatcattctaactcctccaaggaggtcccttcctcagctgttttgagaagccttcgggtgaatgtgggtccagacggagaggagacgagagctcagactgtacagaaatccccggagtttttgtccacttcagagtcttctagcttgttgcaagatctacagccaagtgatagcacttcttttattcttcttaacctaacaagagcaggtctgggctcttcagctgagcacttagtgtttgtacaggatgaggcagaagattcagggaatgatttcctctccagtgagagcacagacagtagcattccatggttcctccgggttcaggagttggcccatgacagtttgattgctgctactcgtgcacaactggcaaagaatgcaaaaaccagcagcaatggagaaaatgtccaccttggttctggtgatgggcagtcaaaagattctgggccccttcctcaagtggaaaagaagctcaagtgtacagttgaaggttgtgaccggacatttgtatggccagctcactttaaataccacctcaagactcatcgaaatgaccgctccttcatctgtcctgcagaaggttgtgggaaaagcttctatgtgctgcagaggctgaaggtgcacatgaggacccacaatggagagaagccctttatgtgccatgagtctggctgtggtaagcagtttactacagctggaaacctgaagaaccaccggcgcatccacacaggagagaaacctttcctttgtgaagcccaaggatgtggccgttcctttgctgagtattctagcctccgaaaacatctggtggttcactcaggagagaagcctcatcagtgccaagtctgtgggaagaccttctctcagagtggaagcaggaatgtgcatatgagaaagcatcacctgcagctgggagcagctgggagtcaagagcaggagcaaactgctgagccactaatgggcagtagtttgcttgaagaggcttcagtacccagtaaaaacctggtgtctatgaattcccagcccagccttggtggagagtccttgaacctaccaaataccaattctatcctgggagttgatgatgaggtgcttgctgaaggatccccacgttccctgtcttcagtgcctgatgtgacacatcacctggtgaccatgcagtcagggaggcaatcatatgaagtttctgtcttaactgcagtaaatccacaagagagtctcgctccgttgcccaggctggagtgcagtggtgcgttctcggctcactgcaacctctgcctcccaggttcaagcgattctcctgcctcagcctcctgagtagctgctactacagttactaaaccaaggagatttaactgaaagacggacatgagcgtgggtgctgactcctggaagagcaactctatctgatctcaaaatgcgtatactgggaacaggatgccttagcccacaacagaaccagaatgaatctttgaaggcacaagactctgcttttgccactcttcctctttcctggtatagaagatggatgtaggagagcttcttttctaactaccatctgatcagacaaggaatgaagcaatgactgtgggctgggaaactgtacctacctctcttcccactgcaaatttctgggatagaccaaaag

SEQ ID NO: 3043 - DNA, 2063 bp, Homo sapiens
gtgtgtggacggaattcgggaccgactgacggccggccggcttcccggaactggaaggttacattgattacccacctagtacaacatcttacgggaagagcatagtatttcctagaggaatatgaacataacaggaaggtatcattggctctgaattaaatttgaacttgtcccctgaatagctacaggttttggaagctgaatcaatgttatcagatgagttagaatccaaaccagagctcctggtacagtttgttcagaatacgtccatcccattgggacaggggcttgtagaatcagaagctaaagatattacttgcttgtccctccttcccgtgactgaagcctcagaatgcagtcggctaatgttaccagatgatactacaaatcattctaactcctccaaggaggtcccttcctcagctgttttgagaagccttcgggtgaatgtgggtccagacggagaggagtttttgtccacttcagagtcttctagcttgttgcaagatctacagccaagtgatagcacttcttttattcttcttaacctaacaagagcaggtctgggctcttcagctgagcacttagtgtttgtacaggatgaggcagaagattcagggaatgatttcctctccagtgagagcacagacagtagcattccatggttcctccgggttcaggagttggcccatgacagtttgattgctgctactcgtgcacaactggcaaagaatgcaaaaaccagcagcaatggagaaaatgtccaccttggttctggtgatgggcagtcaaaagattctgggccccttcctcaagtggaaaagaagctcaagtgtacagttgaaggttgtgaccggacatttgtatggccagctcactttaaataccacctcaagactcatcgaaatgaccgctccttcatctgtcctgcagaaggttgtgggaaaagcttctatgtgctgcagaggctgaaggtgcacatgaggacccacaatggagagaagccctttatgtgccatgagtctggctgtggtaagcagtttactacagctggaaacctgaagaaccaccggcgcatccacacaggagagaaacctttcctttgtgaagcccaaggatgtggccgttcctttgctgagtattctagcctccgaaaacatctggtggttcactcaggagagaagcctcatcagtgccaagtctgtgggaagaccttctctcagagtggaagcaggaatgtgcatatgagaaagcatcacctgcagctgggagcagctgggagtcaagagcaggagcaaactgctgagccactaatgggcagtagtttgcttgaagaggcttcagtacccagtaaaaacctggtgtctatgaattcccagcccagccttggtggagagtccttgaacctaccaaataccaattctatcctgggagttgatgatgaggtgcttgctgaaggatccccacgttccctgtcttcagtgcctgatgtgacacatcacctggtgaccatgcagtcagggaggcaatcatatgaagtttctgtcttaactgcagtaaatccacaagagttactaaaccaaggagatttaactgaaagacggacatgagcgtgggtgctgactcctggaagagcaactctatctgatctcaaaatgcgtatactgggaacaggatgccttagcccacaacagaaccagaatgaatctttgaaggcacaagactctgcttttgccactcttcctctttcctggtatagaagatggatgtaggagagcttcttttctaactaccatctgatcagacaaggaatgaagcaatgactgtgggctgggaaactgtacctacctctcttcccactgcaaatttctgggatagaccaaaagtgaatttgattatgtgttggctgaagttcttcattctgactgttgaggggaggttttcctttgaagagttttcatcccagactcagctgtcttttcacatggatgaaataattcctgctaccaacaacagagcttcaccaggaagttgagttttcaagatgccttgttgctttgaag

SEQ ID NO: 3044 - DNA, 1722 bp, Homo sapiens
aggagtcccgaaggccgagagtgagtgagtgagtgggagcggggcggctgcggctcctcctgtccggggcggagccctgcgtcgcgggcctggggaggccccgccagcacccttgacgtctgggtcccgagcagtgcggcagccacacgacactgaggcgagcgagtgggtgtgtgcgtggggggtcagccaaacttcctgtcccgcgctcgagctgcttccggcgggagccggaagacgctgtgtgtggacggaattcgggaccgactgacggccggccggcttcccggaactggaaggttacattgattacccacctagtacaacatcttacgggaagagcatagtatttcctagaggaatatgaacataacaggaaggtatcattggctctgaattaaatttgaacttgtcccctgaatagctacaggttttggaagctgaatcaatgttatcagatgagttagaatccaaaccagagctcctggtacagtttgttcagaatacgtccatcccattgggacaggggcttgtagaatcagaagctaaagatattacttgcttgtccctccttcccgtgactgaagcctcagaatgcagtcggctaatgttaccaggtctgggctcttcagctgagcacttagtgtttgtacaggatgaggcagaagattcagggaatgatttcctctccagtgagagcacagacagtagcattccatggttcctccgggttcaggagttggcccatgacagtttgattgctgctactcgtgcacaactggcaaagaatgcaaaaaccagcagcaatggagaaaatgtccaccttggttctggtgatgggcagtcaaaagattctgggccccttcctcaagtggaaaagaagctcaagtgtacagttgaaggttgtgaccggacatttgtatggccagctcactttaaataccacctcaagactcatcgaaatgaccgctccttcatctgtcctgcagaaggttgtgggaaaagcttctatgtgctgcagaggctgaaggtgcacatgaggacccacaatggagagaagccctttatgtgccatgagtctggctgtggtaagcagtttactacagctggaaacctgaagaaccaccggcgcatccacacaggagagaaacctttcctttgtgaagcccaaggatgtggccgttcctttgctgagtattctagcctccgaaaacatctggtggttcactcaggagagaagcctcatcagtgccaagtctgtgggaagaccttctctcagagtggaagcaggaatgtgcatatgagaaagcatcacctgcagctgggagcagctgggagtcaagagcaggagcaaactgctgagccactaatgggcagtagtttgcttgaagaggcttcagtacccagtaaaaacctggtgtctatgaattcccagcccagccttggtggagagtccttgaacctaccaaataccaattctatcctgggagttgatgatgaggtgcttgctgaaggatccccacgttccctgtcttcagtgcctgatgtgacacatcacctggtgaccatgcagtcagggaggcaatcatatgaagtttctgtcttaactgcagtaaatccacaagagttactaaaccaaggagatttaactgaaagacggacatgagcgtgggtgctgactcctggaagagcaactctatctgatctcaaaatgcgtatact

SEQ ID NO: 3045 - DNA, 537 bp, Homo sapiens
ttttatgggttttgatgcctgttgagcttgttgtattttaaaagaagtgtttcggtttgaattctttatttgcttgcttgttgtgattttttttgtatatgtaaagaagtgtctttatgtacctgtgttttcccactgctcttaatgccccctctctcttttttacccctattctaggttacattgattacccacctagtacaacatcttacgggaagagcatagtatttcctagaggaatatgaacataacaggaaggtatcattggctctgaattaaatttgaacttgtcccctgaatagctacaggttttggaagctgaatcaatgttatcagatgagttagaatccaaaccagagctcctggtacagtttgttcagaatacgtccatcccattgggacaggggcttgtagaatcagaagctaaagatattacttgcttgtccctccttcccgtgactgaagcctcagaatgcagtcggctaatgttaccagatgatactacaaatcattctaactcctccaaggaggtccctt

SEQ ID NO: 3046 - DNA, 2601 bp, Homo sapiens
aattcgggaccgactgacggccggccggcttcccggaactggaaggttacattgattacccacctagtacaacatcttacgggaagagcatagtatttcctagaggaatatgaacataacaggaaggtatcattggctctgaattaaatttgaacttgtcccctgaatagctacaggttttggaagctgaatcaatgttatcagatgagttagaatccaaaccagagctcctggtacagtttgttcagaatacgtccatcccattgggacaggggcttgtagaatcagaagctaaagatattacttgcttgtccctccttcccgtgactgaagcctcagaatgcagtcggctaatgttaccagatgatactacaaatcattctaactcctccaaggaggtcccttcctcagctgttttgagaagccttcgggtgaatgtgggtccagacggagaggagacgagagctcagactgtacagaaatccccggagtttttgtccacttcagagtcttctagcttgttgcaagatctacagccaagtgatagcacttcttttattcttcttaacctaacaagagcaggtctgggctcttcagctgagcacttagtgtttgtacaggatgaggcagaagattcagggaatgatttcctctccagtgagagcacagacagtagcattccatggttcctccgggttcaggagttggcccatgacagtttgattgctgctactcgtgcacaactggcaaagaatgcaaaaaccagcagcaatggagaaaatgtccaccttggttctggtgatgggcagtcaaaagattctgggccccttcctcaagtggaaaagaagctcaagtgtacagttgaaggttgtgaccggacatttgtatggccagctcactttaaataccacctcaagactcatcgaaatgaccgctccttcatctgtcctgcagaaggttgtgggaaaagcttctatgtgctgcagaggctgaaggtgcacatgaggacccacaatggagagaagccctttatgtgccatgagtctggctgtggtaagcagtttactacagctggaaacctgaagaaccaccggcgcatccacacaggagagaaacctttcctttgtgaagcccaaggatgtggccgttcctttgctgagtattctagcctccgaaaacatctggtggttcactcaggagagaagcctcatcagtgccaagtctgtgggaagaccttctctcagagtggaagcaggaatgtgcatatgagaaagcatcacctgcagctgggagcagctgggagtcaagagcaggagcaaactgctgagccactaatgggcagtagtttgcttgaagaggcttcagtacccagtaaaaacctggtgtctatgaattcccagcccagccttggtggagagtccttgaacctaccaaataccaattctatcctgggagttgatgatgaggtgcttgctgaaggatccccacgttccctgtcttcagtgcctgatgtgacacatcacctggtgaccatgcagtcagggaggcaatcatatgaagtttctgtcttaactgcagtaaatccacaagagttactaaaccaaggagatttaactgaaagacggacatgagcgtgggtgctgactcctggaagagcaactctatctgatctcaaaatgcgtatactgggaacaggatgccttagcccacaacagaaccagaatgaatctttgaaggcacaagactctgcttttgccactcttcctctttcctggtatagaagatggatgtaggagagcttcttttctaactaccatctgatcagacaaggaatgaagcaatgactgtgggctgggaaactgtacctacctctcttcccactgcaaatttctgggatagaccaaaagtgaatttgattatgtgttggctgaagttcttcattctgactgttgaggggaggttttcctttgaagagttttcatcccagactcagctgtcttttcacatggatgaaataattcctgctaccaacaacagagcttcaccaggaagttgagttttcaagatgccttgttgctttgaagaagggagtgatgtcaattctcttgttacattctccctttagcaacctgagtaagagactctctgccactgggctgcaaaaaaataaattacttgaatctccccttggcccaggctgaggtactatcttgtcctatacacttctacttggtcactttgctttcttcgttaatggaacatacagtagcatgttaagagggatttcatgtttttgtttttttaaagttaaaaattacatgatgcagagattcaggttttcctttaaataaacaaaacagcccagtcagttctttggctcttgttttatacaaaatttgttttcttagagattaagaatttaatctttccctttaaaatagtgtattgatttacccttaggattccataccagtaaaactgaaccgaggagtcttaggaaacaacaagaacatcttcatttcttaagcccaggtgatagttactctgtcaccaccaaaaaagacgcatctgagaaaatggcaataaaaacagatacttctg

SEQ ID NO: 3047 - DNA, 841 bp, Homo sapiens
tggcgggcccgggagcggccagtctgaagccctgcggctttggcccttcccctcgcgggtttttaggggcgatgttcttgctcctttgcttggttttgggggtagggatataggaacagactgtcctgagaaagccagagtcagcgagtccccggggcgggggctcttggactgcacccgcagccggggcctgcctacggaccttggggccttatttctgaggcctttgtggtgtggggtagaggatgccaggaggccttgccctgaatgtttcagtccagagctaccctctcctttcataccacttactttctgggtttggaaaagggacagctgcctactcggctgggctgggtcgcccgtttctcctttgcctgtttgagatgctgttggatatacatgtggagatacctagcaagcagttagaaatgaaggtttggagttcagaagagatgactagagaaaaatgttacattgattacccacctagtacaacatcttacgggaagagcatagtatttcctagaggaatatgaacataacaggaaggtatcattggctctgaattaaatttgaacttgtcccctgaatagctacaggttttggaagctgaatcaatgttatcagatgagttagaatccaaaccagagctcctggtacagtttgttcagaatacgtccatcccattgggacaggggcttgtagaatcagaagctaaagatattacttgcttgtccctccttcccgtgactgaagcctcagaatgcagtcggctaatgttaccagatgatactacaaatcattctaactcctccaaggaggtcccttcctcagctgtttt

SEQ ID NO: 3048 - DNA, 595 bp, Homo sapiens
gtgtgtggacggaattcgggaccgactgacggccggccggcttcccggaactggaaggtgagctccgaggttacattgattacccacctagtacaacatcttacgggaagagcatagtatttcctagaggaatatgaacataacaggaaggtatcattggctctgaattaaatttgaacttgtcccctgaatagctacaggttttggaagctgaatcaatgttatcagatgagttagaatccaaaccagagctcctggtacagtttgttcagaatacgtccatcccattgggacaggggcttgtagaatcagaagctaaagatattacttgcttgtccctccttcccgtgactgaagcctcagaatgcagtcggctaatgttaccagatgatactacaaatcattctaactcctccaaggaggtcccttcctcagctgttttgagaagccttcgggtgaatgtgggtccagacggagaggagacgagagctcagactgtacagaaatccccggagtttttgtccacttcagagtcttctagcttgttgcaagatctacagccaagtgatagcacttcttttattcttcttaacct

SEQ ID NO: 3049 - DNA, 2461 bp, Homo sapiens
aattcgggaccgactgacggccggccggcttcccggaactggaaggttacattgattacccacctagtacaacatcttacgggaagagcatagtatttcctagaggaatatgaacataacaggaaggtatcattggctctgaattaaatttgaacttgtcccctgaatagctacaggttttggaagctgaatcaatgttatcagatgagttagaatccaaaccagagctcctggtacagtttgttcagaatacgtccatcccattgggacaggggcttgtagaatcagaagctaaagatattacttgcttgtccctccttcccgtgactgaagcctcagaatgcagtcggctaatgttaccagatgatactacaaatcattctaactcctccaaggaggtcccttcctcagctgttttgagaagccttcgggtgaatgtgggtccagacggagaggagacgagagctcagactgtacagaaatccccggagtttttgtccacttcagagtcttctagcttgttgcaagatctacagccaagtgatagcacttcttttattcttcttaacctaacaagagcaggtctgggctcttcagctgagcacttagtgtttgtacaggatgaggcagaagattcagggaatgatttcctctccagtgagagcacagacagtagcattccatggttcctccgggttcaggagttggcccatgacagtttgattgctgctactcgtgcacaactggcaaagaatgcaaaaaccagcagcaatggagaaaatgtccaccttggttctggtgatgggcagtcaaaagattctgggccccttcctcaagtggaaaagaagctcaagtgtacagttgaaggttgtgaccggacatttgtatggccagctcactttaaataccacctcaagactcatcgaaggttgtgggaaaagcttctatgtgctgcagaggctgaaggtgcacatgaggacccacaatggagagaagccctttatgtgccatgagtctggctgtggtaagcagtttactacagctggaaacctgaagaaccaccggcgcatccacacaggagagaaacctttcctttgtgaagcccaaggatgtggccgttcctttgctgagtattctagcctccgaaaacatctggtggttcactcaggagagaagcctcatcagtgccaagtctgtgggaagaccttctctcagagtggaagcaggaatgtgcatatgagaaagcatcacctgcagctgggagcagctgggagtcaagagcaggagcaaactgctgagccactaatgggcagtagtttgcttgaagaggcttcagtacccagtaaaaacctggtgtctatgaattcccagcccagccttggtggagagtccttgaacctaccaaataccaattctatcctgggagttgatgatgaggtgcttgctgaaggatccccacgttccctgtcttcagtgcctgatgtgacacatcacctggtgaccatgcagtcagggaggcaatcatatgaagtttctgtcttaactgcagtaaatccacaagaggtggagtcttgctatgttgcccaggctggagtgcagtggcaccatctcggctcactgcaacctctacctcccgaattcaagcggttcttctgcctcagcctcctgagtagctgggaccacagttactaaaccaaggagatttaactgaaagacggacatgagcgtgggtgctgactcctggaagagcaactctatctgatctcaaaatgcgtatactgggaacaggatgccttagcccacaacagaaccagaatgaatctttgaaggcacaagactctgcttttgccactcttcctctttcctggtatagaagatggatgtaggagagcttcttttctaactaccatctgatcagacaaggaatgaagcaatgactgtgggctgggaaactgtacctacctctcttcccactgcaaatttctgggatagaccaaaagtgaatttgattatgtgttggctgaagttcttcattctgactgttgaggggaggttttcctttgaagagttttcatcccagactcagctgtcttttcacatggatgaaataattcctgctaccaacaacagagcttcaccaggaagttgagttttcaagatgccttgttgctttgaagaagggagtgatgtcaattctcttgttacattctccctttagcaacctgagtaagagactctctgccactgggctgcaaaaaaataaattacttgaatctccccttggcccaggctgaggtactatcttgtcctatacacttctacttggtcactttgctttcttcgttaatggaacatacagtagcatgttaagagggatttcatgtttttgtttttttaaagttaaaaattacatgatgcagagattcaggttttcctttaaataaacaaaacagcccagtca

SEQ ID NO: 3050 - DNA, 1189 bp, Homo sapiens
agctgagaggtggaaaatggcgctgacgtgagcgcgaactcgcactgcccagagggtggccgccgcctaagctgcagccgccggagccgcagaaacaagaggccgagccgtgtcgaagatggaggagaaaccctcagggcccatcccagacatgctggccactgcagagcccagctccagtgagaccgacaaggaggtgttgtccccggctgtgccagctgcagccccttcctcctccatgtcggaggagccaggccctgagcaggcagccacaccgccagtgtgggaacgtggaggggctggagggatgcagcagggctcctccccagccccagacagctgccagcctggccccggacccagccctggcctgaccagcatagtctccgggaccagcgaggacctgcggcctcccagacgacgcccacctccagggaagcaaatcccttgctccagccctggctgctgcctcagttttcccagcgtccgtgacctggcacagcatctgcgaacccactgcccgcccacacagtccctggaaggcaagctcttccgctgctcagccctgagctgcaccgagaccttccccagcatgcaggagctggtggctcacagcaaactgcactacaaacccaatcgctacttcaagtgtgagaactgcctcctgcgcttccgcacgcaccgctcgctcttcaagcacctgcatgtttgcgcggagcatgcgcagagcccagccccgccgccacccccggccctggaccgagagccgcccgcgccggagcgccccccggaggttgaccccgcatcagcgccgggcctgccgttcccgctgctggaacccttcacgacccccgcccctgcccccaccggaccgttcctgccctacttgaaccctgcgccctttggcctaagccccccgcgcctgcgccccttcctggccgctgcacccgggccgccggcttccagcgccgccgtctggaaaaagagccaaggtgctggcagcagcccccgaagaccccagggcggctccgacgcgccctcaggtgcgtgcaggtgaccaccagggaggggtggaggggctttctttcctgcgccctgcggggtctggtggataccaggaggcagcagtgctcatccccttcccagggggcacaaatgccaccgtcccgaaatacaggatttttgcctt

SEQ ID NO: 3051 - DNA, 1403 bp, Homo sapiens
agctgagaggtggaaaatggcgctgacgtgagcgcgaactcgcactgcccagagggtggccgccgcctaagctgcagccgccggagccgcagaaacaagaggccgagccgtgtcgaagatggaggagaaaccctcagggcccatcccagacatgctggccactgcagagcccagctccagtgagaccgacaaggaggtgttgtccccggctgtgccagctgcagccccttcctcctccatgtcggaggagccaggccctgagcaggcagccacaccgccagtgtgggaacgtggaggggctggagggatgcagcagggctcctccccagccccagacagctgccagcctggccccggacccagccctggcctgaccagcatagtctccgggaccagcgaggacctgcggcctcccagacgacgcccacctccagggaagcaaatcccttgctccagccctggctgctgcctcagttttcccagcgtccgtgacctggcacagcatctgcgaacccactgcccgcccacacagtccctggaaggcaagctcttccgctgctcagccctgagctgcaccgagaccttccccagcatgcaggagctggtggctcacagcaaactgcactacaaacccaatcgctacttcaagtgtgagaactgcctcctgcgcttccgcacgcaccgctcgctcttcaagcacctgcatgtttgcgcggagcatgcgcagagcccagccccgccgccacccccggccctggaccgagagccgcccgcgccggagcgccccccggaggttgaccccgcatcagcgccgggcctgccgttcccgctgctggaacccttcacgacccccgcccctgcccccaccggaccgttcctgccctacttgaaccctgcgccctttggcctaagccccccgcgcctgcgccccttcctggccgctgcacccgggccgccggcttccagcgccgccgtctggaaaaagagccaaggtgctggcagcagcccccgaagaccccagggcggctccgacgcgccctcagggcacgcggccccgagccgcatcgtgtgggagcacacacgcggccgctactcgtgcatgcagtgcgccttctccacggcctcgcggcccgccatgaccctgcacctggaggaccaccgccccggcgcccccgcggcccccgcggccgggccgccgcgccccgacgcccccgcggatccggccccgcttgcacccaaggtgtcgccgctgctgtcagagggggagcttccagtgttctcgcagctctgaatcccgccgctttgggggtgggccatgggatgtgggtagttttgtcatttggagggggctgcagggaaggggggctggggtggacaataaagaaggcgccatgagccagcct

SEQ ID NO: 3052 - DNA, 2508 bp, Homo sapiens
tggttctctacctcggcccacgccgcctgagttagaaacgctgcctccggcacagagcgggggtcgccccgctgcgcatcagccggtgggtcgctggcgctggtggcagccgtgcctgggttcccgccccgggtcgcccgccgctcccggccccgctccgctcacaatccgatggcggcggccgtgcttagggattcgacttcggttcccgtgactgcagaagctaaacttatgggctttacacagggctgtgtgacctttgaggacgtggccatttacttctcccaggaagaatgggggctccttgatgaggctcagaggctcctgtaccgcgatgtgatgctggagaactttgcacttataactgcgctggtttgttggcatgggatggaggatgaagagacacctgagcaaagtgtttctgtagaaggagtacctcaggtcaggactccagaggccagtccatccacccagaagattcaatcctgtgacatgtgtgtcccattcctgaccgacattttgcacctgaccgatttgcctgggcaggaactatacttgactggggcatgtgcggtctttcaccaggaccagaagcatcatagtgcagagaaacccttggaaagtgacatggacaaggcctcatttgtgcagtgctgcctgttccatgagtcaggaatgcctttcaccagcagtgaggttgggaaggacttcctagccccattgggcattcttcagccgcaagctattgctaactatgagaagccaaacaaaatcagcaaatgtgaggaggcctttcatgttggaataagtcattacaagtggagtcaatgcaggagagagtccagccacaaacacactttttttcaccctagagtctgcactggaaaaaggctttatgaatctagcaaatgtgggaaagcctgctgctgtgagtgctcccttgttcagctgcaaagagtccaccctggagaaaggccttatgagtgcagtgaatgtgggaaatcttttagccaaacctctcatctgaatgatcatcggagaatccacactggagaaaggccttatgtgtgtggtcagtgtgggaaatcatttagccaaagagccaccctcattaaacatcacagagttcacactggagaaaggccttacgagtgtggtgaatgtgggaaatcttttagccaaagttccaaccttattgaacattgcagaattcacactggagaaaggccttatgagtgtgatgaatgtggaaaagcctttgggtccaaatccactcttgttcgacaccagagaactcacacaggagaaaagccatatgagtgtggtgaatgtgggaaattattcagacaaagcttcagccttgttgtacaccagagaattcacactacagcaaggccttatgagtgtggccagtgtgggaaatcatttagcctaaagtgtggcctcattcagcaccagttaattcacagtggagctaggccctttgagtgtgatgagtgcggaaaatcctttagccaaagaaccaccctcaataaacaccacaaagttcacactgcagaaaggccttatgtatgtggggaatgtgggaaagcttttatgttcaaatctaaacttgttaggcaccagagaactcacactggagaaaggccttttgagtgcagtgaatgtgggaaattttttagacaaagctataccctcgttgaacaccagaaaattcacactggattaaggccttacgactgtggacagtgcgggaaatcctttatccaaaagtctagcctcattcaacaccaagtggttcacacaggagaaaggccatatgagtgtggcaaatgtgggaagtcctttacacaacactctggcctcattctccaccgaaaatctcacactgtggagaggcctcgtgacagcagcaaatgtggaaaaccctacagcccaagatctaacattgtttaactcttgaaactccaaacctgagaaaagccttagacctgcagggaatgtgccatgtctttcttcagtgttatggctatagagagcctttgtgaaggagccgtctgcctaaagttaaacctcatacttctagacctcccgatgggtcagactcccattagttccaggcatatgtgtcttgcaggagctcctttgcatgttctaaactgctggaggcctttgccagagttaaatcattagtcacccttgcatactaaggcgaggcagatacacctgtgttctcccaacccttggaggaaattccttgagcagtctgagcctttaaggggaattccttcccttttctgactgattacagcatacatctgaccagttttggccagaagggcccagcctgggttctgctggaagctgatgtggaaggcttcccttcatggaaattcttgttttcacacaacacttggtagtttttccagcctccaagtcaccacctagtaactggctgcctcacattgctctggtttgtgtggtaataaaggccttatttttaaatct

SEQ ID NO: 3053 - DNA, 1602 bp, Homo sapiens
tggttctctacctcggcccacgccgcctgagttagaaacgctgcctccggcacagagcgggggtcgccccgctgcgcatcagccggtgggtcgctggcgctggtggcagccgtgcctgggttcccgccccgggtcgcccgccgctcccggccccgctccgctcacaatccgatggcggcggccgtgcttagggattcgacttcgggctgtgtgacctttgaggacgtggccatttacttctcccaggaagaatgggggctccttgatgaggctcagaggctcctgtaccgcgatgtgatgctggagaactttgcacttataactgcgctggtttgttggcatgggatggaggatgaagagacacctgagcaaagtgtttctgtagaaggagtacctcaggtcaggactccagaggccagtccatccacccagaagattcaatcctgtgacatgtgtgtcccattcctgaccgacattttgcacctgaccgatttgcctgggcaggaactatacttgactggggcatgtgcggtctttcaccaggaccagaagcatcatagtgcagagaaacccttggaaagtgacatggacaaggcctcatttgtgcagtgctgcctgttccatgagtcaggaatgcctttcaccagcagtgaggttgggaaggacttcctagccccattgggcattcttcagccgcaagctattgctaactatgagaagccaaacaaaatcagcaaatgtgaggaggcctttcatgttggaataagtcattacaagtggagtcaatgcaggagagagtccagccacaaacacactttttttcaccctagagtctgcactggaaaaaggctttatgaatctagcaaatgtgggaaagcctgctgctgtgagtgctcccttgttcagctgcaaagagtccaccctggagaaaggccttatgagtgcagtgaatgtgggaaatcttttagccaaacctctcatctgaatgatcatcggagaatccacactggagaaaggccttattacgagtgtggtgaatgtgggaaatcttttagccaaagttccaaccttattgaacattgcagaattcacactggagaaaggccttatgagtgtgatgaatgtggaaaagcctttgggtccaaatccactcttgttcgacaccagagaactcacacaggagaaaagccatatgagtgtggtgaatgtgggaaattattcagacaaagcttcagccttgttgtacaccagagaattcacactacagcaaggccttatgagtgtggccagtgtgggaaatcatttagcctaaaatctaaacttgttaggcaccagagaactcacactggagaaaggccttttgagtgcagtgaatgtgggaaattttttagacaaagctataccctcgttgaacaccagaaaattcacactggattaaggccttacgactgtggacagtgcgggaaatcctttatccaaaagtctagcctcattcaacaccaagtggttcacacaggagaaaggccatatgagtgtggcaaatgtgggaagtcctttacacaacactctggcctcattctccaccgaaaatctcacactgtg

SEQ ID NO: 3054 - DNA, 1647 bp, Homo sapiens
tggttctctacctcggcccacgccgcctgagttagaaacgctgcctccggcacagagcgggggtcgccccgctgcgcatcagccggtgggtcgctggcgctggtggcagccgtgcctgggttcccgccccgggtcgcccgccgctcccggccccgctccgctcacaatccgatggcggcggccgtgcttagggattcgacttcggttcccgtgactgcagaagctaaacttatgggctttacacagggctgtgtgacctttgaggacgtggccatttacttctcccaggaagaatgggggctccttgatgaggctcagaggctcctgtaccgcgatgtgatgctggagaactttgcacttataactgcgctggtttgttggcatgggatggaggatgaagagacacctgagcaaagtgtttctgtagaaggagtacctcaggtcaggactccagaggccagtccatccacccagaagattcaatcctgtgacatgtgtgtcccattcctgaccgacattttgcacctgaccgatttgcctgggcaggaactatacttgactggggcatgtgcggtctttcaccaggaccagaagcatcatagtgcagagaaacccttggaaagtgacatggacaaggcctcatttgtgcagtgctgcctgttccatgagtcaggaatgcctttcaccagcagtgaggttgggaaggacttcctagccccattgggcattcttcagccgcaagctattgctaactatgagaagccaaacaaaatcagcaaatgtgaggaggcctttcatgttggaataagtcattacaagtggagtcaatgcaggagagagtccagccacaaacacactttttttcaccctagagtctgcactggaaaaaggctttatgaatctagcaaatgtgggaaagcctgctgctgtgagtgctcccttgttcagctgcaaagagtccaccctggagaaaggccttatgagtgcagtgaatgtgggaaatcttttagccaaacctctcatctgaatgatcatcggagaatccacactggagaaaggccttatccatatgagtgtggtgaatgtgggaaattattcagacaaagcttcagccttgttgtacaccagagaattcacactacagcaaggccttatgagtgtggccagtgtgggaaatcatttagcctaaagtgtggcctcattcagcaccagttaattcacagtggagctaggccctttgagtgtgatgagtgcggaaaatcctttagccaaagaaccaccctcaataaacaccacaaagttcacactgcagaaaggccttatgtatgtggggaatgtgggaaagcttttatgttcaaatctaaacttgttaggcaccagagaactcacactggagaaaggccttttgagtgcagtgaatgtgggaaattttttagacaaagctataccctcgttgaacaccagaaaattcacactggattaaggccttacgactgtggacagtgcgggaaatcctttatccaaaagtctagcctcattcaacaccaagtggttcacacaggagaaaggccatatgagtgtggcaaatgtgggaagtcctttacacaacactctggcctcattctccaccgaaaatctcacactgtg

SEQ ID NO: 3055 - DNA, 4703 bp, Homo sapiens
gagacttccggggtctctagtagcggctgtgtatcggtgacgcgggtgtttccccagtttgtggcccctgagtgctggggggggaccgcggtgactgaacctagaaggtggagaggaatcgtcctcggtgcccagaggcggctctgcagccccgtgacggcgaccactgctcccgggccgtgcttccccaagtagtccgatggcagcggctgcgccgaggcgcccgactcagcagggcactgtgacctttgaagatgtggctgtgaacttttcccaggaggagtggtgtcttcttagtgaggctcagaggtgcttgtaccgtgatgtgatgctagagaacctggctctcatatcctcgctgggttgttggtgtggatcaaaagatgaggaggcaccttgtaagcagagaatttctgtacaaagagagtctcagagcaggactcctagggcaggtgtttctcctaagaaggctcacccctgtgaaatgtgtggcctcatcttggaggatgtttttcactttgctgaccaccaggaaactcatcacaagcagaagctgaacaggagtggagcatgtggaaaaaacttggatgacactgcataccttcatcagcaccagaagcagcatattggagagaaattctacagaaagagtgtcagagaagcatcgtttgtaaagaaacgtaagctcagggtgtcacaggagccatttgtcttccgcgagtttgggaaggacgttctgcccagttcaggattgtgccaagaagcagctgctgtagagaagacagacagtgaaactatgcatggcccaccctttcaggagggaaaaactaattacagttgtggaaaacgcacaaaagccttcagcaccaaacactcagttattccacaccagaaacttttcactagagatggatgttatgtgtgcagtgattgtggaaaatcctttagcagatatgtcagcttcagtaatcatcagcgagatcacactgcaaaaggaccttatgattgtggagagtgtgggaaatcttatagtcgaaagagcagccttattcaacatcagcgagtccacactggaaagacagcttatccctgtgaggagtgcgggaaatcttttagtcagaagggcagccttattagccatcagcgtgttcacactggagaaaggccttatgagtgtagagaatatgggaaatcttttggtcaaaagggtaacctcattcaacatcagcaaggtcacactggagagagagcttatcactgtggggaatgtgggaaatcttttcgtcagaagttctgctttattaaccatcagcgtgttcacactggagaaaggccttacaagtgtggagaatgtggaaaatcttttggtcaaaagggcaacctcgttcaacatcagcgaggtcatactggagaaaggccctatgagtgcaaggaatgtgggaaatcatttaggtacagatcccacctcactgaacaccagagacttcacactggggaaagaccttacaattgtagggaatgtgggaaattatttaacaggaagtatcatcttctcgttcatgagagagttcacactggagaaaggccatatgcgtgtgaggtatgtgggaaattatttggtaataagaactgcgtgactatacatcagaggattcacactggagaaaggccgtatgaatgcaatgaatgtgggaaatcatttctttccagctctgcgcttcatgttcataaaagagttcattctggacaaaagccttataagtgcagtgaatgtggaaaatcctttgctgaatgttccagtctcattaaacacaggagaattcacactggagaaaggccttatgaatgtaccaaatgtggaaaaacatttcagcgaagctctaccctccttcatcatcagagttcacacaggagaaaggccttatgagtgcagtgaatatgggaaatcgtttgctgaaacatcccgtctcattaaacacaggagagttcatactggagaaaggccttatgagtgctgtcaatctgggaaacatcagaatgtctgctctccttggtcttaagagacttcgcattggaacggagtctcattctgtcacccaggctggagtgcagtggtgcaatcttggctcactgcaacttgggcctcccaggttcaagtgattctcctacctcagcctcccaaggagctgagattacgagtacaccacaccatgcccggccaaatacttggttttcagtaccacaagagctatgagctggttatccacttcatgtggaatcataagtgtccccaagtgacaatacgtatagattgctgggcagtgaaacagttaagatgtcaccgtagcttgctttctattcaacatctttctaagattaccttactatttcttttgttccaagtttgtatttcctcagagttctcacatatggaaaggatacacactttgtagaaacaagaactttatgttatccaagttctgggatagccatgagctccaattacctcagagctccgagtcctctactcagtacccgttgagatttatgtgttctgaggcttttgtcttctagctacttacttcattctccatgggtaacgtcattcatccacattaactaatttcctcactccaagctcttttctggagataatctccagtccctgtgcagacactgtcattgcactttctgctgaaatggtagtttcttgccagcaaggtgagattatggaatccagaatcttttttcaggggccacatgcccatttccccacttgcatgaatgtcgacactgtagccacagttttggccgtaaatgtgaatttggcaagtaaccactgttcccaaattgggaaatgtcccagtcagaagaagattatctgggacactgatactgacagggagatgggacattctgagggacccggaggcagggagccacctcctcagcttccctgagggctgcctagaatctctcttgtttcctctcactctgaattattcttcctctcatgactgaccaaacacatggaacctcacaaagtccattttaagagctttatcttgtgaagtgaagaacatgaagatagtttgaatcaaagttattgagtggacacttaatgtctttataacattttttacatatgtgtttgtgttttttggggagcataatttgcaaatggaatatctgttattttactaagatgcttcatggatacaagagttaaaacttcctgtcccatttagtgaaacaaaaggttaagaaatgtggataaagcttgtaagttagaaatggcaagataatcagctatatgaagaatctcagctgggtgttttggctcaggcctgtaatcccagcactttgggaggctgaggtgggtggcttacaaggtcaggagttcaagaccaccctggacaatatggtgaaaccctgtctctactaaaaatacaaaaattacccaagcatagtggtgggtgcctgtagtcccagctgcttgggaggctgaggcaggagaattcgttaaacctgggaggcataggttgcagtgagccgagattgcaccactgcactccagcctggtgacagagcgagactccgtctcaaaaaaaaaaaaaaaaaaaaaaaaaaatctcaatccctaaatgttaccttttataacagcaggttatatgggcttagatattatccctaaatttttttttttttttttttttgagacagagtctcactctgtcacccaggctgaagtgcaatggcatggtctcggctcactgcaacctccgcctcccaggttcaagtgattctcttgcctcagcctcccaagtagctgggcctataggttccctccaccacgcccacctaatttttgtatttttagtagagatgggctttcactacgttagccaggctggtctcaaacttgtgacctcatgatccacccccctcagcctcctaaagtgctgggattacaggcatctgccacggcactcggcttatccctagaaatcctatgatagcatgatgtataggcacctaaaggcatggcacttgagaaatgtgaataagattgtaagttacaaatagcaaggtacagtcagatgttaacagtctcagcccctaaatgtcaccttgtattacagcatgttatataagcacatacaggcacatacatgaaatagtgatacttcattctcagtaatatttttcatccttctcactggaaagatctttgatgatttttaatcaacataggagtttcaatgatatctagaagtttaaaagggctcgttcaaacaaattatgaccatacaccctgaagagtatgtgtctgtctcttgtggtgtaaatttttattttattacacccaattatgttcccacaaaacctttataattgggaaattaaggagccttcctcggaaatggaggttgcaatcagctgagatggtaccactgcactctagcctgggcaaaagagcaaggccctgcctcaaaaaaaacaaaacttttttcttcataaactacagtttatataggcaaaactttcagtactaagcaattttagtctctgcaggctcttgtcttgaattaatacaacttttgttaattctcttatgaagttaaatcttcctgcttgtatgcaacttatatgttgaaatttttttgtacaaaagattcatacatctttcctgtttgaaatta

SEQ ID NO: 3056 - DNA, 2446 bp, Homo sapiens
tcggtgacgcgggtgtttccccagtttgtggcccctgagtgctggggggggaccgcggtgactgaacctagaaggtggagaggaatcgtcctcggtgcccagaggcggctctgcagccccgtgacggcgaccactgctcccgggccgtgcttccccaagtagtccgatggcagcggctgcgccgaggcgcccgactcagttataattttgcaaagacggtttcacctgtttctgacacccgtgggatgcggtggggagagcaacaagcacagggaggggcgcaggcaatggcctggagatggacggagccgggaggatggaacctgtctggaacaaagtgtgaggtggagctctccctggaagagtaagcaggccgagggctgtgcattcaagggcactgtgacctttgaagatgtggctgtgaacttttcccaggaggagtggtgtcttcttagtgaggctcagaggtgcttgtaccgtgatgtgatgctagagaacctggctctcatatcctcgctgggttgttggtgtggatcaaaagatgaggaggcaccttgtaagcagagaatttctgtacaaagagagtctcagagcaggactcctagggcaggtgtttctcctaagaaggctcacccctgtgaaatgtgtggcctcatcttggaggatgtttttcactttgctgaccaccaggaaactcatcacaagcagaagctgaacaggagtggagcatgtggaaaaaacttggatgacactgcataccttcatcagcaccagaagcagcatattggagagaaattctacagaaagagtgtcagagaagcatcgtttgtaaagaaacgtaagctcagggtgtcacaggagccatttgtcttccgcgagtttgggaaggacgttctgcccagttcaggattgtgccaagaagcagctgctgtagagaagacagacagtgaaactatgcatggcccaccctttcaggagggaaaaactaattacagttgtggaaaacgcacaaaagccttcagcaccaaacactcagttattccacaccagaaacttttcactagagatggatgttatgtgtgcagtgattgtggaaaatcctttagcagatatgtcagcttcagtaatcatcagcgagatcacactgcaaaaggaccttatgattgtggagagtgtgggaaatcttatagtcgaaagagcagccttattcaacatcagcgagtccacactggaaagacagcttatccctgtgaggagtgcgggaaatcttttagtcagaagggcagccttattagccatcagcgtgttcacactggagaaaggccttatgagtgtagagaatatgggaaatcttttggtcaaaagggtaacctcattcaacatcagcaaggtcacactggagagagagcttatcactgtggggaatgtgggaaatcttttcgtcagaagttctgctttattaaccatcagcgtgttcacactggagaaaggccttacaagtgtggagaatgtggaaaatcttttggtcaaaagggcaacctcgttcaacatcagcgaggtcatactggagaaaggccctatgagtgcaaggaatgtgggaaatcatttaggtacagatcccacctcactgaacaccagagacttcacactggggaaagaccttacaattgtagggaatgtgggaaattatttaacaggaagtatcatcttctcgttcatgagagagttcacactggagaaaggccatatgcgtgtgaggtatgtgggaaattatttggtaataagaactgcgtgactatacatcagaggattcacactggagaaaggccgtatgaatgcaatgaatgtgggaaatcatttctttccagctctgcgcttcatgttcataaaagagttcattctggacaaaagccttataagtgcagtgaatgtggaaaatcctttgctgaatgttccagtctcattaaacacaggagaattcacactggagaaaggccttatgaatgtaccaaatgtggaaaaacatttcagcgaagctctaccctccttcatcatcagagttcacacaggagaaaggccttatgagtgcagtgaatatgggaaatcgtttgctgaaacatcccgtctcattaaacacaggagagttcatactggagaaaggccttatgagtgctgtcaatctgggaaacatcagaatgtctgctctccttggtcttaagagacttcgcattggaacggagtctcattctgtcacccaggctggagtgcagtggtgcaatcttggctcactgcaacttgggcctcccaggttcaagtgattctcctacctcagcctcccaaggagctgagattacgagtacaccacaccatgcccggccaaatacttggttttcagtaccacaagagctatgagctggttatccacttcatgtggaatcataagtgt

SEQ ID NO: 3057 - DNA, 3694 bp, Homo sapiens
ttttggttaatgttgggtgtgtttctgcggtttgtgaggtgagaggcgctggagctatgggtccgaaccgcggtgtctgaacccagaaggtgaagagtccttcttgctgcacagaggcagatcttaggccccgtaacggcgcccgccgctcccggcagtgctttccccgcgtactcgggatggcggcggccgcgctgaggctcccggctcaggcatcatctggctgcaaagaagagaacacactgtgtttgagggaggaggaaggaggatcagagtttaaactcctgccataatgcagggcactgtggcatttgaagatgtggctgtgaacttttcccaggaggagtggagtctccttagtgaggttcagagatgcctttaccatgacgtgatgctggagaactgggtacttatatcctccctgggttgttggtgtggatcagaagatgaggaggcaccttctaagaagagcatttctatacaaagagtgtctcaggtcagcactcctggggcaggtgtgtctcccaagaaggcccactcttgtgaaatgtgtggcgcgatcttgggagacattttgcacttggcagatcatcaggggacacatcacaagcagaaactgcacaggtgtgaggcatgggggaataaattgtatgatagttcaaaccgtccgcaccagaatcagtaccttggagagaaaccctatagaagcagtgttgaggaagcattgtttgtgaagaggtgtaagttccatgtgtcagaggagtcatctatcttcattcagagtggaaaggactttttgcccagctcaggattactgctgcaggaggccactcacactggggagaagtcaaacagcaaacctgagtgtgagtctccctttcagtggggagatactcattacagctgtggagaatgcatgaaacattctagcaccaaacacgtatttgttcaacagcagagacttccctctagagaggaatgttattgctgggaatgtgggaaatcctttagcaaatatgatagcgtcagtaatcatcagagagttcacactgggaaaagaccttatgaatgtggagaatgtgggaaatcttttagtcataagggcagccttgttcagcatcagcgagttcacactgggaaaagaccttatgaatgtggagaatgtgggaaatcttttagtcataagggcagccttgttcagcatcagcgagttcatactggagaaagaccttatgagtgtggagaatgtgggaaatcttttagtcaaaatggtactctcattaaacatcaacgagttcacactggagaaagaccttatgagtgtgaagaatgtgggaaatgttttactcagaagggcaatctcattcaacatcaacgaggtcacactagtgaaagaccttatgagtgtgaagaatgtggaaaatgttttagtcaaaagggcaccctaactgaacatcatcgagttcacactagagaacgaccttatgagtgtggagaatgtgggaaatcttttagtcgaaagggacaccttaggaaccatcagcgaggtcacactggagaaagaccttacgagtgtggagaatgtgggaaatcttttagtcgaaagggcaacctcattcagcatcagcgaagccacactggagaaaggccttatgagtgtagagagtgtaggaaattatttaggggcaagtcccacctcattgaacaccagagagttcacactggagaaaggccatatgaatgtaatgaatgtgggaaatcatttcaagacagctctgggtttcgtgttcatcagagagttcacactggagaaaaaccgtttgagtgtagtgaatgtgggaagtcatttcctcaaagctgttccctccttcgacatcggagagttcatactggagaaaggccttatgaatgtggagaatgtggaaagtcatttcatcagagctcttccctccttcgacatcagaaaactcacactgcagaaagaccttatgagtgcagagaatgtgggaaattcttctccagtctccttgaacacaggagagttcacactggagaaaggccttatgaatgcagggaatgtggaaaaacatttactcgaaggtctgcgcattttaaacatcagagacttcatactcgaggaaagccttacgagtgcagcgaatgtgggaaatcctttgctgaaaccttcagtcttactgaacacaggagagtacacactggagaaaggccttatgagtgcagtgaatgtggaaaatcatttcatcgaagctcttctctccttcgacatcagagagttcacacagaaagaagtccttacaagtgaaaagaaatttgggaaattctttagctaaacctctgtgcatcttcttgatcagagggttcttactggatcaggaccttatgagtgtgacaaacgtgggatattctttatgcagaagtcttgttttattacatacagaagagctcccactgcagaagggcctcttgagtgcgatgaatgtgagaaagccttctgccttctgtcattggataacagattgttctcataaggaaaacactgtacacgtacaggaaatattatttcttgtaaaacataacactggaggagatgccttatgacggagccatctgcctaaattgacataccttcagcatctgcataaactcaattatgttggagctgtgtggcatttttcaccctgccgggttcccttgccagacatgatgtcggttatctggcaaaagccattttatgtcggccacgaggcaggtgttcactgtgcatcattcattcaccccatgatgttctggaagtaaaccttggttgtctttcgttggccagaggaattgaatgtccgtctgtctgcccaggctggagtggcacgatctcagctcactgcagcctccacctccagggttcaagcgattctcctgcctcagcctcccggggatctcaagggcatttccctttgcccacctcaccttttcatatttggtaaactgtatgcatttgcctccagcccaagattataaatatgaactgattatgatctgcatgttctctctttgggttcaagcatttccttacagaagagccaccgtggaagtcatgggtaaatatgtgttgaattggtaactccctcttggagaatttcttgtgaattacacagcaataggggaactcatttaactggagacataatctcaatttgtaaagtgtggcccattttctaacatttttattttgcataccctcccctctcttctcgattgatgaaactaacaaagaggttaataaaagcccatctcgtcatgtacagggactcatgcctttaattccagtgttttgggagactaaggcaagaacatcctggaggccaggagttcgacactgtataacagatatatctgacagcagtaactcaagcacaccctaagaatgaccctgtggtctaagaagagtgttggttcagcgttccaaacgaagaaatccaggagtggccaacctggaggtttctgaacccctggcctgttccttggaatgaggccctttgttttgagctaggcggagggtgataagtgaaaatactatataaactgcatgcttctttcaaatgatagtggtttttttgtccagcctgccgctcctggactgccctgtatctaagtcctcaataaaccctatgtctcattt

SEQ ID NO: 3058 - DNA, 3551 bp, Homo sapiens
ctctggtagcgaccattttggttaatgttgggtgtgtttctgcggtttgtgaggtgagaggcgctggagctatgggtccgaaccgcggtgtctgaacccagaaggtgaagagtccttcttgctgcacagaggcagatcttaggccccgtaacggcgcccgccgctcccggcagtgctttccccgcgtactcgggatggcggcggccgcgctgaggctcccggctcaggcatcatctggctgcaaagaagagaacacactgtgtttgagggaggaggaaggaggatcagagtttaaactcctgccataatgcagaccattctccataacaagggagtgggatttaaatgactctaggtggacagaggaaagtcgtcattgtagaggggtcaccaagtgcaacacagaagtggaatagggccatggatatctaaagccccacctggttctgtggggatgtggagccatgcaagaaggccttcatagaatgacttgggactgcattgctattgggagccatgagaattctgtgcagggcactgtggcatttgaagatgtggctgtgaacttttcccaggaggagtggagtctccttagtgaggttcagagatgcctttaccatgacgtgatgctggagaactgggtacttatatcctccctgggttgttggtgtggatcagaagatgaggaggcaccttctaagaagagcatttctatacaaagagtgtctcaggtcagcactcctggggcaggtgtgtctcccaagaaggcccactcttgtgaaatgtgtggcgcgatcttgggagacattttgcacttggcagatcatcaggggacacatcacaagcagaaactgcacaggtgtgaggcatgggggaataaattgtatgatagttcaaaccgtccgcaccagaatcagtaccttggagagaaaccctatagaagcagtgttgaggaagcattgtttgtgaagaggtgtaagttccatgtgtcagaggagtcatctatcttcattcagagtggaaaggactttttgcccagctcaggattactgctgcaggaggccactcacactggggagaagtcaaacagcaaacctgagtgtgagtctccctttcagtggggagatactcattacagctgtggagaatgcatgaaacattctagcaccaaacacgtatttgttcaacagcagagacttccctctagagaggaatgttattgctgggaatgtgggaaatcctttagcaaatatgatagcgtcagtaatcatcagagagttcacactgggaaaagaccttatgaatgtggagaatgtgggaaatcttttagtcataagggcagccttgttcagcatcagcgagttcacactgggaaaagaccttatgaatgtggagaatgtgggaaatcttttagtcataagggcagccttgttcagcatcagcgagttcatactggagaaagaccttatgagtgtggagaatgtgggaaatcttttagtcaaaatggtactctcattaaacatcaacgagttcacactggagaaagaccttatgagtgtgaagaatgtgggaaatgttttactcagaagggcaatctcattcaacatcaacgaggtcacactagtgaaagaccttatgagtgtgaagaatgtggaaaatgttttagtcaaaagggcaccctaactgaacatcatcgagttcacactagagaacgaccttatgagtgtggagaatgtgggaaatcttttagtcgaaagggacaccttaggaaccatcagcgaggtcacactggagaaagaccttacgagtgtggagaatgtgggaaatcttttagtcgaaagggcaacctcattcagcatcagcgaagccacactggagaaaggccttatgagtgtagagagtgtaggaaattatttaggggcaagtcccacctcattgaacaccagagagttcacactggagaaaggccatatgaatgtaatgaatgtgggaaatcatttcaagacagctctgggtttcgtgttcatcagagagttcacactggagaaaaaccgtttgagtgtagtgaatgtgggaagtcatttcctcaaagctgttccctccttcgacatcggagagttcatactggagaaaggccttatgaatgtggagaatgtggaaagtcatttcatcagagctcttccctccttcgacatcagaaaactcacactgcagaaagaccttatgagtgcagagaatgtgggaaattcttctccagtctccttgaacacaggagagttcacactggagaaaggccttatgaatgcagggaatgtggaaaaacatttactcgaaggtctgcgcattttaaacatcagagacttcatactcgaggaaagccttacgagtgcagcgaatgtgggaaatcctttgctgaaaccttcagtcttactgaacacaggagagtacacactggagaaaggccttatgagtgcagtgaatgtggaaaatcatttcatcgaagctcttctctccttcgacatcagagagttcacacagaaagaagtccttacaagtgaaaagaaatttgggaaattctttagctaaacctctgtgcatcttcttgatcagagggttcttactggatcaggaccttatgagtgtgacaaacgtgggatattctttatgcagaagtcttgttttattacatacagaagagctcccactgcagaagggcctcttgagtgcgatgaatgtgagaaagccttctgccttctgtcattggataacagattgttctcataaggaaaacactgtacacgtacaggaaatattatttcttgtaaaacataacactggaggagatgccttatgacggagccatctgcctaaattgacataccttcagcatctgcataaactcaattatgttggagctgtgtggcatttttcaccctgccgggttcccttgccagacatgatgtcggttatctggcaaaagccattttatgtcggccacgaggcaggtgttcactgtgcatcattcattcaccccatgatgttctggaagtaaaccttggttgtctttcgttggccagaggaattgaatgtccgtctgtctgcccaggctggagtggcacgatctcagctcactgcagcctccacctccagggttcaagcgattctcctgcctcagcctcccggggatctcaagggcatttccctttgcccacctcaccttttcatatttggtaaactgtatgcatttgcctccagcccaagattataaatatgaactgattatgatctgcatgttctctctttgggttcaagcatttccttacagaagagccaccgtggaagtcatgggtaaatatgtgttgaattggtaactccctcttggagaatttcttgtgaattacacagcaataggggaactcatttaactggagacataatctcaatttgtaaagtgtggcccattttctaacatttttattttgcataccctcccctctcttctcgattgatgaaactaacaaagaggttaataaaagcccatctcgtcatgt

SEQ ID NO: 3059 - DNA, 2499 bp, Homo sapiens
ggtagcgaccattttggttaatgttgggtgtgtttctgcggtttgtgaggtgagaggcgctggagctatgggtccgaaccgcggtgtctgaacccagaaggtgaagagtccttcttgctgcacagaggcagatcttaggccccgtaacggcgcccgccgctcccggcagtgctttccccgcgtactcgggatggcggcggccgcgctgaggctcccggctcaggttgttggtgtggatcagaagatgaggaggcaccttctaagaagagcatttctatacaaagagtgtctcaggtcagcactcctggggcaggtgtctcccaagaaggcccactcttgtgaaatgtgtggcgcgatcttgggagacattttgcacttggcagatcatcaggggacacatcacaagcagaaactgcacaggtgtgaggcatgggggaataaattgtatgatagttcaaaccgtccgcaccagaatcagtaccttggagagaaaccctatagaagcagtgttgaggaagcattgtttgtgaagaggtgtaagttccatgtgtcagaggagtcatctatcttcattcagagtggaaaggactttttgcccagctcaggattactgctgcaggaggccactcacactggggagaagtcaaacagcaaacctgagtgtgagtctccctttcagtggggagatactcattacagctgtggagaatgcatgaaacattctagcaccaaacacgtatttgttcaacagcagagacttccctctagagaggaatgttattgctgggaatgtgggaaatcctttagcaaatatgatagcgtcagtaatcatcagagagttcacactgggaaaagaccttatgaatgtggagaatgtgggaaatcttttagtcataagggcagccttgttcagcatcagcgagttcacactgggaaaagaccttatgaatgtggagaatgtgggaaatcttttagtcataagggcagccttgttcagcatcagcgagttcatactggagaaagaccttatgagtgtggagaatgtgggaaatcttttagtcaaaatggtactctcattaaacatcaacgagttcacactggagaaagaccttatgagtgtgaagaatgtgggaaatgttttactcagaagggcaatctcattcaacatcaacgaggtcacactagtgaaagaccttatgagtgtgaagaatgtggaaaatgttttagtcaaaagggcaccctaactgaacatcatcgagttcacactagagaacgaccttatgagtgtggagaatgtgggaaatcttttagtcgaaagggacaccttaggaaccatcagcgaggtcacactggagaaagaccttacgagtgtggagaatgtgggaaatcttttagtcgaaagggcaacctcattcagcatcagcgaagccacactggagaaaggccttatgagtgtagagagtgtaggaaattatttaggggcaagtcccacctcattgaacaccagagagttcacactggagaaaggccatatgaatgtaatgaatgtgggaaatcatttcaagacagctctgggtttcgtgttcatcagagagttcacactggagaaaaaccgtttgagtgtagtgaatgtgggaagtcatttcctcaaagctgttccctccttcgacatcggagagttcatactggagaaaggccttatgaatgtggagaatgtggaaagtcatttcatcagagctcttccctccttcgacatcagaaaactcacactgcagaaagaccttatgagtgcagagaatgtgggaaattcttctccagtctccttgaacacaggagagttcacactggagaaaggccttatgaatgcagggaatgtggaaaaacatttactcgaaggtctgcgcattttaaacatcagagacttcatactcgaggaaagccttacgagtgcagcgaatgtgggaaatcctttgctgaaaccttcagtcttactgaacacaggagagtacacactggagaaaggccttatgagtgcagtgaatgtggaaaatcatttcatcgaagctcttctctccttcgacatcagagagttcacacagaaagaagtccttacaagtgaaaagaaatttgggaaattctttagctaaacctctgtgcatcttcttgatcagagggttcttactggatcaggaccttatgagtgtgacaaacgtgggatattctttatgcagaagtcttgttttattacatacagaagagctcccactgcagaagggcctcttgagtgcgatgaatgtgagaaagccttctgccttctgtcattggataacagattgttctcataaggaaaacactgtacacgtacaggaaatattatttcttgtaaaacataacactggaggagatgccttatgacggagccatctgcctaaattgacataccttcagcatctgcataaactcaattatgttggagctgtgtggcatttttcaccctgc

SEQ ID NO: 3060 - DNA, 2309 bp, Homo sapiens
gactcaggtgaactaacctgcgagaagctggttgtgcgctgaggcgaccagcgccggaaggcacggtggcgactcacgctgttctcgccgctcagaggcgggtctgaggctcggtggcggcgcccagggtggcccgggccctttcctcggtcattgtctcccctccagctctactcacaggctccgatggcggcggccgccctgagggaccccgctcaggttcctgtggctgcagacttgcttacagaccatgaggagggctatgtgacctttgaggatgtggctgtctacttctcccaggaggaatggagattgcttgatgacgctcagaggctcctctaccgcaatgtgatgctggagaactttacacttctggcctctctgggacttgcatcttccaagacccatgaaataacccagctggagtcatgggaggagcccttcatgcctgcttgggaagttgtgacttcagccataccgagaggttgttggcatggagccgaggctgaggaggctcctgagcagattgcttctgtaggactgctcagttcaaacattcagcaacaccagaagcagcactgtggagagaaacccttaaaaagacaagagggcagggtcccagttttgaggagttgcaaagttcacctatcagagaagtccttgcaaagcagggaggttgggaaggccctcctgatcagctcaggtgttctcaagcaccaggtgactcacacaggagagaagtcacataggagctccaaaagtagggaggcctttcatgctggaaaaaggcattacaaatgcagtgaatgtgggaaagcctttggtcagaaatatttacttgttcagcaccagagactacatgctgggaaaaagacgtatgaatgcagtgaatgtgggaagttatttagagatatgtccaacctttttatacaccaaatagttcacactggagaaaggccttacgggtgtagtaactgtggaaaatcctttagccgtaatgctcacctcattgaacaccagagagttcacactggagaaaagccttttacatgcagtgaatgtggaaaagctttcaggcataattccacacttgttcagcatcacaaaatccacactggagtaaggccttatgagtgcagtgaatgtggaaaattgtttagtttcaactccagcctcatgaaacatcagagaattcacactggagaaagaccttataagtgcagtgaatgtggaaaattctatagccacaagtccaaccttatcaaacattggcgtgttcatactggagaaaggccttacaagtgcagcgactgtgggaaattttttacccaatgctcaagcctcatgcaacatcaaaaagttcacactggagaaaagccttttaagtgcaatgaatgtgggagattctttagagagaattccaccctagttagacatcagagggttcacactggagcaaagccttatgagtgcagggaatgtgggaaattttttagccaaagctcaaccctcatgcaacatcgaaaagttcacattggagaaaagccttttaagtgcaatgaatgtgggagattgtttagagagaattccagccttgttaaacatcagagggttcacactggagcaaagccttatgagtgcagggaatgtgggaagttttttcgccacaactccagtctttttaaacatcgaaggattcacactggagaaatgcagtgattgtgtgaaatcctttagccagcgtttcaacctcattcaacaccagaaagttcacagtggaaaaaatcttgaaggtaacagatggaaatccgttagccacacctccagtctcattcaacactggacagtttacaatgtggacaatgtagtgaatatggaaaaaggtttcagccaaaggcctaaccctattcaacaccagaaagtttacactggagaaaggccttagggtgacaggttatgtactgtctctgaatcaatatgacctcacttaaaacagaaactctgaggatggcctttatgagggagctggcaattgaacatcattcatctaaatatgcacactggaggcaagatgagaattcctgacagattgtccttcctgagaagacagccctctgccttggagctccagagagagggagccctgtattcttggctgtacccgtcgaatggagttttgatctcgctgagtttggagttgggggaggaaaggagtggtcttggttcaaatgtgactcacttttgctgttcttgtgaatgttagatcttctttaataaatatttatttcccatacacccttatgaccatt

SEQ ID NO: 3061 - DNA, 1287 bp, Homo sapiens
gacccagtccaaggctatgtgacctttgaggatgtggctgtctacttctcccaggaggaatggagattgcttgatgacgctcagaggctcctctaccgcaatgtgatgctggagaactttacacttctggcctctctgggtaagcatcctgagctgggctcggcttttcctccttttcctagggagaggagtcttgcagtcagcttgatggatcttatccctggtggcctctctgtgcaattgagtcaccaatgtgattgctgtttgactgtgttgttccttgtcctccatgtttcacccagtcatcagcagaacccttcagcagtggctttcactgaatgtgtggttgttggcatggagcgactgctcagttcaaacattcagcaacaccagaagcagcactgtggagagaaacccttaaaaagacaagagggcagggtcccagttttgaggagttgcaaagttcacctatcagagaagtccttgcaaagcagggaggttgggaaggccctcctgatcagctcaggtgttctcaagcaccaggtgactcacacaggagagaagtcacataggagctccaaaagtagggaggcctttcatgctggaaaaaggcattacaaatgcagtgaatgtgggaaagcctttggtcagaaatatttacttgttcagcaccagagactacatactggagaaaggccttacgggtgtagtaactgtggaaaatcctttagccgtaatgctcacctcattgaacaccagagagttcacactggagaaaagccttttacatgcagtgaatgtggaaaagctttcaggcataattccacacttgttcagcatcacaaaatccacactggagtaaggccttatgagtgcagtgaatgtggaaaattgtttagtttcaactccagcctcatgaaacatcagagaattcacactggagaaagaccttataagtgcagtgaatgtggaaaattctatagccacaagtccaaccttatcaaacattggcgtgttcatactggagaaaggccttacaagtgcagcgactgtgggaaattttttacccaatgctcaagcctcatgcaacatcaaaaagttcacactggagaaaagccttttaagtgcaatgaatgtgggagattctttagagagaattccaccctagttagacatcagagggttcacactggagcaaagccttatgagtgcagggaatgtgggaaattttttagccaaagctcaaccctcatgcaacatcgaaaagttcacattggagaaaagcct

SEQ ID NO: 3062 - DNA, 2221 bp, Homo sapiens
gtctcgtttggtattcactttcgcgactcaggtgaactaacctgcgagaagctggttgtgcgctgaggcgaccagcgccggaaggcacggtggcgactcacgctgttctcgccgctcagaggcgggtctgaggctcggtggcggcgcccagggtggcccgggccctttcctcggtcattgtctcccctccagctctactcacaggctccgatggcggcggccgccctgagggaccccgctcaggttcctgtggctgcagacttgcttacagaccatgaggagcagggctatgtgacctttgaggatgtggctgtctacttctcccaggaggaatggagattgcttgatgacgctcagaggctcctctaccgcaatgtgatgctggagaactttacacttctggcctctctgggttgttggcatggagccgaggctgaggaggctcctgagcagattgcttctgtaggactgctcagttcaaacattcagcaacaccagaagcagcactgtggagagaaacccttaaaaagacaagagggcagggtcccagttttgaggagttgcaaagttcacctatcagagaagtccttgcaaagcagggaggttgggaaggccctcctgatcagctcaggtgttctcaagcaccaggtgactcacacaggagagaagtcacataggagctccaaaagtagggaggcctttcatgctggaaaaaggcattacaaatgcagtgaatgtgggaaagcctttggtcagaaatatttacttgttcagcaccagagactacatgctgggaaaaagacgtatgaatgcagtgaatgtgggaagttatttagagatatgtccaacctttttatacaccaaatagttcacactggagaaaggccttacgggtgtagtaactgtggaaaatcctttagccgtaatgctcacctcattgaacaccagagagttcacactggagaaaagccttttacatgcagtgaatgtggaaaagctttcaggcataattccacacttgttcagcatcacaaaatccacactggagtaaggccttatgagtgcagtgaatgtggaaaattgtttagtttcaactccagcctcatgaaacatcagagaattcacactggagaaagaccttataagtgcagtgaatgtggaaaattctatagccacaagtccaaccttatcaaacattggcgtgttcatactggagaaaggccttacaagtgcagcgactgtgggaaattttttacccaatgctcaagcctcatgcaacatcaaaaagttcacactggagaaaagccttttaagtgcaatgaatgtgggagattctttagagagaattccaccctagttagacatcagagggttcacactggagcaaagccttatgagtgcagggaatgtgggaaattttttagccaaagctcaaccctcatgcaacatcgaaaagttcacattggagaaaagccttttaagtgcaatgaatgtgggagattgtttagagagaattccagccttgttaaacatcagagggttcacactggagcaaagccttatgagtgcagggaatgtgggaagttttttcgccacaactccagtctttttaaacatcgaaggattcacactggagaaatgcagtgattgtgtgaaatcctttagccagcgtttcaacctcattcaacaccagaaagttcacagtggaaaaaatcttgaaggtaacagatggaaatccgttagccacacctccagtctcattcaacactggacagtttacaatgtggacaatgtagtgaatatggaaaaaggtttcagccaaaggcctaaccctattcaacaccagaaagtttacactggagaaaggccttagggtgacaggttatgtactgtctctgaatcaatatgacctcacttaaaacagaaactctgaggatggcctttatgagggagctggcaattgaacatcattcatctaaatatgcacactggaggcaagatgagaattcctgacagattgtccttcctgagaagacagccctctgccttggagctccagagagagggagccctgtattcttggctgtacccgtcgaatggagttttgatctcgctgagtttggagttgggggaggaaaggagtggtcttggttcaaatgtgactcacttttgctgttcttgtgaatgttagatcttctttaataaatatttatttcccata

SEQ ID NO: 3063 - DNA, 1569 bp, Homo sapiens
gtgcgacacgcaatgggcgggacttccggcgtctcgtttggtattcactttcgcgactcaggtgaactaacctgcgagaagctggttgtgcgctgaggcgaccagcgccggaaggcacggtggcgactcacgctgttctcgccgctcagaggcgggtctgaggctcggtggcggcgcccagggtggcccgggccctttcctcggtcattgtctcccctccagctctactcacaggctccgatggcggcggccgccctgagggaccccgctcagcagggctatgtgacctttgaggatgtggctgtctacttctcccaggaggaatggagattgcttgatgacgctcagaggctcctctaccgcaatgtgatgctggagaactttacacttctggcctctctgggacttgcatcttccaagacccatgaaataacccagctggagtcatgggaggagcccttcatgcctgcttgggaagttgtgacttcagccataccgagaggttgttggcatggagccgaggctgaggaggctcctgagcagattgcttctgtaggactgctcagttcaaacattcagcaacaccagaagcagcactgtggagagaaacccttaaaaagacaagagggcagggtcccagttttgaggagttgcaaagttcacctatcagagaagtccttgcaaagcagggaggttgggaaggccctcctgatcagctcaggtgttctcaagcaccaggtgactcacacaggagagaagtcacataggagctccaaaagtagggaggcctttcatgctggaaaaaggcattacaaatgcagtgaatgtgggaaagcctttggtcagaaatatttacttgttcagcaccagagactacatgctgggaaaaagacgtatgaatgcagtgaatgtgggaagttatttagagatatgtccaacctttttatacaccaaatagttcacactggagaaaggccttacgggtgtagtaactgtggaaaatcctttagccgtaatgctcacctcattgaacaccagagagttcacactggagaaaagccttttacatgcagtgaatgtggaaaagctttcaggcataattccacacttgttcagcatcacaaaatccacactggagtaaggccttatgagtgcagtgaatgtggaaaattgtttagtttcaactccagcctcatgaaacatcagagaattcacactggagaaagaccttataagtgcagtgaatgtggaaaattctatagccacaagtccaaccttatcaaacattggcgtgttcatactggagaaaggccttacaagtgcagcgactgtgggaaattttttacccaatgctcaagcctcatgcaacatcaaaaagttcacactggagaaaagccttttaagtgcaatgaatgtgggagattctttagagagaattccagccttgttaaacatcagagggttcacactggagcaaagccttatgagtgcagggaatgtgggaagttttttcgccacaactccagtctttttaaacatcgaaggattcacactggagaaatgcagtga

SEQ ID NO: 3064 - DNA, 2186 bp, Homo sapiens
ggtattcactttcgcgactcaggtgaactaacctgcgagaagctggttgtgcgctgaggcgaccagcgccggaaggcacggtggcgactcacgctgttctcgccgctcagaggcgggtctgaggctcggtggcggcgcccagggtggcccgggccctttcctcggtcattgtctcccctccagctctactcacaggctccgatggcggcggccgccctgagggaccccgctcagggctatgtgacctttgaggatgtggctgtctacttctcccaggaggaatggagattgcttgatgacgctcagaggctcctctaccgcaatgtgatgctggagaactttacacttctggcctctctgggttgttggcatggagccgaggctgaggaggctcctgagcagattgcttctgtaggactgctcagttcaaacattcagcaacaccagaagcagcactgtggagagaaacccttaaaaagacaagagggcagggtcccagttttgaggagttgcaaagttcacctatcagagaagtccttgcaaagcagggaggttgggaaggccctcctgatcagctcaggtgttctcaagcaccaggtgactcacacaggagagaagtcacataggagctccaaaagtagggaggcctttcatgctggaaaaaggcattacaaatgcagtgaatgtgggaaagcctttggtcagaaatatttacttgttcagcaccagagactacatgctgggaaaaagacgtatgaatgcagtgaatgtgggaagttatttagagatatgtccaacctttttatacaccaaatagttcacactggagaaaggccttacgggtgtagtaactgtggaaaatcctttagccgtaatgctcacctcattgaacaccagagagttcacactggagaaaagccttttacatgcagtgaatgtggaaaagctttcaggcataattccacacttgttcagcatcacaaaatccacactggagtaaggccttatgagtgcagtgaatgtggaaaattgtttagtttcaactccagcctcatgaaacatcagagaattcacactggagaaagaccttataagtgcagtgaatgtggaaaattctatagccacaagtccaaccttatcaaacattggcgtgttcatactggagaaaggccttacaagtgcagcgactgtgggaaattttttacccaatgctcaagcctcatgcaacatcaaaaagttcacactggagaaaagccttttaagtgcaatgaatgtgggagattctttagagagaattccaccctagttagacatcagagggttcacactggagcaaagccttatgagtgcagggaatgtgggaaattttttagccaaagctcaaccctcatgcaacatcgaaaagttcacattggagaaaagccttttaagtgcaatgaatgtgggagattgtttagagagaattccagccttgttaaacatcagagggttcacactggagcaaagccttatgagtgcagggaatgtgggaagttttttcgccacaactccagtctttttaaacatcgaaggattcacactggagaaatgcagtgattgtgtgaaatcctttagccagcgtttcaacctcattcaacaccagaaagttcacagtggaaaaaatcttgaaggtaacagatggaaatccgttagccacacctccagtctcattcaacactggacagtttacaatgtggacaatgtagtgaatatggaaaaaggtttcagccaaaggcctaaccctattcaacaccagaaagtttacactggagaaaggccttagggtgacaggttatgtactgtctctgaatcaatatgacctcacttaaaacagaaactctgaggatggcctttatgagggagctggcaattgaacatcattcatctaaatatgcacactggaggcaagatgagaattcctgacagattgtccttcctgagaagacagccctctgccttggagctccagagagagggagccctgtattcttggctgtacccgtcgaatggagttttgatctcgctgagtttggagttgggggaggaaaggagtggtcttggttcaaatgtgactcacttttgctgttcttgtgaatgttagatcttctttaataaatatttatttcccatacacccttatgaccatt

SEQ ID NO: 3065 - DNA, 2366 bp, Homo sapiens
gtgcgacacgcaatgggcgggacttccggcgtctcgtttggtattcactttcgcgactcaggtgaactaacctgcgagaagctggttgtgcgctgaggcgaccagcgccggaaggcacggtggcgactcacgctgttctcgccgctcagaggcgggtctgaggctcggtggcggcgcccagggtggcccgggccctttcctcggtcattgtctcccctccagctctactcacaggctccgatggcggcggccgccctgagggaccccgctcaggttcctgtggctgcagacttgcttacagaccatgaggagcagggctatgtgacctttgaggatgtggctgtctacttctcccaggaggaatggagattgcttgatgacgctcagaggctcctctaccgcaatgtgatgctggagaactttacacttctggcctctctgggacttgcatcttccaagacccatgaaataacccagctggagtcatgggaggagcccttcatgcctgcttgggaagttgtgacttcagccataccgagaggttgttggcatggagccgaggctgaggaggctcctgagcagattgcttctgtaggactgctcagttcaaacattcagcaacaccagaagcagcactgtggagagaaacccttaaaaagacaagagggcagggtcccagttttgaggagttgcaaagttcacctatcagagaagtccttgcaaagcagggaggttgggaaggccctcctgatcagctcaggtgttctcaagcaccaggtgactcacacaggagagaagtcacataggagctccaaaagtagggaggcctttcatgctggaaaaaggcattacaaatgcagtgaatgtgggaaagcctttggtcagaaatatttacttgttcagcaccagagactacatgctgggaaaaagacgtatgaatgcagtgaatgtgggaagttatttagagatatgtccaacctttttatacaccaaatagttcacactggagaaaggccttacgggtgtagtaactgtggaaaatcctttagccgtaatgctcacctcattgaacaccagagagttcacactggagaaaagccttttacatgcagtgaatgtggaaaagctttcaggcataattccacacttgttcagcatcacaaaatccacactggagtaaggccttatgagtgcagtgaatgtggaaaattgtttagtttcaactccagcctcatgaaacatcagagaattcacactggagaaagaccttataagtgcagtgaatgtggaaaattctatagccacaagtccaaccttatcaaacattggcgtgttcatactggagaaaggccttacaagtgcagcgactgtgggaaattttttacccaatgctcaagcctcatgcaacatcaaaaagttcacactggagaaaagccttttaagtgcaatgaatgtgggagattctttagagagaattccaccctagttagacatcagagggttcacactggagcaaagccttatgagtgcagggaatgtgggaaattttttagccaaagctcaaccctcatgcaacatcgaaaagttcacattggagaaaagccttttaagtgcaatgaatgtgggagattgtttagagagaattccagccttgttaaacatcagagggttcacactggagcaaagccttatgagtgcagggaatgtgggaagttttttcgccacaactccagtctttttaaacatcgaaggattcacactggagaaatgcagtgattgtgtgaaatcctttagccagcgtttcaacctcattcaacaccagaaagttcacagtggaaaaaatcttgaaggtaacagatggaaatccgttagccacacctccagtctcattcaacactggacagtttacaatgtggacaatgtagtgaatatggaaaaaggtttcagccaaaggcctaaccctattcaacaccagaaagtttacactggagaaaggccttagggtgacaggttatgtactgtctctgaatcaatatgacctcacttaaaacagaaactctgaggatggcctttatgagggagctggcaattgaacatcattcatctaaatatgcacactggaggcaagatgagaattcctgacagattgtccttcctgagaagacagccctctgccttggagctccagagagagggagccctgtattcttggctgtacccgtcgaatggagttttgatctcgctgagtttggagttgggggaggaaaggagtggtcttggttcaaatgtgactcacttttgctgttcttgtgaatgttagatcttctttaataaatatttatttcccatacacccttatgaccatt

SEQ ID NO: 3066 - DNA, 2327 bp, Homo sapiens
gtgcgacacgcaatgggcgggacttccggcgtctcgtttggtattcactttcgcgactcaggtgaactaacctgcgagaagctggttgtgcgctgaggcgaccagcgccggaaggcacggtggcgactcacgctgttctcgccgctcagaggcgggtctgaggctcggtggcggcgcccagggtggcccgggccctttcctcggtcattgtctcccctccagctctactcacaggctccgatggcggcggccgccctgagggaccccgctcagcagggctatgtgacctttgaggatgtggctgtctacttctcccaggaggaatggagattgcttgatgacgctcagaggctcctctaccgcaatgtgatgctggagaactttacacttctggcctctctgggacttgcatcttccaagacccatgaaataacccagctggagtcatgggaggagcccttcatgcctgcttgggaagttgtgacttcagccataccgagaggttgttggcatggagccgaggctgaggaggctcctgagcagattgcttctgtaggactgctcagttcaaacattcagcaacaccagaagcagcactgtggagagaaacccttaaaaagacaagagggcagggtcccagttttgaggagttgcaaagttcacctatcagagaagtccttgcaaagcagggaggttgggaaggccctcctgatcagctcaggtgttctcaagcaccaggtgactcacacaggagagaagtcacataggagctccaaaagtagggaggcctttcatgctggaaaaaggcattacaaatgcagtgaatgtgggaaagcctttggtcagaaatatttacttgttcagcaccagagactacatgctgggaaaaagacgtatgaatgcagtgaatgtgggaagttatttagagatatgtccaacctttttatacaccaaatagttcacactggagaaaggccttacgggtgtagtaactgtggaaaatcctttagccgtaatgctcacctcattgaacaccagagagttcacactggagaaaagccttttacatgcagtgaatgtggaaaagctttcaggcataattccacacttgttcagcatcacaaaatccacactggagtaaggccttatgagtgcagtgaatgtggaaaattgtttagtttcaactccagcctcatgaaacatcagagaattcacactggagaaagaccttataagtgcagtgaatgtggaaaattctatagccacaagtccaaccttatcaaacattggcgtgttcatactggagaaaggccttacaagtgcagcgactgtgggaaattttttacccaatgctcaagcctcatgcaacatcaaaaagttcacactggagaaaagccttttaagtgcaatgaatgtgggagattctttagagagaattccaccctagttagacatcagagggttcacactggagcaaagccttatgagtgcagggaatgtgggaaattttttagccaaagctcaaccctcatgcaacatcgaaaagttcacattggagaaaagccttttaagtgcaatgaatgtgggagattgtttagagagaattccagccttgttaaacatcagagggttcacactggagcaaagccttatgagtgcagggaatgtgggaagttttttcgccacaactccagtctttttaaacatcgaaggattcacactggagaaatgcagtgattgtgtgaaatcctttagccagcgtttcaacctcattcaacaccagaaagttcacagtggaaaaaatcttgaaggtaacagatggaaatccgttagccacacctccagtctcattcaacactggacagtttacaatgtggacaatgtagtgaatatggaaaaaggtttcagccaaaggcctaaccctattcaacaccagaaagtttacactggagaaaggccttagggtgacaggttatgtactgtctctgaatcaatatgacctcacttaaaacagaaactctgaggatggcctttatgagggagctggcaattgaacatcattcatctaaatatgcacactggaggcaagatgagaattcctgacagattgtccttcctgagaagacagccctctgccttggagctccagagagagggagccctgtattcttggctgtacccgtcgaatggagttttgatctcgctgagtttggagttgggggaggaaaggagtggtcttggttcaaatgtgactcacttttgctgttcttgtgaatgttagatcttctttaataaatatttatttcccatacacccttatgaccatt

SEQ ID NO: 3067 - DNA, 714 bp, Homo sapiens
gtgcgacacgcaatgggcgggacttccggcgtctcgtttggtattcactttcgcgactcaggtgaactaacctgcgagaagctggttgtgcgctgaggcgaccagcgccggaaggcacggtggcgactcacgctgttctcgccgctcagaggcgggtctgaggctcggtggcggcgcccagggtggcccgggccctttcctcggtcattgtctcccctccagctctactcacaggctccgatggcggcggccgccctgagggaccccgctcaggttcctgtggctgcagacttgcttacagaccatgaggagggctatgtgacctttgaggatgtggctgtctacttctcccaggaggaatggagattgcttgatgacgctcagaggctcctctaccgcaatgtgatgctggagaactttacacttctggcctctctgggttgttggcatggagccgaggctgaggaggctcctgagcagattgcttctgtaggactgctagaagtccttgcaaagcagggaggttgctcagggaaaaagacgtatgaatgcagtgaatgtgggaagttatttagagatatgtccaacctttttatacaccaaatagttcacactggagaaaggccttacgggtgtagtaactgtggaaaatcctttagccgtaatgctcacctcattgaacaccagagagttcacactggagaaaagcctttt

SEQ ID NO: 3068 - DNA, 1857 bp, Homo sapiens
acgcaatgggcgggacttccggcgtctcgtttggtattcactttcgcgactcaggtgaactaacctgcgagaagctggttgtgcgctgaggcgaccagcgccggaaggcacggtggcgactcacgctgttctcgccgctcagaggcgggtctgaggctcggtggcggcgcccagggtggcccgggccctttcctcggtcattgtctcccctccagctctactcacaggctccgatggcggcggccgccctgagggaccccgctcagggctatgtgacctttgaggatgtggctgtctacttctcccaggaggaatggagattgcttgatgacgctcagaggctcctctaccgcaatgtgatgctggagaactttacacttctggcctctctgggacttgcatcttccaagacccatgaaataacccagctggagtcatgggaggagcccttcatgcctgcttgggaagttgtgacttcagccataccgagaggttgttggcatggagccgaggctgaggaggctcctgagcagattgcttctgtaggactgctcagttcaaacattcagcaacaccagaagcagcactgtggagagaaacccttaaaaagacaagagggcagggtcccagttttgaggagttgcaaagttcacctatcagagaagtccttgcaaagcagggaggttgggaaggccctcctgatcagctcaggtgttctcaagcaccaggtgactcacacaggagagaagtcacataggagctccaaaagtagggaggcctttcatgctggaaaaaggcattacaaatgcagtgaatgtgggaaagcctttggtcagaaatatttacttgttcagcaccagagactacatgctgggaaaaagacgtatgaatgcagtgaatgtgggaagttatttagagatatgtccaacctttttatacaccaaatagttcacactggagaaaggccttacgggtgtagtaactgtggaaaatcctttagccgtaatgctcacctcattgaacaccagagagttcacactggagaaaagccttttacatgcagtgaatgtggaaaagctttcaggcataattccacacttgttcagcatcacaaaatccacactggagtaaggccttatgagtgcagtgaatgtggaaaattgtttagtttcaactccagcctcatgaaacatcagagaattcacactggagaaagaccttataagtgcagtgaatgtggaaaattctatagccacaagtccaaccttatcaaacattggcgtgttcatactggagaaaggccttacaagtgcagcgactgtgggaaattttttacccaatgctcaagcctcatgcaacatcaaaaagttcacactggagaaaagccttttaagtgcaatgaatgtgggagattctttagagagaattccaccctagttagacatcagagggttcacactggagcaaagccttatgagtgcagggaatgtgggaaattttttagccaaagctcaaccctcatgcaacatcgaaaagttcacattggagaaaagccttttaagtgcaatgaatgtgggagattgtttagagagaattccagccttgttaaacatcagagggttcacactggagcaaagccttatgagtgcagggaatgtgggaagttttttcgccacaactccagtctttttaaacatcgaaggattcacactggagaaatgcagtgattgtgtgaaatcctttagccagcgtttcaacctcattcaacaccagaaagttcacagtggaaaaaatcttgaaggtaacagatggaaatccgttagccacacctccagtctcattcaacactggacagtt

SEQ ID NO: 3069 - DNA, 1562 bp, Homo sapiens
aatgggcgggacttccggcgtctcgtttggtattcactttcgcgactcaggtgaactaacctgcgagaagctggttgtgcgctgaggcgaccagcgccggaaggcacggtggcgactcacgctgttctcgccgctcagaggcgggtctgaggctcggtggcggcgcccagggtggcccgggccctttcctcggtcattgtctcccctccagctctactcacaggctccgatggcggcggccgccctgagggaccccgctcaggttcctgtggctgcagacttgcttacagaccatgaggagcagggctatgtgacctttgaggatgtggctgtctacttctcccaggaggaatggagattgcttgatgacgctcagaggctcctctaccgcaatgtgatgctggagaactttacacttctggcctctctgggacttgcatcttccaagacccatgaaataacccagctggagtcatgggaggagcccttcatgcctgcttgggaagttgtgacttcagccataccgagaggttgttggcatggagccgaggctgaggaggctcctgagcagattgcttctgtaggactgctcagttcaaacattcagcaacaccagaagcagcactgtggagagaaacccttaaaaagacaagagggcagggtcccagttttgaggagttgcaaagttcacctatcagagaagtccttgcaaagcagggaggttgggaaggccctcctgatcagctcaggtgttctcaagcaccaggtgactcacacaggagagaagtcacataggagctccaaaagtagggaggcctttcatgctggaaaaaggcattacaaatgcagtgaatgtgggaaagcctttggtcagaaatatttacttgttcagcaccagagactacatgctgggaaaaagacgtatgaatgcagtgaatgtgggaagttatttagagatatgtccaacctttttatacaccaaatagttcacactggagaaaggccttacgggtgtagtaactgtggaaaatcctttagccgtaatgctcacctcattgaacaccagagagttcacactggagaaaagccttttacatgcagtgaatgtggaaaagctttcaggcataattccacacttgttcagcatcacaaaatccacactggagtaaggccttatgagtgcagtgaatgtggaaaattgtttagtttcaactccagcctcatgaaacatcagagaattcacactggagaaagaccttataagtgcagtgaatgtggaaaattctatagccacaagtccaaccttatcaaacattggcgtgttcatactggagaaaggccttacaagtgcagcgactgtgggaaattttttacccaatgctcaagcctcatgcaacatcaaaaagttcacactggagaaaagccttttaagtgcaatgaatgtgggagattctttagagagaattccaccctagttagacatcagagggttcacactggagcaaagccttatgagtgcagggaatgtgggaaattttttagccaaagctcaaccctcatgc

SEQ ID NO: 3070 - DNA, 561 bp, Homo sapiens
attcactttcgcgactcaggtgaactaacctgcgagaagctggttgtgcgctgaggcgaccagcgccggaaggcacggtggcgactcacgctgttctcgccgctcagaggcgggtctgaggctcggtggcggcgcccagggtggcccgggccctttcctcggtcattgtctcccctccagctctactcacaggctccgatggcggcggccgccctgagggaccccgctcagcagggctatgtgacctttgaggatgtggctgtctacttctcccaggaggaatggagattgcttgatgacgctcagaggctcctctaccgcaatgtgatgctggagaactttacacttctggcctctctgggttgttggcatggagccgaggctgaggaggctcctgagcagattgcttctgtaggactgctcagttcaaacattcagcaacaccagaagcagcactgtggagagaaacccttaaaaagacaagagggcagggtcccagttttgaggagttgcaaagttcacctatcagagaagtccttgcaaagcagggaggttgggaag

SEQ ID NO: 3071 - DNA, 646 bp, Homo sapiens
gtgcgacacgcaatgggcgggacttccggcgtctcgtttggtattcactttcgcgactcaggtgaactaacctgcgagaagctggttgtgcgctgaggcgaccagcgccggaaggcacggtggcgactcacgctgttctcgccgctcagaggcgggtctgaggctcggtggcggcgcccagggtggcccgggccctttcctcggtcattgtctcccctccagctctactcacaggctccgatggcggcggccgccctgagggaccccgctcagcagggctatgtgacctttgaggatgtggctgtctacttctcccaggaggaatggagattgcttgatgacgctcagaggctcctctaccgcaatgtgatgctggagaactttacacttctggcctctctgggacttgcatcttccaagacccatgaaataacccagctggagtcatgggaggagcccttcatgcctgcttgggaagttgtgacttcagccataccgagaggttgttggcatggagccgaggctgaggaggctcctgagcagattgcttctgtaggactgctcagttcaaacattcagcaacaccagaagcagcactgtggagagaaacccttaaaaagacaagagggcagggtcccagttttga

SEQ ID NO: 3072 - DNA, 1945 bp, Homo sapiens
gatttggaggcctcgcgtggggagagggccgcgtctgtggaggagcttggctccgcacctgctgggctggcgaacccgaaattgggcttggaacccgggagccagatcttggaccctgaactgcacctctgtcaagagcccagaggagaaagaatggctgtttcagtagcaatgtccaagctctgcattctccagactctgtgctttcctaagataggaacccagaagaggactgatcatttcttgcagctctaaaaaccatggctcggaaattagtgatgttcagggatgttgccattgacttctctcaggaagagtgggaatgcctggactctgctcagagagatttgtatagagatgtgatgttggagaactatagcaacttggtatcactagacttgccttcaaggtgtgcaagtaaggacttatctccagaaaagaacacttatgaaacagaattatcccaatgggaaatgagtgacagacttgaaaactgtgatcttgaagagtccaattccagggattatttggaagccaaaggcaagatggagaagcaacaagaaaatcagaaggaatatttcaggcaagggatgatcatatatgacaaaatgtccattttcaaccagcatacttacttatctcaacattcaagatgtcattctactgagaaaccctataaatgtaaggaatgtgggaaagccttcagacgagcctcacacctaacacaacatcaaagtattcatactggtgaaaaaccctatgaatgtaagcaatgcgggaaggcctttagtcgtgattcacaactcagtcttcatcagagacttcatactggtgagaaaccctatgcatgtaaggaatgtgggaaggcctttactcaaagctcacaacttattttacatcatagaattcatactggtgaaaaaccatataaatgtgaagaatgtgggaaagcctttattcgtagctcacaacttacccgacatcaaaaagttcatactggtgagaaaccttatgaatgtaaagaatgtgggaaggcctttactcagaattcacaacttacactacaccagagacttcatactggtgaaaagctctatgaatgtaaagaatgtaggaaggtctttactcagctctcacaacttattctgcataagagaattcataccggtgagaaaccctatgaatgtaaggaatgtggaaaagcttttatttgtggctcacagctttctcaacatcagaaaattcataatggggaaaaaccatatgaatgtaaggaatgtggaagggcctttattcggggctcactactgatgcaacatcagaggattcatactggtgaaaaaccctataaatgtgaagaatgtgggaaggcctttatccgtggctcacaacttactcaacaccagagaattcacaccaatgaaaagccctatgaatgtaaggaatgtggaaagatgtttagtcatggctcacaacttactcaacatcagagaatacacactggtgagaaaccctatcaatgtaaggaatgtggaaaagcgtttaatcgtggctcactccttacacgacaccagaggattcatactggtgagaaaccctatgaatgtaaagaatgtggaaaaacctttagtcgtggctcagaacttactcaacatgagcgaattcacacagccttccttgcaggtcaacaagatagaagtgatatttatatgagtaggagatttacgaaatccatttttcctgtctttttttccgtgcctacaatgtggacatctaagctggagctccgttactctcatggggactttgagaatggtatctgggtgttatggatcatggagcagaaatacagaaggagtctgcaaccctgatgactttgtggaacagccatactagctctggtctgcttgcctcctgtttctctttaaataaaattaaacatctt

SEQ ID NO: 3073 - DNA, 2984 bp, Homo sapiens
cttggctccgcacctgctgggctggcgaacccgaaattgggcttggaacccgggagccagatcttggaccctgaactgcacctctgtcaagagcccagaggagaaagaatggctgtttcagtagcaatgtccaagctctgcattctccagactctgtgctttcctaagataggaacccagaagaggactgatcatttcttgcagctctaaaaaccatggctcggaaattagtgatgttcagggatgttgccattgacttctctcaggaagagtgggaatgcctggactctgctcagagagatttgtatagagatgtgatgttggagaactatagcaacttggtatcactagacttgccttcaaggtgtgcaagtaaggacttatctccagaaaagaacacttatgaaacagaattatcccaatgggaaatgagtgacagacttgaaaactgtgatcttgaagagtccaattccagggattatttggaagccaaaggcaagatggagaagcaacaagaaaatcagaaggaatatttcaggcaagggatgatcatatatgacaaaatgtccattttcaaccagcatacttacttatctcaacattcaagatgtcattctactgagaaaccctataaatgtaaggaatgtgggaaagccttcagacgagcctcacacctaacacaacatcaaagtattcatactggtgaaaaaccctatgaatgtaagcaatgcgggaaggcctttagtcgtgattcacaactcagtcttcatcagagacttcatactggtgagaaaccctatgcatgtaaggaatgtgggaaggcctttactcaaagctcacaacttattttacatcatagaattcatactggtgaaaaaccatataaatgtgaagaatgtgggaaagcctttattcgtagctcacaacttacccgacatcaaaaagttcatactggtgagaaaccttatgaatgtaaagaatgtgggaaggcctttactcagaattcacaacttacactacaccagagacttcatactggtgaaaagctctatgaatgtaaagaatgtaggaaggtctttactcagctctcacaacttattctgcataagagaattcataccggtgagaaaccctatgaatgtaaggaatgtggaaaagcttttatttgtggctcacagctttctcaacatcagaaaattcataatggggaaaaaccatatgaatgtaaggaatgtggaagggcctttattcggggctcactactgatgcaacatcagaggattcatactggtgaaaaaccctataaatgtgaagaatgtgggaaggcctttatccgtggctcacaacttactcaacaccagagaattcacaccaatgaaaagccctatgaatgtaaggaatgtggaaagatgtttagtcatggctcacaacttactcaacatcagagaatacacactggtgagaaaccctatcaatgtaaggaatgtggaaaagcgtttaatcgtggctcactccttacacgacaccagaggattcatactggtgagaaaccctatgaatgtaaagaatgtggaaaaacctttagtcgtggctcagaacttactcaacatgagcgaattcacacaggtgagaaaccctatgaatgtaaggaatgtgggaaatcttttattcgtggttcccagcttactcaacatcagagaatccatactggtgagaaaccttatgaatgtaaagaatgtagaatggcctttactcagagttcacatctttcccaacatcaaagacttcacactggtgagaaaccctatgtgtgtaatgaatgtggaaaggcctttgcgcgtggcttactacttatacaacatcagagaattcatactggtgagaaaccatatcaatgtaaggaatgtgggaaagcctttattcgtggttcacagttgactcaacatcagcgaattcacactggagaaaaaccctatgaatgcaaggagtgtggcaaggcctttagtcatggctctcagcttactctacatcagagaatccatactggtgagaagccctatgaatgcagagaatgtagaaaggcctttactcagagttcacatctttctcggcatcagagaattcatactggtgagaaaccatatcaatgtaaggaatgtgggaaggcctttactcgtggttcacagctaactcaacatcagagaattcatatcagtgagaaatcttttgaatataaggaatgtgggattgactttagtcatggctcacaagtttacatgtgaattgtctgattatttgagatcactatgaagaggttctctggttgttagcagcaaagaattctcacaaatgtgaatatgggcgcacatttgcctcataaagcacagcatcagataatttatgtgagagaaaatggtagtgtcattcatatagaaaaacatcattactggaaacctattaaacattagcaaattggagaatagttttaatatagtaaatgtaggaagccctttagccatattgaaaacaaatatctttttcaacgttatcttagctctactagttgatctttttgttatatgtatcatgatacttaacctctaccttggtttaatcattttaagatagacctaagtatattacctttattgtaagattcttggaagtattatgtaagttattacatgtaaaagctcttagaatggtgccttgaacgtagcataccacaaatattagctaccattttcactagtgttattttagagaatttgcatgagaggagagtacttatgagtataatgaatattgagaaatcttttatcaacacatccaagatgacttggttggggggcactgtatgccataatgaatgtgagaaagctgtcatttaaatctcatccattattgctataagaggaaattcatactgttaaaaaaaaaaaaacccagtggatataatcagtgtattattaaaaaaaaaaaaa

SEQ ID NO: 3074 - DNA, 2302 bp, Homo sapiens
gtgagcgcctgagagtctttttgcctttcagagttaaggcctcactggcctgggaaaataattgctgccttttgcatccgcgttggctccgtccccaggatcttcccggttcagggacctggcgatttctgagtgttccggaatcccaataaccctgtttaaagaggaatggagattgccactgtccatttagattaatgaggtgtcctgaagtgatggtgacatcaatgaaaggagggttctgacacgttctcacctcgcgggatggcagctgctgatttgtcccatggacattatctttctggggacccagtttgccttcatgaagaaaagacaccagcaggaagaatagtggctgactgcctaacagattgttatcaggattcagtgacctttgacgatgtggctgtggacttcacccaggaggagtggactttactggactcaactcagagaagcctctacagtgacgtgatgctggagaactacaagaacctggccacagtaggaggtcagatcatcaaacccagtctaatctcttggttggaacaagaagagtcaaggacagttcagggaggagttctccaaggatgggaaatgcgacttgaaacccagtggtctatacttcagcaggactttttgaggggtcagacatccattgggatacaattggaaggaaaacacaatggaagggaactctgtgactgtgagcaatgtggagaagtcttcagtgaacactcatgccttaagacgcacgtgagaactcaaagtacagggaacactcatgactgtaatcagtatggaaaagatttccttaccctgtgtgagaaaacctctactggtgagaaactttctgagtttaatcagagtgaaaaaatcttcagcctgacaccaaatattgtataccagagaactagcacacaagaaaagtcatttgaatgtagtcactgtggaaaatccttcattaatgagtcataccttcaggcacatatgagaactcacaatggagaaaaactctacgaatggaggaattatgggccaggttttattgactctacaagcctttctgtgcttatagaaaccctcaatgcaaaaaagccctacaaatgtaaggaatgtggaaaaggctatagatacccagcctacctcagtattcacatgcgaacccacactggggagaaaccatatgaatgtaaggaatgtgggaaagccttcaattattccaactcatttcagatacatggaagaactcacactggagagaaaccctatgtatgtaaggaatgtgggaaagccttcactcagtactcgggccttagtatgcatgtacgatctcacagtggagacaagccctatgaatgtaaggaatgtgggaaatccttccttacatcctcacgccttattcaacatataagaactcacactggagagaagccttttgtatgtgttgaatgtgggaaagcctttgcagtttcctcaaatcttagtggacatttgagaactcacactgaagagaaggcctgtgagtgtaagatatgtgggaaagtatttgggtatccctcatgtcttaataatcacatgcgaacgcacagtgcccagaaaccatacacctgtaaggaatgtgggaaggcttttaactattccacccaccttaaaattcacatgcgaatccacactggagaaaaaccctatgagtgtaaacaatgtggaaaggccttcagtcattccagttcatttcaaatacatgaaaggactcacactggagagaaaccctatgaatgcaaggagtgtgggaaagccttcacgtgttccagttcctttagaattcatgaaaaaactcacacagaagagaaaccctataaatgtcagcaatgcgggaaagcttacagtcatccccgttcacttcgaagacatgaacaaattcactagtgagaaactgtccatgtaataaatgtgggaaagctctcatttgttccagttcactttaaagacatgaatgaactcactctggagagaagaagctgcatgaaaattacttaattcctgtaatcccagcattttgagaggctgaggtgggtggatcacttgaggtcaggagtttgagaccaccctggccaacatggtgaaaccttgtctctactgaaaatacaaaaaatttagccaggtgtggtgggcacctgtaatcccagctacttgggaggctgaggcaagtgaatcacttgaacccaggaagcagaggttgcagtgagcagagatcatgccactgcactccagcctgggcgatggagtgagactccatctc

SEQ ID NO: 3075 - DNA, 2375 bp, Homo sapiens
ttgtttgtttacttatttttatttttgtttctttagagatagggtcttgctatgttgcccaggctggtctcaaacttctaggctgaagcagtcctcccaccctggcctcccaaaatgctgggattacaggcatgagctactgccccagccggtgtatatgtttgatggctgatgattaagtactgcttgttgattattgattaataccaacaggaatcccaataaccctgtttaaagaggaatggagattgccactgtccatttagattaatgaggtgtcctgaagtgatggtgacatcaatgaaaggagggttctgacacgttctcacctcgcgggatggcagctgctgatttgtcccatggacattatctttctggggacccagtttgccttcatgaagaaaagacaccagcaggaagaatagtggctgactgcctaacagattgttatcaggattcagtgacctttgacgatgtggctgtggacttcacccaggaggagtggactttactggactcaactcagagaagcctctacagtgacgtgatgctggagaactacaagaacctggccacagtaggaggtcagatcatcaaacccagtctaatctcttggttggaacaagaagagtcaaggacagttcagggaggagttctccaaggatgggaaatgcgacttgaaacccagtggtctatacttcagcaggactttttgaggggtcagacatccattgggatacaattggaaggaaaacacaatggaagggaactctgtgactgtgagcaatgtggagaagtcttcagtgaacactcatgccttaagacgcacgtgagaactcaaagtacagggaacactcatgactgtaatcagtatggaaaagatttccttaccctgtgtgagaaaacctctactggtgagaaactttctgagtttaatcagagtgaaaaaatcttcagcctgacaccaaatattgtataccagagaactagcacacaagaaaagtcatttgaatgtagtcactgtggaaaatccttcattaatgagtcataccttcaggcacatatgagaactcacaatggagaaaaactctacgaatggaggaattatgggccaggttttattgactctacaagcctttctgtgcttatagaaaccctcaatgcaaaaaagccctacaaatgtaaggaatgtggaaaaggctatagatacccagcctacctcagtattcacatgcgaacccacactggggagaaaccatatgaatgtaaggaatgtgggaaagccttcaattattccaactcatttcagatacatggaagaactcacactggagagaaaccctatgtatgtaaggaatgtgggaaagccttcactcagtactcgggccttagtatgcatgtacgatctcacagtggagacaagccctatgaatgtaaggaatgtgggaaatccttccttacatcctcacgccttattcaacatataagaactcacactggagagaagccttttgtatgtgttgaatgtgggaaagcctttgcagtttcctcaaatcttagtggacatttgagaactcacactgaagagaaggcctgtgagtgtaagatatgtgggaaagtatttgggtatccctcatgtcttaataatcacatgcgaacgcacagtgcccagaaaccatacacctgtaaggaatgtgggaaggcttttaactattccacccaccttaaaattcacatgcgaatccacactggagaaaaaccctatgagtgtaaacaatgtggaaaggccttcagtcattccagttcatttcaaatacatgaaaggactcacactggagagaaaccctatgaatgcaaggagtgtgggaaagccttcacgtgttccagttcctttagaattcatgaaaaaactcacacagaagagaaaccctataaatgtcagcaatgcgggaaagcttacagtcatccccgttcacttcgaagacatgaacaaattcactagtgagaaactgtccatgtaataaatgtgggaaagctctcatttgttccagttcactttaaagacatgaatgaactcactctggagagaagaagctgcatgaaaattacttaattcctgtaatcccagcattttgagaggctgaggtgggtggatcacttgaggtcaggagtttgagaccaccctggccaacatggtgaaaccttgtctctactgaaaatacaaaaaatttagccaggtgtggtgggcacctgtaatcccagctacttgggaggctgaggcaagtgaatcacttgaacccaggaagcagaggttgcagtgagcagagatcatgccactgcactccagcctgggcgatggagtgagactccatctc

SEQ ID NO: 3076 - DNA, 2210 bp, Homo sapiens
gtgagcgcctgagagtctttttgcctttcagagttaaggcctcactggcctgggaaaataattgctgccttttgcatccgcgttggctccgtccccaggatcttcccggttcagggacctggcgatttctgagtgttccggaatcccaataaccctgtttaaagaggaatggagattgccactgtccatttagattaatgaggtgtcctgaagtgatggtgacatcaatgaaaggagggttctgacacgttctcacctcgcgggatggcagctgctgatttgtcccatggattcagtgacctttgacgatgtggctgtggacttcacccaggaggagtggactttactggactcaactcagagaagcctctacagtgacgtgatgctggagaactacaagaacctggccacagtaggaggtcagatcatcaaacccagtctaatctcttggttggaacaagaagagtcaaggacagttcagggaggagttctccaaggatgggaaatgcgacttgaaacccagtggtctatacttcagcaggactttttgaggggtcagacatccattgggatacaattggaaggaaaacacaatggaagggaactctgtgactgtgagcaatgtggagaagtcttcagtgaacactcatgccttaagacgcacgtgagaactcaaagtacagggaacactcatgactgtaatcagtatggaaaagatttccttaccctgtgtgagaaaacctctactggtgagaaactttctgagtttaatcagagtgaaaaaatcttcagcctgacaccaaatattgtataccagagaactagcacacaagaaaagtcatttgaatgtagtcactgtggaaaatccttcattaatgagtcataccttcaggcacatatgagaactcacaatggagaaaaactctacgaatggaggaattatgggccaggttttattgactctacaagcctttctgtgcttatagaaaccctcaatgcaaaaaagccctacaaatgtaaggaatgtggaaaaggctatagatacccagcctacctcagtattcacatgcgaacccacactggggagaaaccatatgaatgtaaggaatgtgggaaagccttcaattattccaactcatttcagatacatggaagaactcacactggagagaaaccctatgtatgtaaggaatgtgggaaagccttcactcagtactcgggccttagtatgcatgtacgatctcacagtggagacaagccctatgaatgtaaggaatgtgggaaatccttccttacatcctcacgccttattcaacatataagaactcacactggagagaagccttttgtatgtgttgaatgtgggaaagcctttgcagtttcctcaaatcttagtggacatttgagaactcacactgaagagaaggcctgtgagtgtaagatatgtgggaaagtatttgggtatccctcatgtcttaataatcacatgcgaacgcacagtgcccagaaaccatacacctgtaaggaatgtgggaaggcttttaactattccacccaccttaaaattcacatgcgaatccacactggagaaaaaccctatgagtgtaaacaatgtggaaaggccttcagtcattccagttcatttcaaatacatgaaaggactcacactggagagaaaccctatgaatgcaaggagtgtgggaaagccttcacgtgttccagttcctttagaattcatgaaaaaactcacacagaagagaaaccctataaatgtcagcaatgcgggaaagcttacagtcatccccgttcacttcgaagacatgaacaaattcactagtgagaaactgtccatgtaataaatgtgggaaagctctcatttgttccagttcactttaaagacatgaatgaactcactctggagagaagaagctgcatgaaaattacttaattcctgtaatcccagcattttgagaggctgaggtgggtggatcacttgaggtcaggagtttgagaccaccctggccaacatggtgaaaccttgtctctactgaaaatacaaaaaatttagccaggtgtggtgggcacctgtaatcccagctacttgggaggctgaggcaagtgaatcacttgaacccaggaagcagaggttgcagtgagcagagatcatgccactgcactccagcctgggcgatggagtgagactccatctc

SEQ ID NO: 3077 - DNA, 2361 bp, Homo sapiens
ttgctgcagccagagctccaggtctcgtcttcatttctgtgtcctttgttcttagaggcccagcctgtgtggccctgtgacccgcagatattgggagatacacagctaagactccaggaccccctggaagcctagaaatgggaccattgacatttacagatgtggccatagaattctctctggaggagtggcagtgcctggacacagcacaacagaacttatatagaaatgtgatgttagagaactacagaaacttggtcttcctgggtattgctgtttctaagccagacctaatcacttgtctagagaaagaaaaagaaccctgcaagatgaagcgacatgaaatggtggatgaacccccagttgtgtgttctcattttgctgaagacttttggccagagcaagacataaaagattctttccaaaaagtgacactgaggagatatgataaacgtggacatgagaacttacaattaagaaaaggctataaaactgtaggtgattgtaagctatacaaaggaggttataatggacttaaccaatgtttgacacttacccagagcaaaatgtatcactgtgatatatatgtaaaagtcttttatgcattttcaaatgcagatagatacaagacaagacatactggaaagaaacctttccagtgtaaaaaatgtggcaaatcattttgcatgctttcacaactaactcaacataagaaaattcatattagagagaatacctacagatgtaaagaatttggcaatgcctttaatcagtcctcagcccttactaaccataagagaatttatgttggtgagaaacactacagatgtgaagaatgtggcaaagcatttaaccactactcaacccttactaaccataagagaattcatactggagagaaaccctacaaatgtaaagaatgtggcaaagcctttagcaggtactcaacccttactacccataagagaattcattctggagagaagccctacaaatgtgatgaatgtggcaaaacctttagcatatcctcaacctttactaaacataagataattcatactgaagagaaaccctacaaatgtaaagaatgtggcaaagcctttaaccggtcctcaacccttactagccataagagaatacatactggtgagaaaccctacaaatgtgaagaatgtggcaaagcctttaactggtcttcaactcttactaaacataaggtaattcatactggagagaagccctacaaatgtgaagaatgtggcaaagcttttaaccagtcttcaagacttactcgacataaaaaaattcatactggagaggaaccctacaaatttgaaaaatgtggcagagtttttacctgttcctcaacacttactcaagacaagaaaattcatactggagagaaaccctacaattgtgaagaatgtggcaaagtttttacctattcctctacacttactagacataagagaattcatactgaagagaaaccctataaatgtaacgaatgtggcaaagcttttaaccggtcctcacaccttactagccataggagaattcatactggagagaaaccctacaaatgtgaagaatgtggcaaagcctttaagcagtcctcaaaccttaacagtcataaaaaaattcatagtggagagaaaccctacaaatgtgaagaatgtggcaaagcttttatcctgtcctcaagacttactcaacataagaaaattcatactggagagaaaccttacaaatgtgaagaatgtggcaaagcttttaaccggtcctcaagacttactcaacataagaaaattcatactggagagaaaccctacaaatgtaaacaatgtgacaaagcttttacccactcctcaaaccttagtagtcataagaaaattcatagtggagagaaaccctacaaatgtgaagaatgtggcaaagcttttaatcggtcctcaagacttactcaacataagaaaattcatactagagagaaaccttacaaatgtgaagaatgtgccaaagcttttacccggtcttcaagacttactcaacataagaaaattcataggatgggtgtggtggctcatgcctgtaatcccagcactttgggaggcagaggtgggcggatcacgaggtcaggagatcgagaccgtcctggctaacatggtgaaaccccgtctctactaaaaatacaaaaaaaaaaaaaaaaaaaattagccaggcgtggtggtgggcacttgtagtcccacctactcgggaggctgaggcaggagaatggcctgaacccggaggtggagcttgcattgagccaagatcacaccactgcactccagcctgggtgacagagccagactccatctc

SEQ ID NO: 3078 - DNA, 3846 bp, Homo sapiens
tttgtctctcgccgcagcctgagctccaggtctccccttcgctgctctgtgtcctctgctcctagaggcccaacatctgtggccctgtgacctgcaggtattgggagacccacagctaagacaccgggaccccctgaaagcctagaaatggacgacttgaaatatggagtgtatcctctcaaggaagcaagtggatgccctggggctgagaggaatcttctagtttactcttattttgaaaaggagacattgacatttagggatgtggccatagaattctctctggaggagtgggaatgcctgaaccctgctcagcagaatttatatatgaatgtgatgttagaaaactacaaaaacctggtcttcttgggtgttgctgtctctaagcaagacccagtcacctgtctggagcaagaaaaagagccctggaatatgaagagacatgagatggtggatgaacccccagctatgtgttcttattttaccaaagacctttggccagagcaagacataaaagattcttttcaacaagtaatactgagaagatatggcaaatgtgaacatgagaatttacagttaagaaaaggctccgcaagtgtagatgagtataaggtgcacaaagaaggttataatgagctaaaccagtgtttgacaactacccagagcaaaatatttccatgtgataaatatgtgaaagtctttcataaatttttaaatgcaaatagacataagacaagacatactggaaagaaacctttcaaatgtaaaaaatgtggcaaatcattttgcatgcttttacacctaagtcaacataaaagaattcatattagagagaattcttaccaatgtgaagaatgtggcaaagcttttaaatggttctcaacccttactagacacaagagaattcatactggagagaaacccttcaaatgtgaagaatgtggcaaagcttttaagcagtcctcaacccttactacacataagataattcatactggggagaaaccatatagatgtgaagaatgtggcaaagccttcaaccggtcctcacaccttactacacataagataattcatactggagagaagccctacaaatgtgaagaatgtggcaaagcttttaaccagtcttcaacccttagtacacataagttcattcatgctggagagaaaccctacaaatgtgaggaatgtgacaaagcttttaatcgattctcataccttactaaacataagataattcatactggagaaaaatcttacaaatgtgaagaatgtggcaaaggctttaattggtcctcaacccttactaaacataaaagaattcatactggagagaaaccctacaaatgtgaagtgtgtggcaaagcctttaatgagtcctcaaaccttactacacataagatgattcatactggagagaaaccctacaaatgtgaagaatgtggcaaagcttttaaccggtccccacaacttactgcacataagataattcatactggagagaaaccttacaaatgtgaagaatgtggcaaagcttttagccagtcatcaatccttactacacataagagaattcacactggagagaaaccctacaaatgtgaagaatgtggcaaagcttttaaccgatcctcaaatcttactaaacataagataattcatacaggagagaaatcttacaaatgtgaagaatgtggtaaagcctttaaccaatcctcaactcttactaaacataggaaaattcatactagacagaaaccctacaactgtgaagaatgtgacaatacatttaaccagtcctcaaaccttattaaacaaaataattcatactggagagaaactctacaaatgtcaagaatgtgggaaagcctttaagcagtcctcaactcttactaagcattaaatattggccgggtgcggtggcttatgcaaaatggctcccagcattttgggaggctgaggtgggtggatcacaaggtcaagagatcgagaccatcctggccaacatggtgaaaccctgtctctactaaaaatacaaaaattatctgggtgtggtggcacgtgcctgtattcccatctactcgggaggcttaggcaggataatcacttgaacctgggaggtggaagttgcagtgagccaagattgtaccactgcactccagtttggcaacagagtgagactccgtctcaaaaaaaatttatactgtacaaaaaccccacaagtgtgaaaaacatggcaaagcctttaagaagccctcaattcttaacagacataagataatttatactggagagaaactctacaaatcagaaagatgtgactacttttgacaacgcctcaaacttttctaaccataaaagtaattatactggtgagaaatcctagaaatctgaagagtgagataaagcctttaaatggttgtcacacttcattgtaggtaagataattcatactggagaaaacgcctacatgtgtgaacaatatggcaaaacttaatgctcacactttattgctaggaaagcatttatacttgagataaattatacaaatataaagactgtgaaaaagccatcattatctgctcacattttactcaacacagagagttcctgcttaataaaagcattataagtgcaattactgtcaaaagatctttcagaaaatataagcttttttagtgaagagtatttattttgaagttgaacatcacaaatataaaaagggttgtagtgcctttacttgtatcacagatctttttgtagacattttcttctagaggaaaactctgaagcagttgatcaaactttgttcaacatcagggaatttatattgaaaaattgtgcaaatataataaatttggaaaaacaatttttcaaaaactacagcttagaaatcaacagttatactagaatatattttttccagatgcagtaaaagtaaaatatttaatccataattaagtctatgcaaatatcagagaatttatggtagaaatatataaggtactgacacttcagatatactaaatcagagtgctaagtatagaaaatctgaaactaaagttggtagaaaagttatttgtatagaactttaagaggatcagaaggttttttgcagagttataattacattcaaagtatactttatttcttgaaaaatattacagattttttgaaaattgaataatgtcatcattcaactctgaaattatttcctgttgtttcttcattcctattggattcacatgtgaaagcatggggttaattgttgctacatcaaagagagagattcttttgtttgtttgttcgtttgttttttgagactgagtttcactctttcgcccaggctggagtgcattggcatgatctcagctcactacaacctctgccttctggtttcaagcaactcttctgcctcagcatcccaagtagctgggataacaggtgccagccaccatgcccagctaatttgtgtatttctagtagagatggggtttcaccatattggccaagctggtcttgaactcctgacctcatgtgatccgcccgcctcagcctcccaaagtgctgggattacaggcttgagccaccacgcccagcctgtagcatattttaataggagaatacaatatataatagtagcagggttaagtaaggcatccatcatctgtagcatttctcctttgttttacaaacaatccaattctacactttaaaaaaaaatttttaaatgtacaattaaatttttatttaccacagtgttatttttatcgtcataataaaaattatatacgagtataaatgaaattcatttctaaattcttaataaatattttctcatgc

SEQ ID NO: 3079 - DNA, 2922 bp, Homo sapiens
aaaagccggaaggccgcattccgctctccatggaaacgcggctgaccgtctctggaggtttagagggggagggagttgggcgaggggcccagaagtggaagaagtttagggaagtaagttcagcttttaagaggtcgcggcgattccaaggagagtcagtccacaggtcctggctaccctgggaagagacaagaagtaaatgaagaaagaggaagattccaggacctagatatgatttctgtggacacccttcactggtgactgaagtttctaaatagaaatttaaggcagatccagaggagacaaagacagagtatcccaggtgctggccatttcccacaacagaagaaaatgatcaatgcccaggaattgctgacactggaggatgttactgtggagttcacctgggaggagtggcagctcctgggcccttttcagaaggatttgtaccgggatgtgatgttggagatctacagcaacctgctatcaatgggttatcaagtcagcaaaccagatgcactctccaagttggaacgaggagaagaaccatggacaatggaagatgaaaggcacagtcgaatctgtccagaaaacaacgaagttgatgatcatctgcaggatcacttggaaaatcaaaggatgctgaagagtgtggaacaataccatgaacataatgcatttggaaatactgcctctcaaaccaaaagcctttgtcttttcagggaaaatcatgatacatttgagttatatataaaaactttgaaatcaaatttaagtttagtcaaccagaacaaaagctgtgaaattaacaactctactaaatttagtggagatgggaaatcatttcttcatggtaactatgaagaactttattctgcagctaaattctctgtaagtacaaaagccaatagcactaaatcccaagtcagtaagcatcagagaactcatgaaatagaaaaaaaccacgtatgcagtgaatgtgggaaagcgtttgtcaagaagtctcagctcactgatcatgagagagttcatacaggagaaaaaccttatggatgtactttgtgtgcaaaagtgttctccagaaagtccaggctaaatgaacatcaaagaattcataaaagagagaaatcttttatatgcagtgaatgtggaaaagtcttcactatgaagagccgtctgattgaacatcagcgaactcatactggagagaaaccctacatatgcaatgaatgtggaaaaggcttcccaggcaagcgtaatctcattgtacatcagcgaaatcatactggagagaaatcctatatatgtagtgaatgtggaaaaggcttcactgggaagagcatgcttattatacatcagcgaactcatacaggagagaagccctacatctgtagtgaatgtgggaaaggcttcaccacaaaacactatgtcatcatacatcaacgaaatcatacaggagagaaaccatatatatgcaatgaatgtgggaaaggcttcaccatgaagagccgtatgatcgaacatcaacgaactcatacaggagagaaaccctacatatgcagtgaatgtggaaaaggctttcccaggaagagtaatcttattgtacatcagagaaatcatacagtagagaagtcatatctatgtagtgaatgtggaaaaggttttactgtgaaaagcatgctcatcatacatcagcgaactcatacaggagagaagccctacacatgcagtgaatgtgggaaaggcttccccttgaagagtcggctgattgtacatcagcgaactcatactggagagaaaccttacaggtgcagtgaatgtgggaaaggtttcattgtgaatagcggactgatgttacatcagcgaactcatactggagagaaaccgtacatatgcaatgaatgtggaaaaggttttgcctttaagagcaatcttgttgtacaccagcgaactcatactggagagaaaccctttatgtgcagtgaatgtggaaaaggcttcaccatgaaacgctatctcattgtacatcagcaaattcatacagaagagaaatcttgtatatgtagtgaatgtggaagaggctttgccaaggaaacagagcttgctttacataagcaagttcatactggagaaaaaccttatggatgtaatgaatgtggtaaaggcttcactatgaagagccgtctaattgttcatcaacgaactcatacaggagagaaaccctttgtatgcagtgaatgtagaaaagccttctcctcaaagagaaatctcattgtacatcagcgaactcataatggaaacaaaccctgacaatgcagtggacatgttcatgcctttgggaagaaaatctgccttgtacaacatcagagatttcacagtatagattttctacatgtgtactgagtatgaaaaatcatatttcaaaatccagtgttattcactaggatgaatgctatcaatgtcagaaaggcttcaacatgaattcaggctctgaattctttgatgtaccaatgtatagaaaattactcatctgagagagagtctgtggattgggggtaacctttcatttgtcaaccttcattaaaactatgacaacgtccacatgacaaatgtgtaaggtacatagtccttttgcagagaatctgaactgattacatacaaacaaattcatgcagagagaaaaccacgttagtaatgtgaactgattaaacagcagtgtgctcctagcatacatgcatataggcagtgtagagcagcctgttgctagattttcacccttggaagacaatgcaatttccaggagcgaattttaatgaatgcagagaatgcactagtgccttcggtgattaattacctcatattttatgtcacaataaacatgtaggaaataaacttgatacatccaatgcagaaaagtcttga

SEQ ID NO: 3080 - DNA, 2280 bp, Homo sapiens
gtccatcggggagggcgaaggccctgctctcctcggttcccggctccaggcggcgagctgaggttgggagcctggctttcccctccgagagggttcaggtgcctctgccatagcttctgtcgcctgtgctgtgacccgcactggtcgtgggagtcacctgaaaggcaagaaatgatgtttcaggattcagtggcctttgaggatgtggctgtgaccttcacccaagaggagtgggctttgctggatccttcccagaaaaatctctgtagagatgtgatgcaagaaaccttcaggaacctggcctctatagggaaaaaatggaaaccccagaacatatatgtagagtacgaaaatctaaggagaaacctaagaattgtgggagagagactctttgaaagtaaagaaggtcatcagcatggagaaattttgacccaggttccagatgacatgctgaagaaaacaactactggagtaaaatcatgcgaaagcagtgtgtatggagaagtaggcagtgctcattcatctcttaataggcacatcagagatgacactggacacaaggcatatgagtatcaagaatatggacagaaaccatataaatgtaaatactgtaaaaaacctttcaactgtctctcctctgttcagacacatgaaagggctcatagtggaaggaaactctatgtttgtgaggaatgcggaaaaacatttatttcccattcaaaccttcaaagacacaggataatgcaccgtggagatggaccttataagtgtaaattttgtgggaaagccttgatgtttctcagtttgtatcttatccacaaacgaactcacactggagagaaaccatatcaatgtaaacagtgtggtaaagcctttagtcattctagtagccttcgaatacatgaaagaactcacactggggagaagccttataaatgtaatgaatgtgggaaagcattccatagttccacatgccttcatgctcataaaagaactcacactggggagaagccatatgaatgtaaacagtgtgggaaagccttcagctcttcccattcctttcaaatacatgaaagaactcacacgggggagaagccatatgaatgtaaggaatgtggaaaagcattcaagtgtcccagttctgttcgcagacatgaaagaacccactctaggaaaaaaccctatgaatgtaaacattgtgggaaagtattatcttatcttaccagctttcaaaaccacttgggaatgcacactggagagatatctcataaatgtaagatatgtgggaaagccttttattctcccagttcacttcaaacacatgaaaaaactcacactggagagaaaccctataaatgcaaccaatgtggtaaagcctttaattcttccagttccttccgatatcatgaaagaactcacactggagagaaaccttacgagtgtaagcaatgtgggaaagccttcagatctgcctcactccttcaaacacatggtaggactcacacgggagagaaaccctatgcatgtaaggaatgtggaaaaccatttagtaatttctctttctttcaaatacatgaaaggatgcacagagaagagaagccgtatgaatgtaagggttatgggaaaacattcagtttgcccagtttatttcatagacatgaaaggactcacactggaggaaaaacctatgaatgcaagcagtgtggcagatccttcaactgttcgagctcctttcgatatcatggaaggactcacactggagagaaaccctatgaatgcaagcaatgtggaaaagccttcagatctgcctcacagcttcaaattcatggaaggactcacactggagagaaaccttatgaatgtaagcagtgtgggaaagcctttggatctgcctcacaccttcaaatgcatggaaggactcacactggagagaaaccctatgaatgtaagcagtgtgggaagtcttttggatgtgcctcgcgacttcaaatgcatggaaggactcacactggagagaaaccgtataaatgtaagcaatgtgggaaagcttttggatgtccctcaaaccttcgaaggcatggaaggactcacactggagagaaaccctataaatgtaaccaatgtggtaaagtctttagatgttcttcacaacttcaagtgcatggaagggctcactgcatagacaccccataaccccaggctttaggaggctgaggtggggggactgcttaagcccaggagttcaagaccagcctgggcaacatagtgagactctgttat

SEQ ID NO: 3081 - DNA, 2322 bp, Homo sapiens
cctgctctcctcggttcccggctccaggcggcgagctgaggttgggagcctggctttcccctccgagagggttcaggtgcctctgccatagcttctgtcgcctgtgctgtgacccgcactggtcgtgggagtcacctgaaaggcaagaaatgggagacaggaattgcagggagaatcatgcatcaatgcctggaaaggtgattcagtggcctttgaggatgtggctgtgaccttcacccaagaggagtgggctttgctggatccttcccagaaaaatctctgtagagatgtgatgcaagaaaccttcaggaacctggcctctatagggaaaaaatggaaaccccagaacatatatgtagagtacgaaaatctaaggagaaacctaagaattgtgggagagagactctttgaaagtaaagaaggtcatcagcatggagaaattttgacccaggttccagatgacatgctgaagaaaacaactactggagtaaaatcatgcgaaagcagtgtgtatggagaagtaggcagtgctcattcatctcttaataggcacatcagagatgacactggacacaaggcatatgagtatcaagaatatggacagaaaccatataaatgtaaatactgtaaaaaacctttcaactgtctctcctctgttcagacacatgaaagggctcatagtggaaggaaactctatgtttgtgaggaatgcggaaaaacatttatttcccattcaaaccttcaaagacacaggataatgcaccgtggagatggaccttataagtgtaaattttgtgggaaagccttgatgtttctcagtttgtatcttatccacaaacgaactcacactggagagaaaccatatcaatgtaaacagtgtggtaaagcctttagtcattctagtagccttcgaatacatgaaagaactcacactggggagaagccttataaatgtaatgaatgtgggaaagcattccatagttccacatgccttcatgctcataaaagaactcacactggggagaagccatatgaatgtaaacagtgtgggaaagccttcagctcttcccattcctttcaaatacatgaaagaactcacacgggggagaagccatatgaatgtaaggaatgtggaaaagcattcaagtgtcccagttctgttcgcagacatgaaagaacccactctaggaaaaaaccctatgaatgtaaacattgtgggaaagtattatcttatcttaccagctttcaaaaccacttgggaatgcacactggagagatatctcataaatgtaagatatgtgggaaagccttttattctcccagttcacttcaaacacatgaaaaaactcacactggagagaaaccctataaatgcaaccaatgtggtaaagcctttaattcttccagttccttccgatatcatgaaagaactcacactggagagaaaccttacgagtgtaagcaatgtgggaaagccttcagatctgcctcactccttcaaacacatggtaggactcacacgggagagaaaccctatgcatgtaaggaatgtggaaaaccatttagtaatttctctttctttcaaatacatgaaaggatgcacagagaagagaagccgtatgaatgtaagggttatgggaaaacattcagtttgcccagtttatttcatagacatgaaaggactcacactggaggaaaaacctatgaatgcaagcagtgtggcagatccttcaactgttcgagctcctttcgatatcatggaaggactcacactggagagaaaccctatgaatgcaagcaatgtggaaaagccttcagatctgcctcacagcttcaaattcatggaaggactcacactggagagaaaccttatgaatgtaagcagtgtgggaaagcctttggatctgcctcacaccttcaaatgcatggaaggactcacactggagagaaaccctatgaatgtaagcagtgtgggaagtcttttggatgtgcctcgcgacttcaaatgcatggaaggactcacactggagagaaaccgtataaatgtaagcaatgtgggaaagcttttggatgtccctcaaaccttcgaaggcatggaaggactcacactggagagaaaccctataaatgtaaccaatgtggtaaagtctttagatgttcttcacaacttcaagtgcatggaagggctcactgcatagacaccccataaccccaggctttaggaggctgaggtggggggactgcttaagcccaggagttcaagaccagcctgggcaacatagtgagactctgttataaaaattaaataaataaataaaaaga

SEQ ID NO: 3082 - DNA, 449 bp, Homo sapiens
ggttcccggctccaggcggcgagctgaggttgggagcctggctttcccctccgagagggttcaggtgcctctgccatagcttctgtcgcctgtgctgtgacccgcactggtcgtgggagtcacctgaaaggcaagaaatgttctggaagcctggaagttatgaagtccatgttcaaggtgctgacagatctggtgcctggattcagtggcctttgaggatgtggctgtgaccttcacccaagaggagtgggctttgctggatccttcccagaaaaatctctgtagagatgtgatgcaagaaaccttcaggaacctggcctctatagggaaaaaatggaaaccccagaacatatatgtagagtacgaaaatctaaggagaaacctaagaattgtgggagagagactctttgaaagtaaagaaggtcatcagcatggagaaattttgaccc

SEQ ID NO: 3083 - DNA, 583 bp, Homo sapiens
tcggttcccggctccaggcggcgagctgaggttgggagcctggctttcccctccgagagggttcaggtgcctctgccatagcttctgtcgcctgtgctgtgacccgcactggtcgtgggagtcacctgaaaggattcagtggcctttgaggatgtggctgtgaccttcacccaagaggagtgggctttgctggatccttcccagaaaaatctctgtagagatgtgatgcaagaaaccttcaggaacctggcctctatagggaaaaaatggaaaccccagaacatatatgtagagtacgaaaatctaaggagaaacctaagaattgtgggagagagactctttgaaagtaaagaaggtcatcagcatggagaaattttgacccaggttccagatgacatgctgaagaaaacaactactggagtaaaatcatgcgaaagcagtgtgtatggagaagtaggcagtgctcattcatctcttaataggcacatcagagatgacactggacacaaggcatatgagtatcaagaatatggacagaaaccatataaatgtaaatactgtaaaaaacctttcaactgtctct

SEQ ID NO: 3084 - DNA, 3027 bp, Homo sapiens
gtaatgggcggagcgaatcgcgccgctgacttccggcccggaggctgagggagaatgtttgataggtttatattgtctttttccatcctcttcagacatccttcaaagttgagccctttttttccgctgtgagtctctacacatgtctgacactctcatgtcccacggattacagaaagacattccttgcaggagaacatggcttcccagtgatgtgggaaagatggactctgatctccagggtagaagtggcaaccagagtaagccagttcgttgaagcaaatgatggctgcagtgaagagtaccgaggcacacccatcctcaaacaaggatcccacacagggccagaaatcagccctccagggtaacagccctgactccgaggcctcccgtcagcgcttcaggcagttttgctaccaggaggtaactggcccacatgaagcttttagcaaactctgggaactctgttgtcagtggctgaggccgaagacccactcaaaagaggaaatcctggagctgctggttttggagcagtttctgactatcttgccagaggagatccagacctgggtgagggagcagcatccagaaaacggcgaggaagctgtggctctggttgaggatgtacagagagctcctggacaacagcctggcttgctcctcaggctcccaggaacctgcctcaaaacacaggtctccacgaccaggagacaggtgctgtggtctggacagctgggtcccaggctagagtggtgctattttatcggtagcagcagctccagtgttgttacagggaccagccatgcgtgacaacagagctgtatccctctgtcagcaagaatggatgtgcccaggccctgcacaaagggccctctacaggggtgccacccagaggaaggacagtcacgtctcgctggcaacaggtgtgccctggggctatgaagagaccaagacgctcctggctattcttagtagttctcaattttatggaaaactccagacctgtcagcagaacagccagatctacagggccatggcggaaggactctgggagcagggttttctgcggaccccagaacagtgtcgcaccaagttcaaaagcctacagttgagttaccgcaaagtgaggagaggccgtgtgcctgagccttgtatcttttatgaggaaatgaatgctctttcaggctcctgggcctctgcacctcctatggcaagcgatgctgttcctggccaagaaggaagtgatattgaggctggagagctgaatcaccagaatggggaacccacggaggtagaagatggcactgtggatggtgcagacagggatgaaaaggacttcaggaatcctggccaggaagtcaggaaactagacctgccagtgctgttcccaaacagacttggttttgagttcaagaacgagattaaaaaagaaaatctaaaatgggatgattcagaggaagtagaaataaacaaggctttacagagaaagtccagaggagtttattggcactctgagctacaaaaaggcttggagagtgagccaacatcaagaaggcaatgtagaaattctccaggggagagtgaggagaaaaccccatcccaggagaagatgagtcaccagagtttttgtgccagggacaaagcctgtacacatatcctctgtgggaaaaactgctctcagagtgtgcactctccccacaagccagcgctcaaactggaaaaagtatctcaatgtcctgaatgtgggaaaacctttagccgaagttcttatcttgttcggcatcaaagaatccacacaggcgagaagcctcacaagtgcagtgagtgcgggaagggctttagtgagcgctccaacctcactgcccacctacgaactcacacaggggagaggccctatcagtgtgggcaatgtgggaaaagcttcaaccagagttccagcctcattgtccaccagaggacccataccggggaaaagccttaccagtgcattgtctgtggaaagagattcaacaacagttcccagttcagtgctcaccggcgcatccacactggggagagcccatacaagtgtgcagtgtgtgggaaaatcttcaacaatagctcccacttcagtgcccaccgaaaaacccacactggtgaaaagccttacaggtgttctcactgtgagagaggcttcactaagaactctgccctcacccgtcatcagacagtacacatgaaagcagtactctcatcacaggaaggaagagatgcgttatgagtgtgtcggtaaactgtcagattaagttcctcaggtcagcatgtatgagctttcttctgctgtggagagatctagccagtccctgactttgcaacagacctactgactactggatcttaagacccatgtctaggaccaggagtcagcataaggacgctgacctctcctggctgtgcctgtgactccagagtcctatcttactgtgacttaaagtttgatggagagaaagctgtaggatccataaattctaccaggaaaccagggtcttcctgttcctagcactgagaatgggcacccagtggtccaagaacactttctgggctaacatagtcctcacacagggctgagaaagaaagtgtctcctttcctggaaagcacatgtaaaagttaagggcctgaatctcttctaaaccaataattgacctctaggcacccaccgtaatactgctaccttcagggcagaagacactgctctttgtaacccagccaccaccaaaaagcaaacagaaagaaggaaggatggttaagccattggataatactgaatctgtttccctaagtgacttaaccttagagcaagcacaacatccaggttaattttttgtaagatttctccttttattattgccctcatcatagttcctgattgtctcttaaagtaagtggtttatagacattactatttctgataataatttacaaactactataaacaaatttataaacattactaatttctgatgaaaataaagttgtttctccctcca

SEQ ID NO: 3085 - DNA, 3048 bp, Homo sapiens
gacatccttcaaagttgagccctttttttccgctgtgagtctctacacatgtctgacactctcatgtcccacggattacagaaagacattccttgcaggagaacatggcttcccagtgatgtgggaaagatggactctgatctccagggtagaagtggcaaccagagtaagccagttcgttgaagcaaatgatggctgcagtgaagagtaccgaggcacacccatcctcaaacaaggatcccacacagggccagaaatcagccctccagggtaacagccctgactccgaggcctcccgtcagcgcttcaggcagttttgctaccaggaggtaactggcccacatgaagcttttagcaaactctgggaactctgttgtcagtggctgaggccgaagacccactcaaaagaggaaatcctggagctgctggttttggagcagtttctgactatcttgccagaggagatccagacctgggtgagggagcagcatccagaaaacggcgaggaagctgtggctctggttgaggatgtacagagagctcctggacaacaggttctagattctgagaaggacttgaaagtactcatgaaggagatggcccctttgggagcaaccagagaatcactgagatcccaatggaaacaggaggttcagccagaggaaccgacttttaagggatcacagagctcacaccaaagaccaggggaacagtcagaagcctggcttgctcctcaggctcccaggaacctgcctcaaaacacaggtctccacgaccaggagacaggtgctgtggtctggacagctgggtcccagggaccagccatgcgtgacaacagagctgtatccctctgtcagcaagaatggatgtgcccaggccctgcacaaagggccctctacaggggtgccacccagaggaaggacagtcacgtctcgctggcaacaggtgtgccctggggctatgaagagaccaagacgctcctggctattcttagtagttctcaattttatggaaaactccagacctgtcagcagaacagccagatctacagggccatggcggaaggactctgggagcagggttttctgcggaccccagaacagtgtcgcaccaagttcaaaagcctacagttgagttaccgcaaagtgaggagaggccgtgtgcctgagccttgtatcttttatgaggaaatgaatgctctttcaggctcctgggcctctgcacctcctatggcaagcgatgctgttcctggccaagaaggaagtgatattgaggctggagagctgaatcaccagaatggggaacccacggaggtagaagatggcactgtggatggtgcagacagggatgaaaaggacttcaggaatcctggccaggaagtcaggaaactagacctgccagtgctgttcccaaacagacttggttttgagttcaagaacgagattaaaaaagaaaatctaaaatgggatgattcagaggaagtagaaataaacaaggctttacagagaaagtccagaggagtttattggcactctgagctacaaaaaggcttggagagtgagccaacatcaagaaggcaatgtagaaattctccaggggagagtgaggagaaaaccccatcccaggagaagatgagtcaccagagtttttgtgccagggacaaagcctgtacacatatcctctgtgggaaaaactgctctcagagtgtgcactctccccacaagccagcgctcaaactggaaaaagtatctcaatgtcctgaatgtgggaaaacctttagccgaagttcttatcttgttcggcatcaaagaatccacacaggcgagaagcctcacaagtgcagtgagtgcgggaagggctttagtgagcgctccaacctcactgcccacctacgaactcacacaggggagaggccctatcagtgtgggcaatgtgggaaaagcttcaaccagagttccagcctcattgtccaccagaggacccataccggggaaaagccttaccagtgcattgtctgtggaaagagattcaacaacagttcccagttcagtgctcaccggcgcatccacactggggagagcccatacaagtgtgcagtgtgtgggaaaatcttcaacaatagctcccacttcagtgcccaccgaaaaacccacactggtgaaaagccttacaggtgttctcactgtgagagaggcttcactaagaactctgccctcacccgtcatcagacagtacacatgaaagcagtactctcatcacaggaaggaagagatgcgttatgagtgtgtcggtaaactgtcagattaagttcctcaggtcagcatgtatgagctttcttctgctgtggagagatctagccagtccctgactttgcaacagacctactgactactggatcttaagacccatgtctaggaccaggagtcagcataaggacgctgacctctcctggctgtgcctgtgactccagagtcctatcttactgtgacttaaagtttgatggagagaaagctgtaggatccataaattctaccaggaaaccagggtcttcctgttcctagcactgagaatgggcacccagtggtccaagaacactttctgggctaacatagtcctcacacagggctgagaaagaaagtgtctcctttcctggaaagcacatgtaaaagttaagggcctgaatctcttctaaaccaataattgacctctaggcacccaccgtaatactgctaccttcagggcagaagacactgctctttgtaacccagccaccaccaaaaagcaaacagaaagaaggaaggatggttaagccattggataatactgaatctgtttccctaagtgacttaaccttagagcaagcacaacatccaggttaattttttgtaagatttctccttttattattgccctcatcatagttcctgattgtctcttaaagtaagtggtttatagacattactatttctgataataatttacaaactactataaacaaatttataaacattactaatttctgatgaaaataaagttgtttctccctcc

SEQ ID NO: 3086 - DNA, 3134 bp, Homo sapiens
cgtgcgtaatgggcggagcgaatcgcgccgctgacttccggcccggaggctgagggagtttgtggagtcgcgagtgctggtgtccgacatccttcaaagttgagccctttttttccgctgtgagtctctacacatgtctgacactctcatgtcccacggattacagaaagacattccttgcaggagaacatggcttcccagtgatgtgggaaagatggactctgatctccagggtagaagtggcaaccagagtaagccagttcgttgaagcaaatgatggctgcagtgaagagtaccgaggcacacccatcctcaaacaaggatcccacacagggccagaaatcagccctccagggtaacagccctgactccgaggcctcccgtcagcgcttcaggcagttttgctaccaggaggtaactggcccacatgaagcttttagcaaactctgggaactctgttgtcagtggctgaggccgaagacccactcaaaagaggaaatcctggagctgctggttttggagcagtttctgactatcttgccagaggagatccagacctgggtgagggagcagcatccagaaaacggcgaggaagctgtggctctggttgaggatgtacagagagctcctggacaacaggttctagattctgagaaggacttgaaagtactcatgaaggagatggcccctttgggagcaaccagagaatcactgagatcccaatggaaacaggaggttcagccagaggaaccgacttttaagggatcacagagctcacaccaaagaccaggggaacagtcagaagcctggcttgctcctcaggctcccaggaacctgcctcaaaacacaggtctccacgaccaggagacaggtgctgtggtctggacagctgggtcccagggaccagccatgcgtgacaacagagctgtatccctctgtcagcaagaatggatgtgcccaggccctgcacaaagggccctctacaggggtgccacccagaggaaggacagtcacgtctcgctggcaacaggtgtgccctggggctatgaagagaccaagacgctcctggctattcttagtagttctcaattttatggaaaactccagacctgtcagcagaacagccagatctacagggccatggcggaaggactctgggagcagggttttctgcggaccccagaacagtgtcgcaccaagttcaaaagcctacagttgagttaccgcaaagtgaggagaggccgtgtgcctgagccttgtatcttttatgaggaaatgaatgctctttcaggctcctgggcctctgcacctcctatggcaagcgatgctgttcctggccaagaaggaagtgatattgaggctggagagctgaatcaccagaatggggaacccacggaggtagaagatggcactgtggatggtgcagacagggatgaaaaggacttcaggaatcctggccaggaagtcaggaaactagacctgccagtgctgttcccaaacagacttggttttgagttcaagaacgagattaaaaaagaaaatctaaaatgggatgattcagaggaagtagaaataaacaaggctttacagagaaagtccagaggagtttattggcactctgagctacaaaaaggcttggagagtgagccaacatcaagaaggcaatgtagaaattctccaggggagagtgaggagaaaaccccatcccaggagaagatgagtcaccagagtttttgtgccagggacaaagcctgtacacatatcctctgtgggaaaaactgctctcagagtgtgcactctccccacaagccagcgctcaaactggaaaaagtatctcaatgtcctgaatgtgggaaaacctttagccgaagttcttatcttgttcggcatcaaagaatccacacaggcgagaagcctcacaagtgcagtgagtgcgggaagggctttagtgagcgctccaacctcactgcccacctacgaactcacacaggggagaggccctatcagtgtgggcaatgtgggaaaagcttcaaccagagttccagcctcattgtccaccagaggacccataccggggaaaagccttaccagtgcattgtctgtggaaagagattcaacaacagttcccagttcagtgctcaccggcgcatccacactggggagagcccatacaagtgtgcagtgtgtgggaaaatcttcaacaatagctcccacttcagtgcccaccgaaaaacccacactggtgaaaagccttacaggtgttctcactgtgagagaggcttcactaagaactctgccctcacccgtcatcagacagtacacatgaaagcagtactctcatcacaggaaggaagagatgcgttatgagtgtgtcggtaaactgtcagattaagttcctcaggtcagcatgtatgagctttcttctgctgtggagagatctagccagtccctgactttgcaacagacctactgactactggatcttaagacccatgtctaggaccaggagtcagcataaggacgctgacctctcctggctgtgcctgtgactccagagtcctatcttactgtgacttaaagtttgatggagagaaagctgtaggatccataaattctaccaggaaaccagggtcttcctgttcctagcactgagaatgggcacccagtggtccaagaacactttctgggctaacatagtcctcacacagggctgagaaagaaagtgtctcctttcctggaaagcacatgtaaaagttaagggcctgaatctcttctaaaccaataattgacctctaggcacccaccgtaatactgctaccttcagggcagaagacactgctctttgtaacccagccaccaccaaaaagcaaacagaaagaaggaaggatggttaagccattggataatactgaatctgtttccctaagtgacttaaccttagagcaagcacaacatccaggttaattttttgtaagatttctccttttattattgccctcatcatagttcctgattgtctcttaaagtaagtggtttatagacattactatttctgataataatttacaaactactataaacaaatttataaacattactaatttctgatgaaaataaagttgtttctccctcca

SEQ ID NO: 3087 - DNA, 1462 bp, Homo sapiens
gtcgcgagtgctggtgtccgacatccttcaaagttgagccctttttttccgctgtgagtctctacacatgtctgacactctcatgtcccacggattacagaaagacattccttgcaggagaacatggcttcccagtgatgtgggaaagatggactctgatctccagggtagaagtggcaaccagagtaagccagttcgttgaagcaaatgatggctgcagtgaagagtaccgaggcacacccatcctcaaacaaggatcccacacagggccagaaatcagccctccagggtaacagccctgactccgaggcctcccgtcagcgcttcaggcagttttgctaccaggaggtaactggcccacatgaagcttttagcaaactctgggaactctgttgtcagtggctgaggccgaagacccactcaaaagaggaaatcctggagctgctggttttggagcagtttctgactatcttgccagaggagatccagacctgggtgagggagcagcatccagaaaacggcgaggaagctgtggctctggttgaggatgtacagagagctcctggacaacaggttctagattctgagaaggacttgaaagtactcatgaaggagatggcccctttgggagcaaccagagaatcactgagatcccaatggaaacaggaggttcagccagaggaaccgacttttaagggatcacagagctcacaccaaagaccaggggaacagtcagaagcctggcttgctcctcaggctcccaggaacctgcctcaaaacacaggtctccacgaccaggagacaggtgctgtggtctggacagctgggtcccagggaccagccatgcgtgacaacagagctgtatccctctgtcagcaagaatggatgtgcccaggccctgcacaaagggccctctacaggggtgccacccagaggaaggacagtcacgtctcgctggcaacaggtgccctggggctatgaagagaccaagacgctcctggctattcttagtagttctcaattttatggaaaactccagacctgtcagcagaacagccagatctacagggccatggcggaaggactctgggagcagggttttctgcggaccccagaacagtgtcgcaccaagttcaaaagcctacagttgagttaccgcaaagtgaggagaggccgtgtgcctgagccttgtatcttttatgaggaaatgaatgctctttcaggctcctgggcctctgcacctcctatggcaagcgatgctgttcctggccaagaaggaagtgatattgaggctggagagctgaatcaccagaatggggaacccacggaggtagaagatggcactgtggatggtgcagacagggatgaaaaggacttcaggaatcctggccaggaagtcaggaaactagacctgccagtgctgttcccaaacagacttggttttgagttcaagaacgagatt

SEQ ID NO: 3088 - DNA, 1267 bp, Homo sapiens
gcgaatcgcgccgctgacttccggcccggaggctgagggagtttgtggagtcgcgagtgctggtgtccggttctagattctgagaaggacttgaaagtactcatgaaggagatggcccctttgggagcaaccagagaatcactgagatcccaatggaaacaggaggttcagccagaggaaccgacttttaagggatcacagagctcacaccaaagaccaggggaacagtcagaaggctagagtggtgctattttatcggtagcagcagctccagtgttgttacagggaccagccatgcgtgacaacagagctgtatccctctgtcagcaagaatggatgtgcccaggccctgcacaaagggccctctacaggggtgccacccagaggaaggacagtcacgtctcgctggcaacaggtgtgccctggggctatgaagagaccaagacgctcctggctattcttagtagttctcaattttatggaaaactccagacctgtcagcagaacagccagatctacagggccatggcggaaggactctgggagcagggttttctgcggaccccagaacagtgtcgcaccaagttcaaaagcctacagttgagttaccgcaaagtgaggagaggccgtgtgcctgagccttgtatcttttatgaggaaatgaatgctctttcaggctcctgggcctctgcacctcctatggcaagcgatgctgttcctggccaagaaggaagtgatattgaggctggagagctgaatcaccagaatggggaacccacggaggtagaagatggcactgtggatggtgcagacagggatgaaaaggacttcaggaatcctggccaggaagtcaggaaactagacctgccagtgctgttcccaaacagacttggtaagactcccttggctctgatggtcaaaggatggcaaagtccactttagaggccattagcctagcagttgagtaggagctgtcactgatcctggcatcatcatcatcttgatgtgtgaccctatccaagttttggttttcatggagttaaaggttattccccttgcattttacagccctgattttgcatttgccaacctctttcaactaagttcatgtcatcttttcccatggagtttcactatgcattgtcagactgctggttaggcctccagaccaggtccatcttctccctttttctctagcatggccttgcctttcacagcctgagcctatgctggctgggtacttagcaccttgctttcttcctgtttg

SEQ ID NO: 3089 - DNA, 1746 bp, Homo sapiens
tccggcccggaggctgagggagtttgtggagtcgcgagtgctggtgtccgcaacaggtgtgccctggggctatgaagagaccaagacgctcctggctattcttagtagttctcaattttatggaaaactccagacctgtcagcagaacagccagatctacagggccatggcggaaggactctgggagcagggttttctgcggaccccagaacagtgtcgcaccaagttcaaaagcctacagttgagttaccgcaaagtgaggagaggccgtgtgcctgagccttgtatcttttatgaggaaatgaatgctctttcaggctcctgggcctctgcacctcctatggcaagcgatgctgttcctggccaagaaggaagtgatattgaggctggagagctgaatcaccagaatggggaacccacggaggtagaagatggcactgtggatggtgcagacagggatgaaaaggacttcaggaatcctggccaggaagtcaggaaactagacctgccagtgctgttcccaaacagacttggttttgagttcaagaacgagattaaaaaagaaaatctaaaatgggatgattcagaggaagtagaaataaacaaggctttacagagaaagtccagaggagtttattggcactctgagctacaaaaaggcttggagagtgagccaacatcaagaaggcaatgtagaaattctccaggggagagtgaggagaaaaccccatcccaggagaagatgagtcaccagagtttttgtgccagggacaaagcctgtacacatatcctctgtgggaaaaactgctctcagagtgtgcactctccccacaagccagcgctcaaactggaaaaagtatctcaatgtcctgaatgtgggaaaacctttagccgaagttcttatcttgttcggcatcaaagaatccacacaggcgagaagcctcacaagtgcagtgagtgcgggaagggctttagtgagcgctccaacctcactgcccacctacgaactcacacaggggagaggccctatcagtgtgggcaatgtgggaaaagcttcaaccagagttccagcctcattgtccaccagaggacccataccggggaaaagccttaccagtgcattgtctgtggaaagagattcaacaacagttcccagttcagtgctcaccggcgcatccacactggggagagcccatacaagtgtgcagtgtgtgggaaaatcttcaacaatagctcccacttcagtgcccaccgaaaaacccacactggtgaaaagccttacaggtgttctcactgtgagagaggcttcactaagaactctgccctcacccgtcatcagacagtacacatgaaagcagtactctcatcacaggaaggaagagatgcgttatgagtgtgtcggtaaactgtcagattaagttcctcaggtcagcatgtatgagctttcttctgctgtggagagatctagccagtccctgactttgcaacagacctactgactactggatcttaagacccatgtctaggaccaggagtcagcataaggacgctgacctctcctggctgtgcctgtgactccagagtcctatcttactgtgacttaaagtttgatggagagaaagctgtaggatccataaattctaccaggaaaccagggtcttcctgttcctagcactgagaatgggcacccagtggtccaagaacactttctgggctaacatagtcctcacacagggctgagaaaga

SEQ ID NO: 3090 - DNA, 3243 bp, Homo sapiens
aattaattaaaaggatttacggtatatcttatgactctacaggagccttgggatatagataaaaatgaatgccatttcccatccagtactgaagtgttaaagttagaagacatttgctaagtcaaatcacttcaggaagctcatcctgggagtggaggaacagatgttctgtcattgccacattcttctggacacagactggagaactataggaatgtatgttgaagaaagtacgcacatcttatcttctgaacattttgatggaattaaccacaaacttcatgcaagaacagtaaaaggaaagatactattcaagtccagtacatcataatgcagaattctgtatcagtaccaccaaaagatgaagatccaatcctttgatggcaatggaggaggaggaggacacacgttgcacattctccaaatatccaacagcctttctggatttctcagagtcctatggatagtgaatcaaacatcccttctggaacaatacagagtaggaaaggtttgcagaataagagtcagtttaggaccattgcaccaaaaattgtgcccaaagtcctaacgtccagaatgctgccatgtcattcaccatcacgctctgatcaggtgaatctgggaccctccatcaactccaagctgctggggatgtccacccagaactatgccctgatgcaggttgctggccaggaggggacattttctcttgttgctctgccacatgttgcctcagctcagccaattcagaaacccagaatgtccctacctgaaaacctgaaacttcctattcctagatatcaaccccctagaaatagcaaagcatcaagaaagaaacccatcctgatctttcctaagagtggctgtagcaaagctcctgcccaaacccaaatgtgtcctcagatgtccccttccccacctcaccaccctgaactcctgtacaaacccagtccatttgaggaagtaccatcactagagcaagccccagccagcattagcacagctgcgctgaccaatggaagtgaccatggggacttgagaccaccagtgaccaacacccatggcagtctgaaccctcctgctaccccagcatcatccacaccagaggagcctgccaagcaggacctcacagctctttcagggaaagcacactttgtaagcaagataacatctagtaaaccttctgctgttgccagtgaaaaatttaaagaacaagttgatcttgcaaaaaccatgaccaatttatcaccaaccattcttggcaatgcagttcagttgatctcttcagtccccaaagggaaactgccaatcccaccctactcaagaatgaagacaatggaggtttacaaaatcaaatcagatgctaacattgcaggtttttctttaccaggacctaaggccgactgtgataagataccctccaccacagaaggctttaatgcagccaccaaggtggcaagcaggctacctgttccacaagtgtcacagcagagtgcctgtgaaagtgccttttgtccacccaccaaacttgatcttaaccacaaaacaaaactgaacagtggagcagcaaagagaaaaggaagaaaacggaaggtaccagatgaaattttggcatttcagggaaaaaggaggaaatatatcattaataagtgtagagatggtaaagaaagagtaaaaaatgatccccaagaattcagagaccaaaagctggggaccctgaaaaaataccgtagcattatgcccaaacctatcatggtcatacccactttggcctccctggcttctccaactacactacagtcccagatgcttgggggcctaggacaggatgttttgttaaataattcactcactcctaaatatcttggctgtaagcaagacaacagctcttcccctaagcccagctccgtgttcagaaatggattctctggcattaagaagccttggcacagatgtcacgtctgcaaccaccacttccagttcaaacagcaccttcgagaccacatgaatacacacaccaacagacgcccttacagttgtcggatttgtcgcaagtcctatgtacgtcctggcagcctgagcacacacatgaaacttcatcatggtgagaaccgtctgaagaaactcatgtgttgtgagttttgtgcaaaagtgtttggccacatccgagtctattttggccatctgaaagaagtgcatagggttgtgatcagcactgagcctgcgcccagtgaactgcagccaggagacataccaaagaacagagacatgagtgtgcgaggcatggagggatcattggagagggaaaacaagtccaacctggaagaagacttccttctaaaccaggcagacgaagtcaaattacaaatcaaatgtggtcgttgtcagattactgctcagtcttttgcggaaataaaatttcatttacttgatgttcatggagaggaaattgagggcaggctacaagaagggaccttcccaggaagcaaggggactcaggaagagttggtgcagcacgctagccccgactggaaaaggcatcctgagagagggaagccggagaaggttcattcctcctccgaggaatcacatgcatgtccaagactgaaaaggcagctccaccttcatcagaatggcgtggaaatgctcatggaaaatgaaggaccccagtcaggaaccaacaagccaagggaaacctgccagggccctgagtgtcctggcctccacacgtttctcttgtggtcccattcaggctttaactgcctgctttgtgcagagatgctgggacggaaagaggacctcctccaccactggaagcaccagcataactgtgaggacccttccaaactgtgggctattttaaatacggtctccaaccagggagtgatcgaactttccagtgaagctgagaaatgagaccccaaggcagcctggggttaaggagagagctctgccgccaccttccttcagagcttcgtgctttatggtggtgcttagtcacaaagatcaaacaacaggattggtgtgagtgaacagaaatgatttttgtacatggttttattttcttaacgaaataaaatataagctctcgaagcatatttttctaactatatgcagtcttattttaaaatacgtactgattcttaatatcttagactttcagaataaataaaaagatcaaaatttgaagattgaaatttagcagaatataggctgttcttcaaatacagctctcagtgaaaa

SEQ ID NO: 3091 - DNA, 3144 bp, Homo sapiens
aattaattaaaaggatttacggtatatcttatgactctacaggagccttgggatatagataaaaatgaatgccatttcccatccagtactgaagtgttaaagttagaagacatttgctaagtcaaatcacttcaggaagctcatcctgggagtggaggaacagatgttctgtcattgccacattcttctggacacagactggagaactataggaatgtatgttgaagaaagtacgcacatcttatcttctgaacattttgatggaattaaccacaaacttcatgcaagaacagtaaaaggaaagatactattcaagtccagtacatcataatgcagaattctgtatcagtaccaccaaaagatgaaggtgaatcaaacatcccttctggaacaatacagagtaggaaaggtttgcagaataagagtcagtttaggaccattgcaccaaaaattgtgcccaaagtcctaacgtccagaatgctgccatgtcattcaccatcacgctctgatcaggtgaatctgggaccctccatcaactccaagctgctggggatgtccacccagaactatgccctgatgcaggttgctggccaggaggggacattttctcttgttgctctgccacatgttgcctcagctcagccaattcagaaacccagaatgtccctacctgaaaacctgaaacttcctattcctagatatcaaccccctagaaatagcaaagcatcaagaaagaaacccatcctgatctttcctaagagtggctgtagcaaagctcctgcccaaacccaaatgtgtcctcagatgtccccttccccacctcaccaccctgaactcctgtacaaacccagtccatttgaggaagtaccatcactagagcaagccccagccagcattagcacagctgcgctgaccaatggaagtgaccatggggacttgagaccaccagtgaccaacacccatggcagtctgaaccctcctgctaccccagcatcatccacaccagaggagcctgccaagcaggacctcacagctctttcagggaaagcacactttgtaagcaagataacatctagtaaaccttctgctgttgccagtgaaaaatttaaagaacaagttgatcttgcaaaaaccatgaccaatttatcaccaaccattcttggcaatgcagttcagttgatctcttcagtccccaaagggaaactgccaatcccaccctactcaagaatgaagacaatggaggtttacaaaatcaaatcagatgctaacattgcaggtttttctttaccaggacctaaggccgactgtgataagataccctccaccacagaaggctttaatgcagccaccaaggtggcaagcaggctacctgttccacaagtgtcacagcagagtgcctgtgaaagtgccttttgtccacccaccaaacttgatcttaaccacaaaacaaaactgaacagtggagcagcaaagagaaaaggaagaaaacggaaggtaccagatgaaattttggcatttcagggaaaaaggaggaaatatatcattaataagtgtagagatggtaaagaaagagtaaaaaatgatccccaagaattcagagaccaaaagctggggaccctgaaaaaataccgtagcattatgcccaaacctatcatggtcatacccactttggcctccctggcttctccaactacactacagtcccagatgcttgggggcctaggacaggatgttttgttaaataattcactcactcctaaatatcttggctgtaagcaagacaacagctcttcccctaagcccagctccgtgttcagaaatggattctctggcattaagaagccttggcacagatgtcacgtctgcaaccaccacttccagttcaaacagcaccttcgagaccacatgaatacacacaccaacagacgcccttacagttgtcggatttgtcgcaagtcctatgtacgtcctggcagcctgagcacacacatgaaacttcatcatggtgagaaccgtctgaagaaactcatgtgttgtgagttttgtgcaaaagtgtttggccacatccgagtctattttggccatctgaaagaagtgcatagggttgtgatcagcactgagcctgcgcccagtgaactgcagccaggagacataccaaagaacagagacatgagtgtgcgaggcatggagggatcattggagagggaaaacaagtccaacctggaagaagacttccttctaaaccaggcagacgaagtcaaattacaaatcaaatgtggtcgttgtcagattactgctcagtcttttgcggaaataaaatttcatttacttgatgttcatggagaggaaattgagggcaggctacaagaagggaccttcccaggaagcaaggggactcaggaagagttggtgcagcacgctagccccgactggaaaaggcatcctgagagagggaagccggagaaggttcattcctcctccgaggaatcacatgcatgtccaagactgaaaaggcagctccaccttcatcagaatggcgtggaaatgctcatggaaaatgaaggaccccagtcaggaaccaacaagccaagggaaacctgccagggccctgagtgtcctggcctccacacgtttctcttgtggtcccattcaggctttaactgcctgctttgtgcagagatgctgggacggaaagaggacctcctccaccactggaagcaccagcataactgtgaggacccttccaaactgtgggctattttaaatacggtctccaaccagggagtgatcgaactttccagtgaagctgagaaatgagaccccaaggcagcctggggttaaggagagagctctgccgccaccttccttcagagcttcgtgctttatggtggtgcttagtcacaaagatcaaacaacaggattggtgtgagtgaacagaaatgatttttgtacatggttttattttcttaacgaaataaaatataagctctcgaagcatatttttctaactatatgcagtcttattttaaaatacgtactgattcttaatatcttagactttcagaataaataaaaagatcaaaatttgaagattgaaatttagcagaatataggctgttcttcaaatacagctctcagtgaaaa

SEQ ID NO: 3092 - DNA, 2173 bp, Homo sapiens
gggggcccagcggcccgcgccccgtggcttgacctccccgactgctgggcccgtgacgtcaccccgctgtgacgcgcacgctgtaggaaaactataaaaatgaatgccatttcccatccagtactgaagtgttaaagttagaagacatttgctaagtcaaatcacttcaggtatgttgaagaaagtacgcacatcttatcttctgaacattttgatggaattaaccacaaacttcatgcaagaacagtaaaaggaaagatactattcaagtccagtacatcataatgcagaattctgtatcagtaccaccaaaagatgaaggtgaatcaaacatcccttctggaacaatacagagtaggaaaggtttgcagaataagagtcagtttaggaccattgcaccaaaaattgtgcccaaagtcctaacgtccagaatgctgccatgtcattcaccatcacgctctgatcaggacctaaggccgactgtgataagataccctccaccacagaaggctttaatgcagccaccaaggtggcaagcaggctacctgttccacaagtgtcacagcagagtgcctgtgaaagtgccttttgtccacccaccaaacttgatcttaaccacaaaacaaaactgaacagtggagcagcaaagagaaaaggaagaaaacggaaggtaccagatgaaattttggcatttcagggaaaaaggaggaaatatatcattaataagtgtagagatggtaaagaaagagtaaaaaatgatccccaagaattcagagaccaaaagctggggaccctgaaaaaataccgtagcattatgcccaaacctatcatggtcatacccactttggcctccctggcttctccaactacactacagtcccagatgcttgggggcctaggacaggatgttttgttaaataattcactcactcctaaatatcttggctgtaagcaagacaacagctcttcccctaagcccagctccgtgttcagaaatggattctctggcattaagaagccttggcacagatgtcacgtctgcaaccaccacttccagttcaaacagcaccttcgagaccacatgaatacacacaccaacagacgcccttacagttgtcggatttgtcgcaagtcctatgtacgtcctggcagcctgagcacacacatgaaacttcatcatggtgagaaccgtctgaagaaactcatgtgttgtgagttttgtgcaaaagtgtttggccacatccgagtctattttggccatctgaaagaagtgcatagggttgtgatcagcactgagcctgcgcccagtgaactgcagccaggagacataccaaagaacagagacatgagtgtgcgaggcatggagggatcattggagagggaaaacaagtccaacctggaagaagacttccttctaaaccaggcagacgaagtcaaattacaaatcaaatgtggtcgttgtcagattactgctcagtcttttgcggaaataaaatttcatttacttgatgttcatggagaggaaattgagggcaggctacaagaagggaccttcccaggaagcaaggggactcaggaagagttggtgcagcacgctagccccgactggaaaaggcatcctgagagagggaagccggagaaggttcattcctcctccgaggaatcacatgcatgtccaagactgaaaaggcagctccaccttcatcagaatggcgtggaaatgctcatggaaaatgaaggaccccagtcaggaaccaacaagccaagggaaacctgccagggccctgagtgtcctggcctccacacgtttctcttgtggtcccattcaggctttaactgcctgctttgtgcagagatgctgggacggaaagaggacctcctccaccactggaagcaccagcataactgtgaggacccttccaaactgtgggctattttaaatacggtctccaaccagggagtgatcgaactttccagtgaagctgagaaatgagaccccaaggcagcctggggttaaggagagagctctgccgccaccttccttcagagcttcgtgctttatggtggtgcttagtcacaaagatcaaacaacaggattggtgtgagtgaacagaaatgatttttgtacatggttttattttcttaacgaaataaaatataagctctcgaagca

SEQ ID NO: 3093 - DNA, 3106 bp, Homo sapiens
agggcggagcctgggggcccagcggcccgcgccccgtggcttgacctccccgactgctgggcccgtgacgtcaccccgctgtgacgcgcacgctgtaggaaaactataaaaatgaatgccatttcccatccagtactgaagtgttaaagttagaagacatttgctaagtcaaatcacttcaggtatgttgaagaaagtacgcacatcttatcttctgaacattttgatggaattaaccacaaacttcatgcaagaacagtaaaaggaaagatactattcaagtccagtacatcataatgcagaattctgtatcagtaccaccaaaagatgaaggtgaatcaaacatcccttctggaacaatacagagtaggaaaggtttgcagaataagagtcagtttaggaccattgcaccaaaaattgtgcccaaagtcctaacgtccagaatgctgccatgtcattcaccatcacgctctgatcaggtgaatctgggaccctccatcaactccaagctgctggggatgtccacccagaactatgccctgatgcaggttgctggccaggaggggacattttctcttgttgctctgccacatgttgcctcagctcagccaattcagaaacccagaatgtccctacctgaaaacctgaaacttcctattcctagatatcaaccccctagaaatagcaaagcatcaagaaagaaacccatcctgatctttcctaagagtggctgtagcaaagctcctgcccaaacccaaatgtgtcctcagatgtccccttccccacctcaccaccctgaactcctgtacaaacccagtccatttgaggaagtaccatcactagagcaagccccagccagcattagcacagctgcgctgaccaatggaagtgaccatggggacttgagaccaccagtgaccaacacccatggcagtctgaaccctcctgctaccccagcatcatccacaccagaggagcctgccaagcaggacctcacagctctttcagggaaagcacactttgtaagcaagataacatctagtaaaccttctgctgttgccagtgaaaaatttaaagaacaagttgatcttgcaaaaaccatgaccaatttatcaccaaccattcttggcaatgcagttcagttgatctcttcagtccccaaagggaaactgccaatcccaccctactcaagaatgaagacaatggaggtttacaaaatcaaatcagatgctaacattgcaggtttttctttaccaggacctaaggccgactgtgataagataccctccaccacagaaggctttaatgcagccaccaaggtggcaagcaggctacctgttccacaagtgtcacagcagagtgcctgtgaaagtgccttttgtccacccaccaaacttgatcttaaccacaaaacaaaactgaacagtggagcagcaaagagaaaaggaagaaaacggaaggtaccagatgaaattttggcatttcagggaaaaaggaggaaatatatcattaataagtgtagagatggtaaagaaagagtaaaaaatgatccccaagaattcagagaccaaaagctggggaccctgaaaaaataccgtagcattatgcccaaacctatcatggtcatacccactttggcctccctggcttctccaactacactacagtcccagatgcttgggggcctaggacaggatgttttgttaaataattcactcactcctaaatatcttggctgtaagcaagacaacagctcttcccctaagcccagctccgtgttcagaaatggattctctggcattaagaagccttggcacagatgtcacgtctgcaaccaccacttccagttcaaacagcaccttcgagaccacatgaatacacacaccaacagacgcccttacagttgtcggatttgtcgcaagtcctatgtacgtcctggcagcctgagcacacacatgaaacttcatcatggtgagaaccgtctgaagaaactcatgtgttgtgagttttgtgcaaaagtgtttggccacatccgagtctattttggccatctgaaagaagtgcatagggttgtgatcagcactgagcctgcgcccagtgaactgcagccaggagacataccaaagaacagagacatgagtgtgcgaggcatggagggatcattggagagggaaaacaagtccaacctggaagaagacttccttctaaaccaggcagacgaagtcaaattacaaatcaaatgtggtcgttgtcagattactgctcagtcttttgcggaaataaaatttcatttacttgatgttcatggagaggaaattgagggcaggctacaagaagggaccttcccaggaagcaaggggactcaggaagagttggtgcagcacgctagccccgactggaaaaggcatcctgagagagggaagccggagaaggttcattcctcctccgaggaatcacatgcatgtccaagactgaaaaggcagctccaccttcatcagaatggcgtggaaatgctcatggaaaatgaaggaccccagtcaggaaccaacaagccaagggaaacctgccagggccctgagtgtcctggcctccacacgtttctcttgtggtcccattcaggctttaactgcctgctttgtgcagagatgctgggacggaaagaggacctcctccaccactggaagcaccagcataactgtgaggacccttccaaactgtgggctattttaaatacggtctccaaccagggagtgatcgaactttccagtgaagctgagaaatgagaccccaaggcagcctggggttaaggagagagctctgccgccaccttccttcagagcttcgtgctttatggtggtgcttagtcacaaagatcaaacaacaggattggtgtgagtgaacagaaatgatttttgtacatggttttattttcttaacgaaataaaatataagctctcgaagcatatttttctaactatatgcagtcttattttaaaatacgtactgattcttaatatcttagactttcagaataaataaaaagatcaaaatttgaagattgaaatttagcagaatataggctgttcttcaaatacagctctcagtg

SEQ ID NO: 3094 - DNA, 2097 bp, Homo sapiens
gacgcgcacgctgtaggaaaactaattaattaaaaggatttacggtatatcttatgactctacaggagccttgggatatagataaaaatgaatgccatttcccatccagtactgaagtgttaaagttagaagacatttgctaagtcaaatcacttcaggtatgttgaagaaagtacgcacatcttatcttctgaacattttgatggaattaaccacaaacttcatgcaagaacagtaaaaggaaagatactattcaagtccagtacatcataatgcagaattctgtatcagtaccaccaaaagatgaaggtgaatcaaacatcccttctggaacaatacagagtaggaaaggtttgcagaataagagtcagtttaggaccattgcaccaaaaattgtgcccaaagtcctaacgtccagaatgctgccatgtcattcaccatcacgctctgatcaggacctaaggccgactgtgataagataccctccaccacagaaggctttaatgcagccaccaaggtggcaagcaggctacctgttccacaaaacaaaactgaacagtggagcagcaaagagaaaaggaagaaaacggaaggtaccagatgaaattttggcatttcagggaaaaaggaggaaatatatcattaataagtgtagagatggtaaagaaagagtaaaaaatgatccccaagaattcagagaccaaaagctggggaccctgaaaaaataccgtagcattatgcccaaacctatcatggtcatacccactttggcctccctggcttctccaactacactacagtcccagatgcttgggggcctaggacaggatgttttgttaaataattcactcactcctaaatatcttggctgtaagcaagacaacagctcttcccctaagcccagctccgtgttcagaaatggattctctggcattaagaagccttggcacagatgtcacgtctgcaaccaccacttccagttcaaacagcaccttcgagaccacatgaatacacacaccaacagacgcccttacagttgtcggatttgtcgcaagtcctatgtacgtcctggcagcctgagcacacacatgaaacttcatcatggtgagaaccgtctgaagaaactcatgtgttgtgagttttgtgcaaaagtgtttggccacatccgagtctattttggccatctgaaagaagtgcatagggttgtgatcagcactgagcctgcgcccagtgaactgcagccaggagacataccaaagaacagagacatgagtgtgcgaggcatggagggatcattggagagggaaaacaagtccaacctggaagaagacttccttctaaaccaggcagacgaagtcaaattacaaatcaaatgtggtcgttgtcagattactgctcagtcttttgcggaaataaaatttcatttacttgatgttcatggagaggaaattgagggcaggctacaagaagggaccttcccaggaagcaaggggactcaggaagagttggtgcagcacgctagccccgactggaaaaggcatcctgagagagggaagccggagaaggttcattcctcctccgaggaatcacatgcatgtccaagactgaaaaggcagctccaccttcatcagaatggcgtggaaatgctcatggaaaatgaaggaccccagtcaggaaccaacaagccaagggaaacctgccagggccctgagtgtcctggcctccacacgtttctcttgtggtcccattcaggctttaactgcctgctttgtgcagagatgctgggacggaaagaggacctcctccaccactggaagcaccagcataactgtgaggacccttccaaactgtgggctattttaaatacggtctccaaccagggagtgatcgaactttccagtgaagctgagaaatgagaccccaaggcagcctggggttaaggagagagctctgccgccaccttccttcagagcttcgtgctttatggtggtgcttagtcacaaagatcaaacaacaggattggtgtgagtgaacagaaatgatttttgtacatggttttattttcttaacgaaataaaatataagctctcgaagcat

SEQ ID NO: 3095 - DNA, 3293 bp, Homo sapiens
agggcggagcctgggggcccagcggcccgcgccccgtggcttgacctccccgactgctgggcccgtgacgtcaccccgctgtgacgcgcacgctgtaggaaaactaattaattaaaaggatttacggtatatcttatgactctacaggagccttgggatatagataaaaatgaatgccatttcccatccagtactgaagtgttaaagttagaagacatttgctaagtcaaatcacttcagaagcagagctcgggaaagaaattgaagaagaaaatgaaactgtcaaatgaaaacaacattggaaggagtacaagagaaaaagatgatacaggaaaaacagtgaggtcatggaaattagacatgagagaggtatgttgaagaaagtacgcacatcttatcttctgaacattttgatggaattaaccacaaacttcatgcaagaacagtaaaaggaaagatactattcaagtccagtacatcataatgcagaattctgtatcagtaccaccaaaagatgaaggtgaatcaaacatcccttctggaacaatacagagtaggaaaggtttgcagaataagagtcagtttaggaccattgcaccaaaaattgtgcccaaagtcctaacgtccagaatgctgccatgtcattcaccatcacgctctgatcaggtgaatctgggaccctccatcaactccaagctgctggggatgtccacccagaactatgccctgatgcaggttgctggccaggaggggacattttctcttgttgctctgccacatgttgcctcagctcagccaattcagaaacccagaatgtccctacctgaaaacctgaaacttcctattcctagatatcaaccccctagaaatagcaaagcatcaagaaagaaacccatcctgatctttcctaagagtggctgtagcaaagctcctgcccaaacccaaatgtgtcctcagatgtccccttccccacctcaccaccctgaactcctgtacaaacccagtccatttgaggaagtaccatcactagagcaagccccagccagcattagcacagctgcgctgaccaatggaagtgaccatggggacttgagaccaccagtgaccaacacccatggcagtctgaaccctcctgctaccccagcatcatccacaccagaggagcctgccaagcaggacctcacagctctttcagggaaagcacactttgtaagcaagataacatctagtaaaccttctgctgttgccagtgaaaaatttaaagaacaagttgatcttgcaaaaaccatgaccaatttatcaccaaccattcttggcaatgcagttcagttgatctcttcagtccccaaagggaaactgccaatcccaccctactcaagaatgaagacaatggaggtttacaaaatcaaatcagatgctaacattgcaggtttttctttaccaggacctaaggccgactgtgataagataccctccaccacagaaggctttaatgcagccaccaaggtggcaagcaggctacctgttccacaagtgtcacagcagagtgcctgtgaaagtgccttttgtccacccaccaaacttgatcttaaccacaaaacaaaactgaacagtggagcagcaaagagaaaaggaagaaaacggaaggtaccagatgaaattttggcatttcagggaaaaaggaggaaatatatcattaataagtgtagagatggtaaagaaagagtaaaaaatgatccccaagaattcagagaccaaaagctggggaccctgaaaaaataccgtagcattatgcccaaacctatcatggtcatacccactttggcctccctggcttctccaactacactacagtcccagatgcttgggggcctaggacaggatgttttgttaaataattcactcactcctaaatatcttggctgtaagcaagacaacagctcttcccctaagcccagctccgtgttcagaaatggattctctggcattaagaagccttggcacagatgtcacgtctgcaaccaccacttccagttcaaacagcaccttcgagaccacatgaatacacacaccaacagacgcccttacagttgtcggatttgtcgcaagtcctatgtacgtcctggcagcctgagcacacacatgaaacttcatcatggtgagaaccgtctgaagaaactcatgtgttgtgagttttgtgcaaaagtgtttggccacatccgagtctattttggccatctgaaagaagtgcatagggttgtgatcagcactgagcctgcgcccagtgaactgcagccaggagacataccaaagaacagagacatgagtgtgcgaggcatggagggatcattggagagggaaaacaagtccaacctggaagaagacttccttctaaaccaggcagacgaagtcaaattacaaatcaaatgtggtcgttgtcagattactgctcagtcttttgcggaaataaaatttcatttacttgatgttcatggagaggaaattgagggcaggctacaagaagggaccttcccaggaagcaaggggactcaggaagagttggtgcagcacgctagccccgactggaaaaggcatcctgagagagggaagccggagaaggttcattcctcctccgaggaatcacatgcatgtccaagactgaaaaggcagctccaccttcatcagaatggcgtggaaatgctcatggaaaatgaaggaccccagtcaggaaccaacaagccaagggaaacctgccagggccctgagtgtcctggcctccacacgtttctcttgtggtcccattcaggctttaactgcctgctttgtgcagagatgctgggacggaaagaggacctcctccaccactggaagcaccagcataactgtgaggacccttccaaactgtgggctattttaaatacggtctccaaccagggagtgatcgaactttccagtgaagctgagaaatgagaccccaaggcagcctggggttaaggagagagctctgccgccaccttccttcagagcttcgtgctttatggtggtgcttagtcacaaagatcaaacaacaggattggtgtgagtgaacagaaatgatttttgtacatggttttattttcttaacgaaataaaatataagctctcgaagcatatttttctaactatatgcagtcttattttaaaatacgtactgattcttaatatcttagactttcagaataaataaaaagatcaaaatttgaagattgaaatttagcagaatataggctgttcttcaaatacagctctcagtg

SEQ ID NO: 3096 - DNA, 3245 bp, Homo sapiens
agggcggagcctgggggcccagcggcccgcgccccgtggcttgacctccccgactgctgggcccgtgacgtcaccccgctgtgacgcgcacgctgtaggaaaactaattaattaaaaggatttacggtatatcttatgactctacaggagccttgggatatagataaaaatgaatgccatttcccatccagtactgaagtgttaaagttagaagacatttgctaagtcaaatcacttcaggaagctcatcctgggagtggaggaacagatgttctgtcattgccacattcttctggacacagactggagaactataggaatgtatgttgaagaaagtacgcacatcttatcttctgaacattttgatggaattaaccacaaacttcatgcaagaacagtaaaaggaaagatactattcaagtccagtacatcataatgcagaattctgtatcagtaccaccaaaagatgaaggtgaatcaaacatcccttctggaacaatacagagtaggaaaggtttgcagaataagagtcagtttaggaccattgcaccaaaaattgtgcccaaagtcctaacgtccagaatgctgccatgtcattcaccatcacgctctgatcaggtgaatctgggaccctccatcaactccaagctgctggggatgtccacccagaactatgccctgatgcaggttgctggccaggaggggacattttctcttgttgctctgccacatgttgcctcagctcagccaattcagaaacccagaatgtccctacctgaaaacctgaaacttcctattcctagatatcaaccccctagaaatagcaaagcatcaagaaagaaacccatcctgatctttcctaagagtggctgtagcaaagctcctgcccaaacccaaatgtgtcctcagatgtccccttccccacctcaccaccctgaactcctgtacaaacccagtccatttgaggaagtaccatcactagagcaagccccagccagcattagcacagctgcgctgaccaatggaagtgaccatggggacttgagaccaccagtgaccaacacccatggcagtctgaaccctcctgctaccccagcatcatccacaccagaggagcctgccaagcaggacctcacagctctttcagggaaagcacactttgtaagcaagataacatctagtaaaccttctgctgttgccagtgaaaaatttaaagaacaagttgatcttgcaaaaaccatgaccaatttatcaccaaccattcttggcaatgcagttcagttgatctcttcagtccccaaagggaaactgccaatcccaccctactcaagaatgaagacaatggaggtttacaaaatcaaatcagatgctaacattgcaggtttttctttaccaggacctaaggccgactgtgataagataccctccaccacagaaggctttaatgcagccaccaaggtggcaagcaggctacctgttccacaagtgtcacagcagagtgcctgtgaaagtgccttttgtccacccaccaaacttgatcttaaccacaaaacaaaactgaacagtggagcagcaaagagaaaaggaagaaaacggaaggtaccagatgaaattttggcatttcagggaaaaaggaggaaatatatcattaataagtgtagagatggtaaagaaagagtaaaaaatgatccccaagaattcagagaccaaaagctggggaccctgaaaaaataccgtagcattatgcccaaacctatcatggtcatacccactttggcctccctggcttctccaactacactacagtcccagatgcttgggggcctaggacaggatgttttgttaaataattcactcactcctaaatatcttggctgtaagcaagacaacagctcttcccctaagcccagctccgtgttcagaaatggattctctggcattaagaagccttggcacagatgtcacgtctgcaaccaccacttccagttcaaacagcaccttcgagaccacatgaatacacacaccaacagacgcccttacagttgtcggatttgtcgcaagtcctatgtacgtcctggcagcctgagcacacacatgaaacttcatcatggtgagaaccgtctgaagaaactcatgtgttgtgagttttgtgcaaaagtgtttggccacatccgagtctattttggccatctgaaagaagtgcatagggttgtgatcagcactgagcctgcgcccagtgaactgcagccaggagacataccaaagaacagagacatgagtgtgcgaggcatggagggatcattggagagggaaaacaagtccaacctggaagaagacttccttctaaaccaggcagacgaagtcaaattacaaatcaaatgtggtcgttgtcagattactgctcagtcttttgcggaaataaaatttcatttacttgatgttcatggagaggaaattgagggcaggctacaagaagggaccttcccaggaagcaaggggactcaggaagagttggtgcagcacgctagccccgactggaaaaggcatcctgagagagggaagccggagaaggttcattcctcctccgaggaatcacatgcatgtccaagactgaaaaggcagctccaccttcatcagaatggcgtggaaatgctcatggaaaatgaaggaccccagtcaggaaccaacaagccaagggaaacctgccagggccctgagtgtcctggcctccacacgtttctcttgtggtcccattcaggctttaactgcctgctttgtgcagagatgctgggacggaaagaggacctcctccaccactggaagcaccagcataactgtgaggacccttccaaactgtgggctattttaaatacggtctccaaccagggagtgatcgaactttccagtgaagctgagaaatgagaccccaaggcagcctggggttaaggagagagctctgccgccaccttccttcagagcttcgtgctttatggtggtgcttagtcacaaagatcaaacaacaggattggtgtgagtgaacagaaatgatttttgtacatggttttattttcttaacgaaataaaatataagctctcgaagcatatttttctaactatatgcagtcttattttaaaatacgtactgattcttaatatcttagactttcagaataaataaaaagatcaaaatttgaagattgaaatttagcagaatataggctgttcttcaaatacagctctcagtg

SEQ ID NO: 3097 - DNA, 2780 bp, Homo sapiens
atggatagtgaatcaaacatcccttctggaacaatacagagtaggaaaggtttgcagaataagagtcagtttaggaccattgcaccaaaaattgtgcccaaagtcctaacgtccagaatgctgccatgtcattcaccatcacgctctgatcaggtgaatctgggaccctccatcaactccaagctgctggggatgtccacccagaactatgccctgatgcaggttgctggccaggaggggacattttctcttgttgctctgccacatgttgcctcagctcagccaattcagaaacccagaatgtccctacctgaaaacctgaaacttcctattcctagatatcaaccccctagaaatagcaaagcatcaagaaagaaacccatcctgatctttcctaagagtggctgtagcaaagctcctgcccaaacccaaatgtgtcctcagatgtccccttccccacctcaccaccctgaactcctgtacaaacccagtccatttgaggaagtaccatcactagagcaagccccagccagcattagcacagctgcgctgaccaatggaagtgaccatggggacttgagaccaccagtgaccaacacccatggcagtctgaaccctcctgctaccccagcatcatccacaccagaggagcctgccaagcaggacctcacagctctttcagggaaagcacactttgtaagcaagataacatctagtaaaccttctgctgttgccagtgaaaaatttaaagaacaagttgatcttgcaaaaaccatgaccaatttatcaccaaccattcttggcaatgcagttcagttgatctcttcagtccccaaagggaaactgccaatcccaccctactcaagaatgaagacaatggaggtttacaaaatcaaatcagatgctaacattgcaggtttttctttaccaggacctaaggccgactgtgataagataccctccaccacagaaggctttaatgcagccaccaaggtggcaagcaggctacctgttccacaagtgtcacagcagagtgcctgtgaaagtgccttttgtccacccaccaaacttgatcttaaccacaaaacaaaactgaacagtggagcagcaaagagaaaaggaagaaaacggaaggtaccagatgaaattttggcatttcagggaaaaaggaggaaatatatcattaataagtgtagagatggtaaagaaagagtaaaaaatgatccccaagaattcagagaccaaaagctggggaccctgaaaaaataccgtagcattatgcccaaacctatcatggtcatacccactttggcctccctggcttctccaactacactacagtcccagatgcttgggggcctaggacaggatgttttgttaaataattcactcactcctaaatatcttggctgtaagcaagacaacagctcttcccctaagcccagctccgtgttcagaaatggattctctggcattaagaagccttggcacagatgtcacgtctgcaaccaccacttccagttcaaacagcaccttcgagaccacatgaatacacacaccaacagacgcccttacagttgtcggatttgtcgcaagtcctatgtacgtcctggcagcctgagcacacacatgaaacttcatcatggtgagaaccgtctgaagaaactcatgtgttgtgagttttgtgcaaaagtgtttggccacatccgagtctattttggccatctgaaagaagtgcatagggttgtgatcagcactgagcctgcgcccagtgaactgcagccaggagacataccaaagaacagagacatgagtgtgcgaggcatggagggatcattggagagggaaaacaagtccaacctggaagaagacttccttctaaaccaggcagacgaagtcaaattacaaatcaaatgtggtcgttgtcagattactgctcagtcttttgcggaaataaaatttcatttacttgatgttcatggagaggaaattgagggcaggctacaagaagggaccttcccaggaagcaaggggactcaggaagagttggtgcagcacgctagccccgactggaaaaggcatcctgagagagggaagccggagaaggttcattcctcctccgaggaatcacatgcatgtccaagactgaaaaggcagctccaccttcatcagaatggcgtggaaatgctcatggaaaatgaaggaccccagtcaggaaccaacaagccaagggaaacctgccagggccctgagtgtcctggcctccacacgtttctcttgtggtcccattcaggctttaactgcctgctttgtgcagagatgctgggacggaaagaggacctcctccaccactggaagcaccagcataactgtgaggacccttccaaactgtgggctattttaaatacggtctccaaccagggagtgatcgaactttccagtgaagctgagaaatgagaccccaaggcagcctggggttaaggagagagctctgccgccaccttccttcagagcttcgtgctttatggtggtgcttagtcacaaagatcaaacaacaggattggtgtgagtgaacagaaatgatttttgtacatggttttattttcttaacgaaataaaatataagctctcgaagcatatttttctaactatatgcagtcttattttaaaatacgtactgattcttaatatcttagactttcagaataaataaaaagatcaaaatttgaagattgaaatttagcagaatataggctgttcttcaaatacagctctcagtg

SEQ ID NO: 3098 - DNA, 3344 bp, Homo sapiens
agggcggagcctgggggcccagcggcccgcgccccgtggcttgacctccccgactgctgggcccgtgacgtcaccccgctgtgacgcgcacgctgtaggaaaactaattaattaaaaggatttacggtatatcttatgactctacaggagccttgggatatagataaaaatgaatgccatttcccatccagtactgaagtgttaaagttagaagacatttgctaagtcaaatcacttcaggaagctcatcctgggagtggaggaacagatgttctgtcattgccacattcttctggacacagactggagaactataggaatgtatgttgaagaaagtacgcacatcttatcttctgaacattttgatggaattaaccacaaacttcatgcaagaacagtaaaaggaaagatactattcaagtccagtacatcataatgcagaattctgtatcagtaccaccaaaagatgaagatccaatcctttgatggcaatggaggaggaggaggacacacgttgcacattctccaaatatccaacagcctttctggatttctcagagtcctatggatagtgaatcaaacatcccttctggaacaatacagagtaggaaaggtttgcagaataagagtcagtttaggaccattgcaccaaaaattgtgcccaaagtcctaacgtccagaatgctgccatgtcattcaccatcacgctctgatcaggtgaatctgggaccctccatcaactccaagctgctggggatgtccacccagaactatgccctgatgcaggttgctggccaggaggggacattttctcttgttgctctgccacatgttgcctcagctcagccaattcagaaacccagaatgtccctacctgaaaacctgaaacttcctattcctagatatcaaccccctagaaatagcaaagcatcaagaaagaaacccatcctgatctttcctaagagtggctgtagcaaagctcctgcccaaacccaaatgtgtcctcagatgtccccttccccacctcaccaccctgaactcctgtacaaacccagtccatttgaggaagtaccatcactagagcaagccccagccagcattagcacagctgcgctgaccaatggaagtgaccatggggacttgagaccaccagtgaccaacacccatggcagtctgaaccctcctgctaccccagcatcatccacaccagaggagcctgccaagcaggacctcacagctctttcagggaaagcacactttgtaagcaagataacatctagtaaaccttctgctgttgccagtgaaaaatttaaagaacaagttgatcttgcaaaaaccatgaccaatttatcaccaaccattcttggcaatgcagttcagttgatctcttcagtccccaaagggaaactgccaatcccaccctactcaagaatgaagacaatggaggtttacaaaatcaaatcagatgctaacattgcaggtttttctttaccaggacctaaggccgactgtgataagataccctccaccacagaaggctttaatgcagccaccaaggtggcaagcaggctacctgttccacaagtgtcacagcagagtgcctgtgaaagtgccttttgtccacccaccaaacttgatcttaaccacaaaacaaaactgaacagtggagcagcaaagagaaaaggaagaaaacggaaggtaccagatgaaattttggcatttcagggaaaaaggaggaaatatatcattaataagtgtagagatggtaaagaaagagtaaaaaatgatccccaagaattcagagaccaaaagctggggaccctgaaaaaataccgtagcattatgcccaaacctatcatggtcatacccactttggcctccctggcttctccaactacactacagtcccagatgcttgggggcctaggacaggatgttttgttaaataattcactcactcctaaatatcttggctgtaagcaagacaacagctcttcccctaagcccagctccgtgttcagaaatggattctctggcattaagaagccttggcacagatgtcacgtctgcaaccaccacttccagttcaaacagcaccttcgagaccacatgaatacacacaccaacagacgcccttacagttgtcggatttgtcgcaagtcctatgtacgtcctggcagcctgagcacacacatgaaacttcatcatggtgagaaccgtctgaagaaactcatgtgttgtgagttttgtgcaaaagtgtttggccacatccgagtctattttggccatctgaaagaagtgcatagggttgtgatcagcactgagcctgcgcccagtgaactgcagccaggagacataccaaagaacagagacatgagtgtgcgaggcatggagggatcattggagagggaaaacaagtccaacctggaagaagacttccttctaaaccaggcagacgaagtcaaattacaaatcaaatgtggtcgttgtcagattactgctcagtcttttgcggaaataaaatttcatttacttgatgttcatggagaggaaattgagggcaggctacaagaagggaccttcccaggaagcaaggggactcaggaagagttggtgcagcacgctagccccgactggaaaaggcatcctgagagagggaagccggagaaggttcattcctcctccgaggaatcacatgcatgtccaagactgaaaaggcagctccaccttcatcagaatggcgtggaaatgctcatggaaaatgaaggaccccagtcaggaaccaacaagccaagggaaacctgccagggccctgagtgtcctggcctccacacgtttctcttgtggtcccattcaggctttaactgcctgctttgtgcagagatgctgggacggaaagaggacctcctccaccactggaagcaccagcataactgtgaggacccttccaaactgtgggctattttaaatacggtctccaaccagggagtgatcgaactttccagtgaagctgagaaatgagaccccaaggcagcctggggttaaggagagagctctgccgccaccttccttcagagcttcgtgctttatggtggtgcttagtcacaaagatcaaacaacaggattggtgtgagtgaacagaaatgatttttgtacatggttttattttcttaacgaaataaaatataagctctcgaagcatatttttctaactatatgcagtcttattttaaaatacgtactgattcttaatatcttagactttcagaataaataaaaagatcaaaatttgaagattgaaatttagcagaatataggctgttcttcaaatacagctctcagtg

SEQ ID NO: 3099 - DNA, 3418 bp, Homo sapiens
attaagctgagaccagaaggctgagtggtggtgacctacaagaagaagaagggaaggtcataacagtaatgacttggagtggagaggccctgcaggttggagaagttcagtgtggctcaccatggagtgtcagagtgagggagatgactgctgagctccgagaggtgaacagagcccctgaattaattaaaaggatttacggtatatcttatgactctacaggagccttgggatatagataaaaatgaatgccatttcccatccagtactgaagtgttaaagttagaagacatttgctaagtcaaatcacttcaggtatgttgaagaaagtacgcacatcttatcttctgaacattttgatggaattaaccacaaacttcatgcaagaacagtaaaaggaaagatactattcaagtccagtacatcataatgcagaattctgtatcagtaccaccaaaagatgaagcaagcaaggagaagcttaggagaaaaaataatggaacaagtatcaggaaagctggactccattccatacctgcctccaaccagctgtggaaccccaggcaaagttattttgcccctgagcctcagttttctcattgaaaaatcgagaatgactaggtgttcctttcaggctctaaaaaggtgaatcaaacatcccttctggaacaatacagagtaggaaaggtttgcagaataagagtcagtttaggaccattgcaccaaaaattgtgcccaaagtcctaacgtccagaatgctgccatgtcattcaccatcacgctctgatcaggtgaatctgggaccctccatcaactccaagctgctggggatgtccacccagaactatgccctgatgcaggttgctggccaggaggggacattttctcttgttgctctgccacatgttgcctcagctcagccaattcagaaacccagaatgtccctacctgaaaacctgaaacttcctattcctagatatcaaccccctagaaatagcaaagcatcaagaaagaaacccatcctgatctttcctaagagtggctgtagcaaagctcctgcccaaacccaaatgtgtcctcagatgtccccttccccacctcaccaccctgaactcctgtacaaacccagtccatttgaggaagtaccatcactagagcaagccccagccagcattagcacagctgcgctgaccaatggaagtgaccatggggacttgagaccaccagtgaccaacacccatggcagtctgaaccctcctgctaccccagcatcatccacaccagaggagcctgccaagcaggacctcacagctctttcagggaaagcacactttgtaagcaagataacatctagtaaaccttctgctgttgccagtgaaaaatttaaagaacaagttgatcttgcaaaaaccatgaccaatttatcaccaaccattcttggcaatgcagttcagttgatctcttcagtccccaaagggaaactgccaatcccaccctactcaagaatgaagacaatggaggtttacaaaatcaaatcagatgctaacattgcaggtttttctttaccaggacctaaggccgactgtgataagataccctccaccacagaaggctttaatgcagccaccaaggtggcaagcaggctacctgttccacaagtgtcacagcagagtgcctgtgaaagtgccttttgtccacccaccaaacttgatcttaaccacaaaacaaaactgaacagtggagcagcaaagagaaaaggaagaaaacggaaggtaccagatgaaattttggcatttcagggaaaaaggaggaaatatatcattaataagtgtagagatggtaaagaaagagtaaaaaatgatccccaagaattcagagaccaaaagctggggaccctgaaaaaataccgtagcattatgcccaaacctatcatggtcatacccactttggcctccctggcttctccaactacactacagtcccagatgcttgggggcctaggacaggatgttttgttaaataattcactcactcctaaatatcttggctgtaagcaagacaacagctcttcccctaagcccagctccgtgttcagaaatggattctctggcattaagaagccttggcacagatgtcacgtctgcaaccaccacttccagttcaaacagcaccttcgagaccacatgaatacacacaccaacagacgcccttacagttgtcggatttgtcgcaagtcctatgtacgtcctggcagcctgagcacacacatgaaacttcatcatggtgagaaccgtctgaagaaactcatgtgttgtgagttttgtgcaaaagtgtttggccacatccgagtctattttggccatctgaaagaagtgcatagggttgtgatcagcactgagcctgcgcccagtgaactgcagccaggagacataccaaagaacagagacatgagtgtgcgaggcatggagggatcattggagagggaaaacaagtccaacctggaagaagacttccttctaaaccaggcagacgaagtcaaattacaaatcaaatgtggtcgttgtcagattactgctcagtcttttgcggaaataaaatttcatttacttgatgttcatggagaggaaattgagggcaggctacaagaagggaccttcccaggaagcaaggggactcaggaagagttggtgcagcacgctagccccgactggaaaaggcatcctgagagagggaagccggagaaggttcattcctcctccgaggaatcacatgcatgtccaagactgaaaaggcagctccaccttcatcagaatggcgtggaaatgctcatggaaaatgaaggaccccagtcaggaaccaacaagccaagggaaacctgccagggccctgagtgtcctggcctccacacgtttctcttgtggtcccattcaggctttaactgcctgctttgtgcagagatgctgggacggaaagaggacctcctccaccactggaagcaccagcataactgtgaggacccttccaaactgtgggctattttaaatacggtctccaaccagggagtgatcgaactttccagtgaagctgagaaatgagaccccaaggcagcctggggttaaggagagagctctgccgccaccttccttcagagcttcgtgctttatggtggtgcttagtcacaaagatcaaacaacaggattggtgtgagtgaacagaaatgatttttgtacatggttttattttcttaacgaaataaaatataagctctcgaagcatatttttctaactatatgcagtcttattttaaaatacgtactgattcttaatatcttagactttcagaataaataaaaagatcaaaatttgaagattgaaatttagcagaatataggctgttcttcaaatacagctctcagtg

SEQ ID NO: 3100 - DNA, 2622 bp, Homo sapiens
gtgagccgagattgcaccattgtactccagcctgggcaataagagtgaaattctgtctcaaaaaaataaaaaaaaaaattgctttatggaagaaagtaagtatagacagagagaaagggatctgatgaccaaagcagggaataaatgtttggagtccacggcatcctgagaacttcttgggaatagagtctaggcccccaatgctgtcactctcacccatcctcctctacacatgtgagatgtttcaggacccagtggcttttaaggatgtggctgtgaacttcacccaggaggagtgggctttgctggatatttcccagaagaatctctacagggaagtgatgctggaaactttctggaacctgacctctataggaaaaaagtggaaagaccagaacattgaatatgagtaccaaaaccccaggagaaacttcaggagtgtcacagaagagaaagtcaatgaaattaaagaagacagtcattgtggagaaacttttaccccagttccagatgacaggctgaacttccagaagaagaaagcttctcctgaagtaaaatcatgtgacagctttgtgtgtgaagttggcctaggtaactcatcttctaatatgaacatcagaggtgacactggacacaaggcatgtgaatgtcaggaatatggaccaaagccatggaagagtcaacaacctaaaaaagccttcagatatcacccctccttgagaacacaagaaagggatcacactggaaagaaaccctatgcttgtaaagaatgtggaaaaaacattatttaccattcaagcattcaaagacacatggtagtgcacagtggggatggaccttataaatgtaagttttgtgggaaagcattccattgtctcagtttatatcttatccatgaaagaactcacactggagagaaaccgtatgaatgtaaacaatgtggtaaatcttttagttattctgctacccatcgaatacatgaaagaactcacattggagaaaagccttatgaatgtcaggaatgtgggaaagcattccatagtcccagatcctgtcacagacatgaaaggagtcacatgggagagaaggcttatcaatgtaaggaatgtggaaaagcattcatgtgtccccgttatgttcgtagacatgaaaggacccactctaggaaaaaactttatgaatgtaagcagtgtgggaaagcattatcctctcttacaagttttcaaacacacataagaatgcactctggagaaagaccttatgaatgtaagacatgtgggaaaggcttttattctgccaagtcatttcaaagacatgaaaaaactcacagtggagagaaaccgtataaatgcaagcaatgtggtaaagccttcactcgttccggttcctttcgatatcatgaaaggactcacactggagagaaaccctatgagtgtaagcaatgtgggaaagccttcagatctgccccaaatcttcaattgcatggtaggactcacactggagagaaaccgtatcaatgtaaggaatgtgggaaagctttcagatctgcctcacaacttcgaatccatcgtaggattcacactggagagaaaccctatgaatgtaagaaatgtgggaaagccttcagatatgtccagaactttcgatttcatgaaaggacacaaacacataagaatgcactctggagaaagaccttataaatataagatatatgggaaacacttttattctgccaagttatttcaaacacatgaaaaaattcacactggagagaaaccctataaatgcaagcaatgtggtaaagccttaattgttccagttcctttcgatatctaaaaggactcacagtggagaaaaactctatgagtgtaagcaatgtgggaaagtcttcagatctgtcaagaacctttcaatttatgaaaggacacacactggagagaaaccctatgaatgtaagaaatgtggaaaagcgttccataatttctcttcttttcaaatacatgaaagttgcacagaggagaggcgccctaagaatgtaagcattgtgggaaagcattcatatctgccaagatcgtttgaatacatgcaaaacacacactggagagaaacctatgaatgtaaggaatgcaaacaagcattcaattatttttcttccttgcatatacatgaaaggactcatacgagagagaatccgtatgaatgtaaggattgtgggaaagcattcagcttgcttaattgctttcatagacatgtaaagacacaccagaaggaaaccctatgaatgtaagcaatgtggcaaaagctttcacttcttccagttcttttcaatatcatgaaaggactcacactggggagaaaccgtatcaatgtaagcaatgtgggaaagccgtcagatcagcctcaagacttcaaatgcatggaagcactcacacttggcagaaactctatgaatgtaagcagtatgggaaagccttcagatcggctaggattctttgaatacaaataatgaatgtaaacaattaactgtttataataactgtatactaacaaatgttattctttttaaataattaagaagctataataaaatatccattggtgtcatgtattagatcaagctta

SEQ ID NO: 3101 - DNA, 4189 bp, Homo sapiens
attcctttagtgctgcgccgacagcggtcaggatctcggctttcttgcttcgagagggactaggtgcctccaccagagcttctgtcgctctgtaacctgcactgtgacctacactagtcgcgggagccacgcagaggacgccggaacaccctggaagccgagaaatggacccagtggcttttaaggatgtggctgtgaacttcacccaggaggagtgggctttgctggatatttcccagaggaaactctacagggaagtgatgctggaaactttcaggaacctgacctctttaggaaaaaggtggaaagaccagaacattgaatatgagcaccaaaaccccaggagaaacttcaggagtctcatagaagaaaaagtcaatgaaattaaagatgacagtcattgtggagaaacttttaccccagttccagatgacagactgaacttccaggagaagaaagcttctcctgaagtaaaatcatgtgaaagctttgtgtgtggagaagttggcctaggtaactcatcttttaatatgaacatcagaggtgacattggacacaaggcatatgagtatcaggaatatggaccaaagccatgtaagtgtcaacaacctaaaaaagccttcagataccgcccctcctttagaacacaagaaagggatcacactggagagaaacccaatgcttgtaaagtatgtggaaaaacctttatttcccattcaagtgttcgaagacacatggtaatgcacagtggggatggaccttataaatgtaagttttgtgggaaagcattccattgtctcagattatatcttatccatgaaagaattcacactggagagaaaccatgtgaatgtaaacagtgtggtaaatcctttagttattctgctacccatcgaatacataaaagaactcacactggagaaaagccttatgaatatcaggagtgtgggaaagcatttcatagtcccagatcctatcgtagacatgaaaggattcacatgggagaaaaggcttatcaatgtaaggaatgtggaaaagcattcacgtgtccccgttatgttcgtatacatgaaaggacccactctaggaaaaatctctatgaatgtaagcagtgtgggaaagcattatcctctcttacaagttttcaaacacacgtaagattgcactctggagaaagaccttatgaatgtaagatatgtggaaaagacttttgttctgtgaattcatttcaaagacatgaaaaaattcacagtggagagaaaccctataaatgtaagcagtgtggtaaagccttccctcattccagttcccttcgatatcatgaaaggactcacactggagagaaaccctatgagtgtaagcaatgtgggaaagccttcagatctgcctcacaccttcgagtgcatggtaggactcacactggagagaaaccgtatgaatgtaaggaatgtgggaaagccttcagatatgtgaataaccttcaaagtcatgaaaggacacaaacacacataagaatacactctggagaaagacgttataaatgtaagatatgtgggaaaggcttttattgtcccaaatcatttcaaagacatgaaaaaactcacactggagagaaactctatgaatgcaagcaacgttcagtagttccttcagtagttccagttccttttgatatcatgaaaggactcacactggagagaagccctataaatgcgagcaatgtgggaaagccttcagagctgtgtcaatcctttgaatgcatggtaggactcaccctgaagagaaaccctatgagtgtgagcaatgacggaaagccttcagatctgccccacacctttgaatacgtggtaggacacacaatggagagaagccctatgcatgtaaggaatgtgggaaacccttcggatctgcccagaaccttcgaattcatgaaaggacacaaacacacataatgcactctgtagagagaccttataaatgtaagatatgtgggaggggcttttattctgccaagtcatttcaaatacatgaaaaatcttacactggagagaaaccctatgagtgtaagcaatgtgggaaagcctttgtttccttcacttcctttcgatatcatgaaaggactcacactggagagaacccctatgagtgtaagcaatttgggaaagccttcagatctgtcaaaaatcttcgatttcataaaaggacacacactggagagaaaccctgtgaatgtaagaaatgtagaaaagcattccataatttctcttctttgcaaatacatgaaaggatgcacagaggagagaagctctgtgaatgtaagcattgtgggaaagcattcatatctgccaagatcctttgaatacatgcaagaacacacaatggagagaaaccctatgaatgtaaagaatgcagaaaagcattcagcttgcctacttcctttcatagacatgaaaagactcacactggaaggaaacactatgaatgcaagcaatgtggcaaagctttcacttcttccagttcttttcaatatcatgaaagaacacactagggagaaaccctatcaatgtaagcaatgtgcaaaagcctttatttcttccacttcttttcaatatcatgaaaggactcacatgggagagaaaccctatgagtgtatgccaagtgggaaagccttcatttcttctagttcccttcaatatcatgaaaggactcacactggagagaagccctatgaatataagcaatgtgggaaagccttcagatcagcctcgcaccttcaaatgcatggaaggactcacactggagaaaaaccctatgaatgtaagcagtatgggaaagcgttcagacctgacaagattctttgaatacagataatgaatgtaaacaattaactgtttataataactgtatactaacaaatgatattctttttaaataagaagctataatatcccattggtgtcatgtattagatcagccttatactgttaaattgttattatttggacattgtgagtcagtataaccatgtggataaaatgccagacatctttttattcgaaaattttacttttcatgcttctgtacttacatttttatctcaaccttaatttttctttctttttttttttcccccagaaagaatctcactctgtcacccaggctggagtgcagtggcatgatctcaggtcactgcaacctctgcctccagggttcaagcaattctcctgcctcagtctcctgagtagctgggactacaggcatgcgccaccatgccaggctaattttttgtattttttagtagagacggggtttcaccatattggctaggctggtctcaaactccagacctcatgatttacccacctcggcctcccaaaatgctgggattacagacatgaaccatcatgcccagctgcaaccctaatttttcattcagtcataataccaatagttatctcatgcacctctgagtgccttcttccccaaaaccagcagtgccatacctgctgtcagcaagggtgtaatataccatagtgataaatatgaccaaaagccataaatgactgtgagatgtatgagaattacaagtcacattagtaagaagagaaaaattttggtcatgtttatgatttgaaatacgttttcctctatcacatttaaaaatatagttacaaaatgcccttgtttttgtcctgattcatcatggtcactgaggagcatcgtctcatatgcctggtatgtgacacgtgtctctccaacaataaaagacttggccttggctgggcatggtggctcacgcctgtaatcccagcactttgggaggccgaggtcaggagttagagaccattctgaccaatatgatcaaaccccgtctctactaaaaatacaaaagttagcagggcgtggtggcatgctcctgtaatcctagctattcaggaggctgacataggagaattgcttgaatataggaagcagaggttgcagtgagccgaggttgcaccattgtactccagcctgggcaacaagagtgaaactctgtcttaaaaaacacaaaaaaagacttggccttagggccgagtgcggtggctcacgcctataatcccagcactttgggaggccgaggcgggcggatcactaggtcaggaaatggagaccatcctggccaacacagtgaaacccagtctctact

SEQ ID NO: 3102 - DNA, 4356 bp, Homo sapiens
actgagagacgccctggaacgtctgtggcagcttctgtctcgctgggacccgcactgacagcgggaggcagagggaggaacctggacgccggaagccgggaaatggactcagtggcatttgaggatgtggctataaacttcacctgtgaggagtgggctttgctgggtccatcacagaagagtctctacagagatgtgatgcaggaaaccatcagaaacctggactgtataggaatgatatggcaaaatcatgatatagaagaagatcagtacaaagatctcagaagaaatctaagatgtcatatggtagagagagcctgtgaaattaaagataatagtcaatgtggaggaccctttacccagactcaagacagtattgtgaacgagaaaatacctggagtagatccatgggaaagcagtgagtgtacagacgtcctcatgggtcgttcatctcttaattgctacgttagagttgacagtgaacacaaaccatgtgagtatcaagaatatggagagaagccatatacacatacacaatgtgggacagctttcagttatcagccctgctttcaaatacatgaaagacctcagcatggaaagaaactctatgattgtaaggaatgtgcaagcttcagttctcttgaaaaccttcaaagacacatggcagcacaccatggagatggacctcgtatatgtaagttgtgtggaaacgcctttatttggcctagtttatttcatatgcttagaagaactcacactgaagagaaaccatatgaatatgagcagtgttctacagcgtttcctgcttatagttccactctaagacatgaaagaacacacagtggagagaaaccctatcaatgtaaacaatgtgggaaagccttcagttgttcctgttacactcaactatatgaaaggactcacactggagaacaatcctatgaatgtaagcaatgtgggaaagcattttatcatcttggaagctttcaaagacacatgatagtgcacactggagatgggcctcataaatgtaagatatgtggaaaaggctttctttctcccagttcagttcgaagacataaaagaactcacactggagagaaaccgtatgaatgtaagtattgtgggaaagcattctctgattgcacaggttttcgaagacacatgataacgcacactggagatggacctcataaatgcaaggtatgtgggaaagcctttgattctcccagtttatgtcgaaggcatgaaacaactcatactggggagaaaccctataaatgtgaatgtgggaaagcctttagtgatttctattactttcgaaatcatgaaactactcacactggagagaagccatataaatgtaaacaatgtggaaaagccttcatttgttgcacttaccttcaaatacatgaaagaattcacactggggagagaccctataaatgtaaacaatgcggaaaagccttcaggtcttccaattacattcgagtacatgaaaagactcacactggagaaaagccctatgaatgtaagcagtgtggaaaagcactttctcatctgaaaagctttcagagacacatgataatgcacactggagatggacctcataaatgtaagatatgtgggaaaagctttgattctcccagttcatttcgaagacatgaaagaattcacactggggagagaccctataagtgtaaactatgtgggaaaggcttcaggtcttccagttacattcaactacatgaaaggactcacactggagagaaaccctatggttgtcagcaatgtgggaaagcattatctgatctctcaagctttcgaagacacatgataacacatactggaaatggacctcataaatgtaagatatgtgggaaaggctttgattatcccagttcagtgcaaagacatgaaagaactcacactggagagaaaccctatgaatgcaaggaatgtggtaaagccttcagtcattcaagttacttacgaatacacgaaagagttcatactggagagaagccgtataaatgtaaggaatgtgggaaaccattccattgtcccagtgcctttcataaacatgaaaggacccacagtatggagaaaccctataagtgtaaagaatgtggggaagcatttcattgtatcagttcctttcataaacatgaaatgactcactagagaaaacccctatgagtgttgaacatgtgagaaagccttaagtactttcagcttcttacaaatacataagagactcacactgaaaaaagttgtatgaatataaaaatgtactaaaaccttccatttttttcagtaccttttgaaaacatgaccaaactcatacttcaaaaatatatatataatgaatgtgaggaatatgaaaaaactttctttgtctagcaaactttcaaaggtggttattataacatactagcaatggaccttactactgtaaggaatgtagaaatgcatttactagtcctaattcatttcagttacatgaaagatttcaaactgcagagaaccactatgaatgtaaacaatgtggtaaagcatttagtagcttcagtttcttttgaatacagtcttctctagtttctgaggtgaattgattccagcaccctcaggaatacctatattcagagatattcaagtccctgatattaaaaacagcatatttgcatataatctaggcacatttttctgtatatcttaaatcatttctagattacttataatacacaatgcattgtaaattctgtataagttgcttttgtattatttagggaatcatgacaagaaaaaagtctacatgttcagtacaaatacaactgtcattcattgtcctaagtacgtgtacatgtcagcaacaatgtcaggatctgtggagtttgcgagtataagatctttaagtgttgaaggtttcatctccataattgcagctgctttagctacaaatattataggaagctgttccttctttttctttacatcaccaaaccttccagtggttataggcattttgttatccttcaagtgacctggagcctttgttgcatgacaggattgtacctgaagatcacattctttaacaattggacctactgaatctgtaaaactactagaagaaaacatattgaaaatacttcaggacattggtttaggcaaagattttatggctaatacctcaaagcacagacaacaaagataaaaatagacaaatgagactatcttacactaaaaagtagctgtgcaaagtaaagggaacaacaagagtgcagagaaaacctgttgaatatgagagaatatttgcaaactatgcgacaagggactaatatccaaatatacaaggaactcaaacatctcaacagcaaaaaatataaataatcccattaaagtgggaaaaggatgtgaacagacagttctcaaaagaagacatgcaaatggccaaaaagtatatggaaatatgttcaacatcactaatgattaggaaaatgcaaattgaaaccacaatgagatactctacttagaattgttcttactaaaaaagataaaaaacaacaaatgctgatgaggatgtggagaaaagaaaactttcactgttggtgaaagtataaattagaacaactactgtggaaaacagtatgtagatttctcaaaaacctaaaaatagaaccaccacatgatccagcaaaccaagtataaccacaggaaaagaaatcagtatatcaaagagatacttgcacttgcatatttatcacagcactattcatgataacaaagatatggaattaacctaagcatccatcagtggacacagggataaagaaaatgtttatgtacacagtggaatactatttggccataaaaaagagtaaaatgttattgctaacaacatggatggaacttgaggtcattatggtaagtgaaataagccaggcacagaaagacaaataccacatgttctcacttatatgtgggaggtgaaaaacttcacctcatggagatagggaatagaataagttatccggggctgagaaggggaaatgaagagaaattggtgaatatgtacaaatttccatttagatcaaaggaataagttctgatgttagaaagcatactagagtgaactatagttagcaaaaatatattgcatatttcaaagtagttggaagagaggacttgaaatgttaccaacacatagaagtggtaaatactcaagatcatggataccccaaatacgctgacttgaccattacacattctatgcatgcaagaaatgctcatgtgtaccttatatatatgtaaaatatgtatcaataaaagaaaatatataagatagttttaaaataa

SEQ ID NO: 3103 - DNA, 2828 bp, Homo sapiens
actgagagacgccctggaacgtctgtggcagcttctgtctcgctgggacccgcactgacagcgggaggcagagggaggaacctggacgccggaagccgggaaatggactcagtggcatttgaggatgtggctataaacttcacctgtgaggagtgggctttgctgggtccatcacagaagagtctctacagagatgtgatgcaggaaaccatcagaaacctggactgtatagactgaataagaggaggggttggtcttgctgtctcaagagtagcagagactgaagaaattcatatgaatgatatggcaaaatcatgatatagaagaagatcagtacaaagatctcagaagaaatctaagatgtcatatggtagagagagcctgtgaaattaaagataatagtcaatgtggaggaccctttacccagactcaagacagtattgtgaacgagaaaatacctggagtagatccatgggaaagcagtgagtgtacagacgtcctcatgggtcgttcatctcttaattgctacgttagagttgacagtgaacacaaaccatgtgagtatcaagaatatggagagaagccatatacacatacacaatgtgggacagctttcagttatcagccctgctttcaaatacatgaaagacctcagcatggaaagaaactctatgattgtaaggaatgtgcaagcttcagttctcttgaaaaccttcaaagacacatggcagcacaccatggagatggacctcgtatatgtaagttgtgtggaaacgcctttatttggcctagtttatttcatatgcttagaagaactcacactgaagagaaaccatatgaatatgagcagtgttctacagcgtttcctgcttatagttccactctaagacatgaaagaacacacagtggagagaaaccctatcaatgtaaacaatgtgggaaagccttcagttgttcctgttacactcaactatatgaaaggactcacactggagaacaatcctatgaatgtaagcaatgtgggaaagcattttatcatcttggaagctttcaaagacacatgatagtgcacactggagatgggcctcataaatgtaagatatgtggaaaaggctttctttctcccagttcagttcgaagacataaaagaactcacactggagagaaaccgtatgaatgtaagtattgtgggaaagcattctctgattgcacaggttttcgaagacacatgataacgcacactggagatggacctcataaatgcaaggtatgtgggaaagcctttgattctcccagtttatgtcgaaggcatgaaacaactcatactggggagaaaccctataaatgtgaatgtgggaaagcctttagtgatttctattactttcgaaatcatgaaactactcacactggagagaagccatataaatgtaaacaatgtggaaaagccttcatttgttgcacttaccttcaaatacatgaaagaattcacactggggagagaccctataaatgtaaacaatgcggaaaagccttcaggtcttccaattacattcgagtacatgaaaagactcacactggagaaaagccctatgaatgtaagcagtgtggaaaagcactttctcatctgaaaagctttcagagacacatgataatgcacactggagatggacctcataaatgtaagatatgtgggaaaagctttgattctcccagttcatttcgaagacatgaaagaattcacactggggagagaccctataagtgtaaactatgtgggaaaggcttcaggtcttccagttacattcaactacatgaaaggactcacactggagagaaaccctatggttgtcagcaatgtgggaaagcattatctgatctctcaagctttcgaagacacatgataacacatactggaaatggacctcataaatgtaagatatgtgggaaaggctttgattatcccagttcagtgcaaagacatgaaagaactcacactggagagaaaccctatgaatgcaaggaatgtggtaaagccttcagtcattcaagttacttacgaatacacgaaagagttcatactggagagaagccgtataaatgtaaggaatgtgggaaaccattccattgtcccagtgcctttcataaacatgaaaggacccacagtatggagaaaccctataagtgtaaagaatgtggggaagcatttcattgtatcagttcctttcataaacatgaaatgactcactagagaaaacccctatgagtgttgaacatgtgagaaagccttaagtactttcagcttcttacaaatacataagagactcacactgaaaaaagttgtatgaatataaaaatgtactaaaaccttccatttttttcagtaccttttgaaaacatgaccaaactcatacttcaaaaatatatatataatgaatgtgaggaatatgaaaaaactttctttgtctagcaaactttcaaaggtggttattataacatactagcaatggaccttactactgtaaggaatgtagaaatgcatttactagtcctaattcatttcagttacatgaaagatttcaaactgcagagaaccactatgaatgtaaacaatgtggtaaagcatttagtagcttcagtttcttttgaatacagtcttctctagtttctgaggtgaattgattccagcaccctcaggaatacctatattcagagatattcaagtccctgatattaaaaacagcatatttgcatataatctaggcacatttttctgtatatcttaaatcatttctagattacttataatacacaatgcattgtaaattctg

SEQ ID NO: 3104 - DNA, 2797 bp, Homo sapiens
gaagccctggcaggtcagtggcaggcactgtcacgctgagtcctatgctggcagcggggaaccttggggagaacacgggacaccgcggaagccgggaaatgattgtgcggctgtaaccggcacaggttcgcggtccgagtcactgcaccgagactccaaggcctgcagcagaaacagtttaatagggggagaggagagaagaccccagttccgcctccatgagaggtttggggatgggggtgtttaggggtctggacaggggcggctgaagtgtggggtcgctggttggtggggaagtgacaggcgaatcctgggacgggaggtgaagaaaccgcattctcctgctgagtgggttccctcgtggggttttcaccctgcttggcgccagcctttccgttggaattcaagatctgagaaagaacttgggcaactcgagcagctctccgagatcttatccccaggcacaatgcagaagccggcggtcagtgtcttctgtgacctgactctcaggaaggcggcccccgcgaggcagtggggctcaggtttccattccttggggacacacggctggtcagccagttgaatgattgtatttgggggagaagacagaagtgatctcttccttcctgactctcagactaatgaagagagaaaacaatatgattcagtagcctttgaggatgtggcggtgaacttcacccaggaagagtgggctttgctgggtccatcacagaagagtctgtacagagatgtgatgtgggaaaccattaggaacctggactgtataggaatgaaatgggaagacacaaacattgaagatcagcacagaaatcccaggaggagcctaagatgtcatatcatagagagatttagtgaaagtcgccagccagatagtactgtgaatgaaaaacctcctggagtagatccatgtaaaagcagtgtgtgtggagaaatcatgggttgttcattccttaattgctatatcacatttgatgctggacacaaaccagatgagtgtcaggaatatggagagaagccacatacacataaacaatgtgggacagccttcaattatcaccactcctttcaaacacaggaaagacctcacactggaaagaaacgctatgattgtaaggaatgtgggaaaaccttcagttcttcgggaaaccttcgaagacacataatagtacaacgtggaggtggaccttatatatgtaagttgtgtgggaaagcctttttttggcctagtttatttcgtatgcatgaaagaactcacactggagagaaaccgtatgaatgtaagcagtgttgtaaagccttccctatttacagttcctatctaagacatgaaagaacacacactggggagaaaccatatgaatgcaagcactgttccaaagccttccctgattacagttcctatgtaagacatgaaagaactcacactggagaaaaaccctataaatgtaaacgatgtggaagagccttcagtgtttccagttcccttcgaatacatgaaagaactcacactggagagaaaccctatgaatgcaagcaatgcgggaaagcatttcatcatctgggaagctttcaaagacacatgataaggcacactggagatggacctcataaatgtaagatatgtgggaaaggctttgattgtcctagttcactgcaaagtcatgaaagaactcacactggagagaaaccctatgaatgcaagcagtgtgggaaagcgttatctcatcactcaagctttcgaagtcatatgataatgcacactggagatggacctcacaaatgcaaggtatgtgggaaagccttcatttatcccagtgtatttcaaggacatgaaaggactcatactggtgagaaaccctatgaatgtaaagaatgtggtaaagccttccgtatttctagttcccttcgaagacatgaaacaactcacactggagagaaaccctataaatgtaaatgtgggaaagcctttattgatttctattcctttcaaaatcatgaaacaactcacactggagagaagccatatgagtgtaaggaatgtgggaaagcattcagttgtttcacatacctttctcaacatagaaggactcacatggctgaaaaaccttatgaatgtaaaacatgtaagaaagccttcagtcattttggtaacttaaaagtccatgaaaggattcacactggagagaagccatatgaatgtaaggaatgcaggaaagcattctcttggctcacttgccttctgcgacatgaaagaattcacactggaaagaaatcttatgaatgtcaacaatgtggtaaagccttcactcgttctcgtttccttcgaggacatgaaaaaactcacactggagagaagatgcatgaatgtaaggaatgtgggaaggcactgagttctctcagttccttgcatagacataaaaggactcactggagagatactctataaatgtggaaaagcattcattaattttatttcatttcagaaacgtgaaagaaatcacataggagataagcctcatgaatgcaaacacatggtaaagccttaagatgtttcttttgaatatggttatcccctaaccatatgcaggggattggttccagaccccctaagcatacctaaatccacagatgctgtgttccttttataaaaggacatttgcatgtaacctatccacatcctcctgcatcccataaatcatgcctagattacttaatttttcaccaacccaaagcttttgtaaaagtaaaaataaaaagtaggttactaaaatacctc

SEQ ID NO: 3105 - DNA, 1906 bp, Homo sapiens
agctgagagaagccctggcaggtcagtggcaggcactgtcacgctgagtcctatgctggcagcggggaaccttggggagaacacgggacaccgcggaagccgggaaatggaatgaaatgggaagacacaaacattgaagatcagcacagaaatcccaggaggagcctaagatgtcatatcatagagagatttagtgaaagtcgccagccagatagtactgtgaatgaaaaacctcctggagtagatccatgtaaaagcagtgtgtgtggagaaatcatgggttgttcattccttaattgctatatcacatttgatgctggacacaaaccagatgagtgtcaggaatatggagagaagccacatacacataaacaatgtgggacagccttcaattatcaccactcctttcaaacacaggaaagacctcacactggaaagaaacgctatgattgtaaggaatgtgggaaaaccttcagttcttcgggaaaccttcgaagacacataatagtacaacgtggaggtggaccttatatatgtaagttgtgtgggaaagcctttttttggcctagtttatttcgtatgcatgaaagaactcacactggagagaaaccgtatgaatgtaagcagtgttgtaaagccttccctatttacagttcctatctaagacatgaaagaacacacactggggagaaaccatatgaatgcaagcactgttccaaagccttccctgattacagttcctatgtaagacatgaaagaactcacactggagaaaaaccctataaatgtaaacgatgtggaagagccttcagtgtttccagttcccttcgaatacatgaaagaactcacactggagagaaaccctatgaatgcaagcaatgcgggaaagcatttcatcatctgggaagctttcaaagacacatgataaggcacactggagatggacctcataaatgtaagatatgtgggaaaggctttgattgtcctagttcactgcaaagtcatgaaagaactcacactggagagaaaccctatgaatgcaagcagtgtgggaaagcgttatctcatcactcaagctttcgaagtcatatgataatgcacactggagatggacctcacaaatgcaaggtatgtgggaaagccttcatttatcccagtgtatttcaaggacatgaaaggactcatactggtgagaaaccctatgaatgtaaagaatgtggtaaagccttccgtatttctagttcccttcgaagacatgaaacaactcacactggagagaaaccctataaatgtaaatgtgggaaagcctttattgatttctattcctttcaaaatcatgaaacaactcacactggagagaagccatatgagtgtaaggaatgtgggaaagcattcagttgtttcacatacctttctcaacatagaaggactcacatggctgaaaaaccttatgaatgtaaaacatgtaagaaagccttcagtcattttggtaacttaaaagtccatgaaaggattcacactggagagaagccatatgaatgtaaggaatgcaggaaagcattctcttggctcacttgccttctgcgacatgaaagaattcacactggaaagaaatcttatgaatgtcaacaatgtggtaaagccttcactcgttctcgtttccttcgaggacatgaaaaaactcacactggagagaagatgcatgaatgtaaggaatgtgggaaggcactgagttctctcagttccttgcatagacataaaaggactcactggagagatactctataaatgtggaaaagcattcattaattttatttcatttcagaaacgtgaaagaaatcacataggagataagcctcatgaatgcaaacacatggtaaagccttaagatgtttcttttgaatat

SEQ ID NO: 3106 - DNA, 2663 bp, Homo sapiens
aactgtcaatcaggcactgcccagagaagtgtgtgtggttgaaaaagcccgcggcgtctgctccacccacctgcgctcggctctgggttctgtagctgagagacgacctggaagttctgaggcagcctttgtctggctggaacacgcattggcagcgggagctgtcggtaggacctgggacaccgcggaagtcgggaaatggcctcagtggctttagaggatgtggctgtgaacttcacccgagaagagtgggctttgctgggtccttgtcagaagaatctctacaaagatgtgatgcaggaaaccatcaggaacctggattgtgtagtaatgaaatggaaagaccagaacattgaagatcaatatagatatcccaggaaaaatctaagatgtcgtatgttagagagatttgttgaaagtaaagatggaactcaatgtggagaaacatctagccagattcaagatagtattgtgaccaagaacactcttcctggagtaggtccttgtgaaagcagtatgagaggagaaaaagtcatgggtcattcatcccttaattgttacatcagagttggtgctgggcacaaaccacatgagtatcatgaatgtggagagaagccagatacgcataaacaacgtgggaaagccttcagttaccacaactcatttcaaacacatgagaggcttcacactggaaagaaaccatatgattgtaaagaatgtgggaagtccttcagttctttgggaaaccttcaaagacacatggcagtgcagcgtggagatggaccttataaatgtaagttgtgtgggaaagcgtttttttggcccagtttattacatatgcatgaaagaacgcacactggagagaaaccatatgaatgtaagcagtgttctaaagccttttctttttacagttcctatctaagacatgaaagaacacatactggggagaaaccgtatgaatgtaaacagtgttctaaagcctttcctttttacagttcctatctaagacatgaaagaacacatactggggagaaaccatataaatgtaagcagtgttctaaagccttccctgattccagttcttgtctaatacatgaaagaactcacactggagagaaaccctatacatgtaaacaatgtgggaaagccttcagtgtttccggttcccttcaaagacatgaaaccactcacagtgcagagaaaccctatgcatgtcagcaatgtgggaaagcgtttcatcatctgggaagctttcaaagacacatgataaggcacactggaaatggacctcataaatgtaagatatgtgggaaaggctttgattgtcctagttcactgcaaagtcatgaaagaactcacactggagagaaaccctatgaatgcaagcagtgtgggaaagcattatctcatcgctcaagctttcgaagtcatatgataatgcacactggagatggacctcataaatgcaaggtatgtgggaaagcctttgtttatcccagtgtatttcaaagacatgaaaggactcacactgcagagaaaccctataaatgtaaacaatgtggcaaagcctaccgtatttccagttcccttcgaaggcatgaaacaactcatactggagagaaaccctataaatgcaaacttgggaaagcctgtattgatttctgttcctttcaaaatcacaaaacaactcacactggagagaagccatatgagtgtaaggaatgtgggaaagcattcagtcgtttcagatacctttctcgacataaaaggactcacacaggagagaaaccttatgagtgtaaaacatgtaggaaagccttcggtcattatgataacttaaaggtacatgaaagaattcactctggagagaagccgtatgaatgtaaggaatgtgggaaagcattctcttggctcacttgctttctacgacatgaaagaattcacatgagagagaaatcctatgaatgtccacaatgtggtaaagccttcactcattcccgttttcttcaaggacatgaaaaaactcatactggagagaacccgtatgaatgtaaggaatgtgggaaagcatttgcttctctcagttccttgcatagacataaaaagactcactggaaaaaaactcacactggagagaacccatatgaatgtaaggaatgtgggaaagcatttgcttctctcagttccttgcatagacataaaaagactcactagcattctctctaaatgtatggaatgtgggaaagcatttattaattttatttcatttcagatacttgtacgaaacacattggagatagaccctgtgaatgtaagcacttggtaaagccttaagtagtttcagtttctttccagtacagtcatcccttgatacctgctgggtattggttccagcactccgtgagccatgtccagtcccttttataaaatgacatgtttgtatgtaacttacccacatcctcttgtatagtctcaattatgtctagattacttaaaatacctcatgcattataaaagctatgcaaatagttgttctattgtattgtttagggaatcatgataaggaaaagagtctatgtattttcagtatagatgcagtaattgtgagcctatcaacatagtgtagtcagccagaacattaaagtttctttgtttcaactctc

SEQ ID NO: 3107 - DNA, 2239 bp, Homo sapiens
gtcggtaggacctgggacaccgcggaagtcgggaaatggcctcagtggctttagaggatgtggctgtgaacttcacccgagaagagtgggctttgctgggtccttgtcagaagaatctctacaaagatgtgatgcaggaaaccatcaggaacctggattgtgtagtaatgaaatggaaagaccagaacattgaagatcaatatagatatcccaggaaaaatctaagatgtcgtatgttagagagatttgttgaaagtaaagatggaactcaatgtggagaaacatctagccagattcaagatagtattgtgaccaagaacactcttcctggagtaggtccttgtgaaagcagtatgagaggagaaaaagtcatgggtcattcatcccttaattgttacatcagagttggtgctgggcacaaaccacatgagtatcatgaatgtggagagaagccagatacgcataaacaacgtgggaaagccttcagttaccacaactcatttcaaacacatgagaggcttcacactggaaagaaaccatatgattgtaaagaatgtgggaagtccttcagttctttgggaaaccttcaaagacacatggcagtgcagcgtggagatggaccttataaatgtaagttgtgtgggaaagcgtttttttggcccagtttattacatatgcatgaaagaacgcacactggagagaaaccatatgaatgtaagcagtgttctaaagccttttctttttacagttcctatctaagacatgaaagaacacatactggggagaaaccgtatgaatgtaaacagtgttctaaagcctttcctttttacagttcctatctaagacatgaaagaacacatactggggagaaaccatataaatgtaagcagtgttctaaagccttccctgattccagttcttgtctaatacatgaaagaactcacactggagagaaaccctatacatgtaaacaatgtgggaaagccttcagtgtttccggttcccttcaaagacatgaaaccactcacagtgcagagaaaccctatgcatgtcagcaatgtgggaaagcgtttcatcatctgggaagctttcaaagacacatgataaggcacactggaaatggacctcataaatgtaagatatgtgggaaaggctttgattgtcctagttcactgcaaagtcatgaaagaactcacactggagagaaaccctatgaatgcaagcagtgtgggaaagcattatctcatcgctcaagctttcgaagtcatatgataatgcacactggagatggacctcataaatgcaaggtatgtgggaaagcctttgtttatcccagtgtatttcaaagacatgaaaggactcacactgcagagaaaccctataaatgtaaacaatgtggcaaagcctaccgtatttccagttcccttcgaaggcatgaaacaactcatactggagagaaaccctataaatgcaaacttgggaaagcctgtattgatttctgttcctttcaaaatcacaaaacaactcacactggagagaagccatatgagtgtaaggaatgtgggaaagcattcagtcgtttcagatacctttctcgacataaaaggactcacacaggagagaaaccttatgagtgtaaaacatgtaggaaagccttcggtcattatgataacttaaaggtacatgaaagaattcacatgagagagaaatcctatgaatgtccacaatgtggtaaagccttcactcattcccgttttcttcaaggacatgaaaaaactcatactggagagaacccgtatgaatgtaaggaatgtgggaaagcatttgcttctctcagttccttgcatagacataaaaagactcactggaaaaaaactcacactggagagaacccatatgaatgtaaggaatgtgggaaagcatttgcttctctcagttccttgcatagacataaaaagactcactagcattctctctaaatgtatggaatgtgggaaagcatttattaattttatttcatttcagatacttgtacgaaacacattggagatagaccctgtgaatgtaagcacttggtaaagccttaagtagtttcagtttctttccagtacagtcatcccttgatacctgctgggtattggttccagcactccgtgagccatgtccagtcccttttataaaatgacatgtttgtatgtaacttacccacatcctcttgtatagtctcaattatgtctag

SEQ ID NO: 3108 - DNA, 1050 bp, Homo sapiens
atgcctccaggcaggtggcatgctgccagctcaggcccagtcttcgagggagcgaggcttcagacagtaaagaaggaagaagaggatgaaagctatactccagtgcaggctgccaggccacagactctcaaccgccctggccaggagctgttccgccagctcttcagacagcttcgctaccatgagtcttcagggcccctagaaactctgagccggctccgggaactctgtcgctggtggctgaggcctgacgttctctccaaggcacagatcctagagctgctggtgctggaacagttcctgagcatcctgcctggggagctccgggtttgggtgcagcttcataaccctgagagtggcgaggagtggccttgctggaggagctgcagagggaccttgatgggacatcctggagggacccgggccccagagcccagatgtgcattggatgggtacaggagccgatctgcacagatatggtcccttgcttcacctctcaggagcagctctgctctgggggaccacctggagcctccctatgaaatagaagcacgtgacttcctggctgggcaatccgatactcctgctgcccagatgcctgcccttttcccgagagaggggtgcccgggagaccaggtaacaccaaccaggtccctgacagcccagctccaggagaccatgactttcaaggatgtggaggtgaccttctcccaggacgagtgggggtggctggactctgctcagaggaacctgtacagggatgtgatgctggagaattataggaacatggcttccctggtgggaccattcaccaaacctgctctgatctcctggttggaagcaagggagccatggggcctgaacatgcaggcagctcagcctaaggggaatccagttgctgctcctacaggagatgacctccagagtaaaacaaacaaattcatcttaaatcaggaacctttggaagaagcagaaaccttagctgtgtcatcaggatgtcctgcgacaagtgtttctgagggaattgggctcagagaatcttttcaacag

SEQ ID NO: 3109 - DNA, 9105 bp, Homo sapiens
ggagccgccgggaggtaggcgcgggacgggcggctgcggtggcggcgggtggaccgattgtcgctcggcggcgggagtcggtggagtctcgctctttcgcaaggctggagtgcaatggcatgatctcggctcactgcagcctccgcctcctgggttcaagtgattcttctgcctcagcctcccgagtagctgggactacagaaatgctggtaatttcagtcacttgctgatgacttctgatgtcccagcaaatgttggcattgttgactgctgagaagatacttctgaggacccacgtctaaggtggacttggttcgcactcttctggttagtccctgaacaggagtgatgcctccaggcaggtggcatgctgcctatccagctcaggcccagtcttcgagggagcgagggcggcttcagacagtaaagaaggaagaagaggatgaaagctatactccagtgcaggctgccaggccacagactctcaaccgccctggccaggagctgttccgccagctcttcagacagcttcgctaccatgagtcttcagggcccctagaaactctgagccggctccgggaactctgtcgctggtggctgaggcctgacgttctctccaaggcacagatcctagagctgctggtgctggaacagttcctgagcatcctgcctggggagctccgggtttgggtgcagcttcataaccctgagagtggcgaggaggctgtggccttgctggaggagctgcagagggaccttgatgggacatcctggagggacccgggccctgcccagagcccagatgtgcattggatgggtacaggagccctgcgatctgcacagatatggtcccttgcttcacctctcaggagcagctctgctctgggggaccacctggagcctccctatgaaatagaagcacgtgacttcctggctgggcaatccgatactcctgctgcccagatgcctgcccttttcccgagagaggggtgcccgggagaccaggtaacaccaaccaggtccctgacagcccagctccaggagaccatgactttcaaggatgtggaggtgaccttctcccaggacgagtgggggtggctggactctgctcagaggaacctgtacagggatgtgatgctggagaattataggaacatggcttccctggtgggaccattcaccaaacctgctctgatctcctggttggaagcaagggagccatggggcctgaacatgcaggcagctcagcctaaggggaatccagttgctgctcctacaggagatgacctccagagtaaaacaaacaaattcatcttaaatcaggaacctttggaagaagcagaaaccttagctgtgtcatcaggatgtcctgcgacaagtgtttctgagggaattgggctcagagaatcttttcaacagaagagcaggcagaaggatcaatgtgaaaatcccatacaagtaagagttaagaaagaagagaccaatttcagtcacaggacaggaaaagactctgaagtatcaggaagtaatagtcttgacttaaaacatgttacatatttgagagtttctggaagaaaggaatcccttaaacatggctgtggcaaacacttcagaatgagttcacaccactatgactacaagaaatatgggaaggggctcagacacatgattgggggcttcagcctacatcagagaattcatagtggactgaaagggaacaaaaaggacgtgtgtggaaaagacttcagccttagctctcatcaccaacgtgggcagagtcttcacacagtgggagtgtcatttaagtgcagtgactgtggaaggactttcagtcatagctcccatcttgcgtatcatcagagacttcacactcaagagaaagcatttaaatgtagggtgtgtgggaaagccttccggtggagttccaactgtgcgcggcatgagaaaattcacactggagtgaagccttataaatgcgatttatgtgagaaagctttccgacgcctgtcagcctaccgtctgcaccgagaaacccatgctaagaagaaatttcttgaattgaatcagtatagggcagctctcacctacagctcagggtttgatcatcatttgggagaccaaagtggggagaaactctttgactgcagccagtgcaggaaatccttccactgtaagtcatatgttcttgaacatcaaaggattcacacccaggagaagccctataaatgtaccaaatgtaggaaaacctttagatggagatcaaactttactcgtcatatgaggttgcatgaggaggaaaaattctacaaacaagatgaatgtcgtgaaggcttcaggcaatctcctgactgcagtcagccccagggtgctcccgctgtggagaaaacatttctgtgtcagcagtgtgggaaaacttttactagaaagaaaactctcgttgaccaccagagaattcacacaggtgagaaaccttaccagtgtagcgattgtgggaaggactttgcctataggtcagcctttattgttcataagaagaagcatgccatgaaaagaaaacctgagggcgggccatcttttagtcaggacacagtgttccaggttcctcagagcagtcactccaaagaggagccctacaaatgcagccagtgtggcaaggccttccgcaatcactcattcctcctcatccatcagagagttcacactggagagaagccatataagtgcagggagtgtgggaaagccttcagatggagttccaatctctaccgacatcagaggattcactctcttcaaaaacagtatgattgccatgaaagtgaaaagactccaaatgtggagccaaaaatcctcactggtgagaaacgtttttggtgtcaagaatgtgggaaaacctttacacgtaaaagaacccttttagatcataagggaatacacagtggagagaagcgctataaatgtaatctatgtgggaaatcttatgatagaaactatcgccttgttaaccatcagaggatccactctacagagagacctttcaaatgtcagtggtgtgggaaagagttcattgggagacataccctttccagtcaccagaggaaacacaccagagcagcacaggctgaacgtagcccgcctgcacggtcttcctctcaggacacaaagttgagattacagaagctaaaaccaagtgaagagatgcccctcgaagactgcaaagaagcttgcagccagagctccaggctcactggactccaggacataagcattgggaaaaagtgccacaaatgcagcatatgtgggaaaacttttaacaagagttcacaactcattagccacaagagatttcatactcgagagaggcccttcaaatgcagcaagtgtggaaagaccttcaggtggtcttcgaacctggctcggcatatgaaaaaccatattagagattagcctgggacctgacagtgacagtgggggtgggttctcagtcccctgctagagaacccttaattataggcattgtggagtaactttgataaagggcccagccctttctgttttggaagctagtgacagaatcccaaggatttgaaagctcggggagtccccagcctgcctgctaggatgtgacgctggggaagtgcagcaccatgtcctttggagcccttctggagactccggcccctaggagtggcctctgcaccatagcctgcggctcccctattcaggtctccttccacaactctgaagagagagaccactgccctttgtggttggacagaatatctgtggcatcatgggctatggctgctggaaaggggccagtgggatcctagatttgtcttcaagtttggcctgtggccatgcctattctgttgactttaaaagcagcagcatcaagaactcctagccttcccaaatgccccctggggagttctggctggggcttcagccttcctggctggcttttggatatctgctagggggttagagtggtctcagcggcaggtggaggagagcaggatgctgggctcaagcgcttggcgtgtggatctctaccagtaccctgttgccatccccatcccacaggcctgcataggcagcagcggtccatctgtttaacagaaatgtgctgagcactcccatacaccaggcgctggtgtgtttgccagagacccagcagggaccagaacagatgaaaatcctgccatcttggatctttacagatgacaaacaaatgggatacgcagtattctggatggtgatgtgtgtagtggacaaagtgaatcagagaagagcagagggagtgctggattgggagatcagtcgtgattttagatagtctggtcagggagggcctcaactgagaaggtgaaatgtgagcaaagacgtgaaggaagccagggaggtagcaggtagctctctagggagagttgcaggcagaggagattgggtcttgactggtgtcctcaggaaggaagcccctgggatggagtgcagggagccagctggaagggaaggagaggggccagggaggccacaggcccggccatatgagcatcatgggtcattacgggggcttgagctggctcagagggaggcagggagcttttggacaattttgagttgaggagtgatgtggtttgaatctgaattatattttataagggttaaccacagatccaaggactcagtaaaagggtgaaaggcttctcatgcagttagccttgctgccagttcccataaatcagactcctccccactccgtttctgaattttctataggatcctcggcctcagcagatataaacgcttaccattgttgtgttcatgtctctagcccctgcacactgcaggcccctctcagcttcacatacccctctccatgtatgagatctggtgctagcaatcagattcaacccgaaggaacaagtgcatgtgcctgctgctctcaggagaaaaggcagcctgttctgggaggagctccctcactggcccacccacttgtgttgaagcaaaaagcaagaatcaattacttaaaggcaaaggagtgatattgctaaagcatgtgagtaatcattgcttctgattattgaagaggtcagattatgaatgaaaggataaaatgttttaatagtagagcagtgtcctgactataggggcccgttcatggagctggtcatttcttgaaatgagaagaaaccaacctggaagatgtctttttcagtagagtatggaataatcttacctgctctggattgccatgagcaggtgaaaatgaaggctctgatattgtgtggtggtgtcacaggatggtgggggcggggcagaagtctcctgttggtgttctgatgcctgttcagctttgtcctcaggaaggtttggtcatcttggttctgccatcctcttgccttcctacggcagcagctgttcatggcactgaagatgtcccttcactgtcccaaaactggcactagaagtggctgggcaggggggccagagtcataggaagggtcttggagtcatcagatctgggttccaggcatggtgtgccttttcttggcaggattgatcttgagcaagtcaatgaacctctgcatcaatttccttatgtgtgaagttagagtgcttggctgtgctacctgattcctgagattggtgaaagagggcttggtttaccaaggctctccatcaggtggttgacctctaggaccagggccctctcagaggtgcagcttccatgtcagttggtgttgtaaccatggaaaagtccctttccaatcaaacttttagcacccctttccccccatctctgctccctttgccacaggataccttgtaaagttcctgccccagtatagggatatttttactgtcttttttattttttgagacagggttgcccagggtggagtgcagtggcaggatcacagcttactgcagccttgacctcccaggctcaggtcccatctgagcctcccgagtagctggggctacaggtgtgtgccaccctgccagctaattttttatatttttttgtagagacaaaacttttatttttttttcccatgttgctcatgctggtctcaaactcctgggctcaagcaatccacccacctctgcctcccaaagtgctgggattacaggcgtgagccactgtgcctgacctgtcatttttatagaatgaaatgtgcttatttctaaacattctaatcaaattttaaaatgtgcaaagaatgaagtgaaaaactgaatttttttttttttttgatacggagtctcactctgttacccaggctagagtgcagtggcgcgatctccgctcactgcaagctctgcctcctgggctcacaccattctcctgcctcagcctcctcagtagctgggactacaagtgcctgccaccacgcctgggttattttttatatttttagtagagacggggtttcactgtgttagccaggatggtctcgatctccaggatggtctcgatctccaggatggtctcgatctcctgacgtcgtgatccacccgcctcggcctcccaaaatgctgggattacaggtgtgagccactgtgcccggccaaaagaacagaaattattttatcctgaagtaagctgtttatatttgggattatactgaacctatttgtccaataacctgagttttcaaataattttagttctataagtactataattatataaatattaatgaattcagattagctgaaaggaaaaaaagtagaagcctgactacttggtgctaactactaaagattttggcagaatcaatgttggatttggctttcctgtcccttccccatgccagccccccagagtgttctgccttgtgctgcctcccttcacctggagtgccacacccctctctctgccagttcagctcttcattcttcaaggcctgaccttgtctgacccttgtgcctctaaacccgtggccccacctctcttggttcctatgtcaggtgatgtttgtgtttttggttatgcccatctccatagccagaccaagcactctggaagccagggttgggtgcttatttatctgtttgccatgcagaaaatatcttgcacaaaattacctctgttaaggaatctgaagctgaatttagtttggctgagtcagggttgggttttttttaaggggctgtggggtgaaatgttgactggaagccacccacaaacacacacctgctggttaggaacccggctgtgggtggttctgagctgtttggcttcagttgacagtttctgattgccctgagcaccaggtctcatcttgcatctcatcctggcctggagaacattcagtttccttccaacccttcccacctttcccccactcccttggaggaactgaagttggggttgaggagagccagatggctggagtgggtatttgaaggtctttctgtcacctgttcagtgtggtctgccccacccctgctgaccaagactgactgaaatgtaaaataatacagaccatctcacactcagaaagctggcacatttttgaaagcccaagtgtgggtaagtgcgtggaacaacgataattcacactgctttatgagtagaaattgtgagaaatattgtgccaggcaatttgcaaaatcttggaaggttgtgtgcacttaaccacccagcaactactcctggatgcatcctagagaagtgccatgtgaacagagaatgattttaagacttcactgaagtattgtttaggtagcaagattgggaaaagcctgcatttcatcagcagaagaatggataaataaatgggttgtttttggtccttggaaagtgaatatgaaagagttacgtctcaacacagatagatgaaaaattatgctgagaaagttggtgaagctacatacaaggtacccttagtgtaaagttaagcatactgtgtacctgtgggcacgttacttcaacttgtttttcactttttctgtaaaatgggatagtagtggcaatctcacagggtgattgtgggtgggggggtggtcaatgaagtaatgcatgtaaaatgcttagaatagtgtctagcatgtaagccttgtggacatatagaaagtgttattgttttgcacagtaatctattttctgtggattcaaataatatgaaatgagtataaaatcatgtattggaacgatgtgtgcaagtcaccattctgccttcctaaggcaggagacctgatggatttggggagggtacatggggccttcagttgtgttttctttgtttttttctaaaaattgatgcagaggcatcacaatgttaagatttttacagggtagtgtggtgggtactttttaactgtttgcttaaagtgtttcaaagtaaaaatatttcttaagcatagtctctgacatcttatgactttatagaaatccctgccaggtacatgatgttacttagagtgagccacctaatctttcaaggcttccatttcctcacctgcaaaaattgggagtgtcagaggcgtttgaaccagagtgactccatcttgaatagggaactgggtaaaataaggctgagacctactgggctgcattcccaggaggttaggcattccaagtcatgggatgagataggaggtcagcacaagatacagtcataaagaccttgccaataaaacagcatgtggtaaagaagccggtcaaaaccaagatggcaatgaaagtgacctctggttgtcctcactgctgtaattatactgtaattataatgcattagcatgctaacagacactcccaccagtgccatgacagtttacaaacgccatggcaggcctggcacgatggctcatgcctgtaatcccagcactttgggaggccaaggcgggcggattatgaggtcaggagattgagaccagcctggccaacatggtgaaaccctgtctctactaaaaaatacaaaaattagctgggcatggtggcacgtgcctgtaatcccagctacttgagaggctgaggcaggagaatctctagatcccgggagttggaggttgcagtgagccaagatggtgccactgcactccagcctgggtgacagagcaagactctgtctcaaaaaaaaaaaaaaaaaa

SEQ ID NO: 3110 - DNA, 10243 bp, Homo sapiens
ggagccgccgggaggtaggcgcgggacgggcggctgcggtggcggcgggtggaccgattgtcgctcggcggcgggagtcggtgagaggcctggcggggcgcgggggtgggggtggcggcattgcgggcgcggggctccccgaagtccgcggcattctcgggcctgcccgggcggcggacggggcccggcctggagaaatgctggtaatttcagtcacttgctgatgacttctgatgtcccagcaaatgttggcattgttgactgctgagaagatacttctgaggacccacgtctaaggtggacttggttcgcactcttctggttagtccctgaacaggagtgatgcctccaggcaggtggcatgctgcctatccagctcaggcccagtcttcgagggagcgagggcggcttcagacagtaaagaaggaagaagaggatgaaagctatactccagtgcaggctgccaggccacagactctcaaccgccctggccaggagctgttccgccagctcttcagacagcttcgctaccatgagtcttcagggcccctagaaactctgagccggctccgggaactctgtcgctggtggctgaggcctgacgttctctccaaggcacagatcctagagctgctggtgctggaacagttcctgagcatcctgcctggggagctccgggtttgggtgcagcttcataaccctgagagtggcgaggaggctgtggccttgctggaggagctgcagagggaccttgatgggacatcctggagggacccgggccctgcccagagcccagatgtgcattggatgggtacaggagccctgcgatctgcacagatatggtcccttgcttcacctctcaggagcagctctgctctgggggaccacctggagcctccctatgaaatagaagcacgtgacttcctggctgggcaatccgatactcctgctgcccagatgcctgcccttttcccgagagaggggtgcccgggagaccaggtaacaccaaccaggtccctgacagcccagctccaggagaccatgactttcaaggatgtggaggtgaccttctcccaggacgagtgggggtggctggactctgctcagaggaacctgtacagggatgtgatgctggagaattataggaacatggcttccctggtgggaccattcaccaaacctgctctgatctcctggttggaagcaagggagccatggggcctgaacatgcaggcagctcagcctaaggggaatccagttgctgctcctacaggagatgacctccagagtaaaacaaacaaattcatcttaaatcaggaacctttggaagaagcagaaaccttagctgtgtcatcaggatgtcctgcgacaagtgtttctgagggaattgggctcagagaatcttttcaacagaagagcaggcagaaggatcaatgtgaaaatcccatacaagtaagagttaagaaagaagagaccaatttcagtcacaggacaggaaaagactctgaagtatcaggaagtaatagtcttgacttaaaacatgttacatatttgagagtttctggaagaaaggaatcccttaaacatggctgtggcaaacacttcagaatgagttcacaccactatgactacaagaaatatgggaaggggctcagacacatgattgggggcttcagcctacatcagagaattcatagtggactgaaagggaacaaaaaggacgtgtgtggaaaagacttcagccttagctctcatcaccaacgtgggcagagtcttcacacagtgggagtgtcatttaagtgcagtgactgtggaaggactttcagtcatagctcccatcttgcgtatcatcagagacttcacactcaagagaaagcatttaaatgtagggtgtgtgggaaagccttccggtggagttccaactgtgcgcggcatgagaaaattcacactggagtgaagccttataaatgcgatttatgtgagaaagctttccgacgcctgtcagcctaccgtctgcaccgagaaacccatgctaagaagaaatttcttgaattgaatcagtatagggcagctctcacctacagctcagggtttgatcatcatttgggagaccaaagtggggagaaactctttgactgcagccagtgcaggaaatccttccactgtaagtcatatgttcttgaacatcaaaggattcacacccaggagaagccctataaatgtaccaaatgtaggaaaacctttagatggagatcaaactttactcgtcatatgaggttgcatgaggaggaaaaattctacaaacaagatgaatgtcgtgaaggcttcaggcaatctcctgactgcagtcagccccagggtgctcccgctgtggagaaaacatttctgtgtcagcagtgtgggaaaacttttactagaaagaaaactctcgttgaccaccagagaattcacacaggtgagaaaccttaccagtgtagcgattgtgggaaggactttgcctataggtcagcctttattgttcataagaagaagcatgccatgaaaagaaaacctgagggcgggccatcttttagtcaggacacagtgttccaggttcctcagagcagtcactccaaagaggagccctacaaatgcagccagtgtggcaaggccttccgcaatcactcattcctcctcatccatcagagagttcacactggagagaagccatataagtgcagggagtgtgggaaagccttcagatggagttccaatctctaccgacatcagaggattcactctcttcaaaaacagtatgattgccatgaaagtgaaaagactccaaatgtggagccaaaaatcctcactggtgagaaacgtttttggtgtcaagaatgtgggaaaacctttacacgtaaaagaacccttttagatcataagggaatacacagtggagagaagcgctataaatgtaatctatgtgggaaatcttatgatagaaactatcgccttgttaaccatcagaggatccactctacagagagacctttcaaatgtcagtggtgtgggaaagagttcattgggagacataccctttccagtcaccagaggaaacacaccagagcagcacaggctgaacgtagcccgcctgcacggtcttcctctcaggacacaaagttgagattacagaagctaaaaccaagtgaagagatgcccctcgaagactgcaaagaagcttgcagccagagctccaggctcactggactccaggacataagcattgggaaaaagtgccacaaatgcagcatatgtgggaaaacttttaacaagagttcacaactcattagccacaagagatttcatactcgagagaggcccttcaaatgcagcaagtgtggaaagaccttcaggtggtcttcgaacctggctcggcatatgaaaaaccatattagagattagcctgggacctgacagtgacagtgggggtgggttctcagtcccctgctagagaacccttaattataggcattgtggagtaactttgataaagggcccagccctttctgttttggaagctagtgacagaatcccaaggatttgaaagctcggggagtccccagcctgcctgctaggatgtgacgctggggaagtgcagcaccatgtcctttggagcccttctggagactccggcccctaggagtggcctctgcaccatagcctgcggctcccctattcaggtctccttccacaactctgaagagagagaccactgccctttgtggttggacagaatatctgtggcatcatgggctatggctgctggaaaggggccagtgggatcctagatttgtcttcaagtttggcctgtggccatgcctattctgttgactttaaaagcagcagcatcaagaactcctagccttcccaaatgccccctggggagttctggctggggcttcagccttcctggctggcttttggatatctgctagggggttagagtggtctcagcggcaggtggaggagagcaggatgctgggctcaagcgcttggcgtgtggatctctaccagtaccctgttgccatccccatcccacaggcctgcataggcagcagcggtccatctgtttaacagaaatgtgctgagcactcccatacaccaggcgctggtgtgtttgccagagacccagcagggaccagaacagatgaaaatcctgccatcttggatctttacagatgacaaacaaatgggatacgcagtattctggatggtgatgtgtgtagtggacaaagtgaatcagagaagagcagagggagtgctggattgggagatcagtcgtgattttagatagtctggtcagggagggcctcaactgagaaggtgaaatgtgagcaaagacgtgaaggaagccagggaggtagcaggtagctctctagggagagttgcaggcagaggagattgggtcttgactggtgtcctcaggaaggaagcccctgggatggagtgcagggagccagctggaagggaaggagaggggccagggaggccacaggcccggccatatgagcatcatgggtcattacgggggcttgagctggctcagagggaggcagggagcttttggacaattttgagttgaggagtgatgtggtttgaatctgaattatattttataagggttaaccacagatccaaggactcagtaaaagggtgaaaggcttctcatgcagttagccttgctgccagttcccataaatcagactcctccccactccgtttctgaattttctataggatcctcggcctcagcagatataaacgcttaccattgttgtgttcatgtctctagcccctgcacactgcaggcccctctcagcttcacatacccctctccatgtatgagatctggtgctagcaatcagattcaacccgaaggaacaagtgcatgtgcctgctgctctcaggagaaaaggcagcctgttctgggaggagctccctcactggcccacccacttgtgttgaagcaaaaagcaagaatcaattacttaaaggcaaaggagtgatattgctaaagcatgtgagtaatcattgcttctgattattgaagaggtcagattatgaatgaaaggataaaatgttttaatagtagagcagtgtcctgactataggggcccgttcatggagctggtcatttcttgaaatgagaagaaaccaacctggaagatgtctttttcagtagagtatggaataatcttacctgctctggattgccatgagcaggtgaaaatgaaggctctgatattgtgtggtggtgtcacaggatggtgggggcggggcagaagtctcctgttggtgttctgatgcctgttcagctttgtcctcaggaaggtttggtcatcttggttctgccatcctcttgccttcctacggcagcagctgttcatggcactgaagatgtcccttcactgtcccaaaactggcactagaagtggctgggcaggggggccagagtcataggaagggtcttggagtcatcagatctgggttccaggcatggtgtgccttttcttggcaggattgatcttgagcaagtcaatgaacctctgcatcaatttccttatgtgtgaagttagagtgcttggctgtgctacctgattcctgagattggtgaaagagggcttggtttaccaaggctctccatcaggtggttgacctctaggaccagggccctctcagaggtgcagcttccatgtcagttggtgttgtaaccatggaaaagtccctttccaatcaaacttttagcacccctttccccccatctctgctccctttgccacaggataccttgtaaagttcctgccccagtatagggatatttttactgtcttttttattttttgagacagggttgcccagggtggagtgcagtggcaggatcacagcttactgcagccttgacctcccaggctcaggtcccatctgagcctcccgagtagctggggctacaggtgtgtgccaccctgccagctaattttttatatttttttgtagagacaaaacttttatttttttttcccatgttgctcatgctggtctcaaactcctgggctcaagcaatccacccacctctgcctcccaaagtgctgggattacaggcgtgagccactgtgcctgacctgtcatttttatagaatgaaatgtgcttatttctaaacattctaatcaaattttaaaatgtgcaaagaatgaagtgaaaaactgaatttttttttttttttgatacggagtctcactctgttacccaggctagagtgcagtggcgcgatctccgctcactgcaagctctgcctcctgggctcacaccattctcctgcctcagcctcctcagtagctgggactacaagtgcctgccaccacgcctgggttattttttatatttttagtagagacggggtttcactgtgttagccaggatggtctcgatctccaggatggtctcgatctccaggatggtctcgatctcctgacgtcgtgatccacccgcctcggcctcccaaaatgctgggattacaggtgtgagccactgtgcccggccaaaagaacagaaattattttatcctgaagtaagctgtttatatttgggattatactgaacctatttgtccaataacctgagttttcaaataattttagttctataagtactataattatataaatattaatgaattcagattagctgaaaggaaaaaaagtagaagcctgactacttggtgctaactactaaagattttggcagaatcaatgttggatttggctttcctgtcccttccccatgccagccccccagagtgttctgccttgtgctgcctcccttcacctggagtgccacacccctctctctgccagttcagctcttcattcttcaaggcctgaccttgtctgacccttgtgcctctaaacccgtggccccacctctcttggttcctatgtcaggtgatgtttgtgtttttggttatgcccatctccatagccagaccaagcactctggaagccagggttgggtgcttatttatctgtttgccatgcagaaaatatcttgcacaaaattacctctgttaaggaatctgaagctgaatttagtttggctgagtcagggttgggttttttttaaggggctgtggggtgaaatgttgactggaagccacccacaaacacacacctgctggttaggaacccggctgtgggtggttctgagctgtttggcttcagttgacagtttctgattgccctgagcaccaggtctcatcttgcatctcatcctggcctggagaacattcagtttccttccaacccttcccacctttcccccactcccttggaggaactgaagttggggttgaggagagccagatggctggagtgggtatttgaaggtctttctgtcacctgttcagtgtggtctgccccacccctgctgaccaagactgactgaaatgtaaaataatacagaccatctcacactcagaaagctggcacatttttgaaagcccaagtgtgggtaagtgcgtggaacaacgataattcacactgctttatgagtagaaattgtgagaaatattgtgccaggcaatttgcaaaatcttggaaggttgtgtgcacttaaccacccagcaactactcctggatgcatcctagagaagtgccatgtgaacagagaatgattttaagacttcactgaagtattgtttaggtagcaagattgggaaaagcctgcatttcatcagcagaagaatggataaataaatgggttgtttttggtccttggaaagtgaatatgaaagagttacgtctcaacacagatagatgaaaaattatgctgagaaagttggtgaagctacatacaaggtacccttagtgtaaagttaagcatactgtgtacctgtgggcacgttacttcaacttgtttttcactttttctgtaaaatgggatagtagtggcaatctcacagggtgattgtgggtgggggggtggtcaatgaagtaatgcatgtaaaatgcttagaatagtgtctagcatgtaagccttgtggacatatagaaagtgttattgttttgcacagtaatctattttctgtggattcaaataatatgaaatgagtataaaatcatgtattggaacgatgtgtgcaagtcaccattctgccttcctaaggcaggagacctgatggatttggggagggtacatggggccttcagttgtgttttctttgtttttttctaaaaattgatgcagaggcatcacaatgttaagatttttacagggtagtgtggtgggtactttttaactgtttgcttaaagtgtttcaaagtaaaaatatttcttaagcatagtctctgacatcttatgactttatagaaatccctgccaggtacatgatgttacttagagtgagccacctaatctttcaaggcttccatttcctcacctgcaaaaattgggagtgtcagaggcgtttgaaccagagtgactccatcttgaatagggaactgggtaaaataaggctgagacctactgggctgcattcccaggaggttaggcattccaagtcatgggatgagataggaggtcagcacaagatacagtcataaagaccttgccaataaaacagcatgtggtaaagaagccggtcaaaaccaagatggcaatgaaagtgacctctggttgtcctcactgctgtaattatactgtaattataatgcattagcatgctaacagacactcccaccagtgccatgacagtttacaaacgccatggcaggcctggcacgatggctcatgcctgtaatcccagcactttgggaggccaaggcgggcggattatgaggtcaggagattgagaccagcctggccaacatggtgaaaccctgtctctactaaaaaatacaaaaattagctgggcatggtggcacgtgcctgtaatcccagctacttgagaggctgaggcaggagaatctctagatcccgggagttggaggttgcagtgagccaagatggtgccactgcactccagcctgggtgacagagcaagactctgtctcaaaaaaaaaaaaaaaaaatgccatggcaacatcaggaagtaacactatatggtctaaaaaggagaggaaccctcagttctggtaattgctcacacctttcccgggaaacttatgaataatctaccccttgtttagcatataatcaataaataaccataaaaataggcaaccagcagcccttggggctactcttcctatggagtagccattctgtatttctttactttcttaatattaactactttcactttgtggactcgcccgaattcttttcttgagcaaggtccaagaactctctcttggggactggatcacgaccgctttctggtaacaggagcaatacaaatggctattagtaaacgaacgcttaagtaactctagtacatctatgatgaaataccaggccacagtttttttaaaaatgaggatgttctctatatactgacgcacagtcaccaagacatgcactttataggaaattataagctcctccttgcctaaatctccttaattttgcttaataaataacaagtgaagccagaagctgtaaactcataattttaatgaagaaatgggatccagaagatggagatgtttttcattctactttattagatgaggaaaaggagagtaaatacttgtatgccagctaccacaccttttaaagttaatgttaaccctgctaagaacagcaaggagattttatatcagccaggttttagttgccagaaaccacaccagttattttagcaaagaccttataaagaagtgtactatatttaagtagctaaaaaggcaagaagaaaatgccaaggtgtcttggaggtagcaactgctaagcagctgccaccccaggactgggggagctagaatagagtctccccatgtttgacgtttgtctgctaatagcattcaagctctccccctcagtttgcctggatctggacaagctgataagaaagcccagccacttcctctttgcgtcagaggggaagttcaaactgtgcaaaccctgactgtcaaatgcactgagctctcataaccacaacaaaaaccagagccacttgttcgtcctttcactgaagcccaacagactggcgtgggtgcccgctttgctttccctagaaggcctcatgtgagtagtaaactttttcataacctc

SEQ ID NO: 3111 - DNA, 1291 bp, Homo sapiens
acagaaatgctggtaatttcagtcacttgctgatgacttctgatgtcccagcaaatgttggcattgttgactgctgagaagatacttctgaggacccacgtctaaggtggacttggttcgcactcttctggttagtccctgaacaggagtgatgcctccaggcaggtggcatgctgccatcagctcaggcccagtcttcgagggagcgagggcgcttcagacagtaaagaaggaagaagaggatgaaagctatactccagtgcaggctgccaggccacagactctcaaccgccctggccaggagctgttccgccagctcttcagacagcttcgctaccatgagtcttcagggcccctagaaactctgagccggctccgggaactctgtcgctggtggctgaggcctgacgttctctccaaggcacagatcctagagctgctggtgctggaacagttcctgagcatcctgcctggggagctccgggtttgggtgcagcttcataaccctgagagtggcgaggagctgtggccttgctggaggagctgcagagggaccttgatgggacatcctggagggacccgggccctgccagagcccagatgtgcattggatgggtacaggagcctgcgatctgcacagatatggtcccttgcttcacctctcaggagcagctctgctctgggggaccacctggagcctccctatgaaatagaagcacgtgacttcctggctgggcaatccgatactcctgctgcccagatgcctgcccttttcccgagagaggggtgcccgggagaccaggtaacaccaaccaggtccctgacagcccagctccaggagaccatgactttcaaggatgtggaggtgaccttctcccaggacgagtgggggtggctggactctgctcagaggaacctgtacagggatgtgatgctggagaattataggaacatggcttccctgggtaagtaatcgatatcctcatgcttctatccatctttatttctgccttcttgggttgttctgtgctgcatagaaaggtacctgacctggttttagatcctggctctgtaactgctgaccagatcacttaatctagcaccttggtagcctcttttgaaaaatggggagaataatgcctgccattctggattattgtaaagattaaaggtggctgggtgtggtagctcacacctgtaatcccaccacttcgggaggcccaggtgggaagattgcttgagctcaggagtttgagaccagtctgggcaacatagtgaaaccccatctcta

SEQ ID NO: 3112 - DNA, 1968 bp, Homo sapiens
ttttggggacagatcccgaagttcgagcatccctcggataggccgggtgtcaggcctggtctctcaggcccgtccaggcccatcttgacgattccaagaccacccccttgagcaagaatgccatcccctctgggtcccccatgcctgcccgtcatggacccagagaccacccttgaggagcctgagactgcccgcctccgcttccgagggttctgctaccaggaggtggcaggtccccgagaagccctggcccggctgcgtgagctgtgttgccagtggctgcagcctgaggcacactccaaggagcagatgctggagatgctggtgctggagcagttcctgggcacactgcctcccgagatccaggcctgggtgcgcggtcagcggccaggcagtcctgaggaggccgctgccctagtcgaaggactgcagcatgaccctgggcaactgttgggctggatcacagcccatgtcctgaagcaggaggtgctccctgcagcccagaagacagaggaaccacttgggagcccccacccctcagggacagtggagtcccctggggaaggtccccaggacaccagaatagaggggtctgtccagctcagctgcagtgtgaaggaggagcccaatgtcgatggacaggaagtggcaccctccagccctccacttgcagcacagtcccctgaggggaaccatggacaccaagaaccagcctccacatccttccacccacccaggattcaggaggagtgggggctgctggaccggtcacagaaggaactgtactgggatgcgatgctggagaagtacggcacagtggtctccctggggttaccgccccaccagccagaggcacaggcccagtcagagctggggatgctgctcacggggacaggcgtctgcagaagcctgcgctcgggaaatgagagtgagggtccacctggctgcccagaggcccagccgccccagggcccagggccggcagcctgggagggcttgtctggggctgccactcctgcccccactgtgcgcccagggacaccgccagtgcccactcagcccacacctgcagagacgagactggagccggctgccacccccaggaagccctacacgtgcgagcagtgtggccgcggcttcgactggaagtcagtgttcgtcatccaccaccggacacacacgagtgggccaggtgtgcagtccccggggctagccaccggggaaagcacagagaagccaccacaaggggaggtggcctttccgcaccacccccgacgctcactcacaggcccccggagttacccgtgtgaggagtgcgggtgcagcttcagctggaagtcgcagctggtcatccaccgcaagagccacacaggccagcggcgtcacttctgcagtgactgtggccgcgccttcgactggaagtcgcagctggtcatccaccgcaagggccaccggccggaggttccatgagcagccagacagcacagtccctcggggcctcggtgttctcggggcctggatacagcctctggggcaccagcagaagactctggaggcagcaggggatgccagagtgaacaaggggtcccaagccagttccctgcccctggtctggtctcccccaaaagacctgggtgcaaggaaaaggagctgctctctctcttcttgcccctgcctcctagagggaggtctgggttcccttctatggctgaccagtgcctgtggggtgactgccaagcaccaggctccctccctccctgtgacatggcctgggctgacaacactccctctcctgggacctccttgcctcaggtgggtgttcaaaaactgtgccttcccactcgtctgtgcagaggctgggcctgaggtctcagtgtggagagcagcagaagacccaggaaagcacagttggcttccgtttctcctgctccctgtgtgtgttagaattttaacataaattccactttc

SEQ ID NO: 3113 - DNA, 2148 bp, Homo sapiens
tcgagcatccctcggataggccgggtgtcaggcctggtctctcaggcccgtccaggcccatcttgacgattccaagaccacccccttgagcaagaatgccatcccctctgggtcccccatgcctgcccgtcatggacccagagaccacccttgaggagcctgagactgcccgcctccgcttccgagggttctgctaccaggaggtggcaggtccccgagaagccctggcccggctgcgtgagctgtgttgccagtggctgcagcctgaggcacactccaaggagcagatgctggagatgctggtgctggagcagttcctgggcacactgcctcccgagatccaggcctgggtgcgcggtcagcggccaggcagtcctgaggaggccgctgccctagtcgaaggactgcagcatgaccctgggcaactgttgggctggatcacagcccatgtcctgaagcaggaggtgctccctgcagcccagaagacagaggaaccacttgggagcccccacccctcagggacagtggagtcccctggggaaggtccccaggacaccagaatagaggggtctgtccagctcagctgcagtgtgaaggaggagcccaatgtcgatggacaggaagtggcaccctccagccctccacttgcagcacagtcccctgaggggaaccatggacaccaagaaccagcctccacatccttccacccacccaggattcaggaggagtgggggctgctggaccggtcacagaaggaactgtactgggatgcgatgctggagaagtacggcacagtggtctccctgggtgaggaccagccagccccaccccgcccctctccctggggcctgcacccaccctgcagcaggcctagctgggcagggcctctgtgctaccagccctacccagctctcccaccttccagaggaacaccctgtcacctaccagaaccgaccccacccctccttcatgcaaaccccatgcctaactgtgccccccacccgggcagggttaccgccccaccagccagaggcacaggcccagtcagagctggggatgctgctcacggggacaggcgtctgcagaagcctgcgctcgggaaatgagagtgagggtccacctggctgcccagaggcccagccgccccagggcccagggccggcagcctgggagggcttgtctggggctgccactcctgcccccactgtgcgcccagggacaccgccagtgcccactcagcccacacctgcagagacgagactggagccggctgccacccccaggaagccctacacgtgcgagcagtgtggccgcggcttcgactggaagtcagtgttcgtcatccaccaccggacacacacgagtgggccaggtgtgcagtccccggggctagccaccggggaaagcacagagaagccaccacaaggggaggtggcctttccgcaccacccccgacgctcactcacaggcccccggagttacccgtgtgaggagtgcgggtgcagcttcagctggaagtcgcagctggtcatccaccgcaagagccacacaggccagcggcgtcacttctgcagtgactgtggccgcgccttcgactggaagtcgcagctggtcatccaccgcaagggccaccggccggaggttccatgagcagccagacagcacagtccctcggggcctcggtgttctcggggcctggatacagcctctggggcaccagcagaagactctggaggcagcaggggatgccagagtgaacaaggggtcccaagccagttccctgcccctggtctggtctcccccaaaagacctgggtgcaaggaaaaggagctgctctctctcttcttgcccctgcctcctagagggaggtctgggttcccttctatggctgaccagtgcctgtggggtgactgccaagcaccaggctccctccctccctgtgacatggcctgggctgacaacactccctctcctgggacctccttgcctcaggtgggtgttcaaaaactgtgccttcccactcgtctgtgcagaggctgggcctgaggtctcagtgtggagagcagcagaagacccaggaaagcacagttggcttccgtttctcctgctccctgtgtgtgttagaattttaacataaattccactttc

SEQ ID NO: 3114 - DNA, 1086 bp, Homo sapiens
aggcccatcttgacgattccaagaccacccccttgagcaagaatgccatcccctctgggtcccccatgcctgcccgtcatggacccagagaccacccttgaggagcctgagactgcccgcctccgcttccgagggttctgctaccaggaggtggcaggtccccgagaagccctggcccggctgcgtgagctgtgttgccagtggctgcagcctgaggcacactccaaggagcagatgctggagatgctggtgctggagcagttcctgggcacactgcctcccgagatccaggcctgggtgcgcggtcagcggccaggcagtcctgaggaggccgctgccctagtcgaaggactgcagcatgaccctgggcaactgttgggctggatcacagcccatgtcctgaagcaggaggtgctccctgcagcccagaagacagaggaaccacttggagcccccacccctcagggacagtggagtcccctggggaaggtccccaggacaccagaatagaggggtctgtccagctcagctgcagtgtgaaggaggagcccaatgtcgatggacaggaagtggcaccctccagccctccacttgcagcacagtcccctgaggggaaccatggacaccaagaaccagcctccacatccttccacccacccaggattcaggaggagtgggggctgctggaccggtcacagaaggaactgtactgggatgcgatgctggagaagtacggcacagtggtctccctggggttaccgccccaccagccagaggcacaggcccagtcagagctggggatgctgctcacggggacaggcgtctgcagaagcctgcgctcggactctgcacttgatggatcagctggccccacccagatccataaaatggctcatctgatcttgtggcccccaggaactgactccgcgcaagacgacagcttcgactctgtatgatctcatccctgaccaatcagcactcctggctcactggcttcccccaacccaccaagttgtccttaaaaactctgctccctgaatgctcagggagactgatctgagtgataacaaaacccttgtctcccgc

SEQ ID NO: 3115 - DNA, 1869 bp, Homo sapiens
ccgaagttcgagcatccctcggataggccgggtgtcaggcctggtctctcaggcccgtccaggcccatcttgacgattccaagaccacccccttgagcaagaatgccatcccctctgggtcccccatgcctgcccgtcatggacccagagaccacccttgaggagcctgagactgcccgcctccgcttccgagggttctgctaccaggaggtggcaggtccccgagaagccctggcccggctgcgtgagctgtgttgccagtggctgcagcctgaggcacactccaaggagcagatgctggagatgctggtgctggagcagttcctgggcacactgcctcccgagatccaggcctgggtgcgcggtcagcggccaggcagtcctgaggaggccgctgccctagtcgaaggactgcagcatgaccctgggcaactgttgggctggatcacagcccatgtcctgaagcaggaggtgctccctgcagcccagaagacagaggaaccacttgggagcccccacccctcagggacagtggagtcccctggggaaggtccccaggacaccagaatagaggggtctgtccagctcagctgcagtgtgaaggaggagcccaatgtcgatggacaggaagtggcaccctccagccctccacttgcagcacagtcccctgaggggaaccatggacaccaagaaccagcctccacatccttccacccacccaggattcaggaggagtgggggctgctggaccggtcacagaaggaactgtactgggatgcgatgctggagaagtacggcacagtggtctccctggggttaccgccccaccagccagaggcacaggcccagtcagagctggggatgctgctcacggggacaggcgtctgcagaagcctgcgctcgggaaatgagagtgagggtccacctggctgcccagaggcccagccgccccagggcccagggccggcagcctgggagggcttgtctggggctgccactcctgcccccactgtgcgcccagggacaccgccagtgcccactcagcccacacctgcagagacgagactggagccggctgccacccccaggaagccctacacgtgcgagcagtgtggccgcggcttcgactggaagtcagtgttcgtcatccaccaccggacacacacgagtgggccaggtgtgcagtccccggggctagccaccggggaaagcacagagaagccaccacaaggggaggtggcctttccgcaccacccccgacgctcactcacaggcccccggagttacccgtgtgaggagtgcgggtgcagcttcagctggaagtcgcagctggtcatccaccgcaagagccaccggccggaggttccatgagcagccagacagcacagtccctcggggcctcggtgttctcggggcctggatacagcctctggggcaccagcagaagactctggaggcagcaggggatgccagagtgaacaaggggtcccaagccagttccctgcccctggtctggtctcccccaaaagacctgggtgcaaggaaaaggagctgctctctctcttcttgcccctgcctcctagagggaggtctgggttcccttctatggctgaccagtgcctgtggggtgactgccaagcaccaggctccctccctccctgtgacatggcctgggctgacaacactccctctcctgggacctccttgcctcaggtgggtgttcaaaaactgtgccttcccactcgtctgtgcagaggctgggcctgaggtctcagtgtggagagcagcagaagacccaggaaagcacagttggcttccgtttctcctgctccctgtgtgtgttagaattttaacataaattccactttc

SEQ ID NO: 3116 - DNA, 2238 bp, Homo sapiens
gaagcggcctccaagcaaccgctccgggttgaggtgagcgcaggctgccagagtgggcgcagcctttccaccccgtgggagggcttggggtcgccctctggggcctgaacggctcctgctgtcggcgccctggagggcccgcccacttcccgacaggccgcgcgcgtcacctcagccttcgctcaggcctttcctaccctcaacgccgttccggggggccgggcctggcaagtcctcttggaacgcctccctcttgccttccccttttggggacagatcccgaagttcgagcatccctcggataggccgggtgtcaggcctggtctctcaggcccgtccaggcccatcttgacgattccaagaccacccccttgagcaagaatgccatcccctctgggtcccccatgcctgcccgtcatggacccagagaccacccttgaggagcctgagactgcccgcctccgcttccgagggttctgctaccaggaggtggcaggtccccgagaagccctggcccggctgcgtgagctgtgttgccagtggctgcagcctgaggcacactccaaggagcagatgctggagatgctggtgctggagcagttcctgggcacactgcctcccgagatccaggcctgggtgcgcggtcagcggccaggcagtcctgaggaggccgctgccctagtcgaaggactgcagcatgaccctgggcaactgttgggctggatcacagcccatgtcctgaagcaggaggtgctccctgcagcccagaagacagaggaaccacttgggagcccccacccctcagggacagtggagtcccctggggaaggtccccaggacaccagaatagaggggtctgtccagctcagctgcagtgtgaaggaggagcccaatgtcgatggacaggaagtggcaccctccagccctccacttgcagcacagtcccctgaggggaaccatggacaccaagaaccagcctccacatccttccacccacccaggattcaggaggagtgggggctgctggaccggtcacagaaggaactgtactgggatgcgatgctggagaagtacggcacagtggtctccctggggttaccgccccaccagccagaggcacaggcccagtcagagctggggatgctgctcacggggacaggcgtctgcagaagcctgcgctcgggaaatgagagtgagggtccacctggctgcccagaggcccagccgccccagggcccagggccggcagcctgggagggcttgtctggggctgccactcctgcccccactgtgcgcccagggacaccgccagtgcccactcagcccacacctgcagagacgagactggagccggctgccacccccaggaagccctacacgtgcgagcagtgtggccgcggcttcgactggaagtcagtgttcgtcatccaccaccggacacacacgagtgggccaggtgtgcagtccccggggctagccaccggggaaagcacagagaagccaccacaaggggaggtggcctttccgcaccacccccgacgctcactcacaggcccccggagttacccgtgtgaggagtgcgggtgcagcttcagctggaagtcgcagctggtcatccaccgcaagagccacacaggccagcggcgtcacttctgcagtgactgtggccgcgccttcgactggaagtcgcagctggtcatccaccgcaagggccaccggccggaggttccatgagcagccagacagcacagtccctcggggcctcggtgttctcggggcctggatacagcctctggggcaccagcagaagactctggaggcagcaggggatgccagagtgaacaaggggtcccaagccagttccctgcccctggtctggtctcccccaaaagacctgggtgcaaggaaaaggagctgctctctctcttcttgcccctgcctcctagagggaggtctgggttcccttctatggctgaccagtgcctgtggggtgactgccaagcaccaggctccctccctccctgtgacatggcctgggctgacaacactccctctcctgggacctccttgcctcaggtgggtgttcaaaaactgtgccttcccactcgtctgtgcagaggctgggcctgaggtctcagtgtggagagcagcagaagacccaggaaagcacagttggcttccgtttctcctgctccctgtgtgtgttagaattttaacataaattccactttcataata

SEQ ID NO: 3117 - DNA, 4998 bp, Homo sapiens
ggaagcccgggagtgagagaaagcggctccgggggcatagcgggccagtaagggccgctcctcctttgaagaggttttgcgtctctttccgccggtggcgtcggcgctcacgcaggggcgggtcccggtagcgccaggcggtgcagggcgggaaggggattcgtggcgacggcggcggcagggacagcaggagcagtggtgctgtcagcgcggccgtcggagacatgggagacccggggtcggagataatagaatctgtccctccagctggccctgaggcatctgagtcaacaacggatgaaaatgaagacgacattcagtttgtcagtgaaggaccattacgacctgttcttgaatacattgatctggtcagcagtgatgatgaagagcctagcacctcttatactgatgagaatattaaacgtaaagaccatattgattatcagaaggataaagttgctttaactctggctcgtctagcccgccatgttgaagtggagaaacagcagaaagaagagaagaatagagcattcagagaaaaaattgattttcagcatgctcatgggttacaagaattggaatttattcgaggacattctgatacagaagcagcaagactgtgtgtggaccagtggctaaaaatgccaggactcaaaacaggcacaattaattgtggaacaaaaagttcattccgaagaggaggccacacgtgggtgtctgggaaaccaattttatgtcctataatgcactgtaacaaggagtttgacaatgggcaccttctcttaggacatttgaaaaggttcgatcactctccatgtgatccaacaattacactacatggacctttcttcagctcctttgcttgtgtagtatgttataaaaaatttgttactcaacaacaatatagagatcacctttttgataaggaagccacagatgatggacataacaacaaccttcttcctcagattattcagtgttttgcatgtccaaattgcttccttctttttagcagaaaggaggagtgttcaaagcatatgtctggaaagaatcatttccatcagagtttcaaactgggtgataacaaaggaattgcacatccaatatctttcccatcttttgcaaagaaacttttgatctctctgtgcaaagatgttccctttcaagttaagtgtgtggcctgccacaagacactgcgttcccacatggagctcactgcccatttcagagttcattgtcgaaatgctggacctgtagctgtagctgagaagagcattacccaggttgcagagaaattcatattaagaggttattgtccagattgcaatcaagtctttgtggatgaaaccagcacccaaaatcataagcagaattcaggacacaaagtccgagtcattaactcagtggaagaatcagtcttactctattgccacagcagcgaagggaacaaggatccttcttctgacttgcatttattgttggatcaatcaaaattttcatcacttaaaagaaccatgtctattaaagaatctagctcactggagtgcattgccattccaaaaaagaagatgaatttaaaagataaaagccatgaaggtgttgcttgtgtccagaaagaaaaatcagtagttaaaacctggttctgtgaatgcaatcagcgattcccaagtgaagatgcagtagaaaagcatgttttctcagcaaacacaatgggttataaatgtgtggtctgtggaaaggtatgtgatgattcaggggtcattcgtttacacatgagccggattcacggaggggcacatttaaataactttcttttctggtgtcggacatgcaaaaaggagttaacaaggaaagatactatcatggcacatgtgactgaatttcataatggacacagatatttttatgagatggatgaggtagaaggtgaaactttgccatcatcctctacaacattggataatttgactgctaacaagccttcatcagctattactgttattgatcattccccggcaaatagttctccgaggggtaaatggcaatgccggatttgtgaagatatgtttgattcccaggaatatgtaaaacagcactgcatgtctttggcaagccacaagtttcatagatacagctgtgctcactgcagaaagccttttcataagatagaaacattgtaccgacattgccaagatgagcatgacaatgagataaagattaaatacttctgtgggctttgtgatcttatctttaatgtggaagaagcatttctgagtcattatgaggagcaccacagcatagattatgtatttgtgtcagaaaaaactgaaacttcaattaaaaccgaagatgattttccagtaatagagaccagtaaccagttaacttgtggttgccgtgagagttacatctgtaaagtcaacagaaaagaagattatagcagatgtctccaaatcatgctggataaaggaaaactgtggtttcgctgcagtttatgttcggcaacagcacagaatttaaccgacatgaacactcatatccatcaagtgcacaaagaaaagagtgatgaggaggagcagcagtatgtaatcaagtgtggcacctgcaccaaagcatttcatgatcctgagagtgcacagcagcatttccatagaaaacattgcttcttacagaaacccagtgtggctcattttggatctgaaaaatcaaacctgtacaagtttactgctagtgcctcacatacagagagaaaactgaaacaggcaataaactattcaaaaagtttagacatggagaaaggagttgagaatgacctaagctatcagaatataggaggaaacaccaattggaagcctccgctcaactgtaagatttataactacctgaacaggattggatgcttcttccttcatcctcgctgtagtaaaagaaaagatgctgctgattttgccatatgtatgcatgctggccgtctagatgaacaactacccaagcaaattcctttcaccatcctctcaggagatcaaggttttctggagctagagaatcaatttaagaagactcagaggccagctcatatactaaaccctcaccacttagagggagatatgatgtgtgccttgttaaatagcatatctgataccaccaaagaatgtgacagtgatgataacatgggtgccaaaaatacttcaataggagaagaatttatatccacagaagatgtggaattagaagaagctattagaagaagtcttgaggaaatgtaattaaagatattaccacacaacatcaagtggccttgaagagactgagataacgaattcttgagtttgttttctaaaggagaccagaaatccactattacaaatgtatttgaaaacatgtttttgctttcatatgttcaaaatctgatctttgttttgtatttttgtgctaatgtgcaaacatgtacagaagaaatagaatacatgttcatgcaaatataaattatgtattctaatataggtgtaacagtttcccagttaactttgaatttatatatttagatttaaaggattaaaaaaaaggaaagctcttgacagttgtttcccaaatagcattagttctttaattttatttgtactgtacaaatgatgctagtttatttttttagcagtgaaaatgaatataaaaaaggtgacataggtcaagttttccataaattctacttctcatgtggcactattatataatacctttgagatctttgtttatgtttattagaagagggtaatggaaactgatcatggaaacatttaaaattttatcagcaatgttctttgtgggtgccatgcatatgtaaattattgctttaattagagcagcacattgctaaaataaaaaatacaccttaatttttaagaaataatttaaatgaaacaatttccattccttttacctgcttagacttttatgtgacttgtatggtctcctggttaaagggaatggtgtcagaatatttgcataaaattatttttcataacagtccttttttatatattggtgtaaacataatattcttcaagaaataatgttgaaagcctactcaggaataatcttccttaactctttaaatttttatttcatgtgaagtgttttcagtttagttattcactgaattgtcagtttccttcatttggtattacatatttaattcttaaatattgaggccccattgtgagtaataaaaaatacgacataagtagaagactaagaagggcttgtcatattatctttgtgtatatgcttcatgttatttaaccagaaatgtcttatctctaaaaatttttagtagtaattatttaccaaacttaaaaacatttctataaatataaagcttttctttatatttaagacaaaatataaaggctagaatttggttccttctctgtaacactaaatattttagtgtgaaattgaatttttttattactatagtcttttcaatctataatttgtgtttttaatttcttgatatgtcacttctgttcctccctgcttgcattttttaaaaactagacattgtggcttgagaatttatcaatcatctttccgaaatgaccacattgtgcttttagtttgtatgtttaagtggtcaagcaaggctctaggaggtagtcactgagctggaccttaaacacatctgcaggagctcacaaaatgggagcaaaagaggcattccagaaagaagagtagttaagcagatgtgggggcagggcaagaggagacagcaccttgttgccagagattctacacaaaggtgtgatggacactgatgctctattaagaagcttttgtggtgtgtgtggtagagaataattaaggcttctgataagacaggaaagggatatttcatcatgactgttaagaaaaggtaactgggttgtttaatgttttaattgataattgtcactgatcgtatttctacttgttaaataattaaaaatcatcttaaaattc

SEQ ID NO: 3118 - DNA, 5268 bp, Homo sapiens
atcctgcgcggcgcggggaaggaagcccgggagtgagagaaagcggctccgggggcatagcgggccagtaagggccgctcctcctttgaagaggttttgcgtctctttccgccggtggcgtcggcgctcacgcaggggcgggtcccggtagcgccaggcggtgcagggcgggaaggggattcgtggcgacggcggcggcagggacagcaggagcagtggtgctgtcagcgcggccgtcggagacatgggagacccggggtcggagataatagaatctgtccctccagctggccctgaggcatctgagtcaacaacggatgaaaatgaagacgacattcagtttgtcagtgaaggaccattacgacctgttcttgaatacattgatctggtcagcagtgatgatgaagagcctagcacctcttatactgatgagaatattaaacgtaaagaccatattgattatcagaaggataaagttgctttaactctggctcgtctagcccgccatgttgaagtggagaaacagcagaaagaagagaagaatagagcattcagagaaaaaattgattttcagcatgctcatgggttacaagaattggaatttattcgaggacattctgatacagaagcagcaagactgtgtgtggaccagtggctaaaaatgccaggactcaaaacaggcacaattaattgtggaacaaaaagttcattccgaagaggaggccacacgtgggtgtctgggaaaccaattttatgtcctataatgcactgtaacaaggagtttgacaatgggcaccttctcttaggacatttgaaaaggttcgatcactctccatgtgatccaacaattacactacatggacctttcttcagctcctttgcttgtgtagtatgttataaaaaatttgttactcaacaacaatatagagatcacctttttgataaggaagccacagatgatggacataacaacaaccttcttcctcagattattcagtgttttgcatgtccaaattgcttccttctttttagcagaaaggaggagtgttcaaagcatatgtctggaaagaatcatttccatcagagtttcaaactgggtgataacaaaggaattgcacatccaatatctttcccatcttttgcaaagaaacttttgatctctctgtgcaaagatgttccctttcaagttaagtgtgtggcctgccacaagacactgcgttcccacatggagctcactgcccatttcagagttcattgtcgaaatgctggacctgtagctgtagctgagaagagcattacccaggttgcagagaaattcatattaagaggttattgtccagattgcaatcaagtctttgtggatgaaaccagcacccaaaatcataagcagaattcaggacacaaagtccgagtcattaactcagtggaagaatcagtcttactctattgccacagcagcgaagggaacaaggatccttcttctgacttgcatttattgttggatcaatcaaaattttcatcacttaaaagaaccatgtctattaaagaatctagctcactggagtgcattgccattccaaaaaagaagatgaatttaaaagataaaagccatgaaggtgttgcttgtgtccagaaagaaaaatcagtagttaaaacctggttctgtgaatgcaatcagcgattcccaagtgaagatgcagtagaaaagcatgttttctcagcaaacacaatgggttataaatgtgtggtctgtggaaaggtatgtgatgattcaggggtcattcgtttacacatgagccggattcacggaggggcacatttaaataactttcttttctggtgtcggacatgcaaaaaggagttaacaaggaaagatactatcatggcacatgtgactgaatttcataatggacacagatatttttatgagatggatgaggtagaaggtgaaactttgccatcatcctctacaacattggataatttgactgctaacaagccttcatcagctattactgttattgatcattccccggcaaatagttctccgaggggtaaatggcaatgccggatttgtgaagatatgtttgattcccaggaatatgtaaaacagcactgcatgtctttggcaagccacaagtttcatagatacagctgtgctcactgcagaaagccttttcataagatagaaacattgtaccgacattgccaagatgagcatgacaatgagataaagattaaatacttctgtgggctttgtgatcttatctttaatgtggaagaagcatttctgagtcattatgaggagcaccacagcatagattatgtatttgtgtcagaaaaaactgaaacttcaattaaaaccgaagatgattttccagtaatagagaccagtaaccagttaacttgtggttgccgtgagagttacatctgtaaagtcaacagaaaagaagattatagcagatgtctccaaatcatgctggataaaggaaaactgtggtttcgctgcagtttatgttcggcaacagcacagaatttaaccgacatgaacactcatatccatcaagtgcacaaagaaaagagtgatgaggaggagcagcagtatgtaatcaagtgtggcacctgcaccaaagcatttcatgatcctgagagtgcacagcagcatttccatagaaaacattgcttcttacagaaacccagtgtggctcattttggatctgaaaaatcaaacctgtacaagtttactgctagtgcctcacatacagagagaaaactgaaacaggcaataaactattcaaaaagtttagacatggagaaaggagttgagaatgacctaagctatcagaatatagaggaagaaattgttgagcttccagatttggattacctgcgaaccatgactcatatagtctttgtagattttgataactggtcaaacttttttggtcatctaccagggcatctaaaccaaggaacatttatttggggctttcaaggaggaaacaccaattggaagcctccgctcaactgtaagatttataactacctgaacaggattggatgcttcttccttcatcctcgctgtagtaaaagaaaagatgctgctgattttgccatatgtatgcatgctggccgtctagatgaacaactacccaagcaaattcctttcaccatcctctcaggagatcaaggttttctggagctagagaatcaatttaagaagactcagaggccagctcatatactaaaccctcaccacttagagggagatatgatgtgtgccttgttaaatagcatatctgataccaccaaagaatgtgacagtgatgataacatgggtgccaaaaatacttcaataggagaagaatttatatccacagaagatgtggaattagaagaagctattagaagaagtcttgaggaaatgtaattaaagatattaccacacaacatcaagtggccttgaagagactgagataacgaattcttgagtttgttttctaaaggagaccagaaatccactattacaaatgtatttgaaaacatgtttttgctttcatatgttcaaaatctgatctttgttttgtatttttgtgctaatgtgcaaacatgtacagaagaaatagaatacatgttcatgcaaatataaattatgtattctaatataggtgtaacagtttcccagttaactttgaatttatatatttagatttaaaggattaaaaaaaaggaaagctcttgacagttgtttcccaaatagcattagttctttaattttatttgtactgtacaaatgatgctagtttatttttttagcagtgaaaatgaatataaaaaaggtgacataggtcaagttttccataaattctacttctcatgtggcactattatataatacctttgagatctttgtttatgtttattagaagagggtaatggaaactgatcatggaaacatttaaaattttatcagcaatgttctttgtgggtgccatgcatatgtaaattattgctttaattagagcagcacattgctaaaataaaaaatacaccttaatttttaagaaataatttaaatgaaacaatttccattccttttacctgcttagacttttatgtgacttgtatggtctcctggttaaagggaatggtgtcagaatatttgcataaaattatttttcataacagtccttttttatatattggtgtaaacataatattcttcaagaaataatgttgaaagcctactcaggaataatcttccttaactctttaaatttttatttcatgtgaagtgttttcagtttagttattcactgaattgtcagtttccttcatttggtattacatatttaattcttaaatattgaggccccattgtgagtaataaaaaatacgacataagtagaagactaagaagggcttgtcatattatctttgtgtatatgcttcatgttatttaaccagaaatgtcttatctctaaaaatttttagtagtaattatttaccaaacttaaaaacatttctataaatataaagcttttctttatatttaagacaaaatataaaggctagaatttggttccttctctgtaacactaaatattttagtgtgaaattgaatttttttattactatagtcttttcaatctataatttgtgtttttaatttcttgatatgtcacttctgttcctccctgcttgcattttttaaaaactagacattgtggcttgagaatttatcaatcatctttccgaaatgaccacattgtgcttttagtttgtatgtttaagtggtcaagcaaggctctaggaggtagtcactgagctggaccttaaacacatctgcaggagctcacaaaatgggagcaaaagaggcattccagaaagaagagtagttaagcagatgtgggggcagggcaagaggagacagcaccttgttgccagagattctacacaaaggtgtgatggacactgatgctctattaagaagcttttgtggtgtgtgtggtagagaataattaaggcttctgataagacaggaaagggatatttcatcatgactgttaagaaaaggtaactgggttgtttaatgttttaattgataattgtcactgatcgtatttctacttgttaaataattaaaaatcatcttaaaattcatactttgactttaatttagacacaaggagatgtaatcgctgtgtaacatcagagaaagctatatggattatcgtcagaagtaaatgtttctaacattgacaaaga

SEQ ID NO: 3119 - DNA, 9478 bp, Homo sapiens
agtaagggccgctcctcctttgaagaggttttgcgtctctttccgccggtggcgtcggcgctcacgcaggggcgggtcccggtagcgccaggcggtgcagggcgggaaggggattcgtggcgacggcggcggcagggacagcaggagcagtggtgctgtcagcgcggccgtcggagacatgggagacccggggtcggagataatagaatctgtccctccagctggccctgaggcatctgagtcaacaacggatgaaaatgaagacgacattcagtttgtcagtgaaggaccattacgacctgttcttgaatacattgatctggtcagcagtgatgatgaagagcctagcacctcttatactgatagaatgcctgaatctaaggtgccatcctctgagaatcatcgcccagaaatgtgctctagctgcaatgttcctcttcccattggagatagcagctccttctctgggagttgttccagcagtccagaaaggatagtttctcaaacttcctctgttgagaacccattggagaaccagaaaaatgatcaaaataattcagatactaagatctctgagacagagacccttaaatcatcacagaattttcagactctgccttcatctccacttctggtcccccaagaatctttggcctcttctgaggtcaaagagaatttacgtatagattcttcttcagcttcacagcatggacgggatgccatcctctatctccagacacaagtagctgaaatgtcccgagtgatacgtgatctgcagtccaggagctgttttagatttcatcattctaggccaagtgagaactcctcagttccttgggacatctccacctctaaagaggaaaatttatccacagttgaagaagaaactgattacaaatcaccatcagctgatgacaaagggcagccatctgaccccagccaatctagtttcacaggtcttttgaagagaatggaacaaagaggtgttataaaaagggtgacattacaatctgaagcggagtcatgtgaagggaaacctgattgtgtgacttctaaaaaacgtttggttcctccattgcatcctcttctgagaattgccaccactgaggtttttaaagaccctgctgattgccatccttcttccttcatgggacacagggtatatcctgtggccaaggacacctctcctttccaaccaaacccaccagctgaaggccccattgtagaagcattagaacacagcaaaagaggaaacacaacatcccctctagattctacctcaaaagaaatggaggtcatgggttgtaggttttaccacgctgcctccattgcagcccgagctgctagctacatggcctatatgactcaatatcagcgtaaactctgggaagacatggaagatctggttcatgacccagaatttgatcgtggaaaagcaagatgcataatatctgatggtatggatgcaggcctttggcaactttgtactactagggacataatggactctgtagtcagagttatggccatggccatagactatagacggcaggcctggcttcgacttacatctctcactaagaaaacccaggagaagatctcccacttgccctttgatggtacttccctttttggacaagatgtgaaagctgttgttgcagaagacaacaatataaaagaaaatgactataaagatcacaaatactataatcagcatcgatacttttatagtcatgatcagaaagcacattatcacaatagaggatactccaaaggggattggtacaaacctcgaaaccacccctatagatatagaaagaagggagactctccagaacgccatgggtacaagaattaataacctgtttaatgttcagcagagtagtcattcaagatcctaactattttacttgttcctccttgtacaaataggatctacaggtaggagatcatctcaaaaactggatgcatgtctggaatgatcacagctgacatttgaattctagacttttgaaatgaagtatataataaagaaactcatgacttattggccaagtgagcagtggagactttcttgaaagggttggacaaatgtttatcctttatttctggtccaaaaataagtgtggaggaggaccactcaggaatctgaatcctcttgtgattaaagaaaaatataaagatgtgttcctcaggaaaatcttatttgtaaactgaggactagcagattttgaatctagaaataatactagatgtctgtttactaagaccagaggtaaatccttaacttttaggttatcagtgcttccttgttcaggcttcagtttgacagatcttcacaaaatgacacatctgttaaaatgtctttatgtcaagatggtcaactcaccaagagtccgtactactatcaagctctgtgagacttcagaatcagccatgaagctttgtgtcaactggaattcaaatcaaattttgccaaatccagtttgcttccccttggaatggctagatgtcgcaggtctattatggacaccaactggaaaaagacttctacctgtaacatctctgtagaaattgcacagtaactatcttcatcaagactttgatggccaccataccatcactactcataaagctacatgtgagagaattgtttgttgttatcaatcctaatagtctttgacctatcaagctctcgtatcaagctgtaagactgagtcatggtagtctctcactgtaagctgggcctttcaccaagatggccttcttaaacaacctaccttctaaacatttaattcttttgagcttgatagtgcatcacactctaaatacaaaaaagatacgcacatcagtgccctggaaataaaggatgttacacgatccaggcatgcaaatctgaactcctaagaccaagaattccaaacatgcctgacaatcttgtccccttattgtaataaagagggataccatcagtctagattttattgagaatccttaagatttaaagcatagctgtggatgtggtgaagagaacaagccacacagctctgtttctggatatctaagtgatgatatccattaatgatttgaaaggctgaaatcaagatttaagtgatacgctcttggttaattggttacttaatttagtcagattcttagtgtaagagacagcttatctttttgctcccaattggtcccattaatagtttttcaccatactggaactggcagcagatacctcaattatatgtcccacagtatcttctctttagactcaaggtagtggatgtatggtatatcagcccttagatccatgtcttcacagcatgacatcaggaatggagaatatgtcaaatttgaggggtctgaatacatcacctagtattatttgcttggcagccaaaaacagttgtttttattgacagacttaattctgtaacttctgcgttttttcatctgcttgatcaaggcattttggatgtactgctaatggaatatggcactgttttacggtttatgtggcttctgttcttgccacagttgttgcacagtggtaattgatgttttctctggtgccacactttttaataatctattggaagctcattcctcctcccccatcataaccatattcagcacccatttttaaatctacttttcttccttatttgtgctacagaggttgatggcgtaaattttcctacttggaagaaattactttatcagttaatttcagggtactgtattgatcttgtttgtcctatttgtagattaaacttgaactagtcttaataaaggggatattgttttgcaaatttagcccagtcatatcaagagttaatatttatcttatttttctgtattttactcaaaattttatttccacttctgtagaaataggtccatgccagtgttctctacaaagtgtctttcaaactaaactctagaagaatatcgattacctgaacagaaacaaaggcctaagaaatcatacatttttgtagcttatgtgtattgcaccaatcaagcaatcccatgtgctcttgatattggcactgtagttttatcttagaggacttgccactggagaactcagtggtgagagaccttggaaatgttttatgtggctgcacataagtgtttctgactagctaaggctacttcagacttttcactttccatttgtccccttttccttccctgaattagatgctatgtcataaacttggtggtttttgaaatactcttatttcaaaccttaaactaaaccgaaataagttatgcctgagaatgcgtttgtctgaaacgattttggcacttccctttaatatgcttccccttccctttgccttttaaattgtggttaaaaaaaaagaaaaaaaaaggcacataaagctgagcaccttaaccattttttaagcgtatggtagtgttgactatatttgcattgttgcgcagctcctccattcttaaatatttgtaagatgatgttgctgttctcttttcctcctgtgatatttatgttgcccagtaataagtaaaagtatcctttcttagttactctaactgatatgcccaagtgtctccagatactctgttttcctggaagtgtaaaggtattgggaaattatcaaattggtgaccaagtagttctgaaaggatttgaccgtttaatagggatggggacagaatgcagatcaggaagagtttttagtaatagattagtttcttgattgcaaaagaaatatctttaatgtgttaattttttattattttaaaatctctggcatacttgaatgataatgttataaaacttaaagtgaggatttggtctagggagattaccccaatagaatcagaaactcttagtcagataataaatcctcatattatgcctgccatgttcagaacctgcaacaaaattccctactaggccaacctctaacgtttaaatacctctaggttttctaggaggccttggaatagttgcaagtttaatgatctggtattctcaaaaaggatgtatctaatgatcttgattcttcaaaatgttatttcttgattagatatacaatgtatatagagacaatatggtttcttgtagttactgtgtatagagaagtactgtttccatttttatatgaagtgcctttttaattctacacttttctttaaaacttaaactttgatgtcttgcatatattgctggtggtatttatgtgaattttgtacagtgatttaatcttgtagtttatcatttgtacaattgcactatctaaatgtactcccttctgaatgttaatttgttttctttatagcactgttgattcatttcagaaggttgtagagtatacctccctcccccttatttaactaactagacagtagttcctttttgttattagtgagtggctaattttggggggccttaaggcagctttgttttctatagatatgctctaggttttctgattgtctcgtatctaaccttgttcttagccatgataacacaacttatatttgataagtggatgtgtttacttggttagaataagcaaggacatttttaaaaagcagtaaatttgctgacacttttatctttttttaaaagaatgaatgacagcttccttatcagtataattacatttaaacttttttttttaaaccgtgtggcagcttctttatcaatcagtataattccatttatttacttagccctcaaaatgacattttgaagggagcataaactctttcaggctacttggacagtatttagtattctatattagtactacactaataatttactgagtgctacctaagtgacctgattgataatgtccttaaggacctgatacatccaggataacctctcaggtactgtaaacaaggaggttgaaaaagacacattccggaatccctttgtctggtaaaattggatactgatgtggatggacatgacattcattattcttgaagatataactagttgactgggattctgatgaaggtttgaaattatggattagatctttgtagaagtagtttaaagattgcaataagtgaaatcttttttttttttttttttttgagacagtttcgctcttgttgcccaggctggagtgcaatggcacgatcttggctgactgcaaccgccacctcccgggttcaagcaattctgtctcagcctcccgagtagctgggattacaggcatgtgtcaccatgacctgctaattttgtatttttagtagagacggggtctctccatgttggtcaggctggtctcaaactcctgacctcaagtgatccgcccgccttggcctcccaaagtgctgggattataggcgtgagccaccgcgcctggctgtgaaattttttttttttttttttttatgtgaggcatattttgccacagtctcgcactgtttaggttctcttgtcttttggaatctatcattctgtatttaatgttagtggctagtccaataattgattgtctcatctgtatgcatcttatgcatgtgattcaatagactagatcgattctgtgtggtttatcatagtagatacacaaaccagtctttattttttacttaagaaaatatataagtggaagttatcagtaaactggtgattattgtattgaatgcaaatctttttattatttttccagatatattgagttttataaaccattaaaatattattttatgaaatttcccttcctggatgaacagaatattgttttattaaatcttctcttattagtggaatattttttacttctttgtcttttcatttacttgttttttgttataatgaaaactttactagtgtttggtaccattgagataacttattactggaaattttgtttgcttcctgtgggatatatctggaagtggtcatagtccaaccatgtccttttgatgttgttagcatatcagttattctatgtattgatcttttcttctcctgtattcaacacctctttctgaaaggatgtctgatcttcccataatcgctttgatgtagatgatatttttattctatcagtgtatactagacaggattttgatgtggctttgtatttgtatatttaaataccatgtctttaaagcattattagaagagatattctagtttcttctaatgtcccttttaaaaaaaatatagccagtccaatatctcaaactactttgatttttgaacttaaatcaacttttagtgctaccttgtttaatggtagtagtattttctcatttctacatgttcacacaagtttattatatatagtttatggtcatatgtatcttataaaaattttgaagcccatccccatggatttattataatacagctctgatatatcttaaagttaacccgttttccgtagatgttaagggctttactggttgaggtaacctatttcaaatggtctgttgggttttgtggtaccttgtcaagaattcaataagaattctcaggctgtctgtattttcttttaggactttggagatctctcaagttgtactgttttctagtattcctgagtatattcctttggtaacgtgaaagtaaatagtttatatttgatgattttttttttttttttttgagacggagtcttgctctgtcacccaggctggagtacagtggtgagatcacggctcactgcaagctctgcctcccgggttcacgccattctcctgcctaagcctcctgagtagctgggactacaggcgcccgccaccacacccggcgaattttttgtatttttagtagagatggggtttcaccgtgttagtccaggtggtctcaatctcctgaaccttgtgatccacctaccttggcctcccaaagtgctgggattacaggcgtgagccacagtgcccggcctgtatttggtgatattttaaaaaattctactttgaccttaagtgcttcaagaattgtgttcagttagtagtccttttgtaagactaactttcatatgctatctttgctccatgagctatcatagtactgttttctttcattacccgtaagagtggctctatcacagcatttactgttaagggctacagttagacctcttgttaactctacttttatttgtgatggctgtgtttcacactaccttgatttataaatgtagtaatgtgttaaataactatatgttgtggtcccttaatacctcttttgattggtgaggtaacagtgatgtggatgatgaaataaaaacgtttccccaagtcactaaacacagttttcaattcatttttttttacatatttaatttacatctaactactgttaggtatgcagcccgttcctttttgccttcagtagaatatagttatataagtagtctcatttagattcttgggacagaacggcctgtgtattgatctttctttaatggcttggaacagcttctatatattctgacaggtcttggaagcatgttaatatccgtgtgtttaattgtcatcttcctgcctgggaaggcagtagaagaaagaatctacatttgtatagtctgtagtacaggctctgtgctgattgcaaggcactcttgagagaaattcattcttattttgcagaagaagaactgaaacttcattaagtcattaagcaacttgctcaggtggtggaactgagctttaaatatggactttttccagtctcaattcagcattatactaggctgcctccatgtgtttttcaaagccccattcaagttttacttctatggtaaactaattttacatacacaaatcttttcattttctgaacttcctttatggctttactgtcaccccactagtatttgatgtcttagctattaactaattcctgattatttcacttgtcacatcaggaaccctatcctcttagttctcccattgagatttcactgctggactaagattattcttgattcgtagtcattggtttctgtttccattcattttcagcactgattatgttaatcgtattgcttgagttttttctttgttcaatgttgtttattacattcattttgtttcatatacacacattttttttttttaactggcattttgaggatattggtttaatggaaggaaaaaggaatggtgcaaagcacatggtatttgaattccaaagaccttgaccctcagcattagcaagtcacttgttttctgagcctcagttttcttactctcaaatgaggtaatatccgaaagtactttgacaacacactaaagcctgatgcagatttcctttttgaagtaattgtgctgtttctattcatattggatatggtattctatggtattggctatagatacatacattttaaaatgttatttaacagcatgtaaatgttcatttcatgccatgtgatcatgttcccctttatgattttttaaggctgtcttacaagcctaacagtgtactaagtcattaaaagatatatttaaagtaaaa

SEQ ID NO: 3120 - DNA, 2332 bp, Homo sapiens
gcagttcggctcccggctgcagactccagctcattgtgttctgactgcgatgtggcgcttgcgatctctcgccgccggcagaggctcctcgaagagcgacacggggctgaccaggcacggtggtcaaagccgcagagggagagcgggagcggtcgtgaggtcgtctggggagaagggcggaggcaaagccgaggagcaggtgtgtggacccttctagcctgaggagtcctgcaggtgtgaagctccacacctgcctccatagcactttgcctgtccctaagagggctcatcggagaagaaagaatggctgtcagccacctgccaaccatggtccaggaatcggtgaccttcaaggatgtggctatactgttcacccaggaagagtgggggcagctgagccccgcccagagggccctgtacagggacgtgatgctggagaactacagcaacctggtctcactgggactcttaggacccaaaccagatacgttttcccagctagaaaaaagggaagtgtggatgccagaggacacccctggaggcttctgtcttgactggatgactatgcctgccagtaagaaatctactgtcaaggcagagattcctgaagaagaattggatcaatggacaataaaggaaagattcagtagcagtagtcactggaagtgtgctagcctgctggagtggcaatgtggaggccaggagatcagtttgcagcgagtggtactcactcaccccaacaccccatcacaggaatgtgatgaatccgggagcactatgagctcatctcttcacagtgatcaaagtcagggatttcaacctagcaaaaatgcctttgagtgtagtgagtgtggaaaagtcttctctaagagttcaactcttaataaacatcagaaaattcataatgaaaaaaatgcaaatcagaaaattcatattaaggagaaaagatatgaatgtagagaatgtgggaaagcctttcaccagagtacgcaccttatccatcaccaaagaattcacactggcgagaaaccctatgaatgtaaggaatgtggcaaggccttctcagtgagctcctcacttacgtaccatcagaaaattcatactggagagaagccttttgaatgcaacttatgtggaaaagcttttatccgaaatatacaccttgcccatcatcatagaatacatactggagagaaaccttttaaatgtaacatttgtgaaaaagcctttgtgtgcagggcacaccttaccaaacaccagaatatccacagtggagagaaaccctataaatgcaatgaatgtggaaaagcctttaatcagagtacaagtttccttcagcatcagagaattcacactggagagaaaccctttgaatgtaatgaatgtgggaaggccttcagggtgaactcttcccttactgaacatcagagaattcatactggagagaaaccttataaatgtaatgaatgtgggaaagctttcagggataattcatcctttgcacgacatcggaaaattcacactggagagaaaccttacagatgtggcttgtgtgagaaagcctttcgggaccaatcagcactagcccaacatcagagaattcatactggggaaaaaccttatacatgtaacatatgtgaaaaagccttcagtgaccattcagcccttacccaacataagagaattcatactagggaaaaaccttacaaatgtaaaatctgtgagaaagcctttatccgaagcactcacctgactcaacatcagaggattcacacaggagagaaaccctataaatgtaataaatgtgggaaagcttttaaccagactgcaaacctcattcagcatcagagacatcatattggagagaagtgatatgaatgcagtttgtatggaagacctttgagactgagtagatgaattattgaatgtgagataatccgttctagagaataactatgaaagcttgcatcaagatagtcactttatttactgagggtcaggtttcacagtgtcatggggtttgggcatttaagaatggcaaacactcggctgggcacagtggctcacgtctgtaatctttgggagcactttgggaggccgaggtgggcggatcacgaggtcaggagatcgagaccatcctggctaacagggtgaaaccccatcgctactaaaaatataaaaaattacccgggcatggtggtgggcgcctgtagtcccagctactcgggaggctgaggcaggagaatggcatgaacccgggaggcagaggttgcagtgagccgagatcgtgccactgcactccagcctgggcgacagagcaagactcagtctc

SEQ ID NO: 3121 - DNA, 2142 bp, Homo sapiens
attgtgttctgactgcgatgtggcgcttgcgatctctcgccgccggcagaggctcctcgaagagcgacacggggctgaccaggcacggtggtcaaagccgcagagggagagcgggagcggtcgtgaggtcgtctggggagaagggcggaggcaaagccgaggaggtgcgggttgtggtccattctggaggacgctgatcgaatgccccaaacttcccggaatcaggtgtgtggacccttctagcctgaggagtcctgcaggtgtgaagctccacacctgcctccatagcactttgcctgtccctaagagggctcatcggagaagaaagaatggctgtcagccacctgccaaccatggtccaggaatcggtgaccttcaaggatgtggctatactgttcacccaggaagagtgggggcagctgagccccgcccagagggccctgtacagggacgtgatgctggagaactacagcaacctggtctcactgggactcttaggacccaaaccagatacgttttcccagctagaaaaaagggaagtgtggatgccagaggacacccctggaggcttctgtcttgactggatgactatgcctgccagtaagaaatctactgtcaaggcagagattcctgaagaagaattggatcaatggacaataaaggaaagattcagtagcagtagtcactggaagtgtgctagcctgctggagtggcaatgtggaggccaggagatcagtttgcagcgagtggtactcactcaccccaacaccccatcacaggaatgtgatgaatccgggagcactatgagctcatctcttcacagtgatcaaagtcagggatttcaacctagcaaaaatgcctttgagtgtagtgagtgtggaaaagtcttctctaagagttcaactcttaataaacatcagaaaattcataatgaaaaaaatgcaaatcagaaaattcatattaaggagaaaagatatgaatgtagagaatgtgggaaagcctttcaccagagtacgcaccttatccatcaccaaagaattcacactggcgagaaaccctatgaatgtaaggaatgtggcaaggccttctcagtgagctcctcacttacgtaccatcagaaaattcatactggagagaagccttttgaatgcaacttatgtggaaaagcttttatccgaaatatacaccttgcccatcatcatagaatacatactggagagaaaccttttaaatgtaacatttgtgaaaaagcctttgtgtgcagggcacaccttaccaaacaccagaatatccacagtggagagaaaccctataaatgcaatgaatgtggaaaagcctttaatcagagtacaagtttccttcagcatcagagaattcacactggagagaaaccctttgaatgtaatgaatgtgggaaggccttcagggtgaactcttcccttactgaacatcagagaattcatactggagagaaaccttataaatgtaatgaatgtgggaaagctttcagggataattcatcctttgcacgacatcggaaaattcacactggagagaaaccttacagatgtggcttgtgtgagaaagcctttcgggaccaatcagcactagcccaacatcagagaattcatactggggaaaaaccttatacatgtaacatatgtgaaaaagccttcagtgaccattcagcccttacccaacataagagaattcatactagggaaaaaccttacaaatgtaaaatctgtgagaaagcctttatccgaagcactcacctgactcaacatcagaggattcacacaggagagaaaccctataaatgtaataaatgtgggaaagcttttaaccagactgcaaacctcattcagcatcagagacatcatattggagagaagtgatatgaatgcagtttgtatggaagacctttgagactgagtagatgaattattgaatgtgagataatccgttctagagaataactatgaaagcttgcatcaagatagtcactttatttactgagggtcaggtttcacagtgtcatggggtttgggcatttaagaatggcaaacactcggctgggcacagtggctcacgtctgtaatctttgggagcactttgggaggccgaggtgggcggatcacg

SEQ ID NO: 3122 - DNA, 10414 bp, Homo sapiens
ggagagggagggagggagagagagagagagggagagagacggatatctcaggtcatctgcagctgcagcgagtctgaggagccgaggaaggcagggaagatggcgatcctccattgctgagacccggcagaagcacatgagactcccaaacaacttccacaacaataacccgagcaggaagaggagaaagagaaagaggataaggaggcggtggggctggagaacccgaagcacctcccggcgccgggacgcttcttctgttcctaatgtgagaggctagacccagatcatggaggtgcttcagtgtgatggctgtgatttccgagccccgtcttatgaagatctcaaggcacacattcaggatgtccacacggcatttctgcagccaactgatgttgctgaggacaatgtgaatgagctacgatgtgggtccgtgaatgccagtaatcagacagaggtggagttttcttctataaaggatgaatttgccattgcagaagatttatcaggtcaaaatgcaacttcattggggaccggaggttactatggccacagtccaggatattatggtcagcatattgccgctaatcccaaaccaacaaacaagttttttcaatgcaagttctgtgtacgctacttcaggtcaaaaaacctcctcatagaacacactagaaaggtccatggagctcaagctgaagggagttcatcaggaccccctgtcccgggatccttaaattataatatcatgatgcacgagggatttggaaaggtcttctcttgccagttttgcacatacaagtcaccaagaagggcaagaataattaagcatcagaagatgtatcacaaaaacaatttgaaggagaccactgctcccccacctgctcctgctccaatgccagaccctgtggttccgcccgtatcactgcaggacccctgcaaggaactgccagcagaggttgtggagcgcagcatcttagagtctatggtcaagcctttgaccaaatctcgaggcaacttttgttgtgagtggtgcagctaccagaccccccgccgagaacgctggtgtgaccacatgatgaagaaacaccgcagtatggtcaagatcctttccagtctcagacagcaacaagaaggaactaatctacctgatgtgccgaacaagagtgcccccagccccacttccaactccacctatctgaccatgaatgctgcaagccgggagatacccaatactaccgtctccaacttcaggggctccatgggcaactccatcatgagacccaattcttcagcttccaagttttcgcccatgtcttaccctcagatgaagccgaagtcacctcacaattctggtctagttaacttgacagagagatcccgttatggaatgactgacatgaccaattcttctgctgacctggaaactaacagcatgctaaatgactctagttctgatgaagagttaaatgaaatagacagtgagaatggtttaagtgctatggatcaccagacatcaggcctgtctgcagagcagctgatgggctcagatggcaacaaattattggagaccaaggggattccatttagaagattcatgaataggttccagtgccccttttgtcctttcctcaccatgcatcgacgtagcatctctcgtcacatagaaaacatccacttatctggaaagacagctgtctacaaatgtgacgaatgtccgtttacttgcaagagctcgttgaaacttggggctcacaaacagtgtcacacgggtacaacgtcagattgggatgctgtgaattcccagagtgaaagcatttcttcctcactgaatgaaggtgtggtgtcttatgagagctcaagcatcaatggtagaaagtcaggagtcatgttggatcccttgcagcagcaacagccaccgcagccaccaccaccgccgccgccaccaccaccatcacagccacagccactgcagcagccacagccaccacagctgcagccaccacatcaggtgccaccccagccacaaacacagccaccaccaacgcagcagccacagccacccacacaagccgcacctctgcacccatacaaatgcaccatgtgtaattactccaccacaactctgaaagggctaagagtccatcagcagcataaacattcattctgtgacaacttgccaaaattcgaggggcagccctcaagcctaccattggaaaatgagacagacagccacccctcttccagcaacactgtgaagaaaagtcagacctcaattcttgggttgtcctccaagaacaattttgtagctaaagcctctaggaagctcgccaatgactttcctctagatttgtcacccgtgaagaagagaaccaggattgacgagatagcaagcaaccttcagagcaaaattaaccaaaccaaacagcaggaagatgcagtgatcaatgttgaggatgatgaagaggaagaggaagacaacgaagtcgagatagaggttgagttggacagggaggaagaaccgacagaacccatcatagaggttcccacttccttttctgcccaacagatatgggtaagagataccagtgagccccagaaagagcccaacttcagaaacatcacccacgattacaatgccaccaatggggctgagattgagctcaccctttctgaagatgaagaggattattatggctcctcaacaaacttgaaagatcaccaagtttccaatactgctctgctgaatacccaaactcccatctatgggactgagcacaatagtgaaaacacagactttggtgactctggaaggctttactattgtaaacactgtgactttaacaacaaatctgcccggagtgttagcacccactaccaacgaatgcacccatacattaaattcagctttaggtacatcttggaccccaatgatcacagtgcagtgtacaggtgcctggaatgctacatcgattacaccaacttcgaagatctccagcagcattatggcgagcaccacccagaagccatgaatgtactcaactttgatcactcggacctgatctaccggtgtcggttttgttcatacacgagcccgaatgttagaagcctgatgccacattaccaaagaatgcatcccacggtgaagatcaacaacgcgatgatattttcaagctatgtcgtggagcagcaggaagggctgaatacagaatcccagaccctgagggagattctgaattcggctcccaagaacatggcgacttccacacctgtggctcgtggtggtggtttgccagctacgttcaacaaaaacactcctaagacctttactcctgaatgtgaaaatcagaaggaccctttggtcaacactgttgttgtttatgattgtgatgtttgttcgtttgcaagccccaacatgcattctgtcttggttcattatcagaagaaacaccccgaagaaaaggcttcctactttaggatccagaaaactatgcgaatggtgtctgtggacaggggctctgccctttctcaattatcatttgaggtgggtgctccaatgtctcccaaaatgtccaacatgggttccccaccccccccacaacccccgccaccagacctcagtactgagctttactactgcaaacactgttcctacagcaatcggtcagttgtgggagtgcttgtccactaccagaaaagacacccagaaataaaggttactgccaaatatatcagacaggctcctcccacagctgcaatgatgagaggggtcgaagggccccaaggctccccccggccacccgcccccatacaacagctgaaccgaagcagctctgagagagatggccctcctgtggagaatgagatgttcttttgccagcactgtgattatgggaaccggacggtcaaaggggtactcattcattatcagaagaagcaccgagacttcaaggccaatgcagatgtgatccggcagcatacggccaccattcgaagcctctgcgaccgaaatcagaagaagcctgccagctgcgtgcttgtctccccctctaatctggagcgggacaaaacgaaactccgagcactcaaatgtaggcagtgctcatatacctccccctacttctatgcactgaggaagcatatcaagaaagaccaccccgccctgaaagccacagtcacgtccatcatgcgatgggcatttctagatggcttgatagaagctggctaccactgcgagtggtgcatctactcccatacggagcccaacggtttgctcctgcattaccaacggaggcatccagaacactatgttgattacacctacatggctactaaactgtgggctgggccagacccatcccctccctctctcacaatgccagccgaagccaaaacctacagatgcagggactgtgttttcgaagctgtttccatctgggacatcactaatcactaccaagcattccacccctgggccatgaatggtgatgagtcagtgctactggacatcatcaaggagaaagatgctgtggagaagcccattctttcatccgaagagttggcaggccctgtgaattgtgaaaacagtatacccacccctttcccggagcaggaagctgaatgtccagaggatgcaagactgtcccctgagaaaagcctgcagctagcttcagccaaccccgccatatcctccaccccataccagtgcacggtatgccaatctgagtataacaacttgcacggccttctcactcattatgggaagaagcaccctggcatgaaagtgaaggctgctgactttgcccaggacattgacatcaacccaggtgccgtctacaaatgcaggcattgcccatacatcaacacccgcatccacggcgtactgacccactaccagaagcgacacccgtccatcaaggtgaccgctgaggactttgtgcacgacgtagagcagtctgctgacatatcccagaatgacgtggaggagacgagcaggatcttcaagcaagggtatggcgcctaccggtgcaaactgtgtccgtacacacacggcactttggagaaactaaaaatccactacgagaagtatcacaatcagcctgaatttgatgtcttttcccagtcgcccccgaagctgccagtccccctcgagcccgagatgaccactgaagtgagcccttcccaagtctccatcactgaggaggaggtgggagaggagcccgtgtccacttctcacttctctacctcccacctggtctcccacactgtgttccggtgccagctctgcaagtacttctgctccacgaggaaggggatcgccaggcactaccgcatcaagcacaataatgtccgagcccagccagaaggcaagaacaacctcttcaagtgtgccctgtgtgcctacaccaaccccatccgcaaaggtctggcagcccactaccagaagcgccacgacattgatgcgtattacactcactgcttggcagcctccaggaccatcagcgacaagcccaacaaagtgatcatcccatccccgcccaaggacgactcccctcagctgagcgaggaactccggcgggcagtggagaagaaaaagtgctccttgtgctctttccagtcgttcagcaagaagggcatcgtgtcccattacatgaaacgccacccaggggtgttcccaaagaagcagcacgccagcaagttggggggctacttcacggccgtctatgcagatgagcatgagaagcccacactgatggaagaagaggagagaggcaactttgagaaagccgaggtggagggtgaagctcaggaaatcgagtggctcccattccgctgcatcaaatgcttcaagctgtcctttagcactgcagagctgctgtgcatgcattacactgaccaccacagtcgggacctaaagagggacttcatcattctgggcaacggcccccgcttgcagaactccacctaccagtgtaagcactgtgatagcaaactgcaaagcacagccgagctgacctcacacttgaacattcacaatgaggaattccagaagcgtgccaaacgtcaggagaggaggaaacagcttttgagcaagcagaaatatgcagatggtgcttttgcagatttcaaacaagagaggccttttggtcacttagaagaggtgccaaagatcaaggagaggaaagtggtgggctacaaatgtaaattctgtgtggaagtgcacccaacgctccgagccatctgcaatcacctccgaaagcacgtccagtatggcaatgtcccagctgtgtcagctgctgtgaaggggctgcgttctcatgagaggagccacctggccctggccatgtttacccgcgaggacaagtacagctgccagtattgctcgtttgtttctgctttcaggcacaatttggatcgccatatgcaaacccaccacggacaccataaaccattccgatgcaaactctgctccttcaagtcctcctataacagccggctgaaaacacatatactcaaagctcatgctggtgagcatgcctacaagtgttcttggtgctcattctccaccatgacaatcagccagctgaaggaacactccctcaaggtccacggaaaagccctgaccctccccaggccacggatcgtcagtctcctctcctcacactcccaccactcctcccaaaaagctaccccggctgaagaagtggaagactccaatgactcatcatattcagagcccccagatgttcagcagcagttgaaccactatcagtcagctgccctggcaaggaacaacagccgtgttagccctgtgcctctttctggggctgctgctggcactgagcagaaaactgaagccgtgcttcactgcgaattctgtgaattctcctccggctacatccagagcatcaggcgtcattaccgggacaagcatggtgggaagaagcttttcaagtgcaaagactgctccttttacacaggctttaaatctgcttttactatgcacgtggaagctgggcactcagcagttcccgaggagggccccaaagatcttcgctgtcctctctgcctctatcacaccaaatacaagcgcaacatgattgaccacatcgtgctgcaccgagaagagcgtgttgtccccattgaagtttgccggtccaaactgtccaaatacttgcagggagtagttttccgctgtgataagtgtaccttcacctgctccagtgatgagagcctccagcaacatatagaaaagcacaatgaactgaaaccttacaaatgccagctctgctactatgagaccaagcacacggaggaactggacagccaccttcgggatgagcataaggtaagccgtaactttgagctggttggacgggttaacttggatcagctggaacagatgaaggagaaaatggagagctccagcagcgatgatgaggacaaggaagaagaaatgaacagcaaggctgaagacagagagctgatgagattttctgaccacggggctgctcttaacactgagaagcgttttccatgtgaattttgtggacgggcgttttcacagggctctgagtgggaaagacatgtgctgagacacggcatggcattgaatgacaccaagcaggtgagcagagaagaaatccacccaaaagagatcatggagaacagtgttaaaatgccctccatagaggaaaaggaagatgacgaggccattgggatagacttttccctaaagaatgaaacagtagccatctgtgtagtaactgccgacaaatctctcctggagaatgcagaggccaaaaaagaatgagcgtttggtgaaattcttaatcaaaccttacttgaacagtgatgaaaaagtgggagggctggcttgggctgagaagggagggacagaaaagagaagacagaacaaagctgctttttaggactgaacaatctattttcaaagcactggtacctgtgtgagtgagtatgtaaattaaagttatttaaatggttggaatatgtggctccttttccatcactacatcttttcttccggatcttcatcatggaagtttcatttgttgcggaatatggaagcacctcccaatggtacggtgcaccctgtggtggtcttggacagtatgtggaaacagaagctccatgacggtagaagacttctcattggggagcaactttttgacgcacaacttttggtgcgtttttctagttttaataccttaagctttttcaagacctaactgcagccgctttgggaaaaaaaaacaaaaaacaaaaaacagaaaacaaaaaaaaaaaaactgctttgcataaaacagtcacctgtttcctagtacctcaaacttaaccaagggaactctctgcatttgtcagtactacctgtcgtcgttgtggttaaatgtagagagaactgctgggcaagatggtgaatggagaaaaaaaaagagttttaaagaaaggaacacaaattgtgcttaaaatccccatgtgggttttatttcttaaaatactgtgatttttttaattattttagtaaaaaacaaaacaaaaaaaagaaacagactttaattattagataactgtttgtgaattgtcatcctttattccaggtaagctgtttattagtgttcaactataatttagaatttggtagattcatgtgagctaattttaaggtgattgtggagttttgtttgccacatgtttattttctatcaatttgagtgttacaaacacagcacaattcagtttttcatatgaattgtttttcgtgtgtgtgttgttattgttgttttaatttcggggcaagggagatttagttttttgtgaataggaatgtttttattttaaacatggaaataacaaagaagttaactttcttttttttttttttttttttttttaatttaactaaagaaccaaactttcggcacagctatgcagcttgtgggccagacgaggaggtcctcctcacccttttgttgcctgtcaaattcacgcattatccgtctcataaataatttctgttaggattggctggcttttgtgtgtgattttaaaatctgtgttttgtttctgctggcattgtgttttgttgggggttttcatttatttaggggacgaggggatgtactagaatcccatccctttcgtgagagtggacaagaaataacatatcctacaaggagcctggagaactactttctttctttctttttttttttttttttttttttttaaatctagctgccagctgctctgtcccccatatcagctttttcaggagggagcagcttagactaaatctaagcctacatttataatatgttctgattgtgaacaaagggtttcgttccaaaaaatagaaaagaacttttcttgaagcctaggttttagaagcccgtgtgtgtgtgtgcttggatgtgtgtgtgcgtgtatgagtgtgtgtgtgcatgtgtgcacgtgtgaatcctttggttttcatgtttttttttttttttttttacttggaagggttgtgggagggtgggagggaagaaagggaaggggaattgctgagatgacagtgtcccacacagcttcaaataaaatccatggaaagatgttgcatttgtggaataagtgcttacttgaaaagcatgttcttcttttattttcttactgttaagaatttttatttgtaggatgtttgttttaatttaatttttttaagggatgggggccatcatgtggaaaccagaaaatggggaaagtgtgaactatccagacaaagattcattttgtgtctatatttgtttttaattggcctcatttcaaatgtattaaacagttccatacctggattgggtgtttgtaatggttaccaaaaaacaaacaaaaaaagaaagaaaaaggaaaaaaaaaaagaaaataattgtgacatgcttttatcactactttatttttcaaataacatgtaaatattgtaatccattggattttgttttgctaacctgttaataaaaatatgggaccattatccttttaacaaggctagaatgtcatttttttctttttcaaacatatacctgatattttgtggccgcacattttggatgcattattataattctgttgactgtaatgacatagaatttacaacattttttgttgttgtttaatttatacagaggacatttttttcagagcttgagagaagaaaataaatagcaaaatgataacctattgactccagtaatcagtgtttcccaatacttcataagagatagggagaccctgagtccttgaagccaagggtttaaaaacaaaacaaaaacaaaaaaaaccacaagtaggttattcaagttgtttgcaacatacattttgtaatgaaatgtgagaaattaataaagaatttttttcacatgtg

SEQ ID NO: 3123 - DNA, 1233 bp, Homo sapiens
ggaacactccctcaaggtccacggaaaagccctgaccctccccaggccacggatcgtcagtctcctctcctcacactcccaccactcctcccaaaaagctaccccggctgaagaagtggaagactccaatgactcatcatattcagagcccccagatgttcagcagcagttgaaccactatcagtcagctgccctggcaaggaacaacagccgtgttagccctgtgcctctttctggggctgctgctggcactgagcagaaaactgaagccgtgcttcactgcgaattctgtgaattctcctccggctacatccagagcatcaggcgtcattaccgggacaagcatggtgggaagaagcttttcaagtgcaaagactgctccttttacacaggctttaaatctgcttttactatgcacgtggaagctgggcactcagcagttcccgaggagggccccaaagatcttcgctgtcctctctgcctctatcacaccaaatacaagcgcaacatgattgaccacatcgtgctgcaccgaggtaacctttctaacttggttttcttggatgcagcggggggcaggcagcagagatggccttctagggatgctctctcagagtggcagtagcacctgtgccttgttcctcaccttatcttcaggcaagaaaccacagtgataaccacagtgacagccaaaagggcaaaaacaccttcctgctgggagtatttcctccacctggagggaggcaaaggtgatggattctgcagtgaacatttccgtagggcttcccagcatgggggatttgtacattctgacaattctgccacccacagccttgcgtagactgcatagaaggaatgaacaagaaacaaaatgggtgggtgaaagcaaatgtgaaatgtggagagctctatggctgtgagagattctttcaagaagaccaaaatgatttccaaagcagaacatggaacttcccttgaaatggttgaagggagagagaattctttaaaataatgtatattatacattctaataatagtctctattatatattctaataataattagaaaatccatgggctttggatttaaattctggttttagagcccactgtgtttaacctctccatccattaaaagagatgattgtacctatgagataatgggtaaagtgtccagtggtttttcataatggatgcataatgactgctcaataaatgttggttcctgctgat

SEQ ID NO: 3124 - DNA, 8442 bp, Homo sapiens
ggagagggagggagggagagagagagagagggagagagacggatatctcaggtcatctgcagctgcagcgagtctgaggagccgaggaaggcagggaagatggcgatcctccattgctgagacccggcagaagcacatgagactcccaaacaacttccacaacaataacccgagcaggaagaggagaaagagaaagaggataaggaggcggtggggctggagaacccgaagcacctcccggcgccgggacgcttcttctgttcctaatgtgagaggctagacccagatcatggaggtgcttcagtgtgatggctgtgatttccgagccccgtcttatgaagatctcaaggcacacattcaggatgtccacacggcatttctgcagccaactgatgttgctgaggacaatgtgaatgagctacgatgtgggtccgtgaatgccagtaatcagacagaggtggagttttcttctataaaggatgaatttgccattgcagaagatttatcaggtcaaaatgcaacttcattggggaccggaggttactatggccacagtccaggatattatggtcagcatattgccgctaatcccaaaccaacaaacaagttttttcaatgcaagttctgtgtacgctacttcaggtcaaaaaacctcctcatagaacacactagaaaggtccatggagctcaagctgaagggagttcatcaggaccccctgtcccgggatccttaaattataatatcatgatgcacgagggatttggaaaggtcttctcttgccagttttgcacatacaagtcaccaagaagggcaagaataattaagcatcagaagatgtatcacaaaaacaatttgaaggagaccactgctcccccacctgctcctgctccaatgccagaccctgtggttccgcccgtatcactgcaggacccctgcaaggaactgccagcagaggttgtggagcgcagcatcttagagtctatggtcaagcctttgaccaaatctcgaggcaacttttgttgtgagtggtgcagctaccagaccccccgccgagaacgctggtgtgaccacatgatgaagaaacaccgcagtatggtcaagatcctttccagtctcagacagcaacaagaaggaactaatctacctgatgtgccgaacaagagtgcccccagccccacttccaactccacctatctgaccatgaatgctgcaagccgggagatacccaatactaccgtctccaacttcaggggctccatgggcaactccatcatgagacccaattcttcagcttccaagttttcgcccatgtcttaccctcagatgaagccgaagtcacctcacaattctggtctagttaacttgacagagagatcccgttatggaatgactgacatgaccaattcttctgctgacctggaaactaacagcatgctaaatgactctagttctgatgaagagttaaatgaaatagacagtgagaatggtttaagtgctatggatcaccagacatcaggcctgtctgcagagcagctgatgggctcagatggcaacaaattattggagaccaaggggattccatttagaagattcatgaataggttccagtgccccttttgtcctttcctcaccatgcatcgacgtagcatctctcgtcacatagaaaacatccacttatctggaaagacagctgtctacaaatgtgacgaatgtccgtttacttgcaagagctcgttgaaacttggggctcacaaacagtgtcacacgggtacaacgtcagattgggatgctgtgaattcccagagtgaaagcatttcttcctcactgaatgaaggtgtggtgtcttatgagagctcaagcatcaatggtagaaagtcaggagtcatgttggatcccttgcagcagcaacagccaccgcagccaccaccaccgccgccgccaccaccaccatcacagccacagccactgcagcagccacagccaccacagctgcagccaccacatcaggtgccaccccagccacaaacacagccaccaccaacgcagcagccacagccacccacacaagccgcacctctgcacccatacaaatgcaccatgtgtaattactccaccacaactctgaaagggctaagagtccatcagcagcataaacattcattctgtgacaacttgccaaaattcgaggggcagccctcaagcctaccattggaaaatgagacagacagccacccctcttccagcaacactgtgaagaaaagtcagacctcaattcttgggttgtcctccaagaacaattttgtagctaaagcctctaggaagctcgccaatgactttcctctagatttgtcacccgtgaagaagagaaccaggattgacgagatagcaagcaaccttcagagcaaaattaaccaaaccaaacagcaggaagatgcagtgatcaatgttgaggatgatgaagaggaagaggaagacaacgaagtcgagatagaggttgagttggacagggaggaagaaccgacagaacccatcatagaggttcccacttccttttctgcccaacagatatgggtaagagataccagtgagccccagaaagagcccaacttcagaaacatcacccacgattacaatgccaccaatggggctgagattgagctcaccctttctgaagatgaagaggattattatggctcctcaacaaacttgaaagatcaccaagtttccaatactgctctgctgaatacccaaactcccatctatgggactgagcacaatagtgaaaacacagactttggtgactctggaaggctttactattgtaaacactgtgactttaacaacaaatctgcccggagtgttagcacccactaccaacgaatgcacccatacattaaattcagctttaggtacatcttggaccccaatgatcacagtgcagtgtacaggtgcctggaatgctacatcgattacaccaacttcgaagatctccagcagcattatggcgagcaccacccagaagccatgaatgtactcaactttgatcactcggacctgatctaccggtgtcggttttgttcatacacgagcccgaatgttagaagcctgatgccacattaccaaagaatgcatcccacggtgaagatcaacaacgcgatgatattttcaagctatgtcgtggagcagcaggaagggctgaatacagaatcccagaccctgagggagattctgaattcggctcccaagaacatggcgacttccacacctgtggctcgtggtggtggtttgccagctacgttcaacaaaaacactcctaagacctttactcctgaatgtgaaaatcagaaggaccctttggtcaacactgttgttgtttatgattgtgatgtttgttcgtttgcaagccccaacatgcattctgtcttggttcattatcagaagaaacaccccgaagaaaaggcttcctactttaggatccagaaaactatgcgaatggtgtctgtggacaggggctctgccctttctcaattatcatttgaggtgggtgctccaatgtctcccaaaatgtccaacatgggttccccaccccccccacaacccccgccaccagacctcagtactgagctttactactgcaaacactgttcctacagcaatcggtcagttgtgggagtgcttgtccactaccagaaaagacacccagaaataaaggttactgccaaatatatcagacaggctcctcccacagctgcaatgatgagaggggtcgaagggccccaaggctccccccggccacccgcccccatacaacagctgaaccgaagcagctctgagagagatggccctcctgtggagaatgagatgttcttttgccagcactgtgattatgggaaccggacggtcaaaggggtactcattcattatcagaagaagcaccgagacttcaaggccaatgcagatgtgatccggcagcatacggccaccattcgaagcctctgcgaccgaaatcagaagaagcctgccagctgcgtgcttgtctccccctctaatctggagcgggacaaaacgaaactccgagcactcaaatgtaggcagtgctcatatacctccccctacttctatgcactgaggaagcatatcaagaaagaccaccccgccctgaaagccacagtcacgtccatcatgcgatgggcatttctagatggcttgatagaagctggctaccactgcgagtggtgcatctactcccatacggagcccaacggtttgctcctgcattaccaacggaggcatccagaacactatgttgattacacctacatggctactaaactgtgggctgggccagacccatcccctccctctctcacaatgccagccgaagccaaaacctacagatgcagggactgtgttttcgaagctgtttccatctgggacatcactaatcactaccaagcattccacccctgggccatgaatggtgatgagtcagtgctactggacatcatcaaggagaaagatgctgtggagaagcccattctttcatccgaagagttggcaggccctgtgaattgtgaaaacagtatacccacccctttcccggagcaggaagctgaatgtccagaggatgcaagactgtcccctgagaaaagcctgcagctagcttcagccaaccccgccatatcctccaccccataccagtgcacggtatgccaatctgagtataacaacttgcacggccttctcactcattatgggaagaagcaccctggcatgaaagtgaaggctgctgactttgcccaggacattgacatcaacccaggtgccgtctacaaatgcaggcattgcccatacatcaacacccgcatccacggcgtactgacccactaccagaagcgacacccgtccatcaaggtgaccgctgaggactttgtgcacgacgtagagcagtctgctgacatatcccagaatgacgtggaggagacgagcaggatcttcaagcaagggtatggcgcctaccggtgcaaactgtgtccgtacacacacggcactttggagaaactaaaaatccactacgagaagtatcacaatcagcctgaatttgatgtcttttcccagtcgcccccgaagctgccagtccccctcgagcccgagatgaccactgaagtgagcccttcccaagtctccatcactgaggaggaggtgggagaggagcccgtgtccacttctcacttctctacctcccacctggtctcccacactgtgttccggtgccagctctgcaagtacttctgctccacgaggaaggggatcgccaggcactaccgcatcaagcacaataatgtccgagcccagccagaaggcaagaacaacctcttcaagtgtgccctgtgtgcctacaccaaccccatccgcaaaggtctggcagcccactaccagaagcgccacgacattgatgcgtattacactcactgcttggcagcctccaggaccatcagcgacaagcccaacaaagtgatcatcccatccccgcccaaggacgactcccctcagctgagcgaggaactccggcgggcagtggagaagaaaaagtgctccttgtgctctttccagtcgttcagcaagaagggcatcgtgtcccattacatgaaacgccacccaggggtgttcccaaagaagcagcacgccagcaagttggggggctacttcacggccgtctatgcagatgagcatgagaagcccacactgatggaagaagaggagagaggcaactttgagaaagccgaggtggagggtgaagctcaggaaatcgagtggctcccattccgctgcatcaaatgcttcaagctgtcctttagcactgcagagctgctgtgcatgcattacactgaccaccacagtcgggacctaaagagggacttcatcattctgggcaacggcccccgcttgcagaactccacctaccagtgtaagcactgtgatagcaaactgcaaagcacagccgagctgacctcacacttgaacattcacaatgaggaattccagaagcgtgccaaacgtcaggagaggaggaaacagcttttgagcaagcagaaatatgcagatggtgcttttgcagatttcaaacaagagaggccttttggtcacttagaagaggtgccaaagatcaaggagaggaaagtggtgggctacaaatgtaaattctgtgtggaagtgcacccaacgctccgagccatctgcaatcacctccgaaagcacgtccagtatggcaatgtcccagctgtgtcagctgctgtgaaggaggcggatgaccctgcccacttgttcctggatggattggaagcagccaaagacgccagtggcgccctggtgggccgggtggatggtgaacactgcttgcttgatggaatgttggaggatgaaacccggccggggggataccattgcagtcaatgtgacagagtcctgatgtccatgcaggggctgcgttctcatgagaggagccacctggccctggccatgtttacccgcgaggacaagtacagctgccagtattgctcgtttgtttctgctttcaggcacaatttggatcgccatatgcaaacccaccacggacaccataaaccattccgatgcaaactctgctccttcaagtcctcctataacagccggctgaaaacacatatactcaaagctcatgctggtgagcatgcctacaagtgttcttggtgctcattctccaccatgacaatcagccagctgaaggaacactccctcaaggtccacggaaaagccctgaccctccccaggccacggatcgtcagtctcctctcctcacactcccaccactcctcccaaaaagctaccccggctgaagaagtggaagactccaatgactcatcatattcagagcccccagatgttcagcagcagttgaaccactatcagtcagctgccctggcaaggaacaacagccgtgttagccctgtgcctctttctggggctgctgctggcactgagcagaaaactgaagccgtgcttcactgcgaattctgtgaattctcctccggctacatccagagcatcaggcgtcattaccgggacaagcatggtgggaagaagcttttcaagtgcaaagactgctccttttacacaggctttaaatctgcttttactatgcacgtggaagctgggcactcagcagttcccgaggagggccccaaagatcttcgctgtcctctctgcctctatcacaccaaatacaagcgcaacatgattgaccacatcgtgctgcaccgagaagagcgtgttgtccccattgaagtttgccggtccaaactgtccaaatacttgcagggagtagttttccgctgtgataagtgtaccttcacctgctccagtgatgagagcctccagcaacatatagaaaagcacaatgaactgaaaccttacaaatgccagctctgctactatgagaccaagcacacggaggaactggacagccaccttcgggatgagcataaggtaagccgtaactttgagctggttggacgggttaacttggatcagctggaacagatgaaggagaaaatggagagctccagcagcgatgatgaggacaaggaagaagaaatgaacagcaaggctgaagacagagagctgatgagattttctgaccacggggctgctcttaacactgagaagcgttttccatgtgaattttgtggacgggcgttttcacagggctctgagtgggaaagacatgtgctgagacacggcatggcattgaatgacaccaagcaggtgagcagagaagaaatccacccaaaagagatcatggagaacagtgttaaaatgccctccatagaggaaaaggaagatgacgaggccattgggatagacttttccctaaagaatgaaacagtagccatctgtgtagtaactgccgacaaatctctcctggagaatgcagaggccaaaaaagaatgagcgtttggtgaaattcttaatcaaaccttacttgaacagtgatgaaaaagtgggagggctggcttgggctgagaagggagggacagaaaagagaagacagaacaaagctgctttttaggactgaacaatctattttcaaagcactggtacctgtgtgagtgagtatgtaaattaaagttatttaaatggttggaatatgtggctccttttccatcactacatcttttcttccggatcttcatcatggaagtttcatttgttgcggaatatggaagcacctcccaatggtacggtgcaccctgtggtggtcttggacagtatgtggaaacagaagctccatgacggtagaagacttctcattggggagcaactttttgacgcacaacttttggtgcgtttttctagttttaataccttaagctttttcaagacctaactgcagccgctttggg

SEQ ID NO: 3125 - DNA, 1771 bp, Homo sapiens
gagtaagaaggccccactcatggttcacacctgctgctatgttacctggagcctcagtcaccttttctgtaaaatggggctgagaacaggagattgatcggatggcgttagatttggcaaatgcaggcattttaaaaatgagaattggaggaattgctatgatttacccaaagtttggatcgccatatgcaaacccaccacggacaccataaaccattccgatgcaaactctgctccttcaagtcctcctataacagccggctgaaaacacatatactcaaagctcatgctggtgagcatgcctacaagtgttcttggtgctcattctccaccatgacaatcagccagctgaaggaacactccctcaaggtccacggaaaagccctgaccctccccaggccacggatcgtcagtctcctctcctcacactcccaccactcctcccaaaaagctaccccggctgaagaagtggaagactccaatgactcatcatattcagagcccccagatgttcagcagcagttgaaccactatcagtcagctgccctggcaaggaacaacagccgtgttagccctgtgcctctttctggggctgctgctggcactgagcagaaaactgaagccgtgcttcactgcgaattctgtgaattctcctccggctacatccagagcatcaggcgtcattaccgggacaagcatggtgggaagaagcttttcaagtgcaaagactgctccttttacacaggctttaaatctgcttttactatgcacgtggaagctgggcactcagcagttcccgaggagggccccaaagatcttcgctgtcctctctgcctctatcacaccaaatacaagcgcaacatgattgaccacatcgtgctgcaccgagaagagcgtgttgtccccattgaagtttgccggtccaaactgtccaaatacttgcagggagtagttttccgctgtgataagtgtaccttcacctgctccagtgatgagagcctccagcaacatatagaaaagcacaatgaactgaaaccttacaaatgccagctctgctactatgagaccaagcacacggaggaactggacagccaccttcgggatgagcataaggtaagccgtaactttgagctggttggacgggttaacttggatcagctggaacagatgaaggagaaaatggagagctccagcagcgatgatgaggacaaggaagaagaaatgaacagcaaggctgaagacagagagctgatgagattttctgaccacggggctgctcttaacactgagaagcgttttccatgtgaattttgtggacgggcgttttcacagggctctgagtgggaaagacatgtgctgagacacggcatggcattgaatgacaccaagcaggtgagcagagaagaaatccacccaaaagagatcatggagaacagtgttaaaatgccctccatagaggaaaaggaagatgacgaggccattgggatagacttttccctaaagaatgaaacagtagccatctgtgtagtaactgccgacaaatctctcctggagaatgcagaggccaaaaaagaatgagcgtttggtgaaattcttaatcaaaccttacttgaacagtgatgaaaaagtgggagggctggcttgggctgagaagggagggacagaaaagagaagacagaacaaagctgctttttaggactgaacaatctattttcaaagcactggtacctgtgtgagtgagtatgtaaattaaagttatttaaatggttgg

SEQ ID NO: 3126 - DNA, 3912 bp, Homo sapiens
ggtttctgtcctgcgcgcgcagattcgcgcagaccaggaagtggatcccgtggaatgacggtcacgccgcggcgggcggattgacttctaaagactgttggtacgtgagaaagaaacccagaagaggaagaggaaagcaaaggagtcagggatggctcttcctcagggtctattgacattcagggacgtggccatagaattctctcaggaggagtggaaatgcctggaccctgctcagaggactttatacagggacgtgatgctggagaattataggaacctcgtctccctggatatctcttccaaatgcatgttgaagacgttgtcgtcaacagggcaaggcaatacagaagtgatccacacagggacattgcacagacaagcaagtcatcacattggagaattttgtttccatgaaattgagaaagacattcatggcttcgagtttcagtggaaagaagatgaaacaaatggccatgcagcacccatgacagaaatcaaagagttggctggtagtacaggccaacatgatcaaaggcatgctggaaacaagcgtattaaagatcagcttggatcaagctttcatttgcatctgcctgaaccgcacatatttcagtctgaagggaaaattggtaatcaagttgagaagtctatcaacaatgcttcctcagtttcaacatcccaaagaatttgttgtaggcccaaaacccatatttctaataagtatggaaataattccctccattcttcattactcacacaaaaatgggaagtacacatgagagaaaaatcttttgaatgtatacagagcttcaaatcctttaattgcagctcactcttaaaaaaacatcagataattcacttagaagagaaacaatgtaaatgtgatgtatgtggcaaggtctttaatcagaagcgataccttgcctgccatcgtagatgtcacactggtgagaaaccttacaagtgtaatgagtgtggcaagacctttggtcataattcatccctcttcattcacaaagcgcttcatactggagagaaaccttatgaatgtgaagaatgtgacaaagttttcagtcgcaaatcacaccttgaaagacataagaggattcatactggagagaaaccatacaaatgtaaggtttgtgatgaggctttcgcatataattcatatctggcaaaacatactatacttcacactggagagaaaccttacacatgtaatgaatgtggcaaagtttttaatcgactatcaacccttgcacgccatcatagacttcatactggagagaaaccttacaaatgtgaagagtgtgacaaagttttcagtcgcaaatcacaccttgaaagacataggaggattcatagtggagagaaaccttacaaatgtgaagaatgttgcaaagttttcagtcgcaaatcaaacctggaaagacacaggaggattcatactggagagaaaccatacaaatgtaaggtttgtgacaaggctttccagagggattcacacctggcacaacatcagagagttcatactggagagaaaccttacaagtgtaatgagtgtggcaagaccttcggtcagacatcatcgcttataatccatcgtaggcttcatactggagagaaaccttacaagtgtaatgagtgtggcaagaccttcagtcagatgtcatcccttgtataccatcataggcttcatagtggagagaagccttaatagtgtaatgagtgtggcaagaccttccatcacaattcaaccctgtaagtcataaggcaattcatactggagagaaaccttacaagcataatgaatgtggcaaggtttttaatcaaaaagcaacctttgcacatcaccatagacttcatactggagagaaaccttacaaatgggaggaatgtgacaaaagttttcagttgtaaatcaaaccttaaaacacataagaaaattcacattgaagagaaaccatacagaggtaaggtttgtgacaaggtttttgcatataatgcatatctggcaaaacatactagaattcacactggagagaaactcattataagtgtaatgagtgtggcaagaccgttggtcaaaattcacaccttgtaattaaaaggtcaaaattcacaccttgtaattcatagtggagagaaaccttacaagcacaatgaatgtgacatggtttttaatcaacaatcacaccttgcaagtcatcatagacttcatactgcatagaaatcttacaaacgtgaacaatgtgacaaagttttcattcacaaatccagcttcaaatacataggagaattcacactggagaaaagccatagaaatgtaaggtttgtgacaaggctttcgggaatgattcacacgtggcaccccatactagaattcacactggagagaaaccttacaagtgcaatgagtgtggcaaaccctttagtgggcagtcaccacttattcaccatcaagcaatccatggtatagggaaacttgactaatgtaatgattgtcacaaagttttcagtaatgctacaaccattgcacatcattggagaatccacagtgaagagatcttacaagtgtaataaatgtggcaaatttttcagacatcgttcatgccttgcatttcactggtgaactcatgctggagagaaaccttataaatgtcatgattgaggcaaggtcttcagtcaagcttcatcctatgcaaaacataggaggattcatacaggagagaaacctcacaagtgtgatgattgtggcaaagcgtttacttcacattcacacctcattagacatcagagaatccatgctggacagaaatcttacaaatgtcatcagtgtggaagggtcttcagtccaaggtcactccttgcagaccatcagacaattccttttggagacagttgtttcaaatgcagtgagtatagcaaaccatcaagcattaattgacattagagtcaaatcagccttgacctgagtttgttgatttaacattgatttcaagcattaattgccattaaactgtttatgttaagaggattgcactgggggccatggctcatgcctgtaattccagcactttgagaggcaaagacaggtaggtcactggagctcacgagtttgagaacagcctagccaacagatgggagctacttttcccagcctttattttctttttcttgttttttttttgagatggagtcttgctctgtcgcccaggttggagtgcagtggcacgatctcagctcactgcaacctcctcctcccaggttcaagcaattctcctgcctcagtctcccaagtagctgacactacagttgtgtgccaccacacctgggtaattttttgtgtttttagtagagactgggtttcaccgtgttagccagaatggtctctatcttctgactttatgatccacccgactccacctcccaaagtgctgagattacaggagtgagccactgtgcctggcctgttttttgtttctttaacaaaaagttatagagacttctatgagtattgtaccgaatctaaatcacaattgagtatataatcattgagcgatattcatttttccaatcagtatgggatttatatctatttatacatgtttttaatcattttgatcaatgtttatagatttcaaggtacaaacctcactttttatgtttattcctaaatatttcttactttaagttctttagcaaatggaattggtttttaattttcttttaaaattatttattgttaatgtatggaaattcaactaatttttggtgctgttattctattctgcaaataaactgaatgtgtttgttagttccagttgcattttggctgactctttgtgattttctttacagaaggtcatgtcatctacaaacaaataaaatttgacttctttctttctg

SEQ ID NO: 3127 - DNA, 3912 bp, Homo sapiens; identical to SEQ ID NO: 3126

SEQ ID NO: 3128 - DNA, 651 bp, Homo sapiens
gtctttaatcagaagcgataccttgcctgccatcgtagatgtcacactggtgagaaaccttacaagtgtaatgagtgtggcaagacctttggtcataattcatccctcttcattcacaaagcgcttcatactggagagaaaccttatgaatgtgaagaatgtgacaaagttttcagtcgcaaatcacaccttgaaagacataagaggattcatactggagagaaaccatacaaatgtaaggtttgtgatgaggctttcgcatataattcatatctggcaaaacatactatacttcacactggagagaaaccttacacatgtaatgaatgtggcaaagtttttaatcgactatcaacccttgcacgccatcatagacttcatactggagagaaaccttacaaatgtgaagagtgtgacaaagttttcagtcgcaaatcacaccttgaaagacataggaggattgtggagagaaaccttacaaatgtgaagaatgttgcaaagttttcatcgcaaatcaaacctggaaagacacaggagttcatactggagagaaaccatacaaatgtaaggtttgtgacaaggctttccagagggattcacacctggcacaacatcagagagttcatactggagagaaaccttacaagtgta

SEQ ID NO: 3129 - DNA, 4030 bp, Homo sapiens
ggtttctgtcctgcgcgcgcagattcgcgcagaccaggaagtggatcccgtggaatgacggtcacgccgcggcgggcggattgacttctaaagactgttggtacgtgagaaagaaacccagaagaggaagaggaaagcaaaggagtcagggatggctcttcctcagggtctattgacattcagggacgtggccatagaattctctcaggaggagtggaaatgcctggaccctgctcagaggactttatacagggacgtgatgctggagaattataggaacctcgtctccctggagttttggtctgtcatcccggctaaagtacagtggtgtcatctccgctcactgcaacctccacttcccaggttcaagcaattctcctgcctcagccttccaagtacctgggactacagatatctcttccaaatgcatgttgaagacgttgtcgtcaacagggcaaggcaatacagaagtgatccacacagggacattgcacagacaagcaagtcatcacattggagaattttgtttccatgaaattgagaaagacattcatggcttcgagtttcagtggaaagaagatgaaacaaatggccatgcagcacccatgacagaaatcaaagagttggctggtagtacaggccaacatgatcaaaggcatgctggaaacaagcgtattaaagatcagcttggatcaagctttcatttgcatctgcctgaaccgcacatatttcagtctgaagggaaaattggtaatcaagttgagaagtctatcaacaatgcttcctcagtttcaacatcccaaagaatttgttgtaggcccaaaacccatatttctaataagtatggaaataattccctccattcttcattactcacacaaaaatgggaagtacacatgagagaaaaatcttttgaatgtatacagagcttcaaatcctttaattgcagctcactcttaaaaaaacatcagataattcacttagaagagaaacaatgtaaatgtgatgtatgtggcaaggtctttaatcagaagcgataccttgcctgccatcgtagatgtcacactggtgagaaaccttacaagtgtaatgagtgtggcaagacctttggtcataattcatccctcttcattcacaaagcgcttcatactggagagaaaccttatgaatgtgaagaatgtgacaaagttttcagtcgcaaatcacaccttgaaagacataagaggattcatactggagagaaaccatacaaatgtaaggtttgtgatgaggctttcgcatataattcatatctggcaaaacatactatacttcacactggagagaaaccttacacatgtaatgaatgtggcaaagtttttaatcgactatcaacccttgcacgccatcatagacttcatactggagagaaaccttacaaatgtgaagagtgtgacaaagttttcagtcgcaaatcacaccttgaaagacataggaggattcatagtggagagaaaccttacaaatgtgaagaatgttgcaaagttttcagtcgcaaatcaaacctggaaagacacaggaggattcatactggagagaaaccatacaaatgtaaggtttgtgacaaggctttccagagggattcacacctggcacaacatcagagagttcatactggagagaaaccttacaagtgtaatgagtgtggcaagaccttcggtcagacatcatcgcttataatccatcgtaggcttcatactggagagaaaccttacaagtgtaatgagtgtggcaagaccttcagtcagatgtcatcccttgtataccatcataggcttcatagtggagagaagccttaatagtgtaatgagtgtggcaagaccttccatcacaattcaaccctgtaagtcataaggcaattcatactggagagaaaccttacaagcataatgaatgtggcaaggtttttaatcaaaaagcaacctttgcacatcaccatagacttcatactggagagaaaccttacaaatgggaggaatgtgacaaaagttttcagttgtaaatcaaaccttaaaacacataagaaaattcacattgaagagaaaccatacagaggtaaggtttgtgacaaggtttttgcatataatgcatatctggcaaaacatactagaattcacactggagagaaactcattataagtgtaatgagtgtggcaagaccgttggtcaaaattcacaccttgtaattaaaaggtcaaaattcacaccttgtaattcatagtggagagaaaccttacaagcacaatgaatgtgacatggtttttaatcaacaatcacaccttgcaagtcatcatagacttcatactgcatagaaatcttacaaacgtgaacaatgtgacaaagttttcattcacaaatccagcttcaaatacataggagaattcacactggagaaaagccatagaaatgtaaggtttgtgacaaggctttcgggaatgattcacacgtggcaccccatactagaattcacactggagagaaaccttacaagtgcaatgagtgtggcaaaccctttagtgggcagtcaccacttattcaccatcaagcaatccatggtatagggaaacttgactaatgtaatgattgtcacaaagttttcagtaatgctacaaccattgcacatcattggagaatccacagtgaagagatcttacaagtgtaataaatgtggcaaatttttcagacatcgttcatgccttgcatttcactggtgaactcatgctggagagaaaccttataaatgtcatgattgaggcaaggtcttcagtcaagcttcatcctatgcaaaacataggaggattcatacaggagagaaacctcacaagtgtgatgattgtggcaaagcgtttacttcacattcacacctcattagacatcagagaatccatgctggacagaaatcttacaaatgtcatcagtgtggaagggtcttcagtccaaggtcactccttgcagaccatcagacaattccttttggagacagttgtttcaaatgcagtgagtatagcaaaccatcaagcattaattgacattagagtcaaatcagccttgacctgagtttgttgatttaacattgatttcaagcattaattgccattaaactgtttatgttaagaggattgcactgggggccatggctcatgcctgtaattccagcactttgagaggcaaagacaggtaggtcactggagctcacgagtttgagaacagcctagccaacagatgggagctacttttcccagcctttattttctttttcttgttttttttttgagatggagtcttgctctgtcgcccaggttggagtgcagtggcacgatctcagctcactgcaacctcctcctcccaggttcaagcaattctcctgcctcagtctcccaagtagctgacactacagttgtgtgccaccacacctgggtaattttttgtgtttttagtagagactgggtttcaccgtgttagccagaatggtctctatcttctgactttatgatccacccgactccacctcccaaagtgctgagattacaggagtgagccactgtgcctggcctgttttttgtttctttaacaaaaagttatagagacttctatgagtattgtaccgaatctaaatcacaattgagtatataatcattgagcgatattcatttttccaatcagtatgggatttatatctatttatacatgtttttaatcattttgatcaatgtttatagatttcaaggtacaaacctcactttttatgtttattcctaaatatttcttactttaagttctttagcaaatggaattggtttttaattttcttttaaaattatttattgttaatgtatggaaattcaactaatttttggtgctgttattctattctgcaaataaactgaatgtgtttgttagttccagttgcattttggctgactctttgtgattttctttacagaaggtcatgtcatctacaaacaaataaaatttgacttctttctttctg

SEQ ID NO: 3130 - DNA, 4407 bp, Homo sapiens
agaccaggaagtggatcccgtggaatgacggtcacgccgcggcgggcggattgacttctaaagactgttggtacgtgagaaagaaacccagaagaggaagaggaaagcaaaggagtcagggatggctcttcctcagggtctattgacattcagggacgtggccatagaattctctcaggaggagtggaaatgcctggaccctgctcagaggactttatacagggacgtgatgctggagaattataggaacctcgtctccctggatatctcttccaaatgcatgttgaagacgttgtcgtcaacagggcaaggcaatacagaagtgatccacacagggacattgcacagacaagcaagtcatcacattggagaattttgtttccatgaaattgagaaagacattcatggcttcgagtttcagtggaaagaagatgaaacaaatggccatgcagcacccatgacagaaatcaaagagttggctggtagtacaggccaacatgatcaaaggcatgctggaaacaagcgtattaaagatcagcttggatcaagctttcatttgcatctgcctgaaccgcacatatttcagtctgaagggaaaattggtaatcaagttgagaagtctatcaacaatgcttcctcagtttcaacatcccaaagaatttgttgtaggcccaaaacccatatttctaataagtatggaaataattccctccattcttcattactcacacaaaaatgggaagtacacatgagagaaaaatcttttgaatgtatacagagcttcaaatcctttaattgcagctcactcttaaaaaaacatcagataattcacttagaagagaaacaatgtaaatgtgatgtatgtggcaaggtctttaatcagaagcgataccttgcctgccatcgtagatgtcacactggtgagaaaccttacaagtgtaatgagtgtggcaagacctttggtcataattcatccctcttcattcacaaagcgcttcatactggagagaaaccttatgaatgtgaagaatgtgacaaagttttcagtcgcaaatcacaccttgaaagacataagaggattcatactggagagaaaccatacaaatgtaaggtttgtgatgaggctttcgcatataattcatatctggcaaaacatactatacttcacactggagagaaaccttacacatgtaatgaatgtggcaaagtttttaatcgactatcaacccttgcacgccatcatagacttcatactggagagaaaccttacaaatgtgaagagtgtgacaaagttttcagtcgcaaatcacaccttgaaagacataggaggattcatagtggagagaaaccttacaaatgtgaagaatgttgcaaagttttcagtcgcaaatcaaacctggaaagacacaggaggattcatactggagagaaaccatacaaatgtaaggtttgtgacaaggctttccagagggattcacacctggcacaacatcagagagttcatactggagagaaaccttacaagtgtaatgagtgtggcaagaccttcggtcagacatcatcgcttataatccatcgtaggcttcatactggagagaaaccttacaagtgtaatgagtgtggcaagaccttcagtcagatgtcatcccttgtataccatcataggcttcatagtggagagaagccttaatagtgtaatgagtgtggcaagaccttccatcacaattcaaccctgtaagtcataaggcaattcatactggagagaaaccttacaagcataatgaatgtggcaaggtttttaatcaaaaagcaacctttgcacatcaccatagacttcatactggagagaaaccttacaaatgggaggaatgtgacaaaagttttcagttgtaaatcaaaccttaaaacacataagaaaattcacattgaagagaaaccatacagaggtaaggtttgtgacaaggtttttgcatataatgcatatctggcaaaacatactagaattcacactggagagaaactcattataagtgtaatgagtgtggcaagaccgttggtcaaaattcacaccttgtaattaaaaggtcaaaattcacaccttgtaattcatagtggagagaaaccttacaagcacaatgaatgtgacatggtttttaatcaacaatcacaccttgcaagtcatcatagacttcatactgcatagaaatcttacaaacgtgaacaatgtgacaaagttttcattcacaaatccagcttcaaatacataggagaattcacactggagaaaagccatagaaatgtaaggtttgtgacaaggctttcgggaatgattcacacgtggcaccccatactagaattcacactggagagaaaccttacaagtgcaatgagtgtggcaaaccctttagtgggcagtcaccacttattcaccatcaagcaatccatggtatagggaaacttgactaatgtaatgattgtcacaaagttttcagtaatgctacaaccattgcacatcattggagaatccacagtgaagagatcttacaagtgtaataaatgtggcaaatttttcagacatcgttcatgccttgcatttcactggtgaactcatgctggagagaaaccttataaatgtcatgattgaggcaaggtcttcagtcaagcttcatcctatgcaaaacataggaggattcatacaggagagaaacctcacaagtgtgatgattgtggcaaagcgtttacttcacattcacacctcattagacatcagagaatccatgctggacagaaatcttacaaatgtcatcagtgtggaagggtcttcagtccaaggtcactccttgcagaccatcagacaattccttttggagacagttgtttcaaatgcagtgagtatagcaaaccatcaagcattaattgacattagagtcaaatcagccttgacctgagtttgttgatttaacattgatttcaagcattaattgccattaaactgtttatgttaagaggattgcactgggggccatggctcatgcctgtaattccagcactttgagaggcaaagacaggtaggtcactggagctcacgagtttgagaacagcctagccaacagatgggagctacttttcccagcctttattttctttttcttgttttttttttgagatggagtcttgctctgtcgcccaggttggagtgcagtggcacgatctcagctcactgcaacctcctcctcccaggttcaagcaattctcctgcctcagtctcccaagtagctgacactacagttgtgtgccaccacacctgggtaattttttgtgtttttagtagagactgggtttcaccgtgttagccagaatggtctctatcttctgactttatgatccacccgactccacctcccaaagtgctgagattacaggagtgagccactgtgcctggcctgttttttgtttctttaacaaaaagttatagagacttctatgagtattgtaccgaatctaaatcacaattgagtatataatcattgagcgatattcatttttccaatcagtatgggatttatatctatttatacatgtttttaatcattttgatcaatgtttatagatttcaaggtacaaacctcactttttatgtttattcctaaatatttcttactttaagttctttagcaaatggaattggtttttaattttcttttaaaattatttattgttaatgtatggaaattcaactaatttttggtgctgttattctattctgcaaataaactgaatgtgtttgttagttccagttgcattttggctgactctttgtgattttctttacagaaggtcatgtcatctacaaacaaataaaatttgacttctttctttctgatttggatgagtttgatttcttttgctatttcattgttctggctaggacagccagtattgattgaatagaaggggtgagagcattcttgcatcatgtgagatcctacaggaaaagcattccgttttccctgattggttatttctgctgtggtcatttcatggatggtctttgtattgctgaggtaaattttcttctgtatctattttgtgtgggatttctatgatgacttgatgttgacttttgtgaaatgctttttctccatgtattgagatgatgtggttttcatctttcattgtgttcaagtggtatatcacattgatttgcttgactatgttgaaccatccttgcatcccagaaataagtggcacttgcatatctacaatccttttaatatcctcttgaatacagttcgctagtacaaggggtcttcaagaagttcatgaaaaaaatacatattatgtgaaaattgcacatgatgtcacattttctgcaccaaaataaactggcacaaatctgttataaca

SEQ ID NO: 3131 - DNA, 2825 bp, Homo sapiens
gggaggtctgggcggggcagcggccgaggctggactggggcgcggcgggggcggtgtcctggttcctgtgtgggcggcgggcgtgagcgtgcgcgtgtggcctggtggctgtgagtgcccatacgtggtgagcgtgcggtgctgtgctgaggaggggcgagcgcgcgcggggatggcggcccggtgtgtgactgtccggtgcgtggccgcgaatctgcgcctgcgtgcatggcccggcggcgtgcggaaggcggtgtgtgttggaatgagtgaagcactttaagtggccaagagcaggaaacccggccggaggaggcttaccccgttctcccctgtatcgactgcgtagagcccagtgtgggcaaagtcctagagcccggggaagttgcccgggcggggcagcctcggctgaagcatttcctgtcagccctatctggaaggggcagagcccaggacagggctccatgtccacaggacggcgaggagcgaagaccatggggactgagtacacagatgaagacacagaagcatagagaggataagtaatcactagcaagtggaagaaccgggattcagatccagaacaggctgactccagagtcactggctgtcatgtagtttcctcaactactgcctcagctctacaatcccagagtaaagctcttctccaaatgaagagccaggaagaggtagaggtggcaggaattaaactttgtaaagccatgtccctgggttcagtgactttcacagatgtggccatagacttttcccaagatgaatgggagtggctgaatcttgctcagagaagtttgtacaagaaggtgatgttagaaaactacaggaacctagtttcagtgggtctttgcatttctaaaccagatgtgatctccttactggagcaagagaaagacccttgggtgataaaaggagggatgaacagaggcctgtgcccagacttggagtgtgtgtgggtgaccaaatcattatctttaaaccaggatatttatgaagaaaaattacccccggcaatcataatggaaagacttaaaagctatgaccttgaatgttcaacattagggaaaaactggaaatgtgaagacttgtttgagagggagcttgtaaaccagaagacacattttaggcaagagaccatcactcatatagatactcttattgaaaaaagagatcactctaacaaatctgggacagtttttcatctgaatacattatcttatataaaacagatttttcccatggaagagagaatatttaattttcatacagataagaaaagcttaaaaacacattcagttgtgaaaaaacacaagcaagaccgtggagaaaagaaacttttaaaatgtaatgactgtgagaaaatattcagcaaaatctcaacccttactcttcaccaaagaattcatacaggagagaaaccctatgaatgtattgaatgtggaaaggcctttagccagagtgcccaccttgctcaacatcagagaatacacacaggagaaaaaccttttgaatgtactgaatgtgggaaagccttcagccagaatgctcatcttgttcaacaccagagagttcatactggagagaaaccttatcagtgtaagcagtgtaataaagcattcagccagcttgcacaccttgctcaacatcagagggtccacactggagagaaaccctatgaatgtattgaatgtgggaaggcttttagtgattgctcatccctagctcatcatcgaaggattcacactgggaaaagaccttatgaatgtattgactgtgggaaagctttcaggcagaatgcttctcttatacgtcatcggcgatattatcatactggagagaaaccctttgactgtattgattgtgggaaggctttcactgatcacataggacttattcagcataagagaactcatactggagagagaccttacaaatgtaatgtgtgtgggaaggcttttagccatggctcatctctgacagtacatcagagaattcatacaggagagaaaccttatgaatgcaatatctgtgagaaagccttcagccatcgtgggtctcttactcttcatcagagagttcatactggagagaaaccctatgaatgtaaagaatgtgggaaagctttccggcagagcacgcatctggctcatcatcagagaattcatactggagagaaaccttatgaatgtaaggaatgcagcaaaaccttcagccagaatgcacacctcgcgcaacatcagaaaatacacactggggagaaaccttatgaatgtaaggaatgtggtaaggccttcagtcagattgcacaccttgttcagcaccagagagttcatactggtgagaagccttacgaatgtattgaatgtgggaaggcctttagtgatggctcatatcttgttcaacatcagagactccacagtggcaaaagaccgtatgaatgtcttgaatgtgggaaggcattcaggcagagggcatccttgatttgtcatcagagatgtcatactggtgagaaaccttatgaatgtaatgtttgtgggaaagcctttagccatcgtaaatcccttactctgcatcagagaattcatacaggagagaaaccttatgagtgtaaggaatgtagcaaagccttcagccaggttgcccatcttactctacataagagaattcatactggagaaaggccctatgagtgtaaagaatgtggaaaagccttcaggcagagtgtacatcttgctcatcatcagcgaattcataccggagagtcatcagttattctctcctctgccctcccataccaccaagtcctatag

SEQ ID NO: 3132 - DNA, 7141 bp, Homo sapiens
gagaagggaggtctgggcggggcagcggccgaggctggactggggcgcggcgggggcggtgtcctggttcctgtgtgggcggcgggcgtgagcgtgcgcgtgtggcctggtggctgtgagtgcccatacgtggtgagcgtgcggtgctgtgctgaggaggggcgagcgcgcgcggggatggcggcccggtgtgtgactgtccggtgcgtggccgcgaatctgcgcctgcgtgcatggcccggcggcgtgcggaaggcggtgtgtgttggaatgagtgaagcactttaagtggccaagagcaggaaacccggccggaggaggcttaccccgttctcccctgtatcgactgcgtagagcccagtgtgggcaaagtcctagagcccggggaagttgcccgggcggggcagcctcggctgaagcatttcctgtcagccctatctggaaggggcagagcccaggacagggctccatgtccacaggacggcgaggagcgaagaccatggggactgagtacacaggtaagagtgacagatgacggatagtgaggactgtgagtgaggacagaagaagctgaagggaagaaagcattttcagactttgattattagtgctacttggtttctcactacttctttttctccccagctctacaatcccagagtaaagctcttctccaaatgaagagccaggaagaggtagaggtggcaggaattaaactttgtaaagccatgtccctgggttcagtgactttcacagatgtggccatagacttttcccaagatgaatgggagtggctgaatcttgctcagagaagtttgtacaagaaggtgatgttagaaaactacaggaacctagtttcagtgggtctttgcatttctaaaccagatgtgatctccttactggagcaagagaaagacccttgggtgataaaaggagggatgaacagaggcctgtgcccagacttggagtgtgtgtgggtgaccaaatcattatctttaaaccaggatatttatgaagaaaaattacccccggcaatcataatggaaagacttaaaagctatgaccttgaatgttcaacattagggaaaaactggaaatgtgaagacttgtttgagagggagcttgtaaaccagaagacacattttaggcaagagaccatcactcatatagatactcttattgaaaaaagagatcactctaacaaatctgggacagtttttcatctgaatacattatcttatataaaacagatttttcccatggaagagagaatatttaattttcatacagataagaaaagcttaaaaacacattcagttgtgaaaaaacacaagcaagaccgtggagaaaagaaacttttaaaatgtaatgactgtgagaaaatattcagcaaaatctcaacccttactcttcaccaaagaattcatacaggagagaaaccctatgaatgtattgaatgtggaaaggcctttagccagagtgcccaccttgctcaacatcagagaatacacacaggagaaaaaccttttgaatgtactgaatgtgggaaagccttcagccagaatgctcatcttgttcaacaccagagagttcatactggagagaaaccttatcagtgtaagcagtgtaataaagcattcagccagcttgcacaccttgctcaacatcagagggtccacactggagagaaaccctatgaatgtattgaatgtgggaaggcttttagtgattgctcatccctagctcatcatcgaaggattcacactgggaaaagaccttatgaatgtattgactgtgggaaagctttcaggcagaatgcttctcttatacgtcatcggcgatattatcatactggagagaaaccctttgactgtattgattgtgggaaggctttcactgatcacataggacttattcagcataagagaactcatactggagagagaccttacaaatgtaatgtgtgtgggaaggcttttagccatggctcatctctgacagtacatcagagaattcatacaggagagaaaccttatgaatgcaatatctgtgagaaagccttcagccatcgtgggtctcttactcttcatcagagagttcatactggagagaaaccctatgaatgtaaagaatgtgggaaagctttccggcagagcacgcatctggctcatcatcagagaattcatactggagagaaaccttatgaatgtaaggaatgcagcaaaaccttcagccagaatgcacacctcgcgcaacatcagaaaatacacactggggagaaaccttatgaatgtaaggaatgtggtaaggccttcagtcagattgcacaccttgttcagcaccagagagttcatactggtgagaagccttacgaatgtattgaatgtgggaaggcctttagtgatggctcatatcttgttcaacatcagagactccacagtggcaaaagaccgtatgaatgtcttgaatgtgggaaggcattcaggcagagggcatccttgatttgtcatcagagatgtcatactggtgagaaaccttatgaatgtaatgtttgtgggaaagcctttagccatcgtaaatcccttactctgcatcagagaattcatacaggagagaaaccttatgagtgtaaggaatgtagcaaagccttcagccaggttgcccatcttactctacataagagaattcatactggagaaaggccctatgagtgtaaagaatgtggaaaagccttcaggcagagtgtacatcttgctcatcatcagcgaattcataccggagagtcatcagttattctctcctctgccctcccataccaccaagtcctatagattcaatctcgtaaatgcttctagcatccatctgcttttttccagcacatgtcccatcatcatagtccaagacgcaaccatctcatctggatttctgcagtagcataactgttgccccttttgcttctatcaactacatgtttaacactgtaggcagcctaaccttttaaaaataaaaatacataatttatgttattttcccatttaaaacacttgatttgaaaaatatattaactaatccatttcaaggatttagcacacactggcatatagttattgctaaataaatgctagccattaaggtaaaggtttccttacaaactatcatattaagcagcaagtaaaccaaacagtaagtctaagactaagattttagagcagacagaagactactctcctggtagagaggaaagatgaacaaactcagaattgaaagatttatggtacacaaggtaacatggtggcttatcactccctctgtgacattgttgatgagcaactctcactttacctgacactgagaagtgagaatcagccaattagaacaaaagcttttagctgggtgcggtggctcatgcctgtagtcccagcactttgggaggctgaggcaggcagattgcttgagctcaggagttcgagaccaacctgagcaacatggtgaaaccctgtctctacaaaaaatacagaaattagccaggcgtggtggtgcacacctgtagtcctagctactcaggaggctgaagcaggaggattgcttgagcccaggaggtagaggttgcagtgagtcatgatcacaccactgcaattccagctgggcagcagagccagacactgtctcaaggaaaaacaaagaacaaaagcatttggtagaatgtaggactaaccagggtaggtagtagtaaaccaaaagtaacaagccaaaaaaacttgaatagattaatagccatgaaacactgaaaagggtagttcaatactttggcctttataaaagtaccacagacaattcgtgtggtatttaaattgttctagcataaaataaaatgcaataagaccttccatcttgttccatgagattgacaagacatgccaaaacataaaaatatgtacactgcaattagtttctgaatgtagatgttacaacttaaacttatttttaaaatatttaaaaataggaaggctagacatgcctctgtatagaaaatctgataaaaatatttctccctaaattgtaaattcattgatattccagtaaaaatttccatatttttttagttgagaagctgattctgatcatctgtagaattttgattttaacgaggaatgtagtttacattaggaatgtagtactaatactaattgaacatttgctaatgtttcacacactattttaggtgctgggggatacagtaaggtacaagatggacaaaaatacgtgctcttacagatctagtagaacagaaaaaattaaatgcatgctatgtgataagtatatgatatgtcccataaagagaaatgatataaaaaagaagctagggagtgctggatcaggcaccttactatccccagaacatgttggtattagaggatgagggaagaactagaggtaactgtgagacacaaaaggcataatgaaaatagtcatgatagtcccaaggcagatattgtttatgatgctttgagtgttggaggaagggaggattgatggtttaacagagatcatggcagttatgttcactcatataaatgttgatttagaagctggtggaagggtattttttgagtgacagctttattgagacaaagcaattctggagaacacccatatccttctctctgtatccatcagcagaagtgaagagggagccccaaagttccacttaaagtgtacaacttatggcttttagttcattcacggagttgtgcaaccatcaccaccatcaattttagaacattttcatcacctcaaagaggaatcccttgtccttttgtagttatggccatccctggaagagtacttttttttttttttcaactgaagcacccagagctcttgggttccctcttaactgctttctgtggaagtatagagggccatgtgagggaagccgttatccagagtacatgactgctagaaaatggagtttggggctccctcttcacttctgctgatagaagcataatggctaggggatgggtagtctcaccagagaatgtggagctttcagactctccttatatatgataaaaaggatttttcattgtagtggggaaaaggtggtttgatcaaatggcattgggaaacttagctcactggaaaaacagatctgtacctttcacactaatgaaatgcctgagatattaaaggtctaaatgtaaaattaaagtacatgaaaaacagaataatatatatgtaccctcggtttgaaatagactttaagcactaatgcataaccccaaagctgacattaggcttttatatggtggaaaacatcatagtcaatagataaatgagagactgacacaaagtgtttgcaacagatataataaaggactgtaattcgtgatattcaaagtactattacaaaccaataataatctgcaacttagaaaaatggactaatgtcccattcacaaaagatgcaataaaagcagttaatgaaaattatccaatatcactagaaatcaagaaatgcaaattaaagtgattatctactttttccccaaaagactgactaatcgagtgataacattcagtattggtgaatgtgtggaaacaagggaattccattgttgattacatatctattgctttatgtatataccctttgaattaatattccttggaaaccaacatatacaaaggtagataaatgtattagtggcaaaaaaattaatggtaaactattaaaacaacaagtgtccatcagggtaataaataaattaattatggtatatatccattcaataggaattatgcagctgttgaaaaaaaatcaatgtgtgtagtcatagaaagatagctgtgctatactaaatgaaaaattgcagacctgtattgtagtataggcccataattgtgatatcaaaaataaaaatcaaaatatatattatagtaggcatttgtttttctctgcccagtttcccttgcctcctccttttggctgcactatctcatcttttccttttgagtaactggccataccctaccatatgtttttgatggacgtggccaataaaattgtctctgaatttcaaaaggcatttggatctgtgtcatccaatggcaactccctaaaagctgatgcagttattcttttgattggtccttggaaccaccctggtttttgtactttccaagtctgtgattcctcaaactacccattgtctttccggtacttgatttttgcctcctgttggtcagttgcttgcaagtaaagaaacaatcatacagaatttggtacgaagattgggtaatgggcattagaatctttggaaaaatcaggtattgggagttgctttttggatgagatggggcgaataagacttatattctagactggaaagcatctcatggtgtgcgatgagcaaacgcctgattattcattatagtcacctgggatgaatagaggtctagggttctggataatgataatttaaggaggatggagaatgctgaatccaaaaggtatatgtaatactggtatctaactgcttggaataacttaaagtttagctcttgaatttctagcattaaggcaaaaaaaattcacctaagggattttgtatgatattgttgaaagatgtcttacattgtttaaagtcatagggttaagatggctcataaccaaatttagagactatttttatgcattgttaaagtggaatgctggttaaattttatactttattcacaagagtcactgtgaattgaattgtgaattcagttctgaattgtgttcccaccagcaccaccaaatgctggcctctaccaccaccaaatttacttgttgaagtcctaaaccccaacatgactgtatttggacataaggcctttaagaaactaaggttaagttaggccataagagtgaggccctaatcccataggactagtgtccttataagaggaagagacaccagaggtttgtctctccacatgtgcacagaggaaatgctgtgtaaggacacaacaagaatgctgccatctgcaagccaggaggagagacctcaccaggaaccagccctgccagcaccttgatcttggacttttaatctccaggactgtgagaaaataaatgttggttgtttaagcc

SEQ ID NO: 3133 - DNA, 4967 bp, Homo sapiens
cctgcgcgatggggggttccagcgtcgactcacggagtccttcggatgagagcgtctgggtgccagacgaggccggggccttgccctcccaagacactgttcttcaagagaaagaccagaagagaaggcaaaaatgaatgttgaagtagtaaaagtcatgccccaggacttagtgacattcaaggatgtggcaatagatttttcccaggaagaatggcaatggatgaaccctgctcagaagcgtttatacaggagtatgatgttggagaactatcagagcctggtatcacttggtctttgcatttctaagccatatgtgatctccttattggagcaagggagagagccttgggagatgacgagtgagatgacaagaagcccattctcagattgggaatctatatatgtgacacaggaattacctctgaagcagttcatgtatgatgatgcatgcatggagggaattactagctatggacttgagtgttccacttttgaagaaaattggaaatgggaagacctttttgagaagcagatgggaagtcatgagatgtttagcaagaaagaaataatcactcataaagaaaccatcactaaggaaacagaattcaaatatactaaatttgggaaatgtatccatctggaaaacatagaagagagtatttataatcacacatcagataaaaaaagcttctccaaaaattctatggtaataaaacacaagaaagtctatgtaggaaagaagctttttaaatgtaatgaatgtgacaaaaccttcacccatagctcatcccttactgttcattttagaattcatactggtgaaaaaccatatgcatgtgaggaatgtggaaaagccttcaagcaaaggcaacaccttgctcaacatcacagaacacatactggagagaaactctttgaatgtaaagaatgtaggaaagccttcaaacaaagtgaacaccttattcagcatcaaagaattcatactggagaaaaaccatataaatgtaaggaatgcagaaaagccttcagacagcctgcacaccttgctcagcatcagagaattcatactggagagaaaccctatgaatgtaaagaatgtggcaaagccttcagtgatggctcgtcttttgctcgacatcagagatgtcacactggcaaaagaccctatgaatgtattgagtgtgggaaggcttttaggtataacacatcttttattcgtcactggaggagttatcatactggagagaagccttttaattgcattgattgtgggaaagccttcagtgttcacataggacttattctgcataggagaattcatacaggagagaaaccttacaaatgtggtgtgtgtggaaaaaccttcagctcgggttcatcccgtactgtacatcagagaattcatacaggagagaaaccttatgaatgtgatatatgtgggaaagattttagccatcatgcatcactcactcagcatcaaagagtacattctggagagaaaccgtatgaatgcaaggaatgtgggaaagcctttaggcagaatgtacaccttgttagtcatttgagaattcatactggtgaaaaaccctatgaatgtaaagaatgtggaaaagcttttagaatcagttcacagctggctactcatcagagaattcatactggagagaagccttatgaatgtattgaatgtggaaatgctttcaaacagagatcacaccttgcccaacatcagaaaactcatacaggagagaaaccttatgagtgtaatgaatgcgggaaagccttcagccaaacttccaatcttactcaacatcaaagaattcatactggagagaaaccctataaatgtactgaatgtggaaaggcttttagtgatagctcatcctgtgctcagcatcaaagactccacactggccaaaggccctatcagtgttttgaatgtgggaaggcgttcagaagaaagttatccttaatttgtcatcaaagaagtcatactggagaagaaccttaagaatgtagtgcatgtggccaagcctttagttatcaccaatcccctactgttaatcagagatgtcccactggataaaaaacatataaatgtaagaaatgtagaaaaaccttcagccaggaggctggcaagatggccgaataggaacagctctgatctgcagttcccagtgagatcaacgcagaaggtgggtgctttctgtatttccagctgaggtacctggctcatctcattgggactggttagacagtgggtgcagcccacggagggtgagctgaagcagggtggggcgtaacctcacctgggaagtgcaaggagtcggggatctccctcccctagccaagggaagccatgagggactgtgccatgaggaatggtgcactccggcacagatactacgcttttcccatggtcttcgcaacccacagaccaggagatcccccttgggtgcctatgccaccaaggccctgggtttcaagcacaaaactgggcggccattcgggcagacaccgagctagctgtaggagtttttttgatagcccagtggcacctggaatgccagtgaaacagaaccgcttactcccttgttaagggggctgaagccggggagccaagtggttcccatgcccactgagcccagcaagctaagatccactggcttggaattctccctgccagcacagcagtctgaagtcaacctgggatgatcaagcttggtggggggaggggcgccaaccattaccaaagcttgaataggtggttttcccctcacagcgtaaacaaagccatggggaagttccagctgagcagagccctccacagctcagcaaagcctctgtagccagactgcctctctagattcctcctctctgggcagcgcatctttgaaaaaagtgcagataaaaccctcatctccctgggacaaagcacgtgggggaaaggggtggctgtgggcacagcttcagcagacttaaacattcctgcctgccagctctgaagagagcagcagttcttccagcacagcgcttgagctctgctaagggacagactgcctcctcaagtgggtccctgacccccatgcctcctgacggggagacacctcccagcaggggtccacagacacctcatacaggagagctctggctggcatctggtgggtgcccctctgggacaaagcttccagaggaaggaacaggcagcaatctttgctgttctgcagcctccaccggtgatacccaggcagatatggtctggagtggacctccagcaaactccagcagacctgcagccgaggggcctcactgttagaaggaaaactaacaggaatataatcaacatcaacaaaggacatccacacagaaaccccatctgaaggttaccagcatcaaagaccaaaggtagataaattcacgaagatgaggagaaaccagtgcaaaaagcctgaaaattccaaaaaccagaatgcctcttctcctccaaaggatcacaactccttgccggcaagggaacaaaactggatagagaatgagtttgacaaattgacagaagtaggcttcagaaggtgggaaataacaaactcctctgagctaaaggagcatgttctaacccaatgcaaggaagctaagaaccttgaaaaaaggttagaggaattgctaactagaataaccagtttagagaagaacataaatgacctgatggagctgaaaaacacagcatgagaacttcgtgaagcatacagaagaaaaaccttcagccagattgaatgctttacagggaagaattcatactgcagagcggtcttaacaatgtaaagaatgtgcaaatgtcctcagacaagatgcacaccttgctcattagtgagttcatttcaggcagccagctcttcctcacccactacatcaccaagtcctgtggatatatctgctaaatatttttggaatttatccacttcttttggttccccagtccaaaacacagtcatttcacctggactatttcaatcattacacaggtgtccaaccttttgtcttccctgggccacattggaagaagaaaaattgtcttgtgccacacatacaatacactaacattaacaatagctgatgagctaagaaaaaaaaaaagtctgtgcatagttttagtgatacaccacctccgataagcaaaaaagtcctcacattcaatgggttgcatacccatgaattctaaaacttcatcctcttttgtccctttcgagttaacattacagccacagtgacctttcaaaaatgcaaattaagttactcttaaaactctagttaaaatacttgatgtacataaagtgcttagcaaaatgaccaactcatactaagtgcttagtaaatgttagataagtattctccagaattgatgtaaattatttttaaacagtgcattcttgaaagcagtatggcagtcataaaaattttggaaccaaaacagtatctttttttaagctaaaaaaaaagttttaaatggtgtctttctatgttgcccagggtggtctcaaactcctgtgctcaagtgaccctcccacctcattctcaagtggctgcaattacaggcaaccagcctgacttaaaacagtatcttaaggtagatggtgattagcacatgtagtatgcttaacatttaatattataataagacatcacagcggctgtctcatgattaaggctgtgttcccttgttggtgaggaaattaattatgacttgataaatagaacatgttttaagaagtggctatatagctctggataaaacgaacaaaagaattagaattcctgcggggaatatatacaagactttatttagtcaagtaaaaaaaaatcactaatgtttaactgaagaaagagaaattgaataatatagttctatttcaacatgtgggttcacagatttattctaaccttccaagtaaagttgttccactagtaaa

SEQ ID NO: 3134 - DNA, 4688 bp, Homo sapiens
gggaaatagagtcctggcgctgccgcggaggatcctgggtgcagccgctcagagaagcttctcgcgcacaggaagtcgctgcgaggaggcgcgtgtgcggggagttgaatctcccgctcccttgaggctggggttgcgtctgttgacgcggccgactacaatcccgagggagactcacattgggacttgtcctcctcctcctggacattttgggggctcgtcagcatggacagcgagtcagccatgggtggaagggaggctttctcacagctcccttgtgcttcccacagccctgccagccgggaacacggaggggaaggaggaggagcttaaaagaggctactgaaccccagttggccatggctgaggaatttgtgaccctcaaggatgtcggcatggacttcaccttgggagactgggagcagctcgggctggaacagggggacacgttctgggacacagcgttggacaattgccaggacctcttcctgctggaccccccaagacccaacctgacctcccacccagatggcagtgaagatctggagcctctggcaggaggaagcccagaagcaacaagccctgatgtgactgagaccaagaactctcctctgatggaggatttcttcgaagaaggattctcccaggagattatagagatgttatccaaggatggcttctggaactccaatttcggagaagcctgtatagaggacacctggttagatagtttgctaggcgatccagaaagtcttctgaggtctgatattgccaccaacggggaaagtcccacggaatgcaagagtcatgaattaaagagaggactcagtcctgtgtccaccgtttccacgggagaagattccatggtgcataatgtttctgaaaagaccctcacaccagctaagtctaaggaatataggggtgagtttttctcctactccgaccacagccagcaggattctgttcaggaaggggagaaaccatatcaatgtagtgaatgtgggaaaagcttcagtgggagttaccgtcttacccagcactggatcactcatactagggagaaacccactgtccatcaagagtgtgagcaaggttttgaccggaatgcttccctttctgtgtatccgaaaactcacacgggctacaaattctatgtgtgtaatgaatatgggacaacttttagtcagagtacatacctgtggcatcagaaaactcacactggagaaaaaccatgtaagagtcaagatagtgaccacccacccagtcatgacacacagcctggtgagcatcagaaaactcacacagatagtaagtcctacaactgtaacgaatgcggcaaggcttttacccggatcttccaccttactcggcaccagaagatccacactcggaaacgctatgagtgttccaagtgccaggcgaccttcaacttgagaaaacacctcatccaacatcagaaaactcacgctgcaaaaactacctctgagtgtcaggagtgtgggaagatttttaggcacagttcgctgctcattgaacaccaggctcttcatgctggagaggagccttataagtgtaacgaacgtgggaaatccttcaggcataactctaccctaaagatccatcagagggttcacagtggagagaagccttacaaatgcagtgagtgtgggaaggccttccaccggcacactcaccttaatgaacatcggcgaattcatacaggctacagaccccacaaatgtcaggaatgcgtcaggagtttcagccggccctcacatctgatgcgacatcaggccattcacaccgcagaaaagccctatagctgtgctgaatgcaaggagactttcagcgataacaatcgccttgtgcaacaccagaaaatgcacactgtcaaaaccccatatgaatgtcaggagtgcggagaacgcttcatttgcggctcaaccctgaagtgccacgagagtgttcacgccagagaaaaacaaggattttttgtgagtgggaagatcttggatcagaacccagaacagaaagagaagtgctttaagtgtaacaaatgtgagaaaacctttagctgcagcaaatacctaactcagcacgagaggattcacaccaggggagtgaagccctttgaatgtgaccagtgtgggaaagcctttggccaaagtactcggctcattcaccatcaaagaatccactctagagtgaggctgtataaatggggtgagcaagggaaagccatcagcagtgcctcccttatcaaacttcagtccttccacacaaaggagcacccttttaaatgtaacgaatgcggaaagaccttcagccacagtgcacacctctcaaaacatcagttaattcacgctggagagaatccctttaaatgtagtaagtgtgacagagtcttcacccagagaaactaccttgttcagcatgagcgaactcatgccagaaagaagccgttggtgtgtaacgaatgcgggaaaacgttccgtcagagctcatgcctttctaagcatcagagaattcactcaggtgagaagccctatgtatgtgattactgcgggaaggccttcggcctgagtgctgagcttgtccgccaccagagaattcacactggagaaaagccttatgtttgtcaggaatgcgggaaagccttcacccagagctcatgcctttctattcaccggagagttcacactggggagaagccctacagatgtggtgaatgtgggaaagcctttgcccagaaagcaaatctaacacagcaccagagaattcacacaggggagaagccttactcctgtaatgtgtgtggcaaagcttttgtcctcagtgcccatctcaaccagcacctgagagttcacacccaggagacactttatcagtgtcaacgttgccagaaagcctttcggtgccactcgagcctcagccgccatcagcgtgtacacaacaagcagcaatactgcctgtagccattgggtggcagcagagtcccagaatatgagaccgttactcggatgttgaaagttggaaactatcccattgcaagtttctctccaaataaatgcatctaaagattgattagaaagtttgtgcgcatgtttttcattataacaatgaaaacacaaaagtggagaagctgtacaacgtcaggattcagaggtaggctctggagccagtctaccttgagttaaatcccacctctgccatctactacctaagtgaccttgggaaggtcagaaaaatctctcagggcctcggtgtccttatctgtaaaatgggcatcacctacctcagagggcttttctgaggattaaataaataaatgtgaagcacttagaactgatggccagcacatgagggctcaccaagtgtaagccacaaatacacatcagctatagcacaaatatacttgtgttacaagaaaggaattagtaatctgtgtttactgtagttaatgttcttacaatgtatcgcttttaatttaagttttccttttttacagtttttctccagcactttactcttcttaagtgcctggccttttttgtccctttatctctcctggtttttttcttaagccccagaaagccaaaaagaacatgtaaactcttcacctcaactagctacaaccttccactcctaacctcccaagcttctcacttaaagaggactccctatcccacaaacacatgctccctcttcctatgaccttcctccatttaacagtgttggttatgcaataagacacccaatttttcatgggagttgacaccaaaacacagctggattccatcaggaaagctgcattgatcagggtgttaaccgcatatgaaacaacccatatggaagacatacttaggggtcaaacctgtggtgtgtggaagtgaccactgggatgtcatcattcaccatttatccaggatggccgctcaccaggcaatttgctaggctcgggggcgggtagtatccatacactatgcactactgctctgaagcttctggaatcagaaatgaacccattttcatcgacgattgctgttagttgacaagtgacatcttgaaaatgccacattccctcatgtcacaggaagttctgggatcaccaaggattgttggagagtccagtgagatggaaccacacaaccagttccctaccagtgtcttgtcagctctgggtgtttgttccctgccactaagtggctcagtcacacctttgctgaaacacagtagtcttatgaaaagcactggacacatactttgaatacctttcatattttaggtgctgaaaatggtgagggagtgagtgctctgcacccttgggcttttcaactcttgcacctggagttctgctggttaagtttgttaaacttagttgaaactgggaacctgttggctaaccattggggccttacactgtttttcaaatggttgcaacatttaacttctcgcacatggttcccgtcctctggagctctgtcttgtcggggagatgggcatgttgtataccaaaagagtgtacaaagtgttgcagggctgtgacacaatagggactctatggaaaactggcagccattgggtgtgggggcagtctgtaaatcagtcacctgtgttgctgcaggccaaggtagaaacgccctccgtgtgtgcatatttgttggttctctgattaaagttttgagtct

SEQ ID NO: 3135 - DNA, 4566 bp, Homo sapiens
gggaaatagagtcctggcgctgccgcggaggatcctgggtgcagccgctcagagaagcttctcgcgcacaggaagtcgctgcgaggaggcgcgtgtgcggggagttgaatctcccgctcccttgaggctggggttgcgtctgttgacgcggccgactacaatcccgagccctgccagccgggaacacggaggggaaggaggaggagcttaaaagaggctactgaaccccagttggccatggctgaggaatttgtgaccctcaaggatgtcggcatggacttcaccttgggagactgggagcagctcgggctggaacagggggacacgttctgggacacagcgttggacaattgccaggacctcttcctgctggaccccccaagacccaacctgacctcccacccagatggcagtgaagatctggagcctctggcaggaggaagcccagaagcaacaagccctgatgtgactgagaccaagaactctcctctgatggaggatttcttcgaagaaggattctcccaggagattatagagatgttatccaaggatggcttctggaactccaatttcggagaagcctgtatagaggacacctggttagatagtttgctaggcgatccagaaagtcttctgaggtctgatattgccaccaacggggaaagtcccacggaatgcaagagtcatgaattaaagagaggactcagtcctgtgtccaccgtttccacgggagaagattccatggtgcataatgtttctgaaaagaccctcacaccagctaagtctaaggaatataggggtgagtttttctcctactccgaccacagccagcaggattctgttcaggaaggggagaaaccatatcaatgtagtgaatgtgggaaaagcttcagtgggagttaccgtcttacccagcactggatcactcatactagggagaaacccactgtccatcaagagtgtgagcaaggttttgaccggaatgcttccctttctgtgtatccgaaaactcacacgggctacaaattctatgtgtgtaatgaatatgggacaacttttagtcagagtacatacctgtggcatcagaaaactcacactggagaaaaaccatgtaagagtcaagatagtgaccacccacccagtcatgacacacagcctggtgagcatcagaaaactcacacagatagtaagtcctacaactgtaacgaatgcggcaaggcttttacccggatcttccaccttactcggcaccagaagatccacactcggaaacgctatgagtgttccaagtgccaggcgaccttcaacttgagaaaacacctcatccaacatcagaaaactcacgctgcaaaaactacctctgagtgtcaggagtgtgggaagatttttaggcacagttcgctgctcattgaacaccaggctcttcatgctggagaggagccttataagtgtaacgaacgtgggaaatccttcaggcataactctaccctaaagatccatcagagggttcacagtggagagaagccttacaaatgcagtgagtgtgggaaggccttccaccggcacactcaccttaatgaacatcggcgaattcatacaggctacagaccccacaaatgtcaggaatgcgtcaggagtttcagccggccctcacatctgatgcgacatcaggccattcacaccgcagaaaagccctatagctgtgctgaatgcaaggagactttcagcgataacaatcgccttgtgcaacaccagaaaatgcacactgtcaaaaccccatatgaatgtcaggagtgcggagaacgcttcatttgcggctcaaccctgaagtgccacgagagtgttcacgccagagaaaaacaaggattttttgtgagtgggaagatcttggatcagaacccagaacagaaagagaagtgctttaagtgtaacaaatgtgagaaaacctttagctgcagcaaatacctaactcagcacgagaggattcacaccaggggagtgaagccctttgaatgtgaccagtgtgggaaagcctttggccaaagtactcggctcattcaccatcaaagaatccactctagagtgaggctgtataaatggggtgagcaagggaaagccatcagcagtgcctcccttatcaaacttcagtccttccacacaaaggagcacccttttaaatgtaacgaatgcggaaagaccttcagccacagtgcacacctctcaaaacatcagttaattcacgctggagagaatccctttaaatgtagtaagtgtgacagagtcttcacccagagaaactaccttgttcagcatgagcgaactcatgccagaaagaagccgttggtgtgtaacgaatgcgggaaaacgttccgtcagagctcatgcctttctaagcatcagagaattcactcaggtgagaagccctatgtatgtgattactgcgggaaggccttcggcctgagtgctgagcttgtccgccaccagagaattcacactggagaaaagccttatgtttgtcaggaatgcgggaaagccttcacccagagctcatgcctttctattcaccggagagttcacactggggagaagccctacagatgtggtgaatgtgggaaagcctttgcccagaaagcaaatctaacacagcaccagagaattcacacaggggagaagccttactcctgtaatgtgtgtggcaaagcttttgtcctcagtgcccatctcaaccagcacctgagagttcacacccaggagacactttatcagtgtcaacgttgccagaaagcctttcggtgccactcgagcctcagccgccatcagcgtgtacacaacaagcagcaatactgcctgtagccattgggtggcagcagagtcccagaatatgagaccgttactcggatgttgaaagttggaaactatcccattgcaagtttctctccaaataaatgcatctaaagattgattagaaagtttgtgcgcatgtttttcattataacaatgaaaacacaaaagtggagaagctgtacaacgtcaggattcagaggtaggctctggagccagtctaccttgagttaaatcccacctctgccatctactacctaagtgaccttgggaaggtcagaaaaatctctcagggcctcggtgtccttatctgtaaaatgggcatcacctacctcagagggcttttctgaggattaaataaataaatgtgaagcacttagaactgatggccagcacatgagggctcaccaagtgtaagccacaaatacacatcagctatagcacaaatatacttgtgttacaagaaaggaattagtaatctgtgtttactgtagttaatgttcttacaatgtatcgcttttaatttaagttttccttttttacagtttttctccagcactttactcttcttaagtgcctggccttttttgtccctttatctctcctggtttttttcttaagccccagaaagccaaaaagaacatgtaaactcttcacctcaactagctacaaccttccactcctaacctcccaagcttctcacttaaagaggactccctatcccacaaacacatgctccctcttcctatgaccttcctccatttaacagtgttggttatgcaataagacacccaatttttcatgggagttgacaccaaaacacagctggattccatcaggaaagctgcattgatcagggtgttaaccgcatatgaaacaacccatatggaagacatacttaggggtcaaacctgtggtgtgtggaagtgaccactgggatgtcatcattcaccatttatccaggatggccgctcaccaggcaatttgctaggctcgggggcgggtagtatccatacactatgcactactgctctgaagcttctggaatcagaaatgaacccattttcatcgacgattgctgttagttgacaagtgacatcttgaaaatgccacattccctcatgtcacaggaagttctgggatcaccaaggattgttggagagtccagtgagatggaaccacacaaccagttccctaccagtgtcttgtcagctctgggtgtttgttccctgccactaagtggctcagtcacacctttgctgaaacacagtagtcttatgaaaagcactggacacatactttgaatacctttcatattttaggtgctgaaaatggtgagggagtgagtgctctgcacccttgggcttttcaactcttgcacctggagttctgctggttaagtttgttaaacttagttgaaactgggaacctgttggctaaccattggggccttacactgtttttcaaatggttgcaacatttaacttctcgcacatggttcccgtcctctggagctctgtcttgtcggggagatgggcatgttgtataccaaaagagtgtacaaagtgttgcagggctgtgacacaatagggactctatggaaaactggcagccattgggtgtgggggcagtctgtaaatcagtcacctgtgttgctgcaggccaaggtagaaacgccctccgtgtgtgcatatttgttggttctctgattaaagttttgagtct

SEQ ID NO: 3136 - DNA, 2811 bp, Homo sapiens
aagtcgctgcgaggaggcgcgtgtgcggggagttgaatctcccgctcccttgaggctggggttgcgtctgttgacgcggccgactacaatcccgaggaatttgtgaccctcaaggatgtcggcatggacttcaccttgggagactgggagcagctcgggctggaacagggggacacgttctgggacacagcgttggacaattgccaggacctcttcctgctggaccccccaagacccaacctgacctcccacccagatggcagtgaagatctggagcctctggcaggaggaagcccagaagcaacaagccctgatgtgactgagaccaagaactctcctctgatggaggatttcttcgaagaaggattctcccaggagattatagagatgttatccaaggatggcttctggaactccaatttcggagaagcctgtatagaggacacctggttagatagtttgctaggcgatccagaaagtcttctgaggtctgatattgccaccaacggggaaagtcccacggaatgcaagagtcatgaattaaagagaggactcagtcctgtgtccaccgtttccacgggagaagattccatggtgcataatgtttctgaaaagaccctcacaccagctaagtctaaggaatataggggtgagtttttctcctactccgaccacagccagcaggattctgttcaggaaggggagaaaccatatcaatgtagtgaatgtgggaaaagcttcagtgggagttaccgtcttacccagcactggatcactcatactagggagaaacccactgtccatcaagagtgtgagcaaggttttgaccggaatgcttccctttctgtgtatccgaaaactcacacgggctacaaattctatgtgtgtaatgaatatgggacaacttttagtcagagtacatacctgtggcatcagaaaactcacactggagaaaaaccatgtaagagtcaagatagtgaccacccacccagtcatgacacacagcctggtgagcatcagaaaactcacacagatagtaagtcctacaactgtaacgaatgcggcaaggcttttacccggatcttccaccttactcggcaccagaagatccacactcggaaacgctatgagtgttccaagtgccaggcgaccttcaacttgagaaaacacctcatccaacatcagaaaactcacgctgcaaaaactacctctgagtgtcaggagtgtgggaagatttttaggcacagttcgctgctcattgaacaccaggctcttcatgctggagaggagccttataagtgtaacgaacgtgggaaatccttcaggcataactctaccctaaagatccatcagagggttcacagtggagagaagccttacaaatgcagtgagtgtgggaaggccttccaccggcacactcaccttaatgaacatcggcgaattcatacaggctacagaccccacaaatgtcaggaatgcgtcaggagtttcagccggccctcacatctgatgcgacatcaggccattcacaccgcagaaaagccctatagctgtgctgaatgcaaggagactttcagcgataacaatcgccttgtgcaacaccagaaaatgcacactgtcaaaaccccatatgaatgtcaggagtgcggagaacgcttcatttgcggctcaaccctgaagtgccacgagagtgttcacgccagagaaaaacaaggattttttgtgagtgggaagatcttggatcagaacccagaacagaaagagaagtgctttaagtgtaacaaatgtgagaaaacctttagctgcagcaaatacctaactcagcacgagaggattcacaccaggggagtgaagccctttgaatgtgaccagtgtgggaaagcctttggccaaagtactcggctcattcaccatcaaagaatccactctagagtgaggctgtataaatggggtgagcaagggaaagccatcagcagtgcctcccttatcaaacttcagtccttccacacaaaggagcacccttttaaatgtaacgaatgcggaaagaccttcagccacagtgcacacctctcaaaacatcagttaattcacgctggagagaatccctttaaatgtagtaagtgtgacagagtcttcacccagagaaactaccttgttcagcatgagcgaactcatgccagaaagaagccgttggtgtgtaacgaatgcgggaaaacgttccgtcagagctcatgcctttctaagcatcagagaattcactcaggtgagaagccctatgtatgtgattactgcgggaaggccttcggcctgagtgctgagcttgtccgccaccagagaattcacactggagaaaagccttatgtttgtcaggaatgcgggaaagccttcacccagagctcatgcctttctattcaccggagagttcacactggggagaagccctacagatgtggtgaatgtgggaaagcctttgcccagaaagcaaatctaacacagcaccagagaattcacacaggggagaagccttactcctgtaatgtgtgtggcaaagcttttgtcctcagtgcccatctcaaccagcacctgagagttcacacccaggagacactttatcagtgtcaacgttgccagaaagcctttcggtgccactcgagcctcagccgccatcagcgtgtacacaacaagcagcaatactgcctgtagccattgggtggcagcagagtcccagaatatgagaccgttactcggatgttgaaagttggaaactatcccattgcaagtttctctccaaataaatgcatctaaagattg

SEQ ID NO: 3137 - DNA, 4828 bp, Homo sapiens
gtcacaacgcgtttccatggcaacctaccgcttgctcttcggaaaaggttaacactccctgacttctagtaaagtgctaaggctgaagaagcaggaggagatgggaaggcgaaagaagtcgcccgcacagccctctgggaaatagagtcctggcgctgccgcggaggatcctgggtgcagccgctcagagaagcttctcgcgcacaggaagtcgctgcgaggaggcgcgtgtgcggggagttgaatctcccgctcccttgaggctggggttgcgtctgttgacgcggccgactacaatcccgagggagactcacattgggacttgtcctcctcctcctggacattttgggggctcgtcagcatggacagcgagtcagccatgggtggaagggaggctttctcacagctcccttgtgcttcccacagccctgccagccgggaacacggaggggaaggaggaggagcttaaaagaggctactgaaccccagttggccatggctgaggaatttgtgaccctcaaggatgtcggcatggacttcaccttgggagactgggagcagctcgggctggaacagggggacacgttctgggacacagcgttggacaattgccaggacctcttcctgctggaccccccaagacccaacctgacctcccacccagatggcagtgaagatctggagcctctggcaggaggaagcccagaagcaacaagccctgatgtgactgagaccaagaactctcctctgatggaggatttcttcgaagaaggattctcccaggagattatagagatgttatccaaggatggcttctggaactccaatttcggagaagcctgtatagaggacacctggttagatagtttgctaggcgatccagaaagtcttctgaggtctgatattgccaccaacggggaaagtcccacggaatgcaagagtcatgaattaaagagaggactcagtcctgtgtccaccgtttccacgggagaagattccatggtgcataatgtttctgaaaagaccctcacaccagctaagtctaaggaatataggggtgagtttttctcctactccgaccacagccagcaggattctgttcaggaaggggagaaaccatatcaatgtagtgaatgtgggaaaagcttcagtgggagttaccgtcttacccagcactggatcactcatactagggagaaacccactgtccatcaagagtgtgagcaaggttttgaccggaatgcttccctttctgtgtatccgaaaactcacacgggctacaaattctatgtgtgtaatgaatatgggacaacttttagtcagagtacatacctgtggcatcagaaaactcacactggagaaaaaccatgtaagagtcaagatagtgaccacccacccagtcatgacacacagcctggtgagcatcagaaaactcacacagatagtaagtcctacaactgtaacgaatgcggcaaggcttttacccggatcttccaccttactcggcaccagaagatccacactcggaaacgctatgagtgttccaagtgccaggcgaccttcaacttgagaaaacacctcatccaacatcagaaaactcacgctgcaaaaactacctctgagtgtcaggagtgtgggaagatttttaggcacagttcgctgctcattgaacaccaggctcttcatgctggagaggagccttataagtgtaacgaacgtgggaaatccttcaggcataactctaccctaaagatccatcagagggttcacagtggagagaagccttacaaatgcagtgagtgtgggaaggccttccaccggcacactcaccttaatgaacatcggcgaattcatacaggctacagaccccacaaatgtcaggaatgcgtcaggagtttcagccggccctcacatctgatgcgacatcaggccattcacaccgcagaaaagccctatagctgtgctgaatgcaaggagactttcagcgataacaatcgccttgtgcaacaccagaaaatgcacactgtcaaaaccccatatgaatgtcaggagtgcggagaacgcttcatttgcggctcaaccctgaagtgccacgagagtgttcacgccagagaaaaacaaggattttttgtgagtgggaagatcttggatcagaacccagaacagaaagagaagtgctttaagtgtaacaaatgtgagaaaacctttagctgcagcaaatacctaactcagcacgagaggattcacaccaggggagtgaagccctttgaatgtgaccagtgtgggaaagcctttggccaaagtactcggctcattcaccatcaaagaatccactctagagtgaggctgtataaatggggtgagcaagggaaagccatcagcagtgcctcccttatcaaacttcagtccttccacacaaaggagcacccttttaaatgtaacgaatgcggaaagaccttcagccacagtgcacacctctcaaaacatcagttaattcacgctggagagaatccctttaaatgtagtaagtgtgacagagtcttcacccagagaaactaccttgttcagcatgagcgaactcatgccagaaagaagccgttggtgtgtaacgaatgcgggaaaacgttccgtcagagctcatgcctttctaagcatcagagaattcactcaggtgagaagccctatgtatgtgattactgcgggaaggccttcggcctgagtgctgagcttgtccgccaccagagaattcacactggagaaaagccttatgtttgtcaggaatgcgggaaagccttcacccagagctcatgcctttctattcaccggagagttcacactggggagaagccctacagatgtggtgaatgtgggaaagcctttgcccagaaagcaaatctaacacagcaccagagaattcacacaggggagaagccttactcctgtaatgtgtgtggcaaagcttttgtcctcagtgcccatctcaaccagcacctgagagttcacacccaggagacactttatcagtgtcaacgttgccagaaagcctttcggtgccactcgagcctcagccgccatcagcgtgtacacaacaagcagcaatactgcctgtagccattgggtggcagcagagtcccagaatatgagaccgttactcggatgttgaaagttggaaactatcccattgcaagtttctctccaaataaatgcatctaaagattgattagaaagtttgtgcgcatgtttttcattataacaatgaaaacacaaaagtggagaagctgtacaacgtcaggattcagaggtaggctctggagccagtctaccttgagttaaatcccacctctgccatctactacctaagtgaccttgggaaggtcagaaaaatctctcagggcctcggtgtccttatctgtaaaatgggcatcacctacctcagagggcttttctgaggattaaataaataaatgtgaagcacttagaactgatggccagcacatgagggctcaccaagtgtaagccacaaatacacatcagctatagcacaaatatacttgtgttacaagaaaggaattagtaatctgtgtttactgtagttaatgttcttacaatgtatcgcttttaatttaagttttccttttttacagtttttctccagcactttactcttcttaagtgcctggccttttttgtccctttatctctcctggtttttttcttaagccccagaaagccaaaaagaacatgtaaactcttcacctcaactagctacaaccttccactcctaacctcccaagcttctcacttaaagaggactccctatcccacaaacacatgctccctcttcctatgaccttcctccatttaacagtgttggttatgcaataagacacccaatttttcatgggagttgacaccaaaacacagctggattccatcaggaaagctgcattgatcagggtgttaaccgcatatgaaacaacccatatggaagacatacttaggggtcaaacctgtggtgtgtggaagtgaccactgggatgtcatcattcaccatttatccaggatggccgctcaccaggcaatttgctaggctcgggggcgggtagtatccatacactatgcactactgctctgaagcttctggaatcagaaatgaacccattttcatcgacgattgctgttagttgacaagtgacatcttgaaaatgccacattccctcatgtcacaggaagttctgggatcaccaaggattgttggagagtccagtgagatggaaccacacaaccagttccctaccagtgtcttgtcagctctgggtgtttgttccctgccactaagtggctcagtcacacctttgctgaaacacagtagtcttatgaaaagcactggacacatactttgaatacctttcatattttaggtgctgaaaatggtgagggagtgagtgctctgcacccttgggcttttcaactcttgcacctggagttctgctggttaagtttgttaaacttagttgaaactgggaacctgttggctaaccattggggccttacactgtttttcaaatggttgcaacatttaacttctcgcacatggttcccgtcctctggagctctgtcttgtcggggagatgggcatgttgtataccaaaagagtgtacaaagtgttgcagggctgtgacacaatagggactctatggaaaactggcagccattgggtgtgggggcagtctgtaaatcagtcacctgtgttgctgcaggccaaggtagaaacgccctccgtgtgtgcatatttgttggttctctgattaaagttttgagtctaaaa

SEQ ID NO: 3138 - DNA, 2072 bp, Homo sapiens
ggcaggaaagaagagtcacatcacgtaggtgatgggcctagagatatttcacaatgccttctgtaattagaacccagaaaaaagagttatatcatttgggttaaaggtcttgtgatatgtcacaatcccaactaagggcaggacccaggcagaaaaggagagtcacttcctttgatgattggtccagagatacattacaatttcccctgaggacagctctcatgcagaagaggaactgaatatactgcatggcccaggtatctgcagatttatggctaaaagaccaggaccccctggaagccgagaaatgggactgttgacattcagagacatagctatagaattctctctggaggaatggcaatgcctggattgtgctcagcggaatttatatagagatgtgatgttagagaactacagaaacctggtctccctgggtattgctgtctctaagccagacttgatcacctgtctggagcaaaataaagagtcccagaatataaagagaaatgagatggtagccaaacacccagttacgcgttcccatttcacccaagaccttcagccagagcagggcatcaaagattcactccaaaaagtaataccaagaacatatggaaaatgtggacatgagaaattacaatttaaaaaatgctgtaaaagtgtgggtgaatatgaggtgcacaagggaggttatagtgaagttaaccaatgtttgtcaactacccaaaacaaaatatttcagactcataaatatgtcaaagtctttggtaaattttcaaattccaatagagataaaacaagatatactggaaataaacatttcaaatgtaacaaatatggcaaatcattttgcatgctttcacacctaaatcaacatcaggtaattcatactagggagaagtcctacaaatgcaaagaatgtggcaaatcctttaactgctcctcaaaccatactacacataaaataattcatactggagagaaaccatatagatgtgaggaatgtggcaaagcctttagctggtctgcaaaccttactagacataagagaactcatactggagagaaaccctacacgtgtgaagaatgtggccaagcctttaggcgctcctcagcacttactaaccacaagagaattcatactggagagagaccctacaaatgtgaagaatgtggcaaagcctttagcgtatcctcaaccctcactgaccacaagagaattcatactggagagaaaccctgcaggtgtgaggaatgtggcaaagcctttagctggtcctcaaaccttactagacataagagaattcatactagagagaaaccctatgcctgtgaagaatgtggccaagcctttagcttatcctcgaaccttatgagacataggagaattcatactggagagaaaccctacacatgtgaagaatgtggccaagactttaggcgctcctcagcacttactatccacaagagaattcatactggagagagaccctacaaatgtgaagagtgtggcaaagtctttagcttatcctcaaccctcactgaccacaagagaattcatactggagagagaccctacaaatgtgaagaatgtggcaaagcctttagcttatcctcaaccctcactgaccacaagagaattcatactggagagagaccctacacatgtgaagaatgtggcaaagcctttaattgctcctcaacccttatgcaacataagagaattcatactggagagaaaccctacaaatgtgaagaatgtgagcaagcttttaagtggcattcaagtcttgctaaacataagataattcacactggagagaaaccctacaaatgtgaataatatggcaaagtccaccctcaggccttataatacataaaataatttacactggaaaaaaacactacaaatgtagagaatgtggccaagcctttaaccagttccaaaccttaattgaatgtaagagaattcatattggacagaaattttataaatgtaaaaaaatgtaacaaagcctttaaccaaccctcaaaccttaataaacctaagagaatttattttaaaaaaa

SEQ ID NO: 3139 - DNA, 3234 bp, Homo sapiens
tccccgcccccggtggccgcccccgggacgcctgggtccgagcccgctcccggcttggcgcggagcctgcatcccggagccgctggcggctcgggcgcctgcaccccgctgaggagctccggagggcgccggggtggcggagccggaggcggccggcaaggtgagagcggcggctgcgcgctgggaggagcagcaggtgcaggggcggccggcggcgcgggcagggggcaccgggagccgcgcccgtacctgggacccgacgccgcccggtgcccgcgctggccggcagagggcagcggcagggcgccgcgggccacacatggctgcgtgaccgcgggatgctgtctgtccccttgctcagggcggcgtgccggcgatggagcgcgcggtagagccttggggcccagatctccaccgcccggaggagagggagccacagagaggcgcccgcacaggtctagggagtgagaacgtgatttctcagccgaatgagtttgaacataccccacaggaagatgacttggggttcaaggaagaagatttggctccagatcatgaagtaggaaatgcctctctcaaacctgaaggcatccagaactgggatgacttatgggtccagagagagggtctaggaaagcctcagcctcgggacagaggcccccggctcctgggtgaaccacgctggggccaggctagtagtgatcgggccgctgtgtgtggtgagtgtggcaaaagcttcaggcagatgtcagatctggtgaaacaccagcggacccacacaggggagaaaccctacaagtgtggggtctgtggcaagggctttggggatagctctgcccggatcaaacaccagcggactcatagtggggagaagccctatagagcccggccaccagcccagggtcccccaaagattcctcggtcccggatccctgctggtgagcgccccactatctgtggtgaatgtggcaagagcttccggcagagttctgacctggtgaaacaccagcggacacacactggtgagaagccctacaagtgtggcatatgtggcaagggctttggcgacagttccgcccgcatcaagcaccagcggacacaccggggggagcagcccccccgaccagtggtgccccgacggcagccatctcgggcagccacggcagctacccagggaccgaaggcccaggacaagccatatatctgcactgattgcggcaagaggtttgtgctcagctgcagcctcctgagtcaccagcgtagtcacttggggcccaagccctttggctgtgatgtgtgtggaaaggagtttgcccggggatccgacctggtgaagcacctgcgggtgcacacgggtgagaagccctacctctgcccagagtgcggcaaaggtttcgcggacagctccgcccgagtcaaacacctccgcacccacagtggcgagaggccccatgcctgcccggaatgcgaccgtaccttcagcctcagctccacccttcttcgccaccgcctcactcacatggagccccaggacttcagcttcccaggctatcccctacccgctctgatccccagcccacccccacctcctctgggcaccagccccccgctgacacctcgaagtccctcacactcgggtgagccttttggcctgcctggcttggagccagagcctgggggcccacaggctggggagccacccccaccactggcgggcgacaagccccacaagtgccctgagtgtggcaagggcttccgccgaagctctgacctggtgaaacaccatcgtgtgcacacaggggagaaaccctacctctgtcctgaatgcggcaagggttttgctgacagctcagcccgagtcaagcacctccgcacccaccgtggtgaacgggcccggccaccaccaccatccactctgctgcggccacataacccacctggcccagtacccatggcccctcgaccccgagttcgggcccagccttctggacccagccagccccacgtgtgtggcttctgtgggaaggagttcccccggagctcagatctggtcaaacacaggcgtacacacacgggggagaagccatacaagtgtgcagagtgtggcaagggttttggtgacagttctgcccgcatcaagcaccagcgtgggcacctggtcctgacgccctttgggataggggatggtagggcaaggcccctcaagcaggaggcagcaacaggactggaatgacgcggtccagggagggcggaggcccaggagaccaaagggaggggctctgccgcttagcagagaagaaagggcctgggaggtggtgggagggagaaggaagggaagaaaggggaggaagaatagatagaaatagggattggagacagtaaccttgaagctcaggaaactgtcctggctgggctgagtcaggaccttgccaggacgggctgtacccctggcttctagaagactgcctagcacacagtaggcattcaatacttgttgaataaataaactggctttcacctaaggactcaaccctaaattcctgctgcctcatctgttaagaactgacactttccccttgctgggcaggtagtacacacctgtaatcccagcagtttgggaggctgaggtgggagaatcacttgagcccaaaagtttgaggctgcagtgagctgattgcaccactgatgcctcccaaccttgctctgggagaccaatgcctgaaccagggtttgtttaccttctgagctgcagagatggggcttctggaatttaaggtaacaggatgaggcaggggtatcttgatcatccggatggggcaaatactgctgtgtggcatggtggtacccacccctatggaggggcactcttggacagagcccagacctttgtgccctggagggagccaacccaccctgacacggagacactggcagaatagaccagagacagaaggtgctctcatggtatccagcctggatgccaagcccaagtcctggtggatagcagaggccagctgtttgggaaaagggcaggatgctctgaggcctggcagccacatttccatgtgtctttttaccaataaacggcttctcttctgaggcttggacagtgtgtgtgtacacacaggcatgaaaaaggtggagaggggtctctgcgcgcaaaactcagactgtaaattttgtgtgcttcccttgctctctgagcccattaaataaagaggttgtcttggcgta

SEQ ID NO: 3140 - DNA, 912 bp, Homo sapiens
tttctttgtctctcccaggtcggagtggctggcgctgtcggccggccggggaggtcggcgcgggtggctggagacacacagccacaattacgaagagcctcgggcctcaccacccagctgcagcccaggaggcacacggttaataccaccgagttcgggccgccggcctcggcttagagtagcccctgggccgcacgctgccgcccgccggccacagagctaccgccgacgcgggcgacccccacaggcccgcagctcctccaaggtcctagagcggctccgtgcggccccgcgcttccgcttcccgtccccgcccccggtggccgcccccgggacgcctgggtccgagcccgctcccggcttggcgcggagcctgcatcccggagccgctggcggctcgggcgcctgcaccccgctgaggagctccggagggcgccggggtggcggagccggaggcggccggcaagggcggcgtgccggcgatggagcgcgcggtagagccttggggcccagatctccaccgcccggaggagagggagccacagagaggcgcccgcacaggtctagggagtgagaacgtgatttctcagccgaatgagtttgaacataccccacaggaagatgacttggggttcaaggaagaagatttggctccagatcatgaagtaggaaatgcctctctcaaacctgaaggcatccagaactgggatgacttatgggtccagagagagggtctaggaaagcctcagcctcgggacagaggcccccggctcctgggtgaaccacgctggggccaggctagtagtgatcgggccgctgtgtgtggtgagtgtggcaaaagcttcaggcagatgtcagatctggtgaaacaccagcggacccacacaggggagaaaccctacaagtgtgggg

SEQ ID NO: 3141 - DNA, 555 bp, Homo sapiens
ctagcccgcgcgagggcggcacccgcggaggtcccggggggcgctgggcagtgtggggcgcggggattggacaagaggccgactgaaggcggagccgagggcggcgtgccggcgatggagcgcgcggtagagccttggggcccagatctccaccgcccggaggagagggagccacagagaggcgcccgcacaggtctagggagtgagaacgtgatttctcagccgaatgagtttgaacataccccacaggaagatgacttggggttcaaggaagaagatttggctccagatcatgaagtaggaaatgcctctctcaaacctgaaggcatccagaactgggatgacttatgggtccagagagagggtctaggaaagcctcagcctcgggacagaggcccccggctcctgggtgaaccacgctggggccaggctagtagtgatcgggccgctgtgtgtggtgagtgtggcaaaagcttcaggcagatgtcagatctggtgaaacaccagcggacccacacaggggagaaaccctacaagtgtggggtctgtggcaag

SEQ ID NO: 3142 - DNA, 3655 bp, Homo sapiens
cgttggtgctgtttgcggatgctgatgcagtttctgcaggactgtaaactggattcctggaacctttgatattcctggctgtgtatagtgcctgttggtggactgtactgatactcaactagagtgtgaagggactggattcctgcccctgagacacaatgcaagctgtagtgcccttgaacaagatgacagccatctcaccagaacctcaaactctggcctcgactgaacaaaatgaggtcccaagagtggttacttctggggaacaagaagctattttaagaggaaatgctgctgatgcagagtctttcagacagaggtttaggtggttttgttactcagaagtagctggacccaggaaagctctgagtcaactctgggagctctgcaatcagtggctgagaccagacattcacacgaaagaacagattttagagcttctggtgtttgagcagttcctgaccattttgcctggggagatcaggatttgggtaaagtcacaacatcctgagagtagtgaggaagtggtgaccctaatagaagatttgacccagatgcttgaagaaaaagatccagtctctcaagattctactgtttcccaagaggagaactcaaaagaggataaaatggtcactgtttgtcccaatactgagtcctgtgaatctataacattgaaggatgtagctgtgaacttttcaagaggagagtggaagaagctggagccttttcaaaaggagctatataaggaagtgctactggaaaacctcaggaacctagaatttctggactttccagtttcaaaattagagttgatttcccagctaaagtgggttgaattgccatggctgctggaagaagtctcaaaaagctcccgactagatgaatcagctttagataaaataatagaaaggtgcctcagggatgatgatcatggcttgatggaagaatcccagcaatattgtggcagctcagaggaggatcacggtaatcagggaaattcaaaaggaagagtcgcacaaaacaaaactcttgggagtggcagtaggggtaagaaatttgacccagataaaagcccctttggacataatttcaaagaaacttcagacttaattaaacatctgagagtctacttgaggaagaaatctcggaggtataatgaaagcaagaaacccttcagttttcattcagaccttgttctgaaccgcaaggagaaaaccgccggagaaaagtcacggaaatctaatgatggtgggaaagtcctgagtcactcttcagctcttactgaacatcagaaacgtcagaagattcatttgggggataggtcccaaaaatgcagtaagtgtgggataatctttattagaagatcaactctttctaggagaaaaacccctatgtgtgagaaatgtcggaaagattcatgtcaagaagcagccttaaataaagatgagggaaatgagagtggagaaaaaactcataaatgtagtaagtgtggaaaagcctttggctatagcgcctcactcaccaaacatcggagaattcacactggagaaaaaccctatatgtgtaatgaatgtggaaaagcttttagtgatagttcatcgctcacaccacatcatagaactcatagtggagagaaacccttcaaatgtgatgactgtgggaaaggtttcaccctaagtgctcacctcattaaacatcagagaattcatactggagaaaaaccttataaatgtaaagactgtgggagaccctttagtgacagttcatctcttattcaacatcagcgaattcatactggagaaaaaccctatacatgtagcaattgtggaaaatccttcagtcatagctcatccctttccaaacatcagagaattcatactggagagaaaccctataaatgtggcgaatgtggaaaagcctttaggcagaattcatgccttacccggcatcagagaattcacactggagaaaaaccatatttgtgtaatgattgcggaatgacttttagccattttacgtctgtgatttatcatcaaagacttcattcaggagaaaaaccctacaaatgtaaccagtgtgagaaagccttcccaacccattcactgctaagtcgtcatcagagaattcatactggtgtaaaaccttataaatgtaaagaatgtgggaagtccttcagtcagagttcatctcttaatgagcaccaccgaattcatacaggagagaaaccctatgagtgtaactattgtggtgcaacctttagtcgaagctcaatccttgtagaacacctaaaaattcataccggaaggagagaatatgaatgtaacgaatgtgagaagacatttaaaagtaattcaggcctcattagacatcggggatttcactctgcagagtaatcctggaactacattaaagtggggggaatttaattcaaattgtcagttactgaaaccctgggatgtaaacttacagtattgatcagtagctgcagctttcgtaaattggcagttaggaaaaatatccttttgcccattcatccctcttcttttcaaggatggcaacgactggtaaacagtaattagttggtaaagtcactggaaagggaagaatgcaaaatgattctgaggccagacgaattggaaaagctcttttcttcaggggatttctctctgatttcttctactaccatgtagtgtgatggagagaacttgactgcagtcacataacttggattctgtcccagtttgccaaccaacttgctgtatacaccttggacaagtcatttgacctttcagaattttattttcgtcaccagcagaatgaagggatgggattaatgatttttgccttttttggttttttagttttttattggtatcctgataatctctgaagctgtggacataagttatttttttttatttgtcattactttcaagtttctctagtaaaaaatacaataccactattcaggatgctggacttcttttcttttttttttcttttttttttttcaatttttcttttttgggatggagtctcactatgttgcccagactggtcttgaactcctgggctcaagtgatccttccatctcactttcctgagtagctgacattacgggtacactccatcaagcctggttcctaggatgctggacttctagcttagtgagaatgcagtatactttttgaaaacttcgtgcaggaatccctcaaatgctgtaactaggaatgggtcagtgaagttcaaacgacttttccttgagggagtattttaatcggacaagggaactctttttcttttgggcattggccaacaggactgagaagccagagagcttgcacctgagccatctcagccgtgagagtaacagtcctaggaaaatagatgggggctgggggtaaggaaatgtgctgaagacagagctattctggatggattttggtttgcaaaaattctactttaaaacaattttgcctgtagcaagtacatttttttgcaattggagtgtaaacattctgtgtggcaacagttaaaagctgttataacaatttgcttgggtgtgtgtgcatgtgtgtgtgtgtgtgtgtgtgtgtatacattgttgccactatctaaaattagggcatttcatactaaaaacaaagcttgtctt

SEQ ID NO: 3143 - DNA, 1239 bp, Homo sapiens
gcgcactcgctgcgggacaagcttctggaagctctttgcggtggcgttggtgctgtttgcggatgctgatgcagtttctgcaggactgtaaactggattcctggaacctttgatattcctggctgtgtatagtgcctgttggtggactgtactgatactcaactagagtgtgaagggactggattcctgcccctgagacacaatgcaagctgtagtgcccttgaacaagatgacagccatctcaccagaacctcaaactctggcctcgactgaacaaaatgaggtcccaagagtggttacttctggggaacaagaagctattttaagaggaaatgctgctgatgcagagtctttcagacagaggtttaggtggttttgttactcagaagtagctggacccaggaaagctctgagtcaactctgggagctctgcaatcagtggctgagaccagacattcacacgaaagaacagattttagagcttctggtgtttgagcagttcctgaccattttgcctggggagatcaggatttgggtaaagtcacaacatcctgagagtagtgaggaagtggtgaccctaatagaagatttgacccagatgcttgaagaaaaagatccagtctctcaagattctactgtttcccaagaggagaactcaaaagaggataaaatggtcactgtttgtcccaatactgagtcctgtgaatctataacattgaaggatgtagctgtgaacttttcaagaggagagtggaagaagctggagccttttcaaaaggagctatataaggaagtgctactggaaaacctcaggaacctagaatttctggactttccagtttcaaaattagagttgatttcccagctaaagtgggttgaattgccatggctgctggaagaagtctcaaaaagctcccgactaggaagtgtgatttgataaaggttcaataagagaatgaggctgggtgtggtggctcatgcctgtaatcccagcactttgggaggccaaggcaggtggatcacctgaggtcaggaattgaagaccagcctgaccaacatggagaagccccatctctactaaaaatacaaaattagctgggcgtggtggtacatgcctgtaatccaggctacttgggaggctgaggcaggagaatcgcttgaacctgggaggcagagattgcggtgagccaagatcgcacattgcatccagcctgggcaacaagagcaaaactccgtctc

SEQ ID NO: 3144 - DNA, 2433 bp, Homo sapiens
gcaggcgcagtggttcccgcaggcttgcgcgcgcactcgctgcgggacaagcttctggaagctctttgcggtggcgttggtgctgtttgcggatgctgatgcagtttctgcaggactgtaaactggattcctggaacctttgatattcctggctgtgtatagtgcctgttggtggactgtactgatactcaactagagtgtgaagggactggattcctgcccctgagacacaatgcaagctgtagtgcccttgaacaagatgacagccatctcaccagaacctcaaactctggcctcgactgaacaaaatgaggtcccaagagtggttacttctggggaacaagaagctattttaagaggaaatgctgctgatgcagagtctttcagacagaggtttaggtggttttgttactcagaagtagctggacccaggaaagctctgagtcaactctgggagctctgcaatcagtggctgagaccagacattcacacgaaagaacagattttagagcttctggtgtttgagcagttcctgaccattttgcctggggagatcaggatttgggtaaagtcacaacatcctgagagtagtgaggaagtggtgaccctaatagaagatttgacccagatgcttgaagaaaaagatccagtctctcaagattctactgtttcccaagaggagaactcaaaagaggataaaatggtcactgtttgtcccaatactgagtcctgtgaatctataacattgaaggatgtagctgtgaacttttcaagaggagagtggaagaagctggagccttttcaaaaggagctatataaggaagtgctactggaaaacctcaggaacctagaatttctggactttccagtttcaaaattagagttgatttcccagctaaagtgggttgaattgccatggctgctggaagaagtctcaaaaagctcccgactagacatacatggagcagtaaaaaagatgcagatgttctctgaggctgaataagaccatgctctgccttcttgtttcaactgttacacagagatgaccagaggatggggccactgcagtgcagttcaagaggctctggttcggggaagagctggatggagtatgaatcccaactctgggggtattagctagtggagtggccataggcaagttacttaacacttctgaacctccttttgtctttcataaaataaaagctactaggatgagttgttttaaggatttcagattatagtctatgtgagatatgtgcaaacatgtacatatttcccctagaagcaatggttttcagccttggtggtgaccttatagaacataaatattgtgaataatgaaaatccactgaatctaataagggacttgtatcggtaagatgtaaagaactcttggccaggtgtggtggctcatgcctataatcccagcactttgggaggccaaggcaggtggatcacctgaggtcaggagttcgagaccaacctggccaacatgacgaaactccgtctctatttaaaatacaaaaattagctgggcatggtggtgcatgcctgtaatcccagctactcgggaggctgaggcaggagaatcacttgaactcgggaggtggaggttgcagtgagccaagatcgcgccactgcactccagcctggatgacagagcaaaaaactgtctcaaaaaaaaaaaaatcttacaacctcacaaataacctagttcaaaaatgggcaaagattttgaacagatatttctccaaagaagatatacaaatggcaaatacatacgttgaaagatccttaatattgttagccatagggaaatgcaagtcaaactcaaatcagaatgaaatatcacttcaaacctactaggatggttataataaaaaagacagacaatagcacgtgttggtgagtatgtagagaagttggaaccctcatacactgcttgtgggaatgtaaagtactgtagccactttgcaaaacagtttgacagctcctcaaaatgttaaacatgaaattatcatatgacccagcaattctactcataggtatatacttaaaagaaatgaaaaatccacacaaaaacctctgcatgaatgttcatagtaacattatacttcatagccagaaagtataagctaatacccatcaggctgggtgtggtggctcacgcctgtaatcctagcactttgggaggccgagttgggaggtttgcttgagcccaggagttccagaccagcctgggcaacatggcgaaaccccatctctactaaaaatataaaaattagttgcgtgtggtggcacatccctatagtcccagctacttgggaggctgaggtggaaggattgcttgagcgagggaggtcgaggctgcagtgagccacgatcacaccactgcactccagcctaggtgacagagtgagatcctgtctc

SEQ ID NO: 3145 - DNA, 800 bp, Homo sapiens
gaagctctttgcggtggcgttggtgctgtttgcggatgctgatgcagtttctgcaggactgtaaactggattcctggaacctttgatattcctggctgtgtatagtgcctgttggtggactgtactgatactcaactagagtgtgaagggactggattcctgcccctgagacacaatgcaagctgtagtgcccttgaacaagatgacagccatctcaccagaacctcaaactctggcctcgactgaacaaaatgaggtcccaagagtggttacttctggggaacaagaagctattttaagaggaaatgctgctgatgcagagtctttcagacagaggtttaggtggttttgttactcagaagtagctggacccaggaaagctctgagtcaactctgggagctctgcaatcagtggctgagaccagacattcacacgaaagaacagattttagagcttctggtgtttgagcagttcctgaccattttgcctggggagatcaggatttgggtaaagtcacaacatcctgagagtagtgaggaagtggtgaccctaatagaagatttgacccagatgcttgaagaaaaaggtgagatttatagatggagggaggaagcgggagacattgcctcaaagtccgaaagtaaattcctcaaaagaaggcaatttactgctaaagaggagtctgaggttagaagttgggactgggtttgaatcagccctgccatttactgtgtgattttgggcaagctgtgtaaactctcagaatgtaaatatttttatctgttaaaaagggatttta

SEQ ID NO: 3146 - DNA, 2836 bp, Homo sapiens
agcgctgtaagaagtacctctaggcctgggaggcattgagaaaaaggaagtgggtcctgttctggttcttgcgactatagtcacctcccgaggcaaatgaccactgtcctgagaggacgtgggtgaggggcaggaatcagtgtcattcaaggacgtaactgtagacttcagtagggatgagtggcaacaattagaccttgctcagaaaagcctgtacagagaagtgatgctggaaaactatttcaacttgatctcagtgggatgtcaagttcccaaaccagaagtcatcttcagcttggaacaagaagagccatgtatgttggatggtgagatccccagtcagagccgtccagatggggacattggttttggacctttacaacagaggatgtctgaagaagtttctttccagtctgagattaatattaatctcttcacaagagatgacccatattccattttagaagaattgtggaaagacgatgaacacacaagaaaatgtggagaaaaccagaacaaacctttaagtcgtgttgtcttcattaacaagaaaacactagctaatgacagcatctttgaatataaggacattggggaaatagttcatgtaaacacacacctggtttcctcaagaaaaagaccccataactgtaactcgtgtggaaagaatttggagcctatcataaccttatataatagaaacaatgcaacagaaaattctgataagactattggagatggtgatattttcactcatttgaattctcatacagaagtgactgcttgtgaatgtaaccaatgtgggaaacctctgcatcataagcaagctctcattcaacaacagaaaattcatactagagagagcctctatttgttttctgactacgtaaatgttttctccccgaagtcacatgcctttgcacatgagagtatttgtgctgaagaaaagcagcatgaatgccatgaatgtgaggcagtcttcactcagaagtcccagcttgatggcagtcagagggtttatgcaggaatatgcactgaatatgagaaggatttttccctcaagtcaaaccgtcagaaaactccttatgaggggaattactataaatgcagtgactatggaagagcctttatccagaagtcagatctgttcagatgccagagaattcattctggagaaaaaccttatgagtacagtgaatgtgagaaaaacctccctcagaattcaaaccttaatatacataaaaaaattcatactggagggaaacactttgaatgtactgaatgtggaaaagctttcacaaggaaatcaacactaagtatgcatcagaaaatccatacaggagaaaaaccttatgtatgtactgaatgtgggaaggcctttatccggaagtcacattttatcacacatgaaagaattcatactggagaaaaaccctatgaatgcagtgactgtgggaaatcctttattaaaaaatcacaactccatgtgcatcagcgaattcacacaggagagaatccctttatatgttcagaatgtgggaaggtcttcactcacaagacaaatctcattatacaccagaaaattcatacaggagaaagaccctatatatgtactgtgtgtggtaaggcctttactgacaggtcaaatctcattaagcaccaaaaaattcatactggagagaaaccttataaatgcagcgactgtggaaaatcattcacctggaagtctcggctcaggatacatcagaagtgtcatactggagagagacattatgaatgcagtgaatgtgggaaagcattcattcagaagtcaacattaagtatgcaccagagaattcatagaggggaaaaaccatatgtttgcactgaatgtggtaaggccttcttccacaaatcccattttattacacatgagagaattcatactggagagaaaccctatgaatgcagtatttgtgggaaatccttcactaagaaatcacagctccacgtacatcagcagattcacacaggagagaaaccctataggtgtgctgaatgtggaaaggcttttactgacagatcaaatctctttacacaccagaaaattcacactggagagaaaccttataaatgtagtgactgtgggaaagccttcactaggaagtcaggtctccatatacatcagcaatcccatactggagaaaggcattatgagtgcagtgaatgtgggaaagcctttgcaagaaaatcaacactaattatgcatcagagaattcatacaggagagaaaccctatatttgtaatgaatgtgggaaatccttcatccagaagtcacacttaaatagacacaggagaattcatactggagagaaaccctatgaatgcagtgactgtggcaagtctttcattaagaaatcacaactccatgagcatcatcgaattcacacaggagagaaaccatatatatgtgctgagtgtggaaaggccttcaccatcagatcaaatcttattaaacaccagaaaattcatactaaacagaaaccctataagtgcagtgacttggggaaagccttaaactggaagccacaactcagtatgcctcagaaatctgacaatggggaagtagagtgctccatgccacaattatggtgtggggactcagaaggtgaccaaggccaactttcttctatctagttagaattatgaacatctggatcatatagctgatgtgtagttacacatatggggagacacttttgagagtgtttaagcaatgtatagtggccatctttggttacttgatattggtgttgtcaagctcctgcaaataatagtaaatgtgcaaggagatga

SEQ ID NO: 3147 - DNA, 2867 bp, Homo sapiens
tacctctaggcctgggaggcattgagaaaaaggaagtgggtcctgttctggttcttgcgactatagtcacctcccgaggcaaatgaccactgtcctgagaggacgtgggtgaggggcagatttctgcccctttgtccgaagagccaaaaatgaccaagtccctggaatcagtgtcattcaaggacgtaactgtagacttcagtagggatgagtggcaacaattagaccttgctcagaaaagcctgtacagagaagtgatgctggaaaactatttcaacttgatctcagtgggatgtcaagttcccaaaccagaagtcatcttcagcttggaacaagaagagccatgtatgttggatggtgagatccccagtcagagccgtccagatggggacattggttttggacctttacaacagaggatgtctgaagaagtttctttccagtctgagattaatattaatctcttcacaagagatgacccatattccattttagaagaattgtggaaagacgatgaacacacaagaaaatgtggagaaaaccagaacaaacctttaagtcgtgttgtcttcattaacaagaaaacactagctaatgacagcatctttgaatataaggacattggggaaatagttcatgtaaacacacacctggtttcctcaagaaaaagaccccataactgtaactcgtgtggaaagaatttggagcctatcataaccttatataatagaaacaatgcaacagaaaattctgataagactattggagatggtgatattttcactcatttgaattctcatacagaagtgactgcttgtgaatgtaaccaatgtgggaaacctctgcatcataagcaagctctcattcaacaacagaaaattcatactagagagagcctctatttgttttctgactacgtaaatgttttctccccgaagtcacatgcctttgcacatgagagtatttgtgctgaagaaaagcagcatgaatgccatgaatgtgaggcagtcttcactcagaagtcccagcttgatggcagtcagagggtttatgcaggaatatgcactgaatatgagaaggatttttccctcaagtcaaaccgtcagaaaactccttatgaggggaattactataaatgcagtgactatggaagagcctttatccagaagtcagatctgttcagatgccagagaattcattctggagaaaaaccttatgagtacagtgaatgtgagaaaaacctccctcagaattcaaaccttaatatacataaaaaaattcatactggagggaaacactttgaatgtactgaatgtggaaaagctttcacaaggaaatcaacactaagtatgcatcagaaaatccatacaggagaaaaaccttatgtatgtactgaatgtgggaaggcctttatccggaagtcacattttatcacacatgaaagaattcatactggagaaaaaccctatgaatgcagtgactgtgggaaatcctttattaaaaaatcacaactccatgtgcatcagcgaattcacacaggagagaatccctttatatgttcagaatgtgggaaggtcttcactcacaagacaaatctcattatacaccagaaaattcatacaggagaaagaccctatatatgtactgtgtgtggtaaggcctttactgacaggtcaaatctcattaagcaccaaaaaattcatactggagagaaaccttataaatgcagcgactgtggaaaatcattcacctggaagtctcggctcaggatacatcagaagtgtcatactggagagagacattatgaatgcagtgaatgtgggaaagcattcattcagaagtcaacattaagtatgcaccagagaattcatagaggggaaaaaccatatgtttgcactgaatgtggtaaggccttcttccacaaatcccattttattacacatgagagaattcatactggagagaaaccctatgaatgcagtatttgtgggaaatccttcactaagaaatcacagctccacgtacatcagcagattcacacaggagagaaaccctataggtgtgctgaatgtggaaaggcttttactgacagatcaaatctctttacacaccagaaaattcacactggagagaaaccttataaatgtagtgactgtgggaaagccttcactaggaagtcaggtctccatatacatcagcaatcccatactggagaaaggcattatgagtgcagtgaatgtgggaaagcctttgcaagaaaatcaacactaattatgcatcagagaattcatacaggagagaaaccctatatttgtaatgaatgtgggaaatccttcatccagaagtcacacttaaatagacacaggagaattcatactggagagaaaccctatgaatgcagtgactgtggcaagtctttcattaagaaatcacaactccatgagcatcatcgaattcacacaggagagaaaccatatatatgtgctgagtgtggaaaggccttcaccatcagatcaaatcttattaaacaccagaaaattcatactaaacagaaaccctataagtgcagtgacttggggaaagccttaaactggaagccacaactcagtatgcctcagaaatctgacaatggggaagtagagtgctccatgccacaattatggtgtggggactcagaaggtgaccaaggccaactttcttctatctagttagaattatgaacatctggatcatatagctgatgtgtagttacacatatggggagacacttttgagagtgtttaagcaatgtatagtggccatctttggttacttgatattggtgttgtcaagctcctgcaaataatagtaaatgtgcaaggagatga

SEQ ID NO: 3148 - DNA, 3180 bp, Homo sapiens
gaatcagtgtcattcaaggacgtaactgtagacttcagtagggatgagtggcaacaattagaccttgctcagaaaagcctgtacagagaagtgatgctggaaaactatttcaacttgatctcagtgggatgtcaagttcccaaaccagaagtcatcttcagcttggaacaagaagagccatgtatgttggatggtgagatccccagtcagagccgtccagatggggacattggttttggacctttacaacagaggatgtctgaagaagtttctttccagtctgagattaatattaatctcttcacaagagatgacccatattccattttagaagaattgtggaaagacgatgaacacacaagaaaatgtggagaaaaccagaacaaacctttaagtcgtgttgtcttcattaacaagaaaacactagctaatgacagcatctttgaatataaggacattggggaaatagttcatgtaaacacacacctggtttcctcaagaaaaagaccccataactgtaactcgtgtggaaagaatttggagcctatcataaccttatataatagaaacaatgcaacagaaaattctgataagactattggagatggtgatattttcactcatttgaattctcatacagaagtgactgcttgtgaatgtaaccaatgtgggaaacctctgcatcataagcaagctctcattcaacaacagaaaattcatactagagagagcctctatttgttttctgactacgtaaatgttttctccccgaagtcacatgcctttgcacatgagagtatttgtgctgaagaaaagcagcatgaatgccatgaatgtgaggcagtcttcactcagaagtcccagcttgatggcagtcagagggtttatgcaggaatatgcactgaatatgagaaggatttttccctcaagtcaaaccgtcagaaaactccttatgaggggaattactataaatgcagtgactatggaagagcctttatccagaagtcagatctgttcagatgccagagaattcattctggagaaaaaccttatgagtacagtgaatgtgagaaaaacctccctcagaattcaaaccttaatatacataaaaaaattcatactggagggaaacactttgaatgtactgaatgtggaaaagctttcacaaggaaatcaacactaagtatgcatcagaaaatccatacaggagaaaaaccttatgtatgtactgaatgtgggaaggcctttatccggaagtcacattttatcacacatgaaagaattcatactggagaaaaaccctatgaatgcagtgactgtgggaaatcctttattaaaaaatcacaactccatgtgcatcagcgaattcacacaggagagaatccctttatatgttcagaatgtgggaaggtcttcactcacaagacaaatctcattatacaccagaaaattcatacaggagaaagaccctatatatgtactgtgtgtggtaaggcctttactgacaggtcaaatctcattaagcaccaaaaaattcatactggagagaaaccttataaatgcagcgactgtggaaaatcattcacctggaagtctcggctcaggatacatcagaagtgtcatactggagagagacattatgaatgcagtgaatgtgggaaagcattcattcagaagtcaacattaagtatgcaccagagaattcatagaggggaaaaaccatatgtttgcactgaatgtggtaaggccttcttccacaaatcccattttattacacatgagagaattcatactggagagaaaccctatgaatgcagtatttgtgggaaatccttcactaagaaatcacagctccacgtacatcagcagattcacacaggagagaaaccctataggtgtgctgaatgtggaaaggcttttactgacagatcaaatctctttacacaccagaaaattcacactggagagaaaccttataaatgtagtgactgtgggaaagccttcactaggaagtcaggtctccatatacatcagcaatcccatactggagaaaggcattatgagtgcagtgaatgtgggaaagcctttgcaagaaaatcaacactaattatgcatcagagaattcatacaggagagaaaccctatatttgtaatgaatgtgggaaatccttcatccagaagtcacacttaaatagacacaggagaattcatactggagagaaaccctatgaatgcagtgactgtggcaagtctttcattaagaaatcacaactccatgagcatcatcgaattcacacaggagagaaaccatatatatgtgctgagtgtggaaaggccttcaccatcagatcaaatcttattaaacaccagaaaattcatactaaacagaaaccctataagtgcagtgacttggggaaagccttaaactggaagccacaactcagtatgcctcagaaatctgacaatggggaagtagagtgctccatgccacaattatggtgtggggactcagaaggtgaccaaggccaactttcttctatctagttagaattatgaacatctggatcatatagctgatgtgtagttacacatatggggagacacttttgagagtgtttaagcaatgtatagtggccatctttggttacttgatattggtgttgtcaagctcctgcaaataatagtaaatgtgcaaggagatgattggcagtctttcttgtttcactttttgggcaaacagttttataaattcatggctgttgagtttttcatgttctgggtaccacaactattcaatattgacccgcaaaaattcataatgagtagtatgatgagataattttacattgtctaagcagcctaaggacactgagatcaaggcaaagagagggcaatttaggtctataatgaaagtgaatcagcagtttttgtgaaaacactaaagacagaaagaaaggactctactttttttaaaattttctttgggaagtcaccattatttattgttatatctgttggcgtatgctggggcagcagttagccaagaggtctgaaattgctctttgcctatttctcaaaagtctatattattaccttagaactggccctacgatcatggaacttagatacagggacccaggtctagatagcagcactttagatcctcagctttcaccacag

SEQ ID NO: 3149 - DNA, 2847 bp, Homo sapiens
cccgaggcaaatgaccactgtcctgagaggacgtgggtgaggggcaggtgagtagagggatggcagcatctgtggactgagcaagaagaatctctgatgtctgtcctgagccttccggaatcagtgtcattcaaggacgtaactgtagacttcagtagggatgagtggcaacaattagaccttgctcagaaaagcctgtacagagaagtgatgctggaaaactatttcaacttgatctcagtgggatgtcaagttcccaaaccagaagtcatcttcagcttggaacaagaagagccatgtatgttggatggtgagatccccagtcagagccgtccagatggggacattggttttggacctttacaacagaggatgtctgaagaagtttctttccagtctgagattaatattaatctcttcacaagagatgacccatattccattttagaagaattgtggaaagacgatgaacacacaagaaaatgtggagaaaaccagaacaaacctttaagtcgtgttgtcttcattaacaagaaaacactagctaatgacagcatctttgaatataaggacattggggaaatagttcatgtaaacacacacctggtttcctcaagaaaaagaccccataactgtaactcgtgtggaaagaatttggagcctatcataaccttatataatagaaacaatgcaacagaaaattctgataagactattggagatggtgatattttcactcatttgaattctcatacagaagtgactgcttgtgaatgtaaccaatgtgggaaacctctgcatcataagcaagctctcattcaacaacagaaaattcatactagagagagcctctatttgttttctgactacgtaaatgttttctccccgaagtcacatgcctttgcacatgagagtatttgtgctgaagaaaagcagcatgaatgccatgaatgtgaggcagtcttcactcagaagtcccagcttgatggcagtcagagggtttatgcaggaatatgcactgaatatgagaaggatttttccctcaagtcaaaccgtcagaaaactccttatgaggggaattactataaatgcagtgactatggaagagcctttatccagaagtcagatctgttcagatgccagagaattcattctggagaaaaaccttatgagtacagtgaatgtgagaaaaacctccctcagaattcaaaccttaatatacataaaaaaattcatactggagggaaacactttgaatgtactgaatgtggaaaagctttcacaaggaaatcaacactaagtatgcatcagaaaatccatacaggagaaaaaccttatgtatgtactgaatgtgggaaggcctttatccggaagtcacattttatcacacatgaaagaattcatactggagaaaaaccctatgaatgcagtgactgtgggaaatcctttattaaaaaatcacaactccatgtgcatcagcgaattcacacaggagagaatccctttatatgttcagaatgtgggaaggtcttcactcacaagacaaatctcattatacaccagaaaattcatacaggagaaagaccctatatatgtactgtgtgtggtaaggcctttactgacaggtcaaatctcattaagcaccaaaaaattcatactggagagaaaccttataaatgcagcgactgtggaaaatcattcacctggaagtctcggctcaggatacatcagaagtgtcatactggagagagacattatgaatgcagtgaatgtgggaaagcattcattcagaagtcaacattaagtatgcaccagagaattcatagaggggaaaaaccatatgtttgcactgaatgtggtaaggccttcttccacaaatcccattttattacacatgagagaattcatactggagagaaaccctatgaatgcagtatttgtgggaaatccttcactaagaaatcacagctccacgtacatcagcagattcacacaggagagaaaccctataggtgtgctgaatgtggaaaggcttttactgacagatcaaatctctttacacaccagaaaattcacactggagagaaaccttataaatgtagtgactgtgggaaagccttcactaggaagtcaggtctccatatacatcagcaatcccatactggagaaaggcattatgagtgcagtgaatgtgggaaagcctttgcaagaaaatcaacactaattatgcatcagagaattcatacaggagagaaaccctatatttgtaatgaatgtgggaaatccttcatccagaagtcacacttaaatagacacaggagaattcatactggagagaaaccctatgaatgcagtgactgtggcaagtctttcattaagaaatcacaactccatgagcatcatcgaattcacacaggagagaaaccatatatatgtgctgagtgtggaaaggccttcaccatcagatcaaatcttattaaacaccagaaaattcatactaaacagaaaccctataagtgcagtgacttggggaaagccttaaactggaagccacaactcagtatgcctcagaaatctgacaatggggaagtagagtgctccatgccacaattatggtgtggggactcagaaggtgaccaaggccaactttcttctatctagttagaattatgaacatctggatcatatagctgatgtgtagttacacatatggggagacacttttgagagtgtttaagcaatgtatagtggccatctttggttacttgatattggtgttgtcaagctcctgcaaataatagtaaatgtgcaaggagatgattggcagtctttcttgtttcacttttt

SEQ ID NO: 3150 - DNA, 2054 bp, Homo sapiens
cacttccgcttccggtccagcctgtctccgcgtggtgcgagcgctgcaccagcccctggctggtggttactgtccgaacggcgtggtgtggtcgctgactctctgggcgtgcagctccgcagccctgccggctcggttcgattgacttacgcaggattctcagcccttgcctgggagaacagttcaggagacagatggccccaagagcccagatccagggaccgctgacatttggggatgtggctgtggcctttacccggattgagtggagacacctggatgctgctcagcgggccctgtacagggatgtgatgctggagaactatgggaatctggtgtctgtggggcttctctcttccaaaccaaaactaattactcagttggagcaaggggcagagccctggactgaggtgcgagaggctccatcaggcacacatgcagtcgaggattactggtttgaaacaaagatgtcagccctaaagcaaagcacttctgaagcatctgttctgggagagcgaacgaaaagtgtcatgatggaaaaaggcctggactgggagggcagaagctccacagagaagaactataagtgcaaggaatgtgggaaagtcttcaaatacaattcgtcctttattagccaccagagaaatcacaccagtgagaaaccacataaatgtaaagaatgtgggatcgcctttatgaacagttcatcccttttaaatcaccataaggttcatgcaggcaaacagccttatagatgtattgaatgtgggaagttcctgaagaagcactcaacgtttatcaaccatcagagaattcattctagggagaaaccccacaaatgcattgaatgtggaaaaactttcagaaagaactcaatccttttaagtcatcagagaattcatactggccagaaaccctacaaatgtaatgactgtgggaaagccttcgctcagaatgcagctcttactcgtcatgaaagaatacatagtggagagaagccttttaaatgtaacaagtgtgggagagctttcagggataattcaactgtgttggaacatcagaaaatccatactggtgagaagccatatcagtgtaatgaatgtggaaaagcctttaggaagagctcaactcttattagtcaccaaagaatgcatactggggagaaaccctatcactgcagtaaatgtggaaaatctttcaggtatagctcatcctttgctggtcatcagaaaactcacagtggaaataaaccgtatcagtgtcgtgactgtgggaaggcctttacaaagagctcaacccttactggacatcagagaattcatactggagaaaaaccctatcactgtaagaaatgtgggaaagcctttcggcacagctcaggccttgttgaacatcagagactccatactggggaaaaaccttataaatgtaatgaatgtgggaaagcttttccccgaagttcagcccttaagcaacataagaaaattcataataaagaaagagccatgaaatgtagttagtgtggcaaattgtgcagagtagtttattccttctgaccatcatagaggagacattaaataaattatgcatttaacagaaatactctgtacttctgagagaacacatcacttgtgaggatattcattgtgaggttctactagtgaaatatttgaagaaactaaatgtatgtcagtatggaagtagttatagcatactgtgtgctaattgaaaagaatgaggtggagctgtaaatactgtacaaagccaggcatggtggcatatgcctgtagtcccagttacttgggaggctgagacaggattgcttaagcccaggagtttgagtctgtaatgcactatgattgtgcatgtgaatagccactgcactccagcctgggcaacatagcaagactccatctctaagtaaaaaaatacaacagtagaaatatacccatgataatatacccaatatacccttgttaaagaagcaagtttcaggaaatctatattatatgcattcaaaaagacctggacaaataaagaccaatcttaacagc

SEQ ID NO: 3151 - DNA, 2052 bp, Homo sapiens
gcctgtctccgcgtggtgcgagcgctgcaccagcccctggctggtggttactgtccgaacggcgtggtgtggtcgctgactctctgggcgtgcagctccgcagccctgccggctcggttcggttcgtgagcggccgggattgacttacgcaggattctcagcccttgcctgggagaacagttcaggagacagatggccccaagagcccagatccagggaccgctgacatttggggatgtggctgtggcctttacccggattgagtggagacacctggatgctgctcagcgggccctgtacagggatgtgatgctggagaactatgggaatctggtgtctgtggggcttctctcttccaaaccaaaactaattactcagttggagcaaggggcagagccctggactgaggtgcgagaggctccatcaggcacacatgcagtcgaggattactggtttgaaacaaagatgtcagccctaaagcaaagcacttctgaagcatctgttctgggagagcgaacgaaaagtgtcatgatggaaaaaggcctggactgggagggcagaagctccacagagaagaactataagtgcaaggaatgtgggaaagtcttcaaatacaattcgtcctttattagccaccagagaaatcacaccagtgagaaaccacataaatgtaaagaatgtgggatcgcctttatgaacagttcatcccttttaaatcaccataaggttcatgcaggcaaacagccttatagatgtattgaatgtgggaagttcctgaagaagcactcaacgtttatcaaccatcagagaattcattctagggagaaaccccacaaatgcattgaatgtggaaaaactttcagaaagaactcaatccttttaagtcatcagagaattcatactggccagaaaccctacaaatgtaatgactgtgggaaagccttcgctcagaatgcagctcttactcgtcatgaaagaatacatagtggagagaagccttttaaatgtaacaagtgtgggagagctttcagggataattcaactgtgttggaacatcagaaaatccatactggtgagaagccatatcagtgtaatgaatgtggaaaagcctttaggaagagctcaactcttattagtcaccaaagaatgcatactggggagaaaccctatcactgcagtaaatgtggaaaatctttcaggtatagctcatcctttgctggtcatcagaaaactcacagtggaaataaaccgtatcagtgtcgtgactgtgggaaggcctttacaaagagctcaacccttactggacatcagagaattcatactggagaaaaaccctatcactgtaagaaatgtgggaaagcctttcggcacagctcaggccttgttgaacatcagagactccatactggggaaaaaccttataaatgtaatgaatgtgggaaagcttttccccgaagttcagcccttaagcaacataagaaaattcataataaagaaagagccatgaaatgtagttagtgtggcaaattgtgcagagtagtttattccttctgaccatcatagaggagacattaaataaattatgcatttaacagaaatactctgtacttctgagagaacacatcacttgtgaggatattcattgtgaggttctactagtgaaatatttgaagaaactaaatgtatgtcagtatggaagtagttatagcatactgtgtgctaattgaaaagaatgaggtggagctgtaaatactgtacaaagccaggcatggtggcatatgcctgtagtcccagttacttgggaggctgagacaggattgcttaagcccaggagtttgagtctgtaatgcactatgattgtgcatgtgaatagccactgcactccagcctgggcaacatagcaagactccatctctaagtaaaaaaatacaacagtagaaatatacccatgataatatacccaatatacccttgttaaagaagcaagtttcaggaaatctatattatatgcattcaaaaagacctggacaaataaagaccaatcttaacagc

SEQ ID NO: 3152 - DNA, 1515 bp, Homo sapiens
cacttccgcttccggtccagcctgtctccgcgtggtgcgagcgctgcaccagcccctggctggtggttactgtccgaacggcgtggtgtggtcgctgactctctgggcgtgcagctccgcagccctgccggctcggttcgattgacttacgcaggattctcagcccttgcctgggagaacagttcaggagacagatggccccaagagcccagatccagtcgaggattactggtttgaaacaaagatgtcagccctaaagcaaagcacttctgaagcatctgttctgggagagcgaacgaaaagtgtcatgatggaaaaaggcctggactgggagggcagaagctccacagagaagaactataagtgcaaggaatgtgggaaagtcttcaaatacaattcgtcctttattagccaccagagaaatcacaccagtgagaaaccacataaatgtaaagaatgtgggatcgcctttatgaacagttcatcccttttaaatcaccataaggttcatgcaggcaaacagccttatagatgtattgaatgtgggaagttcctgaagaagcactcaacgtttatcaaccatcagagaattcattctagggagaaaccccacaaatgcattgaatgtggaaaaactttcagaaagaactcaatccttttaagtcatcagagaattcatactggccagaaaccctacaaatgtaatgactgtgggaaagccttcgctcagaatgcagctcttactcgtcatgaaagaatacatagtggagagaagccttttaaatgtaacaagtgtgggagagctttcagggataattcaactgtgttggaacatcagaaaatccatactggtgagaagccatatcagtgtaatgaatgtggaaaagcctttaggaagagctcaactcttattagtcaccaaagaatgcatactggggagaaaccctatcactgcagtaaatgtggaaaatctttcaggtatagctcatcctttgctggtcatcagaaaactcacagtggaaataaaccgtatcagtgtcgtgactgtgggaaggcctttacaaagagctcaacccttactggacatcagagaattcatactggagaaaaaccctatcactgtaagaaatgtgggaaagcctttcggcacagctcaggccttgttgaacatcagagactccatactggggaaaaaccttataaatgtaatgaatgtgggaaagcttttccccgaagttcagcccttaagcaacataagaaaattcataataaagaaagagccatgaaatgtagttagtgtggcaaattgtgcagagtagtttattccttctgaccatcatagaggagacattaaataaattatgcatttaacagaaatactctgtacttctgagagaacacatcacttgtgaggatattcattgtgaggttctactagtgaaatatttgaagaaactaaatgtatgtcagtatggaagtagttatagcatactgtgtgctaattgaaaagaatga

SEQ ID NO: 3153 - DNA, 529 bp, Homo sapiens
cggtccagcctgtctccgcgtggtgcgagcgctgcaccagcccctggctggtggttactgtccgaacggcgtggtgtggtcgctgactctctgggcgtgcagctccgcagccctgccggctcgattgacttacgcaggattctcagcccttgcctgggagaacagttcaggagacagatggccccaagagcccagatccagggaccgctgacatttggggatgtggctgtggcctttacccggattgagtggagacacctggatgctgctcagcgggccctgtacagggatgtgatgctggagaactatgggaatctggtgtctgtggggcttctctcttccaaaccaaaactaattactcagttggagcaaggggcagagccctggactgaggtgcgagaggctccatcaggcacacatgcagtcgaggattactggtttgaaacaaagatgtcagccctaaagcaaagcacttctgaagcatctgttctgggagagcgaacgaaaagtgtcatgatggaaaaaggcc

SEQ ID NO: 3154 - DNA, 1522 bp, Homo sapiens
agaggcccaccctctgtggccctgtgtcctgtaggtattgggagatccacagccaagatgccgggaccccttagaagcctagaaatggaatcattgcaatttagagatgtggctgtagaattctctctggaggagtggcattgcctggacactgcacagcagaatttatatagggatgtgatgttagagaactacagacacctggtcttccttggtattattgtctctaagccagacctgatcacctgtctggagcaaggaataaaacctctgactatgaagagacatgagatgattgccaaacccccagttgtgtgttctcattttgcccaagacctttggccagagcagagcataaaagattcttaccaaaaagtgatactgagaaaatttgaaaaatgtggacatggcaatttacactttaaaaaaggctgtgaaagtgtggatgagtgtaagttacacaaaagaggttataatggacttaaccaatgtttgacaactacccagagcaaaatatttcaatgtggtaaatatgtgaaagtctttcatcaattttcaaattcaaagagacataaaagaagacatactgaaaaaaaacctttgaaatatatagaaggtgacaaagcttttaaccagtcctcaacccatactacacataaaaaaattgatactggagagaaaccatacaaatgtgaagaatgtggcaaagccttcaaccggtcctcacaccttactacacataagataactcatactagagagaaaccctacaaatgtgaagaatgtggcaaagtctttaagtacttctctagctttactacacataagaaaattcatagtggagagaaaccctacatttgtgaagaatgtggcaaagcctttatgtacccctatacccttactacacataagataatccatactggagagcaaccctacaaatgtaaagaatgtgacaaagcttttaaccatcctgcaactctttcttcacataagaaaattcatactggagagaaaccgtacacgtgtgataaatgtggcaaagcctttatttcatcctcgatccttagtaaacatgagaagattcatacgggagagaaaccctacaaatgtgaagaatgtggcaaagccttcacccgctcctcacaccttactatgcataagataattcatactggagagaaaccatacaaatgtgaagaatgtggcaaagcctttacatggtctgcaggcctccataaacataggagaactcatactggagagaaaccctacaaatgtgaagaatgtggcaaagcgtatactacatcctcaaatctaactgaacataagacaactcatactggagagaaaccttacaaatgtaaagaatgtggcaaagcttttaactggtcctcagaccttaataaacataagagaattcatattggacagaaaccaagaacgtgacaaaggattattttattattattatttttttgagaggtaattctgctgttgtttcccaggctggagtgcaatg

SEQ ID NO: 3155 - DNA, 1582 bp, Homo sapiens
gtctctcgctgcatctggagctctaggtcgcctcttcgctactctgtgtcctctgctcctagaggcccaccctctgtggccctgtgtcctgtaggtattgggagatccacagccaagatgccgggaccccttagaagcctagaaatggaatcattgcaatttagagatgtggctgtagaattctctctggaggagtggcattgcctggacactgcacagcagaatttatatagggatgtgatgttagagaactacagacacctggtcttccttggtattattgtctctaagccagacctgatcacctgtctggagcaaggaataaaacctctgactatgaagagacatgagatgattgccaaacccccagttgtgtgttctcattttgcccaagacctttggccagagcagagcataaaagattcttaccaaaaagtgatactgagaaaatttgaaaaatgtggacatggcaatttacactttaaaaaaggctgtgaaagtgtggatgagtgtaagttacacaaaagaggttataatggacttaaccaatgtttgacaactacccagagcaaaatatttcaatgtggtaaatatgtgaaagtctttcatcaattttcaaattcaaagagacataaaagaagacatactgaaaaaaaacctttgaaatatatagaaggtgacaaagcttttaaccagtcctcaacccatactacacataaaaaaattgatactggagagaaaccatacaaatgtgaagaatgtggcaaagccttcaaccggtcctcacaccttactacacataagataactcatactagagagaaaccctacaaatgtgaagaatgtggcaaagtctttaagtacttctctagctttactacacataagaaaattcatagtggagagaaaccctacatttgtgaagaatgtggcaaagcctttatgtacccctatacccttactacacataagataatccatactggagagcaaccctacaaatgtaaagaatgtgacaaagcttttaaccatcctgcaactctttcttcacataagaaaattcatactggagagaaaccgtacacgtgtgataaatgtggcaaagcctttatttcatcctcgatccttagtaaacatgagaagattcatacgggagagaaaccctacaaatgtgaagaatgtggcaaagccttcacccgctcctcacaccttactatgcataagataattcatactggagagaaaccatacaaatgtgaagaatgtggcaaagcctttacatggtctgcaggcctccataaacataggagaactcatactggagagaaaccctacaaatgtgaagaatgtggcaaagcgtatactacatcctcaaatctaactgaacataagacaactcatactggagagaaaccttacaaatgtaaagaatgtggcaaagcttttaactggtcctcagaccttaataaacataagagaattcatattggacagaaaccaagaacgtgacaaaggattattttattattattatttttttgagaggtaattctgctgttgtttcccaggctggagtgcaatg

SEQ ID NO: 3156 - DNA, 568 bp, Homo sapiens
cgcggccccgcccccggacgcccagccgcggtcccagcgaccttcgctttcgtggggaagccggactgcgccgtgtcttcctgaagaaggctgggggatcagtgtccttcagtgatgtggctgtgggcttcacccaggaggagtggcagcatctggactctgctcagaggaccccgtacagagacatgatgctggagaactacagcctcctcctctcagtgggatattgcattaccaaaccagaggtggtttgcaagttggagcatggacaggtgctgtggatattagaggaagagtccccaagtcagagccacctagactgctgcatagatgatgacctgatggagaagagacaggaaaatcaagaccagcatttgcagaaagttgattttgtcaacaataaaacactgactatggacagaaatggtgtattaggaaaaacattttctcttgacacaaaccccattctatcaagaaaaatacgtggcaactgtgactcatctggaatgaatttgaataatatttcagaattaattattagtaatagaagctcctttgtaaggaaccc

SEQ ID NO: 3157 - DNA, 1347 bp, Homo sapiens
atggcgtcgcggccccgcccccggacgcccagccgcggtcccagcgaccttcgctttcgtggggaagccggactgcgccgtgtcttcctgaagaaggctgggggatcagtgtccttcagtgatgtggctgtgggcttcacccaggaggagtggcagcatctggactctgctcagaggaccccgtacagagacatgatgctggagaactacagcctcctcctctcagtgggatattgcattaccaaaccagaggtggtttgcaagttggagcatggacaggtgctgtggatattagaggaagagtccccaagtcagagccacctagactgctgcatagatgatgacctgatggagaagagacaggaaaatcaagaccagcatttgcagaaagttgattttgtcaacaataaaacactgactatggacagaaatggtgtattaggaaaaacattttctcttgacacaaaccccattctatcaagaaaaatacgtggcaactgtgactcatctggaatgaatttgaataatatttcagaattaattattagtaatagaagctcctttgtaaggaaccctgctgagtgtaatgtacgtgggaaatttctcctctgtatgaagcgtgagaatccttatgccagagggaaacctttggaatatgatggaaatgggaaagccgtctctcagaatgaggacttatttaggcatcagtatattcaaactcttaagcagtgttttgaatacaatcacagaggatacacagaggagagaaaccctatgaatgcactgaatgtgggaaaacttttggatataggtcatgccttgcagtacatcaaagaacacacacgggacaaaacctatgaatgtaatgaatgtggaaaaaacttctgtgagaagtcaaatcttcatgtacatcagagaacacacacaggagagaaaccctatggatgtaatgaatgtcagaaagcctttggtgataggtcagctctaaaagtacatcagagaatacatactggcgagaaaccctatgagttacatcagagaacccacacaggagagaaaccctatgcatgtagtgaatgtgggaaaaccttctaccagaagtcatccctcacaacacatcagagaacacacacaagggagcaaccctatgaatataatgaaagcttttaccagaatcccaacttcactaaatgtcagagagacaacatagaggaaacccttgtcaacatcctgaaggctcagaaaccttcaccttcttggactcgttccatagcagaaacaacccaggttgggggatcagtgtcgctcaaggacgtgactgtggacttcacccaggaggagtggtag

SEQ ID NO: 3158 - DNA, 1491 bp, Homo sapiens
agtttccatggtgagatggtcaacaagcctgtaagttcctcagctacgactaccaggtacctcgggttcctccctcctccgagagaccgccgaggtgcgggctgtgagagggggagcgtggagcctccgaggccgagggatcagtgtccttcagtgatgtggctgtgggcttcacccaggaggagtggcagcatctggactctgctcagaggaccccgtacagagacatgatgctggagaactacagcctcctcctctcagtgggatattgcattaccaaaccagaggtggtttgcaagttggagcatggacaggtgctgtggatattagaggaagagtccccaagtcagagccacctagactgctgcatagatgatgacctgatggagaagagacaggaaaatcaagaccagcatttgcagaaagttgattttgtcaacaataaaacactgactatggacagaaatggtgtattaggaaaaacattttctcttgacacaaaccccattctatcaagaaaaatacgtggcaactgtgactcatctggaatgaatttgaataatatttcagaattaattattagtaatagaagctcctttgtaaggaaccctgctgagtgtaatgtacgtgggaaatttctcctctgtatgaagcgtgagaatccttatgccagagggaaacctttggaatatgatggaaatgggaaagccgtctctcagaatgaggacttatttaggcatcagtatattcaaactcttaagcagtgttttgaatacaatcagtgtgggaaggcttttcatgaagaggcagcctgcagtacccataagagagtgtgctcatgggagaccctgtgaatataatgaacatgtgagagccttttccgatagaccaatattcattgttcatcagagaactcacataaggaagagtcaccatgaattcaatgaatgtgagaggaggtctggtgagaggccacctgtaaataaacaccacagggttatggagatgaaatactatgagtgtaatgcgagtgagaatagttttggcaagaaatcactcctcattctacaaagttacagaggagagaaaacttgactgtagtagacatttggaagtattctgcaagaagccaaatttcactcaacatcaagaaacacatataggaaagaatgcctataaaattaatcagtatgctagtacattttgctgtaagccaaagcattctgtatatcagaaaacagatacagaagaaaaactctatgaatgtagtgaatgtgggaaaaccttcagccataaatcctcttttatcctacagcagaggatacacagaggagagaaaccctatgaatgcactgaatgtgggaaaacttttggatataggtcatgccttgcagtacatcaaagaacacacacgggacaaaacctatgaatgtaatgaatgtggaaaaaacttctgtgagaagtcaaatcttcatgtacatcagagaacac

SEQ ID NO: 3159 - DNA, 645 bp, Homo sapiens
agtttccatggtgagatggtcaacaagcctgtaagttcctcagctacgactaccaggtacctcgggttcctccctcctccgagagaccgccgaggtgcgggctgtgagagggggagcgtggagcctccgaggccgagggatcagtgtccttcagtgatgtggctgtgggcttcacccaggaggagtggcagcatctggactctgctcagaggaccccgtacagagacatgatgctggagaactacagcctcctcctctcagtgggatattgcattaccaaaccagaggtggtttgcaagttggagcatggacaggtgctgtggatattagaggaagagtccccaagtcagagccacctagactgctgcatagatgatgacctgatggagaagagacaggaaaatcaagaccagcatttgcagaaagttgattttgtcaacaataaaacactgactatggacagaaatggtgtattaggaaaaacattttctcttgacacaaaccccattctatcaagaaaaatacgtggcaactgtgactcatctggaatgaatttgaataatatttcagaattaattattagtaatagaagctcctttgtaaggaaccctgctgagtgtaatgtacgtgggaaatttctcctct

SEQ ID NO: 3160 - DNA, 563 bp, Homo sapiens
gtcttcctgaagaaggctggggtaagagtccggccagcggacaagagggcagctggtcttgaactcctgacctcagatgccacccgcctcagcctcccaaagtgttgagactacagggatcagtgtccttcagtgatgtggctgtgggcttcacccaggaggagtggcagcatctggactctgctcagaggaccccgtacagagacatgatgctggagaactacagcctcctcctctcagtgggatattgcattaccaaaccagaggtggtttgcaagttggagcatggacaggtgctgtggatattagaggaagagtccccaagtcagagccacctagactgctgcatagatgatgacctgatggagaagagacaggaaaatcaagaccagcatttgcagaaagttgattttgtcaacaataaaacactgactatggacagaaatggtgtattaggaaaaacattttctcttgacacaaaccccattctatcaagaaaaatacgtggcaactgtgactcatctggaatgaatttgaataatatttcagaattaattattagt

SEQ ID NO: 3161 - DNA, 3561 bp, Homo sapiens
gcgggatctggccgccctcagggctccggcgccaagttcagagccacgcgcagtgctcttggccgggaggaggctgtgctgcaccagcacctcttgctccacatctccagagagcccagggccctgtggccgagtgtgtccagcccagtgtcatggggagcttccatatctcatggctccttgctgggccaagccctccagaaccccaaacccccaaagactgatgaatgccagagtggccaccttgcttatctgtggccccggccctggtgatcaccatggcagctgggaagggagccccgttgagcccatcggctgaaaacagatggcgacttagcgaacctgagctgggccggggctgcaagccagtgctgctcgagaagacgaaccgcctgggccctgaggctgctgtgggcagggcgggccgggatgtgggcagtgcggagctggcactgttggtagccccaggcaagccccgacctggcaagccgctgcccccgaagacacgtggagagcagaggcagagcgccttcacggagctgccgaggatgaaggaccggcaggtggatgctcaggcccaggagagggagcacgatgaccccacaggccaacctggtgccccacagctgacccagaacatccccagaggcccagctggcagcaaagtcttctctgtgtggcccagcggagcacgaagtgagcaaagaagcgcctttagcaaaccaaccaagcgaccagcagagaggcctgagctaacctcagtcttccctgcaggggaatctgcagatgccctgggggagctgtctggactcctcaacactacagacctcgcttgttggggtcgactttcaactcccaagcttttggttggtgatttgtggaacttgcaagcattgccacagaatgctccactctgtagcacttttctgggtgcccctacactgtggctggagcatacccaggcccaggtgcccccaccctcatcatcctccaccacttcgtgggccctcctgccacccaccctcacctccctgggcttgtccacccagaactggtgtgcaaagtgcaacctgtcctttcgcctaacgtccgacctggtctttcacatgcgatcccaccacaaaaaggagcatgcggggcctgacccacattctcagaagcggagagaagaggcccttgcctgccctgtgtgccaggagcacttccgggagcgccaccacctctcccggcacatgacttctcacagctagcaggtgaccgcagaatgacctgctgggtgcagcagccagcctttggcagaggggggctccctgggcctgcgttgagggggctgtcatggtcctttgcagagctgctgcttttggcattcatagataaacagctcaggcataatttgaaaaagccacacctgcatgatgtgttttgaaggaaatgaagtcctgaaataaagtgatgggctttgcaaatccagggtagaggccctaacaggcacagagagcaggggcaactcctggcacacatcatgggctttggaggcacacaagcctggattcgaatctgggctctttcacatactagctgtgaccctggacaaagagctttaacctgctgagtccccattttctcatctgtgaaatggagatgataacactgtgtcttaggttggcattcaggtcacatgaaaggtgtgtggaaagtggccagcattctgcctgcagaccctgagcactgagtcaacaaggtttgtgatgatgtctgtactagttagctattgttattaacaagatctccatggcagacaagctaaagcatctgcctaagtcgtgagtctgtgggttggctcaggttaagctgagcttggctgggcttggcagcaagtctcagatttgatcaagtcatattcgttttcttcttcggctggtgggctacccagagcgagcacgcttctctcgtggtcatgccaagaacacaggagggtgagtctaacaagcacacctcaagcctctgcttgggtcacattgccaatgtcctctcagcccatacaagtggcaggaccaggcccaatattaaggagtggaaaagtgtaggctgcccttggtgaagctgtgacaagggagtgaccatccatcccctccacaggagggtgaggaattgggacaggtaattccagccaatacctggtccatagttcttcacattgtgagtatatgaatacggggaaatagaaccccctccccaccacctacacacatgctgttttaccttccaagaataggacatgtgcaaaaactaggcttccagatcgtgaggctggggagcattctaggtaccatttattatctactgcgtttcggtcagtagctgttgtaggtacccgcatcagcccttgttcctaaggatgtgtggagcccaggctgtactctttgacattccacaggtcagtctgcgtgaaagccctttgtggggagtttccaagccagtgtcgtttttgcactggtttccacctcactgtcagatattgttcttttgatatgcagtttccagccctccaatgagtccccagcacagatctcaggcttgtggctgggaataagcccagctgagcaggtggggatctcagccagcctcccagactgcacctcttctattgctctcctctgtccaccgttccaggcagcagcactcccacctggctgctctgatgtcctcgctccctccattcctgcctctcaccatgcacgcatccattgtccacacacacacaaccagataatcttctgaaagtgtaactcagatgatgcctccaaccctgtggctgcccttcacacttacaggcctaaccccagcaggacctgccagctgcttcatgaacaagtccctgcctcatgttaattgcaagcactcatttcactctccctgtgtgccaggcaatagcataagcactggaagaatacagatgttatagtgagtcctacaatagccctggaaggcaagagctgtttcctttccatttctacaatgagtcaattgcagatgatgctataacacttccagtgtttctgacacttccctgaagctatacctgctaccttcatgggccgagcttgcccttatgaggcccacaggtggcagtgggcagaggggaccccgctataccacctcgctgctgttccactgtctgctcccgtgttctgaccacagctctggtgccgtttctcaagcctgggcttcattcaacattttctatctagctcttcatggtgctgctcctgctatggttccacagggcttcttctcgcaggtcagctccttagagaggtctcccagattccccgtaaagcagccctgcagcctctgcctctctcagccgcatcaccctgttgcttccttcacagcatgtctcaccatctgcaaccatctttctgtttgtcgtcttgttgatttgctgcctccacactgtcagctccttgggaacagagattggtttgtttactgtgcatccctggtgcccagaacagggcatggcatattgttggtgcataataaatattgtggaaataa

SEQ ID NO: 3162 - DNA, 543 bp, Homo sapiens
gaaggcacagctccactgtgcccacagcggtctggacagaggaggatctgcaggtgcaaagggcgcaggcaggttcccggaggaaagcaggagccacgtcttcggtctggcccttgttctgttggggttctggaggacgtgctgtgccctggccttactgaccttactccatgcagtgctgatgcatgcgacagcggtgaccctccagggtcccagggccctgtggccgagtgtgtccagcccagtgtcatggggagcttccatatctcatggctccttgctgggccaagccctccagaaccccaaacccccaaagactgatgaatgccagagtggccaccttgcttatctgtggccccggccctggtgatcaccatggcagctgggaagggagccccgttgagcccatcggctgaaaacagatggcgacttagcgaacctgagctgggccggggctgcaagccagtgctgctcgagaagacgaaccgcctgggccctgaggctgctgtgggcagggcgggccgggatgtgggcagtgcggag

SEQ ID NO: 3163 - DNA, 982 bp, Homo sapiens
tctaaccccatctcacttggctttcctgcactgcagaggttgggaagctaaatccatgtttcccagactcttttgcagccagggtgcaggcctttgacacagatcctcacaagcagccagatacatcacccagccccggatgtgcagtcgagtcccatgagctgaagtctttggcatgcaggtgatatctgtcactcacggtggcagggacatctggacttgtggggtggctgtggtggactttgtaggagtttggtcccttgtgattggtgctggtaccagcagtttctactagacagtgccagggcatggttaggcttttttttctggctaccctgacccttggagagctcccaagcttggtctctggctctcacagggatttaatgagctgcatgatagcctttaataagttcctttctgtttaaactacccaggtagaggctgctgtctgcaggtgggaagccctgattgctggaacctaagggatgtgagaaatcactgtggagtgtcaagggccctgtggccgagtgtgtccagcccagtgtcatggggagcttccatatctcatggctccttgctgggccaagccctccagaaccccaaacccccaaagactgatgaatgccagagtggccaccttgcttatctgtggccccggccctggtgatcaccatggcagctgggaagggagccccgttgagcccatcggctgaaaacagatggcgacttagcgaacctgagctgggccggggctgcaagccagtgctgctcgagaagacgaaccgcctgggccctgaggctgctgtgggcagggcgggccgggatgtgggcagtgcggagctggcactgttggtagccccaggcaagccccgacctggcaagccgctgcccccgaagacacgtggagagcagaggcagagcgccttcacggagctgccgaggatgaaggaccggcaggtggatgctcaggcccaggaga

SEQ ID NO: 3164 - DNA, 538 bp, Homo sapiens
gcagtgctcttggccgggaggaggctgtgctgcaccagcacctcttgctccacatctccagagagcccagatgatgctattgttggaacctgggaaggtcggaaggaatagctgagggccctgtggccgagtgtgtccagcccagtgtcatggggagcttccatatctcatggctccttgctgggccaagccctccagaaccccaaacccccaaagactgatgaatgccagagtggccaccttgcttatctgtggccccggccctggtgatcaccatggcagctgggaagggagccccgttgagcccatcggctgaaaacagatggcgacttagcgaacctgagctgggccggggctgcaagccagtgctgctcgagaagacgaaccgcctgggccctgaggctgctgtgggcagggcgggccgggatgtgggcagtgcggagctggcactgttggtagccccaggcaagccccgacctggcaagccgctgcccccgaagacacgtggagagcagaggcagagcgccttcacggagct

SEQ ID NO: 3165 - DNA, 537 bp, Homo sapiens
agtgctcttggccgggaggaggctgtgctgcaccagcacctcttgctccacatctccagagagcccagggtgactttcaggctgcagttgttttcctccctcccactgtctctcccggggtttatcctgtgttgctgttattctcagcccgggcttgcgctgggcagtaggggccctgtggccgagtgtgtccagcccagtgtcatggggagcttccatatctcatggctccttgctgggccaagccctccagaaccccaaacccccaaagactgatgaatgccagagtggccaccttgcttatctgtggccccggccctggtgatcaccatggcagctgggaagggagccccgttgagcccatcggctgaaaacagatggcgacttagcgaacctgagctgggccggggctgcaagccagtgctgctcgagaagacgaaccgcctgggccctgaggctgctgtgggcagggcgggccgggatgtgggcagtgcggagctggcactgttggtagccccaggcaagccccgacctggc

SEQ ID NO: 3166 - DNA, 503 bp, Homo sapiens
gcagtgctcttggccgggaggaggctgtgctgcaccagcacctcttgctccacatctccagagagcccaggtcttcggtctggcccttgttctgttggggttctggaggacgtgctgtgccctggccttactgaccttactccatgcagtgctgatgcatgcgacagcggtgaccctccagggtcccagggccctgtggccgagtgtgtccagcccagtgtcatggggagcttccatatctcatggctccttgctgggccaagccctccagaaccccaaacccccaaagactgatgaatgccagagtggccaccttgcttatctgtggccccggccctggtgatcaccatggcagctgggaagggagccccgttgagcccatcggctgaaaacagatggcgacttagcgaacctgagctgggccggggctgcaagccagtgctgctcgagaagacgaaccgcctgggccctgaggctgctgtgggcagggcgggccgggatgt

SEQ ID NO: 3167 - DNA, 580 bp, Homo sapiens
actgtgcccacagcggtctggacagaggaggatctgcaggtgcaaagggcgcaggcaggttcccggaggaaagcaggagccacggccctgtggccgagtgtgtccagcccagtgtcatggggagcttccatatctcatggctccttgctgggccaagccctccagaaccccaaacccccaaagactgatgaatgccagagtggccaccttgcttatctgtggccccggccctggtgatcaccatggcagctgggaagggagccccgttgagcccatcggctgaaaacagatggcgacttagcgaacctgagctgggccggggctgcaagccagtgctgctcgagaagacgaaccgcctgggccctgaggctgctgtgggcagggcgggccgggatgtgggcagtgcggagctggcactgttggtagccccaggcaagccccgacctggcaagccgctgcccccgaagacacgtggagagcagaggcagagcgccttcacggagctgccgaggatgaaggaccggcaggtggatgctcaggcccaggagagggagcacgatgaccccacaggccaacctgg

SEQ ID NO: 3168 - DNA, 4237 bp, Homo sapiens
cgcttccgccggtgggacggaactggtgccctccgtggacaattgtgttgaagcagaaattgttccggatctcgggtcggacacggaagtcttcctgcagtgtttctggatgcggggacagggatgcgcaggaattccagtctcagtttccagatggagcgacccctcgaggagcaagtccagagcaagtggtcgtctagtcaaggccgcacaggaacaggagggtctgatgtcctccagatgcagaacagtgaacaccatggacaaagcatcaagactcaaactgactccatctcccttgaggatgtggctgtgaacttcaccctggaggagtgggctttgctggatcctggccagaggaatatctacagagatgtgatgcgggcaaccttcaagaacctggcctgtataggggaaaaatggaaagaccaggatattgaagatgaacacaaaaaccagggaagaaatctaagaagtcctatggttgaagcactctgtgaaaataaagaagattgtccatgtggaaaaagcactagccagattcctgatcttaatacgaacctggaaactcctactggattaaaaccatgtgactgcagtgtgtgtggggaagtcttcatgcatcaggtctcccttaataggcacatgagatctcacactgaacagaaaccaaatgagtgtcacgaatatggagagaagccacataaatgcaaagaatgtgggaaaaccttcactcgcagctccagtattcgaacccatgaaagaattcacactggagagaaaccctatgaatgtaaggaatgtggcaaagccttcgcatttctcttttcctttcgaaaccatataagaattcatactggagagacaccctatgaatgtaaggaatgtgggaaggcattcagatatctcactgctcttcggcgccatgaaaaaaatcacactggagagaaaccctacaaatgtaaacagtgtggaaaagcctttatatattaccagccttttctaacccacgaaaggactcacactggagagaaaccttatgaatgtaagcaatgtgggaaagccttcagttgtcccacgtacttacggagtcatgagaaaactcatactggagagaaaccttttgtatgtagggaatgtgggagagccttcttttctcactcaagccttcgaaaacacgtgaaaacccacaccggagttcaaccttatacatgtaagaaatgtggggaagccttcaagtcatctagttcctgtgaagtgcacgaaagaactcattttggagaaaaaccctatgaatgtaaacaatgtggtaaagccttcaattcttcaagttaccttcagttgcacgaaagagttcacactggcgagaaaacttacgaatgtaaagaatgtggtaaagcctttctttattccactcactttcgaatccatgaaagaacccatactagagagaaaccctatgaatgcaaacagtgtggtcgggtcttcatttacttcagtcaccttcgaaggcacgaaagaagtcacactggagtgaaaccatgtgagtgtaagcagtgtggcaaagctttcacttgtttaaattccctgaaagtacacaaaagaattcatactggagaaagaccctttcagtgtagacaatgtggtaaagccttcagttactcaaagtctttgcacgtgcacgaaaggactcatagtagacagaagccctaagaaagtaaagtgtggtaatgctgtcagttgtattagttccttttggatgtatgagagtacttacgctggagagaaattcaaggaatgtaaacggtgtgattaagccttcagttgtcctaattccctttgaagacgtgactcatgcggcaatgaaatatttaacaaatgggggaggaacttgcactctcctgcgggattgcagatatgtgaatggactccatggacagaaaagctacgaatgtatggagtgtaggaaagccttcacttcacgtaatcttttaaagacacctgagaatatatactggagagaaactataaagaaaattctatatccatcccatcttttgtggggtttgttttttgtttttgtttttgttgagatgtaattttgctcttgttgcccaggctggagtgcagtggtgcgatcgcggctcaccgcaacctccgcctcccggattcaagcaattctcctgccgcagcctcccaagaagctgggattacaggcatgcgccaccacgcctggctaattttgtaattttagtagagatggggtttctccatgttggtcaggctggtctcaaactcctgacctcaggtgatctgcctgcctcggcctcccaaagtgctgggattacaggtgtgagccacagcacccaacctttttttccccgccgcaccccaagatggtgtctcactctgttgccccaggctggagtgcagtggtgtgatcctggctcactgtaacctctgggttcaagcaattcttctgcctcagccttccaagtagctgggattacaagtgcccaccaccatgcccagctaatttttatatttttagtagagacagtgtttcaccatgttgaccaggctgatcttaaactcttgacctcaaatgatccacccaccttggcctcccaaattgttcgttttacttttttttttttttttttttgagctggagtcttactctgttgcctaggctggagtgaaagtggcgcaacctctgcctcccaggtcaaagcaatcctgcctcaggccccctagtagctggcattacaggcacatgccaccacgcccaactaatttttatatttttagtagagacggggtttcaccatgttggccaggctggtcttgaactcctgacctcaggtaatccacctgccttggcctcccaaagtgctgggattacaggcgtgagccaccacacccggcccccagttctttttttttttttttgagacggagtccttgcccaggctggagtgcagtggcgcgatctcagctcactgcaagctccgcctcctgggttcacgccattctcctgcctcagcctcccgagtagctgggactacaggcgcccgccaccacgcccggctcattttttgtatttttagtggagacggggtttcaccgtgttagccaggatagtcttgatctcctgacctcgtgatccgccctcctcggcctcccaaagtgctgggattataggcgtgagccaccgcgcccggcctccagttcattttaaaaccatgaaaccacccacactggagagccaccttcttaaatgtaagcaatatgggaacatcttcaatgacatctgcaaccattgtcgagattcttcgtaggaagaattaaaggaatggggaagaaggacttgggccccagcaggccttttgtggcatccagtcagaagttaggaaacaccctctagggcagtgcctgccctcagctctcacacatgactggagagaagtgagaagactcccagaatctgccttttaagtttccatcagtgtcctcgggtcagactgtgggaatgctgtacttctaagacaaaggttcgcatcttacagtttttccccaagtgggatctgcctatgcacatcctaattcacagacattgtcagcattgcattattccagggctgttttgaggtcatctccagctccatttcccatctcaaacctacactttggacacttgtttaaacattcacatctgaatttctctgtggcaaccgcaggtggctctgaggtgagagactgaagaagcagagcctgtatcatgggacacacaccccttgaccacacagcatccactctcctgcggttaccagccctgcaccaaccaccacagtcagaataatctcaaaactgctagtggagtcacagacacactctgccatgtcttagctgtaggacactcagaattcttacctcccctaacttgctttccctgttttctggcacattctaccctgagatattcagcggcatatgcactgatgatgctccggccttctcacgtcagtgcatgtcacatgcatcctgctccaggactggtttcctagcctcccgctaagactagcacttagctcttcttggaaaaggacccaccctgcagcgctccagctctgttgtgtatgggaggtgctggtgtcagggttcacaagccatggaactaccttgcttcacatcacaaggcaaggtgaactcaactcccaataaactgcttgctgga

SEQ ID NO: 3169 - DNA, 2471 bp, Homo sapiens
aatccggggaagcagaaggccgcactcagagtctctgcactcctttgttgctggggtccgttgcgttctgcatccagtccttgctgctccgagaggccccaggtgcctccgccacggctcctgtgacgctgtcacctgcgctgtgacctgctccggagtcataaagaggacgccgggacaccaagaagcagggaaatggacccagtggcctttgaggatgtggctgtgaacttcacccaggaggagtgggccttgttgaatcctttccagaagatctctacagagatgtgatgcaggaaaccttcacgaacctcatctgtatagaaattttatgggagagagactctttgagagtgcagaaggtagtcagtgtggagaaactttcacccaggttccggaagacatgctgaacaagaaaactcttcctggagtaaaatcatgtgaaagtggtacatgtggagaaatcttcatgggatattcatcctttaataggaacatcagaactgacactggacaccaaccacataagtgtcagaaatttttagagaagccatataaacataaacaacgtaggaaagccttgagccatagccactgctttcgaacacatgaaaggcctcacactagagagaaaccttttgattgtaaggaatgtgaaaaatctttcatttctcctgcaagcattcgaagatatatggtaacgcacagtggagatggaccttataaatgtaagttttgtgggaaagccttggattgtctcagtttataccttacccatgaacgaactcacactggagagaaacgatatgaatgtaaacaatgtggtaaagccttcagttggcacagttctgttcgaatccatgaaagaactcacactggggagaagccatatgaatgtaaggagtgtgggaaatcattcaatttttccagttcctttcgcagacatgaaaggacacacacaggagagaagccgtacaaatgtaaggaatgtgggaaagccttcaattgtcccagttcttttcacaggcatgaaaggactcacacaggagaaaaaccctatgaatgtaaactatatgggaaagcattatctcgccttataagctttcgaagacacatgagaatgcacactggagagaggcctcataaatgtaagatatgtgggaaagccttttactctcccagttcatttcaaaggcatgaaagaagtcacactggagagaaaccctacaaatgcaagcaatgtgggaaagccttcacttgttccacttcgtttcaatatcatgaaaggactcacactggagagaaacccgatgggtgtaagcaatgtgggaaagccttcagatctgccaagtacattcgaatacatggaaggactcacactggtgagaaaccctatgaatgtaagcaatgtgggaaagcatttcattgtgtcagctcctttcatagacatgaaaggactcacgctggagaaaaaccttatgaatgtaagcattgtgggaaagccttcacttgttccatatatattagaatacatgaaagaattcacactggagagaaaccttaccaatgtaaggaatgtgggaaagccttcattcgttccagttactgtcgaaaacatgaaagaactcacactattaatatatgagagaaatgctattttttaatttttattttaatagagacagggtctcactatcttgtccaggttggtcttgaactcctggcctcaagcatccctcccagcttgaagtgtcaataaaggaaggcaataaaatgtagagatggagttaggtgatgccacgctgggattcactggtggcctatcttacatatgatttcgaaggcagacatgaggaaggccttagtcacattttagagccagccaaattcacatgggctgtgtggccccctgattctagcccattttcctgattctctggcttgtcaatcaagagtatcctccaaatctcttgactttccttttttcagaggtgtaggtttccaaagatgtccccagaagctccacattcaagttctatctacagtttggtttttctttaagtattgtaatgtacataccagagagataatgcagactgtcatgggtggggaatgttctctgatgctcaactcccctagtctgcagattgagttggtaggaggtgtgatttgtttacatgcacctttgttcctgctggtagtgaccttgttcttgattcagcctgacagctactatgctgccatcagaaccaacttgatgagagctctgctgccctgtgcagtgactggtctcatccaggactctcatgtgagaaggaacaccttgctctggtcaggaaatgtccagtgtttcctgttatccacaggagaatgtaatgcctcagttcattttcagttatctttgattatatgtgattgacaatgtgtatttttgagggagcaaagatttctgtacatatttcttaaaaata

SEQ ID NO: 3170 - DNA, 578 bp, Homo sapiens
gttgctggggtccgttgcgttctgcatccagtccttgctgctccgagaggccccaggtgcctccgccacggctcctgtgacgctgtcacctgcgctgtgacctgctccggagtcataaagaggacgccgggacaccaagaagcagggaaatgaaattttatgggagagagactctttgagagtgcagaaggtagtcagtgtggagaaactttcacccaggttccggaagacatgctgaacaagaaaactcttcctggagtaaaatcatgtgaaagtggtacatgtggagaaatcttcatgggatattcatcctttaataggaacatcagaactgacactggacaccaaccacataagtgtcagaaatttttagagaagccatataaacataaacaacgtaggaaagccttgagccatagccactgctttcgaacacatgaaaggcctcacactagagagaaaccttttgattgtaaggaatgtgaaaaatctttcatttctcctgcaagcattcgaagatatatggtaacgcacagtggagatggaccttataaatgtaagttttgtgggaaagcctt

SEQ ID NO: 3171 - DNA, 1584 bp, Homo sapiens
aggccgcactcagagtctctgcactcctttgttgctggggtccgttgcgttctgcatccagtccttgctgctccgagaggccccaggtgcctccgccacggctcctgtgacgctgtcacctgcgctgtgacctgctccggagtcataaagaggacgccgggacaccaagaagcagggaaatggacccagtggcctttgaggatgtggctgtgaacttcacccaggaggagtgggccttgttgaatcctttccagaagatctctacagagatgtgatgcaggaaaccttcacgaacctcatctgtatagaaattttatgggagagagactctttgagagtgcagaaggtagtcagtgtggagaaactttcacccaggttccggaagacatgctgaacaagaaaactcttcctggagtaaaatcatgtgaaagtggtacatgtggagaaatcttcatgggatattcatcctttaataggaacatcagaactgacactggacaccaaccacataagtgtcagaaatttttagagaagccatataaacataaacaacgtaggaaagccttgagccatagccactgctttcgaacacatgaaaggcctcacactagagagaaaccttttgattgtaaggaatgtgaaaaatctttcatttctcctgcaagcattcgaagatatatggtaacgcacagtggagatggaccttataaatgtaagttttgtgggaaagccttggattgtctcagtttataccttacccatgaacgaactcacactggagagaaacgatatgaatgtaaacaatgtggtaaagccttcagttggcacagttctgttcgaatccatgaaagaactcacactggggagaagccatatgaatgtaaggagtgtgggaaatcattcaatttttccagttcctttcgcagacatgaaaggacacacacaggagaaaaaccctatgaatgtaaactatatgggaaagcattatctcgccttataagctttcgaagacacatgagaatgcacactggagagaggcctcataaatgtaagatatgtgggaaagccttttactctcccagttcatttcaaaggcatgaaagaagtcacactggagagaaaccctacaaatgcaagcaatgtgggaaagccttcacttgttccacttcgtttcaatatcatgaaaggactcacactggagagaaacccgatgggtgtaagcaatgtgggaaagccttcagatctgccaagtacattcgaatacatggaaggactcacactggtgagaaaccctatgaatgtaagcaatgtgggaaagcatttcattgtgtcagctcctttcatagacatgaaaggactcacgctggagaaaaaccttatgaatgtaagcattgtgggaaagccttcacttgttccatatatattagaatacatgaaagaattcacactggagagaaaccttaccaatgtaaggaatgtgggaaagccttcattcgttccagttactgtcgaaaacatgaaagaactcacactattaatatatgagagaaatgctattttttaatttttattttaatagagaca

SEQ ID NO: 3172 - DNA, 4245 bp, Homo sapiens
gtctttgtctctcgctgcagtcggagtatggtctagtgttcgctgttctgcgtcctctggtcctagaggcccatcctctgtggccctgtgacctgcaggtattgggagatccacagctaagacgctaggaccccctggaagcctagaaacgggagtgttgacatttagggatgtggccatagaattctctctggaggagtggcaatgcctggacaccgcacagcagaatttatataggaatgtgatgttagagaactacagaaacctggtcttcgtgggtattgctgcctctaagccagacctgatcacctgtctggagcaaggaaaagaaccttggaatgtgaagagacatgagatggtagctgaacccccagttgtatgttcttattttgcccgagacctttggccaaagcagggcaaaaaaaattatttccaaaaagtgatactgagaagatataaaaaatgtggatgtgaaaatttacagttaagaaaatactgtaaaagcatggatgagtgtaaggtgcacaaagaatgttacaatggacttaaccagtgtttgacgactacccagaacaaaatatttcaatgtgacaaatatgtgaaagtctttcataaattttcaaattcaaacagacatacgataagacatactggaaagaaatctttcaaatgtaaagaatgtgaaaagtcattttgcatgctttcacacttagctcaacataaaagaattcatagtggagagaaaccctacaaatgtaaagaatgtgggaaagcctataatgagacctcaaacctttctacacataaaagaattcatactggaaagaaaccctacaaatgcgaagagtgtggaaaagcctttaaccggctctcacaccttactacacataagataattcatactggaaagaaaccctacaaatgtgaggagtgtggcaaagcttttaaccaatctgcaaaccttactacacataagagaattcatactggagagaaaccctacaaatgtgaagaatgtggcagagcttttagccagtcctcaacccttactgcacataagataattcatgctggagagaaaccttacaaatgtgaagaatgtggcaaagcttttagccagtcctcaacccttactacacataagataattcatactggagagaaattctacaaatgtgaagaatgtggtaaggcctttagccagttatcccaccttactacacataagagaattcattctggagagaaaccctacaagtgtgaagaatgtggcaaagcttttaaacaatcctcaacccttactacacataagagaattcatgctggagagaaattctacaaatgtgaagtatgtagcaaagcctttagccggttctcacaccttactacacataagagaattcatactggagagaagccctacaaatgtgaagaatgtggcaaagcttttaacctatcgtcacaacttactacacataagataattcatactggagagaaaccctacaaatgtgaagaatgtggcaaagcttttaaccagtcctcaactctttctaaacataaggtaattcatactggagagaagccctacaaatatgaagaatgtggcaaagcttttaaccagtcctcacaccttactacacataagatgattcatactggagagaaaccctacaagtgtgaagaatgtggcaaagcctttaacaactcctctattcttaacagacataagatgattcatactggagagaaactctacaaacctgaaagttgtaacaatgcttgtgacaacattgcaaagatttccaaatataaaagaaattgtgctggtgagaaataatagaaatatgaatgtgacaaagcctttaaatggttatcacactggattgtaggtaaggtaattcattctggagaaaacttctacaagtgtgaatgaacagtgtggcaaaacttacacaatgctcaaaccttattgcacaggaaagcctttatacttgagaacaaatgtacaaatataaagaaagtaaaaaagtgattaatatctgtgcacatcttattcaacatcagagtttatattaatagcattaaaagtgcaattactgtcaaaagagttcaaaaaataagcatttaaagtgctgaagaggatttattttgaagacaaacattacaaatataaacgaagttgtggtaactttacttgtaacacagatcttgttgtattcattctgtattagagcaaaccctgaggcaattgctcaaactttgttcaacatcagagaatttatatcgaagaaaaaccctgtaaatgtaataaatttagaaaaaaacatttattcaaaaactacaggttagaaaattccagagagttcatattaaaatatttttgcatatacagtaaatagaaaaaaatatttaattcaatggtaagtttatgtaaatatcagagaatttatgttagaaatatataaggcaatgacacttcagactttacactgaatcagagttctgagtttagaaagtaatccaaaactaaacttggcagaaaaattatttgtttataactttaaaagagtagaagattttttggagagttacaagtatacttttttttagaaagattacagattttttttaaaagtaaataactctcaaattacttcatacaaataatgttgtaattaactcaaattacttcgtgttaatgttgtaattaactctcaaattacttcatgctaaggaaattagtttttctttttcttcttctttttttttttttttttagatggagtcttgctctatcgcccccccaggctggagtacagtggcacgatctcagctcactgcaacctccgtctccagggttcaagtgattctcctgcctcagcctcccaagtggctgggattacaggcgcaaaccaccatgcgtggctaaattttgtatttttaatagagccagggttttgccatgttggccaggctggtctcgaactcgagactttaggtgatccgcccagcttggcctcccgcaatgctgcaattacaggtgttagccactgcgcctgcctgatgttgtttctttattcctattgtattcatatgtgaaagcatgtgaccaaaagatatgaggattattttttattaggtgagcatttatgacctcttctatgaaagagtaaggacattaaaatgcatgatgaaaatctaagtaaagaggttctttgtgattcacttacagtactgagtgatgcatgaggtaggtgttctgagtaatattctgcattatattgagagacaaatttttagttttagttaaaattaaaaataaattagtatattattttactaattttacttttatgaaaatgcagtacatgttaaaaattttagattatgtgtgaacttaatttcttaattcaacatttttaacagtttaaatattgtgcattcaatcaagtcacattattccacttactttaacctagtccaccttactcaagggtgtaggtaaaaggtggtaacaaggccgggcacggtggctcacgcctgtaatcccagcactttgggaggcaaaggtgggtagatcacctgaggtcgggagttcaagaccagcctgaccaacatggagaaacgccatctctactaaaaatacaaaattagccaggcatggtggcgcatgcctgtaatcccagctactcgggaggctgaggcaggagaatcacttgaacccgggaagcagaggttgcggtgagccgagatcatgccatggcactccgtcctgggtgacaaagtgagactccctctcaaaaaataaataagtaaataaaataaatggtggtaacaatacactatttggtaaaagaatgcactaacatctgtagtactaatcttttttccagtggctttaaactgcaaataaggaatgttgtttctgtaggtaaaatttttatttattttttcccatttaaatttacttttgttagttttttcaggcatataatatttatgttatatatggcatattctgataagaggcatacaatatgtaataatcacattagggtaaatgaggtatccatcacctttagaatttattttttgtattatgaacagttcaattgtacagttttagtttttttaaaatatacgattgttattgactacagggttatttttataataaaaattatatacaagtataaaatttacacatttctgagtcctgaataaataaaaataatttcttgt

SEQ ID NO: 3173 - DNA, 4386 bp, Homo sapiens
attgtttctctctgctgccggagctccaggtctacccttcactgctctgtgtcctcagcgtgtgtggcttcgtgacctgaagatactgggaaatccatagctaagatgccaggaccccctgaaagcctagacatgttatatgttctcattttgctgaagacttttgcccagggccaggcattaaagattcttttcaaaaagtgatactgagagaatatgtaaaatgtggacataaggatttacagttaagaaaaggatgtaaaagtatgaatgagtgtaatgtgcacaaagaaggttataatgaactaaaccagtatttgacaactacccagagcaaaatatttcaatgtgataaatatgtgaaagtctttcataaacttttaaattcaaatagacataacacaaaacatactggaaagaaacctttcaaatgtaaaaaatgtggcaaatcattttgcatgcttttacacctatgtcagcataaaagaattcatattagagagaattcttaccgatgtgaagaatgtggcaaagcctttatctggttttcaacccttactagacacaggagagttcatactggagagaaatcctacaaatatgaatgtggcaaatcttttaaccaggactcaaaccttactacacataagagaattcatactggacagaaaccctacaaatgtgaagaatgtggcacatctttctaccaattctcataccttactaggcataagctaattcatactagagagaaaccctataaatgtgaacaatatggcaaaacttttaaccaatcttcaacccttactggacataagataattcataatggagaaaaaccctataaatgtgaagaatgtggcaaagcctttagtattttctcaacccctactaaacataagataattcacactgaagagaaatcccacagatgtgaagaatattgcaaagcttataaggagtcctcacaccttactacacataaaagaattcatactggagagaaaccctacaaatgtgaagaatgtggcaaagcctttagtattttctcaacccttactaaacataagataattcacactgaagagaaatcccacagatgtgaagaatgtggcaaagcttataaggagtcttcacaccttactacacataaaagaattcatactggagagaaaccctacaaatgtgaagaatgtggcaaaacctttagtgtattctcaattcttactaaacataaaataattcatacagaagagaaaccctacaaatgtgaagaatgtggcaaagcttttaaacgatcttcaacccttactaaacataggataattcatactgaagagaaaccctacaaatgtgaagaatgtggcaaagcttttaaccaatcttcaacccttagtatacataaaataattcatactggagaaaaaccctacaaatgtgaagaatgtggcaaagcttttaaacgatcttcaacccttactatacataaaatgattcacactggagaaaaaccctacaaatgtgaagaatgtggcaaagcttttaatcggtcctcacaccttactacacataagagaattcatactggacacaaaccctacaaatgtaaagaatgtggcaaatcctttagtgtattctcaacccttactaaacacaagataattcatactgataagaaaccctacaaatgtgaagaatgtggcaaagcttttaaccgatcttcaatccttagtatacataagaaaattcatactggagaaaaaccctacaaatgtgaagaatgtggcaaagcttttaagcggtcctcacacctcgctgggcacaagcaaattcatagtgtacaaaaaccctacaaatgtgaagaatgtggcaaagcctttagtatattctcaacccttactaaacataagataattcatactgaagagaaaccctacaaatgtgaaaaatgtggcaaaactttctaccgattctcaaaccttaatacgcataagataattcatactggagagaaaccttgcaaatgtgaagaatgtggcaaagcttttaaccattcctcaaaccttattaaacataagctaattcatactggagacaaaccctacaaatgtgaagcatgtggcaaagcttttaggcggtcttcacatcttagtagacataagataattcatattggaattcatactgaagagactgtacaaaagtgaagaatgtggcaaaggcctttactgctcctattcccttactaaagaatgtggcaaagcttttcaccagtactttacccttaatacacataagataattaatgctggagagaaaccctacaaatgtgaagaatgtggcaaagatttctattgattctcataccttactaaatataagataattcatattggagagaaattctacagatgtgaagaatgtggcaaaggctttaattagttctcatcccttactaaacataagagaattcataccatagagaaatcctacaaatatgaagaatgtgacaaagcttttaaccacttctcaaccctgcctacacgtaagataattcatactggaaggaaaccctacaaatatgaggaatgtctcaaagctttttactgattcttataccttactaaacataaaataattcataaaggagataaattatacaaatgtgaagaatgtggcaaagcttttaacaaatcctcatccattagtaaacataagataattcatactggagagaaaacctacaaatgtgaggaatgtggcaaagcctttagcctgtccctccaatttactgcacataagataatttatactggagagaagccctacaaatgtgaaaaatgtggcaaaccttttaaccaatcctcaacccttactacacattagataattcatgctggagagaaaccctacaaatgtgaaaaatgtggcaaagcttttaaccaattttcaaaccttactaaacataagataactcatactggagaaaaatcttacaaatgtgaagaatgtggcaaagcctttatccagtcctcaactcctagtaaacataattaatgatggagagaaaccatacaactgtgaagaatgtggcaaagcttttaaccagtcctcaaactttattgaacaaaataattcatacaggagagaaaccctacaaatgtgaagaatgtgacaaagcctttaaccagtcctcaatttttactaaacataagaaaattcatactggagagaaaccctatgattgtgaaaaatatggcaaaggctttaactagtcctcagttcttaacacacatacgataattcttactgcagagaaactctacaaaccagtaagatgtgacagtgcttctgacaacatctcaaacttttctaatcataaaagaaatcatattggtgagaaatcctagaaatgtggagaatgtaacaaagtatttaaatggttgtcacacttgattataggtaatattcatattggaaaaatttcctacaagtaagaacaatgtggcaaagtttttaactaatacaccttattgcacagaaaatcatttatatttgagaaaaattgtagaaatatagactgtgaaaaagacgtcaatatctgctcacatcttactaaacaccagagagttcatgcttaataaaagcatgataagtgcaattactgccaaaagatctttcagaaaatattatcctttaaagtgaaggagagtatttatattaaagatgaacattacaaccataaagagggttgaagtacctttacttgtatcagatcttattgtccacattttgtactacagaaaaactctgaagaggtcactcaaactttgttcaacatcagggaatttatattggagagctgtcttgcaaatgtaataaatttgggaaaacaaattttcaaaaactacagcttagaaaacaccagagtttatacgaaaatatattttcaaaggtgtagtaaaaataaaaaaaattttaatccaaatttgtctatgtaaataccagaatttatagtagaaatatatgaggaagcgacacttcgaatattctactaaatgagagttctgagtatagaaaataaaactaaagttggtagaaaaattatttgtatataatgttaagaggagtaaaagattttttgtagaataataactatattcggattatactttgtttcttgaaaaaattacagattttttgaaaagcaaatgatgtaactcaactcattattttctgctgtttcttcattcttattcacttgtgaaagcttgtgatcatttgttgctgcatcagaggtatgagagattcttcttcattagatgggcattatttatgatcttttctatggatgagtaagaatattaaaatgtaagatgcatggtg

SEQ ID NO: 3174 - DNA, 5023 bp, Homo sapiens
ggccattgtttctctctgctgccggagctccaggtctacccttcactgctctgtgtcctcagcgtgtgtggcttcgtgacctgaagatactgggaaatccatagctaagatgccaggaccccctgaaagcctagacatggggccgttgacatttagggatgtggccatagaattctctctggaggagtggcaatgcctggacactgctcagcaggatttgtataggaaagtgatgttagagaactacagaaacctggtcttcttgggtattgctgtctctaagccagatctggtcacctgtctggagcaaggaaaagatccctggaatatgaagggacacagtacggtagtcaaacccccagttatatgttctcattttgctgaagacttttgcccagggccaggcattaaagattcttttcaaaaagtgatactgagagaatatgtaaaatgtggacataaggatttacagttaagaaaaggatgtaaaagtatgaatgagtgtaatgtgcacaaagaaggttataatgaactaaaccagtatttgacaactacccagagcaaaatatttcaatgtgataaatatgtgaaagtctttcataaacttttaaattcaaatagacataacacaaaacatactggaaagaaacctttcaaatgtaaaaaatgtggcaaatcattttgcatgcttttacacctatgtcagcataaaagaattcatattagagagaattcttaccgatgtgaagaatgtggcaaagcctttatctggttttcaacccttactagacacaggagagttcatactggagagaaatcctacaaatatgaatgtggcaaatcttttaaccaggactcaaaccttactacacataagagaattcatactggacagaaaccctacaaatgtgaagaatgtggcacatctttctaccaattctcataccttactaggcataagctaattcatactagagagaaaccctataaatgtgaacaatatggcaaaacttttaaccaatcttcaacccttactggacataagataattcataatggagaaaaaccctataaatgtgaagaatgtggcaaagcctttagtattttctcaacccctactaaacataagataattcacactgaagagaaatcccacagatgtgaagaatattgcaaagcttataaggagtcctcacaccttactacacataaaagaattcatactggagagaaaccctacaaatgtgaagaatgtggcaaagcctttagtattttctcaacccttactaaacataagataattcacactgaagagaaatcccacagatgtgaagaatgtggcaaagcttataaggagtcttcacaccttactacacataaaagaattcatactggagagaaaccctacaaatgtgaagaatgtggcaaaacctttagtgtattctcaattcttactaaacataaaataattcatacagaagagaaaccctacaaatgtgaagaatgtggcaaagcttttaaacgatcttcaacccttactaaacataggataattcatactgaagagaaaccctacaaatgtgaagaatgtggcaaagcttttaaccaatcttcaacccttagtatacataaaataattcatactggagaaaaaccctacaaatgtgaagaatgtggcaaagcttttaaacgatcttcaacccttactatacataaaatgattcacactggagaaaaaccctacaaatgtgaagaatgtggcaaagcttttaatcggtcctcacaccttactacacataagagaattcatactggacacaaaccctacaaatgtaaagaatgtggcaaatcctttagtgtattctcaacccttactaaacacaagataattcatactgataagaaaccctacaaatgtgaagaatgtggcaaagcttttaaccgatcttcaatccttagtatacataagaaaattcatactggagaaaaaccctacaaatgtgaagaatgtggcaaagcttttaagcggtcctcacacctcgctgggcacaagcaaattcatagtgtacaaaaaccctacaaatgtgaagaatgtggcaaagcctttagtatattctcaacccttactaaacataagataattcatactgaagagaaaccctacaaatgtgaaaaatgtggcaaaactttctaccgattctcaaaccttaatacgcataagataattcatactggagagaaaccttgcaaatgtgaagaatgtggcaaagcttttaaccattcctcaaaccttattaaacataagctaattcatactggagacaaaccctacaaatgtgaagcatgtggcaaagcttttaggcggtcttcacatcttagtagacataagataattcatattggaattcatactgaagagactgtacaaaagtgaagaatgtggcaaaggcctttactgctcctattcccttactaaagaatgtggcaaagcttttcaccagtactttacccttaatacacataagataattaatgctggagagaaaccctacaaatgtgaagaatgtggcaaagatttctattgattctcataccttactaaatataagataattcatattggagagaaattctacagatgtgaagaatgtggcaaaggctttaattagttctcatcccttactaaacataagagaattcataccatagagaaatcctacaaatatgaagaatgtgacaaagcttttaaccacttctcaaccctgcctacacgtaagataattcatactggaaggaaaccctacaaatatgaggaatgtctcaaagctttttactgattcttataccttactaaacataaaataattcataaaggagataaattatacaaatgtgaagaatgtggcaaagcttttaacaaatcctcatccattagtaaacataagataattcatactggagagaaaacctacaaatgtgaggaatgtggcaaagcctttagcctgtccctccaatttactgcacataagataatttatactggagagaagccctacaaatgtgaaaaatgtggcaaaccttttaaccaatcctcaacccttactacacattagataattcatgctggagagaaaccctacaaatgtgaaaaatgtggcaaagcttttaaccaattttcaaaccttactaaacataagataactcatactggagaaaaatcttacaaatgtgaagaatgtggcaaagcctttatccagtcctcaactcctagtaaacataattaatgatggagagaaaccatacaactgtgaagaatgtggcaaagcttttaaccagtcctcaaactttattgaacaaaataattcatacaggagagaaaccctacaaatgtgaagaatgtgacaaagcctttaaccagtcctcaatttttactaaacataagaaaattcatactggagagaaaccctatgattgtgaaaaatatggcaaaggctttaactagtcctcagttcttaacacacatacgataattcttactgcagagaaactctacaaaccagtaagatgtgacagtgcttctgacaacatctcaaacttttctaatcataaaagaaatcatattggtgagaaatcctagaaatgtggagaatgtaacaaagtatttaaatggttgtcacacttgattataggtaatattcatattggaaaaatttcctacaagtaagaacaatgtggcaaagtttttaactaatacaccttattgcacagaaaatcatttatatttgagaaaaattgtagaaatatagactgtgaaaaagacgtcaatatctgctcacatcttactaaacaccagagagttcatgcttaataaaagcatgataagtgcaattactgccaaaagatctttcagaaaatattatcctttaaagtgaaggagagtatttatattaaagatgaacattacaaccataaagagggttgaagtacctttacttgtatcagatcttattgtccacattttgtactacagaaaaactctgaagaggtcactcaaactttgttcaacatcagggaatttatattggagagctgtcttgcaaatgtaataaatttgggaaaacaaattttcaaaaactacagcttagaaaacaccagagtttatacgaaaatatattttcaaaggtgtagtaaaaataaaaaaaattttaatccaaatttgtctatgtaaataccagaatttatagtagaaatatatgaggaagcgacacttcgaatattctactaaatgagagttctgagtatagaaaataaaactaaagttggtagaaaaattatttgtatataatgttaagaggagtaaaagattttttgtagaataataactatattcggattatactttgtttcttgaaaaaattacagattttttgaaaagcaaatgatgtaactcaactcattattttctgctgtttcttcattcttattcacttgtgaaagcttgtgatcatttgttgctgcatcagaggtatgagagattcttcttcattagatgggcattatttatgatcttttctatggatgagtaagaatattaaaatgtaagatgcatggtgaaaatctaagtggagaggttctttgtggttaacttatactattgagtgatgcacaaggtaggtgttaagagtaatattcttttgcattatgagaaaactagtatattattcatatattttactaattgtactttttttattatactttaagttttagggtacatgtgcacaatgtgcaggttagttacatatgtatacatgtgccatgctggtgcgctgcacccactaactcgtcatctagcattaggtatatctcccaatgctatccgtcccccctccccccaattgtacttttatataataaaatgcagtacattttaaaaaattttaaattctgtgtgaaggtaactgtttcaacatttttaacatggtaaatattattgtgcattcaataaagtgttgttatgcca

SEQ ID NO: 3175 - DNA, 1665 bp, Homo sapiens
ctccaggtctacccttcactgctctgtgtcctcagcgtgtgtggcttcgtgacctgaagatactgggaaatccatagctaagatgccaggaccccctgaaagcctagacatggggccgttgacatttagggatgtggccatagaattctctctggaggagtggcaatgcctggacactgctcagcaggatttgtataggaaagtgatgttagagaactacagaaacctggtcttcttggcaggtattgctgtctctaagccagatctggtcacctgtctggagcaaggaaaagatccctggaatatgaagggacacagtacggtagtcaaacccccagtagagacggggtttcaccgttttagccaggatggtctctatctcctgacctcgtgatccgcccgcctcagtctcccaaagtgctggtattacaggcgtgagccaccatgcccagcctaataaaaatttttttatttctattgtatccaatagcttgttttaagtgtgtagaacaataacttacacttttatgttaattttatattttgttaatttactgactgtattattagtttagacaaatttcaatgtactgtggttttttatgtgtaagattatatgttcctcaaacagcaactttttacttatttgtcttcagtttcaatggctttaaaaagaattcttttttcattattctgccacatgcttccagtgctatgttaaaatagaaacattgacaaagggcacaatagagtttactattggtgtctgtgaatttgaaatggcaaacaactccttaagtttttataagctgatttcaggaggtaaagatcttcttttcttgtgttccccagggttttgggatgccctctgggtttgtagtggagtggggttgtaacttggttgcaaggctgctggttctacattagggtccatatttagttgtcatgttacaagaggcttgggtagttgtacttcccaatttttttttttttttttttttttttttttgagacaggagtctcgctctgtcgcctggctggagtgcagtggtgtgatctcagctcatcaaaacttttgcctccctagttcaagcgattctcctacctcagcctcctgagtagctgggattacaggtgcccaccagcacgcccagctaattttttgtgtgtttttagtggagacggggtttcaccatgttggctaagctgggtctcgaactcctgacctcaggtgatccacccgccttggcctcctgggtgctgggattacagacgtgagccaccacccccggccacttgtttcttttaaatgcttattaaaagtttctcatcagaatattttatttataattatactgcatattctctgaaattttactgccaatttttcaaaatacctgcttttgatgagtacagttacagtcaaatactgtagttagacaaattcttttttaatggtatattaatgttgcataccaaattgtatgagttaaacgtctcttcctgtgcagtttcatattagtggtgttttcagtgtaggtatcttaatatcagcttatcgtggtttttggttatgtattataattttagtcaatttgcaattctgtctgtatactttatgtcaatgtgaggttgaattaaaagatagccatatgtctatcacaa

SEQ ID NO: 3176 - DNA, 3466 bp, Homo sapiens
accattccacgcggctcgagcccgcgtgcgggcctctttcaggccgctcctagtggacgcagaggcgggccgaggacggtgccagcccccaggccccaagaggagctggtccccaggacagaggagggagaggagcaagaggctcccctgggccccttccaggccccacctccaggtcacaggcgcgagatggagtccccaagagggtggaccctgcaggtggccccagaggaaggccaggtcctctgcaatgtgaagactgccacgaggggcctctctgagggggctgtgtctggaggctggggggcctgggaaaactccacggaggttccgagggaggcaggggacggccagcggcagcaagccacactgggggcggcggacgaacagggaggccccggcagggagctgggccccgcagacggtgggcgggacggggctgggcccaggagcgagcctgcagaccgggcgttgcgcccttcgcctctcccagaggagccgggctgccggtgcggggagtgcggcaaggcgttcagccagggctcttacttgctgcagcatcggcgcgtgcacacaggcgagaagccgtacacgtgccccgagtgcggcaaggccttcgcctggagctccaacctcagccagcaccagcgcatccacagcggcgagaagccctacgcttgcagggagtgcggcaaggccttccgcgcgcactcgcagctcatccaccaccaggagacacacagcggcctgaagcccttccgctgcccggactgcggcaagtccttcggccgaagcaccacgctggtgcagcaccgacgcacgcacacgggcgagaagccctacgagtgcccggagtgcggcaaggccttcagctggaactccaatttcctggagcaccggcgcgtgcacacgggcgcgcggccgcacgcctgccgggactgtggcaaggccttcagccagagctccaacctggccgagcacctgaagatccacgcgggcgcacggccacacgcctgtcccgactgcggcaaggccttcgtgcgtgtggcggggctgcggcagcaccggcgcacgcacagcagcgagaagcccttcccctgcgccgagtgcggaaaggctttccgcgagagctcgcagctcctgcagcaccagcgcacgcacactggtgagcggcccttcgagtgcgccgagtgcggccaggctttcgtcatgggctcctacctggcggagcaccggcgcgtgcacacgggcgagaagcctcatgcgtgcgcccagtgcggcaaggccttcagccagcgctccaacctactgagccaccggcgcacgcactcgggcgccaagcccttcgcctgcgccgactgcggcaaggccttccgcggcagttccggcctggcgcaccaccggctttcgcacacgggagagcgacccttcgcctgcgcagaatgcggcaaggccttccgcggcagctccgagctgcgccagcaccagcgcctgcactctggcgagaggccgttcgtctgcgcccactgcagcaaggccttcgtgcgcaagtcggagctcttaagccaccggcgcacgcacacgggcgagaggccctacgcttgcggcgagtgcgggaagcctttcagccaccgttgcaacctcaacgagcaccagaagcggcacgggggccgcgctgcgccctgacccgaggacgccctgagcgggaggtcgcggacacacggcattgcggggtctcgggcgtgagtgcgctgtctgctggcccagactttttcgggccgccggtgcgggcgccctcctgctgggagtgcaggggcggccttgggtgtggagaaccctggctgcacagtccctttgacgatagtccaccggccacccaggcctgtctggggacatgtaggatgggctcttaccccagggagggcggcaggctccacttcggcgagaggttcgtccatgcagaggtgggcaagaactggggtctccgacaggtgtggctatttctttgagttctctggcactgtcaaaagcagccaacccaccccccagtccacatggtcaccactgctgctaccagctgctcagtgcagtggccactgtgtctcctaaggtgctcgcttcagtcagcacttcatctcaggcaaccacaggtgacagttaaacatgatgaaaccgcatgctatggctttctagtgtctcatattctgttggcaagaagctcagcactgcattcctgaccgaggtcagaaccagatcaatctcagaatctcacctgtgtaggtctgtttcatgggacttttcttttttgggggagggggcagggtttcactctgtcacccaggctggagtgcagtggtgcaatcactgtttattgcagccgcgacttcttaggctcaggtgatcctcccacctcagcctcccaagcagctgggatgacagacttgcgtcactacacctggctaattttaaaattttttgtaaggacagtgtctcaccatgttgcctaggcgggtctcaaaactcctgggctcaagtgatcctcctgcctcagcctcccaaagcgttgggattataggcgtgagccaccgcacctggccagggaaccttctttataccaagtaccacaccagtcagagtcaagtcaggaaatagaaaccacactaggtatttcaaacagaggggatataagttagggactgattgtgcaggttttgcaaggctcagagagcaaaagtggatgttgcagaatctcagagctggatacttgcaggaagctgctaccacccttagggctggagaacccagggaagctaagaggagggtgcaacgaggctggtgttgggactgccaaaggaaacacagaatgacagctccatctctgcagacctcagatttgaccaggcctctggctgcctgggcagcctcattgccaatgggctgaaaggttctgtcactgttcagtggtctgacttctgagttctgtgcacaccctgagctctgctcctctggcctggccaccagtccttgtctgagtgccccaggtctggttatgacttcaggcctcagcacctggttgtctcttctgcaaagaatgcattctcccccagtccacccagaacacacagcctccatccaggtactggctctgagcaggacagagagcatgcagcaggtgctcagcaatatggaaatgggaccaaacagagggagtctccacagctccccgtccctcacagcagaagccagagccgctgcagtgcccagctggtcttcatcacgtctatgagctctgcaatcgctctgcagtcgcctcaactcctggtctcctctgctccttctcactgcacccgcatctcccatgtttgcactggctgttccctctgcctggaatgctccttgcccagttatcccactgtcttctttgcatctggcacacagtagatgctcaataaatgcctgtggaatg

SEQ ID NO: 3177 - DNA, 675 bp, Homo sapiens
cacagcggcgagaagccctacgcttgcagggagtgcggcaaggccttccgcgcgcactcgcagctcatccaccaccaggagacacacagcggcctgaagcccttccgctgcccggactgcggcaagtccttcggccgaagcaccacgctggtgcagcaccgacgcacgcacacgggcgagaagccctacgagtgcccggagtgcggcaaggccttcgtgcgtgtggcggggctgcggcagcaccggcgcacgcacagcagcgagaagcccttcccctgcgccgagtgcggaaaggctttccgcgagagctcgcagctcctgcagcaccagcgcacgcacactggtgagcggcccttcgagtgcgccgagtgcggccaggctttcgtcatgggctcctacctggcggagcaccggcgcgtgcacacgggcgagaagcctcatgcgtgcgcccagtgcggcaaggccttcagccagcgctccaacctactgagccaccggcgcacgcactcgggcgccaagcccttcgcctgcgccgactgcggcaaggccttccgcggcagttccggcctggcgcaccaccggctttcgcacacgggagagcgacccttcgcctgcgcagaatgcggcaaggccttccgcggcagctccgagctgcgccagcaccagcgcctgcac

SEQ ID NO: 3178 - DNA, 1861 bp, Homo sapiens
ggccgctcctagtggacgcagaggcgggccgaggacggtcacaggcgcgagatggagtccccaagagggtggaccctgcaggtggccccagaggaaggccaggtcctctgcaatgtgaagactgccacgaggggcctctctgagggggctgtgtctggaggctggggggcctgggaaaactccacggaggttccgagggaggcaggggacggccagcggcagcaagccacactgggggcggcggacgaacagggaggccccggcagggagctgggccccgcagacggtgggcgggacggggctgggcccaggagcgagcctgcagaccgggcgttgcgcccttcgcctctcccagaggagccgggctgccggtgcggggagtgcggcaaggcgttcagccagggctcttacttgctgcagcatcggcgcgtgcacacaggcgagaagccgtacacgtgccccgagtgcggcaaggccttcgcctggagctccaacctcagccagcaccagcgcatccacagcggcgagaagccctacgcttgcagggagtgcggcaaggccttccgcgcgcactcgcagctcatccaccaccaggagacacacagcggcctgaagcccttccgctgcccggactgcggcaagtccttcggccgaagcaccacgctggtgcagcaccgacgcacgcacacgggcgagaagccctacgagtgcccggagtgcggcaaggccttcagctggaactccaatttcctggagcaccggcgcgtgcacacgggcgcgcggccgcacgcctgccgggactgtggcaaggccttcagccagagctccaacctggccgagcacctgaagatccacgcgggcgcacggccacacgcctgtcccgactgcggcaaggccttcgtgcgtgtggcggggctgcggcagcaccggcgcacgcacagcagcgagaagcccttcccctgcgccgagtgcggaaaggctttccgcgagagctcgcagctcctgcagcaccagcgcacgcacactggtgagcggcccttcgagtgcgccgagtgcggccaggctttcgtcatgggctcctacctggcggagcaccggcgcgtgcacacgggcgagaagcctcatgcgtgcgcccagtgcggcaaggccttcagccagcgctccaacctactgagccaccggcgcacgcactcgggcgccaagcccttcgcctgcgccgactgcggcaaggccttccgcggcagttccggcctggcgcaccaccggctttcgcacacgggagagcgacccttcgcctgcgcagaatgcggcaaggccttccgcggcagctccgagctgcgccagcaccagcgcctgcactctggcgagaggccgttcgtctgcgcccactgcagcaaggccttcgtgcgcaagtcggagctcttaagccaccggcgcacgcacacgggcgagaggccctacgcttgcggcgagtgcgggaagcctttcagccaccgttgcaacctcaacgagcaccagaagcggcacgggggccgcgctgcgccctgacccgaggacgccctgagcgggaggtcgcggacacacggcattgcggggtctcgggcgtgagtgcgctgtctgctggcccagactttttcgggccgccggtgcgggcgccctcctgctgggagtgcaggggcggccttgggtgtggagaaccctggctgcacagtccctttgacgatagtccaccggccacccaggcctgtctggggacatgtaggatgggctcttaccccagggagggcggcaggctccacttcggcgagaggttcgtccatgcagaggtgggcaagaactggggtctccgacaggtgtggct

SEQ ID NO: 3179 - DNA, 3800 bp, Homo sapiens
atgcttaaagagcatccagagatggcggaagctcctcagcagcagttgggtattcctgtggtgaaactggagaaagagttgccatggggcagaggaagggaggaccctagtccagagacttttcggctgaggtttcggcagttccgctaccaggaggcagctggaccccaggaagctcttagggagctccaggagctctgtcgtcggtggctgaggcccgagttgcacaccaaggagcagatcctggagctgctggtgctggagcagttcctcactatcctgccccgcgagttctacgcctggatccgggagcatggcccagagagtggcaaggccctggccgccatggtggaggacctgacagaaagagcactggaggccaaggcggttccatgccacaggcagggagagcaggaggaaacagcactttgcagaggcgcttgggagccaggcatccagctggggccagtggaggtcaagcctgaatgggggatgccccctggggaaggagttcaaggtccagacccaggtaccgaggagcagctcagtcaggaccctggagatgagacacgggccttccaggagcaaggcggtgggagcaaggaaaaggaggcaaaacccccacaggaagacctgaaaggggcgctggtggcactgacatcagagaggtttggggaagcctctctccagggccctgggctcggaagggtctgtgagcaggagcctggtggccctgcaggcagtgcgcctgggcttcctcctccccagcacggtgccatccccctgcctgacgaagtcaaaacccacagctccttctggaagcctttccagtgccctgagtgtgggaaaggattcagtcggagctccaatctcgtcaggcaccagcgaacccacgaagagaagtcttatggctgtgtggagtgtgggaagggctttaccctgagagaatacctgatgaagcaccagagaacccacctgggaaagaggccctacgtgtgcagcgagtgctggaaaaccttcagccagagacaccacctggaggtgcaccagcgcagccacactggggagaagccctacaagtgcggggactgctggaagagcttcagccgcaggcagcacctgcaggtgcaccggaggacgcacaccggggagaagccctacacctgcgagtgtggcaagagcttcagcaggaatgccaatctggcggtgcaccggcgtgcccacactggcgagaagccatatgggtgccaggtgtgcgggaagcggttcagcaaaggggagcggctggtccgacaccagagaatccatacaggggagaagccctaccactgtcctgcctgcgggcgaagcttcaaccagaggtccatcctcaaccggcaccagaagacccagcaccgccaggagccgctggtgcagtgagcatagcaggtggcaggcagcaccatcattcatctttctcactgcagggccttgcggggtgcaaggtgatggctgcaggaaagcactggtcccatcgccttcccacccattcgccaacgcgggaaaggcaaggcctggcttacttagagcttccagagagcatagctgcttccatctcttacccaagtggtgctaaacaatttttcttccaatgtttgagggaagcagtctcctgcggttcagttcaggctgagattttctccttcagtggactgtctgtgtccccctgccgaacaaagctgggagtaaaggcaaaaccttgacacgtgttggtagctgggacctcatcttcctgagggctctgtcttgcctgcagggtcatagctcagactcttcccccaccccctctcttttccattgaacaaacatttattgaacatcctctgagcacctggccgtgggaatgccgtggtgaatgagagactagacgtgatgcctctgggggttgtgcgttggggatgcatgcgacagcccatgacccgaggcattctcagggtatctgtgctgtgtgcccgtgagaacatcttcccatgaccactcctgccctcctgccccgtgctggatcttccctccccagctgggatctgctcccaggcaactgtgtgaattttacattatttggagcctcatctgtgtcaggctataacattctatcctcatctgtaaaacttccccgtccattattccttgcactataacaactgtcaacacaccaactattaggaagttagtattttgctattgatcactgaataaacatcagagtattttaaaaaacagttctctagaaagaactgttataattaaaatgagtctgaaagatgaactctagtattaatgccctatatttgatggcactttatagttcataaaattaatttcaccccattctcattggacccatttcccaagtatttattgaggccctgtaacaaacatgtcaggaactcttctgggtgcttgagacacatccatgaataaaatagggggagaagctgttgacctcgtagagcttatgtctcgtggatgtacctgatcttcagaacccgtggatattcctgcaaatcctctgggcctgtattcattgctttgtcagcatcttgccctgaaatgcatttgtcacctacctcttgttactaaatggtctctgccctccagacccttgtcatccaaggcactaggggtcctggacacccactggggatgatgagctggtagcgacctgttttgcatgagtgccaagtcaggaaaaataaagatatttgtaggcattaaaaaaaaatacatttctttaaaaatgagaagatgcaatatttgtaaactgttgaagcttccttattgtgccatcacttaagggtttcatttctgtttaaagttctggaagctgcataactagcgtggactgactgctgtgtcattgtgctgtgcctttgaaccctggctgagtgagtgagtttgtcctttgttgatagtgtcctataattgcaaaatgtggtttgtcttctgatgcctcttaataccagattcttttactgagatttttttttttcattttccattgtaaataaggtaaatggtaatgactaacacaaagctgtattactcagcccactttgaaacgtggttttatcacctgttcttgttaggcagcatggtgtctaattttggcttagcaaatgacgctccttggtcttcctggctcattagctgtgcccacgaggctgcactgactgggtcgtaaatgtatctgagatgtccacacggggctgctgctgctcctctgtaatactgaggtccacatgcaaaatcagctttttttcccccgtaattatcagagcagctaggcagggctgacagccaggcagactcagtgggaggcttctggcctgagtgtggccttccccagagggtggttttccaaaggcaggtggggactggggaggcctcggggggctgcttgtcattacctgaatcacagatgctcttttgtcatacacagccagcattcctctgggtttcagcaagttggcatatcttaagcttcagaaggagctgggccttgctgactttcctatctggcctcttccctatctcctgtggggccaagagcttaggacagtgtctcagaaaagcctctaagtagggggtttttcccatgggattgtggtagtctgatttttcatatctattcaaatgttaagaaatattttgttttctgtatttttctattctttagaaatttttttataatagataatttcaaacctatataaataaatccttatgtatttatcatttgactttattataaactcataatc

SEQ ID NO: 3180 - DNA, 4079 bp, Homo sapiens
gttctcaaaagggtcattgatgcagtcattctcagtctcctcggagggagtctgaagatgcttaaagagcatccagagatggcggaagctcctcagcagcagttgggtattcctgtggtgaaactggagaaagagttgccatggggcagaggaagggaggaccctagtccagagacttttcggctgaggtttcggcagttccgctaccaggaggcagctggaccccaggaagctcttagggagctccaggagctctgtcgtcggtggctgaggcccgagttgcacaccaaggagcagatcctggagctgctggtgctggagcagttcctcactatcctgccccgcgagttctacgcctggatccgggagcatggcccagagagtggcaaggccctggccgccatggtggaggacctgacagaaagagcactggaggccaaggcggttccatgccacaggcagggagagcaggaggaaacagcactttgcagaggcgcttgggagccaggcatccagctggggccagtggaggtcaagcctgaatgggggatgccccctggggaaggagttcaaggtccagacccaggtaccgaggagcagctcagtcaggaccctggagatgagacacgggccttccaggagcaagcactacctgttctgcaggcgggtcctggcctccccgcagtgaatcccagagaccaagagatggcagctgggttctttactgctggatcgcaggggttggggccatttaaagatatggccctggccttccctgaggaggagtggaggcatgtgaccccagcccagatagactgctttggggagtatgtggaaccgcaggactgcagggtctctccaggcggtgggagcaaggaaaaggaggcaaaacccccacaggaagacctgaaaggggcgctggtggcactgacatcagagaggtttggggaagcctctctccagggccctgggctcggaagggtctgtgagcaggagcctggtggccctgcaggcagtgcgcctgggcttcctcctccccagcacggtgccatccccctgcctgacgaagtcaaaacccacagctccttctggaagcctttccagtgccctgagtgtgggaaaggattcagtcggagctccaatctcgtcaggcaccagcgaacccacgaagagaagtcttatggctgtgtggagtgtgggaagggctttaccctgagagaatacctgatgaagcaccagagaacccacctgggaaagaggccctacgtgtgcagcgagtgctggaaaaccttcagccagagacaccacctggaggtgcaccagcgcagccacactggggagaagccctacaagtgcggggactgctggaagagcttcagccgcaggcagcacctgcaggtgcaccggaggacgcacaccggggagaagccctacacctgcgagtgtggcaagagcttcagcaggaatgccaatctggcggtgcaccggcgtgcccacactggcgagaagccatatgggtgccaggtgtgcgggaagcggttcagcaaaggggagcggctggtccgacaccagagaatccatacaggggagaagccctaccactgtcctgcctgcgggcgaagcttcaaccagaggtccatcctcaaccggcaccagaagacccagcaccgccaggagccgctggtgcagtgagcatagcaggtggcaggcagcaccatcattcatctttctcactgcagggccttgcggggtgcaaggtgatggctgcaggaaagcactggtcccatcgccttcccacccattcgccaacgcgggaaaggcaaggcctggcttacttagagcttccagagagcatagctgcttccatctcttacccaagtggtgctaaacaatttttcttccaatgtttgagggaagcagtctcctgcggttcagttcaggctgagattttctccttcagtggactgtctgtgtccccctgccgaacaaagctgggagtaaaggcaaaaccttgacacgtgttggtagctgggacctcatcttcctgagggctctgtcttgcctgcagggtcatagctcagactcttcccccaccccctctcttttccattgaacaaacatttattgaacatcctctgagcacctggccgtgggaatgccgtggtgaatgagagactagacgtgatgcctctgggggttgtgcgttggggatgcatgcgacagcccatgacccgaggcattctcagggtatctgtgctgtgtgcccgtgagaacatcttcccatgaccactcctgccctcctgccccgtgctggatcttccctccccagctgggatctgctcccaggcaactgtgtgaattttacattatttggagcctcatctgtgtcaggctataacattctatcctcatctgtaaaacttccccgtccattattccttgcactataacaactgtcaacacaccaactattaggaagttagtattttgctattgatcactgaataaacatcagagtattttaaaaaacagttctctagaaagaactgttataattaaaatgagtctgaaagatgaactctagtattaatgccctatatttgatggcactttatagttcataaaattaatttcaccccattctcattggacccatttcccaagtatttattgaggccctgtaacaaacatgtcaggaactcttctgggtgcttgagacacatccatgaataaaatagggggagaagctgttgacctcgtagagcttatgtctcgtggatgtacctgatcttcagaacccgtggatattcctgcaaatcctctgggcctgtattcattgctttgtcagcatcttgccctgaaatgcatttgtcacctacctcttgttactaaatggtctctgccctccagacccttgtcatccaaggcactaggggtcctggacacccactggggatgatgagctggtagcgacctgttttgcatgagtgccaagtcaggaaaaataaagatatttgtaggcattaaaaaaaaatacatttctttaaaaatgagaagatgcaatatttgtaaactgttgaagcttccttattgtgccatcacttaagggtttcatttctgtttaaagttctggaagctgcataactagcgtggactgactgctgtgtcattgtgctgtgcctttgaaccctggctgagtgagtgagtttgtcctttgttgatagtgtcctataattgcaaaatgtggtttgtcttctgatgcctcttaataccagattcttttactgagatttttttttttcattttccattgtaaataaggtaaatggtaatgactaacacaaagctgtattactcagcccactttgaaacgtggttttatcacctgttcttgttaggcagcatggtgtctaattttggcttagcaaatgacgctccttggtcttcctggctcattagctgtgcccacgaggctgcactgactgggtcgtaaatgtatctgagatgtccacacggggctgctgctgctcctctgtaatactgaggtccacatgcaaaatcagctttttttcccccgtaattatcagagcagctaggcagggctgacagccaggcagactcagtgggaggcttctggcctgagtgtggccttccccagagggtggttttccaaaggcaggtggggactggggaggcctcggggggctgcttgtcattacctgaatcacagatgctcttttgtcatacacagccagcattcctctgggtttcagcaagttggcatatcttaagcttcagaaggagctgggccttgctgactttcctatctggcctcttccctatctcctgtggggccaagagcttaggacagtgtctcagaaaagcctctaagtagggggtttttcccatgggattgtggtagtctgatttttcatatctattcaaatgttaagaaatattttgttttctgtatttttctattctttagaaatttttttataatagataatttcaaacctatataaataaatccttatgtatttatcatttgactttattataaactcataatcaatctt

SEQ ID NO: 3181 - DNA, 4349 bp, Homo sapiens
agctcacttccggaccgcggatagcactggcgaccctagcgggtgagaggcccttcagggccgcggcgggttgagcgcaccatcacatctaagccatcagcaagtttgttggttttaatctccaaaatacgtcttgattttgtctgactctttgccaccaccctgatctaagcccttatcatctgcttgaatcactaacttgtctccacttgcagtttttaaaagagttgcttccatttgactttttctgtctgctgtaccagcatatgagtttcaggaggggtcattgatgcagtcattctcagtctcctcggagggagtctgaagatgcttaaagagcatccagagatggcggaagctcctcagcagcagttgggtattcctgtggtgaaactggagaaagagttgccatggggcagaggaagggaggaccctagtccagagacttttcggctgaggtttcggcagttccgctaccaggaggcagctggaccccaggaagctcttagggagctccaggagctctgtcgtcggtggctgaggcccgagttgcacaccaaggagcagatcctggagctgctggtgctggagcagttcctcactatcctgccccgcgagttctacgcctggatccgggagcatggcccagagagtggcaaggccctggccgccatggtggaggacctgacagaaagagcactggaggccaaggcggttccatgccacaggcagggagagcaggaggaaacagcactttgcagaggcgcttgggagccaggcatccagctggggccagtggaggtcaagcctgaatgggggatgccccctggggaaggagttcaaggtccagacccaggtaccgaggagcagctcagtcaggaccctggagatgagacacgggccttccaggagcaagcactacctgttctgcaggcgggtcctggcctccccgcagtgaatcccagagaccaagagatggcagctgggttctttactgctggatcgcaggggttggggccatttaaagatatggccctggccttccctgaggaggagtggaggcatgtgaccccagcccagatagactgctttggggagtatgtggaaccgcaggactgcagggtctctccaggcggtgggagcaaggaaaaggaggcaaaacccccacaggaagacctgaaaggggcgctggtggcactgacatcagagaggtttggggaagcctctctccagggccctgggctcggaagggtctgtgagcaggagcctggtggccctgcaggcagtgcgcctgggcttcctcctccccagcacggtgccatccccctgcctgacgaagtcaaaacccacagctccttctggaagcctttccagtgccctgagtgtgggaaaggattcagtcggagctccaatctcgtcaggcaccagcgaacccacgaagagaagtcttatggctgtgtggagtgtgggaagggctttaccctgagagaatacctgatgaagcaccagagaacccacctgggaaagaggccctacgtgtgcagcgagtgctggaaaaccttcagccagagacaccacctggaggtgcaccagcgcagccacactggggagaagccctacaagtgcggggactgctggaagagcttcagccgcaggcagcacctgcaggtgcaccggaggacgcacaccggggagaagccctacacctgcgagtgtggcaagagcttcagcaggaatgccaatctggcggtgcaccggcgtgcccacactggcgagaagccatatgggtgccaggtgtgcgggaagcggttcagcaaaggggagcggctggtccgacaccagagaatccatacaggggagaagccctaccactgtcctgcctgcgggcgaagcttcaaccagaggtccatcctcaaccggcaccagaagacccagcaccgccaggagccgctggtgcagtgagcatagcaggtggcaggcagcaccatcattcatctttctcactgcagggccttgcggggtgcaaggtgatggctgcaggaaagcactggtcccatcgccttcccacccattcgccaacgcgggaaaggcaaggcctggcttacttagagcttccagagagcatagctgcttccatctcttacccaagtggtgctaaacaatttttcttccaatgtttgagggaagcagtctcctgcggttcagttcaggctgagattttctccttcagtggactgtctgtgtccccctgccgaacaaagctgggagtaaaggcaaaaccttgacacgtgttggtagctgggacctcatcttcctgagggctctgtcttgcctgcagggtcatagctcagactcttcccccaccccctctcttttccattgaacaaacatttattgaacatcctctgagcacctggccgtgggaatgccgtggtgaatgagagactagacgtgatgcctctgggggttgtgcgttggggatgcatgcgacagcccatgacccgaggcattctcagggtatctgtgctgtgtgcccgtgagaacatcttcccatgaccactcctgccctcctgccccgtgctggatcttccctccccagctgggatctgctcccaggcaactgtgtgaattttacattatttggagcctcatctgtgtcaggctataacattctatcctcatctgtaaaacttccccgtccattattccttgcactataacaactgtcaacacaccaactattaggaagttagtattttgctattgatcactgaataaacatcagagtattttaaaaaacagttctctagaaagaactgttataattaaaatgagtctgaaagatgaactctagtattaatgccctatatttgatggcactttatagttcataaaattaatttcaccccattctcattggacccatttcccaagtatttattgaggccctgtaacaaacatgtcaggaactcttctgggtgcttgagacacatccatgaataaaatagggggagaagctgttgacctcgtagagcttatgtctcgtggatgtacctgatcttcagaacccgtggatattcctgcaaatcctctgggcctgtattcattgctttgtcagcatcttgccctgaaatgcatttgtcacctacctcttgttactaaatggtctctgccctccagacccttgtcatccaaggcactaggggtcctggacacccactggggatgatgagctggtagcgacctgttttgcatgagtgccaagtcaggaaaaataaagatatttgtaggcattaaaaaaaaatacatttctttaaaaatgagaagatgcaatatttgtaaactgttgaagcttccttattgtgccatcacttaagggtttcatttctgtttaaagttctggaagctgcataactagcgtggactgactgctgtgtcattgtgctgtgcctttgaaccctggctgagtgagtgagtttgtcctttgttgatagtgtcctataattgcaaaatgtggtttgtcttctgatgcctcttaataccagattcttttactgagatttttttttttcattttccattgtaaataaggtaaatggtaatgactaacacaaagctgtattactcagcccactttgaaacgtggttttatcacctgttcttgttaggcagcatggtgtctaattttggcttagcaaatgacgctccttggtcttcctggctcattagctgtgcccacgaggctgcactgactgggtcgtaaatgtatctgagatgtccacacggggctgctgctgctcctctgtaatactgaggtccacatgcaaaatcagctttttttcccccgtaattatcagagcagctaggcagggctgacagccaggcagactcagtgggaggcttctggcctgagtgtggccttccccagagggtggttttccaaaggcaggtggggactggggaggcctcggggggctgcttgtcattacctgaatcacagatgctcttttgtcatacacagccagcattcctctgggtttcagcaagttggcatatcttaagcttcagaaggagctgggccttgctgactttcctatctggcctcttccctatctcctgtggggccaagagcttaggacagtgtctcagaaaagcctctaagtagggggtttttcccatgggattgtggtagtctgatttttcatatctattcaaatgttaagaaatattttgttttctgtatttttctattctttagaaatttttttataatagataatttcaaacctatataaataaatccttatgtatttatcatttgactttattataaactcataatcaatctt

SEQ ID NO: 3182 - DNA, 594 bp, Homo sapiens
ggatagcactggcgaccctagcgggtgagaggcccttcagggccgcggcgggatctccttcccctggtgctttggacttccaagtctgtcttcccagtctaggtcttccgcataatccacttggaggttgagcgcaccatcacatctaagccatcagcaagtttgttggttttaatctccaaaatacgtcttgattttgtctgactctttgccaccaccctgatctaagcccttatcatctgcttgaatcactaacttgtctccacttgcagtttttaaaagagttgcttccatttgactttttctgtctgctgtaccagcatatgagtttcaggaggggtcattgatgcagtcattctcagtctcctcggagggagtctgaagatgcttaaagagcatccagagatggcggaagctcctcagcagcagttgggtattcctgtggtgaaactggagaaagagttgccatggggcagaggaagggaggaccctagtccagagacttttcggctgaggtttcggcagttccgctaccaggaggcagctggaccccaggaagctcttagggagctccaggagctctgtcgtcggtgg

SEQ ID NO: 3183 - DNA, 3252 bp, Homo sapiens
cgcacggcctggtttgcacccctggtttagggtcttcggccccggctctggcgtccctggctgccaagcctgaggcccgcagtcctactcccgccgagacccgccgctccggtcctgccccgaactgcccacggccggcagcgcttccaggccctgaaaaaaactctcttcctgtgtctggccagaggtatagagagagacaggttcaactctaaggcctgaaaaggaacaaggcccaccggaagcaatggccactgtccctggcctccagcccctgccaaccttggagcaggacctggaacaggaagagatcctgattgtgaaggtggaggaggacttctgcttggaagaggagccctccgtggagacggaggaccccagccctgagactttccgccagctcttccggctcttctgctaccaggaggtggctgggccccgggaggccctgagccgcctctgggagctgtgctgccgctggctgcggccggagctgcgcaccaaggagcagatcctggagctgctggtgctggagcagttcctgactgtgctgccgggggagatccaggctcgggtacgcgagcagcagccggagagcggtgaggaggccgtggtccttgtggaagggctgcagcggaagcccaggaaacacaggcagcggggctcagagctgctttctgatgacgaggtgcccctcgggatagggggacagttcttaaaacaccaggcagaggctcagccagaggatctgtccctggaggaagaggctcgattctccagccagcagcccccagcccagctgagccacaggccacagaggggcccgctgttgtggccagagagaggccctccagctccccggcatcaggagatggcgtcagcctcgcccttcctttcggcctggtcccaggtgcccgtgaacttggaggacgtggctgtatacctttctggggaggagccaagatgcatggacccagctcagcgggacgcgccgctggagaatgaaggacctgggatccagttggaggacggcggtgatggcagggaggatgccccgttgagaatggagtggtaccgagtgctctcggcacgatgccaggggcctggccacccgctcccaggtcagaggccagccccagtcaggggcttggtcaggcctgatcagccaagaggcggccccccaccaggaagacgggcttcccatggggctgacaagccgtacacctgccccgaatgtggcaaaggcttcagcaagacgtcccacttgaccaagcaccagcgcacacacacgggcgagcggccttacaagtgcctagtctgtgggaagggctttagcgaccgctccaacttcagcacgcaccagagggtgcacacaggcgagaagccctacccgtgccccgagtgtgggaagcgcttcagccagagctccagcctggtcatccaccgcaggacacacagcggggagcggccctatgcctgcacccagtgcgggaagcgcttcaacaacagctcgcacttcagcgcccaccgccggacgcacacaggtgagaagccctacacctgcccggcctgtggccggggcttccgccggggcaccgacctgcacaagcaccagcggacccacatgggggcaggctccttgccgacgctccagccggtggctcctggaggccccggtgccaaagcctgatcaccaggcctgaaactccctttccaggactctcatccctgggcacagaattcaggaaactgctagacagcctggtccgaaagcattgccagctgcccgtttcctcccatggcccagtatgaggccagcaggggacatttgggatgcccaggccgcagaggaagctgggcactgggtgcagaacaagggcaaggacaggctctgagtgtccagtggcagccagaacaggtgacacagagcaggggcttcagccacagagacacactcaggaggccagaagccgacactcaaggtgttcgtggggctggctcctgaagggcctgggagggtccatcagctgcctccagcatccagtggctgctggcatacagcctcatccccacgtcccaacccctctcctgtgtgtctgtgaccctgtgcgctgtctctgtgtgtaccccccacctgctcccccccccttttttttttgagacggggccttgctgtgtcccccaggcgggaatacagtgccatgatcatagctcactgcagcctcgaatccctgggctcaagtgttcctcctgcctcatcctcctgagtagctggggttacaggtgtgtgccgccatgcccagtctcttttttggtagggccaccactcactgggtttagggtcccccaatacactgtgacctcatcttaactaattatatcatcaaaacccgtgtttccaaataaggtcacattctgaggtctgggtgcacatgaatttgagggacccctcgtctgctgcagggagccctgctgtaccccagccttcccaggacgtggtctccagcttcttcatcctgccagagtttccaaatggagcccggggctctgcagcattccagtcccctttgcagatccatagctgctctgcagggcggaagacacctggggcgggaaagcacccctgagttccatcttcctgacatgttgcctgggatgtgacgggcctgacatctccccagggccggggcccagggctgcgtttgctcctggccccttagtgtctggaatgtggccttccacggttgccccactttgtctttctaaggtaagaagccttcaccttccagcttttgtctggcctgtgctgcgtgggagccactggtctgtgcacatccacggtgggtgagtggccaagacaagcagtgtgatagagtccttggtgggtttagtcatctcggaagtcgtagggcagctatggaaaccactgggttctggaacgttccagccaggcagtggttgttcctcataggtaggtggccttggccttcatcccagcctgggatgctccattgcatttgtcacctagtcactgtatatacgtgcacatttgaccttttggcacagcccaggttccaggtgcgtgacctgccctttttctcattcccttaactgacattatttagtgtcagaggccgagcacagtggctcccacctataatcctagcactttgggaggccaacgcgggtggattgcttgagcccaggagttcaagagcagcctgggcaatatagaaagacctcttccctacc

SEQ ID NO: 3184 - DNA, 2440 bp, Homo sapiens
agccaatggtgccacggctacgttacccacaatgccgcctgcgggcccacccgcacggcctggtttgcacccctggtttagggtcttcggccccggctctggcgtccctggctgccaagcctgaggcccgcagtcctactcccgccgagacccgccgctccggtcctgccccgaactgcccacggccggcagcgcttccaggccctgaaaaaaactctcttcctgtgtctggccagaggtatagagagagacaggttcaactctaaggcctgaaaaggaacaaggcccaccggaagcaatggccactgtccctggcctccagcccctgccaaccttggagcaggacctggaacaggaagagatcctgattgtgaaggtggaggaggacttctgcttggaagaggagccctccgtggagacggaggaccccagccctgagactttccgccagctcttccggctcttctgctaccaggaggtggctgggccccgggaggccctgagccgcctctgggagctgtgctgccgctggctgcggccggagctgcgcaccaaggagcagatcctggagctgctggtgctggagcagttcctgactgtgctgccgggggagatccaggctcgggtacgcgagcagcagccggagagcggtgaggaggccgtggtccttgtggaagggctgcagcggaagcccaggaaacacaggcagcggggctcagagctgctttctgatgacgaggtgcccctcgggatagggggacagttcttaaaacaccaggcagaggctcagccagaggatctgtccctggaggaagaggctcgattctccagccagcagcccccagcccagctgagccacaggccacagaggggcccgctgttgtggccagagagaggccctccagctccccggcatcaggagatggcgtcagcctcgcccttcctttcggcctggtcccaggtgcccgtgaacttggaggacgtggctgtatacctttctggggaggagccaagatgcatggacccagctcagcgggacgcgccgctggagaatgaaggacctgggatccagttggaggacggcggtgatggcagggaggatgccccgttgagaatggagtggtaccgagtgctctcggcacgatgccaggggcctggccacccgctcccaggtcagaggccagccccagtcaggggcttggtcaggcctgatcagccaagaggcggccccccaccaggaagacgggcttcccatggggctgacaagccgtacacctgccccgaatgtggcaaaggcttcagcaagacgtcccacttgaccaagcaccagcgcacacacacgggcgagcggccttacaagtgcctagtctgtgggaagggctttagcgaccgctccaacttcagcacgcaccagagggtgcacacaggcgagaagccctacccgtgccccgagtgtgggaagcgcttcagccagagctccagcctggtcatccaccgcaggacacacagcggggagcggccctatgcctgcacccagtgcgggaagcgcttcaacaacagctcgcacttcagcgcccaccgccggacgcacacaggtcacattctgaggtctgggtgcacatgaatttgagggacccctcgtctgctgcagggagccctgctgtaccccagccttcccaggacgtggtctccagcttcttcatcctgccagagtttccaaatggagcccggggctctgcagcattccagtcccctttgcagatccatagctgctctgcagggcggaagacacctggggcgggaaagcacccctgagttccatcttcctgacatgttgcctgggatgtgacgggcctgacatctccccagggccggggcccagggctgcgtttgctcctggccccttagtgtctggaatgtggccttccacggttgccccactttgtctttctaaggtaagaagccttcaccttccagcttttgtctggcctgtgctgcgtgggagccactggtctgtgcacatccacggtgggtgagtggccaagacaagcagtgtgatagagtccttggtgggtttagtcatctcggaagtcgtagggcagctatggaaaccactgggttctggaacgttccagccaggcagtggttgttcctcataggtaggtggccttggccttcatcccagcctgggatgctccattgcatttgtcacctagtcactgtatatacgtgcacatttgaccttttggcacagcccaggttccaggtgcgtgacctgccctttttctcattcccttaactgacattatttagtgtcagaggccgagcacagtggctcccacctataatcctagcactttgggaggccaacgcgggtggattgcttgagcccaggagttcaagagcagcctgggcaatatagaaagacctcttccctacc

SEQ ID NO: 3185 - DNA, 648 bp, Homo sapiens
atgaattccagccaaatatcactcagaatgaaacatgggagagttaacatgcagaagaaaccttcaaagtgtagtgaatgtgggaagttctttactcagagatcatctcttacccagcaccagaggattcacagaggagagaagccctatgtgtgcagtgaatgtggaagttgtttccgtaaacagtcaaatcttactcaacatctgagaattcataccggagagaaaccttataaatgtaatgaatgtgagaaagcctttcaaacaaaagcaattcttgttcagcatctgagaattcatactggagagaaaccctataaatgcaatgaatgtggaaaagccttttgtcagagcccatcccttattaaacaccagcgaattcatactggagagaagccctacacatgcactgaatgtggtaaagccttcactcagaactcttcccttgttgaacatgaaaggactcacactggagagaaactttataagtgtagtgagtgtgaaaaaactttccgcaaacaagcacaccttagtgagcattacagaattcatactggagaaaaaccttatgagtgtgttggatgtgggaaatcctttaggcacagttcagcacttcttcgacatcagaggcttcatgctggagagtaa

SEQ ID NO: 3186 - DNA, 3099 bp, Homo sapiens
gactgctgacgtcacgccggctgggcgcgtccgggacttactcctttccgcagggcagcacccagggacctgagtgttgcaaggtgcgagaggggagcgccgcggggagcgccgcgggaagcgcatgtgcctcaaattcctgcctttcctcaagagaagagcccccaggagaaaagccagtattgcttgtgctcctaacaacctgtctcttgagaggctgatcatcaggggttcactttcagagaagttgagaatgcaggctgaacaaggaagaggaaggggaatcctgcagggatgaatgagaggacagcaatgcatgtgtgatgtgtgtgagcacacacacacagtaacctttcctaggagaactgtattactctaatgataatcacctttgaggaaaaaaaacttgtaagtatgaatttggtgttacaagcagcatgaattccagccaaatatcactcagaatgaaacatgggagagttaacatgcagaagaaaccttcaaagtgtagtgaatgtgggaagttctttactcagagatcatctcttacccagcaccagaggattcacagaggagagaagccctatgtgtgcagtgaatgtggaagttgtttccgtaaacagtcaaatcttactcaacatctgagaattcataccggagagaaaccttataaatgtaatgaatgtgagaaagcctttcaaacaaaagcaattcttgttcagcatctgagaattcatactggagagaaaccctataaatgcaatgaatgtggaaaagccttttgtcagagcccatcccttattaaacaccagcgaattcatactggagagaaaccatataaatgtacagaatgtggcaaagccttcagtcagagcatatgccttactcgtcatcagagaagtcattctggagataaaccttttaagtgtaatgaatgtgggaaagcctttaatcagagtgcatgtctcatgcagcatcagagaattcattcaggagagaagccctacacatgcactgaatgtggtaaagccttcactcagaactcttcccttgttgaacatgaaaggactcacactggagagaaactttataagtgtagtgagtgtgaaaaaactttccgcaaacaagcacaccttagtgagcattacagaattcatactggagaaaaaccttatgagtgtgttggatgtgggaaatcctttaggcacagttcagcacttcttcgacatcagaggcttcatgctggagagtaaaatttggaatataatgagtatgggaagatttgtatggaagcaccttttttttctcctaaattcctaggaatgtaagactcaatctgtagctagtatgaatattttgtattttgaacaagaaatgttgtgtcctaatgtgtcctagtctggagtttgatgccttatctgctgctcagtgggtgtaaccttatcccttctgagcctcagtttccccattccccccaatagaaaaatggggatatttcctagggttgtcctgagaataaaatgagttctgtgtgacagttaactgccattaattaattagccgttctaaaagtttatttacaatatcaaaatctgacaagtaaatcagcattgttgtttggttctcataatgtattgtttcttaagaacattttgtaattgggctatgattttatgatctacagacgtctatttaaactataatgtcttggtttaaataggataatacaatctaagactggtttgtccttgagaaatttcagatttaatcagagaaaaatgtactgattgggatttgagtggacattgtggggtgtatttctggataccctcaagatcttcatttaaattttgatactttctattactagatctaatttgattttaagctctaagtttcacttttccattaaacggaaagcctccctgacattaactgaataaaacctcatgttgtgggacttctgtgtgtgtttagggttggcagcaggtgattaggagaaggcatatgacagtagagaggactggaatatagaggagaatataagcatgtagatgaggatgtggctgtatttgttttgagttctaggagcacagcaccaaatgtggtctcttaagggaagatgagggtagaagatgttaagatcccaggttccagcaactgatgccactgactaacaactagccacttgtcagaggaaggagagaacagtgtcttggggatgctgatgggttggagtgcctaatggctcattaaaagccatgaaaaagcaaagaaatcaaagaatacttttgatggagctttaggctatgctaagccttttaatgtaaacaagcacctctaacgctaaaagcacccttgcaagaaaggtaggagttactattcacatcctagagtcaaggaaaaagagaagatgtttgacttgctcaaagtcaagcaggtaatgtcagaattgaatctcaaatctatatctttatagatttgcagttctggtttatataataccaaagtcacatacaggtaatttcccaccattgaaccttcctgttggtgtgagatgccaaatctgtgaaaaccagacacaggtggccaggtgggtgtcgaactcctgacctcaagtgatccgcctgcctcagcctcccaaagtgctgggattacaggtgtgagtcaccacatctggtcggattttaactattctaataggtatgtagtggtattaattgttttaatctgcagttcaccaataatatatgaatttagcatcttttcatatgtttgccatctgtatagctttggtgaggtatctgttagaggttttgcccatttttaattggattgctcattttcttattgttgaattttaagtgttccttgtatattttgtataacagacctttatcagataggtcttttgcaaatattttcctcccaggctgtggcttattttctcaatccttgattccttctctttactttttttttcttttttctttttttaaagaaatggtagcataatatacacagttgtccattttttaaagactaaaccatctcacagattgttctgtatcagtaaataaagatctttcccccaccctt

SEQ ID NO: 3187 - DNA, 3270 bp, Homo sapiens
attcttccggtttcagaagttaaggctggtgtcctggccccagtccacctctgggagcgcctgcgccgctccgcggagagtccgtggatctcacagtgaaaaatgtttgctgacccttgacattgacaaactgctgacagctcagatgatccatgattggaaggatgtggtcatcaccaagatgtctttctttctccggttcccagttttccagacctgaagtgttttccaatcaaagcgaagagacgatctgtggatgttgaatatgcaaggagctgaagagagagacattagaagagagacttgtccaggctgggtaaacaagaacaagcctgctctggagcaggatgtctgtaaaattgactcatcagggatagtagtaaagaggttccaagaggatgaataccaagattctacatttgaagaaaaatatgcatgtgagggcatgaaggaaaactctcctagggagattgctgaatcatgccttttccaggaaggaggttttgggagaataactttcatccacaaagaagcaccccctgaaattattagtcaaggatataattttgagaaaagcttgcttttgacctcaagccttgttacacgtctcagggtttctacagaagagagtctgcatcagtgggaaacaagtaatatacaaaccaatgatatttcagaccaaagtaaatgtccaactctctgcacacagaaaaaatcttggaaatgtaatgaatgtggaaaaacctttactcagagctcatcccttacccaacatcagagaactcatactggagagagaccctacacatgtgaggaatgtgggaaagcctttagtcgtagttcattccttgttcaacatcaaagaattcacactggagtgaaaccatatggatgtgagcagtgtgggaaaacatttcgatgtcgatcatttcttactcagcatcaaagaattcacactggagagaaaccttataaatgcaatgaatgtgggaattccttccgcaatcactcacatctcactgaacaccagagaattcacactggagagaaaccttataaatgcaataggtgtgggaaggcattcaatcagaatacacaccttattcatcatcagagaattcacactggtgagaagccttacatatgcagtgaatgtggctcttcttttcgaaaacactcaaatcttacgcaacatcagagaattcacactggggaaaaaccccataaatgtgacgaatgtgggaaaactttccaaacaaaggcaaacctctctcagcatcagagaattcatagtggagagaaaccctataaatgtaaagaatgtggcaaagccttttgtcagagcccatctcttattaaacaccagcgaattcatactggagaaaaaccatataagtgtaaagaatgtggcaaagcgtttactcagagcaccccactcactaaacatcagagaatacatacaggggagagaccctacaaatgcagtgaatgtggtaaagccttcattcagagcatttgccttattcggcaccagagaagtcacactggagaaaaaccctataaatgcaatgaatgtggaaagggctttaatcagaacacctgcctcactcagcatatgagaattcatactggagagaagccctataaatgtaaagaatgtgggaaagcctttgctcatagctcatctcttactgaacatcatagaactcacactggtgagaagctctataaatgtagtgagtgtgagaaaaccttccgcaagtatgcacaccttagtgaacattacagaattcacactggtgagaagccttatgagtgtattgagtgtggaaagttcttcagacatagttcagtccttttcagacatcagaaacttcacagtggtgactaatgctgccatttaggttatgacagtttctctagcgaggatgactacgaatctgactgggagtagaggggcaggtagagttcctggagggaaggatgaaggagccttggctactgtactctgagaggaatgtttccagaaatggaggtgggagcttagggaatgcagagcctacttgaggtgggcatctgggaatacagggtagaaagaaattcctgcttttcagataaagcctacacattgccactgtctccccatgtgactcttacagcttgaggaggcatttgttagcacttctgttcactttactacatcctgccccacattctgacttgtcacccattttcgttggctggcaggttgagatgtttttcttaaacactgcctgtcagtgtgaagtggcacagctctgatgtagtgctaagtctagcctccagatttgaggcagccctgaccatgctaccatgggggaggctcccaacctgtggaagtggtcctgtgaaaaggagacagaaacaagtaagagccaaaaaaaaaaaaaaaaaaaatccatatccattcattaaaaaaatgagatataaagcaacaactgggctgacctctatagatctgccagtaaagaaggctttctttcattatcagggtgaaggtctttcctgattcttccaagctttgaggtgactcagagctaagaatgaaataggagaccaagttagaattcatgatactggtttatggggaggcagtcatacctgttcagagaaccaggaagactcaatatctatctcagaggaaatatggttacccaggaaagaaatggtctgctagagtgataagactcagaacaggaagcctgcatgtgactgagcaagtcacctacataaccctgcctgtactaaggtgtacacctgtctattgtaagtttgcctaggctgttggtgtacagagaccagaggagagagacacactaggactaacaatgtcctaacaaaatggtacttagtttgttggtctttaggagaaagcattagtaatgaaagaagaaagaattttcacttggttggacattggggctcttaagaaagttgacatttgtcgtggaatgactttggaaagacttctaaaagaatctttttcaaatccctgaaaatcaggatagcacattttgctactgactgtgacagtgttttattcttttgagagaaatgacatagttttccctttatttcccaaattcctttcatgttcttaactgctacccagaaattgagcttcagaagattgaggatagcctttgattggtatttaaaataatttctaagctgtgaagcttatagcatttttaaagtatggctattaaaaacactaagttgattctggaa

SEQ ID NO: 3188 - DNA, 593 bp, Homo sapiens
gtcctggccccagtccacctctgggagcgcctgcgccgctccgcggagagtccgtggatctcacagtgaggttcccagttttccagacctgaagtgttttccaatcaaagcgaagagacgatctgtggatgttgaatatgcaaggagctgaagagagagacattagaagagagacttgtccaggctgggtaaacaagaacaagcctgctctggagcaggatgtctgtaaaattgactcatcagggatagtagtaaagaggttccaagaggatgaataccaagattctacatttgaagaaaaatatgcatgtgagggcatgaaggaaaactctcctagggagattgctgaatcatgccttttccaggaaggaggttttgggagaataactttcatccacaaagaagcaccccctgaaattattagtcaaggatataattttgagaaaagcttgcttttgacctcaagccttgttacacgtctcagggtttctacagaagagagtctgcatcagtgggaaacaagtaatatacaaaccaatgatatttcagaccaaagtaaatgtccaactctctgcacacagaaaaaatcttgg

SEQ ID NO: 3189 - DNA, 2313 bp, Homo sapiens
attcttccggtttcagaagttaaggctggtgtcctggccccagtccacctctgggagcgcctgcgccgctccgcggagagtccgtggatctcacaggttcccagttttccagacctgaagtgttttccaatcaaagcgaagagacgatctgtggatgttgaatatgcaaggagctgaagagagagacattagaagagagacttgtccaggctgggtaaacaagaacaagcctgctctggagcaggatgtctgtaaaattgactcatcagggatagtagtaaagaggttccaagaggatgaataccaagattctacatttgaagaaaaatatgcatgtgagggcatgaaggaaaactctcctagggagattgctgaatcatgccttttccaggaaggaggttttgggagaataactttcatccacaaagaagcaccccctgaaattattagtcaaggatataattttgagaaaagcttgcttttgacctcaagccttgttacacgtctcagggtttctacagaagagagtctgcatcagtgggaaacaagtaatatacaaaccaatgatatttcagaccaaagtaaatgtccaactctctgcacacagaaaaaatcttggaaatgtaatgaatgtggaaaaacctttactcagagctcatcccttacccaacatcagagaactcatactggagagagaccctacacatgtgaggaatgtgggaaagcctttagtcgtagttcattccttgttcaacatcaaagaattcacactggagtgaaaccatatggatgtgagcagtgtggaaaacatttcgatgtcgatcatttcttactcagcatcaaagaattcacactggagagaaaccttataaatgcaatgaatgtgggaattccttccgcaatcactcacatctcactgaacaccagagaattcacactggagagaaaccttataaatgcaataggtgtgggaaggcattcaatcagaatacacaccttattcatcatcagagaattcacactggtgagaagccttacatatgcagtgaatgtggctcttcttttcgaaaacactcaaatcttacgcaacatcagagaattcacactggggaaaaaccccataaatgtgacgaatgtgggaaaactttccaaacaaaggcaaacctctctcagcatcagagaattcatagtggagagaaaccctataaatgtaaagaatgtggcaaagccttttgtcagagcccatctcttattaaacaccagcgaattcatactggagaaaaaccatataagtgtaaagaatgtggcaaagcgtttactcagagcaccccactcactaaacatcagagaatacatacaggggagagaccctacaaatgcagtgaatgtggtaaagccttcattcagagcatttgccttattcggcaccagagaagtcacactggagaaaaaccctataaatgcaatgaatgtggaaagggctttaatcagaacacctgcctcactcagcatatgagaattcatactggagagaagccctataaatgtaaagaatgtgggaaagcctttgctcatagctcatctcttactgaacatcatagaactcacactggtgagaagctctataaatgtagtgagtgtgagaaaaccttccgcaagtatgcacaccttagtgaacattacagaattcacactggtgagaagccttatgagtgtattgagtgtggaaagttcttcagacatagttcagtccttttcagacatcagaaacttcacagtggtgactaatgctgccatttaggttatgacagtttctctagcgaggatgactacgaatctgactgggagtagaggggcaggtagagttcctggagggaaggatgaaggagccttggctactgtactctgagaggaatgtttccagaaatggaggtgggagcttagggaatgcagagcctacttgaggtgggcatctgggaatacagggtagaaagaaattcctgcttttcagataaagcctacacattgccactgtctccccatgtgactcttacagcttgaggaggcatttgttagcacttctgttcactttactacatcctgccccacattctgacttgtcacccattttcgttggctggcaggttgagatgtttttcttaaacactgcctgtcagtgtgaagtggcacagctctgatgtagtgctaagtctagcctccagatttgaggcagccctgaccatgctaccatgggggaggctcccaacctgtggaagtggtcctgtgaaaaggagacagaaacaagtaagagcc

SEQ ID NO: 3190 - DNA, 2314 bp, Homo sapiens
attcttccggtttcagaagttaaggctggtgtcctggccccagtccacctctgggagcgcctgcgccgctccgcggagagtccgtggatctcacaggttcccagttttccagacctgaagtgttttccaatcaaagcgaagagacgatctgtggatgttgaatatgcaaggagctgaagagagagacattagaagagagacttgtccaggctgggtaaacaagaacaagcctgctctggagcaggatgtctgtaaaattgactcatcagggatagtagtaaagaggttccaagaggatgaataccaagattctacatttgaagaaaaatatgcatgtgagggcatgaaggaaaactctcctagggagattgctgaatcatgccttttccaggaaggaggttttgggagaataactttcatccacaaagaagcaccccctgaaattattagtcaaggatataattttgagaaaagcttgcttttgacctcaagccttgttacacgtctcagggtttctacagaagagagtctgcatcagtgggaaacaagtaatatacaaaccaatgatatttcagaccaaagtaaatgtccaactctctgcacacagaaaaaatcttggaaatgtaatgaatgtggaaaaacctttactcagagctcatcccttacccaacatcagagaactcatactggagagagaccctacacatgtgaggaatgtgggaaagcctttagtcgtagttcattccttgttcaacatcaaagaattcacactggagtgaaaccatatggatgtgagcagtgtgggaaaacatttcgatgtcgatcatttcttactcagcatcaaagaattcacactggagagaaaccttataaatgcaatgaatgtgggaattccttccgcaatcactcacatctcactgaacaccagagaattcacactggagagaaaccttataaatgcaataggtgtgggaaggcattcaatcagaatacacaccttattcatcatcagagaattcacactggtgagaagccttacatatgcagtgaatgtggctcttcttttcgaaaacactcaaatcttacgcaacatcagagaattcacactggggaaaaaccccataaatgtgacgaatgtgggaaaactttccaaacaaaggcaaacctctctcagcatcagagaattcatagtggagagaaaccctataaatgtaaagaatgtggcaaagccttttgtcagagcccatctcttattaaacaccagcgaattcatactggagaaaaaccatataagtgtaaagaatgtggcaaagcgtttactcagagcaccccactcactaaacatcagagaatacatacaggggagagaccctacaaatgcagtgaatgtggtaaagccttcattcagagcatttgccttattcggcaccagagaagtcacactggagaaaaaccctataaatgcaatgaatgtggaaagggctttaatcagaacacctgcctcactcagcatatgagaattcatactggagagaagccctataaatgtaaagaatgtgggaaagcctttgctcatagctcatctcttactgaacatcatagaactcacactggtgagaagctctataaatgtagtgagtgtgagaaaaccttccgcaagtatgcacaccttagtgaacattacagaattcacactggtgagaagccttatgagtgtattgagtgtggaaagttcttcagacatagttcagtccttttcagacatcagaaacttcacagtggtgactaatgctgccatttaggttatgacagtttctctagcgaggatgactacgaatctgactgggagtagaggggcaggtagagttcctggagggaaggatgaaggagccttggctactgtactctgagaggaatgtttccagaaatggaggtgggagcttagggaatgcagagcctacttgaggtgggcatctgggaatacagggtagaaagaaattcctgcttttcagataaagcctacacattgccactgtctccccatgtgactcttacagcttgaggaggcatttgttagcacttctgttcactttactacatcctgccccacattctgacttgtcacccattttcgttggctggcaggttgagatgtttttcttaaacactgcctgtcagtgtgaagtggcacagctctgatgtagtgctaagtctagcctccagatttgaggcagccctgaccatgctaccatgggggaggctcccaacctgtggaagtggtcctgtgaaaaggagacagaaacaagtaagagcc

SEQ ID NO: 3191 - DNA, 3173 bp, Homo sapiens
accattcttccggtttcagaagttaaggctggtgtcctggccccagtccacctctgggagcgcctgcgccgctccgcggagagtccgtggatctcacagtgaggttcccagttttccagacctgaagtgttttccaatcaaagcgaagagacgatctgtggatgttgaatatgcaaggagctgaagagagagacattagaagagagacttgtccaggctgggtaaacaagaacaagcctgctctggagcaggatgtctgtaaaattgactcatcagggatagtagtaaagaggttccaagaggatgaataccaagattctacatttgaagaaaaatatgcatgtgagggcatgaaggaaaactctcctagggagattgctgaatcatgccttttccaggaaggaggttttgggagaataactttcatccacaaagaagcaccccctgaaattattagtcaaggatataattttgagaaaagcttgcttttgacctcaagccttgttacacgtctcagggtttctacagaagagagtctgcatcagtgggaaacaagtaatatacaaaccaatgatatttcagaccaaagtaaatgtccaactctctgcacacagaaaaaatcttggaaatgtaatgaatgtggaaaaacctttactcagagctcatcccttacccaacatcagagaactcatactggagagagaccctacacatgtgaggaatgtgggaaagcctttagtcgtagttcattccttgttcaacatcaaagaattcacactggagtgaaaccatatggatgtgagcagtgtgggaaaacatttcgatgtcgatcatttcttactcagcatcaaagaattcacactggagagaaaccttataaatgcaatgaatgtgggaattccttccgcaatcactcacatctcactgaacaccagagaattcacactggagagaaaccttataaatgcaataggtgtgggaaggcattcaatcagaatacacaccttattcatcatcagagaattcacactggtgagaagccttacatatgcagtgaatgtggctcttcttttcgaaaacactcaaatcttacgcaacatcagagaattcacactggggaaaaaccccataaatgtgacgaatgtgggaaaactttccaaacaaaggcaaacctctctcagcatcagagaattcatagtggagagaaaccctataaatgtaaagaatgtggcaaagccttttgtcagagcccatctcttattaaacaccagcgaattcatactggagaaaaaccatataagtgtaaagaatgtggcaaagcgtttactcagagcaccccactcactaaacatcagagaatacatacaggggagagaccctacaaatgcagtgaatgtggtaaagccttcattcagagcatttgccttattcggcaccagagaagtcacactggagaaaaaccctataaatgcaatgaatgtggaaagggctttaatcagaacacctgcctcactcagcatatgagaattcatactggagagaagccctataaatgtaaagaatgtgggaaagcctttgctcatagctcatctcttactgaacatcatagaactcacactggtgagaagctctataaatgtagtgagtgtgagaaaaccttccgcaagtatgcacaccttagtgaacattacagaattcacactggtgagaagccttatgagtgtattgagtgtggaaagttcttcagacatagttcagtccttttcagacatcagaaacttcacagtggtgactaatgctgccatttaggttatgacagtttctctagcgaggatgactacgaatctgactgggagtagaggggcaggtagagttcctggagggaaggatgaaggagccttggctactgtactctgagaggaatgtttccagaaatggaggtgggagcttagggaatgcagagcctacttgaggtgggcatctgggaatacagggtagaaagaaattcctgcttttcagataaagcctacacattgccactgtctccccatgtgactcttacagcttgaggaggcatttgttagcacttctgttcactttactacatcctgccccacattctgacttgtcacccattttcgttggctggcaggttgagatgtttttcttaaacactgcctgtcagtgtgaagtggcacagctctgatgtagtgctaagtctagcctccagatttgaggcagccctgaccatgctaccatgggggaggctcccaacctgtggaagtggtcctgtgaaaaggagacagaaacaagtaagagccaaaaaaaaaaaaaaaaaaaatccatatccattcattaaaaaaatgagatataaagcaacaactgggctgacctctatagatctgccagtaaagaaggctttctttcattatcagggtgaaggtctttcctgattcttccaagctttgaggtgactcagagctaagaatgaaataggagaccaagttagaattcatgatactggtttatggggaggcagtcatacctgttcagagaaccaggaagactcaatatctatctcagaggaaatatggttacccaggaaagaaatggtctgctagagtgataagactcagaacaggaagcctgcatgtgactgagcaagtcacctacataaccctgcctgtactaaggtgtacacctgtctattgtaagtttgcctaggctgttggtgtacagagaccagaggagagagacacactaggactaacaatgtcctaacaaaatggtacttagtttgttggtctttaggagaaagcattagtaatgaaagaagaaagaattttcacttggttggacattggggctcttaagaaagttgacatttgtcgtggaatgactttggaaagacttctaaaagaatctttttcaaatccctgaaaatcaggatagcacattttgctactgactgtgacagtgttttattcttttgagagaaatgacatagttttccctttatttcccaaattcctttcatgttcttaactgctacccagaaattgagcttcagaagattgaggatagcctttgattggtatttaaaataatttctaagctgtgaagcttatagcatttttaaagtatggctattaaaaacactaagttgattctgg

SEQ ID NO: 3192 - DNA, 2875 bp, Homo sapiens
cattgtctctcgctgacgccagagatccagctatcgtcttcactgctctgtgccgtcagctcctagaggcccagcctctgtggccctgtgacctgcaggtattaggagggtcacagctaggacgccgggaccccctggaagcctagaaatgggaccattgcaatttagagatgtggccatagaattctctctggaggagtggcattgcctggacgctgcacagcggaatctatatagggatgtgatgttagagaactacagaaacctgatcttccttggtattgttgtctctaaaccaaacctgatcacctgtctggagcaaggaaaaaaacctttaactatgaagaggcatgagatgattgccaaacccccagttatgtattctcattttgcccaagacctttggtcagagcagagcataaaagattctttccaaaaagtgatactaagaagatatgaaaaatgtagacatgacaatttacagttaaaaaaaggctgtgaaagtgtagatgagtgtccagtgcacaaaagaggttataatggacttaaacaatgtttggcaactacccagagaaaaatatttcaatgtgatgaatatgtgaaattcttgcataaattttcaaattcaaacaaacataagataagagatactggaaaaaaatcttttaaatgtatagaatatgggaaaacttttaaccagtcttcaacccgtactacatataagaaaattgatgctggagagaaacgctataaatgtgaagaatgtggtaaagcctataagcagtcctcacaccttactacacataagaaaattcatactggagagaaaccctacaaatgtgaagaatgtggcaaagcctataagcagtcctgtaaccttactacacataagataattcatactggagagaaaccctacagatgtagagaatgtggcaaagcttttaaccaccctgcaacccttttttcacataagaaaattcatactggagagaaaccatacaagtgtgataaatgtggcaaagcctttatttcatcctcaacccttactaaacatgagataattcatactggagagaaaccctacaaatgtgaggaatgtggcaaagcttttaaccgttcctcaaaccttactaaacataagagaattcatactggagatgtaccctacaaatgtgacgaatgtggcaaaacctttacctggtactcaagcctctctaaacataagagagctcatactggagagaaaccctacaagtgtgaagaatgtggcaaagcctttactgcattctcaactctaactgaacataagataattcatactggagagaaaccgtacaaatgtgaagaatgtggcaaagcttttaactggtcctcagcccttaataaacataagaaaattcatattagacagaaaccctgcatagtgaagaatgtggaaaatcttttaaatgttcctcaacccttaataagcataagataattcatactggagagaaaccgtatgaatgtgatgaatgtgggaaagcctttaactagccctggactctgactaaatatgagaatttatatggaacataaaccctacaaatataaagaatgtgacaaagctttttaaggaagttctcaacccttattacacataatttatactggacagaaaccctacaagtgtgaagaatatggcaaagcctataacaacctgtcaactctttttgttttttgagatggagtttcactcttgtcacccaggctggagtgcaatggcacgatctcagctcactgcaacttctgcctcctggtatcaagccattctcctgcctcagcctcccgagtagctgggattactggtgcccaccaccatgcccagctaatttttgtatttttagtagagatggggtttcatcatgtttgccagactggtctccaactcctgacctcagatggtccacccacctcggcatcctaaagtgctgagatgacaggcatgagccacgacgcccagccacaagttctcaattcttaagagacatggcgataattcatgctgaagaggaactctacaaacctgaaagatgcaacagtgcttttaccaccacctccaacttttgtatacataaaaataaattatactaatgtgaaaccctggaaatgtatgaaatgagacaaagcgtttatatggttgccacacttgattgtagatggagtctcggtctttcacccaggctggagtgctgtggcacgatctcggctcactgcaacctccacctcccaggttcacaccattctcctgcctcagcttcctgagtagctgggactacaggcacccgccaccatgcccggctaatttttttgtatttttagtagagatggggtttcactgtgttagccgggatggtcaatctcctgaccttgtgatccgcccacctcggcctcccaaagtgctgggattacaggcgtgagccaccgcacctggccattatgccactaactttaacctatcccaccttaatcaagggtgtacttaaaagatggtaacaatatactgtttggtacgtagtggaataacatctctacttgtcactttgccagtggctttaaactgcaaatgagttgaattgttcccatagcttaaattttttttcttattgaaatctattactagtatttgtgggtatacagtatgtgtatatctttatgccttatatggcatattttgattcaggcctacaatatgtagtaattacattagggtaaagtatccatcacctctagcatttatcctttgaattacagtgtaattatacatttttaattattttaaaatgtacaattaaattgttactgactacaggtttatttttatggtcataat

SEQ ID NO: 3193 - DNA, 3220 bp, Homo sapiens
cattgtctctcgctgacgccagagatccagctatcgtcttcactgctctgtgccgtcagctcctagaggcccagcctctgtggccctgtgacctgcaggtattaggagggtcacagctaggacgccgggaccccctggaagcctagaaatgggaccattgcaatttagagatgtggccatagaattctctctggaggagtggcattgcctggacgctgcacagcggaatctatatagggatgtgatgttagagaactacagaaacctgatcttccttgttatgtattctcattttgcccaagacctttggtcagagcagagcataaaagattctttccaaaaagtgatactaagaagatatgaaaaatgtagacatgacaatttacagttaaaaaaaggctgtgaaagtgtagatgagtgtccagtgcacaaaagaggttataatggacttaaacaatgtttggcaactacccagagaaaaatatttcaatgtgatgaatatgtgaaattcttgcataaattttcaaattcaaacaaacataagataagagatactggaaaaaaatcttttaaatgtatagaatatgggaaaacttttaaccagtcttcaacccgtactacatataagaaaattgatgctggagagaaacgctataaatgtgaagaatgtggtaaagcctataagcagtcctcacaccttactacacataagaaaattcatactggagagaaaccctacaaatgtgaagaatgtggcaaagcctataagcagtcctgtaaccttactacacataagataattcatactggagagaaaccctacagatgtagagaatgtggcaaagcttttaaccaccctgcaacccttttttcacataagaaaattcatactggagagaaaccatacaagtgtgataaatgtggcaaagcctttatttcatcctcaacccttactaaacatgagataattcatactggagagaaaccctacaaatgtgaggaatgtggcaaagcttttaaccgttcctcaaaccttactaaacataagagaattcatactggagatgtaccctacaaatgtgacgaatgtggcaaaacctttacctggtactcaagcctctctaaacataagagagctcatactggagagaaaccctacaagtgtgaagaatgtggcaaagcctttactgcattctcaactctaactgaacataagataattcatactggagagaaaccgtacaaatgtgaagaatgtggcaaagcttttaactggtcctcagcccttaataaacataagaaaattcatattagacagaaaccctgcatagtgaagaatgtggaaaatcttttaaatgttcctcaacccttaataagcataagataattcatactggagagaaaccgtatgaatgtgatgaatgtgggaaagcctttaactagccctggactctgactaaatatgagaatttatatggaacataaaccctacaaatataaagaatgtgacaaagctttttaaggaagttctcaacccttattacacataatttatactggacagaaaccctacaagtgtgaagaatatggcaaagcctataacaacctgtcaactctttttgttttttgagatggagtttcactcttgtcacccaggctggagtgcaatggcacgatctcagctcactgcaacttctgcctcctggtatcaagccattctcctgcctcagcctcccgagtagctgggattactggtgcccaccaccatgcccagctaatttttgtatttttagtagagatggggtttcatcatgtttgccagactggtctccaactcctgacctcagatggtccacccacctcggcatcctaaagtgctgagatgacaggcatgagccacgacgcccagccacaagttctcaattcttaagagacatggcgataattcatgctgaagaggaactctacaaacctgaaagatgcaacagtgcttttaccaccacctccaacttttgtatacataaaaataaattatactaatgtgaaaccctggaaatgtatgaaatgagacaaagcgtttatatggttgccacacttgattgtaggtaagagaattaatgctgccaaaactcctacaagtgtgaagaatgtggcaaaacttttgagtgcttacaccttatttcacaggaaagcttttatccttgagaaaaatcgtacagatataaagaatatggaaacgccattaacgcccactcacatctcaacagaaggttcatagttaataaaagcaataaaagtgcaattactgtcaaaaaatctttcagaaaatataagcctttaaagaagaatatttattctgaaatcagctattacaaatataagggggggttgtagtacctttacttgtatcacagatcttgttgcacacattgtgtactagaggaaaacctgaagcagttgctccagctttattcaacaacatggaatttatattggagaagagtcctgcaaatataatgaatttggaaagactttttttttcaaaatctatagcttagaaaacatcagagagtttatactaaagtatatttttgcagatgtaaatatgaaaaaaatatttaattcaaaattgattttacgtaaatatgagaatttacactagaataaggcactgacacttcagacattacactaaatcagagtattgagtataaaaatgaatccacaactaaagctgtttttgtatataactttaaaagggagattttctgaagcattgtaatttcattgaaagtgtacttgtttcttgaaaaaaatttttgaacagtgaataatgatgtaatacaactttcaaatttctttacgctgttattttattcctattgtggtcacatgtgaaagcatgtgatcaattgttgctgcatcagggatattacagattcttttttattgggtattatgaccttttctataaaagaataaggacattaaaatgtaagatgcatgataaaaatgtaagtggagaggctctttgtagttaacttatattaagtaatgtataaggtgggggttctcatttgtataatcctagcctatgacttaatgttgatgttttgctttgtcttttggatggcctaacctacattaacatgttggcagaccattttaaaactttttttttcaaaaattataatgaattactttattaataaagattttt

SEQ ID NO: 3194 - DNA, 3316 bp, Homo sapiens
cattgtctctcgctgacgccagagatccagctatcgtcttcactgctctgtgccgtcagctcctagaggcccagcctctgtggccctgtgacctgcaggtattaggagggtcacagctaggacgccgggaccccctggaagcctagaaatgggaccattgcaatttagagatgtggccatagaattctctctggaggagtggcattgcctggacgctgcacagcggaatctatatagggatgtgatgttagagaactacagaaacctgatcttccttggtattgttgtctctaaaccaaacctgatcacctgtctggagcaaggaaaaaaacctttaactatgaagaggcatgagatgattgccaaacccccagttatgtattctcattttgcccaagacctttggtcagagcagagcataaaagattctttccaaaaagtgatactaagaagatatgaaaaatgtagacatgacaatttacagttaaaaaaaggctgtgaaagtgtagatgagtgtccagtgcacaaaagaggttataatggacttaaacaatgtttggcaactacccagagaaaaatatttcaatgtgatgaatatgtgaaattcttgcataaattttcaaattcaaacaaacataagataagagatactggaaaaaaatcttttaaatgtatagaatatgggaaaacttttaaccagtcttcaacccgtactacatataagaaaattgatgctggagagaaacgctataaatgtgaagaatgtggtaaagcctataagcagtcctcacaccttactacacataagaaaattcatactggagagaaaccctacaaatgtgaagaatgtggcaaagcctataagcagtcctgtaaccttactacacataagataattcatactggagagaaaccctacagatgtagagaatgtggcaaagcttttaaccaccctgcaacccttttttcacataagaaaattcatactggagagaaaccatacaagtgtgataaatgtggcaaagcctttatttcatcctcaacccttactaaacatgagataattcatactggagagaaaccctacaaatgtgaggaatgtggcaaagcttttaaccgttcctcaaaccttactaaacataagagaattcatactggagatgtaccctacaaatgtgacgaatgtggcaaaacctttacctggtactcaagcctctctaaacataagagagctcatactggagagaaaccctacaagtgtgaagaatgtggcaaagcctttactgcattctcaactctaactgaacataagataattcatactggagagaaaccgtacaaatgtgaagaatgtggcaaagcttttaactggtcctcagcccttaataaacataagaaaattcatattagacagaaaccctgcatagtgaagaatgtggaaaatcttttaaatgttcctcaacccttaataagcataagataattcatactggagagaaaccgtatgaatgtgatgaatgtgggaaagcctttaactagccctggactctgactaaatatgagaatttatatggaacataaaccctacaaatataaagaatgtgacaaagctttttaaggaagttctcaacccttattacacataatttatactggacagaaaccctacaagtgtgaagaatatggcaaagcctataacaacctgtcaactctttttgttttttgagatggagtttcactcttgtcacccaggctggagtgcaatggcacgatctcagctcactgcaacttctgcctcctggtatcaagccattctcctgcctcagcctcccgagtagctgggattactggtgcccaccaccatgcccagctaatttttgtatttttagtagagatggggtttcatcatgtttgccagactggtctccaactcctgacctcagatggtccacccacctcggcatcctaaagtgctgagatgacaggcatgagccacgacgcccagccacaagttctcaattcttaagagacatggcgataattcatgctgaagaggaactctacaaacctgaaagatgcaacagtgcttttaccaccacctccaacttttgtatacataaaaataaattatactaatgtgaaaccctggaaatgtatgaaatgagacaaagcgtttatatggttgccacacttgattgtaggtaagagaattaatgctgccaaaactcctacaagtgtgaagaatgtggcaaaacttttgagtgcttacaccttatttcacaggaaagcttttatccttgagaaaaatcgtacagatataaagaatatggaaacgccattaacgcccactcacatctcaacagaaggttcatagttaataaaagcaataaaagtgcaattactgtcaaaaaatctttcagaaaatataagcctttaaagaagaatatttattctgaaatcagctattacaaatataagggggggttgtagtacctttacttgtatcacagatcttgttgcacacattgtgtactagaggaaaacctgaagcagttgctccagctttattcaacaacatggaatttatattggagaagagtcctgcaaatataatgaatttggaaagactttttttttcaaaatctatagcttagaaaacatcagagagtttatactaaagtatatttttgcagatgtaaatatgaaaaaaatatttaattcaaaattgattttacgtaaatatgagaatttacactagaataaggcactgacacttcagacattacactaaatcagagtattgagtataaaaatgaatccacaactaaagctgtttttgtatataactttaaaagggagattttctgaagcattgtaatttcattgaaagtgtacttgtttcttgaaaaaaatttttgaacagtgaataatgatgtaatacaactttcaaatttctttacgctgttattttattcctattgtggtcacatgtgaaagcatgtgatcaattgttgctgcatcagggatattacagattcttttttattgggtattatgaccttttctataaaagaataaggacattaaaatgtaagatgcatgataaaaatgtaagtggagaggctctttgtagttaacttatattaagtaatgtataaggtgggggttctcatttgtataatcctagcctatgacttaatgttgatgttttgctttgtcttttggatggcctaacctacattaacatgttggcagaccattttaaaactttttttttcaaaaattataatgaattactttattaataaagattttt

SEQ ID NO: 3195 - DNA, 1007 bp, Homo sapiens
gctatcgtcttcactgctctgtgccgtcagctcctagaggcccagcctctgtggccctgtgacctgcaggtattaggagggtcacagctaggacgccgggaccccctggaagcctagaaatgggaccattgcaatttagagatgtggccatagaattctctctggaggagtggcattgcctggacgctgcacagcggaatctatatagggatgtgatgttagagaactacagaaacctgatcttccttggtattgttgtctctaaaccaaacctgatcacctgtctggagcaaggaaaaaaacctttaactatgaagaggcatgagatgattgccaaacccccaggtggtctataaagaggaatgttttatgagctattgagaaggctatgtatcctgatgatgttgaggagtgttctctataccttcattagaaataattgttttttactgccttctagtcctctgttcccttactaatatactgtcttgttttattattattacagaaagtggggtattgaaatatcctactataattatattgctctattcaactttgttagtatttgctttatatatttgaaaccccaatttgagacacacacacgcacaaatacacacatggataaacaaatttgtcataggtttccatgaattaatctatatattgtttaatgtccttcttttttgaagttttaacttaaagtacattttataaaatatgacagcttttgactttaacaatgtagcttgtgtaatattattttgacctcttctgctctcattttgttagtatttacatgaaatttctacttggtcttgccactttcagtcttttcttatcattagatctcagctgactcttgtaaaaaggcaagttgagtcttgatttttaaaattttttaatgagcctttttagaagtatgtctcttgattggaaagataattatatttaaatagttttctgaaagagaaaaacttactgttaataaaataattgttttg

SEQ ID NO: 3196 - DNA, 7623 bp, Homo sapiens
tcacgtgatccgtccccagcgccgccattttggagctccggatgaggagggggaaaccgggggaaaagagggaaaagagccgggagagaggtgggcaaggacgagggcgagggcacggccgggtcctggctggccaaacgaggctcgcggaagcagcagccgccgcctgaccgcagatatggaagaaagtagcagtgttgccatgttggtgccagatattggggaacaggaagctatactgactgctgaaagtatcatcagtccttcattggaaattgatgaacaaagaaaaactaaaccagatccattaatccatgttatccagaagttaagcaagatagtggaaaatgaaaagtcacaaaaatgtcttttaattgggaagaaacgcccacgttcaagtgctgcaacacactctcttgaaacccaagaactttgtgagattccggctaaagtaatccagtcacctgctgctgatactagaagggctgagatgtcacaaacaaattttacccctgacactcttgcccagaatgaagggaaggctatgtcttatcagtgtagcctttgtaagtttctatcatcatccttttccgtgttaaaagatcatattaagcaacatggtcagcaaaatgaagtgatactgatgtgctcagagtgccatattacatctagaagccaggaggaacttgaagcccacgtggtgaatgaccatgacaatgatgccaatatccacacccaatccaaagcccaacagtgcgtaagcccctccagctctttgtgtcggaaaaccacagaaagaaatgaaaccattccagatatcccagtaagtgtggacaatctacagactcatactgtccaaactgcatctgtggcagaaatgggtaggaggaaatggtatgcatacgaacagtacggcatgtatcgatgcttgttttgtagttatacttgtggccagcagagaatgttgaaaacacacgcttggaaacatgctggggaggttgattgctcctatccaatctttgaaaatgaaaatgaacccctaggcctgctggattcttcagcagctgctgcgcctggtggggtcgatgcagtcgtcattgctattggagagagtgaactgagtatccacaatgggccatcagtgcaagtgcagatttgcagctcagaacagttatcatcttcatctcctttagaacagagtgcagaaagaggagtacacctaagtcagtcagttaccctggaccccaatgaggaagaaatgctagaagtgatttctgatgcagaggagaatctgattcctgatagcctgcttacatcagcacagaaaatcatcagcagcagccccaataaaaaagggcatgttaacgtgatagtggagcgattgccaagtgctgaagaaaccctttcacagaagcgcttcctcatgaacactgaaatggaagaagggaaggacctgagcctgacagaagctcagattgggcgcgaaggaatggatgatgtttatcgtgctgataaatgtactgttgatattgggggattgatcataggctggagcagttcagagaaaaaagacgagttaatgaataaaggcctggctactgatgagaatgccccaccaggccggagaaggacaaattctgagtctcttcgattacactcattagctgcagaagcccttgtcacaatgcctataagagctgcagagttgacaagagccaacctggggcactatggagatataaaccttttagatccagatactagtcaaaggcaagtagatagtacattggcagcgtactcaaaaatgatgtcgccacttaaaaactcttcagatggattaactagtcttaaccaaagcaactccaccttggtagcactcccagagggtaggcaggaattgtcagatgggcaggttaagacaggcatcagcatgtccttactcaccgtcattgaaaaattgagagaaaggacagaccaaaacgcttcagacgatgacattttgaaagagttgcaggacaacgcccagtgccaacccaacagcgatacaagtttgtccggaaacaatgtggtggaatacatcccgaatgctgaacgaccctaccgttgccgcctgtgtcactacacaagtggcaacaagggctacatcaagcagcacttacgagtccatcgacagagacagccttatcagtgtcctatctgcgagcacatagcggacaacagcaaagatttggagagtcacatgatccaccactgtaagacaagaatataccagtgcaagcagtgtgaagaatccttccattataagagtcaattgaggaaccatgagagagaacagcacagtcttccagataccttgtcaatagcaacttctaatgagccaagaatttccagtgatacagctgatggaaaatgtgtccaggaagggaataagtcttcagtccagaaacaatatagatgtgatgtgtgtgattatacaagtacaacatatgttggtgtcagaaaccacaggcgaatccataactctgataagccgtacagatgctctctgtgtgggtatgtgtgtagccatcctccttctttgaagtctcatatgtggaaacatgcaagtgaccaaaattacaactacgaacaagtaaacaaggctattaacgacgcgatttcacaaagtggcagagttctggggaaatcccctggaaagactcaattaaagagcagtgaagagagtgcagatcccgtcactggaagttcagaaaatgcagtgtcatcttcagaactgatgtcccagactcccagtgaagttctgggtaccaacgagaatgagaaactgagccctacaagtaatacctcatatagtttagaaaaaatctccagtctggcccctcctagcatggagtactgcgttttactcttctgctgttgtatttgtggttttgaatcaaccagcaaagaaaacctcttggatcatatgaaagagcacgagggtgaaattgtaaacatcatcctgaataaggaccacaatacagctctaaacacaaattaggtggaataatgactcgagcaggaaagcagtagaagaggattccttcaccacagtttcacctttacgctgtcagacaacttcctgccacagaagaagtcgttgatgtgatttttgaggaaatgacagatgtgactttggaaccaaacttgtaataaaaggaattccaaatggacaagcagtaatgatatttaaatattttgagtgagggggagtgggtcaaagaggaagtagaggtgtaatcctgtattaaccctctgtcaccccttcttagtgtcgagtgtatttattaataaaagcttattagagtgtagaaatgccagcaagagttaagaaagggcttttcaggaactattctaaaagtcataaaagggtcacagtcttaagcagagcttagttttcttctcacttgtcaaatgcagactgtgaggcctccagtgagaaatgggaggcagttctgggagggggttttttcagtgtcaccaacagagtcaacaaggaaacataattagagggctttgaaatgatctactgaaatacctaaattgatagaaattaatcatactcaatctaggacatgttcctttactccttaaaaaagaaaggaaagatctctaaattcaaagctagattgtaaataggcattcaagaagtattgtcttaaatttacgatgaatttcttgtgagcagaggacgaaacaggtgaattctcaccagactcaaaccagatctcaattcgtagtaatgctaaatcgtcttccgtgttctcagaggttcttttcagtgtctgtcagaacttggcatactttctccatagtacgtagaccttctaatactctgctaaatgaaaccacacttgttatctgaaagtgtgtgaaagaaacaatgtatgaaaatttacatttgatcatccggcattggaaatagtttgaactatttccaaaaatcccttaggggatgaggggtgaaatttaaaagctcctgaaaatgagtactgctgtgttgagcttttctttcctggggtatattaatttagttatatttagcagaagaggaatataaccaaatgtgactaaaatatagcagaaattcaggttgtttgtaaaaattttaataacaaatagcatttggcaagtctataggattcttcctatctggaaattctattttgttagagtgcgataggacatatggaaaaccaacacaaagtgctttagcattaaaactcaccatcaaatagatgtaatcttattaattacacattttgtattttaattatttcaaggagtgaagaaaacagggtgtttttgtttttgtagttctgattactcatttatgcattgttttgtttaagtaaattctgcctacaagtgaaaaggtcggtgcgctcttctgtgcaccatcctcacggtgctatttccgaatatctgaatattgatttctaacacctggatgaggctgtgaccgatcaacttggaacactgtaaaggttttcgaatgggatacgctgtaggcacgttttaagaagtattctgttcctaaagtccaggtatgattggattaatatttataaaattattattaggaattatttaagtggggccaggcatcttgcaacattttctgatttttttttctttctttctaatctcattttggtgatatttaaacaaacataaatgattgtaactttgcagcttttttatttaggtagctttaatttatttatgaaagttaatccatttctgatacgtggtttttaaaaatatgaaatggatttatatatactatattcctcaaatccactgtatgtggacttatattcattttctccttttttcggaattgaaacattttaatttcaaattcaaatagaacatttaaaatgatttcattattattacccatactgttgccactcatattgtaagtcagttttttcattgctggtacaatgactcagtatttctttataaaaatctgttgttctgaaaatcaacaaccttagaaggattttgtcttagaaaatttccttggctttagttttatatcatatttagaaaataataatgaaaagcatccccaaaatttcaatgatgtgaatttttaaattacctttatttctttaaactaattccattgattgttacttaaattttccacctggaatcatggatttaaaatttccccacctcatggggaaaaaactaacccagaagttcaaagcctttaaagtttcatctgattctggccttagaattgtccttaaaagctttctcctggccgataggaggaagcatatatcaaggaggttctttcccttcccattatcattttgtggcaagccttaagttaacaatgtgtctaccaagaacaattgagttttctaaaagtaataatgaagattatgcaattctaactgtagaagagatagctattaaaataatcagtagcctgggcatagtggctcacacctgtaatcccaatactttagaaggccaaggctggaggactgcttgagtccagaagtttaagaccagcctgggcaacacggggagaccctgtctctacaagaaattaaaaattagccaggcatagttggcacgtgcctgtagcaccagctacttgggaggttaaggtgggaggatcacttgagcctgggagatagaggcttgcagtgagccgtgatggcaccattgcactccaaccggggtgacagatgaggtcctctgtttacctccccccccaaaaaaaaaattcagtaggaattccttcatagaataacatgttatttattggtattgacttcttattagacagagctcatagtatttgttttctgctccgaacacttaaaaaatactaagacgtgatagtgaaaatagctttgaaaagaaactacatatggcaaaggtggggaggggggaagatgatgcattctgatcattataaagaatacttttcagggctctatcattttctccctttctctaatcatccagaatatggcgggtgtcccagtgttcaacagtatcatgctaatattccatttgatcggtagtccaagttctttggccagatagtgcaatgttgtgacaccgaccgaagcctttgttctggatctttcttcctattgaaggtggctgctggtggcttcataattttctgttttttttctcacaaagtaaatggtgggcatccatgtttacattgcaccttcccgtgctgtaattggcttgacaaagacaagcaggcttctctgttgagacttattgtgtttttagttttcatagacacttatttaatctttttaaattgtacagcaaggtgctctaagtaatattcgataaaatatatttaatagaaatttgcgtttgatattcatgaacatgaatacatgtatttttttaagaaataagtattgtgtaacactatggcattgcttctatagccaaagtataaaaatttctggaatactgacatgtaaagactacagttaattctgacactgtatcttattaaaataggatgatttgcattttgtaaaattatcctgcacatcaagctgcatgccttaaagcggaaactctaggactgtgttcatgggagagcagttcatctgttcagaacagtgaggcaaggtctgtagtgcttctttaactacctttggaaatactgtacaatgttagaataatttattttgctttacaggagtttgtcatgtattgactttaatattgtattttggtaataaattttttgttaaaaaaaacttggctccaagttctattaaccacaggttgtgttcattcttttcctggaaatgatgactttattgcttagaaagttgtaaataattaaaagcttcccaagagttaaatgaaggttatgatgactcttgataacttgttaatctgttgctgactagcattagactgttacacgaagataaactgaataagcatttagctttttaaatcattttaaaaattaagtctaattttgaagcttttttccttgctacccagttcagtttctcttccaaatgtgacacgcttatatgctttcaattctgatatagtcaaagtgctaaagactagttctgctattgacgaaggaattagcattccttagtgaaggccaaaaactacagtgatatgttcacaccttgatcactctgtcgtctatacagacagctattgacatatttgttgcattgacgaagctaacatcatctgactgtatcgtgggtctggttatccatttgtgccctagaatcctgggtcacctcagttgaaagtgaccaaggccaaatatttcgtcccatgcttcccagggacaacataatcatatcccctgtctttgaaaaacccaatctgaaactgtgtcactaacctccaaattaaagaatccgagcatggaagctctagaacgtatggtccagtgtggcagccactataatatctaagtgtaaaatacatagcagttgcaaagacttagtacaaaaagaatggaaatgtattaacagttttttatattgattacatgttgaaatgatattttggtttaaataaaatattaaaatt

SEQ ID NO: 3197 - DNA, 7717 bp, Homo sapiens
tcacgtgatccgtccccagcgccgccattttggagctccggatgaggagggggaaaccgggggaaaagagggaaaagagccgggagagaggtgggcaaggacgagggcgagggcacggccgggtcctggctggccaaacgaggctcgcggaagcagcagccgccgcctgaccgcagctggattttgaagattgatccaagggactgtattaatttcaggaattgatttgaaagacactggctctgccacttaacagccatgtaaccttggatatggaagaaagtagcagtgttgccatgttggtgccagatattggggaacaggaagctatactgactgctgaaagtatcatcagtccttcattggaaattgatgaacaaagaaaaactaaaccagatccattaatccatgttatccagaagttaagcaagatagtggaaaatgaaaagtcacaaaaatgtcttttaattgggaagaaacgcccacgttcaagtgctgcaacacactctcttgaaacccaagaactttgtgagattccggctaaagtaatccagtcacctgctgctgatactagaagggctgagatgtcacaaacaaattttacccctgacactcttgcccagaatgaagggaaggctatgtcttatcagtgtagcctttgtaagtttctatcatcatccttttccgtgttaaaagatcatattaagcaacatggtcagcaaaatgaagtgatactgatgtgctcagagtgccatattacatctagaagccaggaggaacttgaagcccacgtggtgaatgaccatgacaatgatgccaatatccacacccaatccaaagcccaacagtgcgtaagcccctccagctctttgtgtcggaaaaccacagaaagaaatgaaaccattccagatatcccagtaagtgtggacaatctacagactcatactgtccaaactgcatctgtggcagaaatgggtaggaggaaatggtatgcatacgaacagtacggcatgtatcgatgcttgttttgtagttatacttgtggccagcagagaatgttgaaaacacacgcttggaaacatgctggggaggttgattgctcctatccaatctttgaaaatgaaaatgaacccctaggcctgctggattcttcagcagctgctgcgcctggtggggtcgatgcagtcgtcattgctattggagagagtgaactgagtatccacaatgggccatcagtgcaagtgcagatttgcagctcagaacagttatcatcttcatctcctttagaacagagtgcagaaagaggagtacacctaagtcagtcagttaccctggaccccaatgaggaagaaatgctagaagtgatttctgatgcagaggagaatctgattcctgatagcctgcttacatcagcacagaaaatcatcagcagcagccccaataaaaaagggcatgttaacgtgatagtggagcgattgccaagtgctgaagaaaccctttcacagaagcgcttcctcatgaacactgaaatggaagaagggaaggacctgagcctgacagaagctcagattgggcgcgaaggaatggatgatgtttatcgtgctgataaatgtactgttgatattgggggattgatcataggctggagcagttcagagaaaaaagacgagttaatgaataaaggcctggctactgatgagaatgccccaccaggccggagaaggacaaattctgagtctcttcgattacactcattagctgcagaagcccttgtcacaatgcctataagagctgcagagttgacaagagccaacctggggcactatggagatataaaccttttagatccagatactagtcaaaggcaagtagatagtacattggcagcgtactcaaaaatgatgtcgccacttaaaaactcttcagatggattaactagtcttaaccaaagcaactccaccttggtagcactcccagagggtaggcaggaattgtcagatgggcaggttaagacaggcatcagcatgtccttactcaccgtcattgaaaaattgagagaaaggacagaccaaaacgcttcagacgatgacattttgaaagagttgcaggacaacgcccagtgccaacccaacagcgatacaagtttgtccggaaacaatgtggtggaatacatcccgaatgctgaacgaccctaccgttgccgcctgtgtcactacacaagtggcaacaagggctacatcaagcagcacttacgagtccatcgacagagacagccttatcagtgtcctatctgcgagcacatagcggacaacagcaaagatttggagagtcacatgatccaccactgtaagacaagaatataccagtgcaagcagtgtgaagaatccttccattataagagtcaattgaggaaccatgagagagaacagcacagtcttccagataccttgtcaatagcaacttctaatgagccaagaatttccagtgatacagctgatggaaaatgtgtccaggaagggaataagtcttcagtccagaaacaatatagatgtgatgtgtgtgattatacaagtacaacatatgttggtgtcagaaaccacaggcgaatccataactctgataagccgtacagatgctctctgtgtgggtatgtgtgtagccatcctccttctttgaagtctcatatgtggaaacatgcaagtgaccaaaattacaactacgaacaagtaaacaaggctattaacgacgcgatttcacaaagtggcagagttctggggaaatcccctggaaagactcaattaaagagcagtgaagagagtgcagatcccgtcactggaagttcagaaaatgcagtgtcatcttcagaactgatgtcccagactcccagtgaagttctgggtaccaacgagaatgagaaactgagccctacaagtaatacctcatatagtttagaaaaaatctccagtctggcccctcctagcatggagtactgcgttttactcttctgctgttgtatttgtggttttgaatcaaccagcaaagaaaacctcttggatcatatgaaagagcacgagggtgaaattgtaaacatcatcctgaataaggaccacaatacagctctaaacacaaattaggtggaataatgactcgagcaggaaagcagtagaagaggattccttcaccacagtttcacctttacgctgtcagacaacttcctgccacagaagaagtcgttgatgtgatttttgaggaaatgacagatgtgactttggaaccaaacttgtaataaaaggaattccaaatggacaagcagtaatgatatttaaatattttgagtgagggggagtgggtcaaagaggaagtagaggtgtaatcctgtattaaccctctgtcaccccttcttagtgtcgagtgtatttattaataaaagcttattagagtgtagaaatgccagcaagagttaagaaagggcttttcaggaactattctaaaagtcataaaagggtcacagtcttaagcagagcttagttttcttctcacttgtcaaatgcagactgtgaggcctccagtgagaaatgggaggcagttctgggagggggttttttcagtgtcaccaacagagtcaacaaggaaacataattagagggctttgaaatgatctactgaaatacctaaattgatagaaattaatcatactcaatctaggacatgttcctttactccttaaaaaagaaaggaaagatctctaaattcaaagctagattgtaaataggcattcaagaagtattgtcttaaatttacgatgaatttcttgtgagcagaggacgaaacaggtgaattctcaccagactcaaaccagatctcaattcgtagtaatgctaaatcgtcttccgtgttctcagaggttcttttcagtgtctgtcagaacttggcatactttctccatagtacgtagaccttctaatactctgctaaatgaaaccacacttgttatctgaaagtgtgtgaaagaaacaatgtatgaaaatttacatttgatcatccggcattggaaatagtttgaactatttccaaaaatcccttaggggatgaggggtgaaatttaaaagctcctgaaaatgagtactgctgtgttgagcttttctttcctggggtatattaatttagttatatttagcagaagaggaatataaccaaatgtgactaaaatatagcagaaattcaggttgtttgtaaaaattttaataacaaatagcatttggcaagtctataggattcttcctatctggaaattctattttgttagagtgcgataggacatatggaaaaccaacacaaagtgctttagcattaaaactcaccatcaaatagatgtaatcttattaattacacattttgtattttaattatttcaaggagtgaagaaaacagggtgtttttgtttttgtagttctgattactcatttatgcattgttttgtttaagtaaattctgcctacaagtgaaaaggtcggtgcgctcttctgtgcaccatcctcacggtgctatttccgaatatctgaatattgatttctaacacctggatgaggctgtgaccgatcaacttggaacactgtaaaggttttcgaatgggatacgctgtaggcacgttttaagaagtattctgttcctaaagtccaggtatgattggattaatatttataaaattattattaggaattatttaagtggggccaggcatcttgcaacattttctgatttttttttctttctttctaatctcattttggtgatatttaaacaaacataaatgattgtaactttgcagcttttttatttaggtagctttaatttatttatgaaagttaatccatttctgatacgtggtttttaaaaatatgaaatggatttatatatactatattcctcaaatccactgtatgtggacttatattcattttctccttttttcggaattgaaacattttaatttcaaattcaaatagaacatttaaaatgatttcattattattacccatactgttgccactcatattgtaagtcagttttttcattgctggtacaatgactcagtatttctttataaaaatctgttgttctgaaaatcaacaaccttagaaggattttgtcttagaaaatttccttggctttagttttatatcatatttagaaaataataatgaaaagcatccccaaaatttcaatgatgtgaatttttaaattacctttatttctttaaactaattccattgattgttacttaaattttccacctggaatcatggatttaaaatttccccacctcatggggaaaaaactaacccagaagttcaaagcctttaaagtttcatctgattctggccttagaattgtccttaaaagctttctcctggccgataggaggaagcatatatcaaggaggttctttcccttcccattatcattttgtggcaagccttaagttaacaatgtgtctaccaagaacaattgagttttctaaaagtaataatgaagattatgcaattctaactgtagaagagatagctattaaaataatcagtagcctgggcatagtggctcacacctgtaatcccaatactttagaaggccaaggctggaggactgcttgagtccagaagtttaagaccagcctgggcaacacggggagaccctgtctctacaagaaattaaaaattagccaggcatagttggcacgtgcctgtagcaccagctacttgggaggttaaggtgggaggatcacttgagcctgggagatagaggcttgcagtgagccgtgatggcaccattgcactccaaccggggtgacagatgaggtcctctgtttacctccccccccaaaaaaaaaattcagtaggaattccttcatagaataacatgttatttattggtattgacttcttattagacagagctcatagtatttgttttctgctccgaacacttaaaaaatactaagacgtgatagtgaaaatagctttgaaaagaaactacatatggcaaaggtggggaggggggaagatgatgcattctgatcattataaagaatacttttcagggctctatcattttctccctttctctaatcatccagaatatggcgggtgtcccagtgttcaacagtatcatgctaatattccatttgatcggtagtccaagttctttggccagatagtgcaatgttgtgacaccgaccgaagcctttgttctggatctttcttcctattgaaggtggctgctggtggcttcataattttctgttttttttctcacaaagtaaatggtgggcatccatgtttacattgcaccttcccgtgctgtaattggcttgacaaagacaagcaggcttctctgttgagacttattgtgtttttagttttcatagacacttatttaatctttttaaattgtacagcaaggtgctctaagtaatattcgataaaatatatttaatagaaatttgcgtttgatattcatgaacatgaatacatgtatttttttaagaaataagtattgtgtaacactatggcattgcttctatagccaaagtataaaaatttctggaatactgacatgtaaagactacagttaattctgacactgtatcttattaaaataggatgatttgcattttgtaaaattatcctgcacatcaagctgcatgccttaaagcggaaactctaggactgtgttcatgggagagcagttcatctgttcagaacagtgaggcaaggtctgtagtgcttctttaactacctttggaaatactgtacaatgttagaataatttattttgctttacaggagtttgtcatgtattgactttaatattgtattttggtaataaattttttgttaaaaaaaacttggctccaagttctattaaccacaggttgtgttcattcttttcctggaaatgatgactttattgcttagaaagttgtaaataattaaaagcttcccaagagttaaatgaaggttatgatgactcttgataacttgttaatctgttgctgactagcattagactgttacacgaagataaactgaataagcatttagctttttaaatcattttaaaaattaagtctaattttgaagcttttttccttgctacccagttcagtttctcttccaaatgtgacacgcttatatgctttcaattctgatatagtcaaagtgctaaagactagttctgctattgacgaaggaattagcattccttagtgaaggccaaaaactacagtgatatgttcacaccttgatcactctgtcgtctatacagacagctattgacatatttgttgcattgacgaagctaacatcatctgactgtatcgtgggtctggttatccatttgtgccctagaatcctgggtcacctcagttgaaagtgaccaaggccaaatatttcgtcccatgcttcccagggacaacataatcatatcccctgtctttgaaaaacccaatctgaaactgtgtcactaacctccaaattaaagaatccgagcatggaagctctagaacgtatggtccagtgtggcagccactataatatctaagtgtaaaatacatagcagttgcaaagacttagtacaaaaagaatggaaatgtattaacagttttttatattgattacatgttgaaatgatattttggtttaaataaaatattaaaatt

SEQ ID NO: 3198 - DNA, 5764 bp, Homo sapiens
aaagagggaaaagagccgggagagaggtgggcaaggacgagggcgagggcacggccgggtcctggctggccaaacgaggctcgcggaagcagcagccgccgcctgaccgcagctggattttgaagattgatccaagggactgtattaatttcaggaattgatttgaaagacactggctctgccacttaacagccatgtaaccttggatatggaagaaagtagcagtgttgccatgttggtgccagatattggggaacaggaagctatactgactgctgaaagtatcatcagtccttcattggaaattgatgaacaaagaaaaactaaaccagatccattaatccatgttatccagaagttaagcaagatagtggaaaatgaaaagtcacaaaaatgtcttttaattgggaagaaacgcccacgttcaagtgctgcaacacactctcttgaaacccaagaactttgtgagattccggctaaagtaatccagtcacctgctgctgatactagaagggctgagatgtcacaaacaaattttacccctgacactcttgcccagaatgaagggaaggctatgtcttatcagtgtagcctttgtaagtttctatcatcatccttttccgtgttaaaagatcatattaagcaacatggtcagcaaaatgaagtgatactgatgtgctcagagtgccatattacatctagaagccaggaggaacttgaagcccacgtggtgaatgaccatgacaatgatgccaatatccacacccaatccaaagcccaacagtgcgtaagcccctccagctctttgtgtcggaaaaccacagaaagaaatgaaaccattccagatatcccagtaagtgtggacaatctacagactcatactgtccaaactgcatctgtggcagaaatgggtaggaggaaatggtatgcatacgaacagtacggcatgtatcgatgcttgttttgtagttatacttgtggccagcagagaatgttgaaaacacacgcttggaaacatgctggggaggttgattgctcctatccaatctttgaaaatgaaaatgaacccctaggcctgctggattcttcagcagctgctgcgcctggtggggtcgatgcagtcgtcattgctattggagagagtgaactgagtatccacaatgggccatcagtgcaagtgcagatttgcagctcagaacagttatcatcttcatctcctttagaacagagtgcagaaagaggagtacacctaagtcagtcagttaccctggaccccaatgaggaagaaatgctagaagtgatttctgatgcagaggagaatctgattcctgatagcctgcttacatcagcacagaaaatcatcagcagcagccccaataaaaaagggcatgttaacgtgatagtggagcgattgccaagtgctgaagaaaccctttcacagaagcgcttcctcatgaacactgaaatggaagaagggaaggacctgagcctgacagaagctcagattgggcgcgaaggaatggatgatgtttatcgtgctgataaatgtactgttgatattgggggattgatcataggctggagcagttcagagaaaaaagacgagttaatgaataaaggcctggctactgatgagaatgccccaccaggccggagaaggacaaattctgagtctcttcgattacactcattagctgcagaagcccttgtcacaatgcctataagagctgcagagttgacaagagccaacctggggcactatggagatataaaccttttagatccagatactagtcaaaggcaagtagatagtacattggcagcgtactcaaaaatgatgtcgccacttaaaaactcttcagatggattaactagtcttaaccaaagcaactccaccttggtagcactcccagagggtaggcaggaattgtcagatgggcaggttaagacaggcatcagcatgtccttactcaccgtcattgaaaaattgagagaaaggacagaccaaaacgcttcagacgatgacattttgaaagagttgcaggacaacgcccagtgccaacccaacagcgatacaagtttgtccggaaacaatgtggtggaatacatcccgaatgctgaacgaccctaccgttgccgcctgtgtcactacacaagtggcaacaagggctacatcaagcagcacttacgagtccatcgacagagacagccttatcagtgtcctatctgcgagcacatagcggacaacagcaaagatttggagagtcacatgatccaccactgtaagacaagaatataccagtgcaagcagtgtgaagaatccttccattataagagtcaattgaggaaccatgagagagaacagcacagtcttccagataccttgtcaatagcaacttctaatgagccaagaatttccagtgatacagctgatggaaaatgtgtccaggaagggaataagtcttcagtccagaaacaatatagatgtgatgtgtgtgattatacaagtacaacatatgttggtgtcagaaaccacaggcgaatccataactctgataagccgtacaggaaagagttcagatgctctctgtgtgggtatgtgtgtagccatcctccttctttgaagtctcatatgtggaaacatgcaagtgaccaaaattacaactacgaacaagtaaacaaggctattaacgacgcgatttcacaaagtggcagagttctggggaaatcccctggaaagactcaattaaagagcagtgaagagagtgcagatcccgtcactggaagttcagaaaatgcagtgtcatcttcagaactgatgtcccagactcccagtgaagttctgggtaccaacgagaatgagaaactgagccctacaagtaatacctcatatagtttagaaaaaatctccagtctggcccctcctagcatggagtactgcgttttactcttctgctgttgtatttgtggttttgaatcaaccagcaaagaaaacctcttggatcatatgaaagagcacgagggtgaaattgtaaacatcatcctgaataaggaccacaatacagctctaaacacaaattaggtggaataatgactcgagcaggaaagcagtagaagaggattccttcaccacagtttcacctttacgctgtcagacaacttcctgccacagaagaagtcgttgatgtgatttttgaggaaatgacagatgtgactttggaaccaaacttgtaataaaaggaattccaaatggacaagcagtaatgatatttaaatattttgagtgagggggagtgggtcaaagaggaagtagaggtgtaatcctgtattaaccctctgtcaccccttcttagtgtcgagtgtatttattaataaaagcttattagagtgtagaaatgccagcaagagttaagaaagggcttttcaggaactattctaaaagtcataaaagggtcacagtcttaagcagagcttagttttcttctcacttgtcaaatgcagactgtgaggcctccagtgagaaatgggaggcagttctgggagggggttttttcagtgtcaccaacagagtcaacaaggaaacataattagagggctttgaaatgatctactgaaatacctaaattgatagaaattaatcatactcaatctaggacatgttcctttactccttaaaaaagaaaggaaagatctctaaattcaaagctagattgtaaataggcattcaagaagtattgtcttaaatttacgatgaatttcttgtgagcagaggacgaaacaggtgaattctcaccagactcaaaccagatctcaattcgtagtaatgctaaatcgtcttccgtgttctcagaggttcttttcagtgtctgtcagaacttggcatactttctccatagtacgtagaccttctaatactctgctaaatgaaaccacacttgttatctgaaagtgtgtgaaagaaacaatgtatgaaaatttacatttgatcatccggcattggaaatagtttgaactatttccaaaaatcccttaggggatgaggggtgaaatttaaaagctcctgaaaatgagtactgctgtgttgagcttttctttcctggggtatattaatttagttatatttagcagaagaggaatataaccaaatgtgactaaaatatagcagaaattcaggttgtttgtaaaaattttaataacaaatagcatttggcaagtctataggattcttcctatctggaaattctattttgttagagtgcgataggacatatggaaaaccaacacaaagtgctttagcattaaaactcaccatcaaatagatgtaatcttattaattacacattttgtattttaattatttcaaggagtgaagaaaacagggtgtttttgtttttgtagttctgattactcatttatgcattgttttgtttaagtaaattctgcctacaagtgaaaaggtcggtgcgctcttctgtgcaccatcctcacggtgctatttccgaatatctgaatattgatttctaacacctggatgaggctgtgaccgatcaacttggaacactgtaaaggttttcgaatgggatacgctgtaggcacgttttaagaagtattctgttcctaaagtccaggtatgattggattaatatttataaaattattattaggaattatttaagtggggccaggcatcttgcaacattttctgatttttttttctttctttctaatctcattttggtgatatttaaacaaacataaatgattgtaactttgcagcttttttatttaggtagctttaatttatttatgaaagttaatccatttctgatacgtggtttttaaaaatatgaaatggatttatatatactatattcctcaaatccactgtatgtggacttatattcattttctccttttttcggaattgaaacattttaatttcaaattcaaatagaacatttaaaatgatttcattattattacccatactgttgccactcatattgtaagtcagttttttcattgctggtacaatgactcagtatttctttataaaaatctgttgttctgaaaatcaacaaccttagaaggattttgtcttagaaaatttccttggctttagttttatatcatatttagaaaataataatgaaaagcatccccaaaatttcaatgatgtgaatttttaaattacctttatttctttaaactaattccattgattgttacttaaattttccacctggaatcatggatttaaaatttccccacctcatggggaaaaaactaacccagaagttcaaagcctttaaagtttcatctgattctggccttagaattgtccttaaaagctttctcctggccgataggaggaagcatatatcaaggaggttctttcccttcccattatcattttgtggcaagccttaagttaacaatgtgtctaccaagaacaattgagttttctaaaagtaataatgaagattatgcaattctaactgtagaagagatagctattaaaataatcagtagcctgggcatagtggctcacacctgtaatcccaatactttagaaggccaaggctggaggactgcttgagtccagaagtttaagaccagcctgggcaacacggggagaccctgtctctacaagaaattaaaaattagccaggcatagttggcacgtgcctgtagcaccagctacttgggaggttaaggtgggaggatcacttgagcctgggagatagaggcttgcagtgagccg

SEQ ID NO: 3199 - DNA, 5154 bp, Homo sapiens
gttcgcagctcaggaaggagggagccccaggaacaggagtcccaccgaagaactgctctctgacagaacagagacctcctcaccagggcttccaaacagatgcagaagaacccagaaaggagcaggtcttgatttgcccaaccagcggcacttcttcatccccttgcccagagagcaccagacttggtgatgtcgccacatccagaagccatcacagattgtgtgacactgaacactgtgggccaacttgcagaaggtggttatcctttacggttctccacactctttcaggagcagcagaaaatgaacatatctcaggcatcagtgtcattcaaggacgtgactatagaattcacccaggaggagtggcagcaaatggcccctgttcagaagaatctgtacagagatgtgatgctggagaactacagcaacctcgtctcagtggggtactgctgtttcaaaccagaggtgatcttcaagttggagcaaggagaggagccttggttctcagaggaggaattctcaaaccagagtcacccaaaagattacagaggtgatgacctgatcaagcagaacaagaaaatcaaagacaaacacttggagcaagcaatatgtatcaataataaaacattgactacagaggaagagaaagttttggggaaaccatttactctgcatgtagctgctgttgcttcaacaaaaatgtcctgcaaatgcaactcatgggaagtgaatttgcaaagtatttctgaatttatcattaataatagaaactattcaacaaagaaaataggttgcggtaatgtatgtgagaattcacctttcaaaattaactttgagaaaactcagactggagagaaattttatgaacataataaaaacatgaaagctctcaattataatgaaaatcttcccaagcatccaaagtttcaaactttggagcaagcttttgaatgtaataaaattggaaaagcctttaatgataaggctaactgtgttaaacataacagttctcacacaggagaaacatcctctaaagatgatgaatttaggaaaaattgtgataagaaaactctctttgaccacaggagaactggcacagggaagaaacacctgcatcttaatcaatgtgggaaatcctttgagaagtcaactgtggaggaatataataaacttaatatgggtataaaacattatgaattaaatccaagtggaaataatttcaacagaaaggcacacctcactgatcctcaaacagctgtcatagaagagaacccattggtaagtaatgacagaacacagacttgggttaaatcctctgaatatcatgaaaataagaaatcctaccagacgtcggttcacagagttcgccgaagaagtcactcaatgatgaaaccctataaatgtaatgaatgtgggaaatccttctgtcagaaaggacatctcattcaacatcagagaactcacacaggagagaaaccatttgaatgtagtgaatgtggaaaaactttctcccagaagtcacacctcagtactcatcagagaattcatacagcagaaaaaccctataaatgtaatgaatgtggaaaaacatttgtccagaagtcaaccctcaggggacatcaaagaattcacacaggagaaaaaccctatgaatgtagtgaatgtgggaaaacttttgttcagaagtccaccctcagagatcatcacagaattcacacaggggagaaatcctttcaatgcaatcaatgtggaaaaacatttggccagaagtcaaacctcagaatacatcagagaactcacactggggagaaaacttaccagtgtaatgaatgtgaaaaatccttctggcgaaaagatcatctcattcaacatcagaaaactcacacgggagagaaaccattcaaatgtaacgaatgtgggaaaacttttgcccggacatcaaccctcagagtgcatcaaagaattcacactggggagaaaccatttaaatgtaatgaatgtgggaagaaatttgtccggaaagcaatccttagtgatcatcagagaattcacacaggggagaaaccctttcagtgtaataaatgtgggaaaacttttggccagaaatcaaacctcagaatacatcaaaggactcacagtggggagaaatcttatgaatgcaatgaatatgggaaattatgtaagaagtctaccctaagcttataccagaaaattcagggagaggggaatccctattgatgtaataactagaaaatccttttgacaaaaggaataccccatttgatatcagagatacacaaaaaaccaattgagggtagtgaatgtaagaagacagtcccagaagtaaaccctcactgtgaatcagagaattcacataggaaagaaaccagatgaagatgaatgcaggaagaattgtgtccaaaatgcaaccttcagagtgtatcaaagaattcagacaggcttctgttttcagagtactatggataggcctgaatgaagtcataccctattagatagctcccacacatcacacaggctggtaatctcttcaccagcaccaatttcattttactccaggcacatagtccagatttcccaatctccttttcatccaggttggtctttgtgactggctactaagatgtggatgtccatgatgtatatcacatcccagtctgaaacataagagacttccctaataaattaccagggccctgtcacaacaaaatggatatcatttctaggacaagcttggtgccgtgctttaatgtggcatggtacaagataaagaagtctgtgcctgaatgaatacacgcagcaaaattctcctcttctgtgtctttcccagttgaacattatgtgagcaaaatttaagcttatacagtagtccccccttatctgtattttcactttacgcaatttccattaaccatggtcaactgtactttaaagttattaaatggatccagaaataaacaattcctacattttaaactgcacccgattctgagtagtgggatgaagtctcatgccctcctgctctcccatgagggttattgaatcattccttagtctagcatatccacagtgtatacactatctgccagttagtcacttacttgacattttagttatcagatcacctgtcagggtatgacagtgcttgtattcaagtaacccttgttttactaaataatggcctgaaattgcaagagcatttctggcatgttgttgtaattattccattattagtccttaatttataaattaggcacagcaagagattaaactatcataggcatgtgtatatgtaggaaaaaaatatagtatatacagggttcagtatacccgtggtttcaaacatcaacttggaattcttggagagcattccttgtagttaagcagggactactgtattctgttgagctttcacatgtttgagtctatttgtttctacacataatttagttatcttctgctaggaaggcagaaagcttctgtgtaagccaggcttaagtcaatcagagggcacaaaccttattaggaggctagagagtcaaggagaacctcaaatatgatcagagaattgtggaaaagacatcctttcaatgtaatgaaattgatagtaccacctgatacagggctttgcatgaacctaaaagtcttttggctgaatggtgagcagccactgtgcagttcaacgtaagtgtgccttaattgcacagaggtactgcccccacacctcctgacacctccatataccccagctatatctgctttaaggagttttccctggctccaaaggccattggcacccacccaagtattatgggaaacctccagagaggggagggactcagatttatatggctttattgaatccatgcccaaggcaacatcttactagttcctgtgggggtacaggacacctagatttagctaatggggtttggcaatgggaaggcaaacaaatttaataactttatgggtgaggtactttgggccagtagagtatactacagttatgtttacatctgaaagtgtagtagggattaattcccataagttatagagagaattctaattccctgtaattcgcataagtcatagaattctaatcaggaataattgtatgtaaagatacctctgaggtccaacagctctgatcattttgggcttcaagtctctctctgtgactggtgattttgtgggttgaaacttctggcaaaagggggcagcccttgggagctgggggccaggggattgacttggttccctgacaagggtaccaggtccaccccttctgaaaagcagctgttagtttactcttgggctcttttacacattggatatctcttccttgggtagagggttctgacctaaaattccactttaggagtttgtcgtcttggactcaacaactaacaaaatgaaaaggacccagcaagcctcacttgtggaatgaaaatggggcattcaggaaagcacctgtcctggccccacagtatgtcagctgtataggcaatagtagtagctgtctcttagaagggaaataatgtatcacctctttccagaacgaagcaaagttgctggcttagtagagccctcaattcatagaggttactgtaattgggcctggctcactgatgctttcgccaactgaaactactaggatcctgtgtgtgttcaaactcagtgccattaacaaacccaaagtgaagcggtcactcctctcagtggaaagagcacgaggatgttctcagctctggccaatactccatttcataaaccatgttacatttttgttaagccttggctctggatgtggcctagatatttgatattctaattggaaattacagattaaaaagcaccctttctttgtacagtgggggtaaaagtcacagctgcttagtacaaccatctgggttgctcaagtagatgcccataataagagactattttctgataagactgactggaatcaagctgccgacagctttctccatccagattgtgacggttgctacctggatccatcattttactggtatggcaaaaaatcacccatgtgacactgggtgacatggtaaaagtacatggtacttttacagtaccatgtactgtacaaaataaaggtctctttatctg

SEQ ID NO: 3200 - DNA, 675 bp, Homo sapiens
acggatatgcgcgttttcgtctgcgcatgtgcagtcaaccccactttccggcttctccctgttagtgtttgctggtgcagagggttcgcagctcaggaaggagggagccccaggaacaggagtcccaccgaagaactgctctctgacagaacagagacctcctcaccagggcttccaaacagatgcagaagaacccagaaaggagcaggtcttgatttgcccaaccagcggcacttcttcatccccttgcccagagagcaccagacttggtgatgtcgccacatccagaagccatcacagattgtgtgacactgaacactgtgggccaacttgcagaaggtggttatcctttacggttctccacactctttcaggagcagcagaaaatgaacatatctcaggcatcagtgtcattcaaggacgtgactatagaattcacccaggaggagtggcagcaaatggcccctgttcagaagaatctgtacagagatgtgatgctggagaactacagcaacctcgtctcagtggggtactgctgtttcaaaccagaggtgatcttcaagttggagcaaggagaggagccttggttctcagaggaggaattctcaaaccagagtcacccaagtgagttactgagcagtagtagacataattctgcaggagtggttagactcc

SEQ ID NO: 3201 - DNA, 5616 bp, Homo sapiens
ggtgcagagggttcgcagctcaggtgagagcgccgggcctccacgcggattgcggacctgcagggagggatgtgctagtgtccagggggcgggaacgcgacgtcccgggaactcccccaaagcaggccgtcgctccctgtgcctcggccggcccgggacctcagcctgagaagggccggtgggggcgggctccgggggcgttaggtggggctgagtcctagttggaagatgctcggtgcgggccgaggtatgggcgccagaatgcagccaggcgtcggaaaacgcggtgctggcttcaggaggggaatgcgcgtttattgtattgaccatgaacctgccacaaagcgcgtacagcccgtgggtctgcggtgagaggccgagcctaggagctagaaggacctcgtgaattttggctctgtcacttgagcgtttgaaaatgaggatattagtaaaaactgctttgtgtcgttcagaggaaggagggagccccaggaacaggagtcccaccgaagaactgctctctgacagaacagagacctcctcaccagggcttccaaacagatgcagaagaacccagaaaggagcaggtcttgatttgcccaaccagcggcacttcttcatccccttgcccagagagcaccagacttggtgatgtcgccacatccagaagccatcacagattgtgtgacactgaacactgtgggccaacttgcagaaggtggttatcctttacggttctccacactctttcaggagcagcagaaaatgaacatatctcaggcatcagtgtcattcaaggacgtgactatagaattcacccaggaggagtggcagcaaatggcccctgttcagaagaatctgtacagagatgtgatgctggagaactacagcaacctcgtctcagtggggtactgctgtttcaaaccagaggtgatcttcaagttggagcaaggagaggagccttggttctcagaggaggaattctcaaaccagagtcacccaaaagattacagaggtgatgacctgatcaagcagaacaagaaaatcaaagacaaacacttggagcaagcaatatgtatcaataataaaacattgactacagaggaagagaaagttttggggaaaccatttactctgcatgtagctgctgttgcttcaacaaaaatgtcctgcaaatgcaactcatgggaagtgaatttgcaaagtatttctgaatttatcattaataatagaaactattcaacaaagaaaataggttgcggtaatgtatgtgagaattcacctttcaaaattaactttgagaaaactcagactggagagaaattttatgaacataataaaaacatgaaagctctcaattataatgaaaatcttcccaagcatccaaagtttcaaactttggagcaagcttttgaatgtaataaaattggaaaagcctttaatgataaggctaactgtgttaaacataacagttctcacacaggagaaacatcctctaaagatgatgaatttaggaaaaattgtgataagaaaactctctttgaccacaggagaactggcacagggaagaaacacctgcatcttaatcaatgtgggaaatcctttgagaagtcaactgtggaggaatataataaacttaatatgggtataaaacattatgaattaaatccaagtggaaataatttcaacagaaaggcacacctcactgatcctcaaacagctgtcatagaagagaacccattggtaagtaatgacagaacacagacttgggttaaatcctctgaatatcatgaaaataagaaatcctaccagacgtcggttcacagagttcgccgaagaagtcactcaatgatgaaaccctataaatgtaatgaatgtgggaaatccttctgtcagaaaggacatctcattcaacatcagagaactcacacaggagagaaaccatttgaatgtagtgaatgtggaaaaactttctcccagaagtcacacctcagtactcatcagagaattcatacagcagaaaaaccctataaatgtaatgaatgtggaaaaacatttgtccagaagtcaaccctcaggggacatcaaagaattcacacaggagaaaaaccctatgaatgtagtgaatgtgggaaaacttttgttcagaagtccaccctcagagatcatcacagaattcacacaggggagaaatcctttcaatgcaatcaatgtggaaaaacatttggccagaagtcaaacctcagaatacatcagagaactcacactggggagaaaacttaccagtgtaatgaatgtgaaaaatccttctggcgaaaagatcatctcattcaacatcagaaaactcacacgggagagaaaccattcaaatgtaacgaatgtgggaaaacttttgcccggacatcaaccctcagagtgcatcaaagaattcacactggggagaaaccatttaaatgtaatgaatgtgggaagaaatttgtccggaaagcaatccttagtgatcatcagagaattcacacaggggagaaaccctttcagtgtaataaatgtgggaaaacttttggccagaaatcaaacctcagaatacatcaaaggactcacagtggggagaaatcttatgaatgcaatgaatatgggaaattatgtaagaagtctaccctaagcttataccagaaaattcagggagaggggaatccctattgatgtaataactagaaaatccttttgacaaaaggaataccccatttgatatcagagatacacaaaaaaccaattgagggtagtgaatgtaagaagacagtcccagaagtaaaccctcactgtgaatcagagaattcacataggaaagaaaccagatgaagatgaatgcaggaagaattgtgtccaaaatgcaaccttcagagtgtatcaaagaattcagacaggcttctgttttcagagtactatggataggcctgaatgaagtcataccctattagatagctcccacacatcacacaggctggtaatctcttcaccagcaccaatttcattttactccaggcacatagtccagatttcccaatctccttttcatccaggttggtctttgtgactggctactaagatgtggatgtccatgatgtatatcacatcccagtctgaaacataagagacttccctaataaattaccagggccctgtcacaacaaaatggatatcatttctaggacaagcttggtgccgtgctttaatgtggcatggtacaagataaagaagtctgtgcctgaatgaatacacgcagcaaaattctcctcttctgtgtctttcccagttgaacattatgtgagcaaaatttaagcttatacagtagtccccccttatctgtattttcactttacgcaatttccattaaccatggtcaactgtactttaaagttattaaatggatccagaaataaacaattcctacattttaaactgcacccgattctgagtagtgggatgaagtctcatgccctcctgctctcccatgagggttattgaatcattccttagtctagcatatccacagtgtatacactatctgccagttagtcacttacttgacattttagttatcagatcacctgtcagggtatgacagtgcttgtattcaagtaacccttgttttactaaataatggcctgaaattgcaagagcatttctggcatgttgttgtaattattccattattagtccttaatttataaattaggcacagcaagagattaaactatcataggcatgtgtatatgtaggaaaaaaatatagtatatacagggttcagtatacccgtggtttcaaacatcaacttggaattcttggagagcattccttgtagttaagcagggactactgtattctgttgagctttcacatgtttgagtctatttgtttctacacataatttagttatcttctgctaggaaggcagaaagcttctgtgtaagccaggcttaagtcaatcagagggcacaaaccttattaggaggctagagagtcaaggagaacctcaaatatgatcagagaattgtggaaaagacatcctttcaatgtaatgaaattgatagtaccacctgatacagggctttgcatgaacctaaaagtcttttggctgaatggtgagcagccactgtgcagttcaacgtaagtgtgccttaattgcacagaggtactgcccccacacctcctgacacctccatataccccagctatatctgctttaaggagttttccctggctccaaaggccattggcacccacccaagtattatgggaaacctccagagaggggagggactcagatttatatggctttattgaatccatgcccaaggcaacatcttactagttcctgtgggggtacaggacacctagatttagctaatggggtttggcaatgggaaggcaaacaaatttaataactttatgggtgaggtactttgggccagtagagtatactacagttatgtttacatctgaaagtgtagtagggattaattcccataagttatagagagaattctaattccctgtaattcgcataagtcatagaattctaatcaggaataattgtatgtaaagatacctctgaggtccaacagctctgatcattttgggcttcaagtctctctctgtgactggtgattttgtgggttgaaacttctggcaaaagggggcagcccttgggagctgggggccaggggattgacttggttccctgacaagggtaccaggtccaccccttctgaaaagcagctgttagtttactcttgggctcttttacacattggatatctcttccttgggtagagggttctgacctaaaattccactttaggagtttgtcgtcttggactcaacaactaacaaaatgaaaaggacccagcaagcctcacttgtggaatgaaaatggggcattcaggaaagcacctgtcctggccccacagtatgtcagctgtataggcaatagtagtagctgtctcttagaagggaaataatgtatcacctctttccagaacgaagcaaagttgctggcttagtagagccctcaattcatagaggttactgtaattgggcctggctcactgatgctttcgccaactgaaactactaggatcctgtgtgtgttcaaactcagtgccattaacaaacccaaagtgaagcggtcactcctctcagtggaaagagcacgaggatgttctcagctctggccaatactccatttcataaaccatgttacatttttgttaagccttggctctggatgtggcctagatatttgatattctaattggaaattacagattaaaaagcaccctttctttgtacagtgggggtaaaagtcacagctgcttagtacaaccatctgggttgctcaagtagatgcccataataagagactattttctgataagactgactggaatcaagctgccgacagctttctccatccagattgtgacggttgctacctggatccatcattttactggtatggcaaaaaatcacccatgtgacactgggtgacatggtaaaagtacatggtacttttacagtaccatgtactgtacaaaataaaggtctctttatctg

SEQ ID NO: 3202 - DNA, 2004 bp, Homo sapiens
gtgatgcagttgccccccgcgctgtgcgcccgcctcgctgcggggcccggggcggcggagccgctgcctgtagagcgggatcccgcggctggggccgcgccctttcgcttcgttgcgcgccccgtgcgcttcccgcgggagcaccagttcttcgaggatggggacgtgcagcgccacctctacctccaggacgtgatcatgcaggtggccgacgtgcctgagaagcccagggtgcccgcgtttgcctgccaggtggccggctgctgccaggtgttcgatgccctggacgactacgagcaccactaccacacgctgcacggaaatgtttgctccttttgcaagcgggccttcccttccggacacctgctggacgcccacatcctggagtggcacgattcgctcttccagatcctgtctgagaggcaggacatgtatcagtgcttggtagaaggctgcacagagaagttcaagaccagcagagaccggaaggatcacatggtgaggatgcacctgtaccccgcggacttccggtttgataagccaaagaaaagcagaagcccagcctcagcagaagccccaggggacagtggagagcggtcagaaggggaggccatggaaatctgctctgagcctgtggcagcctcccctgcaccggcaggtgagaggcggatctacagacataggtcagtgtctgagctctttctgaaacccgttctcaacatgtgttcggtgctgaggattctgggctgcacctgggccgcagctcttctcatactgaattcagaaaggtaacgctgggtaagaaaatcggcttccgccagagaagaaagtccagatatctcaggtcctgtgaataacttagtttctctcgcatactctgtttttgagccattgaagcgcaggaatgccaagcaccactcacttttcctcattgtctgagtgggatggaaagagtctcacttgcagttgcttcagtcacaacccaggcgtctgccttaatagcatcacctgtgccgtctgcgtttctagcgtcacctgtgccgtctgcgtttctagcgtcacctgtgccgtctgccttcctagcatgacctgtgccgtctgcctttctagcatgacctgtactgtctgcctttctagcgtcacctgtgccgtctgcctttctagttaaagttgattttaaattaatttgggaaaaacggtgaacaagtggggaaaaacatcaccaaagactccaaacaggtggaacgatgaacttaatgttccctgcaccctccttacagatgcctggactttggcctgtgaatgagccccggggggctgggacagtaggggttttcatggaatggacatggggtagcaggaagtctcagccccagagggcttggcaggagccgccctctctgcggagttcttcccagcgggtgtgcgttggtggctggcggggaccccccacaggaactaggtctcaggctgtggaaagggagctgccccagggcccaggagggccggctctgcattccgcatgttcccagagtgaaagagaatgagaaggagacacacaagtgctgttatgacctgggttgttggttggcaaatacagcatctaatagaaactttcttccatcccagaataccctctaccatctgctttggtcagggtgccgctcgaggatttaaaagcaacaagaagaaaaccaaacaatgctgatagactcagaaaaggagtggggggcagtcaccactgctgggcgtggcatccgccttgggcctttctccgaccttctggtgtggccgccctgggggccaggccctcgccatcctccccatccttgttcctcagcaaatggcattagcagctgtcatcagaagctgtgagggacccacagattttggaaacgacctggacacactattgggaaggagatgtggacggcctgtctcctcctgcagggcccaccctaagaatgtatttttaaacacatgaaataagtatttttcactgat

SEQ ID NO: 3203 - DNA, 1520 bp, Homo sapiens
ccagggactgcagcgggagacgacaggcggggcaaggcggacgggagagggcgtgcgagagggggacctgcgacccggcttcccagggctgggaggggacacccgggacgacccggaggcccgctccgccccgccccggctgagtgtcgggccgcggggcaagacgctggcctggccggtgcaggcccgaagggcttcggccccagagttcggggaccgctgcacagccagagggagcgcgcgggaagagccgcgtcccgccagccccgtcgcctcgtgggcccccccgggcctggcagtcccccaaccccctcatcacgcccgcgcccgcgttcggccaggactcaccgcagtcccggagccacagcccccgcgcagcccccgacggcggcggaagtgagcgtgacgtcacgtccggctcggctcgcggacggtggccgacaggctgcgcccgcccgcgcccggggtgatgcagttgccccccgcgctgtgcgcccgcctcgctgcggggcccggggcggcggagccgctgcctgtagagcgggatcccgcggctggggccgcgccctttcgcttcgttgcgcgccccgtgcgcttcccgcgggagcaccagttcttcgaggatggggacgtgcagcgccacctctacctccaggacgtgatcatgcaggtggccgacgtgcctgagaagcccagggtgcccgcgtttgcctgccaggtggccggctgctgccaggtgttcgatgccctggacgactacgagcaccactaccacacgctgcacggaaatgtttgctccttttgcaagcgggccttcccttccggacacctgctggacgcccacatcctggagtggcacgattcgctcttccagatcctgtctgagaggcaggacatgtatcagtgcttggtagaaggctgcacagagaagttcaagaccagcagagaccggaaggatcacatggtgaggatgcacctgtaccccgcggacttccggtttgataagccaaagaaaagcagaagcccagcctcagcagaagccccaggggacagtggagagcggtcagaaggggaggccatggaaatctgctctgagcctgtggcagcctcccctgcaccggcaggtgagaggcggatctacagacatagaataccctctaccatctgctttggtcagggtgccgctcgaggatttaaaagcaacaagaagaaaaccaaacaatgctgatagactcagaaaaggagtggggggcagtcaccactgctgggcgtggcatccgccttgggcctttctccgaccttctggtgtggccgccctgggggccaggccctcgccatcctccccatccttgttcctcagcaaatggcattagcagctgtcatcagaagctgtgagggacccacagattttggaaacgacctggacacactattgggaaggagatgtggacggcctgtctcctcctgcagggcccaccctaagaatgtatttttaaacacatgaaataagtatttttcac

SEQ ID NO: 3204 - DNA, 1044 bp, Homo sapiens
cctctacctccaggacgtgatcatgcaggtggccgacgtgcctgagaagcccagggtgcccgcgtttgcctgccaggtggccggctgctgccaggtgttcgatgccctggacgactacgagcaccactaccacacgctgcacggaaatgtttgctccttttgcaagcgggccttcccttccggacacctgctggacgcccacatcctggagtggcacgattcgctcttccagatcctgtctgagaggcaggacatgtatcagtgcttggtagaaggctgcacagagaagttcaagaccagcagagaccggaaggatcacatggtgaggatgcacctgtaccccgcggacttccggtttgataagccaaagaaaagcagaagcccagcctcagcagaagccccaggggacagtggagagcggtcagaaggggaggccatggaaatctgctctgagcctgtggcagcctcccctgcaccggcaggtgagaggcggatctacagacataggctcctcctggtcaccagcctggtggttgtgctgctgtgggaggcaggtgcagtcccagcacccaaggtccctatcaagatgcaagtcaaacactggccctcagagcaggacccagagaaggcctggggcgcccgtgtggtggagcctccggagaaggacgaccagctggtggtgctgttccctgtccagaagccgaaactcttgaccaccgaggagaagccacgaggtcagggcaggggccccatccttccaggcaccaaggcctggatggagaccgaggacaccctgggccatgtcctgagtcccgagcccgaccatgacagcctgtaccaccctccgcctgaggaggaccagggcgaggagaggccccggttgtgggtgatgccaaatcaccaggtgctcctgggaccggaggaagaccaagaccacatctaccacccccagtagggctccaggggccatcactgcccccgccctgtcccaaggcccaggctgttgggactgggaccctccctaccctgccccagctagacaaa

SEQ ID NO: 3205 - DNA, 3422 bp, Homo sapiens
cccacatccgggagaggagagcggaagtggcgttggtctggccggagcccttgggtgaaattgttaggcgtggagagggagtgatgtcttccagactcggtgctgtacccgccacttcgggacccacaacctttaagcagcagaggagcacgaggatcgtgggagctaagaatagcaggacccagtgctccataaaggataatagtttccagtacactatccctcatgatgactccttaagtggttcatcgtctgcatcttcgtgtgaaccagtgagtgattttccagcatctttccgaaaatctacctactggatgaagatgagaagaatcaagccagctgctacttctcatgtcgaagggtcaggtggagtatcagccaaggggaaaaggaaacccaggcaggaagaagatgaagactatcgagaatttcctcagaagaagcataagctttatgggaggaagcaacggcctaaaactcagcccaatcccaaatcccaggcccgtcgtattcggaaggaaccaccagtttatgcagcaggcagtttggaggagcaatggtacttagaaatcgttgataaaggcagtgtctcctgccctacctgccaggcagtggggaggaagaccatagagggtttaaagaaacacatggaaaactgcaagcaggaaatgtttacttgtcatcattgtgggaaacaacttcgttcactggcagggatgaagtatcatgtcatggcaaatcataatagtttgcccattttgaaagccggagatgaaatagatgagccaagtgagagggaaaggctccgaacagttctaaagagactgggaaagctcaggtgcatgcgtgagagttgctccagtagcttcaccagcatcatgggatatctctaccatgtcagaaaatgtggcaaaggggctgcagagctggaaaagatgaccctgaaatgtcaccactgtggaaaaccatataggtcgaaggctggacttgcatatcacctgaggtcagagcatgggcctatatccttctttccagagtcaggacagccagagtgcttaaaggagatgaacctagagtcaaagagtgggggccgagttcagagacgttctgccaagatagctgtataccacctacaggagctggcctctgctgaactggccaaggaatggcccaagaggaaggtgcttcaggacctggtacctgatgatcgaaagttaaaatatactcgtccagggctccctaccttcagccaggaagtactacataaatggaagacagatatcaagaaatatcatcgtattcagtgtcctaaccagggctgtgaggctgtctacagcagtgtatctggccttaaagctcacctgggctcttgtacattgggaaactttgtggctggaaaatacaaatgtcttctatgtcagaaagaatttgtgtcagagagtggtgtcaagtatcacatcaactccgtccatgctgaggactggttcgttgtaaacccaacaacaaccaaaagctttgaaaagctgatgaagataaagcagcggcagcaagaagaagaaaagcggaggcagcagcacaggagcagaaggtctctaagaaggcggcagcagcctggcattgagcttcccgagacagagctgagtcttagagtagggaaggatcagaggaggaataatgaggaactggtagtgtcagcctcctgtaaggaaccagagcaggagccagtgccagcacagttccagaaagtaaagcccccaaagactaatcataaacgaggaaggaaataggcagtcagtgtaaaagtgctcctaggaaagcagatgtgatgctgttgtcacggggacctgtgctgggaggactgagtgaagattctttcagctgtttgtgtaaggctgtgactttctcagctccttcctcctgtgtaaatttcactgtcttcccttcttacattttgattcccccctccccttttagtaggttttcctgctattcctcgtcaagtcctcttgtttttttatcttgcccaaagagctccctctcaaggccaactataggctcctcttgccctgtacaaaactaagaaacctctttggttgtcctttccttcctggggtatagaatgttcttggaagctccattgatttagtagctgctccatcatctagcttgtgaaaccattccaaactaattttttaaaaccataactgatttgtcattttgtatttgtgatataacaagtctagaagttagaactgttgtcattcacataataagattactctgtctccttgggaaaaaaactttatggaggctgtttgtcctctcaatatggttttaagattgaaagtaagaaaacggatttaggatgaaaactctagaactaccctatgctgtttatactgggaaatgctttgtaccaagtagcagtgactagacccacagacatgaaaagcaaccttaggagtaaagtgacccaaacattaaaatgacaggaaagagaaagtagaagcagcaataaatactgccccaactttcctggagcccgaggcctcatccatagctatgatcacttgccctctgaagcttatttttgcttctttggttttaagaattgagaaatatcacattgcccctgatgttttgacagtctcctagtgctcctggtagtgccactaagggaaaaccaaggtgcgcattccttctccctggactttaccttacttgttagtctacgccccactgtttccacccatccccttagccaacctctgtctttttgaattttctgagaatattgtcctatcctcttttatatatggagttctctcctctttatatcctgagactttgacaccagatgtagatatttatctggagctggaaagaaaaattctttttctgtacctcatgcctatctggtaatgtttaatgggttatttctctttgagggtggctttctctggaacattggttagagcagctttgttgtcgtgtttctggattctcttccccattttgcgtaaatattggtcttatatattcttgcctattttgtggcatatgccacataaaaaatgaacctgatatagacaagtactaccttttcaaattctgaaaggctattaccactttaactctttgtgctcctccaaatagctttaaaatgtgggcttttgtgaagaccactttcaaacaagggagcactgaaacctgaattggatactgccagaataggtagttttgaaacaagttaaggacatggtatatgcactctgcattttcattggcagtgtgcccttaaagccctttcagtagatgagggttgtcagggaggagaaatgaagaagctatgttaatttctggtgagtaagacctggggaatgtttggcaatgacaaaagaaataaatgactctcagaaaga

SEQ ID NO: 3206 - DNA, 3417 bp, Homo sapiens
cccacatccgggagaggagagcggaagtggcgttggtctggccggagcccttgggtgaaattgttaggcgtggagagggagtgatgtcttccagactcggtgctgtacccgccacttcgggacccacaacctttaagcagcagaggagcacgaggatcgtgggagctaagaacaggacccagtgctccataaaggataatagtttccagtacactatccctcatgatgactccttaagtggttcatcgtctgcatcttcgtgtgaaccagtgagtgattttccagcatctttccgaaaatctacctactggatgaagatgagaagaatcaagccagctgctacttctcatgtcgaagggtcaggtggagtatcagccaaggggaaaaggaaacccaggcaggaagaagatgaagactatcgagaatttcctcagaagaagcataagctttatgggaggaagcaacggcctaaaactcagcccaatcccaaatcccaggcccgtcgtattcggaaggaaccaccagtttatgcagcaggcagtttggaggagcaatggtacttagaaatcgttgataaaggcagtgtctcctgccctacctgccaggcagtggggaggaagaccatagagggtttaaagaaacacatggaaaactgcaagcaggaaatgtttacttgtcatcattgtgggaaacaacttcgttcactggcagggatgaagtatcatgtcatggcaaatcataatagtttgcccattttgaaagccggagatgaaatagatgagccaagtgagagggaaaggctccgaacagttctaaagagactgggaaagctcaggtgcatgcgtgagagttgctccagtagcttcaccagcatcatgggatatctctaccatgtcagaaaatgtggcaaaggggctgcagagctggaaaagatgaccctgaaatgtcaccactgtggaaaaccatataggtcgaaggctggacttgcatatcacctgaggtcagagcatgggcctatatccttctttccagagtcaggacagccagagtgcttaaaggagatgaacctagagtcaaagagtgggggccgagttcagagacgttctgccaagatagctgtataccacctacaggagctggcctctgctgaactggccaaggaatggcccaagaggaaggtgcttcaggacctggtacctgatgatcgaaagttaaaatatactcgtccagggctccctaccttcagccaggaagtactacataaatggaagacagatatcaagaaatatcatcgtattcagtgtcctaaccagggctgtgaggctgtctacagcagtgtatctggccttaaagctcacctgggctcttgtacattgggaaactttgtggctggaaaatacaaatgtcttctatgtcagaaagaatttgtgtcagagagtggtgtcaagtatcacatcaactccgtccatgctgaggactggttcgttgtaaacccaacaacaaccaaaagctttgaaaagctgatgaagataaagcagcggcagcaagaagaagaaaagcggaggcagcagcacaggagcagaaggtctctaagaaggcggcagcagcctggcattgagcttcccgagacagagctgagtcttagagtagggaaggatcagaggaggaataatgaggaactggtagtgtcagcctcctgtaaggaaccagagcaggagccagtgccagcacagttccagaaagtaaagcccccaaagactaatcataaacgaggaaggaaataggcagtcagtgtaaaagtgctcctaggaaagcagatgtgatgctgttgtcacggggacctgtgctgggaggactgagtgaagattctttcagctgtttgtgtaaggctgtgactttctcagctccttcctcctgtgtaaatttcactgtcttcccttcttacattttgattcccccctccccttttagtaggttttcctgctattcctcgtcaagtcctcttgtttttttatcttgcccaaagagctccctctcaaggccaactataggctcctcttgccctgtacaaaactaagaaacctctttggttgtcctttccttcctggggtatagaatgttcttggaagctccattgatttagtagctgctccatcatctagcttgtgaaaccattccaaactaattttttaaaaccataactgatttgtcattttgtatttgtgatataacaagtctagaagttagaactgttgtcattcacataataagattactctgtctccttgggaaaaaaactttatggaggctgtttgtcctctcaatatggttttaagattgaaagtaagaaaacggatttaggatgaaaactctagaactaccctatgctgtttatactgggaaatgctttgtaccaagtagcagtgactagacccacagacatgaaaagcaaccttaggagtaaagtgacccaaacattaaaatgacaggaaagagaaagtagaagcagcaataaatactgccccaactttcctggagcccgaggcctcatccatagctatgatcacttgccctctgaagcttatttttgcttctttggttttaagaattgagaaatatcacattgcccctgatgttttgacagtctcctagtgctcctggtagtgccactaagggaaaaccaaggtgcgcattccttctccctggactttaccttacttgttagtctacgccccactgtttccacccatccccttagccaacctctgtctttttgaattttctgagaatattgtcctatcctcttttatatatggagttctctcctctttatatcctgagactttgacaccagatgtagatatttatctggagctggaaagaaaaattctttttctgtacctcatgcctatctggtaatgtttaatgggttatttctctttgagggtggctttctctggaacattggttagagcagctttgttgtcgtgtttctggattctcttccccattttgcgtaaatattggtcttatatattcttgcctattttgtggcatatgccacataaaaaatgaacctgatatagacaagtactaccttttcaaattctgaaaggctattaccactttaactctttgtgctcctccaaatagctttaaaatgtgggcttttgtgaagaccactttcaaacaagggagcactgaaacctgaattggatactgccagaataggtagttttgaaacaagttaaggacatggtatatgcactctgcattttcattggcagtgtgcccttaaagccctttcagtagatgagggttgtcagggaggagaaatgaagaagctatgttaatttctggtgagtaagacctggggaatgtttggcaatgacaaaagaaataaatgactctcagaaa

SEQ ID NO: 3207 - DNA, 2062 bp, Homo sapiens
agtgatgtcttccagactcggtgctgtacccgccagcctgggacagggctttgagaatgggggaagacgaaggctctggtattgttacccgcctttgcactgctggaagataggacagcatatttttcctaaaagacttcgggacccacaacctttaagcagcagaggagcacgaggatcgtgggagctaagaatagcaggacccagtgctccataaaggataatagtttccagtacactatccctcatgatgactccttaagtggttcatcgtctgcatcttcgtgtgaaccagtgagtgattttccagcatctttccgaaaatctacctactggatgaagatgagaagaatcaagccagctgctacttctcatgtcgaagggtcaggtggagtatcagccaaggggaaaaggaaacccaggcaggaagaagatgaagactatcgagaatttcctcagaagaagcataagctttatgggaggaagcaacggcctaaaactcagcccaatcccaaatcccaggcccgtcgtattcggaaggaaccaccagtttatgcagcaggcagtttggaggagcaatggtacttagaaatcgttgataaaggcagtgtctcctgccctacctgccaggcagtggggaggaagaccatagagggtttaaagaaacacatggaaaactgcaagcaggaaatgtttacttgtcatcattgtgggaaacaacttcgttcactggcagggatgaagtatcatgtcatggcaaatcataatagtttgcccattttgaaagccggagatgaaatagatgagccaagtgagagggaaaggctccgaacagttctaaagagactgggaaagctcaggtgcatgcgtgagagttgctccagtagcttcaccagcatcatgggatatctctaccatgtcagaaaatgtggcaaaggggctgcagagctggaaaagatgaccctgaaatgtcaccactgtggaaaaccatataggtcgaaggctggacttgcatatcacctgaggtcagagcatgggcctatatccttctttccagagtcaggacagccagagtgcttaaaggagatgaacctagagtcaaagagtgggggccgagttcagagacgttctgccaagatagctgtataccacctacaggagctggcctctgctgaactggccaaggaatggcccaagaggaaggtgcttcaggacctggtacctgatgatcgaaagttaaaatatactcgtccagggctccctaccttcagccaggaagtactacataaatggaagacagatatcaagaaatatcatcgtattcagtgtcctaaccagggctgtgaggctgtctacagcagtgtatctggccttaaagctcacctgggctcttgtacattgggaaactttgtggctggaaaatacaaatgtcttctatgtcagaaagaatttgtgtcagagagtggtgtcaagtatcacatcaactccgtccatgctgaggactggttcgttgtaaacccaacaacaaccaaaagctttgaaaagctgatgaagataaagcagcggcagcaagaagaagaaaagcggaggcagcagcacaggagcagaaggtctctaagaaggcggcagcagcctggcattgagcttcccgagacagagctgagtcttagagtagggaaggatcagaggaggaataatgaggaactggtagtgtcagcctcctgtaaggaaccagagcaggagccagtgccagcacagttccagaaagtaaagcccccaaagactaatcataaacgaggaaggaaataggcagtcagtgtaaaagtgctcctaggaaagcagatgtgatgctgttgtcacggggacctgtgctgggaggactgagtgaagattctttcagctgtttgtgtaaggctgtgactttctcagctccttcctcctgtgtaaatttcactgtcttcccttcttacattttgattcccccctccccttttagtaggttttcctgctattcctcgtcaagtcctcttgtttttttatcttgcccaaagagctccctctc

SEQ ID NO: 3208 - DNA, 2178 bp, Homo sapiens
cttgggtgaaattgttaggcgtggagagggagtgatgtcttccagactcggtgctgtacccgccacttcgggacccacaacctttaagcagcagaggagcacgaggatcgtgggagctaagaacaggacccagtgctccataaaggataatagtttccagtacactatccctcatgatgactccttaagtggttcatcgtctgcatcttcgtgtgaaccagtgagtgattttccagcatctttccgaaaatctacctactggatgaagatgagaagaatcaagccagctgctacttctcatgtcgaagggtcaggtggagtatcagccaaggggaaaaggaaacccaggcaggaagaagatgaagactatcgagaatttcctcagaagaagcataagctttatggcagtttggaggagcaatggtacttagaaatcgttgataaaggcagtgtctcctgccctacctgccaggcagtggggaggaagaccatagagggtttaaagaaacacatggaaaactgcaagcaggaaatgtttacttgtcatcattgtgggaaacaacttcgttcactggcagggatgaagtatcatgtcatggcaaatcataatagtttgcccattttgaaagccggagatgaaatagatgagccaagtgagagggaaaggctccgaacagttctaaagagactgggaaagctcaggtgcatgcgtgagagttgctccagtagcttcaccagcatcatgggatatctctaccatgtcagaaaatgtggcaaaggggctgcagagctggaaaagatgaccctgaaatgtcaccactgtggaaaaccatataggtcgaaggctggacttgcatatcacctgaggtcagagcatgggcctatatccttctttccagagtcaggacagccagagtgcttaaaggagatgaacctagagtcaaagagtgggggccgagttcagagacgttctgccaagatagctgtataccacctacaggagctggcctctgctgaactggccaaggaatggcccaagaggaaggtgcttcaggacctggtacctgatgatcgaaagttaaaatatactcgtccagggctccctaccttcagccaggaagtactacataaatggaagacagatatcaagaaatatcatcgtattcagtgtcctaaccagggctgtgaggctgtctacagcagtgtatctggccttaaagctcacctgggctcttgtacattgggaaactttgtggctggaaaatacaaatgtcttctatgtcagaaagaatttgtgtcagagagtggtgtcaagtatcacatcaactccgtccatgctgaggactggttcgttgtaaacccaacaacaaccaaaagctttgaaaagctgatgaagataaagcagcggcagcaagaagaagaaaagcggaggcagcagcacaggagcagaaggtctctaagaaggcggcagcagcctggcattgagcttcccgagacagagctgagtcttagagtagggaaggatcagaggaggaataatgaggaactggtagtgtcagcctcctgtaaggaaccagagcaggagccagtgccagcacagttccagaaagtaaagcccccaaagactaatcataaacgaggaaggaaataggcagtcagtgtaaaagtgctcctaggaaagcagatgtgatgctgttgtcacggggacctgtgctgggaggactgagtgaagattctttcagctgtttgtgtaaggctgtgactttctcagctccttcctcctgtgtaaatttcactgtcttcccttcttacattttgattcccccctccccttttagtaggttttcctgctattcctcgtcaagtcctcttgtttttttatcttgcccaaagagctccctctcaaggccaactataggctcctcttgccctgtacaaaactaagaaacctctttggttgtcctttccttcctggggtatagaatgttcttggaagctccattgatttagtagctgctccatcatctagcttgtgaaaccattccaaactaattttttaaaaccataactgatttgtcattttgtatttgtgatataacaagtctagaagttagaactgttgtcattcacataataagattactctgtctccttgggaaaaaaactttatggaggctg

SEQ ID NO: 3209 - DNA, 1741 bp, Homo sapiens
gagagcggaagtggcgttggtctggccggagcccttgggtgaaattgttaggcgtggagagggagtgatgtcttccagactcggtgctgtacccgcctagcaggacccagtgctccataaaggataatagtttccagtacactatccctcatgatgactccttaagtggttcatcgtctgcatcttcgtgtgaaccagtgagtgattttccagcatctttccgaaaatctacctactggatgaagatgagaagaatcaagccagctgctacttctcatgtcgaagggtcaggtggagtatcagccaaggggaaaaggaaacccaggcaggaagaagatgaagactatcgagaatttcctcagaagaagcataagctttatgggaggaagcaacggcctaaaactcagcccaatcccaaatcccaggcccgtcgtattcggaaggaaccaccagtttatgcagcaggaaatgtttacttgtcatcattgtgggaaacaacttcgttcactggcagggatgaagtatcatgtcatggcaaatcataatagtttgcccattttgaaagccggagatgaaatagatgagccaagtgagagggaaaggctccgaacagttctaaagagactgggaaagctcaggtgcatgcgtgagagttgctccagtagcttcaccagcatcatgggatatctctaccatgtcagaaaatgtggcaaaggggctgcagagctggaaaagatgaccctgaaatgtcaccactgtggaaaaccatataggtcgaaggctggacttgcatatcacctgaggtcagagcatgggcctatatccttctttccagagtcaggacagccagagtgcttaaaggagatgaacctagagtcaaagagtgggggccgagttcagagacgttctgccaagatagctgtataccacctacaggagctggcctctgctgaactggccaaggaatggcccaagaggaaggtgcttcaggacctggtacctgatgatcgaaagttaaaatatactcgtccagggctccctaccttcagccaggaagtactacataaatggaagacagatatcaagaaatatcatcgtattcagtgtcctaaccagggctgtgaggctgtctacagcagtgtatctggccttaaagctcacctgggctcttgtacattgggaaactttgtggctggaaaatacaaatgtcttctatgtcagaaagaatttgtgtcagagagtggtgtcaagtatcacatcaactccgtccatgctgaggactggttcgttgtaaacccaacaacaaccaaaagctttgaaaagctgatgaagataaagcagcggcagcaagaagaagaaaagcggaggcagcagcacaggagcagaagaggctcacaggacacctgcatgcccaaggcactccaccgtatgtgatcaacctggatccagcagtacatgaagttccctttcctgccaatattgatattcgtgatactgtaaagtataaagaagtaatgaaacaatatggacttggacccaatggcggcatagtgacctcactcaatctctttgctaccagatttgatcaggtgatgaaatttattgagaaggcccagaacatgtccaaatatgtgttgattgacacacctggacagattgaggtattcacctggtcagcttctgggacaattatcactgaagcccttgcatcctcatttccaacagttgtcatctatgtaat

SEQ ID NO: 3210 - DNA, 5910 bp, Homo sapiens
ccccgcgcccggcccggcccgggaaggtctacttgctctgcagagatgacggatcctttctgcgttggaggccgtcggctcccggggtccagcaagagtggtcccgggaaggatggcagccgaaaggaggtccgacttccaatgctgcatgacccaccgaagatggggatgccggtggtccgtggtggacagacagtgcccggccaggcccctctctgctttgacccgggaagtccagccagtgacaagacagaagggaagaaaaaggggcggccaaaagccgagaaccaggccctccgagacattcctctctccctgatgaacgactggaaggatgagttcaaggcacactcgagggtgaagtgtccaaactcagggtgctggctggagttccccagcatctacgggctcaagtaccattaccagcggtgccaagggggtgccatctcagatcgcctggccttcccctgccccttctgcgaggccgcattcacctctaagacccagctggagaaacaccggatctggaaccacatggaccgacccctgcctgcctccaagcctgggcccatcagcaggccggtcaccatcagccggcctgttggggtcagcaagcccatcggagtgagcaaacctgtcactattggcaaacctgtgggtgtcagcaaacccattggcatcagcaagccagtctcggtcggcagacccatgccagtcaccaaggccatcccggtcactaggcccgtgccagtcaccaaacctgtcacagtcagcaggcccatgcccgtcaccaaggccatgccggtcaccaaacccatcacagtcaccaagtctgtgccggtcaccaaacccgtacctgtcaccaaacccattacggtaacaaagcttgtgacagttacgaaacccgtgccggtcaccaagccagtgacagtcagcaggcccattgtggtcagcaagccggtgacagtcagcaggcccattgctatcagcagacacacaccgccctgcaaaatggtgctgctgaccaggtcggagaacaaagcacctcgtgccacagggaggaacagtggtaagaaaagggctgcggacagcctggacacctgcccaattccacccaagcaggccaggccagagaatggggagtacggcccctcctccatgggccagagctcggccttccagctgagtgcagacaccagcagtggctccttgtcgccaggcagcaggccgtcagggggcatggaggcactgaaggctgcaggccctgcgtccccgcctgaggaggacccggagcgcacaaagcacagaaggaaacagaaaacacccaaaaagtttacaggggagcagccatccatctcagggacctttgggctcaaaggcctggtcaaagctgaggacaaggcccgagttcaccgctccaagaagcaggaggggccaggccctgaggacgcccggaagaaggtgccagctgcccccatcactgtcagcaaggaggcaccggcccctgtggcccacccagctccaggtggccctgaagagcagtggcagagggccatccatgagcgcggggaagccgtctgccccacctgcaacgtggtcacccggaagactctcgtggggcttaagaagcacatggaggtgtgtcagaagcttcaggatgcactcaagtgccagcactgccggaagcagttcaagtccaaagccggcctcaactaccacactatggccgagcacagtgccaagccctctgacgccgaggcctccgaagggggcgagcaggaggagcgcgagaggctgcgcaaggtgctgaagcagatgggacggctgcgctgcccccaggagggttgcggggctgccttctccagcctcatgggctaccagtaccaccagcggcgctgcgggaagccgccctgcgaggtggacagcccctccttcccctgcacccactgtggcaagacgtaccgatccaaggctggccacgactaccacgtgcgctcggagcacacggcccccccccctgaggagcccacagacaagtcccctgaggctgaggacccgctgggtgtggagcggaccccaagcgggcgtgtccgccgcacgtcggcccaggtggcggtgttccacctgcaggagatagcggaggacgagctggcccgcgactggaccaagcggcgcatgaaggatgaccttgtgcccgagaccgcacggctcaactacactcgaccagggctccccacgctgaacccccagctgctagaggcatggaagaatgaagtgaaggagaaaggccacgtcaactgtcccaacgactgctgtgaagccatctactccagcgtgtccggactcaaggctcatctcgccagctgcagtaagggggcccacctggcagggaagtaccgctgtctgctgtgtccgaaggagttcagttctgagagtggcgtcaaataccacatcctgaagacccacgcagagaactggttccgaacatcagcagacccacctcccaaacacaggagccaggactcattggtgcccaagaaggaaaagaagaaaaatctggcaggtggaaagaagcggggccgaaagcccaaggagcggaccccagaggagcctgtggccaagctgcccccgcgccgggacgactggcctccaggatgcagagacaagggggcccggggctccaccggccggaaggtgggagtcagcaaggcgcctgaaaagtgagcatggtgcgtggggcctggcccccatgcagccgccacaccgccctctgttcaaggcagggccagctccgggacctctgtcctccagttctccatcccccacccccgcctcttcatccgtccagtggggcagccagccactctcccttccctgaaggtggcccttcccctgttaaggctgccacagggcacacctgggttggggctccccaaggtgtgcccagcagaagtgcaatagccaggagggttgcccctcctcatgggaatgtgtctggggtcttggtgccacaggggctgcagcgcagagtaggcagatggcctttggccccccggctccgcttcctcaggccctgccgggtcccttccctggctaccccaaggctcaggcatccctggtgacctgtggttctgggctggtgagggcacctgagcaacctggcacgggcagccaccatcctggcctcacctccacccaacactggaactccagcacccccagctacctcccaggacagacccctgtctgaccactgccatgctgacctgacaggctccggcctgcccttggccacccacttggtccccttgcttctgttttctacctctccaggcctgcccactacccccacccctgctcctcctttgtcagtgcgatccctgctgtgctcaggccctgccccccaggcctgtctgtaattctcccagcttggggcaagggaggggttttgcttcttgtacctacagggcagcagaagcttgatgcccttcaacacagctgccagccctgggggtgtggggcccctggagtgtgctctcctccagtgttcagccttctggcactgcaggcctaggttggagcagcctcgtggagtagggacggactagttcgggccctggggtcttgctggggcccataggcatgtggggcaggaagctgggcagagctggcctggctctgagtggccactgggggaaaggcagccttctgtctgccaatctgggtaggcccagtggccaagctctcatgggagccccctccccacttttttttttaacctgcccccattgtttctggttgtgtggtcatttgatatgggaactgaaggccagccaggggaggggcttggccaaagtcacagcaggttgatggcagctccagagctgtctttgcccctttgtggccctgaggacggctgggtctataggtagggcaggggtcaggcagggagtccagggtgcctggaagaggtggccacagcctgtggctccctccctggggtcctgccttccaaccacggcattgcagggaggatgaggctcagagggggtaggtttggagggaggccattttccagggtgggtgggagtgggctgagggctcggccccactgaccctggacgatgagaattttgatgtttgcccgtgtgcgtgtgtctcctgggtgtagtggatgccagtcttgttgctgtgacaagtaacaaccttttttttaaattgttttttatacaaacactcgcaatccgacatttggtgctaagggtttcctggtgcagacggtgggcctgggggctgggctggaccagggcgtgggtctctggggttggggtcccttgctgctcagggaggcagtactgactgggcactgcctctgcccccagcacccaccctcccccattccccagggagaaggggccccactgggcttggcctgcagtagtagggagacaagttccaggagcactttggggactggggttgcagaacacttcctgtctctggcttcatccttgggccagaaggctccaaccctcagcagcccttgccagatgtgccagggagtgggtgtggagacccggactccccccacccacgcacacctcggcctgatgagaggatggaggctggggcagagatgggcgtgacccagcgtcagagggtcgggggaggcattccttcctgtgtcccagagcttcactggtggagctggaggagccggaggtggagggtggggtctggcagctgctgctggggcagcctcatgaggggaggggaggggaggggaggggagcaggcactgggcgggggcctaggtgcactttgtccttgccaccaatggcgggaggagggtggacctgaacacctgcagggtgtggtgcctgccccagcctctcaggtacttggcccttggggagaagagaagagggtctggtttttgctgggggtgagtttccgggacactcccaaagcccacagataatccctggtgtgggaagaggagtcctggataccttgatgtttagcactttaaccccctttgtctttaaggtaggcgtgggggctactgccagaagtggctgttgggtctgaccccctcctttctgccctccctctgccacatgctggtccgcagagccctcctcccaaggggtggggccctgggtggagctcagcagggtctgcccactccctacgctggcccacataggcctccaggagccctcagtgagagggaccagcatagctgacccccagagtgtggtgggcgccggccctgcccgaggcccagtcggggccctttctgcagatctacctctggctcagcgcacgccccctgccctgagaacaggaaagggcccggaagggctgactcaccgggccgacgctcacacgaaaatgggatgcactttatttgctggtgcaaaggcaggtgagggtgcctcctgtgtgaccgttggccctcctgcctggtggcgctgaagggaaggagccagtgagcctgaccccgggaggggccgtccccgtgtgccgcgtttggcggggccccaggcggctcccccaggcccgggtctggggccccaggctttcccctgcctcgcggccgggcgtcccgtgctttgggtttcttggtttgggttttttaatgccagttctcagtacataagtgcattttgaaagaggttccagctatcacttgtaaccatatatatatacatatatattctatctacaaagtgtttatttgcgagatgtttcaacggtgagttcgggccccgcccgccttgtgaccatctgtccccggtcctcgtccccgccccgcgccctggtcccgagtggcgtggggacgggccatcactgtatgtattaaaatgactgtatcaaataaatgtttattgatttttttccagg

SEQ ID NO: 3211 - DNA, 5919 bp, Homo sapiens
ccccccgccccggcccggcccggcccggccgcagccccgctgggcgccgcagagatgacggatcctttctgcgttggaggccgtcggctcccggggtccagcaagagtggtcccgggaaggatggcagccgaaaggaggtccgacttccaatgctgcatgacccaccgaagatggggatgccggtggtccgtggtggacagacagtgcccggccaggcccctctctgctttgacccgggaagtccagccagtgacaagacagaagggaagaaaaaggggcggccaaaagccgagaaccaggccctccgagacattcctctctccctgatgaacgactggaaggatgagttcaaggcacactcgagggtgaagtgtccaaactcagggtgctggctggagttccccagcatctacgggctcaagtaccattaccagcggtgccaagggggtgccatctcagatcgcctggccttcccctgccccttctgcgaggccgcattcacctctaagacccagctggagaaacaccggatctggaaccacatggaccgacccctgcctgcctccaagcctgggcccatcagcaggccggtcaccatcagccggcctgttggggtcagcaagcccatcggagtgagcaaacctgtcactattggcaaacctgtgggtgtcagcaaacccattggcatcagcaagccagtctcggtcggcagacccatgccagtcaccaaggccatcccggtcactaggcccgtgccagtcaccaaacctgtcacagtcagcaggcccatgcccgtcaccaaggccatgccggtcaccaaacccatcacagtcaccaagtctgtgccggtcaccaaacccgtacctgtcaccaaacccattacggtaacaaagcttgtgacagttacgaaacccgtgccggtcaccaagccagtgacagtcagcaggcccattgtggtcagcaagccggtgacagtcagcaggcccattgctatcagcagacacacaccgccctgcaaaatggtgctgctgaccaggtcggagaacaaagcacctcgtgccacagggaggaacagtggtaagaaaagggctgcggacagcctggacacctgcccaattccacccaagcaggccaggccagagaatggggagtacggcccctcctccatgggccagagctcggccttccagctgagtgcagacaccagcagtggctccttgtcgccaggcagcaggccgtcagggggcatggaggcactgaaggctgcaggccctgcgtccccgcctgaggaggacccggagcgcacaaagcacagaaggaaacagaaaacacccaaaaagtttacaggggagcagccatccatctcagggacctttgggctcaaaggcctggtcaaagctgaggacaaggcccgagttcaccgctccaagaagcaggaggggccaggccctgaggacgcccggaagaaggtgccagctgcccccatcactgtcagcaaggaggcaccggcccctgtggcccacccagctccaggtggccctgaagagcagtggcagagggccatccatgagcgcggggaagccgtctgccccacctgcaacgtggtcacccggaagactctcgtggggcttaagaagcacatggaggtgtgtcagaagcttcaggatgcactcaagtgccagcactgccggaagcagttcaagtccaaagccggcctcaactaccacactatggccgagcacagtgccaagccctctgacgccgaggcctccgaagggggcgagcaggaggagcgcgagaggctgcgcaaggtgctgaagcagatgggacggctgcgctgcccccaggagggttgcggggctgccttctccagcctcatgggctaccagtaccaccagcggcgctgcgggaagccgccctgcgaggtggacagcccctccttcccctgcacccactgtggcaagacgtaccgatccaaggctggccacgactaccacgtgcgctcggagcacacggcccccccccctgaggagcccacagacaagtcccctgaggctgaggacccgctgggtgtggagcggaccccaagcgggcgtgtccgccgcacgtcggcccaggtggcggtgttccacctgcaggagatagcggaggacgagctggcccgcgactggaccaagcggcgcatgaaggatgaccttgtgcccgagaccgcacggctcaactacactcgaccagggctccccacgctgaacccccagctgctagaggcatggaagaatgaagtgaaggagaaaggccacgtcaactgtcccaacgactgctgtgaagccatctactccagcgtgtccggactcaaggctcatctcgccagctgcagtaagggggcccacctggcagggaagtaccgctgtctgctgtgtccgaaggagttcagttctgagagtggcgtcaaataccacatcctgaagacccacgcagagaactggttccgaacatcagcagacccacctcccaaacacaggagccaggactcattggtgcccaagaaggaaaagaagaaaaatctggcaggtggaaagaagcggggccgaaagcccaaggagcggaccccagaggagcctgtggccaagctgcccccgcgccgggacgactggcctccaggatgcagagacaagggggcccggggctccaccggccggaaggtgggagtcagcaaggcgcctgaaaagtgagcatggtgcgtggggcctggcccccatgcagccgccacaccgccctctgttcaaggcagggccagctccgggacctctgtcctccagttctccatcccccacccccgcctcttcatccgtccagtggggcagccagccactctcccttccctgaaggtggcccttcccctgttaaggctgccacagggcacacctgggttggggctccccaaggtgtgcccagcagaagtgcaatagccaggagggttgcccctcctcatgggaatgtgtctggggtcttggtgccacaggggctgcagcgcagagtaggcagatggcctttggccccccggctccgcttcctcaggccctgccgggtcccttccctggctaccccaaggctcaggcatccctggtgacctgtggttctgggctggtgagggcacctgagcaacctggcacgggcagccaccatcctggcctcacctccacccaacactggaactccagcacccccagctacctcccaggacagacccctgtctgaccactgccatgctgacctgacaggctccggcctgcccttggccacccacttggtccccttgcttctgttttctacctctccaggcctgcccactacccccacccctgctcctcctttgtcagtgcgatccctgctgtgctcaggccctgccccccaggcctgtctgtaattctcccagcttggggcaagggaggggttttgcttcttgtacctacagggcagcagaagcttgatgcccttcaacacagctgccagccctgggggtgtggggcccctggagtgtgctctcctccagtgttcagccttctggcactgcaggcctaggttggagcagcctcgtggagtagggacggactagttcgggccctggggtcttgctggggcccataggcatgtggggcaggaagctgggcagagctggcctggctctgagtggccactgggggaaaggcagccttctgtctgccaatctgggtaggcccagtggccaagctctcatgggagccccctccccacttttttttttaacctgcccccattgtttctggttgtgtggtcatttgatatgggaactgaaggccagccaggggaggggcttggccaaagtcacagcaggttgatggcagctccagagctgtctttgcccctttgtggccctgaggacggctgggtctataggtagggcaggggtcaggcagggagtccagggtgcctggaagaggtggccacagcctgtggctccctccctggggtcctgccttccaaccacggcattgcagggaggatgaggctcagagggggtaggtttggagggaggccattttccagggtgggtgggagtgggctgagggctcggccccactgaccctggacgatgagaattttgatgtttgcccgtgtgcgtgtgtctcctgggtgtagtggatgccagtcttgttgctgtgacaagtaacaaccttttttttaaattgttttttatacaaacactcgcaatccgacatttggtgctaagggtttcctggtgcagacggtgggcctgggggctgggctggaccagggcgtgggtctctggggttggggtcccttgctgctcagggaggcagtactgactgggcactgcctctgcccccagcacccaccctcccccattccccagggagaaggggccccactgggcttggcctgcagtagtagggagacaagttccaggagcactttggggactggggttgcagaacacttcctgtctctggcttcatccttgggccagaaggctccaaccctcagcagcccttgccagatgtgccagggagtgggtgtggagacccggactccccccacccacgcacacctcggcctgatgagaggatggaggctggggcagagatgggcgtgacccagcgtcagagggtcgggggaggcattccttcctgtgtcccagagcttcactggtggagctggaggagccggaggtggagggtggggtctggcagctgctgctggggcagcctcatgaggggaggggaggggaggggaggggagcaggcactgggcgggggcctaggtgcactttgtccttgccaccaatggcgggaggagggtggacctgaacacctgcagggtgtggtgcctgccccagcctctcaggtacttggcccttggggagaagagaagagggtctggtttttgctgggggtgagtttccgggacactcccaaagcccacagataatccctggtgtgggaagaggagtcctggataccttgatgtttagcactttaaccccctttgtctttaaggtaggcgtgggggctactgccagaagtggctgttgggtctgaccccctcctttctgccctccctctgccacatgctggtccgcagagccctcctcccaaggggtggggccctgggtggagctcagcagggtctgcccactccctacgctggcccacataggcctccaggagccctcagtgagagggaccagcatagctgacccccagagtgtggtgggcgccggccctgcccgaggcccagtcggggccctttctgcagatctacctctggctcagcgcacgccccctgccctgagaacaggaaagggcccggaagggctgactcaccgggccgacgctcacacgaaaatgggatgcactttatttgctggtgcaaaggcaggtgagggtgcctcctgtgtgaccgttggccctcctgcctggtggcgctgaagggaaggagccagtgagcctgaccccgggaggggccgtccccgtgtgccgcgtttggcggggccccaggcggctcccccaggcccgggtctggggccccaggctttcccctgcctcgcggccgggcgtcccgtgctttgggtttcttggtttgggttttttaatgccagttctcagtacataagtgcattttgaaagaggttccagctatcacttgtaaccatatatatatacatatatattctatctacaaagtgtttatttgcgagatgtttcaacggtgagttcgggccccgcccgccttgtgaccatctgtccccggtcctcgtccccgccccgcgccctggtcccgagtggcgtggggacgggccatcactgtatgtattaaaatgactgtatcaaataaatgtttattgatttttttccagg

SEQ ID NO: 3212 - DNA, 5926 bp, Homo sapiens
ccccgcggcgtctggctcggctcgcgccttccgcgagctgcccccgctgggcgccgcagagatgacggatcctttctgcgttggaggccgtcggctcccggggtccagcaagagtggtcccgggaaggatggcagccgaaaggaggtccgacttccaatgctgcatgacccaccgaagatggggatgccggtggtccgtggtggacagacagtgcccggccaggcccctctctgctttgacccgggaagtccagccagtgacaagacagaagggaagaaaaaggggcggccaaaagccgagaaccaggccctccgagacattcctctctccctgatgaacgactggaaggatgagttcaaggcacactcgagggtgaagtgtccaaactcagggtgctggctggagttccccagcatctacgggctcaagtaccattaccagcggtgccaagggggtgccatctcagatcgcctggccttcccctgccccttctgcgaggccgcattcacctctaagacccagctggagaaacaccggatctggaaccacatggaccgacccctgcctgcctccaagcctgggcccatcagcaggccggtcaccatcagccggcctgttggggtcagcaagcccatcggagtgagcaaacctgtcactattggcaaacctgtgggtgtcagcaaacccattggcatcagcaagccagtctcggtcggcagacccatgccagtcaccaaggccatcccggtcactaggcccgtgccagtcaccaaacctgtcacagtcagcaggcccatgcccgtcaccaaggccatgccggtcaccaaacccatcacagtcaccaagtctgtgccggtcaccaaacccgtacctgtcaccaaacccattacggtaacaaagcttgtgacagttacgaaacccgtgccggtcaccaagccagtgacagtcagcaggcccattgtggtcagcaagccggtgacagtcagcaggcccattgctatcagcagacacacaccgccctgcaaaatggtgctgctgaccaggtcggagaacaaagcacctcgtgccacagggaggaacagtggtaagaaaagggctgcggacagcctggacacctgcccaattccacccaagcaggccaggccagagaatggggagtacggcccctcctccatgggccagagctcggccttccagctgagtgcagacaccagcagtggctccttgtcgccaggcagcaggccgtcagggggcatggaggcactgaaggctgcaggccctgcgtccccgcctgaggaggacccggagcgcacaaagcacagaaggaaacagaaaacacccaaaaagtttacaggggagcagccatccatctcagggacctttgggctcaaaggcctggtcaaagctgaggacaaggcccgagttcaccgctccaagaagcaggaggggccaggccctgaggacgcccggaagaaggtgccagctgcccccatcactgtcagcaaggaggcaccggcccctgtggcccacccagctccaggtggccctgaagagcagtggcagagggccatccatgagcgcggggaagccgtctgccccacctgcaacgtggtcacccggaagactctcgtggggcttaagaagcacatggaggtgtgtcagaagcttcaggatgcactcaagtgccagcactgccggaagcagttcaagtccaaagccggcctcaactaccacactatggccgagcacagtgccaagccctctgacgccgaggcctccgaagggggcgagcaggaggagcgcgagaggctgcgcaaggtgctgaagcagatgggacggctgcgctgcccccaggagggttgcggggctgccttctccagcctcatgggctaccagtaccaccagcggcgctgcgggaagccgccctgcgaggtggacagcccctccttcccctgcacccactgtggcaagacgtaccgatccaaggctggccacgactaccacgtgcgctcggagcacacggcccccccccctgaggagcccacagacaagtcccctgaggctgaggacccgctgggtgtggagcggaccccaagcgggcgtgtccgccgcacgtcggcccaggtggcggtgttccacctgcaggagatagcggaggacgagctggcccgcgactggaccaagcggcgcatgaaggatgaccttgtgcccgagaccgcacggctcaactacactcgaccagggctccccacgctgaacccccagctgctagaggcatggaagaatgaagtgaaggagaaaggccacgtcaactgtcccaacgactgctgtgaagccatctactccagcgtgtccggactcaaggctcatctcgccagctgcagtaagggggcccacctggcagggaagtaccgctgtctgctgtgtccgaaggagttcagttctgagagtggcgtcaaataccacatcctgaagacccacgcagagaactggttccgaacatcagcagacccacctcccaaacacaggagccaggactcattggtgcccaagaaggaaaagaagaaaaatctggcaggtggaaagaagcggggccgaaagcccaaggagcggaccccagaggagcctgtggccaagctgcccccgcgccgggacgactggcctccaggatgcagagacaagggggcccggggctccaccggccggaaggtgggagtcagcaaggcgcctgaaaagtgagcatggtgcgtggggcctggcccccatgcagccgccacaccgccctctgttcaaggcagggccagctccgggacctctgtcctccagttctccatcccccacccccgcctcttcatccgtccagtggggcagccagccactctcccttccctgaaggtggcccttcccctgttaaggctgccacagggcacacctgggttggggctccccaaggtgtgcccagcagaagtgcaatagccaggagggttgcccctcctcatgggaatgtgtctggggtcttggtgccacaggggctgcagcgcagagtaggcagatggcctttggccccccggctccgcttcctcaggccctgccgggtcccttccctggctaccccaaggctcaggcatccctggtgacctgtggttctgggctggtgagggcacctgagcaacctggcacgggcagccaccatcctggcctcacctccacccaacactggaactccagcacccccagctacctcccaggacagacccctgtctgaccactgccatgctgacctgacaggctccggcctgcccttggccacccacttggtccccttgcttctgttttctacctctccaggcctgcccactacccccacccctgctcctcctttgtcagtgcgatccctgctgtgctcaggccctgccccccaggcctgtctgtaattctcccagcttggggcaagggaggggttttgcttcttgtacctacagggcagcagaagcttgatgcccttcaacacagctgccagccctgggggtgtggggcccctggagtgtgctctcctccagtgttcagccttctggcactgcaggcctaggttggagcagcctcgtggagtagggacggactagttcgggccctggggtcttgctggggcccataggcatgtggggcaggaagctgggcagagctggcctggctctgagtggccactgggggaaaggcagccttctgtctgccaatctgggtaggcccagtggccaagctctcatgggagccccctccccacttttttttttaacctgcccccattgtttctggttgtgtggtcatttgatatgggaactgaaggccagccaggggaggggcttggccaaagtcacagcaggttgatggcagctccagagctgtctttgcccctttgtggccctgaggacggctgggtctataggtagggcaggggtcaggcagggagtccagggtgcctggaagaggtggccacagcctgtggctccctccctggggtcctgccttccaaccacggcattgcagggaggatgaggctcagagggggtaggtttggagggaggccattttccagggtgggtgggagtgggctgagggctcggccccactgaccctggacgatgagaattttgatgtttgcccgtgtgcgtgtgtctcctgggtgtagtggatgccagtcttgttgctgtgacaagtaacaaccttttttttaaattgttttttatacaaacactcgcaatccgacatttggtgctaagggtttcctggtgcagacggtgggcctgggggctgggctggaccagggcgtgggtctctggggttggggtcccttgctgctcagggaggcagtactgactgggcactgcctctgcccccagcacccaccctcccccattccccagggagaaggggccccactgggcttggcctgcagtagtagggagacaagttccaggagcactttggggactggggttgcagaacacttcctgtctctggcttcatccttgggccagaaggctccaaccctcagcagcccttgccagatgtgccagggagtgggtgtggagacccggactccccccacccacgcacacctcggcctgatgagaggatggaggctggggcagagatgggcgtgacccagcgtcagagggtcgggggaggcattccttcctgtgtcccagagcttcactggtggagctggaggagccggaggtggagggtggggtctggcagctgctgctggggcagcctcatgaggggaggggaggggaggggaggggagcaggcactgggcgggggcctaggtgcactttgtccttgccaccaatggcgggaggagggtggacctgaacacctgcagggtgtggtgcctgccccagcctctcaggtacttggcccttggggagaagagaagagggtctggtttttgctgggggtgagtttccgggacactcccaaagcccacagataatccctggtgtgggaagaggagtcctggataccttgatgtttagcactttaaccccctttgtctttaaggtaggcgtgggggctactgccagaagtggctgttgggtctgaccccctcctttctgccctccctctgccacatgctggtccgcagagccctcctcccaaggggtggggccctgggtggagctcagcagggtctgcccactccctacgctggcccacataggcctccaggagccctcagtgagagggaccagcatagctgacccccagagtgtggtgggcgccggccctgcccgaggcccagtcggggccctttctgcagatctacctctggctcagcgcacgccccctgccctgagaacaggaaagggcccggaagggctgactcaccgggccgacgctcacacgaaaatgggatgcactttatttgctggtgcaaaggcaggtgagggtgcctcctgtgtgaccgttggccctcctgcctggtggcgctgaagggaaggagccagtgagcctgaccccgggaggggccgtccccgtgtgccgcgtttggcggggccccaggcggctcccccaggcccgggtctggggccccaggctttcccctgcctcgcggccgggcgtcccgtgctttgggtttcttggtttgggttttttaatgccagttctcagtacataagtgcattttgaaagaggttccagctatcacttgtaaccatatatatatacatatatattctatctacaaagtgtttatttgcgagatgtttcaacggtgagttcgggccccgcccgccttgtgaccatctgtccccggtcctcgtccccgccccgcgccctggtcccgagtggcgtggggacgggccatcactgtatgtattaaaatgactgtatcaaataaatgtttattgatttttttccagg

SEQ ID NO: 3213 - DNA, 3011 bp, Homo sapiens
ggcgcggggtggcgggcggggcctggtcctgtgagcgttcggagactgcgggcgcgcagacctgtactgggcccgcgccccggccccttacagagctgggtgtgtccctccgagtgccccccgctagggactgtgcaggccggagctaggcagggacagcggggcgaaccgggctgatagagtcggtccctgctcctgtgaggctctcaccgaatccctgctgtttccgggcagctgaagagcgctgggccctcgcgtcgcgggcgtggctgtggccgtgtctcctggtagtctgagcccactgtgcgtgtggatccacgtgggagctgggttccagagcctggtcctgaggaggagccgagccggggcttccccttctcagaatcctgctcttcctccagagagattcccaggagaagagggaacaaccaattcattcctgaaagccaggcctcgggacctgatgacatttgaagatgtggctgtggaattcagccagtgggagtgggggcagctgaaccctgctcagaaggacctctacagggaggtgatgctggagaacttcaggaacttggccattctgggccttctagtatccaaaccatatgtgatctgccagttggaggaagggggtgagcccttcatggtggagagagaaatctcaacaggagcccactcagactggaagagaaggtctaaatccaaggaatcaatgccaagttggggaatttccaaagaagaattattccaggtagtatcagtggaaaaacacattcaagatgtgctgcagttctcgaagttgaaagcagcctgcggttgtgatggccagttagagatgcagcagataaaacaggagagacacctgaaacaaatgtcaaccattcacaaatctgccaccacccttagcagagattataaatggaatggatttgggagaagcttaggtttaagatcagtccttgttaaccaacacagcattctcatgggagaaggatcttataaatgtgatacagaattcaggcagactttagggggaaacaactctcagagaacccacccagaaaagaaatcttgtaaatgtaatgagtgtgggaagtcctttcacttccagtcagaacttaggcgccatcagcgatgtcacactggagaaaagccgtatgaatgcagtgactgtggaagagcctttggtcatatttcatcccttattaaacatcaaagaactcatactggagaaaagccctatgaatgcagtgaatgtgggagagccttcagccagagttcgtctcttgttctgcactatagatttcacactggagagaaaccctacaaatgtaatgaatgtggacgagcctttggtcacacttcatcccttattaagcatcagaggactcatactggagaaaagccctatgaatgccgggaatgtgggagaaccttcagccagagctcatcactcattgtgcattacagatttcatactggagagaaaccttacaaatgtaataaatgtgggagagccttcagccagagttcatctctcactcaacattacagatttcacactggagagaaaccctacaaatgtaatgagtgtggaagggcctttgctcatactgcatcccttattaaacatcagagaagtcatgctggaaaaaaaaccctataaattcagtgaatatagaagggctttcagctggagtgcagacatcactggaacttaaagaattcatatcagagagagatcctaaaggtgtaatgtatgtgggaagaccacatcttgttccacatcaggcaataattactaaagagaatccctgtcaatgtcaagagggggtgggcttcccctctcttaccaaacatgggagaatccatactagtgagaaaccacgtgaatgtaatgaatgtgggaacgctttgatcagaggatgcatattattcagcatcagacagccgacactggggaggagccttatcaatgcagtgagtgtggcaagccttcagttacatactgattctttaagaaaatcagataacttgtactggagagaaatcctacaagtgtggtaagtatggaaaaatcttcagttgtatctcttcctttactaagcatcaagaacacatactagagagaggccctatgaaagcaggaaatagaggaaggccttcagtcagggctcatcccttattaagcatcagaaaattcatacctgagaaaaacctgtgaatgtgggtaatgtgggagagccttcagccaaacctcattgctttataaaccccttagaactctccctactagctggaaactctggtgacgtgatgaatgtgggaagggctttggtggatgttccaccaaaacacgttagagaatttgtacattagagaatttgtgctagagcaactcttcaaatttagtgaaactgggaaaacccattagtagagttcaagcttcagtattcatctcaaagagaaaccttgggaacatgatgaatgtgaggaaagttcctttccaacttgagatgtataaaactagagctgaaaagaagctgagaaatcaccttgtctggtgattttctgcctggtggggccatttgtataacgacacttgtgcattgcctcctcatgctgttactgacggggcagggtgtcatgcatgggtgcagaggatggaggctgagaaaggtagacagctacccatgatctagcccagtcgtattttagagctaataaaactgatgttcagaaagtgacatgccttggcctatagtcctaactgggctgggcctctttcctgtggttcacagctgtagtatggagattaatagactggatctttgcagtacaacacctctatgcacttctttctctgtagcacatgttacctttctttgtgaggcaatggagtggtctaggattgagcaaaaagcaatttttgttacatctttatgctaatagatttggaatttttgaaatgaaatgaaaccttgtttaaacattaaaattactaaaatagg

SEQ ID NO: 3214 - DNA, 2755 bp, Homo sapiens
tgtggccgtgtctcctggtagtctgagcccactgtgcgtgtggatccacgtgggagctgggttccagagcctggtcctgaggaggagccgagccgggggtaggaggccggacttggcgagggaagagcacgaccccgggcagcagtgcgccgcgctgggcgcaccggggtttgccggccctgctctgggccctgcaggtccgctggccccgccgcgcctagtggggatgccccgtgtcccccaggcagccccagcctgcgtcccgctccctgaaccctcgggaggaccacagggctgtggccgaaagacagagatttggacctagtgaaaggacgccgctccttagccccagctatggactccacagcatcaggtttggctctggagcgtgcagagggccaggagccctcttggggagctagtaccgagcccgatatcaggaggaccccaggaagaggccggggaatcccactgaaggcttccccttctcagaatcctgctcttcctccagagagattcccaggagaagagggaacaaccaattcattcctgaaagccaggcctcgggacctgatgacatttgaagatgtggctgtggaattcagccagtgggagtgggggcagctgaaccctgctcagaaggacctctacagggaggtgatgctggagaacttcaggaacttggccattctgggccttctagtatccaaaccatatgtgatctgccagttggaggaagggggtgagcccttcatggtggagagagaaatctcaacaggagcccactcagactggaagagaaggtctaaatccaaggaatcaatgccaagttggggaatttccaaagaagaattattccaggtagtatcagtggaaaaacacattcaagatgtgctgcagttctcgaagttgaaagcagcctgcggttgtgatggccagttagagatgcagcagataaaacaggagagacacctgaaacaaatgtcaaccattcacaaatctgccaccacccttagcagagattataaatggaatggatttgggagaagcttaggtttaagatcagtccttgttaaccaacacagcattctcatgggagaaggatcttataaatgtgatacagaattcaggcagactttagggggaaacaactctcagagaacccacccagaaaagaaatcttgtaaatgtaatgagtgtgggaagtcctttcacttccagtcagaacttaggcgccatcagcgatgtcacactggagaaaagccgtatgaatgcagtgactgtggaagagcctttggtcatatttcatcccttattaaacatcaaagaactcatactggagaaaagccctatgaatgcagtgaatgtgggagagccttcagccagagttcgtctcttgttctgcactatagatttcacactggagagaaaccctacaaatgtaatgaatgtggacgagcctttggtcacacttcatcccttattaagcatcagaggactcatactggagaaaagccctatgaatgccgggaatgtgggagaaccttcagccagagctcatcactcattgtgcattacagatttcatactggagagaaaccttacaaatgtaataaatgtgggagagccttcagccagagttcatctctcactcaacattacagatttcacactggagagaaaccctacaaatgtaatgagtgtggaagggcctttgctcatactgcatcccttattaaacatcagagaagtcatgctggaaaaaaaaccctataaattcagtgaatatagaagggctttcagctggagtgcagacatcactggaacttaaagaattcatatcagagagagatcctaaaggtgtaatgtatgtgggaagaccacatcttgttccacatcaggcaataattactaaagagaatccctgtcaatgtcaagagggggtgggcttcccctctcttaccaaacatgggagaatccatactagtgagaaaccacgtgaatgtaatgaatgtgggaacgctttgatcagaggatgcatattattcagcatcagacagccgacactggggaggagccttatcaatgcagtgagtgtggcaagccttcagttacatactgattctttaagaaaatcagataacttgtactggagagaaatcctacaagtgtggtaagtatggaaaaatcttcagttgtatctcttcctttactaagcatcaagaacacatactagagagaggccctatgaaagcaggaaatagaggaaggccttcagtcagggctcatcccttattaagcatcagaaaattcatacctgagaaaaacctgtgaatgtgggtaatgtgggagagccttcagccaaacctcattgctttataaaccccttagaactctccctactagctggaaactctggtgacgtgatgaatgtgggaagggctttggtggatgttccaccaaaacacgttagagaatttgtacattagagaatttgtgctagagcaactcttcaaatttagtgaaactgggaaaacccattagtagagttcaagcttcagtattcatctcaaagagaaaccttgggaacatgatgaatgtgaggaaagttcctttccaacttgagatgtataaaactagagctgaaaagaagctgagaaatcaccttgtctggtgattttctgcctggtggggccatttgtataacgacacttgtgcattgcctcctcatgctgttactgacggggcagggtgt

SEQ ID NO: 3215 - DNA, 159 bp, Homo sapiens
cagtcagaacttaggcgccatcagcgatgtcacactggagaaaagccgtatgaatgcagtgactgtggaagagcctttggtcatatttcatcccttattaaacatcaactcatactggagaaaagccctatgaatgcagtgaatgtgggagagccttca

SEQ ID NO: 3216 - DNA, 8619 bp, Homo sapiens
cggggcgtgcgcgtcctcctccccaggcccgccgcctccctgccaagaatctgagagaggccgagtggagttcggtccttctctgaacacttttagctgagagtaccagcatccaactgggagcgttgtcattgcatttccacattcccaggaaagcccaggtgctggctgccagctgctgcgccccccatgtagaaggtgcacctcctgggagcaggcacgtcttttggctcttctgaccatggagagataggacggtccctgcagcccgcgcgacagaaagctgtgccgccaccaccggccgcgcccgtccttcggatggatcgcaacagagaggccgagatggagctgaggcgaggccccagccccaccagggccggccggggccacgaggtggatggggacaaggctacctgccacacctgctgcatctgcggcaagagcttccccttccagagctcgctttcgcagcacatgcgcaagcacacgggcgagaagccctacaagtgtccctactgcgaccaccgggcttcccagaagggcaacctgaagattcacatccggagccaccgcacggggactctgattcagggacacgagccggaggcgggcgaggcgccgctgggtgagatgcgcgcctccgagggcctggacgcctgcgccagccccaccaagagcgcctcggcctgcaaccggctgctgaacggggcctcgcaggccgacggcgccagggtcctgaacggggcctcgcaggccgacagcggcagagtcctgctgcggagcagcaagaagggggcagaggggtccgcatgcgccccgggggaggccaaggcagcggtccagtgctccttctgcaagagccagttcgagcgtaagaaggacctggagctgcacgtgcaccaggcgcacaagccgttcaagtgcaggctgtgcagctacgcgacgctgcgggaggagtcgctgctgagccacatcgagagggaccacatcaccgcgcaggggcccggcagcggcgaggcctgcgtggagaacggcaagcccgagctgagccccggggagttcccgtgcgaggtgtgtggccaggccttcagccagacctggttcctgaaggcgcacatgaagaagcaccggggctccttcgaccacggctgccacatctgcggccgtaggttcaaggagccctggttcctcaagaaccacatgaaggcgcacggccccaagacgggcagcaagaacaggcccaagagtgagctggaccccatcgccaccatcaacaacgtggtccaggaggaggtgatcgtcgccggcctgagcctctacgaggtctgcgccaagtgcgggaacctgtttacaaacctggacagcttgaacgcccacaatgccatccaccgcagagtcgaggccagccgcacgcgcgccccggccgaggagggggcggaggggccctcggacaccaagcagttcttcctccagtgcctgaacctgaggccgtcggcggccggcgactcgtgccctggcacgcaggccggacggcgggtggctgagctggacccggtcaacagctaccaggcctggcagctggccacgcggggtaaggtggccgagccggccgagtacctcaagtacggggcctgggacgaggcgctggccggggacgtggccttcgacaaggacaggcgcgagtacgtcctggtgagccaggagaagcgcaagcgtgagcaggatgcaccagccgcgcaggggcccccgcggaagcgcgcgagcgggcctggggaccccgcgcccgccggccacctcgatccccgctcggccgcgcgccccaaccgcagggccgcagccaccaccggccagggcaagtcctccgagtgcttcgagtgcggcaagatcttccgcacctatcatcagatggtgctgcactcacgcgtgcatcgccgcgcgcgccgcgagagggacagtgacggggacagggcggcgcgggcccgctgcggatcactcagtgagggtgactcggcctcccagcccagcagccctggctccgcctgtgccgctgctgactccccgggctctggcctggccgacgaggctgccgaagacagtggtgaggagggcgcccctgaacctgcaccagggggacagccgcgccgctgctgcttttccgaagaggtgacttcgaccgagctctccagtggagaccagagtcacaagatgggagataacgcctcggaaagagacaccggcgagtccaaggcagggatcgcagcttctgtgtccatacttgaaaacagtagcagagagacttctagaaggcaagagcagcacagattttctatggacttaaagatgccagcatttcaccccaagcaggaggtgcccgtccctggtgatggtgtggagttcccttccagtacgggagcggagggccagacgggtcaccctgcagaaaagctgtccgatttgcacaacaaggaacactctgggggagggaagcgggcgctggccccagacctcatgccgctagatttaagtgcgaggtcgacgcgggatgaccccagcaataaggagacggcctcctccctgcaggcggctttagtcgttcacccgtgtccttactgcagccacaagacctactaccccgaggtcctgtggatgcacaaacgcatctggcaccgcgtcagctgcaactccgtggctcccccgtggattcagcccaatggttacaaaagcatcagaagcaatttggttttcctttcccggagcggacgcacgggccccccgcctgccctcggtggcaaagaatgccagcctttgctccttgctcggttcacccgcactcaggtgccaggggggatgccggggtccaaaagtggctcttctcccctgggagtggtcacaaaagccgctagcatgcctaagaataaggagagccattccggaggtccctgcgctctgtgggcgcccggccctgacgggtatcgacagaccaaaccttgtcacggccaggagccacatggcgcggccacacaggggcccctggccaagcccaggcaggaggctagctccaaaccggtgcctgccccgggtggcgggggcttcagcaggagcgccacccctacgcccaccgtcatcgcccgggctggcgcgcagccctcggccaatagcaagcctgtggagaagtttggggtccccccagcgggggctggctttgcccccacaaataagcacagtgccccggactccctgaaagccaaattcagtgctcagcctcagggtccacctcctgcaaagggcgaagggggcgctcctcctctacctccccgcgagcccccctcgaaggcagcccaggagctgaggactctggccacctgtgctgcggggtccaggggcgacgcggccttgcaggcccagcccggcgtggctggggcgccccccgtcctacactccatcaaacaggagccggtggccgaggggcatgagaagcgcctggacatcctcaacatctttaagacgtacattccaaaggactttgcgaccctctaccagggatggggtgtcagcggccctgggttggagcacagagggacactccggacgcaggcccggccaggagagttcgtctgcatcgagtgcggaaagagcttccaccagcccggccacctcagggcccacatgcgggcacactcagtggtgtttgagtccgatgggcctcggggttctgaagttcataccacctccgcagacgcccccaaacaagggagagaccattctaacacaggtaccgtccagacagtgcctctgagaaagggaacctaaaggcgtgtttccgacgcaccccaggtccccgtaacggccattagcagtaccctcacgatgtcccagcagcctcccacctgtgacctggccgctccatggaagaacagccggggaactcctgagcagacacctcacatcccgagccgctgcgctggagtggaaactgaaggcagatgcctctccttgttaaacgttcagaaataaatgaagatgctatattctagaaatacatgtagatactatatacgcatttacgtgctcatcgtccatagtcccatattttcttataataaacagtagtactggcaggcacagtaggggcacaaggcatctgtcttattcaagacaagtttgagacactggaaaaaaagatacttgttgtgtgtgttggacagagtggcgaggctgagcactgtcacaggggcctcccatgttaagagggactgtggggatgatgtcagaacaagacgtggtggatttgaggttgatcgagtattaatactactgcctctccttgtcttagtgggtatttaaaatagtaaataagagagaggaaggaggtgacgttcaggtgctgtgggaagcaggcttggcggaggggtatgatgatgagaccctcattgttcactggctccatcgcactcctccctggggccgtgtgcctgttccattcttcccaccattcgaactgagcgaatctggcaaaggagacacgtctgtgggaatgcgtagattccgcctcggaagagagctagcgcaacactaagaaaagcaggcttcttgtttattctcaggacctttttgtaacagggctacattctgcaaactgcttacaaaggaagactatacgtcttaacaaattatttagccactgagtcctcccgattcggacctgttttagtaatggcagaagaatccctgagcaggttcaggtgccctagatgactagggtgctgagctctggcgccttctgtccccactctttgcctccccgccccttccctgagccaccccagcaagtgggtgtcttttctccctgggcctggtgacctccacaggatgagtgactttgttcataaagggtggggatcaccagccccttgggtgggggacggcttcatatacctcttcctcagtaatgcaaatgcgagtttttgtggtgggggttaaggcccataacaaaggatcttaaaccatgcagtgtacgcaattgaaatggtattccacagatataaatattttcttttcccattgccgtgacactatgtgtgatggtaatatttctgagagtttcagatttttgcacatatgattttatgcattatcaaaagttactgctgccttgaatgaaaatgttctgtgaaattttttgcaaaagctttactaggtttttttttaattgtgaaattttgtaaaggcaggaaatggattaaaacgagcatgctaaatatatttttcaaaaaagcaataattttacatgtacagaaattatcctaacctttaatactggcgagagcaacagtttacttaatacggtaatggactagtgcagtttttgtagacagtgggcttctgatacaaagtcttgtttaaacacagacacacacacacacaaacacacacacacaccctaaagtgtgggtttcctgttctaatgatttgttgaatattattatattattattattattattattattattgttattgttattagtaatgtttggttctggattctacttgttactgagtttaaattacttgacggttcaggttactttgcaacactttcaaacgatgcaatgtaactggctagcttatatatatatatatatatatatatatatatatttttttttttttttacttatttttttctgatattcttacaccagatatgtacgaaaatgatctgtcctgttggtgtaattaggaatgtccatgcagatacagttaaacaactgtaattgactgttctgtaaagttattttgggcaaagttgcggagacacattcctctgtccacctaagaaatcagaagactcttctgttgatttatgtttaatcatttcagtagtttccccacagtgatcatttctgcattttctggcttttgttttcttggctgaaagtgaatggtgactgttaggaatgtcagggactagtgacccagtcctgtttctctgtgttttagttattaaaaagaaattctgtacccaaagtgacacgaaagtgtagtctacatttttactgtttcagaagcggcatggaaaagtgcagttggcctttggagctggaagtgtcttgctggtgaggctccatcctggaggctctggtggggagtgggctggcgctggggccctgccggccgcgtgctggatccttcctggcttgcaggagagcaggcgtggaggacagtcagcttgcggggccgcgcagggtgcacagagtgcaggaggaaggttttcacccagttaaacagactggggagcccccccaagaacgccatcccttgaggccagctgtgggcaggcctggatgtgtggtcccttccttccacccatcgtcagtattgtgttggtttgttaatttgttgatttggtcatagtatttaatatgatttgtgtttccttatttatttagccaccgttttgattgcctttttttttccgaatggtaatttctgcatgatacacttctgtacgttgtcttctgactgttacagactttctactacctctcccgatctgctgtttccttgtttcttaacaggattttttacagtgttgcgtctaatgtaacttagacaataaagggtttggttgtctacactgcagcttctcggtgtctctcccctgctttccgctcgctgcttcccgctctgcccctgctggggcctggctgcaccctggcctgccttcctatactctcctgtttcctgctcatatctcttcctcatttttgcgttcaaataacacacagctaatgagcttctaaaaatcttttcaggttgttcacttgtattccttaatttgaagaatgaatatttaaattctctcaaaagtcagatattgaggatcttctctgggaaattggccactgtacctgcccacctttctgcctggttccctggaaggtcttattgtcatcttagacggacagatttcattctcagcaccatacagatttggcttcaaagccaggtgaattttgcctttgaggctctgaaaagtattaagtgttttaagaggtcccccaatatttacttatttattttttaaaccaagaaagacactggttccctgaaaagcaggtgcttcaggaagtagcaattgggagttgcatacagttacttcgtcagagaaaggagcgcccagtatgacaggcccccacccctgatccggccactgtgcacaggtcgctgagggtgtgagaacacctctgcaggggctccggcacatgtgggtttcatcgtctcacactccttcaggctgcaggggttgagtgcagaaagggcaagcttcatctccatggtgcctctccaggctggcaactctggtcggcctctgttctttggacagagagggtgtaggttacagggtcagtagggatgctttctggatcaaagaaagtgggtgtagtgcttagtctgttgtgtggaagagggcacctcctgggctttcgtggctggagactgtctaccaacattccttccttcaaactagacaaaccctcctctgccacccccagcaaattctcagaggtttccaagctgtagaaaaaggaaggaaggaaggacggcattcacatagctttactttctgcttcaaaatgtcttaagtagcatatgttgttttactgcttttaactttggtgagttctaatttcagaacgttttgttcactgagcaaaaaaacagatgaaacaaccacaggccaggacttcaagtgaggaggacgcctttgtttgccgtggttggtgggagcacacgccggagcccggtaacgtgcctgtgggagtgaccaagggccacccgcccaagggaaaatgttcattcttcatcagctttgctaattctgctttgaggcagtaaaatgcaaaagaccatagaatttgtatttctttttttaaaatacaatttataacattatattttgtactctttatattagaatttgtaactagattgatgtatttaactatttctgaaaaagtaattcaatgttttagttgtgtgataaaaatatttagataaaacatattcattctattggaatttgaaataaataaaaacatcttggagttctgagatttgtaagacatttttccccaatttcagagggtggcgtaaatcgtttgacagcccgctttggtctgtggttatttatttttgttggctgaacataaaccaaagtgttaatgctctttatttatggaagagttttagggtaattcacaagatcgttcatctgaacagatgcccagatggcccgagtggtttttttccaactcttttgtggactcgaggacatacagttttttaatggagacgctgtgtttttctcattttctttcacagcacacatgttatttccccactgaatacacccactgttcttacccttgcactgtcacccatacaggacgcacagggatggacgcggacggaattctgactcagccacacctggaggaaattattgtgtcaaaaatgtggggacacaagggctggcactgtggtttgcaatggtttactgatgagacagcaaaaatgagacaggaccatcagatgcaataaagattctaattt

SEQ ID NO: 3217 - DNA, 482 bp, Homo sapiens
aagtcacaaaaggaactttagtggggatcctacttacacatacagcagaaaggcattgcccccgtcagcctgccatgcagtttcgaatcttgattgaaggtgctggctgccagctgctgcgccccccatgtagaaggtgcacctcctgggagcaggcacgtcttttggctcttctgaccatggagagataggacggtccctgcagcccgcgcgacagaaagctgtgccgccaccaccggccgcgcccgtccttcggatggatcgcaacagagaggccgagatggagctgaggcgaggccccagccccaccagggccggccggggccacgaggtggatggggacaaggctacctgccacacctgctgcatctgcggcaagagcttccccttccagagctcgctttcgcagcacatgcgcaagcacacgggcgagaagccctacaagtgtccctactgcgaccaccgggcttcccagaagggca

SEQ ID NO: 3218 - DNA, 2335 bp, Homo sapiens
ggaaccggagcctgagagccgggcgccgtgcgctcctccccgcgctgtctcggcggcccaggaattcactgtctgtagcatctgctcctccacagagggaccctggaatggcgatggcactcccgatgcctggacctcaggaggcggttgtgttcgaggatgtggctgtgtacttcacaaggatagagtggagttgcctggcccccgaccagcaggcactctacagggacgtgatgctggagaactatgggaacctggcctcactaggctttcttgttgccaaaccagcactgatctccctattggagcaaggagaggagccgggggccttgattctgcaggtggctgaacagagcgtggccaaagccagcctgtgcacagattccaggatggaggctgggatcatggagtctcctctgcagagaaagctctccaggcaggcaggactgccgggcaccgtgtgggggtgcctcccctgggggcaccctgtgggggggcaccctgcaccaccccacccgcatggcggtcctgaggacgggtcagataaacccacccacccccgggctcgggagcacagcgcctccccaagggttctgcaggaagacctgggccggcctgtggggagctcagccccccgctacaggtgcgtgtgcggcaaggcgttcagatacaactcgctgcttctcaggcaccagatcatccacaccggcgccaagcccttccagtgcacagagtgcgggaaggccttcaagcaaagctccatcctgctgcggcaccagctgatccacactgaggagaagccgttccagtgcggcgagtgcgggaaggccttccggcagagcacgcagctggctgcccaccaccgcgtccacacccgcgagcggccctacgcatgcggcgagtgcggcaaggccttcagccgcagctcccggctgctgcagcaccagaagttccacaccggggagaagcccttcgcgtgcacagagtgcggcaaggcgttctgccgcaggttcaccctcaacgagcacggccgcatccacagcggggagcggccctaccggtgcctgcggtgtgggcagcgcttcatccgagggtcctcgctcctgaagcaccaccggctgcacgcgcaggagggtgcccaggacggcggcgtggggcagggcgccctgctcggagctgcgcagaggccccaggcgggggacccgccccacgagtgcccggtgtgcgggaggccgttccgacacaactccctgctgctgctgcacctgcgcctacacacgggcgagaagccgttcgagtgcgcggagtgcggcaaggccttcggtcgcaagtccaacctcactctgcaccagaagatccacaccaaggagaagcccttcgcgtgcaccgagtgcggcaaggcgttccgcaggagctacacgctgaacgagcactaccggctccacagcggcgagaggccataccggtgccgcgcctgcgggagggcctgcagccggctgtccaccctcatccagcaccagaaggtgcacggccgcgagcccggggaggacacagagggcaggcgggcgccctgttgggcttcctgatgacggggacgacaggccgaggattcacgctggaagcccacccaagccggcggggccctagcgcagaaattcagaaccccctgtcctgaaggtgaagcaaagtctaaagaaagggccagctcccatcaggagctcggcttcttgctccagccgggcactggggagggaaagggcaccaggcagcccgtggtgtggcctcaggaaccactatcagccaccatttcctggggccttccggaaatgtccaggagcgggcagaagggagagagggaggggcagctatgctcagtccccaaagagcagggcacagggggcgccacagacgcatatgcagctgagctccccacaggccggcccgggtcttcgtgcagaaccattgggcacagccaggccttagcgccaggctccgtgtggcggtcaattccaggtgctgtaaagccgactaacagggtacagggagccttagctggctgccatgtctcctgcctgtaatcccatcactttgggaggctgaggtgggaggtttgcttaagcccaggagtttgagaccagcttgggcaacatggtgaaacttctctacaaaaaatttaaaaataagtcaggtatcgtggtctgtgcctgtacgctgtagtcccagctactcaggaggctgaggtgggaggatgggttgagcctgggaagtcaaggctgcagtgagctatgatagcaccacggcactccaacctggttgacagagtgacaccctgttt

SEQ ID NO: 3219 - DNA, 1615 bp, Homo sapiens
aattcactgtctgtagcatctgctcctccacagagggaccctggaatggcgatggcactcccgatgcctggacctcaggaggcggttgtgttcgaggatgtggctgtgtacttcacaaggatagagtggagttgcctggcccccgaccagcaggcactctacagggacgtgatgctggagaactatgggaacctggcctcactaggctttcttgttgccaaaccagcactgatctccctattggagcaaggagaggagccgggggccttgattctgcaggtggctgaacagagcgtggccaaagccagcctgtgcacagattccaggatggaggctgggatcatggagtctcctctgcagagaaagctctccaggcaggcaggactgccgggcaccgtgtgggggtgcctcccctgggggcaccctgtgggggggcaccctgcaccaccccacccgcatggcggtcctgaggacgggtcagataaacccacccacccccgggctcgggagcacagcgcctccccaagggttctgcaggaagacctgggccggcctgtggggagctcagccccccgctacaggtgcgtgtgcggcaaggcgttcagatacaactcgctgcttctcaggcaccagatcatccacaccggcgccaagcccttccagtgcacagagtgcgggaaggccttcaagcaaagctccatcctgctgcggcaccagctgatccacactgaggagaagccgttccagtgcggcgagtgcgggaaggccttccggcagagcacgcagctggctgcccaccaccgcgtccacacccgcgagcggccctacgcatgcggcgagtgcggcaaggccttcagccgcagctcccggctgctgcagcaccagaagttccacaccggggagaagcccttcgcgtgcacagagtgcggcaaggcgttctgccgcaggttcaccctcaacgagcacggccgcatccacagcggggagcggccctaccggtgcctgcggtgtgggcagcgcttcatccgagggtcctcgctcctgaagcaccaccggctgcacgcgcaggagggtgcccaggacggcggcgtggggcagggcgccctgctcggagctgcgcagaggccccaggcgggggacccgccccacgagtgcccggtgtgcgggaggccgttccgacacaactccctgctgctgctgcacctgcgcctacacacgggcgagaagccgttcgagtgcgcggagtgcggcaaggccttcggtcgcaagtccaacctcactctgcaccagaagatccacaccaaggagaagcccttcgcgtgcaccgagtgcggcaaggcgttccgcaggagctacacgctgaacgagcactaccggctccacagcggcgagaggccataccggtgccgcgcctgcgggagggcctgcagccggctgtccaccctcatccagcaccagaaggtgcacggccgcgagcccggggaggacacagagggcaggcgggcgccctgttgggcttcctgatgacggggacgacaggccgaggattcacgctggaagcccacccaagccggcggggccctagcgcagaaattcagaaccccctgtcctgaag

SEQ ID NO: 3220 - DNA, 2536 bp, Homo sapiens
ggaaccggagcctgagagccgggcgccgtgcgctcctccccgcgctgtctcggcggcccaggaattcactgtctgtagcatctgctcctccacagagggaccctggaatggcgatggcactcccgatgcctggacctcaggaggcggttgtgttcgaggatgtggctgtgtacttcacaaggatagagtggagttgcctggcccccgaccagcaggcactctacagggacgtgatgctggagaactatgggaacctggcctcactaggctttcttgttgccaaaccagcactgatctccctattggagcaaggagaggagccgggggccttgattctgcaggtggctgaacagagcgtggccaaagccagcctgtgcacagattccaggatggaggctgggatcatggagtctcctctgcagagaaagctctccaggcaggcaggactgccgggcaccgtgtgggggtgcctcccctgggggcaccctgtgggggggcaccctgcaccaccccacccgcatggcggtcctgaggacgggtcagataaacccacccacccccgggctcgggagcacagcgcctccccaagggttctgcaggaagacctgggccggcctgtggggagctcagccccccgctacaggtgcgtgtgcggcaaggcgttcagatacaactcgctgcttctcaggcaccagatcatccacaccggcgccaagcccttccagtgcacagagtgcgggaaggccttcaagcaaagctccatcctgctgcggcaccagctgatccacactgaggagaagccgttccagtgcggcgagtgcgggaaggccttccggcagagcacgcagctggctgcccaccaccgcgtccacacccgcgagcggccctacgcatgcggcgagtgcggcaaggccttcagccgcagctcccggctgctgcagcaccagaagttccacaccggggagaagcccttcgcgtgcacagagtgcggcaaggcgttctgccgcaggttcaccctcaacgagcacggccgcatccacagcggggagcggccctaccggtgcctgcggtgtgggcagcgcttcatccgagggtcctcgctcctgaagcaccaccggctgcacgcgcaggagggtgcccaggacggcggcgtggggcagggcgccctgctcggagctgcgcagaggccccaggcgggggacccgccccacgagtgcccggtgtgcgggaggccgttccgacacaactccctgctgctgctgcacctgcgcctacacacgggcgagaagccgttcgagtgcgcggagtgcggcaaggccttcggtcgcaagtccaacctcactctgcaccagaagatccacaccaaggagaagcccttcgcgtgcaccgagtgcggcaaggcgttccgcaggagctacacgctgaacgagcactaccggctccacagcggcgagaggccataccggtgccgcgcctgcgggagggcctgcagccggctgtccaccctcatccagcaccagaaggtgcacggccgcgagcccggggaggacacagagggcaggcgggcgccctgttgggcttcctgatgacggggacgacaggccgaggattcacgctggaagcccacccaagccggcggggccctagcgcagaaattcagaaccccctgtcctgaaggatctctctgtcagccagcctggagtgcaatggcacaatcatggcttactgcagcctccagctcccaggctcaagcgtttctcccaccttagcctcctgagtagctgggactaaggcacacacactgtacttggcagctggcgaagcattgtttctgagtgtgtgaggatgttttcagtggactcagtgaagatctgccctcagcgtgggcaggcacatccacttggttggggacccagatggaacacaaagggagaagacaagcaaattctcttttctggagggagacacccatctcctgcccttggacatcaggactccaggttcttcggcctttggactcaggcttgccacagaggcctcccagggctctcggccagtcagcctcagaatgagagttacaccactggcttccttggttcaaccaccttcttacctggactgagcctcacttacagcttctctaggtctccagcttgcagacagcctatgggaggacttctcagcctccataagtgtgtgggccagttcgcctaataaatcccctctcctggccgggcgcggtagctctcccctgtaatctcagcattttgggaggcagaggtaggtggatcacctgaggtcaggagttcaagaccagcctggccaacatggtgagacccccgtctctactaaaagtacaaaaagtagctgggtgtggtgctgggtgcctgtaatcccagctactcgggaggctgaagcaggagaatcacttcaacctgggaggtagaggttgcagtgagccgagatcgagccactgcactccagcctgggtgacagggcaagactctgtctcaaacaaataaaaatcccctctcct

SEQ ID NO: 3221 - DNA, 6894 bp, Homo sapiens
gacgccccttcgccgggacctggcacccgaatccggcctgccgggcctctttgtgcagcgccttgctgacgcccagggttctgatgtagaagcctacaccagggcctgaggttgtgaaactcatggcagtccacgcctgagaagagaaggcctgaaagagaaggaagagcccatgggacttgccacggttttgacttacatctgcaactccaaggctacaggcaggaatgttacctggaatgtcagagagctgaaagcagtcatattttgggatcatgcacctactgcggcagtatataaagaaagataattaagtatgcacccaagaagtagctgcgcccctacccatcacaaactgtatagaaggatatctcctaaggattttatcatgtgaaaactttctgaattttagttggctctttttagaaatgcagataagatgaaggatattggacagcagctatacactacacacttgaacggcggacataattccttgaccatgtcacccaaacagcctgatgctaatggagcacctcggccaaatagacaagaagcacaaacccttttgtatcaaggctcagaggcagaggctgccatgatgaccattgctacatgtgcaaagtgcaaaagtgttcacaagatctctcttcaagatttgcagaagggtacagggaaggacggtatgtatgtctgcttccagtgcagcctcggtgcagctcctcccaattttcattttgtgagcaataattccagtgcgactcatgttggaaataaaactgaaaacttctcaagttctgtcaatagcaaatttaaggtaaggaactttaagccaggcaaatactattgtgataaatgtcgattctctacaaaggacccgctgcagtacaaaaagcacacccttcaacacgaggagattaaattcatttgttctcactgcagctacatttcgtatacgaaaggagagtttcagaggcatttggtgaaacacacaggcatatttccttatcagtgtgagtattgtgactatggtgctattagaaatgattatattgtcaaacacacgaagagagtacatgaaagggcaggtgcgaaacggccagtcaaagctgttgccaagctggagccaaaaagaaccggaacttcaaaacaaaacccagagcttctaaaagcttccaatccacggactacatttcaaaataagtggtcagaccaactgtcaggtttctctctccatgcaaataaagacaaaatgcacaatatcatgttgttacctgaaccaaaggaataccaaaaagatgtagtttgtattccaaataaaatgaccctgtctgagccaaatgaagtcaacctatttgagaacaaaaatgttgaagtagaagtgttatcccctgcaaaagaacctgttcagccaggtatgccattgacagttgttgcaccagcagaactagttgtccctgcaaactgtttagcccagttgatagatgtgaaggttgtcaatggtacacagcagcttgttctgaaactgtttccgctggaagaaaataattgccttgaagctgggagggataatggaggtaattctgaacgtatggtgaaagagaagggttcaaatgaacaagaaaaagtactttctgcagaaaaaacaaagtcactgacagttgacgggaatgttggaaaactcgtaggcattgatagttttcaaccttcagttcagaaacagcttaaaaatgtgaaatgggtaaggtcttatgattttattatgccaaattctagtgtgcacaacaatggaaaatccttcattaattcggaaacaattgaggattttcagaaaaaaaataatttgtatccacatagaactgcttttccttccgttgccttaaaaggtcattctctagcatctgtatttaaaaacagtgttttacgtagtcttggagctgcatcaaacccttttccatataaagctgctgtttgttttgctgaaagtggaagaaatttacacagtagctcacagcagttactcccatttgctgcatcacctgcaacctgttccttctctggagaaaagggcttattgcctgtaagtgaaaatgacttggaatctacaagtaaagtcaatattcctgtaaaagtggtttcctctaataggaagcaggaagataaccagacagaggaacacaaggcagtttcaactgtaggccagatttcctctcaacataagagtgagtatttacatataaacataactggagaagatagatctcaacagcctggggataagcctttggaattaaagaattctgaaaggactaacaacactaatgatggcccagtcatctcatcagtattttctctgagctctggatctgaaaatgtccccgagggcattaagtggaatagctcaacgtctaaaataaagtcaattgaactgttgcgcagaaagatagctcagttaattgagtcctgtgggaagccgtcatctttggcttcaaatagtgcacatcgtcgctctgtagggcaggcatcaaagggaacttcaaaagctacctctgaaggtattcaagaaatcaacgtgtcactcactggtcttggccattccacaggtactcttcagaaacctccgaatgatggtggtattactggtaatagacagcttactcatcaacaaatatatccacactttgcagatggcagtaataggaaaaccaaaagcagagtggccaggaaggctcatgttgccacgccagtgttaatccccaaaggggctgtgttgagggttcttaattcctctgagaatgcccacatcatagaggctacatgtgaagcacctgtcagcataccttgcagtgaaagacagttaataaaaccagttccattttgccctgtgagacaggcggactcagacttacagcctttaagaagtgaaagggggccaatagatatgtccccaaatatcgagacacctctgcggcctaaactgagaaaagagagtgctgtctgtagcaccatccatagaaaaactggcctcttgtatggacagcaaggaagcagtgaattaaataagcaagggagactgctttccagaagtctttctataagtagaaataaaaccaaacaagtacacttatccaggaagaaaaacaaaattcaagctgaacctagccgctgtctcaaggatccttcaatttttcaggttgcaaggcaactaagactgatagcagctaagccagatcagttgattaagtgtccccgtcggaaccagccagtcattgtgttaaaccaccctgatgtggactcgccagaagtgaccaatgtgatgaaggtaataaataaatacaaaggcaatgtcctcaaagttgttttatcagagaggactaggtgtcagctaggcatcagacggcatcatgtacgcctgacctaccagaatgcggaagaagccagtcaaattaaaaggcaaatgatgttgaaaatgaaactcaaaaaagttcataaaaacaactaccaggtagtggattccttgcctgatgattcttcacagtgtgtatttaagtgctggttttgtgggcgactgtatgaagaccaggaagagtggatgagtcatggccaacggcatttgatagaagcaactagagattgggatgttctttcctccaagggcaaataagtaaacagttactctttaaagcaagttatcttttagtttattctggtttggagtccctccaccaagattcagtagaagaaatacagactgtagaaatgagaggactgctaattcttcagaactgtaggaatattgggagctaggagtctgaacctgaagtatgtgattggaccccagaatgtatttgaaggctctgaaattgtacatgcaaattggtacatatgcatttttctggagagagcctgtgaaactgaacagattttcagtgggatctgagacttttctttgtttagcaccccgttttctgagtacatactgatctttcataatccattcagaggggcagattgagaatgttttacacatgctcttcatataaatgctacagaaaaacctttgttttggtgtgcacatccattttgtttttgctttaatttgtgttctgagtatttggtgcacaatggaaattatattttctactttactgtcttcaatttggttatagagaaatggccattcttttactccctccctggttttgtaatactcccgagtgttccgtatagcacaaagagttttgcttttactggccattttaaagaatgttttcaactgcttgcctgaatttactcctttcacagcaagtgttagaagaaagataacattttcaaatacttagcttttgctttctttaaaatacattggtttatgacatatgggaagggaacgtacctttttgcaaagacaaaaagagattacaaaaggaaaatatctaaaactattttctctttgcccttaccactcccagaaacataagtgaccaatttaaaatgctagggaacaggcttacaacataggtaaaactcgcaaacacagttcaaggtaggctcataaagttgtgaaaagggtttcatatgccctttagttttcatttgggattcatccaaagaccatgggtggatgctgtcttctctcttcttgatccctttgattcatggacactagactccctttgccatttcttctgaaccggccctcctgtggactagcacaacttccttgcccactgtttcttcctttctgtgcctttgagaccccttaaggttttccctcatgcgattactagaaaatggcaggaatcaacaaaatggagacctcccactgtttttgctaaagttacaggaacacgatccctagttttcattgatagtaacgctgtttctaatttgtcttaaccacattcatgcttaccctgctgctcagctttctcagggaagcaactccaggaacactccttccactcccctctctaccaacagatgtcaggactgtcatttatctacacatttgtgttctttagaaaaaggcccaccccctgcacaagcacagcctcttgggcagataggtggctgggtcagtgcttaagacaggattctagtcttcacttgcctgtgcagctgggcgctgaccttccaggtagagcacagatggcacaaccccgaggcagccccaacttgcatttccctccctccaggggctattcctgtcttaggcgatttgtggggtgcagtgaatgaaactaaagagttgttgcacctgaaaaagacaccagtgattgtttattgggtagtcgattggagactttgatttttttttttttttttcacatgggaaagtcttagattccagtagatggaattgcaatcctttgcagtttgttctcattacagataatcaacatttcttttgtataattcaatacatgatcatcaagttaattggtaaatttttattgaaatttaaaacttgcatttttatatatgtgtatgtgtacacataaaaatattttttaccatatgaaaattgcagtagctaattttctgatttcctattttataatgatacatgggctggaaaaatgtagaacgtttttatattctagaaatttattttggaagtacatttttataagggtctaatctcacttttggaaaatgaaagcacaggaatgatggggtctggtttatgtgaacaagtgagtagaaacccctttggatcattttattactgcatttttatttggtgctttttaggaagtagatctttggtaccacttcactacgtagagcattcgaagttttatccatgttatatattgtactcctgtggcatgaaaaatagctcccaagatatagagaggagaggagtgaagaaaaggctgtggtttttttttgttttgttttgtttgccacttttttatctcctattcctcaccacatagtgctttttcctgaaaagctggactgagaattggccttgaatcaggtcagagtgttaactgtcaacatgaagtattttcacttcgcagcatcaactttcaagcataagtaaaaacacaacttgcatactttgatggagcttaattgtgtgagtagaatatgtagcaaagctttttaggattttcagaactagaatactttttaaggaattaaaagtgtttctggaagtcaaaaatgggaaagcaaaaagtagctgtcctccctaaagagctttagaagatagcttaacctgtaggtacatgttatgaaataaacacatttctaacaatacaagggagtaggggcagacctgtgttgagtatttgtgtgggttcttaattttgaaggacctccaatcactacattttgttaatactgccaataaaatcattttcaacttattttttaaagtaggttttcttactttggtggaccagaagtgagagattgttatatttaggatataggcaaatacagtaaaagttaaaaaaaaaaaacctgacccaaagtatactctgatagactatattatattcaattttgtatccccagtcgagaacatcttgtaagccttcattaagggccacctgctgtctgttgaactagactgaacaaaatatattttctcacaagctccatccctttttctttaggacatgttatatataatccatctcagaagttgaagatgtgatgttgctcggcctttggaataatttttaaatctgtaaatgtctatatgagcagaaacaaaacattgtgtaacatgttttaagcattattgtaattcctgtgttaacagtttgtgtgtctgctgctctggttttgaaacatgtttgtatatagatacaggagttggcataaattttgttaaataaagcaacaaaaattttctttgccctttgatttcaa

SEQ ID NO: 3222 - DNA, 527 bp, Homo sapiens
gacctacagcgggcgcggcgccggcggtctgcggccggcggtgtagacgccccttcgccgggacctggcacccgaatccggcctgccggtgttacctggaatgtcagagagctgaaagcagtcatattttgggatcatgcacctactgcggcagtatataaagaaagataattaagtatgcacccaagaagtagctgcgcccctacccatcacaaactgtatagaaggatatctcctaaggattttatcatgtgaaaactttctgaattttagttggctctttttagaaatgcagataagatgaaggatattggacagcagctatacactacacacttgaacggcggacataattccttgaccatgtcacccaaacagcctgatgctaatggagcacctcggccaaatagacaagaagcacaaacccttttgtatcaaggctcagaggcagaggctgccatgatgaccattgctacatgtgcaaagtgcaaaagtgttcacaagatctctcttcaagatttgcagaa

SEQ ID NO: 3223 - DNA, 6810 bp, Homo sapiens
aatcaggcgcgcagccagggaggaaggggcggcttccggaatctggcgcggcctttgtctcacttcagccagagcgcggggttagggcttcattgccttgtgtcctctgctccgggagacttcggtgattctgccactcactccgtcgctctgtgacctgctggcattgaatgatttatagctaagactccaggacacccctgaagccgagaaatggaactcttaacattcagggatgtggccatagaattctctccagaagagtggaaatgcctagaccctgcccaacagaatttatatagagatgtgatgttggagaactacagaaacctcgtctccctggctgtgtattcttattacaaccaaggcattttaccagagcaaggcatacaagattcattcaaaaaagcaacactgggaagatatgggagctgtggccttgaaaatatatgcttatggaaaaactgggaaagtataggtgaaggtgaaggacaaaaggaatgttataatctatgtagccaatatttgacaactagtcataacaaacatttaactgtgaaaggagacaaagaatatagaatatttcagaagaagcctcagtttctgtcagctgctcctacagaaccatgtattcctatgaataaatatcaacataaatttttgaaatctgtcttttgtaataaaaatcagataaattttaaccatgactcaaatattagtaaacatcatagtactcattttctagaaaactattacaattgtaatgaatgtgaaaaagtattttaccaatcctcaaagcttattttccctgaaaatatccatattcaaaaaaagccttacaactctaatgaatgtggtgaaacttctgacccattctcaaagcttactcaacatcaaagaatttatattggagagagctcacaaagatgtaataaaaaatgtataatagtctttagtcaatcacatctaaagggacataagataattaacactggagaaaaatcagtgaaatataaagaacgtggcaaagcttttaccaggggcttacatcttggacatcagaaaattcatactggagagaaaccttacaaatgtaaaaaatgtgacaaagcctttaacaagagttcacaccttgctcaacatcagagaatccatactggagagaagcctttcaagtgtaaggaatgtggcaaagcttttaacagaggctcataccttactcaacatcagagaatccatactggagagagagctttcaaatgtgaagaatgtggcaaagcctttaacagggggtcataccttactcaacaccagagaatccataccggagagaaacctttcagatgtaaggaatgtggcaaagcctttaatagaagctcatacgttactcagcatcagagaatgcatactggagagaaacctttcaagtgtaaggaatgtggcaaagcttttaacagagcttcacaccttactcaacatcagagaatccatactggagagaaacacttcaaatgtaaagaatgtggcaaagcctttaacaggggctcacaccttactcgacatcaaagaatccatactggagagaagtctttcaaatgtgaagaatgtggcaaagcttttatctggggctcacaccttactcaacatcagagagtccatactggagagaaattcttcaaatgtaaagaatgtggcaaagcttttaccaggagctcacaccttactcaacatcagagaattcatactggagagaaacctttcaaatgtaaagaatgtggcaaagcttttaacagacgctcaacccttactcaacatcaaataattcataccaggtagaaaccctgcaagtgtaaagaatgtgctaaaaccctaaactggtgctcacaccttactcaacattagaaaatcaatactggatagaaatcccatatgtgtaatgatttttgaaacatcaaaatgaagattaaataaaaattagaagtgtcactttagaaagaactaaggtgctagcacttccgtaaattactctgaatcagtgtgtttattataacaaataattcaaactcaattagataattaaattgtatgtttaaaaagagggacgacattgatggagaggcataattatattcaatgttcacttatttttgtaatcacagtattcatgattgagaaagtattattgatgtaattaaattcaaattaaccttttttttccccactgtggttgattattgctgtctctgacatgagagtcccttctacgttaggtaggcatcattcacatgtctcattcacatgtcatcattcacatgtctcatgacgtcattcacaagtttcccatggaagactaagagcattggcatataggatgtatgatgaaatctaaatggagttgctctttttgtttgacttacaacactgaatataagtcatatatgagttaggtgttcagaatattattgttctgcattaaagtgtgagacagaaacactctgagttttagatatgaatagttttaccaactacccattaaaaggtcttgctagtccattaatattctaatgtatcttcatagcagcaagttagaagtcctgaatgttactgtgataacaataaagaaatcacaaatatcagagagtggtgcaaataacttctctctggtagaacatagattattaattcaatcctctaaatacttaggctcagtttaagaaaagagagaacacatttttttaacataggtcatggtatcagaataagaatgctttttgaatgtttgcagtctgtaattttgatgattgaggaaactggattttgaaatgctttattcagtctgtaaacttaatttttttttaagaataaaatgaaatgtcttttaatttgttaacactgttgcttattgaataatgtcttatcctgacaaaaatgttaacttattccaccttgctcaagattccaggtagtaaatggtaatgatatactatcgggtatgtctagttcatgctgtctttagcatttttttacccttagtggtattaaactccaaatagtttggagaatgttgattccataagttattacttgttactctaacaagttccccaaggtgtgttgagtagttaattagcccttagctatttttaccaaacattaggttattaatttaaaattgtttgtttttaatgtaggtgtttactgctatgaatttctctgaacagtttgctgcatctcatgtttcgatatgtcataacttcattttcatttatctgaaaatattttccagtttcattttttctttaacacattaattaggagtatttttaatttccatatatttgtgagttccccccattttctgcattcatttatttttaatttccttttactaaagtcagggaaaatactttggattattttgatcctgttaattttattgacgttttcctgctgtatggcctagcatatggtctatcctggagaatgatttatgtgtacttctaattttgagtggaaaattctataaatttgagaattctatcagttcatatttgtttacagtgttcaagtgttatgttttcctgttgatcttcccactttttctgcccattatttacattggagtatagaagtttctatacttctgataaactccaaataatggatttgattatttaatctatttatagcctgtaatattatcagtatagttgaatttgcatcattttgctttctatttttatgtctcacgtatttttctttattcttcctttactgctttcttattactttccatataatcttttaatttatataattgttcatgtttttgaagttacttccttgttttctctagcccttatataccttatcagaatctgctttatatttatattaattccaatgagatataaaatattaccactatatagcttttttcccccaatttggattgaatttttaaaatattgtcttaatttagttttattgttttattaaaaaagctaaacttaacaaaattggttgtatattagtttaggtgaggttgttttgtaatgagaaaataatttacaacatatagagaataaattattattattttaaaaagtactctacattttgtatccttaccatttcctttgatagtttaaaattgtaattctctaaataagagatatattcataaatgtgacttgtaaatgttgaaatttatatgtttgctttttctgcattcagtaagggtagtagtttccagcatctgtgcctctttaaagtgaaagacaggggcaggcgtagtggctaatgcctgtaatcccagcacttcgggaggcccaggtgggtggatcacctgaggtcaggagttcgagactagcctagccaacttagtaaaaccctctctctaccaaaaatacaaaaaattagctgggtgtggtggtgggctcctgtaatcccagctacttgggaggctgagacaggaaaatcacttaaacctgagaggtggaggttgcagtgagccaagatcatgtcactgcactgcagcctgggcagcagagtgagactccatctctaaataagtaaattcagcctgggcaacatgtgagactccatctctaaataaataaataaatgaatgaatgaatgataggatggaattaaaatagtttgaaaacacaaattaacaaaatggtgttgacaaagattgttcatttgtggtctaccagggcataaaattctcaaaaaacataatcagtaggaaacctctttattcctgaatattagagaatattatatgtcttaaaattattcatgttgaaaagctctgcctttcatgcatttaggagaaaaagtagagggcaggaggtttatgtagactctggtctgtgcctgatttggggaatggaaagactcgacagaagaggccaggtcagccaagcagggctctgttgcgtgcaagattaactgctggtttgtctttgcagagctccacacagaacatcatcaaagaactgatggacacttcatctccctgggtgaggggcaggtgtaccatgctgtcatggccattcctgcctcgattggggtgtgggtgtagagatggtctctataaccagggcccagacatggctgagaaggccttctgccaggactccaccttgatgactcacaggactttgtgccttggctttccctattgagtgacccacagttttaatccaagggaccctgagtctgtttccttccttcagccccaccatttcaccccagcactgttcaggtgtacaatcggctttcacatatttgtaagaatatctaggaaaattatttatattttactttcacttcatgttatgaccatgagtgtttttgcatttgctagggctcattgttttaattggcccccctttatccctctgagtgcggaaataaatcagccctaaatctggatgagacctgcaggtggactccatcagtgcaggcgtggtggggcagcaggaggagcccgtggtgcccaccttccagagctgccacctcttttacctcctcatgttccttcctgtgcacctagagagagttcacccccacccaacagctcctggacctgctgcccaaaaggtaagtgctccatccctccacagcacaagggggactcagccacctattatctgtgtcttgggaaagtcccttcacatttgtgggcttcagtttgcttctttggaactggggttctaagaagcctaacatgatatgattgtttcaagaactaaatgagataagctatggaaagtacttcagacttggccttgtagaaagcactgctgagggaatagattggttattcatattataaaactatttaaaactctagaaaactatagtaagatataagattataaaaatatcaaaactaagatattgacagtaatagaattaacctactcatctatttgcattttaccagattaattttttcttatgtgtgtgtgttctgtgcaattttattacatgtgtaggttcacctaccagaagattaactcgttttcctcttataaccacatccgcttcccttctccccaccatacccactctgattctgattctttgaaaccattaatttctatttctgcaaatttgtcattccaataatgttatataaatgaaatcataacctgtgcaaccttttgtaattggcccttttccttcagcataattccttggagattcatctaaattggtttatgttttagtttgttccttttgttattgctgtgggttttcatgtgtggatgttaccatgaaatactgtgtgtaacccttcactctttcaagaacatatttgttgttttcagtcagtgtgtggctattatgaataaaagtgctatgtacattcatgtactaggtttcatatgaatacatgttttcattactctggaaaatatttccagcatacaattcctggctcatagggtagttacaagtttaattttaatagaaactagcactctgttatccagagtgactatcattttacattcccatcatcaatgaatttctgttttttcaaatcctcttagccatactgactgatatgtattgatatcacattgttttaatgtacatttttctaaaggataataatgttgaactttatttaatgttctcatatgacatctgcctattatctctgatgaaatgtttattcatgtctgcatgttttctaattgtatttgttttcttgcaagttttgagagttctgtttatattctggttactagctcacataggcaataaataagttttttttccacaaag

SEQ ID NO: 3224 - DNA, 1972 bp, Homo sapiens
cacttcagccagagcgcggggttagggcttcattgccttgtgtcctctgctccgggagacttcggtgattctgccactcactccgtcgctctgtgacctgctggcattgaatgatttatagctaagactccaggacacccctgaagccgagaaatggaactcttaacattcagggatgtggccatagaattctctccagaagagtggaaatgcctagaccctgcccaacagaatttatatagagatgtgatgttggagaactacagaaacctcgtctccctggctgtgtattcttattacaaccaaggcattttaccagagcaaggcatacaagattcattcaaaaaagcaacactgggaagatatgggagctgtggccttgaaaatatatgcttatggaaaaactgggaaagtataggtgaaggtgaaggacaaaaggaatgttataatctatgtagccaatatttgacaactagtcataacaaacatttaactgtgaaaggagacaaagaatatagaatatttcagaagaagcctcagtttctgtcagctgctcctacagaaccatgtattcctatgaataaatatcaacataaatttttgaaatctgtcttttgtaataaaaatcagataaattttaaccatgactcaaatattagtaaacatcatagtactcattttctagaaaactattacaattgtaatgaatgtgaaaaagtattttaccaatcctcaaagcttattttccctgaaaatatccatattcaaaaaaagccttacaactctaatgaatgtggtgaaacttctgacccattctcaaagcttactcaacatcaaagaatttatattggagagagctcacaaagatgtaataaaaaatgtataatagtctttagtcaatcacatctaaagggacataagataattaacactggagaaaaatcagtgaaatataaagaacgtggcaaagcttttaccaggggcttacatcttggacatcagaaaattcatactggagagaaaccttacaaatgtaaaaaatgtgacaaagcctttaacaagagttcacaccttgctcaacatcagagaatccatactggagagaagcctttcaagtgtaaggaatgtggcaaagcttttaacagaggctcataccttactcaacatcagagaatccatactggagagagagctttcaaatgtgaagaatgtggcaaagcctttaacagggggtcataccttactcaacaccagagaatccataccggagagaaacctttcagatgtaaggaatgtggcaaagcctttaatagaagctcatacgttactcagcatcagagaatgcatactggagagaaacctttcaagtgtaaggaatgtggcaaagcttttaacagagcttcacaccttactcaacatcagagaatccatactggagagaaacacttcaaatgtaaagaatgtggcaaagcctttaacaggggctcacaccttactcgacatcaaagaatccatactggagagaagtctttcaaatgtgaagaatgtggcaaagcttttatctggggctcacaccttactcaacatcagagagtccatactggagagaaattcttcaaatgtaaagaatgtggcaaagcttttaccaggagctcacaccttactcaacatcagagaattcatactggagagaaacctttcaaatgtaaagaatgtggcaaagcttttaacagacgctcaacccttactcaacatcaaataattcataccaggtagaaaccctgcaagtgtaaagaatgtgctaaaaccctaaactggtgctcacaccttactcaacattagaaaatcaatactggatagaaatcccatatgtgtaatgatttttgaaacatcaaaatgaagattaaataaaaattagaagtgtcactttagaaagaactaaggtgctagcacttccgtaaattactctgaa

SEQ ID NO: 3225 - DNA, 1109 bp, Homo sapiens
cccgcgcgcgcgcacactcgcgagccccggcgacatgcaaatgagctggctccagtgcccagacccaagccccccactgctcaatggacacccccagcccagacccgttgccttcgcctttgcccggggaggaagagaaacctctggccttatctcctcctgttccccggggccgccgaggccgtcgtcctgggggagccacctcctcaaatcggacactcaaggcctccctccctcgcaagcggggccgcccccccaagtcagggcaggagcccccactggtgcaggtgcagggggtgacagccccagtaggcagcagtggcgggagcgacctcctcctgatcgatgatcagggtgtgccctatacggtctctgaaggttcagcggctgggcctgagggctctggccccaggaaggccccacacttctgcccggtgtgcctgcgggccttcccctacctctccgacctggagcgccacagcatctcgcactcagagctgaagccgcaccagtgcaaggtttgcggcaagaccttcaagcgctccagccacctgcggcggcactgcaacatccatgccggcctgcggcccttccgctgcccgctgtgcccccgccgcttccgcgaggcgggcgagctggcgcaccaccaccgcgtgcactcgggggagcgcccgtaccagtgccccatctgccggctgcgctttacagaggccaacacgctccggcgccatgcgaagcgcaagcacccggaggccatgggggtacccctgtgtgcaccagatccagggtctgaaccgccgtgggacgaggagggcatcccggccacagcaggggccgaggaggaggaggagacagaggggaaaggggagccggcctgacccacacccccggccatcgctccctgggccaggtttagagcagggagtttggctggtgctgggcctgagccagggggccgggacacccttgtttccggtggtcttcccgttgtgggagcaggtggagggtggagacctaaactttggggtccagctgccttcagcccccctcccccagactaacagacccttggaggcaggggctgtggaaataaatctctgcctgctggc

SEQ ID NO: 3226 - DNA, 594 bp, Homo sapiens
atgtcatcccttacatatcatcatcgacttcatactggagagaaaccttacaaatgtgaagaatgtgacaaagctttcagacacaattcagcccttcaaagacataggagaattcatactggagagaaaccacataagtgtaatgagtgtggcaagacctttagtcagaagtcataccttgcatgccatcgtagcattcatactggaaagaaaccttacgaatgtgaagaatgtgacaaagctttcagtttcaaatcaaaccttgaaagtcataggataactcatactggagagaaaccatacaagtgtaatgattgtggcaagaccttcagtcatatgtcaacccttacatgccatcgtagacttcatactggagagaaaccttacaagtgtgaagaatgtgatgaagctttccgtttcaaatcaagtcttgaaagacataggagaattcataatggagagaaactgtacaaatgtaatgagtgtggcaagaccttcagtcaggagttatcccttacctgccattgtagacttcatagtggagagaaaccttgcaagtgtggagaatgtgacaaggcttacagtttcaaataa

SEQ ID NO: 3227 - DNA, 6107 bp, Homo sapiens
acgcgcgcaaacccggaagcagatcgcgtggagtgaaggtccctcagcggcgcaaatgctgaccttggagttgggaatcttctaagtctgaagcttcctgcctgacagggtctattgacattcagggatgtggccatagaattctctcaggaggagtggaaatgcctggaccctgctcagaggactctatacagggacgtgatgctggagaattataggaacctggtctccctgggtatctcttccaaatgcacaatgaaggagttctcatcaacagcacaaggcaatacagaagtgatccacacagggacattgcaaagacatgaacgtcatcacattggagatttttccttccaggaaattgagaaagatattcataactttgagtttcagtggcaagaagatgaaagaaatggccatgaagcacccatgacaaaaatcaaaaaattgatgggtagtacagagcaatatgatcacaggcatgctggaaacaagcctattaaatatcagcttggatcaagctttcattcacatctgtctgaactccacatatttcagcccaaagggaaaattaataatcaagtggagaagtctatcaacgatgcttcctcggtttcaacagcccaaagaatttcttgtaggcccaaaacccatatatctaataactatggggataattttctgaattattcattactcacacaaagacaggaagtacgcatgagagaaaaatctttccaatgtattgagagtggcaaagcctttaattatagctcactcttaaggaaacatcagattattcatctaggagagaaacaatataaatgtgatgtatgtgacaaggtctttattcggaagcgataccttgcacgccatcgtagatgtcacactggtgagaaaccttacaagtgtaatgagtgtggcaagtccttcagtcagatgtcatcccttacatatcatcatcgacttcatactggagagaaaccttacaaatgtgaagaatgtgacaaagctttcagacacaattcagcccttcaaagacataggagaattcatactggagagaaaccacataagtgtaatgagtgtggcaagacctttagtcagaagtcataccttgcatgccatcgtagcattcatactggaaagaaaccttacgaatgtgaagaatgtgacaaagctttcagtttcaaatcaaaccttgaaagtcataggataactcatactggagagaaaccatacaagtgtaatgattgtggcaagaccttcagtcatatgtcaacccttacatgccatcgtagacttcatactggagagaaaccttacaagtgtgaagaatgtgatgaagctttccgtttcaaatcaagtcttgaaagacataggagaattcataatggagagaaactgtacaaatgtaatgagtgtggcaagaccttcagtcaggagttatcccttacctgccattgtagacttcatagtggagagaaaccttgcaagtgtggagaatgtgacaaggcttacagtttcaaataaaatcttgaaatacgtcagaaaattcatactggagagaaatgttataagtgtaatgattgtggcaagatcttcagtcatacgtcatccattgtataccatcataaatttcatagtggagagaaaccttacaaatgtgaagaatgtgatgaagctttcagtttcaaatcaaaccttgaaagacataggagaattcacactggtgagaaaccttacaggtgtaataggtgtggcaagaccttcagtcatacatcatcccttacatgccatcatagacttcatactggagagaaaccttacaaatgtgaagaatgtgatgaaactttcagatacaaatcaaatcttgaaagacataggagaattcataatggagagaaaccgtacaagtgtaatgagtgtggcaagaccttcagtcagaagtcatgccttacacgccatcatagacttcatactggaaataaatcttataagtgtaatgagtgtggcaagaccttcagtaaggagttaacacatgccatcatagacgtcatactggagagaaaccttagaagtgcaatgagtgtggcaaaacctttcataggcagtcagcgcttatttaccatcaagcaatccatggcagagggaaactttacaaatgtaatgattgtcaccacgtcttcagtaatgctacaactattgcaaatcattggagaatccataataaagagagaccttacaagtgtgataaatgtgacaaatttttcagacatcgttcataccttgcagttcacgggcgaactcatgctggagagaaaccttacaaatgtgaagaatgtgataaagctttcagattcaaatcaaaccttgaaagtcataggagaattcatactagagagaaaccttacaagtgtaatgagtgtggtaagatgttcagtcaaaattcggcccttgtaattcataaggcaattcatactggagagaaaccttacaagtgtaatgaatgtggcaaggtttttaatcgcaaagcaaagcttgcatgtcatcatagacttcatactggagagaacgcttgcaagtgtaataaatgtggcgaggtttttaatcaacaagcacaccttgcacgtcatcatagaactcatactggagagaaacattacaagtgtaatgagtgtggcaagacctactctcacaattcagtccttgtaattcataagacaattcacactggggagaaaccttacaagtgtaatgagtgtggcaaaaccttccatcacaattcagtccttgtaattcataaaacaattcatactggagagaaacaagcgtaatgaatgtggcgaggttttcaatcaacaagcacacgttgcacgtcatcatagaattcatactggagagaaaccttagaaatgtgaagaatgtgacaaagtttacagtcgcaaatcaaacctcgaaagacaggagaattcatactggagagaaaccataaaaatgtaagagtttttgacaaggctttcggacgtgattcacacctggcacaacatcccagagttcacactggagagaaaccttacaagtgtaatgagtgtgtcaaagcctttagtgggcagtcaacacttattcaccatcaggcaatccgtagtgtagggaaacttgactaacgtaatgattctcacaacgtcttcagtaatgctacaaccattgtaaatcactggagaagccataatgaagagagatcttacaaatgtaataattgtggcaaatttttcagacatcgttcatacattgccgttcattggcgaactcatgctggagagaaatcttacaatgtcatgattgtggcaaggtcttcagtcaagcttcatcttttgcaaaacaggagaattcatacaggagagaaacctcacaagtgtgatgatcgtggcaaagcctttacttcacattctcacctcattagacatcagagaatccatactggacagaaatcttacaaatgtcatcagtgtggcaaggtcttcagtccgacttcactccttgcagaatatcagaaaattcatttttcaggtaattgttcccaatgcaatgaatatagcaaaccatcaagcattgattgacattagagtcagttcagcattgacttgagtttgagttgacttaacattgagttcaagccttaattgacattaaagtgtttatgttaagaggactgggctgtgtggcatggctcacgcctgtaatcccagcactttggtaggccaaggtgggtaaatcacttgaggtcaggagtttgagatcagcctggacaacagacctgagccacttttcccagcctgttttttgtttctttaacaaaaactgatagggatttttatgggtatcgtattgaatctagattacattgggttatataatcatttaacatattaatttttccaaaccatcaatatgggttgtgtctctatatatgtttttaatcattttgatcaatttttgttgatttcaaggtacaaacgtctcacctttttacgtttattcctaagtatttcttattttaagttctccagcaaatggaagtgtgttaaaattttcttttaaaattgtttattattaaaatatggaaattcaactaatttttggtgctgatactgtattgtgcaaatccactgaatatgtttgttagttccagtactattttggttgagtctgtgattttctacacagaaggtcatgtcgtctacaaacaaatgtaattttacttctttctttctgatttggatgagtttgatttcttttgctatttaattgctctggctaggacaggcagtattgattgaatagaaggggtgagagcattcttgcatcatgtgagatcgtacaggaaagcattccattttccctgcttggttatttactcatttgtcatttcatggatgttctttctattgttgaggtaaatttccttttctattttgtttaggatttctatgatgactggattttgaattttgtggaacgctttttctccatctactaaggtgatgtggttttaatctttcattctgttctagtggtatataacattgatttgcttgaatatgttgaaccatccttgcatcccagaaataactggcacttgaatatctacatttttttaatatcctcttgaatacagttttctaggacaagggatcttcaagaagttctggaaaaatacatattatgagaaaattgtgcatgaatttcacaatttttgcaccaaaataaactagtgctagtctgttataacatgtctgaacaggctctagtttgatgccctcaaaaggataagacatgagtataaaaagagactccatcaaagcaatataaattctgatgaaatttaaacaagaagaaacattaaatttatgatgagaccagatgcagtggctcaggcctgtaatcccagcattttcagaggctgagacaggtgggccacatgagcccaggtattcaagaccagcctgggaaacgtggggaaatccccttttctacaaaaaatacaaaaattagctgggcatggtggcacatgcctgccgtctcagttattgtgaagtctgtgcagggaggatggcatgaacctgggaggtcaagattgcagtgagctatgatcatgccactgcactccagcatgggtgatggagagagatactgtcttaaaaaaagaatacttgtggtaacgtttgggtagaggaataatgaaatcattgatgctttataaaaaggttatggggacaatgcccaaaagaaataaacagtttgtaaacggataacttattttgagttagggcaagacaatgttgacagtgatgcatgaagcagcaggcagaccttccacatcatttttacagaaaaaaaaattaatcttgttcatgctgcaatgaagaggactgacagcaaacagcagaaacatagtcagaatttagagaacagcctggttaacatggtgaaacaccatctctagtaaaaatacaaaaattagctcagcatggtggcatgcgcctgtaatcccagctactcaggaggctgaggcaggggaatctcttgaacccaggaggtggaggatgcagtgaactgagatggcaacattacactctagcctgagcaacaagagcaaaactccatctcaaaaaaaaaaaaattgtcaagttccttctcttccattctttgccatcgtggtgtgtgcttgactctgcttcttgccacatcttctcagaagactttcaggattaagcgattcctggccaagaaacaaaagcaaaaccatcccactcccctgtggattcagatcaaaactggtaataaaatcaggtacgactccaaaaggagacattggagaagaaccaagctgggtctataaggaattgcatgtgagatggcacacatatttatgctgtctgagcatcacaatcacgttaccatatcaagctgaaaatgtcaccactatctggacagttggacatgttttattgggaatatgttttttctctgtaaatttgttataaacgcattggttggctgtgttcagtaataaacgtgagacttttcatttcaaaacaaaagtc

SEQ ID NO: 3228 - DNA, 3890 bp, Homo sapiens
ccttccccgctcagacgcgcgcaaacccggaagcagatcgcgtggagtgaaggtccctcagcggcgcgattgacatctaaagactcttggtacatgaggaagaaacccggaaaaggaaagcagaggagtcagggatggctcttcctcagggtctattgacattcagggatgtggccatagaattctctcaggaggagtggaaatgcctggaccctgctcagaggactctatacagggacgtgatgctggagaattataggaacctggtctccctgggtatctcttccaaatgcacaatgaaggagttctcatcaacagcacaaggcaatacagaagtgatccacacagggacattgcaaagacatgaacgtcatcacattggagatttttccttccaggaaattgagaaagatattcataactttgagtttcagtggcaagaagatgaaagaaatggccatgaagcacccatgacaaaaatcaaaaaattgatgggtagtacagagcaatatgatcacaggcatgctggaaacaagcctattaaatatcagcttggatcaagctttcattcacatctgtctgaactccacatatttcagcccaaagggaaaattaataatcaagtggagaagtctatcaacgatgcttcctcggtttcaacagcccaaagaatttcttgtaggcccaaaacccatatatctaataactatggggataattttctgaattattcattactcacacaaagacaggaagtacgcatgagagaaaaatctttccaatgtattgagagtggcaaagcctttaattatagctcactcttaaggaaacatcagattattcatctaggagagaaacaatataaatgtgatgtatgtgacaaggtctttattcggaagcgataccttgcacgccatcgtagatgtcacactggtgagaaaccttacaagtgtaatgagtgtggcaagtccttcagtcagatgtcatcccttacatatcatcatcgacttcatactggagagaaaccttacaaatgtgaagaatgtgacaaagctttcagacacaattcagcccttcaaagacataggagaattcatactggagagaaaccacataagtgtaatgagtgtggcaagacctttagtcagaagtcataccttgcatgccatcgtagcattcatactggaaagaaaccttacgaatgtgaagaatgtgacaaagctttcagtttcaaatcaaaccttgaaagtcataggataactcatactggagagaaaccatacaagtgtaatgattgtggcaagaccttcagtcatatgtcaacccttacatgccatcgtagacttcatactggagagaaaccttacaagtgtgaagaatgtgatgaagctttccgtttcaaatcaagtcttgaaagacataggagaattcataatggagagaaactgtacaaatgtaatgagtgtggcaagaccttcagtcaggagttatcccttacctgccattgtagacttcatagtggagagaaaccttgcaagtgtggagaatgtgacaaggcttacagtttcaaataaaatcttgaaatacgtcagaaaattcatactggagagaaatgttataagtgtaatgattgtggcaagatcttcagtcatacgtcatccattgtataccatcataaatttcatagtggagagaaaccttacaaatgtgaagaatgtgatgaagctttcagtttcaaatcaaaccttgaaagacataggagaattcacactggtgagaaaccttacaggtgtaataggtgtggcaagaccttcagtcatacatcatcccttacatgccatcatagacttcatactggagagaaaccttacaaatgtgaagaatgtgatgaaactttcagatacaaatcaaatcttgaaagacataggagaattcataatggagagaaaccgtacaagtgtaatgagtgtggcaagaccttcagtcagaagtcatgccttacacgccatcatagacttcatactggaaataaatcttataagtgtaatgagtgtggcaagaccttcagtaaggagttaacacatgccatcatagacgtcatactggagagaaaccttagaagtgcaatgagtgtggcaaaacctttcataggcagtcagcgcttatttaccatcaagcaatccatggcagagggaaactttacaaatgtaatgattgtcaccacgtcttcagtaatgctacaactattgcaaatcattggagaatccataataaagagagaccttacaagtgtgataaatgtgacaaatttttcagacatcgttcataccttgcagttcacgggcgaactcatgctggagagaaaccttacaaatgtgaagaatgtgataaagctttcagattcaaatcaaaccttgaaagtcataggagaattcatactagagagaaaccttacaagtgtaatgagtgtggtaagatgttcagtcaaaattcggcccttgtaattcataaggcaattcatactggagagaaaccttacaagtgtaatgaatgtggcaaggtttttaatcgcaaagcaaagcttgcatgtcatcatagacttcatactggagagaacgcttgcaagtgtaataaatgtggcgaggtttttaatcaacaagcacaccttgcacgtcatcatagaactcatactggagagaaacattacaagtgtaatgagtgtggcaagacctactctcacaattcagtccttgtaattcataagacaattcacactggggagaaaccttacaagtgtaatgagtgtggcaaaaccttccatcacaattcagtccttgtaattcataaaacaattcatactggagagaaacaagcgtaatgaatgtggcgaggttttcaatcaacaagcacacgttgcacgtcatcatagaattcatactggagagaaaccttagaaatgtgaagaatgtgacaaagtttacagtcgcaaatcaaacctcgaaagacaggagaattcatactggagagaaaccataaaaatgtaagagtttttgacaaggctttcggacgtgattcacacctggcacaacatcccagagttcacactggagagaaaccttacaagtgtaatgagtgtgtcaaagcctttagtgggcagtcaacacttattcaccatcaggcaatccgtagtgtagggaaacttgactaacgtaatgattctcacaacgtcttcagtaatgctacaaccattgtaaatcactggagaagccataatgaagagagatcttacaaatgtaataattgtggcaaatttttcagacatcgttcatacattgccgttcattggcgaactcatgctggagagaaatcttacaatgtcatgattgtggcaaggtcttcagtcaagcttcatcttttgcaaaacaggagaattcatacaggagagaaacctcacaagtgtgatgatcgtggcaaagcctttacttcacattctcacctcattagacatcagagaatccatactggacagaaatcttacaaatgtcatcagtgtggcaaggtcttcagtccgacttcactccttgcagaatatcagaaaattcatttttcaggtaattgttcccaatgcaatgaatatagcaaaccatcaagcattgattgacattagagtcagttcagcattgacttgagtttgagttgacttaacattgagttcaagccttaattgacattaaagtgtttatgttaagaggactgggctgtgtggcatggctcacgcctgtaatcccagcactttggtaggccaaggtgggtaaatcacttgaggtcaggagtttgagatcagcctggacaacagacctgagccacttttcccagcctgttttttgttt

SEQ ID NO: 3229 - DNA, 1868 bp, Homo sapiens
gcaaacccggaagcagatcgcgtggagtgaaggtccctcagcggcgcgattgacatctaaagactcttggtacatgaggaagaaacccggaaaaggaaagcagaggagtcagggatggctcttcctcagggtctattgacattcagggatgtggccatagaattctctcaggaggagtggaaatgcctggaccctgctcagaggactctatacagggacgtgatgctggagaattataggaacctggtctccctgggatttctatgatgactggattttgaattttgtggaacgctttttctccatctactaaggtgatgtggttttaatctttcattctgttctagtggtatataacattgatttgcttgaatatgttgaaccatccttgcatcccagaaataactggcacttgaatatctacatttttttaatatcctcttgaatacagttttctaggacaagggatcttcaagaagttctggaaaaatacatattatgagaaaattgtgcatgaatttcacaatttttgcaccaaaataaactagtgctagtctgttataacatgtctgaacaggctctagtttgatgccctcaaaaggataagacatgagtataaaaagagactccatcaaagcaatataaattctgatgaaatttaaacaagaagaaacattaaatttatgatgagaccagatgcagtggctcaggcctgtaatcccagcattttcagaggctgagacaggtgggccacatgagcccaggtattcaagaccagcctgggaaacgtggggaaatccccttttctacaaaaaatacaaaaattagctgggcatggtggcacatgcctgccgtctcagttattgtgaagtctgtgcagggaggatggcatgaacctgggaggtcaagattgcagtgagctatgatcatgccactgcactccagcatgggtgatggagagagatactgtcttaaaaaaagaatacttgtggtaacgtttgggtagaggaataatgaaatcattgatgctttataaaaaggttatggggacaatgcccaaaagaaataaacagtttgtaaacggataacttattttgagttagggcaagacaatgttgacagtgatgcatgaagcagcaggcagaccttccacatcatttttacagaaaaaaaaattaatcttgttcatgctgcaatgaagaggactgacagcaaacagcagaaacatagtcagaatttagagaacagcctggttaacatggtgaaacaccatctctagtaaaaatacaaaaattagctcagcatggtggcatgcgcctgtaatcccagctactcaggaggctgaggcaggggaatctcttgaacccaggaggtggaggatgcagtgaactgagatggcaacattacactctagcctgagcaacaagagcaaaactccatctcaaaaaaaaaaaaattgtcaagttccttctcttccattctttgccatcgtggtgtgtgcttgactctgcttcttgccacatcttctcagaagactttcaggattaagcgattcctggccaagaaacaaaagcaaaaccatcccactcccctgtggattcagatcaaaactggtaataaaatcaggtacgactccaaaaggagacattggagaagaaccaagctgggtctataaggaattgcatgtgagatggcacacatatttatgctgtctgagcatcacaatcacgttaccatatcaagctgaaaatgtcaccactatctggacagttggacatgttttattgggaatatgttttttctctgtaaatttgttataaacgcattggttggctgtgttcagtaataaacgtgagacttttcatttc

SEQ ID NO: 3230 - DNA, 3978 bp, Homo sapiens
agccgattgcagggagaaactgttttcgcagcagtgcgcctcccttttccagccaccggttctcctgaccccgagtgtggggggtgacttcagtctcctgacatccagtgttctctcgagccagtttccagcccacagaaaatgagctcttccggaagtgggcatcttattccaatcccctccctgtgaatgtgtggagaaaaagagatgggaacgaggcagaggaaatagagaaattttgaaagagaaatgaagaatgagagacccattaacagaaggcaaagtagaaggttcacaaattttaagaaagggagaataaagtgaaaaaaatctcagaaggaatccactcaacagacgaggattcacttccaaagagacatattatgcaaggaagcaacttggaagaggaaagaaaagaagtcaggaatggcccttactcagggacccttgaaattcatggatgtggccatagagttctctcaggaagagtggaaatgcctggaccctgcgcagaggactttatacagggacgtgatgttggagaattataggaacctggtctccctgggaatctgtcttcctgacctgagtgttacctccatgttagagcaaaagagagatccctggactctgcagagtgaagagaaaatagcaaacgatccagacggcagggagtgcatcaaaggtgtgaacacagagaggagctctaaattgggaagtaatgcaggaaacaagccttgtaaaaatcaacttggattcacttttcagttacatctgagtgatctacagctatttcaagctgaaaggaaaatttctgggtgtaagcattttgaaaaacccgtcagtgacaattcctcagtttcaccgcttgaaaaaatttcttccagtgtcaaatcccaccttttaaataaatatagaaataattttgatcatgctccattacttccacaagaacagaaagcacacattagggaaaaagcttataaatgtaatgagcacggccaagtctttagagcatctgcaagccttactaaccaagtaatccataacgcagataatccttacaaatgcagtgaatgtggcaaggtctttagttgcagttcaaagcttgtgatacatcgaagaatgcatactggagagaagccttacaaatgtcatgaatgtggcaagctcttcagtagcaattcaaacctttcacaacatcaaagaattcatactggagagaagccttacaaatgtcatgaatgtgacaaggtctttcgaagcagttcaaagcttgcacaacatcaaagaattcatactggagagaagccttacaaatgtcatgaatgtgacaaggtcttcaatcaaattgcacaccttgtacgacatcaaaaaattcatactggagagaaaccttacagttgtaataaatgtggcaaggtctttagtcgccattcatatctagcagaacatcaaacggttcatactggtgagaaaccttacaaatgtgaagaatgtggcaaagcattttcagtgcgttccagcctcataacccatcagttaattcacactggaaggaaaccttacaaatgtaaagaatgtgacaaggtctttgggcgcaagtgtttcctgacctctcatcagagaattcatactagagagagaccttatggatgcagtcagtgtggcaagatctttagtcagaaatcagaccttatacgacatcgaaaaactcatactgatgagaagccttacaaatgtaataaatgtggcacagcgtttagagagttttcagaccttactgcccattttctaatccatagtggagagaaaccttatgaatgtaaagaatgtggcaaagtcttcaggtacaagtcttctctaaccagtcatcatagaattcatactggagagaagccttacaaatgtaacagatgtggcaaggtcttcagtcgcagttcaaacctggtatgccatcagaaaattcatacaggagaaaagccttacaaatgtaatcaatgtggcaaggtctttaatcaagcatcataccttacaagacatcaaataattcatactggagagaggccttacagatgtagtaaatgtggcaaagcatttcgagggtgttcaggccttactgcccatcttgcaatccatactgaaaagaaatctcatgagtgtaaagaatgtggcaagatcttcactcagaagtcttccctcaccaatcaccatagaattcacattggagagaaaccttacaaatgcaccctgtgcagtaaggtcttcagtcacaattctgaccttgcacagcatcagagagttcattcatgagagtccctacaaactgtatggcaaaaccatcatcatgagttctagcattaatcaacatcagtgagtccatactaagtggaaatcatataaatgaaatgtatgtgacacaggctttatcaaggcctgccaaatcactggacatcaccacatcactgtggaggatgaaagcacacagatgaattgtgtgtacttgggctattattcaaggaccattgctatagaacacgataggatttacacaagaagtaactctgtctctggttctctgatactaatctatgatattgcatgatgcagaataatgctaagtcaaaatatgttgaatctcatgacctgatgtatatcaaaggtgcaacggcttgtaaatgaccagttttattcaggctataaagcattcaattatttggggcttatagaaaaggctactttactctttgtgacttcgaaatcttttcatgtgccttccatacaggccattcactgtggtccctgggaaagaatcagtaggatgacagggctgacttcattagctgaggattatttctatccaatttcctgatgaaggacattgccttttgagattaaatattgtctgatttagagagcatggaggtgggcagagtaacataaaactgatgaccgtcatcatactgttgcagttagcacactttctcctgacataagtgcacagagcttcagtgtccaccaactgaccatgaaatagagtatgctgtaatcttaaggcataggttattagtgggaagagagtaataggttgctagtgtctgattatatggtagaaataatgcaaggaaaaaggtagccaccttctccattgaacagcagtacctgctgtttagcaaagactgatgagaagtagacttttttttttttggagatagagtctcactctgttgcccaggctggagtgtagtggtgtgttcttggctcactgcaccctccgcctcctgggctcaagcagtccttctgccttagcctcctaagtagctgagactacagacgtgcgccaccacacccagttcatttttgtatttttagtagagacagtgtttaccatgttggccaggcaggtctccaactcctgacctcaagtgatatgttcacctcagcctcccaaagtgctgggattacaggcatgaaccatggtgcccagcctcatttttgaaatggaatagagaacagttatatcacagttgagagtttaatcaaaatgaccggatcagcatattctttttttagatgagacagagtttcgcccttgtcacccaggctgtagtgcggtggcgcgatctcggctcactgcaacctccgcctcccgggttcaagcaattctcctgcctcagcctcccaagtagctgggattacaggcgtgtaccaccatacccagctaatttttgtatttttagtagagatggggtttcaccacgttggccacactggtctcaaactcctgacctcaggcgatccatctgcctcagcctgaaagtgctaggattacaggcgtgagccaccacacctggccagctcagcatattcttaagtaggattcacatttaattcttggtattataagttgcaaccatttgatttagaatgtatgcagctctcatgtttgtagtaataaagtttcatttttcctaagta

SEQ ID NO: 3231 - DNA, 582 bp, Homo sapiens
agccgattgcagggagaaactgttttcgcagcagtgctttccagcccacagaaaatgagctcttccggaagtgggcatcttattccaatcccctccctgtgaatgtgtggagaaaaagagatgggaacgaggcagaggaaatagagaaattttgaaagagaaatgaagaatgagagacccattaacagaaggcaaagtagaaggttcacaaattttaagaaagggagaataaagtgaaaaaaatctcagaaggaatccactcaacagacgaggattcacttccaaagagacatattatgcaaggaagcaacttggaagaggaaagaaaagaagtcaggaatggcccttactcagggacccttgaaattcatggatgtggccatagagttctctcaggaagagtggaaatgcctggaccctgcgcagaggactttatacagggacgtgatgttggagaattataggaacctggtctccctgggaatctgtcttcctgacctgagtgttacctccatgttagagcaaaagagagatccctggactctgcagagtgaagagaaaatagcaaacgatccagacggc

SEQ ID NO: 3232 - DNA, 465 bp, Homo sapiens
agccgattgcagggagaaactgttttcgcagcagcctcccttttccagccaccggttctcctgaccccgagtgtggggggtgacttcagtctcctgacatccagtgttctctcgagccagtttccagcccacagaaaatgagctcttccggaagtgggcatcttattccaatcccctccctgtgaatgtgtggagaaaaagagatgggaacgaggcagaggaaatagagaaattttgaaagagaaatgaagaatgagagacccattaacagaaggcaaagtagaaggttcacaaattttaagaaagggagaataaagtgaaaaaaatctcagaaggaatccactcaacagacgaggattcacttccaaagagacatattatgcaaggaagcaacttggaagaggaaagaaaagaagtcaggaatggcccttactcagggacccttgaaattcatggatgtggcca

SEQ ID NO: 3233 - DNA, 2964 bp, Homo sapiens
ggaacttccggcgtcctccctgtggcgggcactttggcttgtgtcagttccatccgcgggtgccggatctggacctaggtgctgacagcgagaaggcgcgaggagagtcgttttctcagctgcacagccggggcctgacggtcgccggcggtggtgacagctttgctcttgtctccgcccggatcgtccaccgctcccggcccgctccgcccagagtccgatggcggcggcactgagggccccgacccagcaggtttttgtagcctttgaggatgtggccatttacttctcccaggaggagtgggagctccttgatgagatgcagaggctcctgtaccgcgatgtgatgctggagaactttgcagttatggcatccctaggttgctggtgtggagcagtagatgaggggacgccttctgcagagagcgtttctgtggaagaactgtcacagggcaggactccaaaggcagatacatccactgataagagtcacccctgtgagatttgtaccccagtcctgagagacattttacaaatgattgagctccatgcctcaccctgtggacagaaattgtacttgggtggagcatcaagagatttctggatgagttcaaaccttcaccagctccagaagcttgataatggagagaagctctttaaagtggatggggaccaggcctcatttatgatgaactgcaggttccatgtgtcaggaaaacccttcacgtttggggaagtcgggagggacttttcagccacctcaggacttctccagcatcaggtgactcccaccattgagagaccacacagcaggattagacacttgagagttcccactggacgaaagcctctcaaatacactgaatccaggaaatcttttagagagaaatctgtattcattcaacaccaaagagctgactctggagaaaggccttacaagtgcagtgaatgtgggaaatcctttagtcaaagttctggctttcttcgacacaggaaagcacacggtagaacaaggactcatgaatgtagtgaatgtgggaaatcatttagtcgcaaaactcacctaactcaacaccaaagagttcacactggagaaaggccttatgactgcagtgaatgtggcaaatcctttcgccaggtatctgtcctcattcaacatcaacgagttcacactggagaaaggccttatgagtgcagtgaatgtgggaaatcttttagccacagcactaacctctatcgtcacaggagtgcccacactagcacaaggccttatgagtgcagtgaatgtggaaaatcctttagccatagcactaacctctttcgacactggagagttcacactggagtaaggccttatgagtgtagtgaatgtgggaaagcatttagttgcaatatctaccttattcaccaccaaagatttcacactggagaaagaccttatgtgtgcagtgaatgtgggaaatcatttggccagaaatctgtcctcattcaacaccaaagagttcacactggagaaaggccttatgagtgcagtgaatgtgggaaagtttttagccaaagctctggcctctttcgacacagaagagctcacactaaaacaaagccttatgagtgcagtgaatgtgaaaaatcatttagttgcaaaactgacctcattcgacaccagacagttcacactggagaaaggccttatgagtgcagtgtatgtgggaaatcttttatccgaaaaacccacctcattcgacaccagactgttcacactaatgaaaggccttatgagtgcgatgaatgtgggaaatcctatagccaaagctctgccctccttcagcataggagagttcacactggagaaaggccttatgagtgcagagaatgtgggaaatcttttacccgcaaaaatcacctcattcaacacaagacagttcacactggagaaaggccttatgaatgcagtgaatgtggaaaatcctttagccaaagctctggcctcttaagacacagaagagttcatgtgcagtgaatgtgggaaattattttgtcacttttttttttttttttgagatggaattttgctcgtcacccaggctggagtgcaattgtgcaatctcagctcactgcaacctccgcctcctgggatcaagtgattctcctgccacagcctcctgagtacctgagattacaggcacccaccaccatgcccagctaatttttgtatttttaatagaaacaaggtttcaccatgttggtcaggctggtgttgaactcctgacctcaggtaatccacctgcttcagcctaccaaagtgctgggattacaggcgtgagccaccatgtccggcttgtgttgtgacatttaacacaagatttcccaaagaagaaaggccttatatatgctgtgaatgtgtttttgcttgttagtttgttttaacttggtatgacggcactggaggctagcctttgagaagagccttctctgatgtgactcatgtatccaaacatccatggatttcccataaatttgaggtatgtgggaagcatgtgtagctatgttgtactctctaaacctgcccagggaccttaccagattcgtgtcactgccagtttctgcggctgaagccttttcatcactacccgctgggagacccacagagtgtgcatcagtcaccaccccaacatgctcagggaggcagagttcttccattagttggaggaaagcacgagtagtctaagctcttaggggggtttctcatttcctcctgtggctacatagtgcatataactaccccagtgttggccccaggacctgatctgagttctgctggcagcttccagaggattgccttttttgaggacattgttgatctcaggcgatgcttgtgatgaagcattttttagcttccaccacttaccaggaactgcctgttaactggcttgtgcaatgataaaggccttttgtttaagtacc

SEQ ID NO: 3234 - DNA, 6696 bp, Homo sapiens
tctcgcccttgcacgggtcacgattatacaccttcgtgacctttagcgggcttacatatgtatctttttgtgttccgcaggctatgaccacctgctgtatgtacaatatgtgcttgttacatttgtacaccatctcccttctagaatttaaagacctagctattacatcttgtttactcaatatcattcccccattaaggaaaaaaaaaaacctacatgaactgaacatgccatgtttcaatctggccccagtggctttttctctgaaagcaaacgtgtgtcttttacaccagggctttctccccaccccagggggtgtcttccatccttttgtggctcagttgaaggcgaaaagggctccaaaccactaactaaccagaggagagccccttcttccacctccagggagaatttcagatttaatttgtccgaagatagcgtgctctcttcttactcatttgccatcattacgaggaaaacaaaccaccaccttggcttcaagatcctgggtagaggctcacggtcttttcaaccatctttggcgaggccttgcttccttccactcgaggtatgttctgtcttgtgctttttcttttagaagctactaaagggtgttggggatgcttctgactattatgaaggccaaaaggcctgttgactggggctgcttttaaccctttcctatttgctgagaatgcagccgtgtgacagtaactg[450 bp omitted]cgatctccagtgctgaagagtttgatgacgacgagaagattgaggtggatgacccccctgacaaggaggacatgcgatcaagcttcaggtcgaatgtgttgacggggtcggctccccagcaggactacgataagctgaaggcactcggaggggaaaactccagcaaaactggactctctacgtcaggcaatgtggagaaaaacaaagctgttaagagagaaacagaagccagttctataaacctgagtgtttatgaaccttttaaagtcagaaaagcagaggataaattgaaggaaagctctgacaaggtgctggaaaacagagtcctagatgggaagctgagctccgagaagaatgacaccagcctccccagcgttgcgccatcaaagacaaagtcgtcctccaagctctcgtcctgcatcgctgccatcgcggctctcagcgctaaaaaggcggcttcagactcctgcaaagaaccagtggccaattcgagggaatcctccccgttaccaaaagaagtaaatgacagtccgagagccgctgacaagtctcctgaatcccagaatctcatcgacgggaccaaaaaaccatccctgaagcaaccggatagtcccagaagcatctcaagtgagaacagcagcaaaggatccccgtcctctcccgcagggtccacaccagcaatccccaaagtccgcataaaaaccattaagacatcttctggggaaatcaagagaacagtgaccagggtattgccagaagtggatcttgactctggaaagaaaccttccgagcagacagcgtccgtgatggcctctgtgacatcccttctgtcgtctccagcatcagccgccgtcctttcctctccccccagggcgcctctccagtctgcggtcgtgaccaatgcagtttcccctgcagagctcacccccaaacaggtcacaatcaagcctgtggctactgctttcctcccagtgtctgctgtgaagacggcaggatcccaagtcattaatttgaagctcgctaacaacaccacggtgaaagccacggtcatatctgctgcctctgtccagagtgccagcagcgccatcattaaagctgccaacgccatccagcagcaaactgtcgtggtgccggcatccagcctggccaatgccaaactcgtgccaaagactgtgcaccttgccaaccttaaccttttgcctcagggtgcccaggccacctctgaactccgccaagtgctaaccaaacctcagcaacaaataaagcaggcaataatcaatgcagcagcctcgcaaccccccaaaaaggtgtctcgagtccaggtggtgtcgtccttgcagagttctgtggtggaagctttcaacaaggtgctgagcagtgtcaatccagtccctgtttacatcccaaacctcagtcctcccgccaatgcagggatcacgttaccgacgcgtgggtacaagtgcttggagtgtggggactcctttgcacttgaaaagagtctgacccagcactacgacagacggagcgtgcgcatcgaagtaacgtgcaaccattgtacaaagaacctcgttttttacaacaaatgcagcctcctttcccatgcccgtgggcataaggagaaaggggtggtaatgcaatgctcccacttaattttaaagccagtcccagcagatcaaatgatagtttctccgtcaagcaatacttccacttcaacttccactcttcagagccctgtgggagctggcacacacactgtcacaaaaattcagtctggcataactgggacagtcatatcggctccttcaagcactcccatcaccccagccatgcccctagatgaagacccctccaaactgtgtagacatagtctaaaatgtttggagtgtaatgaagtcttccaggacgagacatcactggctacacatttccagcaggctgcagatacgagtggacaaaagacttgcactatctgccagatgctgcttcctaaccagtgcagttatgcatcacaccagagaatccatcagcacaaatctccctacacctgccctgagtgtggggccatctgcaggtcggtgcacttccagacccacgtcaccaagaactgtctgcactacacgaggagagttggttttcgatgtgtgcattgcaatgttgtgtactctgatgtggctgctctgaagtctcacattcaaggttctcactgtgaagtcttctacaagtgtcctatttgtccaatggcgtttaagtctgccccaagcacacattcccacgcctacacacagcatcctggcatcaagataggagaaccaaaaataatatataagtgttccatgtgcgacactgtgttcaccctgcaaaccttgctgtatcgccactttgaccaacacattgaaaaccagaaggtgtctgttttcaagtgtccagactgttctcttttatatgcacagaagcaacttatgatggaccatatcaagtctatgcatggaacattgaaaagtattgaagggcctccaaacttgggtataaacttgcctttgagcattaagcctgcaactcaaaattcagcaaatcagaacaaagaggacaccaaatccatgaatgggaaagagaaattggaaaagaaatctccatctcctgtgaaaaaatcaatggaaaccaagaaagtggccagtcctgggtggacgtgttgggagtgtgactgcctgttcatgcagagagatgtgtacatatcccacgtgaggaaggagcacgggaagcaaatgaagaaacacccctgccgccagtgtgacaagtctttcagctcgtcccacagcctgtgccggcacaaccggatcaagcacaaaggcatcaggaaagtgtacgcctgctcgcactgcccagactccagacgtacctttaccaaacgtttgatgctggagaagcacgtccagctgatgcatggcatcaaggaccctgacctgaaagaaatgacagatgccaccaatgaggaggaaacagaaataaaagaagacactaaggtccccagtcccaagcggaagttggaagaaccagttctggagttcaggcctccccgaggagcaatcactcaaccactgaaaaagctgaaaatcaatgtttttaaggttcacaagtgtgccgtgtgtggcttcaccaccgaaaacctgctgcaattccacgaacacatccctcagcacaaatcggatggttcttcctaccagtgccgggagtgtggcctctgctacacgtctcacgtctctctgtccaggcacctcttcatcgtacacaagttaaaggaacctcagccagtgtccaagcaaaatggggctggggaagataaccaacaggagaacaaacccagccacgaggatgaatcccctgatggcgccgtgtcagacagaaagtgcaaagtgtgcgcaaaaacttttgaaactgaagctgccttaaatactcacatgcggacacacggcatggccttcatcaaatccaaaaggatgagctcagccgagaaatagccacagatgctccatgaggaaaatccctgtccacattggaataaaaaagacatttttgttacaaagtttgcagtataatagagttaacagtactgtctaggctgttgcaatatattctctttcaatgtaccttccttcacctcgtcgtatatatcctcgataagtattaaaacagtatttgagtttaaaagagtttgtatatatttaaatgaataactttttatactctttgttacatgtttgtatcagtatttagtggaaaaccatttgagttgttttgggttagaatttttctttttgtactgtttctttaaaacagagttcttagtaacaggggcagttcctgaattcaaataaaccattttgtatgtttggattttgaatgggttaactaattacaggctaaaataatgccttttttagtgtttttaatttttagaattcactacataaattgtaagtaattgtgggtctcaaaaacactaggaacttttaagtgtcttagcacttcctcgatgtgcctgccctgagggagtgagttcacatttgagacaactgcactccagtgtggacgtgcctttgtcttcaggccatgccgaagggtgtttaaagcagtcttgcaggtcgctcctttcccagccgtggataaaaactgaagctaggaatctaataaggaatgctgatttcctcagttccattttgaggaatggggaaggctattctaaagaaaaaaatgggatttgttttctcggcagatctgcaaggctggctttaagagcacaaggagggaaagtaacgaaagggctggactactataaaagttacaaatacgtagttagaccaatagatttatatagtcaggtttttgtcatgtaatttattaactaactattacagaaacacagctaagaatatcaagtatttctctggctcttgacagaaaaaaatcagttgacttaaccctttgctgtcaaaagagttggcgtttcctgttctgggtgctactgccaaacgttatggtacttagagtcgggatgcacaacttcaaccaccgacttatcaatgcagccgcctgtgtattgcaattggccgttaccttaagcactgagccacccgggtttagttcagccatttcaagaagtatatttaacgtcggtagttctgctttattaaaatgcagcagaggtactcttctgtcccttccgtttatagttctctgagagagttctattttttggttttgttttgtgttttcttttgcattttgtatcttgtatttatccctgaacatgttttgtaccttttttttttttttttttaagaaaaggaattcttttgtgtatatatagatacttgcatgatatactgtagtcaatgttcggttcctcaaaaggtcttgctgctgtcaggtgttatgcactccatccatcataactgtatgaaacacatttcatatgtaaataaacgtgggacatttggcccttgtgcttctgtgagagaattattgatggtgggtctctgacatctttgtgaagtttgggaagtaattaattgcagcgacaagctacagggtgttgcagaattcttcccactcagaagaatggcatattcgttctcattagtaatcagctattttgtcactttcttgttgactccatcagtacatgggtacaatccgagggtgtgaatttcagcttgaaattccattgctgttccttgttttgtttgtattgctctaagttgtattcataatagcactttcatatgtttctgcatttgaaccttgcaataagcctgtgtggtaggccacataggtccgaataacctagttttacagttgagggagctgagctcagattcagttctttgccgaagccctcatagctggtaagtggctttgcatattagaacccaaatattttgctctctaaatctaatgctcgctctatgtggttatgtacatattgacaaatattcatttattcaacaaataaaaagtatgtacaaaacatga

SEQ ID NO: 3235 - DNA, 1525 bp, Homo sapiens
gctttttcctgtagacccggcacccgactgcgcggaaagactgtctaagccgccactcgattcactttcaaagagacatattatgcaaggaagcaactcggaagaggaaagaaaggaagtcaggaatggcccttactcaggggcaattgtcattcagcgatgtggccatagaattctctcaggaggagtggaaatgcctggaccctgggcagaaagctttatacagggacgtgatgttagagaactacaggaacctggtctccctaggaatctgtcttcctgacctgagtgttacctccatgttggagcaaaagagagatccctggactctgcagagtgaagtgaaaataataaacaatccagatggcagggagtgcatcaaaggtgtgaacacagatttttcacttctggcctgggacgcgcgcgtcttcagggtggaagcctggcgcgcgtccggaggtgctgaggagccaaccggcccaaactttgtgggaaatgactcccctctgccctcgcccctcgctctgctaccatttccttccgtttctgcttcgcttggcgatgcaaaacgcgcgaggctcacggcagagggccgaggccacgggactctcagggccgggcccgcccctcggccgcgcagtgcggcgccgcacgccccggacgctgtccagcgttggccgcctgagcagaggctgccgcggagctaagacacccgccgtttcacccagccagcgggcccagcccgcggaggagggcggcatgcagctccgcgttgcctggctctccgggcacgcgggctacgatctgtacagtgcctgtgattacacaccaccacctatggagaaggctcttgtgaaaacggacattcagacagcgcttccttctggatgttatggagagtagctccaaggtctggcttggctgcaaaacactttgttgatgtaggagctggtatcacagatgaagattatagaggaaatgttggtgttgtactctttaatttttgcaaagaaaagtttgaagtcaaaaaaaggtgatcgaattgcacagctcatttgtgaacggattttttaatccagaaatagaagaagttcaagctttggatgacaccaaaaggggatcaggaggttttggctctaccggaaagaattaaaatttatgccaagaacagaaaacgagaagtcatacctttttcttaaaaacaaagagtttttgcttaaagtgttttggtgttttacacttctgtaaacttactagctttaccttctaaaagtactgcattttttttttatgatcaaagaagagatcatttaaaaaaagcatttctttgtgtttggatcacaaagaaactttgtttttctgcagttgatggttatttgtaaatctactttgtggtgacctgatgtaaacagtgtcttcttaaatgtacatcaattacagattaaaaaaaaaatcctgtattatttaactcaagaaatgataccccttcagcaacttaaaaaaaaaagtttgtttttgttttgtg

SEQ ID NO: 3236 - DNA, 2086 bp, Homo sapiens
ctttcaaagagacatattatgcaaggaagcaactcggaagaggaaagaaaggaagtcaggaatggcccttactcaggggcaattgtcattcagcgatgtggccatagaattctctcaggaggagtggaaatgcctggaccctgggcagaaagctttatacagggacgtgatgttagagaactacaggaacctggtctccctaggtgaggataatgtccgtccagaagcctgcatctgctctggaatctgtcttcctgacctgagtgttacctccatgttggagcaaaagagagatccctggactctgcagagtgaagtgaaaataataaacaatccagatggcagggagtgcatcaaaggtgtgaacacagagaagagttctaaattgggaagcagtgcaggaaacaagtcacttaaaaatcaacatggattaactcttcagttacatctgactgaatggcagccatttcaagctgtaaggaatatttatggatgtaagcatgttgagaaatctatcagtgacaattcttcagtttcaccagttcaaataagttttttcagtgtcaaaacccatatttttaataactacagaaatgattttcttttttctacattactcccacaagaacagaaagtacacattagggaaaagccttatggatgtaatgagcatgggaaagtcttcagagtgtcttcaagccttactaaccgtcaagtaatccacattgcagataaaacttacaaatgtagtgactgtggcgagatctttagtagcaattcaaactttgcacaacatcaacgaatccatactggagagaagccttacaaatataatgaatgtggcaaagtcttcaatcagaattcacaccttgcacaacatcagaaaattcatactggacagaaaccttacaataacaaagaatgtgggaaagtctttagtcaccatgcctaccttgcacagcataggaaaattcatactggagagaagccttacaaatgtagtgaatgtggcaaagcatttagtgtgtgttccagtcttactgctcatcttgtaatccatactggagagaaaccttatgattgtaaggaatgtggcaaggtcttcaggcataagtcttccctaaccactcatcagacagttcatactggagagagaccatacaaatgtaatgaatgtggcaaggggtttagtcgaattgcattccttgcaaggcatcggaaagttcatactggagagaaaccttacaaatgtaatgagtgtggcaaggtctttattggcaattcacgccttgcacgacataggaaaattcatactggggggaggcgttacaaatgtaatgaatgtggcaaagcatttagaacgtgttcagatctcactgcccatcttctaatccatactggagagaaaccttacgaatgtatagactgtggcaaggtcttcaggcacaagtcttccctaacctatcactgtagaattcatactggagagaagccttacaaatgtaacgaatgtggcaaggtcttcagtcagaattcaaaccttcaacgacataggaaaattcatactggagagaagctttacaaatgtaatgaatgtggcaaggtcttccgtcagaattcacaccttgcacaacatagggatattcatactggagagaagccttacagttgtaatgaatgtggcaaggtcttccgtcggaattcacaccttgtgcgacataggaatgttcatactggagaaaagccttacagttgtaatgaatgtggcaaggtcttcagtcggaattcacaccttgcgcgacataggaatattcatactggagagaagcctcacagttgtaatgaatgtggcaaggtcttcagtcggaattcacaccttgcgcgacataggaaaattcatactggagagaagctttacaaatgtaatgaatgtagcaaggtcttcagtcggaattcacgccttgcacaacataggaatattcatactggagtgaagccttacagttgtaatgaatgtggcaaggtctttagtaaaaattccatcctagtacaacattgcagtattcataccagagagaagccttaa

SEQ ID NO: 3237 - DNA, 2022 bp, Homo sapiens
gtccttacaactgggcaattgtcattcagcgatgtggccatagaattctctcaggaggagtggaaatgcctggaccctgggcagaaagctttatacagggacgtgatgttagagaactacaggaacctggtctccctaggtgaggataatgtccgtccagaagcctgcatctgctctggaatctgtcttcctgacctgagtgttacctccatgttggagcaaaagagagatccctggactctgcagagtgaagtgaaaataataaacaatccagatggcagggagtgcatcaaaggtgtgaacacagagaagagttctaaattgggaagcagtgcaggaaacaagtcacttaaaaatcaacatggattaactcttcagttacatctgactgaatggcagccatttcaagctgtaaggaatatttatggatgtaagcatgttgagaaatctatcagtgacaattcttcagtttcaccagttcaaataagttttttcagtgtcaaaacccatatttttaataactacagaaatgattttcttttttctacattactcccacaagaacagaaagtacacattagggaaaagccttatggatgtaatgagcatgggaaagtcttcagagtgtcttcaagccttactaaccgtcaagtaatccacattgcagataaaacttacaaatgtagtgactgtggcgagatctttagtagcaattcaaactttgcacaacatcaacgaatccatactggagagaagccttacaaatataatgaatgtggcaaagtcttcaatcagaattcacaccttgcacaacatcagaaaattcatactggacagaaaccttacaataacaaagaatgtgggaaagtctttagtcaccatgcctaccttgcacagcataggaaaattcatactggagagaagccttacaaatgtagtgaatgtggcaaagcatttagtgtgtgttccagtcttactgctcatcttgtaatccatactggagagaaaccttatgattgtaaggaatgtggcaaggtcttcaggcataagtcttccctaaccactcatcagacagttcatactggagagagaccatacaaatgtaatgaatgtggcaaggggtttagtcgaattgcattccttgcaaggcatcggaaagttcatactggagagaaaccttacaaatgtaatgagtgtggcaaggtctttattggcaattcacgccttgcacgacataggaaaattcatactggggggaggcgttacaaatgtaatgaatgtggcaaagcatttagaacgtgttcagatctcactgcccatcttctaatccatactggagagaaaccttacgaatgtatagactgtggcaaggtcttcaggcacaagtcttccctaacctatcactgtagaattcatactggagagaagccttacaaatgtaacgaatgtggcaaggtcttcagtcagaattcaaaccttcaacgacataggaaaattcatactggagagaagctttacaaatgtaatgaatgtggcaaggtcttccgtcagaattcacaccttgcacaacatagggatattcatactggagagaagccttacagttgtaatgaatgtggcaaggtcttccgtcggaattcacaccttgtgcgacataggaatgttcatactggagaaaagccttacagttgtaatgaatgtggcaaggtcttcagtcggaattcacaccttgcgcgacataggaatattcatactggagagaagcctcacagttgtaatgaatgtggcaaggtcttcagtcggaattcacaccttgcgcgacataggaaaattcatactggagagaagctttacaaatgtaatgaatgtagcaaggtcttcagtcggaattcacgccttgcacaacataggaatattcatactggagtgaagccttacagttgtaatgaatgtggcaaggtctttagtaaaaattccatcctagtacaacattgcagtattcataccagagagaagccttaa

SEQ ID NO: 3238 - DNA, 956 bp, Homo sapiens
ctttcaaagagacatattatgcaaggaagcaactcggaagaggaaagaaaggaagtcaggaatggcccttactcaggggcaattgtcattcagcgatgtggccatagaattctctcaggaggagtggaaatgcctggaccctgggcagaaagctttatacagggacgtgatgttagagaactacaggaacctggtctccctagatttttcacttctggcctgggacgcgcgcgtcttcagggtggaagcctggcgcgcgtccggaggtgctgaggagccaaccggcccaaactttgtgggaaatgactcccctctgccctcgcccctcgctctgctaccatttccttccgtttctgcttcgcttggcgatgcaaaacgcgcgaggctcacggcagagggccgaggccacgggactctcagggccgggcccgcccctcggccgcgcagtgcggcgccgcacgccccggacgctgtccagcgttggccgcctgagcagaggctgccgcggagctaagacacccgccgtttcacccagccagcgggcccagcccgcggaggagggcggcatgcagctccgcgttgcctggctctccgggcacgcgggctacgatctgtacagtgcctgtgattacacaccaccacctatggagaaggctcttgtgaaaacggacattcagacagcgcttccttctggatgttatggagagtagctccaaggtctggcttggctgcaaaacactttgttgatgtaggagctggtatcacagatgaagattatagaggaaatgttggtgttgtactctttaatttttgcaaagaaaagtttgaagtcaaaaaaaggtgatcgaattgcacagctcatttgtgaacggattttttaatccagaaatagaagaagttcaagctttggatgacaccaaaaggggatcaggaggttttggctctaccggaaagaa

SEQ ID NO: 3239 - DNA, 2047 bp, Homo sapiens
ctttcaaagagacatattatgcaaggaagcaactcggaagaggaaagaaaggaagtcaggaatggcccttactcaggggcaattgtcattcagcgatgtggccatagaattctctcaggaggagtggaaatgcctggaccctgggcagaaagctttatacagggacgtgatgttagagaactacaggaacctggtctccctaggaatctgtcttcctgacctgagtgttacctccatgttggagcaaaagagagatccctggactctgcagagtgaagtgaaaataataaacaatccagatggcagggagtgcatcaaaggtgtgaacacagagaagagttctaaattgggaagcagtgcaggaaacaagtcacttaaaaatcaacatggattaactcttcagttacatctgactgaatggcagccatttcaagctgtaaggaatatttatggatgtaagcatgttgagaaatctatcagtgacaattcttcagtttcaccagttcaaataagttttttcagtgtcaaaacccatatttttaataactacagaaatgattttcttttttctacattactcccacaagaacagaaagtacacattagggaaaagccttatggatgtaatgagcatgggaaagtcttcagagtgtcttcaagccttactaaccgtcaagtaatccacattgcagataaaacttacaaatgtagtgactgtggcgagatctttagtagcaattcaaactttgcacaacatcaacgaatccatactggagagaagccttacaaatataatgaatgtggcaaagtcttcaatcagaattcacaccttgcacaacatcagaaaattcatactggacagaaaccttacaataacaaagaatgtgggaaagtctttagtcaccatgcctaccttgcacagcataggaaaattcatactggagagaagccttacaaatgtagtgaatgtggcaaagcatttagtgtgtgttccagtcttactgctcatcttgtaatccatactggagagaaaccttatgattgtaaggaatgtggcaaggtcttcaggcataagtcttccctaaccactcatcagacagttcatactggagagagaccatacaaatgtaatgaatgtggcaaggggtttagtcgaattgcattccttgcaaggcatcggaaagttcatactggagagaaaccttacaaatgtaatgagtgtggcaaggtctttattggcaattcacgccttgcacgacataggaaaattcatactggggggaggcgttacaaatgtaatgaatgtggcaaagcatttagaacgtgttcagatctcactgcccatcttctaatccatactggagagaaaccttacgaatgtatagactgtggcaaggtcttcaggcacaagtcttccctaacctatcactgtagaattcatactggagagaagccttacaaatgtaacgaatgtggcaaggtcttcagtcagaattcaaaccttcaacgacataggaaaattcatactggagagaagctttacaaatgtaatgaatgtggcaaggtcttccgtcagaattcacaccttgcacaacatagggatattcatactggagagaagccttacagttgtaatgaatgtggcaaggtcttccgtcggaattcacaccttgtgcgacataggaatgttcatactggagaaaagccttacagttgtaatgaatgtggcaaggtcttcagtcggaattcacaccttgcgcgacataggaatattcatactggagagaagcctcacagttgtaatgaatgtggcaaggtcttcagtcggaattcacaccttgcgcgacataggaaaattcatactggagagaagctttacaaatgtaatgaatgtagcaaggtcttcagtcggaattcacgccttgcacaacataggaatattcatactggagtgaagccttacagttgtaatgaatgtggcaaggtctttagtaaaaattccatcctagtacaacattgcagtattcataccagagagaagccttaa

SEQ ID NO: 3240 - DNA, 4935 bp, Homo sapiens
gtctggagaagagagtttccacgttgtcatcataggatctggactcaagtgaccaaaaccttgcttggatttttacctgatgaagtttgtcttgaaaagtgaaaatggttccatttccattttccctgttctcaagggatggaagaagcgagcctgtgccttggagtgtcttcggcggagccggaagctgagccccacctgagtggccccgtcctcaacggccagtatgccatgagtcagaagctgcaccagatcacctcccagctcagccatgccttccccgagctccatccccggcccaaccccgaggagaagccccccgcatccctggaggagaaggcccacgtgcccatgagcggccagcccatgggcagtcagatggcgctcctggccaaccagctgggccgggaggtggacaccagcctcaacgggagggtggacttgcagcagttcctcaacgggcagaacctgggcatcatgtcccagatgagcgacatcgaggacgacgcccgcaagaaccgcaagtacccgtgcccactctgcggcaagcgcttccgcttcaacagcatcctctccctgcacatgcgcacgcacacgggcgagaagcccttcaagtgcccgtactgcgaccacagggcggcgcagaaggggaacctcaagattcacctgcggacccacaagctgggcaacctgggcaaggggcgtgggcgtgtgcgcgaggagaaccgcctgctgcacgagctggaggagcgcgccatcctgcgggacaagcagctgaaaggcagcctgctgcagccccggccggacctgaagcccccgccgcacgcccagcaggccccgctggccgcctgcaccctggccctgcaggctaaccacagcgttcccgacgtggcccacccggtgccctcgcccaagcctgccagcgtgcaggaggacgcggtggccccggcggcgggcttccgctgtaccttctgcaagggcaagttcaagaagcgcgaggagctggaccgccacatccgcatcttgcacaagccctacaagtgcacgttgtgcgacttcgcggcttcgcaggaggaggagctcatcagccacgtggagaaggcacacatcacggccgagtcggcccagggccagggccccaacggcggtggcgagcagtcggccaacgagttccgctgcgaggtgtgcggtcaggtgttcagccaggcgtggttcctcaagggtcacatgcgcaagcacaaagactcctttgagcactgctgccagatctgcggccggcgcttcaaggagccctggttcctcaagaaccacatgaaggtccacctcaacaagctgtcggtgaagaacaagtcccccagcgaccccgaggtgcctgtgcccatgggcggcatgtcccaggaggcccacgccaacctgtactccaggtacctctcctgcctgcagagtggcttcatgaccccggacaaagccggcctgagcgagcccagccagctctatggcaagggcgagctgcccatgaaggagaaggaagcgctggggaagctgctgtctcccatctccagcatggcccacggcgtcccggagggggacaagcactccctcctgggatgcctcaatctcgtgccgccgctgaaatccagctgcatcgagcggctgcaggcggctgccaaggctgcggagatggaccccgtgaacagctaccaggcttggcagctcatggccaggggcatggccatggaacatggcttcttgtctaaagagcatccgctgcagcgcaaccacgaagacactttggcaaacgccggggttctgtttgataaggagaagcgggagtacgtgttagtgggagcagatggctccaagcagaaaatgcctgctgatttggttcacagcactaaagtgggcagccagagagacctgccaagtaagctcgaccctttagaaagcagtcgggattttttgtcacacgggctgaaccagactctcgagtataacctgcagggtcctgggaacatgaaggagaagcccaccgagtgccccgactgcggccgggtgttccgcacttaccaccaggtggtcgtgcactcccgtgtccacaagcgggaccgcaagggcgaggaggatgggctgcacgtgggcctggatgagcggcgtggctcgggcagtgaccaggagtcccagtcggtgagccgctccaccacgccgggctcctctaacgtcaccgaggagagcggggtcggaggcggcctctcccagaccgggagtgcccaggaggacagcccgcacccctcctcgccatcctcctcagacattggcgaggaggctgggagatctgccggcgtccagcaaccagcgctgcttcgcgacagaagcctgggctcggccatgaaggactgcccgtactgtgggaaaactttccggacatcccatcaccttaaggtgcacctgaggatacacacaggtgagaaaccctacaagtgtccgcactgtgactatgccggcacgcagtcagcatccttaaaataccacttagagcgacaccatcgggagcggcagaacggggctgggccgctgtctgggcaacccccaaatcaagaccacaaggatgagatgtcaagcaaagcttctctgttcatcaggccagacatcctgaggggggccttcaagggtctccctggaatcgacttcagaggaggccctgcatctcagcagtggacatcaggggttctctcctctggagatcactcggggcaggccacgggcatgtcttcggaggtcccctcagatgctctgaaaggcactgaccttccttccaaaagcacccacttctctgagatcggaagagcttatcaaagcattgtgagcaacggtgtgaatttccaagggtccttgcaagctttcatggacagttttgtcctcagttccttgaagaaggagaaggacatgaaggacaaagccctggctgaccccccttccatgaaagtccacggagtggatggtggtgaggagaaacccagtggcaagtcctcccagaggaagtccgagaaatctcagtatgaacccctggacttgtctgtgcggccagatgccgcctccctcccgggctcctcggtaactgtgcaggacagcattgcatggcacggctgcttgttttgtgctttcacaacgtcctccatggagctcatggcccttcatctccaggccaaccacctgggcaaagcgaaacgcaaagataacaccatcggggtcacagtcaactgcaaagaccaagcccgggaggcgagtaagatggccctgctgccctcgttacaatcaaacaaagacctgggcctctccaatatgatcagctctctagactctgcttctgagaagatggcccaaggtcagctcaaggagactctgggagagcagaagagcggtgcatggaccggccacgtggaccctgcattttgtaacttcccatcagacttctacaagcagtttggtgtttacccaggcatggttggctcaggggcctccagttcctgccccaacaaggagcctgatggaaaggcccactctgaagaggatgtccccatcctgatccccgaaaccacgagtaagaacactactgatgacctctctgacattgcctcctcagaggacatggactcctccaagggggagaacaacgatgaagaggatgttgaaaccgaaccggaaatgatgaccaagccactgtctgccctcagcaaagacagcagcagcgatggcggggacagcctgcagcccacaggcacctcccagcccgtccagggactggtctcacctttatcccaagcaccggagaagcagtggcacagccagggtcttctccaagcccaggaccccttggcgggcctgccaaagccggagcgggggccccagagcctggacaagccgatgaacatgctgtcggtcctcagggcctacagttctgatggcttagcagcctttaacggacttgcaagtagcacagcaaattctggatgtatcaagaggccagacttgtgtggtaagtgacactccctgtcctagtcggtctatctggacttgcccttgtctgttcgtggtcctcggtggttatctgcagcttgttaatcgtgtaaagtcaagagaagaatgtatacacatatgtgtgttgaataattactattggcataggtatgtgtatacacacggtgcaccaatctacagtatatatagcagagaatcagaggctaaaaatattaccccatatgttccagtattagtcatggattgcaaaggcttagtaacttgagcaggagagaaaactccctcaaagtcataaatcctgagtgacaactgctgctggatgacagatcccttcacctgtggacaacctggctgggggtggggggctgttccaccagctcacctgagcatgtagaggtgggtcctgcagtggtctcgtgggtattactgcttgtgtctgattgtcctgtattttgtaacactttagaagaatacagaaaagtgcagtaattctctttctccatagtatttaagcagaaatattgctagtttaatattgtgtcaggtcgtcctattaaccaggagcagatgacagtaaaatttcagtgaatagcaccttgacatctacaacttaaaaatggtgattgaagcaaaatatgtaaacttgtacggggtgatcgtgtgctttggaacagagtattgttgaagtaattagaagatatattaaggtgttcctggtaatgaaggcatgtaagttataataattgtagctttctgaataagtgtcaaactatatctttaagtgtgctgtatgctgagttacaagttaggtcatttatgaatggaatgtaaaataatactaaaaatgcttcaataacttatcttggtattgctaataaaaaaaaaaagctgtgaaacatt

SEQ ID NO: 3241 - DNA, 4632 bp, Homo sapiens
atggaccagtacagccttggagacgagggtgccctcccatcagaaatgcacctcccttcattttcagagagccaagggctcaactgcagcgacaccctcaaccgggatttgggtcccaacacgcgaggctttctttatgctggcctgagtggtctggacccggaccccagcctcccaacgcctgacatgtccagcgaggtgctggaggacaacttagacaccttgtccctgtactccgggaaggacagtgattctgtgaagctgctggaggagtacgcagattcggagtctcaggcatccttacaagacctggggctaggtgtgcttaaggctaaagaggctgacgaaggaggaagggccacctcggggagtgccaggaaaggaaagcggcagcacagttcccctcaaaacccacttctggactgcagcctgtgcgggaaggtgttcagcagcgccagttctctgagcaagcactacctgacacacagccaggaaaggaagcacgtctgcaaaatctgcagcaaggcctttaagcgccaggaccacctgaccgggcacatgctcacccaccagaagacaaagcccttcgtgtgcatcgagcagggctgcagcaagagctactgcgactaccgctctctgcgccggcactacgaggtccatcacggcctgtgcatcctgaaggaagcccccccggaggaagaggcctgcggggactccccccacgcccacgagtcggccggccagccgccccccagcagcctgcggtccctggtgcccccagaggccaggtcccccggctccctcctgccccaccgggacctcctgcgccgcatcgtgagtagcatcgtccaccagaagaccccttctcctggcccagccccggcgggggcttcagacagcgaagggaggaacactgcctgtccctgccccgcctcatcggggtcctcgtcctgcaccccagccggcccccacgcggccccagcagcgctggacaccgagcttcccgaggagccttgcctcccacagaaagagccggccactgacgtgttcacagcccctaattccagggccgccgagaacggcgcccccgacccgccagagccggagccagataccgcgctgctccaggcccggtccaccgcggagtgctggcccgaaggcggctccgtgcctgcctgcctgcctctcttccgaggccagacggtccctgccagttcccagccatcgagccacagcttccagtggctccggaacctgccgggctgtcccaaaagcaaaggcaacaacgtgtttgttgtccacaagccctcggccgtgccctcgcgggagggctccgagtctggcccgggacccagcagcggaagcccctcggaggagtccccgcccggccccggcggtggcctggaggatgctctgcccttccctgccgcgctcctcagggtccccgcggaggccccgagcgaccccaggtcggccagcggggaagatgacccctgcgcccccaagaaggtcaaggtcgactgcgactccttcctgtgccagaaccccggggagcccggcctccaggaggcccagaaggcaggcgggctccctgcggatgcctcgccgctcttccgccagctcttcctcaagtcgcaggaacctcttgtgagccacgagcagatgcaggtgttccagatgatcaccaagtcccagcggatcttctcccatgcccaggtggcagcagtctcctcccagctccctgcgcccgagggcaaaccagccgccctgaggccgctgcaggggccgtggccgcagcagcccccaccactggctcctgctgtggactctctccacgccggccctggaaaccccgaggcagagggctccccagcccgcaggagaaaaaccacacccggggttcccagagaggcctcccccggcagcacgagacgagacgcaaaggggggactgaaagtggccgcggttccaacgccccttgcagcaccgtctctggacccttccaggaatccagacatctcttctctggccaagcagctgcgatcctctaaagggaccttggacctggaggacatcttcccctccacaggccaacggcagacccagttaggtggggaggagccaccaggagcctcgctgccagggaagcaggccccagccgagaatggcgcggcttcaaggatcacaaaaggtgaaaagggcccagcctgctcccggggtggaggctaccggctcttgggcaaccccagggccccgcgattctccggcttccggaaagagaaggcgaagatggatatgtgctgtgcggcttctccgagccaggtagccatggcctccttctcatcggccgggcccccggcagatccctccaagtccaagctgacaatattcagcagaatccagggtggaaacatctacaggctcccccatccggtgaaggaagagaatgtggcaggcagaggtaaccagcaaaacggcagtcccacagactggacgaagcccaggagcacttttgtctgcaagaactgcagccagatgttttatacggagaaagggctgagcagccacatgtgttttcacagcgaccagtggccgtcacctcgagggaagcaggaaccgcaggtgtttggcacagagttttgcaagccgctaagacaggtgctgaggccagaaggggacaggcatagtcccccaggaaccaagaagcccttggaccccacagctgcagcccctttggtggtcccccaatcgatccccgtggttccagtgacccgacacatagggagcatggccatgatggagtggtgcagtaggtggcttcaggcgaccacctgtggttctaaacttcttcagggacaagagaaagacggggaggagcgagacagcaaggagagcagccagcagagaaagcggaagaagcggcccccaccctccacggctggggagcctggccctgcaggatgccaccagagccgcctgcggtcacccatgttcctggtggactgcctcctgaagggcttattccagtgctccccctacacaccacccccaatgctcagccccatccgggagggctctggggtgtacttcaacaccctctgttccacgtccactcaggccagccctgaccagctcatcagctccatgctcgatcaagtggatgggtcctttggcatctgtgtggtgaaggatgacaccaaaatcagcattgagccacatatcaatataggaagccggtttcaggcagagatcccggaactccaggagagatccctggctggaactgacgagcatgtagcttctctggtctggaagccatggggagatatgatgatcagctcagagacacaggatagagtgaccgagctctgcaatgtggcatgctccagcgtgatgccaggagggggcaccaacctggagctcgctctgcactgcctgcacgaggctcagggcaacgttcaggtcgccctggagactcttctgctccgagggccccacaagccacggacacacctgctcgctgactatcgctacacaggttcagacgtctggacccctatagagaagaggctttttaagaaggcgttctatgcccacaagaaggacttctacttgatacacaagatgatccagacaaagacggtagctcagtgcgttgagtattattacatctggaaaaaaatgatcaagtttgactgtggccgagccccagggctagaaaagagggtcaagagagagccggaggaagtggaaaggacagaggaaaaggtcccatgcagccctcgggagagacccagccaccatccaactcccaagttaaagaccaagagttataggagggagtccatcctcagctccagcccaaatgcaggctccaagcggacccccgagctgttgggaagtgcagagagccagggcatttttccatgcagagagtgtgaaagggtgtttgacaagatcaagagtcgaaatgcccatatgaagcggcaccgccttcaggaccacgtggagcccatcatcagggtgaagtggccagtgaagcccttccagctaaaggaagaggagctgggagctgacatcggccccctgcagtggtgactcccgtggcagcaagtccgaatggggcctccagtgctgcccctcctcccttcggcctctccagggcgtttggggcacccctctgcctccccccaccctccctgtcccctgttggccaacctgcctgcaaacatggagggcatttggccacagataggcaggaggagctcagttgtcggacagctatgcagtccctgtccggtggtgctggaggctccactctccttaggttcatagtctctccccttctttcccttccacttctagagcagggaggcttggggaggggaaaatttagctctgggtagctcttaaatcttagcctcagttgtggggtttggtttcatgtgttagataaggccaagacttagagaatcagtgggaaaaaaccttgagatctccaacacgctgggcccctccctggggcggggactctaccttccagattcagtccctagtcttgcgatgaattctgcattgttcggtgttttttgtacatgtcaactcgtaaatctgattaaattgggttcttga

SEQ ID NO: 3242 - DNA, 3800 bp, Homo sapiens
atggaccagtacagccttggagacgagggtgccctcccatcagaaatgcacctcccttcattttcagagagccaagggctcaactgcagcgacaccctcaaccgggatttgggtcccaacacgcgaggctttctttatgctggcctgagtggtctggacccggaccccagcctcccaacgcctgacatgtccagcgaggtgctggaggacaacttagacaccttgtccctgtactccgggaaggacagtgattctgtgaagctgctggaggagtacgcagattcggagtctcaggcatccttacaagacctggggctaggtgtgcttaaggctaaagaggctgacgaaggaggaagggccacctcggggagtgccaggaaaggaaagcggcagcacagttcccctcaaaacccacttctggactgcagcctgtgcgggaaggtgttcagcagcgccagttctctgagcaagcactacctgacacacagccaggaaaggaagcacgtctgcaaaatctgcagcaaggcctttaagcgccaggaccacctgaccgggcacatgctcacccaccagaagacaaagcccttcgtgtgcatcgagcagggctgcagcaagagctactgcgactaccgctctctgcgccggcactacgaggtccatcacggcctgtgcatcctgaaggaagcccccccggaggaagaggcctgcggggactccccccacgcccacgagtcggccggccagccgccccccagcagcctgcggtccctggtgcccccagaggccaggtcccccggctccctcctgccccaccgggacctcctgcgccgcatcgtgagtagcatcgtccaccagaagaccccttctcctggcccagccccggcgggggcttcagacagcgaagggaggaacactgcctgtccctgccccgcctcatcggggtcctcgtcctgcaccccagccggcccccacgcggccccagcagcgctggacaccgagcttcccgaggagccttgcctcccacagaaagagccggccactgacgtgttcacagcccctaattccagggccgccgagaacggcgcccccgacccgccagagccggagccagataccgcgctgctccaggcccggtccaccgcggagtgctggcccgaaggcggctccgtgcctgcctgcctgcctctcttccgaggccagacggtccctgccagttcccagccatcgagccacagcttccagtggctccggaacctgccgggctgtcccaaaagcaaaggcaacaacgtgtttgttgtccacaagccctcggccgtgccctcgcgggagggctccgagtctggcccgggacccagcagcggaagcccctcggaggagtccccgcccggccccggcggtggcctggaggatgctctgcccttccctgccgcgctcctcagggtccccgcggaggccccgagcgaccccaggtcggccagcggggaagatgacccctgcgcccccaagaaggtcaaggtcgactgcgactccttcctgtgccagaaccccggggagcccggcctccaggaggcccagaaggcaggcgggctccctgcggatgcctcgccgctcttccgccagctcttcctcaagtcgcaggaacctcttgtgagccacgagcagatgcaggtgttccagatgatcaccaagtcccagcggatcttctcccatgcccaggtggcagcagtctcctcccagctccctgcgcccgagggcaaaccagccgccctgaggccgctgcaggggccgtggccgcagcagcccccaccactggctcctgctgtggactctctccacgccggccctggaaaccccgaggcagagggctccccagcccgcaggagaaaaaccacacccggggttcccagagaggcctcccccggcagcacgagacgagacgcaaaggggggactgaaagtggccgcggttccaacgccccttgcagcaccgtctctggacccttccaggaatccagacatctcttctctggccaagcagctgcgatcctctaaagggaccttggacctggaggacatcttcccctccacaggccaacggcagacccagttaggtggggaggagccaccaggagcctcgctgccagggaagcaggccccagccgagaatggcgcggcttcaaggatcacaaaaggtgaaaagggcccagcctgctcccggggtggaggctaccggctcttgggcaaccccagggccccgcgattctccggcttccggaaagagaaggcgaagatggatatgtgctgtgcggcttctccgagccaggtagccatggcctccttctcatcggccgggcccccggcagatccctccaagtccaagctgacaatattcagcagaatccagggtggaaacatctacaggctcccccatccggtgaaggaagagaatgtggcaggcagaggtaaccagcaaaacggcagtcccacagactggacgaagcccaggagcacttttgtctgcaagaactgcagccagatgttttatacggagaaagggctgagcagccacatgtgttttcacagcgaccagtggccgtcacctcgagggaagcaggaaccgcaggtgtttggcacagagttttgcaagccgctaagacaggtgctgaggccagaaggggacaggcatagtcccccaggaaccaagaagcccttggaccccacagctgcagcccctttggtggtcccccaatcgatccccgtggttccagtgacccgacacatagggagcatggccatgatccagacaaagacggtagctcagtgcgttgagtattattacatctggaaaaaaatgatcaagtttgactgtggccgagccccagggctagaaaagagggtcaagagagagccggaggaagtggaaaggacagaggaaaaggtcccatgcagccctcgggagagacccagccaccatccaactcccaagttaaagaccaagagttataggagggagtccatcctcagctccagcccaaatgcaggctccaagcggacccccgagctgttgggaagtgcagagagccagggcatttttccatgcagagagtgtgaaagggtgtttgacaagatcaagagtcgaaatgcccatatgaagcggcaccgccttcaggaccacgtggagcccatcatcagggtgaagtggccagtgaagcccttccagctaaaggaagaggagctgggagctgacatcggccccctgcagtggtgactcccgtggcagcaagtccgaatggggcctccagtgctgcccctcctcccttcggcctctccagggcgtttggggcacccctctgcctccccccaccctccctgtcccctgttggccaacctgcctgcaaacatggagggcatttggccacagataggcaggaggagctcagttgtcggacagctatgcagtccctgtccggtggtgctggaggctccactctccttaggttcatagtctctccccttctttcccttccacttctagagcagggaggcttggggaggggaaaatttagctctgggtagctcttaaatcttagcctcagttgtggggtttggtttcatgtgttagataaggccaagacttagagaatcagtgggaaaaaaccttgagatctccaacacgctgggcccctccctggggcggggactctaccttccagattcagtccctagtcttgcgatgaattctgcattgttcggtgttttttgtacatgtcaactcgtaaatctgattaaattgggttcttg

SEQ ID NO: 3243 - DNA, 3671 bp, Homo sapiens
aggattggccctggaacagtgtggggcctggaccgctgggtaggcgcgtccagcggcctgagcaggggagggtaatgaggctgttacgcgccttctccgcatcttggcgggagcctgacgccccgcttcttccctaacggggtgttccaccggcgcctgccgaggcctaggcctccgcagccgccctccgtctcctcagccccgacgctgcgcccgctttgtgcgcatttttctctggggaaactgaggctccgagtgcgaaagtcagccgaggtcgccccgcccaggacagagaagggctgggggtcggctgagccgcggcattcccgggccccgctagggctgcagggtctcaggatggcagcctcggcgcaggtgtctgtgacctttgaggatgtggctgtgacattcacccaggaggagtggggacagttggatgcagcccagagaaccttgtatcaggaggtgatgctggagacctgcggacttctcatgtctctgggctgtcctttgttcaaaccagagctgatctaccagttggatcacagacaggagctatggatggctacaaaagacctctcccaaagctcctatccaggtgacaacacaaaacccaagaccacagagcctaccttttctcacctggccttgcctgaggaagtcttactccaggaacaactgacacaaggagcctcaaagaactcccaattagggcaatccaaggatcaggatgggccatctgaaatgcaagaagtccacttgaaaatagggataggcccccagcgggggaagctgctggagaaaatgagttctgaacgtgatggtttggggtcagatgatggtgtatgtacaaagattacacagaaacaagtttcaacagaaggtgatctctatgaatgtgattcacatggaccagttacagatgccttgattcgcgaagagaaaaattcctataaatgtgaggaatgcgggaaagtgtttaaaaagaatgccctccttgttcagcatgaacggattcacactcaagtgaagccctatgaatgcacagagtgtgggaaaacctttagcaagagcactcatcttcttcagcacctcatcatccacactggggagaagccctataagtgcatggagtgtgggaaggcttttaaccgcaggtcacacctcacacggcaccagcggattcacagtggagagaagccttataagtgcagtgaatgtggaaaggccttcacccaccgctccacttttgtcttgcatcacaggagccacactggagaaaaaccctttgtgtgcaaagagtgtggcaaagcctttcgagataggccaggtttcattcgacactacatcatccacacgggagagaagccctatgagtgcattgagtgtgggaaggccttcaaccgccggtcatacctcacgtggcaccaacagattcacactggagtgaaaccctttgaatgcaacgagtgtggaaaagctttttgcgagagtgcagacctcattcaacactacattatccacactggggagaagccctataagtgcatggagtgtgggaaggcgttcaaccgtaggtcacacctcaagcagcatcaacggattcacactggggagaagccttatgaatgcagtgaatgtggaaaggccttcacccactgctccacttttgtcttgcataaaaggacccacacaggagaaaaaccctatgaatgcaaagaatgtggaaaagcctttagtgatagggcagacctcattcgccacttcagcatccacactggagagaaaccctatgagtgcgtggagtgtggaaaggccttcaaccgcagctcacacctcacgaggcaccaacagattcacactggagagaaaccctatgaatgcatccagtgtgggaaagccttttgccggagcgcaaaccttattcgacactccatcattcacactggagagaagccgtatgaatgcagtgagtgtggaaaggcttttaatcgcggctcatccctcacacatcatcaaaggattcatactgggagaaaccctaccattgtaacagatgtgggaagaccttttatgactgcacagacttcagtcaacatccaggaacttttattagggaaagagtttttgaatatcaccactgaagaaaatctgtggtgaaagggaacatcttaccatctggccattcacactgaagagaaacttcataagcatcctctctttgagaaaacgtgtaatagatgatcatttgtcgtctaaacaatcaagttagaaattgaaccagcctggagtcttattctccacctgagaattcacccatgagagagacccagtggttgctatgcacttaggaaaactttcagccacatctttcttcttagtttacagtgaaatattatctcagggatattttttttttttttttgagacggagtctcgctctgtcgcccaggctggagtgcagtggcgggatctcggctcactgcaagctccgcctcccgggttcacgccattctcctgcctcagcctcccaagtagctgggactacaggcacccgccactacgcctggctaattttttgtatttttagtagagacggggtttcaccgttttagccgggatggtctcgatctcctgacctcgtgatccgcccgcctcagcctcccaaagtgctgggattacaggcgtgagccaccgcgcccggccatctcagggatatttaaacaaaggaagaggaaatatagggaagagaaagaaaccacagcttcttttagacttgtctgacaagcctatggcaattttgtcgtccctttgttattttatgtgggagagggaaatgtttcagaaacgaaagatctcatcccctttatttttctgtgtatgcattcactgctgcccagtgtcagaacagttatacaaacgagggcttgaaaacattttgtgaaaacttgcttagtcctgcaacgttctccactctcgaggtgcagaagcatacatctttataaaaaatatggaggcttgagttatgaaacacttttataaggagataaggatgtacatatgtttggacacattgtccacttcagatgcttgtttaaaaaaatgtttcaccatgtgtctttacccaatacacatactttttcttgatgtggatttactttttttttttttttttaagttttcctgggatagggatgatagtgtaattgttcatgcccacagtaatcctgggaatcttagttttttcctatgattgtggtttctcagcttctttacctctcctttgagttaggtccacctcagttttctaaaggtcaaattaaggcccccccaaaaatacagtatgtagctgaattcctttgaaagatcatgataaactcagaagaacaaacatagaaggaatgtcatttttaatctttttaaagagtgtgtgaaaattcactttaactggaattttaacaggcaagccggcatgcatatatgtagggatgtgtgactttcacagttgtcaccatggacttaggcttgattaaaatgctacacatttagagcgttttgtaattccttttttatatttttaagactagattttgagccatgtgatagttttacctcatattaaatatattgtacagaagtaaaaataatcatgtattcactttgaactcctc

SEQ ID NO: 3244 - DNA, 3512 bp, Homo sapiens
ggggaggggacaggcgctgcaaggagcagagccgcgggaagcaactccctaagccacaatgctagtcgcgaacacaggaaaaagctcatcccgccgccgcggggccccatgctcccgccggcaatgactatgcctgtgggagcaacggctaccggcgcgcggccttctgggagttgtttgttgcgcggagcgcgggcacgtccgccggccaccggaagcaccgccattggccggtgcgtgcaggtggcagccaagagcctcctggcacagcggcaccaggcaggtgacgcctattggaccccagaggtcatcccagctccagacgtggacacattttcttccaatgatgtctacggatgaggaaactgaggcctggagaggttaaagagacccgttcagagtcctacagtggcagactggtcttctgaggacctctgccctctacacagcggcctcttcaggtgcagggaggaaatggaagcacgttctatgctggttccaccccaggcatctgtgtgcttcgaggatgtggctatggcattcacacaggaggagtgggaacagctggacctggcccagaggacactgtaccgagaggtgacactggagacctgggagcatattgtctccctggggcttttcctttccaaatctgatgtgatctctcagctggagcaagaagaggacctgtgcagggcagagcaggaggccccccgagactggaaagctacccttgaggagaataggttgaattctgaaaaagatcgagctagggaagaactatcccaccacgtggaagtgtacaggagtggaccggaggagccaccctctttggtattaggaaaagtgcaagatcagagcaaccagttaagggaacaccaggagaactccttgaggttcatggtactcacctcagagagactgtttgctcaaagggaacattgtgagcttgaacttgggggaggttattctctaccttctactttaagccttctacctacaacattacctacaagtacaggtttccctaagcccaactcacaagttaaagagttgaaacaaaattcagctttcattaatcatgagaaaaatggagcagatgggaagcactgtgagagtcatcagtgtgctagagctttctgtcagagtatttacttgagtaaacttggaaacgttgaaacaggaaagaaaaacccttatgaatatattgtcagtggtgactctctcaactatggttcctccctttgttttcatggtagaactttttcagtgaagaaaagtgatgactgtaaggattatggaaacctcttcagtcacagtgtgtctctgaatgaacagaagccagtgcattttgggaaaagtcagtatgagtgtgatgagtgcagggaaacctgttctgagagtctgtgccttgtacaaacagaaagaagtggccctggagagacccccttcagatgtgaggaacgctgtgctgccttccccatggcctcatctttttctgactgtaacatcattcagactacagagaagccatctgtgtgtaatcagtgtggaaaatctttcagctgttgtaagctcatacaccagagaacacacactggagaaaagcccttcgaatgtactcagtgtgggaaatcttttagccagagctatgaccttgtcatacatcagaggacacacactggagagaagccctatgagtgtgacctgtgtgggaaatccttcacccagagatccaaacttattacacatcagcgaattcacactggagaaaaaccgtatcagtgtattgaatgcagaaaatccttcaggtggaactctaacctcattgtacatcagagaattcatactggagagaaaccgtatgagtgcactcactgtggaaagtccttcagccaaagctatgagttagttacacataaaagaacgcacactggagaaaaacccttcaaatgtactcagtgtgggaaatctttcagccagaagtatgaccttgttgtacatcagaggacacacactggagagaagccctatgagtgcaacctgtgtgggaaatccttctcccagagttccaaacttattacgcatcagcgaattcacactggagaaaaaccgtatcagtgtattgaatgtgggaaatccttcagatggaactctaacctcgtcatacatcagagaattcatactggagagaaaccgtacgattgcactcactgtggaaagtccttcagccaaagctatcagttagttgcacataaaagaactcacactggagaaaagccctatgaatgtaacgagtgtggaaaagccttcaatcgaagcactcagctcatcaggcatctgcaaattcacactggggagaagccgtacaaatgcaatcagtgcaataaagcctttgcaaggagctcctaccttgtgatgcatcagagaactcacactggtgagaaaccttttgagtgtagtcagtgtgggaaagccttttcagggagctctaaccttctttcccatcacagaattcattctggagagaaaccctatgaatgtagtgactgtgggaaatccttccggcagcaatctcaacttgtagtgcatcggcggacacatactggagagaaaccttaggagtgcagtcattgtgggaaagctttcatccagaggtctcccctcatcatgcaccagaggacgcatgtcggtgggaagagctatcagtgtgacgtgtattaagccagcggttgtgactcattgaacatcagaggacatatcctggagaaaagccctacgaatgcattgattgtgggaaagccttcaatgatcgctcaacccttagtaaacacgagaggacacacactggaggcaaaccctatgaatgtgaccattgcgagaaagcctttagccaacggtgtcaacttactaggcagcagagaattcatactggagagaagccctgtgaatgttaacaaatgtggaaaagcttccagttatgatactttccttattcaacatgagaaagctcatgggcaagaaactctatgaataaccaagatggagccgggtgcagttgccaacacttgtaatcccagcagtttgcgaggccgaggcaggtggatcacttgagcccaggagtttgaaaccagcctgggtaacatggcaaaatcctgtctttacaaaaaatacaaaaattagcctagcatggtggcgcatacctgtagtcctagctactcaggaggctgaggtgggaggatcacttgagcttgggaggcggtggttgcagtgagctgtgatcatgccatcacaccgctgccttgtgagagattgagacactctaaataaataataaccaagatgggaaatttccctgccagaccttgtttactagaaatcaggtggccaaaacatgactctcagagtggggcttcatgaccatgtgcatcagaattgcctggagtgtgcactgaaactgtgtattaccaagctcactctagccaactaaataaaaatctctggcagtaaaa

SEQ ID NO: 3245 - DNA, 872 bp, Homo sapiens
caggtggcagccaagagcctcctggcacagcggcaccaggcaggtgacgcctattggaccccagaggtcatcccagctccagacgtggacacattttcttccaatgatgtctacggatgaggaaactgaggcctggagaggttaaagagacccgttcagagtcctacagtggcagactggtcttctgaggacctctgccctctacacagcggcctcttcaggtgcagggaggaaatggaagcacgttctatgctggttccaccccaggcatctgtgtgcttcgaggatgtggctatggcattcacacaggaggagtgggaacagctggacctggcccagaggacactgtaccgagaggtgacactggagacctgggagcatattgtctccctggggcttttcctttccaaatctgatgtgatctctcagctggagcaagaagaggacctgtgcagggcagagcaggaggccccccgaggtacttcaggtctttcacaagtcacaggtgtagtggctgatgggagcttcaggttcccggtctgggacttcacataacacaggcttgacaccagaaagatgtatccaactatctaatcctagtactttgaccccagaaggcatggccagtactgaaaatggtcccttccactttgattgtaattattgagcaggtgatccctccttctatgttttaacaggtaccttgtctgttggcctgattttgggttggtggttagttcctggtgtggggagcttttgagttccaaactcttgtaaagcctgctgaaataatcccaggttaactaggtattttactaaactggatgtttctggatcagagattagatcattagttaaaaatggccttttgt

SEQ ID NO: 3246 - DNA, 2665 bp, Homo sapiens
cagactggtcttctgaggacctctgccctctacacagcggcctcttcaggtgcagggaggaaatggaagcacgttctatgctggttccaccccaggcatctgtgtgcttcgaggatgtggctatggcattcacacaggaggagtgggaacagctggacctggcccagaggacactgtaccgagaggtgacactggagacctgggagcatattgtctccctggactggaaagctacccttgaggagaataggttgaattctgaaaaagatcgagctagggaagaactatcccaccacgtggaagtgtacaggagtggaccggaggagccaccctctttggtattaggaaaagtgcaagatcagagcaaccagttaagggaacaccaggagaactccttgaggttcatggtactcacctcagagagactgtttgctcaaagggaacattgtgagcttgaacttgggggaggttattctctaccttctactttaagccttctacctacaacattacctacaagtacaggtttccctaagcccaactcacaagttaaagagttgaaacaaaattcagctttcattaatcatgagaaaaatggagcagatgggaagcactgtgagagtcatcagtgtgctagagctttctgtcagagtatttacttgagtaaacttggaaacgttgaaacaggaaagaaaaacccttatgaatatattgtcagtggtgactctctcaactatggttcctccctttgttttcatggtagaactttttcagtgaagaaaagtgatgactgtaaggattatggaaacctcttcagtcacagtgtgtctctgaatgaacagaagccagtgcattttgggaaaagtcagtatgagtgtgatgagtgcagggaaacctgttctgagagtctgtgccttgtacaaacagaaagaagtggccctggagagacccccttcagatgtgaggaacgctgtgctgccttccccatggcctcatctttttctgactgtaacatcattcagactacagagaagccatctgtgtgtaatcagtgtggaaaatctttcagctgttgtaagctcatacaccagagaacacacactggagaaaagcccttcgaatgtactcagtgtgggaaatcttttagccagagctatgaccttgtcatacatcagaggacacacactggagagaagccctatgagtgtgacctgtgtgggaaatccttcacccagagatccaaacttattacacatcagcgaattcacactggagaaaaaccgtatcagtgtattgaatgcagaaaatccttcaggtggaactctaacctcattgtacatcagagaattcatactggagagaaaccgtatgagtgcactcactgtggaaagtccttcagccaaagctatgagttagttacacataaaagaacgcacactggagaaaaacccttcaaatgtactcagtgtgggaaatctttcagccagaagtatgaccttgttgtacatcagaggacacacactggagagaagccctatgagtgcaacctgtgtgggaaatccttctcccagagttccaaacttattacgcatcagcgaattcacactggagaaaaaccgtatcagtgtattgaatgtgggaaatccttcagatggaactctaacctcgtcatacatcagagaattcatactggagagaaaccgtacgattgcactcactgtggaaagtccttcagccaaagctatcagttagttgcacataaaagaactcacactggagaaaagccctatgaatgtaacgagtgtggaaaagccttcaatcgaagcactcagctcatcaggcatctgcaaattcacactggggagaagccgtacaaatgcaatcagtgcaataaagcctttgcaaggagctcctaccttgtgatgcatcagagaactcacactggtgagaaaccttttgagtgtagtcagtgtgggaaagccttttcagggagctctaaccttctttcccatcacagaattcattctggagagaaaccctatgaatgtagtgactgtgggaaatccttccggcagcaatctcaacttgtagtgcatcggcggacacatactggagagaaaccttaggagtgcagtcattgtgggaaagctttcatccagaggtctcccctcatcatgcaccagaggacgcatgtcggtgggaagagctatcagtgtgacgtgtattaagccagcggttgtgactcattgaacatcagaggacatatcctggagaaaagccctacgaatgcattgattgtgggaaagccttcaatgatcgctcaacccttagtaaacacgagaggacacacactggaggcaaaccctatgaatgtgaccattgcgagaaagcctttagccaacggtgtcaacttactaggcagcagagaattcatactggagagaagccctgtgaatgttaacaaatgtggaaaagcttccagttatgatactttccttattcaacatgagaaagctcatgggcaagaaactctatgaataaccaagatggagccgggtgcagttgccaacacttgtaatcccagcagtttgcgaggccgaggcaggtggatcacttgagcccaggagtttgaaaccagcctgggtaacatggcaaaatcctgtct

SEQ ID NO: 3247 - DNA, 804 bp, Homo sapiens
atggcctcatctttttctgactgtaacatcattcagactacagagaagccatctgtgtgtaatcagtgtggaaaatctttcagctgttgtaagctcatacaccagagaacacacactggagaaaagcccttcgaatgtactcagtgtgggaaatcttttagccagagctatgaccttgtcatacatcagaggacacacactggagagaagccctatgagtgtgacctgtgtgggaaatccttcacccagagatccaaacttattacacatcagcgaattcacactggagaaaaaccgtatcagtgtattgaatgcagaaaatccttcaggtggaactctaacctcattgtacatcagagaattcatactggagagaaaccgtatgagtgcactcactgtggaaagtccttcagccaaagctatgagttagttgcacataaaagaactcacactggagaaaagccctatgaatgtaacgagtgtggaaaagccttcaatcgaagcactcagctcatcaggcatctgcaaattcacactggggagaagccgtacaaatgcaatcagtgcaataaagcctttgcaaggagctcctaccttgtgatgcatcagagaactcacactggtgagaaaccttttgagtgtagtcagtgtgggaaagccttttcagggagctctaaccttctttcccatcacagaattcattctggagagaaaccctatgaatgtagtgactgtgggaaatccttccggcagcaatctcaacttgtagtgcatcggcggacacatactggagagaaaccttag

SEQ ID NO: 3248 - DNA, 4593 bp, Homo sapiens
acatttcccagaagccccttgggcagtgttgcctggaccccaagggccctttacattgcgttcttaacggttcagtcaccttaaccgttattattcacttgcgggcgagaagtccgagctagggatcctgaaaaggagggaacaattgttgtagcaggtctaaaagttcaggtccaggaaatggaaacattgctttgcttttcctgaattgtccagtgacctatcccaggccttcctttccagtgaacaatggaccatgcaggtggaccctcctcttcacgggcctccaaatgactttctcatttttcaaatcattcctctgcactcactttctataatgccccggtttctctggattctgtgcttctccatggaggaaactcaaggagaactgacaagttcttgtggttctaaaaccatggccaatgtatctttggcatttagggatgtgtccatagacctctcccaagaggagtgggagtgcctggacgctgtgcagagggacttgtacaaggatgtgatgttggagaactacagcaacctggtctcactgggatataccattcctaagccagatgtgattactttattggagcaagagaaagagccctggatagtaatgagggaagggacaaggaattggttcacagatttggaatacaagtatattaccaagaatttgctttcagaaaagaatgtttgcaaaatctatttatctcaattgcagacaggggaaaaaagtaaaaacaccatccatgaggacaccattttcagaaatggtttgcagtgtaaacatgaatttgagagacaagagagacatcagatgggatgcgttagtcaaatgctaatccaaaaacaaatatctcatcctctacatccaaaaattcatgctagagagaaatcatatgaatgtaaggaatgtagaaaggcctttagacaacagtcataccttattcaacatctgagaattcacactggtgagagaccctataaatgtatggaatgtggaaaggccttttgtcgagtgggagaccttagagtacatcacacaatccatgctggggagagaccctatgaatgtaaagaatgtgggaaggcctttagacttcattatcaccttactgaacatcagagaatacattctggtgtgaaaccctacgagtgtaaggaatgtgggaaagcctttagtcgtgttagagaccttagagtacatcagacaattcatgctggagagagaccttatgaatgtaaagaatgtgggaaggcctttagacttcattatcaactaactgaacatcaaagaattcatactggtgagaggccttatgaatgtaaggtttgtggcaagacctttagggtacaacgacatattagtcaacatcagaaaattcatactggtgtcaaaccctataaatgtaatgaatgtgggaaggcctttagtcatggctcataccttgttcaacatcagaaaattcatactggtgaaaaaccctacgaatgtaaagaatgtggtaagtcctttagttttcatgcagaacttgctcgacatcgtagaattcatactggtgagaaaccctatgaatgtagagaatgtggaaaagcctttcgtcttcaaacggaacttactcggcatcatagaactcatactggtgagaaaccctatgaatgtaaggaatgtgggaaggcctttatttgtggttatcaacttactttacatctgagaactcacaccggtgagattccctatgaatgtaaggaatgtggaaaaaccttcagtagtcgctatcatctcactcaacactacagaattcatactggtgagaaaccctacatatgtaacgaatgtggaaaagcctttcgtcttcaaggagaacttacccgacatcacagaattcatacatgtgagaaaccctatgaatgtaaggaatgtgggaaggcttttattcatagcaatcaatttatttcacaccagcgaattcacaccagtgagagcacctacatatgtaaagaatgtgggaagatttttagtcgtcgctataatcttactcaacattttaaaattcatactggtgaaaaaccctacatatgtaatgaatgtgggaaagcctttcgatttcaaacagaacttactcagcatcacagaattcatactggtgaaaaaccctataaatgtacagaatgtgggaaggcctttattcgtagcactcatctcacgcaacatcacagaattcatactggtgagaaaccctacgaatgtacggaatgtgggaagacgtttagtcggcactatcatcttactcaacatcacagaggccatactggtgagaagccctacatatgtaatgaatgtgggaatgcttttatttgcagttatcgacttacattacatcaaagaattcacactggtgagcttccatatgaatgtaaggaatgtggaaagacctttagtcgtcggtatcatcttactcaacattttagacttcatactggtgagaaaccttatagctgtaaagaatgtgggaatgcctttcgtcttcaagcagaacttactcgacatcacatagttcacacgggtgagaaaccctataaatgtaaagaatgtgggaaagccttcagtgttaattcagaacttactcgacatcacagaattcatactggtgaaaaaccctatcaatgtaaagaatgtggaaaagcctttattcgtagtgatcaacttactttacatcagagaaatcatattagtgaggaagtcctatgcataatgtaaagagaatacgatggcctttagaaaatgccctttagcagagaatttgtaatttaagaaattttctgtttgttacggaacatgtgggaatcccttttacttcatgctcacaatttatcagaaattatttcgtatgttaaagagtcgaaagactatagcatcactcagtccctgttagactttagaagattgatactgatgcactgcatcccaaaccatcaagggccttttcccctacaaactgttgttgaacagtgcttctctaaaatgcaataataatgggccaggtgaagtggctcacacctgtaatcccagcactgtggaaagacaggagttcgaaaccagcctgggcaacatagtgagaccctgcctcatggctttagtgagccatgattgtgccactgcactccagcttggtgacagagtgagatcctgtctctaaataaataaataaaatgcgggccaggcacagtggctcacacctgtaatcccagcactatgggaggcccaggtgagcagatcacctgaggtcaggagttcaagaccagcctggccaacatggtgaaaccccttctctactaaaatacacaaattagctaggcattgtggggggtgcctgtaatcccagctactcaggaggctgaggcaggaaaattgcatgaacctaagtggcagaggttgcagtgagctgagatcgcaccactgcactctagcttgggcaacagagcaagactctgtctcttaaataaataaataaatagattaccagaaaaatgaaaagaaaaaaacagacatacaaaataaaagccccagttttttattatggtatttaactgagttaactctgtcagattgctgcaaacatttctaaatacttgctcttggtatctataacttttgcagagaccagaagcaaacaatttgtgggccagtgtcaacacatggaccacactttatatagcactgtaacggaaaatgattctgttaatgtaatgaacatgggaaagaccagccttggcctatctttatgatatatataaataatataattctcataattccacctctgcctatgtggtgtttggcaaaacatgcccctgtgccttggtttttaaaatggtaataacagtaccacctaatagtatttttgtgaggatgaaatgctaataaaagataaaacctttaaaagagtatttggcacacagcattttatcaataaatattgctttatttttttcattggggatacatttagtacattcatgtgagaggaaggccctgtgggtgtaagaaatttgtaaaaactgtccattacctttcactccttatttagattggaataattaactggagataatatccagtaaaatagattaaacttccatttataaagtcagaacctatctctgaaaattaatgtgagaaagaaatctctagatttgatgggtgtgaagattatgagagtaaagttttgaagactcagggatagctgtaatgcttttttctttttataacccaaaaagcaggtatgtcagtcgctttttctgcccacaatgataaattaaaaacagccactatccatttggaaaacttaaaagaataatgaacagttatgttctatctagattcagcaattgttaatatgttgtcacatttggtttgcttatacataatatttacatattttgctgtagtatttgagtataaattgcagatactataacacatcacatctaagaataaaggctgcctcctacttaattgctatataacaattgtccaacctgtctgtgccccagggcagctttgaatgcagtccaacagaaatt

SEQ ID NO: 3249 - DNA, 1341 bp, Homo sapiens
aagacctttagggtacaacgacatattagtcaacatcagaaaattcatactggtgtcaaaccctataaatgtaatgaatgtgggaaggcctttagtcatggctcataccttgttcaacatcagaaaattcatactggtgaaaaaccctacgaatgtaaagaatgtggtaagtcctttagttttcatgcagaacttgctcgacatcgtagaattcatactggtgagaaaccctatgaatgtagagaatgtggaaaagcctttcgtcttcaaacggaacttactcggcatcatagaactcatactggtgagaaaccctatgaatgtaaggaatgtgggaaggcctttatttgtggttatcaacttactttacatctgagaactcacaccggtgagattccctatgaatgtaaggaatgtggaaaaaccttcagtagtcgctatcatctcactcaacactacagaattcatactggtgagaaaccctatgaatgtaaggaatgtgggaaggcttttattcatagcaatcaatttatttcacaccagcgaattcacaccagtgagagcacctacatatgtaaagaatgtgggaagatttttagtcgtcgctataatcttactcaacattttaaaattcatactggtgaaaaaccctacatatgtaatgaatgtgggaaagcctttcgatttcaaacagaacttactcagcatcacagaattcatactggtgaaaaaccctataaatgtacagaatgtgggaaggcctttattcgtagcactcatctcacgcaacatcacagaattcatactggtgagaaaccctacgaatgtacggaatgtgggaagacgtttagtcggcactatcatcttactcaacatcacagaggccatactggtgagaagccctacatatgtaatgaatgtgggaatgcttttatttgcagttatcgacttacattacatcaaagaattcacactggtgagcttccatatgaatgtaaggaatgtggaaagacctttagtcgtcggtatcatcttactcaacattttagacttcatactggtgagaaaccttatagctgtaaagaatgtgggaatgcctttcgtcttcaagcagaacttactcgacatcacatagttcacacgggtgagaaaccctataaatgtaaagaatgtgggaaagccttcagtgttaattcagaacttactcgacatcacagaattcatactggtgaaaaaccctatcaatgtaaagaatgtggaaaagcctttattcgtagtgatcaacttactttacatcagagaaatcatattagtgacagagaatttgtaatttgtaaagaa

SEQ ID NO: 3250 - DNA, 2772 bp, Homo sapiens
aaaagcgcgagaagcggcttggttccttgtacgcagaggcggtagtgacacaggcacaactgacagtggcagaagctcagctgacaaggactggggacggcggtgtccttgtcttgcctttgtcgcccccgcccctctcttccctggctggacttgcggagtccccgccgaagaacccgagggtcccctggcgatggcagaaatgaaccctgcacagggtcatgtggtttttgaagacgtggccatatatttctcccaggaggagtgggggcatctcgatgaggctcagagattgctgtaccgtgatgtgatgctggagaatttggcccttttgtcctcactaggttgttgccatggagctgaggatgaggaggcacctttagagccaggtgtttctgtaggagtgtcacaggtcatggctccaaagccctgtctatctacccagaatacccagccctgtgagacatgtagctcacttctgaaggacattctgcgtctggctgagcatgacggaacacaccccgagcagggactgtacacgtgtccagcacatcttcaccagcaccaaaaggagcagattagagagaaactttctagaggggatggaggaagaccgacatttgtgaagaaccacagagttcacatggcagggaagaccttcttgtgcagtgaatgtgggaaagcctttagccacaaacataaactttctgaccatcagaaaatccacactggagaaagaacttataagtgcagcaaatgtgggatattgtttatggaaaggtccacactcaatagacatcagagaactcacactggagaaaggccttatgagtgcaatgaatgtgggaaagcctttctttgtaagtctcaccttgttcgtcaccagacaatccactctggagaaaggccttatgagtgcagtgaatgtgggaaattgtttatgtggagttccacactcattacacatcagagggttcacactggaaagaggccttatggttgcagtgaatgtgggaagttctttaagtgcaactcaaacctctttaggcattacagaattcatacaggaaaaaggtcttatggttgcagtgaatgtgggaaattctttatggaaaggtctacactcagtagacatcagagagttcacactggagaaaggccttatgagtgcaatgaatgtgggaaattcttcagcttgaaatccgtcctcattcaacaccaaagagttcacactggagaacggccttatgaatgcagtgagtgtgggaaggccttccttacaaagtcccacctcatttgtcatcagacagttcacactgcagcaaagcagtgcagtgaatgtgggaaattctttaggtataactctacacttctcagacatcagaaagtccacactggataaggcccttatgaatgcagtggatatgggaaagccttcagtcaccaacatattgtggctggacagcaggcagtacacactggagaaagactgaatgccgtgaacgtgggtaattatgtaggtacagctctccagtcgctatgtatcagagaattcacactgcagaaatgtgtgttcagcaaactcgggacattattttggtttgactctcatctcattagacattggagagtttacactgaagaagagtcttttcaataaagtagaaagtggtaaagattcaacatgcaagattgtacttattgggcttcagaatatccacactagtgaaagtcttctgagtacagcaaatgtgtgacattattttgctactactccacactacttagacatcatgtagttcacactggaaaaaggccacgtatgtgccttgaatgtagccaaaatgacgaacaacacccagaaatctgtgatttagcactgagaactagtattatatggtttttaaaaaacaatggtgaagtacatgccacataaaatttgccatcttaactattgtaatgtcttgtttaatacttgaagtacattaacattgttgagcaaagaatatcctgaactctttatcttgtaaaatgaaactctataaccaccattaaaaaaacaactcattcccacattcttcagtccctggcgaccaccatatttttaagtcattatgactctgactattcttggtacttctcagaagaagaatcttagagtgtttttcattattttttttcacttaggataatatcctcaaagttcattcattttttagcatgtgtcagaaattttaaggctgagcaatatttcattgtttgcatttaccacatttcctttatttctgacatctattcatggacacttgggttacttctacctctggctattgtgaatattgctactacaagcataagggcacaaatatctctttgagaccctgctttcaattcttattgggtaccccaaaaagtggaactgctggatcacatggtacttctaactttaattctttgatgaactgagaaacttttccataaaacttgcaccgttttacattcctaacattccacaaaagttgtgatttgtcctcattctaatccatagaaggcaacatttctaacaggtttctaggtgattttgttgttgctgatgtagggactacattttgagaactgtcctatcccatttttataacaatgcagagcttctctgtaaataccccttgtttctatgttctatcctgtgagccttttcattttgttaatttttcccagtgtttacaaccaggaaatagcttgtcatctttgatacaaaacagaaatctttgc

SEQ ID NO: 3251 - DNA, 1258 bp, Homo sapiens
aaaagcgcgagaagcggcttggttccttgtacgcagaggcggtagtgacacaggcacaactgacagtggcagaagctcagctgacaaggactggggacggcggtgtccttgtcttgcctttgtcgcccccgcccctctcttccctggctggacttgcggagtccccgccgaagaacccgagggtcccctggcgatggcagaaatgaaccctgcacagggtcatgtggtttttgaagacgtggccatatatttctcccaggaggagtgggggcatctcgatgaggctcagagattgctgtaccgtgatgtgatgctggagaatttggcccttttgtcctcactaggttgttgccatggagctgaggatgaggaggcacctttagagccaggtgtttctgtaggagtgtcacaggtcatggctccaaagccctgtctatctacccagaatacccagccctgtgagacatgtagctcacttctgaaggacattctgcgtctggctgagcatgacggaacacaccccgagcagggactgtacacgtgtccagcacatcttcaccagcaccaaaaggagcagattagagagaaactttctagaggggatggaggaagaccgacatttgtgaagaaccacagagttcacatggcagggaagaccttcttgtgcagtgaatgtgggaaagcctttagccacaaacataaactttctgaccatcagaaaatccacactggagaaagaacttataagtgcagcaaatgtgggatattgtttatggaaaggtccacactcaatagacatcagagaactcacactggagaaaggccttatgagtgcaatgaatgtgggaaagcctttctttgtaagtctcaccttgttcgtcaccagacaatccactctggagaaaggccttatgagtgcagtgaatgtgggaaattgtttatgtggagttccacactcattacacatcagagggttcacactggaaagaggccttatggttgcagtgaatgtgggaagttctttaagtgcaactcaaacctctttaggcattacagaattcatacaggaaaaaggtcttatggttgcagtgaatgtgggaaattctttatggaaaggtctacactcagtagacatcagagagttcacactggagaaaggccttatgagtgcaatgaatgtgggaaattcttcagcttgaaatccgtcctcattcaacaccaaagaagagtttacactgaagaagagtcttttcaataa

SEQ ID NO: 3252 - DNA, 4548 bp, Homo sapiens
gggcgggacttccgccgtcctcctggtggtggtcgttttggttctgtgtggtgtttcaccaacttcggcctatggctctgtctgacgtcaccgaagtgacggaacggaaaagcgcgagaagcggctcggttcccaccacggagaggcgggagtgagtcaactgacaagcgctggggacagtggcgtccttgtcttgcctttgtcgctcccgccccgctcttccctggctgggctggcggaggccttgctgatgaacctgactgagggtcccctggcgatggcagaaatggaccctacacagggccgtgtggtctttgaggacgtggccatatatttctcccaggaggagtgggggcaccttgatgaggctcagagattgctgtaccgtgatgtgatgctggagaatttggcccttttgtcctcactaggttcttggcatggagctgaggatgaggaggcaccttcacagcaaggtttttctgtaggagtgtcagaggttacagcttcaaagccctgtctgtccagccagaaggtccaccctagtgagacatgtggcccacccttgaaagacattctgtgcctggttgagcacaatggaattcatcctgagcaacacatatatatttgtgaggcagagctttttcagcacccaaagcagcaaattggagaaaatctttccagaggggatgattggataccttcatttgggaagaaccacagagttcacatggcagaggagatcttcacatgcatggagggctggaaggacttaccagccacctcatgccttctccagcaccagggccctcaaagcgagtggaagccatacagggacacagaggacagagaagcctttcagactggacaaaatgattacaaatgtagtgaatgtgggaaaaccttcacctgcagctattcatttgttgagcaccagaaaatccacacaggagaaaggtcttatgaatgtaacaaatgtgggaaattctttaagtacagtgccaatttcatgaaacatcagacagttcacactagtgaaaggacttatgagtgcagagaatgtggaaaatcctttatgtacaactaccgactcatgagacataagcgagttcacactggagaaaggccttatgagtgcaacacatgtgggaaattctttcggtacagctccacatttgttagacatcagagagttcacaccggagaaaggccgtatgagtgcagggaatgtgggaaattctttatggacagctccacactcattaaacatcagagagttcacaccggagaaagaccttataagtgcaatgattgtgggaaattttttaggtatatctccacactcattagacatcagagaattcacactggagaaaggccttatgagtgcagtgtatgtggggaattgtttaggtacaactccagccttgttaaacattggagaaatcacactggagaaaggccttataaatgcagtgaatgtgggaaatcatttaggtaccactgcaggctcattagacaccagagagtccacacgggagaaaggccttatgagtgcagcgaatgcgggaaattctttcgttacaactccaacctcattaaacattggagaaatcacactggagaaaggccttacgagtgcagagagtgtgggaaagcctttagccacaagcatatacttgttgagcaccagaaaatccacagtggagaaagaccttatgagtgcagcgaatgccagaaggcctttattagaaagtctcacctggttcatcaccagaaaatccacagtgaagagaggcttgtgtgctccatgaatgtggggaattctttagctaaaactccaacctcattaaacatcagagatttcacaatggagaaagtttaccattgactattgtaattgggtagtaatgttatataaattccacatttttatgcaactaatctccagaacatttttcctcttaccaagaagtaaaatgctgtacccattaacaacaactcattccccttccctacttccccagaaatgtctcaactatatttctatactctatggtacttatatgaggtaccaatagatatctatgaatttgatatatatttgtacctcatataagtggattctacagtatttatcttttgagactggcttatttcacttaggataaggtcttcacggttcacccatgttgtataatgtgtcagaatatccttcctttttaggtgaaataatattctatggtatttatataccacatttatttatccattcatctgttagtggatacttgggctacttccaccttttgcctattgaaataatgctgctatgaagatgagtgtacaagtgtctattcaagattctactttcaattcttatagggtatatactcagaaatggtggtgctggatcatataggatttctattttttttttttgtttgtttttgagacagagtcttgctctgtcacccaggctggagtgcagtgctgtgatcttggctcactgcaagctccgcctcccaggttcatgccattctcctgcctcaccctcccgagtagctgggactacaggtgcctgccaccacgcctggctaatttttttgtatttttagtagagacggggtttcaccgtgttagccaggatggtcctgatctcctgaccttgtgatctgcctgccttggcctctcaaagtgctgggattacgggcgtgagccaccgcgcctggccaggatttctatttttaatatttttgggaaaatttttccatagtacctgtgccattttacattcccaccagcagtgcacaaggattgcaatctatatacatcctcaccaacattgttcattttctatttctgtttttggggttttttgtagtgccttttgttttggatagcagctatcttgttggatgtgaggtggaatctatagtgtctttcatttttattttgtgaatgattgatgatgttgaggatcttttcatgtgcttgttaggcatttgtgtatctggaaaaatattcaagtcttttttttccatttttaatgggactatttgctttttgttgttgagttgtagttctttatacattctggatattaactccttaccaaatatatgctttttacatattacctcccagtccataggttgctttttcgctctgttgattgtgtcctttgatgaaattttaagttttgatgtactgttgactctttctgtctgtgggttctgtattcatggatcgaagcaaccatggatcaaaagtatttggagcatccatggattgcagtgatcattaatcaaaaatatttggaaaacaaaaagggtagttgcatctgtactaaacatgaacagacattttttcttgtcattattccctaaactatatagtataataaatatttacatagcatttacattgtattagaagttataaataacctaatgataatctatataggaagatgtgtgtaggttatattcaaacactatgcctttttatgtgagggacctcttgagcatcagatgattttggtatccacaaggggtcctggaatcagtcccccacagacaccaagggatgactgtagtgcattttatctatttttacttctgttacctgggcttttgatgttatatattaaaaaaaattagtatcaaatccaatgccaagcattttccctatgctttattctaagaattttatatttgaaggtcttacatttaggtcttttttttttttttcttttggaggcagagtcttgctctgtcacccagcctggagtgcagtagtggaatctcagctcactacaacctccgcctcctgggttcgagccatcaccccacctcagcctcccaagtagcttggattacaagtgtacaccaccacacctggctaatttttgtatttttagtagagatggggttttgccatgttggccaggctggtcttaaacttctggccttaagtgatccccctgcctcggcctcccaaattgctgagattacaggcaggagttgtaatgcactgtgcctggctacatttagatctttaatctacttggggttcatttttgcatatggtttaaggcaaaagtccactttatgtggctatccagttttccaagcaccattttttgaaaagagcatctttcctctgttgagtagtcttggcacacttgtcaaaatcatttgtccatatatgccatggtttatatgtggattctctattttattggtcatatgtctgtctttatgtcagtaccacacattttaggtgtgtgtgtgtgagactcagtgttgaggacaaggctagtgggctttcacactccagactgctgtattccagcccaaattactcaaattagccaatccatggggaacatggaaaacgtagctaatgcaatccgcttgccttacctaagttgtcccctgcagcctcaggttgctgttactgtgtttcagatgcaaccctctgtgggaccctacccaagttctctcattcttagctataggtaataaattgttctgattttgtgtatcc

SEQ ID NO: 3253 - DNA, 4512 bp, Homo sapiens
gggcgggacttccgccgtcctcctggtggtggtcgttttggttctgtgtggtgtttcaccaacttcggcctatggctctgtctgacgtcaccgaagtgacggaacggaaaagcgcgagaagcggctcggttcccaccacggagaggcgggagtgagtcaactgacaagcgctggggacagtggcgtccttgtcttgcctttgtcgctcccgccccgctcttccctggctgggctggcggaggccttgctgatgaacctgactgagggccgtgtggtctttgaggacgtggccatatatttctcccaggaggagtgggggcaccttgatgaggctcagagattgctgtaccgtgatgtgatgctggagaatttggcccttttgtcctcactaggttcttggcatggagctgaggatgaggaggcaccttcacagcaaggtttttctgtaggagtgtcagaggttacagcttcaaagccctgtctgtccagccagaaggtccaccctagtgagacatgtggcccacccttgaaagacattctgtgcctggttgagcacaatggaattcatcctgagcaacacatatatatttgtgaggcagagctttttcagcacccaaagcagcaaattggagaaaatctttccagaggggatgattggataccttcatttgggaagaaccacagagttcacatggcagaggagatcttcacatgcatggagggctggaaggacttaccagccacctcatgccttctccagcaccagggccctcaaagcgagtggaagccatacagggacacagaggacagagaagcctttcagactggacaaaatgattacaaatgtagtgaatgtgggaaaaccttcacctgcagctattcatttgttgagcaccagaaaatccacacaggagaaaggtcttatgaatgtaacaaatgtgggaaattctttaagtacagtgccaatttcatgaaacatcagacagttcacactagtgaaaggacttatgagtgcagagaatgtggaaaatcctttatgtacaactaccgactcatgagacataagcgagttcacactggagaaaggccttatgagtgcaacacatgtgggaaattctttcggtacagctccacatttgttagacatcagagagttcacaccggagaaaggccgtatgagtgcagggaatgtgggaaattctttatggacagctccacactcattaaacatcagagagttcacaccggagaaagaccttataagtgcaatgattgtgggaaattttttaggtatatctccacactcattagacatcagagaattcacactggagaaaggccttatgagtgcagtgtatgtggggaattgtttaggtacaactccagccttgttaaacattggagaaatcacactggagaaaggccttataaatgcagtgaatgtgggaaatcatttaggtaccactgcaggctcattagacaccagagagtccacacgggagaaaggccttatgagtgcagcgaatgcgggaaattctttcgttacaactccaacctcattaaacattggagaaatcacactggagaaaggccttacgagtgcagagagtgtgggaaagcctttagccacaagcatatacttgttgagcaccagaaaatccacagtggagaaagaccttatgagtgcagcgaatgccagaaggcctttattagaaagtctcacctggttcatcaccagaaaatccacagtgaagagaggcttgtgtgctccatgaatgtggggaattctttagctaaaactccaacctcattaaacatcagagatttcacaatggagaaagtttaccattgactattgtaattgggtagtaatgttatataaattccacatttttatgcaactaatctccagaacatttttcctcttaccaagaagtaaaatgctgtacccattaacaacaactcattccccttccctacttccccagaaatgtctcaactatatttctatactctatggtacttatatgaggtaccaatagatatctatgaatttgatatatatttgtacctcatataagtggattctacagtatttatcttttgagactggcttatttcacttaggataaggtcttcacggttcacccatgttgtataatgtgtcagaatatccttcctttttaggtgaaataatattctatggtatttatataccacatttatttatccattcatctgttagtggatacttgggctacttccaccttttgcctattgaaataatgctgctatgaagatgagtgtacaagtgtctattcaagattctactttcaattcttatagggtatatactcagaaatggtggtgctggatcatataggatttctattttttttttttgtttgtttttgagacagagtcttgctctgtcacccaggctggagtgcagtgctgtgatcttggctcactgcaagctccgcctcccaggttcatgccattctcctgcctcaccctcccgagtagctgggactacaggtgcctgccaccacgcctggctaatttttttgtatttttagtagagacggggtttcaccgtgttagccaggatggtcctgatctcctgaccttgtgatctgcctgccttggcctctcaaagtgctgggattacgggcgtgagccaccgcgcctggccaggatttctatttttaatatttttgggaaaatttttccatagtacctgtgccattttacattcccaccagcagtgcacaaggattgcaatctatatacatcctcaccaacattgttcattttctatttctgtttttggggttttttgtagtgccttttgttttggatagcagctatcttgttggatgtgaggtggaatctatagtgtctttcatttttattttgtgaatgattgatgatgttgaggatcttttcatgtgcttgttaggcatttgtgtatctggaaaaatattcaagtcttttttttccatttttaatgggactatttgctttttgttgttgagttgtagttctttatacattctggatattaactccttaccaaatatatgctttttacatattacctcccagtccataggttgctttttcgctctgttgattgtgtcctttgatgaaattttaagttttgatgtactgttgactctttctgtctgtgggttctgtattcatggatcgaagcaaccatggatcaaaagtatttggagcatccatggattgcagtgatcattaatcaaaaatatttggaaaacaaaaagggtagttgcatctgtactaaacatgaacagacattttttcttgtcattattccctaaactatatagtataataaatatttacatagcatttacattgtattagaagttataaataacctaatgataatctatataggaagatgtgtgtaggttatattcaaacactatgcctttttatgtgagggacctcttgagcatcagatgattttggtatccacaaggggtcctggaatcagtcccccacagacaccaagggatgactgtagtgcattttatctatttttacttctgttacctgggcttttgatgttatatattaaaaaaaattagtatcaaatccaatgccaagcattttccctatgctttattctaagaattttatatttgaaggtcttacatttaggtcttttttttttttttcttttggaggcagagtcttgctctgtcacccagcctggagtgcagtagtggaatctcagctcactacaacctccgcctcctgggttcgagccatcaccccacctcagcctcccaagtagcttggattacaagtgtacaccaccacacctggctaatttttgtatttttagtagagatggggttttgccatgttggccaggctggtcttaaacttctggccttaagtgatccccctgcctcggcctcccaaattgctgagattacaggcaggagttgtaatgcactgtgcctggctacatttagatctttaatctacttggggttcatttttgcatatggtttaaggcaaaagtccactttatgtggctatccagttttccaagcaccattttttgaaaagagcatctttcctctgttgagtagtcttggcacacttgtcaaaatcatttgtccatatatgccatggtttatatgtggattctctattttattggtcatatgtctgtctttatgtcagtaccacacattttaggtgtgtgtgtgtgagactcagtgttgaggacaaggctagtgggctttcacactccagactgctgtattccagcccaaattactcaaattagccaatccatggggaacatggaaaacgtagctaatgcaatccgcttgccttacctaagttgtcccctgcagcctcaggttgctgttactgtgtttcagatgcaaccctctgtgggaccctacccaagttctctcattcttagctataggtaataaattgttctgattttgtgtatcc

SEQ ID NO: 3254 - DNA, 3962 bp, Homo sapiens
agaatcttccggcgtctttccggtggtggtcgtttttgctgcctgcgagcgcgtccgcgggctgggcgtttccggctcgctgggtccgggccaggtaactggagccggaaaccggtggaggtggtgtccgcccgcagaggagcttgcctggtctcggtctgagcgtcgcccagcgatttgccaccgcacgcacgccggatcccgggctttaccgcccgcctttccaggccccgccccgcctaaagtcccatggccgaggcagcgctagtgattacgccgcagggccatgtgacctttgaggatattgctgtgtacttctcccaggaggagtggggcctccttgatgaagctcaaaggtgcctgtatcatgatgtgatgctggagaacttttcgcttatggcctcagtaggttgtttgcatggaatagaggctgaggaggccccttctgagcagactctttctgcgcaaggagtgtcacaggccaggactccaaagctaggtccttccatcccaaatgctcattcttgtgagatgtgtatcctggtcatgaaagacattttgtacctcagtgagcatcaggggacacttccctggcagaaaccttatacgtctgtggccagtgggaaatggttttcatttggttctaacctgcaacagcaccagaaccaggacagtggagagaaacacatcagaaaggaggagagcagtgccttgcttctgaatagctgcaaaattcctctgtcagacaatcttttcccatgcaaagatgttgagaaggattttccaaccatcctgggccttctccaacaccagaccacccacagcagacaagagtatgcacatagaagcagggagacctttcaacaaagacgttacaaatgtgagcaagttttcaatgagaaagttcatgttactgagcatcagagagtccacactggagaaaaagcttataagcgtagggaatatgggaaatccttgaactctaaatacttatttgttgaacaccagagaacccataatgcagaaaagccttatgtgtgcaatatatgtgggaaatcattcctccataaacaaacactcgttgggcaccagcagagaattcacactagagaaaggtcttatgtgtgcatcgaatgtgggaaatccttgagctccaaatactcacttgtggaacaccagagaacccataatggagaaaagccttatgtgtgcaatgtatgtgggaaatcattccgccacaaacaaacatttgttggccatcagcagagaatccacactggagagaggccttatgtgtgtatggaatgtgggaaatcttttattcattcctatgaccgcattcgacaccagagagttcacactggagaaggggcttatcagtgcagtgaatgtgggaaatccttcatatacaaacagtcacttcttgatcaccatagaatccacacgggagaaaggccttatgagtgcaaagaatgtgggaaggccttcattcacaaaaaaagacttcttgagcaccagagaattcatactggagaaaagccttatgtgtgcatcatatgtgggaaatcatttatccgctcgtctgactacatgcgacaccagagaattcacactggagaaagggcttatgaatgcagtgactgtgggaaagccttcatctccaaacaaacacttcttaagcatcacaaaatccacactagagaaaggccttatgaatgcagtgaatgtggaaaaggcttctaccttgaggttaaacttcttcagcaccaaagaatccatactagagaacaactttgtgagtgcaatgaatgtggaaaagtcttcagccaccaaaaaagacttcttgagcaccagaaagttcacactggcgaaaagccctgtgagtgcagtgaatgtgggaaatgctttagacaccgcaccagcctcattcaacaccagaaagttcacagtggagagaggccttataactgcactgcatgtgagaaggcctttatctataaaaacaaacttgttgagcatcagcgaatccacaccggagaaaagccgtatgaatgtggtaaatgtgggaaagccttcaacaaaagatattcccttgtcaggcaccagaaggtacatataacagaagagccctagcaattgttgggatgtgtaattgtcttattcactgtaggacaccagagagctgatttttcaagggatccaacagacagaaattcaccctcatacatctgcatatcactagttgaaagattcactacaaggtccaagtacttgggaagctttctagagattacttgtactttctaatctgcccagtgttacaacagacactaccatgtggcatatcctcaccgttttcatcagtcactcacatgtgctcaaggaatgcagaccactgtgcttaccaaattctgaagggaataatataataaaagcctgttgagggtcctcttccatcttgctgaactgttcgaggcaaagacaaaacccaactttgaccaagaagagcaatctggattcttgtagcccatggaggtttaccttcttcataggttttttttttttttatgtgattgccatagtgggatattccctctcccacattacccaagagggaaatgggctgtcttaccatgtgctgatgtatgtgctctgccagtgtgaagggtgaacagctccaactttatgtccccccagggacatagtatgagatcggaaaatagttcttagtcctgtttgtcttaatttttattggtttccaaggtctcctaggaaggagagcagagctgtgtggtcctaatcatggtgtcgatgccagatttatttgtaggtccagaggtctccctgagaagaggcatttgtgacaaactcaagtgctgggacctgcatgaattgtttatttgcagtgatgcttcatatttcccagcactgttcatggtatcttatttcccaggtccttcattgtagccatgggcactgaaggactgaattggtaggtaggtcactggttgtaagacctactggggccaggtaagaacagtaattggcccagacaggtaggtgtgataaacagagtagaaaagattgtggccaagaagagtgaatgtgtcccatccaaaggtgcatccagatatgtctgtgttactatggcttcatggtttgggggtatatagaaattctcaggacctcagacctttgattctcctttagcaacacacatcgtcagcataaggcatctaaagattttgtggactcataacttatgtactgtttttgagatgattgctgcacgggcaggaaagcaggatttgagagaacatacaccttgccttccagatatgtggtttttgtgattcacccagatctgttgtgccagttaggaattatctttattacttcccgtttattgccactgctgagaaggctgtccttcctaacttgtgaggagatgaatccttaataataagtaaatcttgtgttatcctatagtctggttttccaaaaggagaggtagatgcatatttttgtgtggaaccatttatcttaaaacattgaggtgcagttttcatacacaaaaccttctatctttttaagaactgtctgtatggtttattgcccagttaatgggttttgatagtcatgttatctcagtaagtgtcttgtcttagaaatatgtgtgtataggctgggtgcggtggctcatgcctgtaatcccagcactttgggaggccaaggcaggtggatcacctgaggtcaggagtttgagaccagcctgaccaacatggtgaaatccagtctctacttaaaatacaaaaattagccaggcgtggtggcgtgcatttgtaatcccagctacacaggaggctgaggcaggagaattgcttgaacctggggggcggaggttgcaatgagccaaggtcgcgccattgcactccagcctgggcgacagagtgacacttctc

SEQ ID NO: 3255 - DNA, 3933 bp, Homo sapiens
tttccggctcgctgggtccgggccaggtaactggagccggaaaccggtggaggtggtgtccgcccgcagaggagcttgcctggtctcggtctgagcgtcgcccagcgatttgccaccgcacgcacgccggatcccgggctttaccgcccgcctttccaggccccgccccgcctaaagtcccatggccgaggcagcgctagtgattacgccgcagattcccatggtaacagaagagtttgtgaaaccatcacagggccatgtgacctttgaggatattgctgtgtacttctcccaggaggagtggggcctccttgatgaagctcaaaggtgcctgtatcatgatgtgatgctggagaacttttcgcttatggcctcagtaggttgtttgcatggaatagaggctgaggaggccccttctgagcagactctttctgcgcaaggagtgtcacaggccaggactccaaagctaggtccttccatcccaaatgctcattcttgtgagatgtgtatcctggtcatgaaagacattttgtacctcagtgagcatcaggggacacttccctggcagaaaccttatacgtctgtggccagtgggaaatggttttcatttggttctaacctgcaacagcaccagaaccaggacagtggagagaaacacatcagaaaggaggagagcagtgccttgcttctgaatagctgcaaaattcctctgtcagacaatcttttcccatgcaaagatgttgagaaggattttccaaccatcctgggccttctccaacaccagaccacccacagcagacaagagtatgcacatagaagcagggagacctttcaacaaagacgttacaaatgtgagcaagttttcaatgagaaagttcatgttactgagcatcagagagtccacactggagaaaaagcttataagcgtagggaatatgggaaatccttgaactctaaatacttatttgttgaacaccagagaacccataatgcagaaaagccttatgtgtgcaatatatgtgggaaatcattcctccataaacaaacactcgttgggcaccagcagagaattcacactagagaaaggtcttatgtgtgcatcgaatgtgggaaatccttgagctccaaatactcacttgtggaacaccagagaacccataatggagaaaagccttatgtgtgcaatgtatgtgggaaatcattccgccacaaacaaacatttgttggccatcagcagagaatccacactggagagaggccttatgtgtgtatggaatgtgggaaatcttttattcattcctatgaccgcattcgacaccagagagttcacactggagaaggggcttatcagtgcagtgaatgtgggaaatccttcatatacaaacagtcacttcttgatcaccatagaatccacacgggagaaaggccttatgagtgcaaagaatgtgggaaggccttcattcacaaaaaaagacttcttgagcaccagagaattcatactggagaaaagccttatgtgtgcatcatatgtgggaaatcatttatccgctcgtctgactacatgcgacaccagagaattcacactggagaaagggcttatgaatgcagtgactgtgggaaagccttcatctccaaacaaacacttcttaagcatcacaaaatccacactagagaaaggccttatgaatgcagtgaatgtggaaaaggcttctaccttgaggttaaacttcttcagcaccaaagaatccatactagagaacaactttgtgagtgcaatgaatgtggaaaagtcttcagccaccaaaaaagacttcttgagcaccagaaagttcacactggcgaaaagccctgtgagtgcagtgaatgtgggaaatgctttagacaccgcaccagcctcattcaacaccagaaagttcacagtggagagaggccttataactgcactgcatgtgagaaggcctttatctataaaaacaaacttgttgagcatcagcgaatccacaccggagaaaagccgtatgaatgtggtaaatgtgggaaagccttcaacaaaagatattcccttgtcaggcaccagaaggtacatataacagaagagccctagcaattgttgggatgtgtaattgtcttattcactgtaggacaccagagagctgatttttcaagggatccaacagacagaaattcaccctcatacatctgcatatcactagttgaaagattcactacaaggtccaagtacttgggaagctttctagagattacttgtactttctaatctgcccagtgttacaacagacactaccatgtggcatatcctcaccgttttcatcagtcactcacatgtgctcaaggaatgcagaccactgtgcttaccaaattctgaagggaataatataataaaagcctgttgagggtcctcttccatcttgctgaactgttcgaggcaaagacaaaacccaactttgaccaagaagagcaatctggattcttgtagcccatggaggtttaccttcttcataggttttttttttttttatgtgattgccatagtgggatattccctctcccacattacccaagagggaaatgggctgtcttaccatgtgctgatgtatgtgctctgccagtgtgaagggtgaacagctccaactttatgtccccccagggacatagtatgagatcggaaaatagttcttagtcctgtttgtcttaatttttattggtttccaaggtctcctaggaaggagagcagagctgtgtggtcctaatcatggtgtcgatgccagatttatttgtaggtccagaggtctccctgagaagaggcatttgtgacaaactcaagtgctgggacctgcatgaattgtttatttgcagtgatgcttcatatttcccagcactgttcatggtatcttatttcccaggtccttcattgtagccatgggcactgaaggactgaattggtaggtaggtcactggttgtaagacctactggggccaggtaagaacagtaattggcccagacaggtaggtgtgataaacagagtagaaaagattgtggccaagaagagtgaatgtgtcccatccaaaggtgcatccagatatgtctgtgttactatggcttcatggtttgggggtatatagaaattctcaggacctcagacctttgattctcctttagcaacacacatcgtcagcataaggcatctaaagattttgtggactcataacttatgtactgtttttgagatgattgctgcacgggcaggaaagcaggatttgagagaacatacaccttgccttccagatatgtggtttttgtgattcacccagatctgttgtgccagttaggaattatctttattacttcccgtttattgccactgctgagaaggctgtccttcctaacttgtgaggagatgaatccttaataataagtaaatcttgtgttatcctatagtctggttttccaaaaggagaggtagatgcatatttttgtgtggaaccatttatcttaaaacattgaggtgcagttttcatacacaaaaccttctatctttttaagaactgtctgtatggtttattgcccagttaatgggttttgatagtcatgttatctcagtaagtgtcttgtcttagaaatatgtgtgtataggctgggtgcggtggctcatgcctgtaatcccagcactttgggaggccaaggcaggtggatcacctgaggtcaggagtttgagaccagcctgaccaacatggtgaaatccagtctctacttaaaatacaaaaattagccaggcgtggtggcgtgcatttgtaatcccagctacacaggaggctgaggcaggagaattgcttgaacctggggggcggaggttgcaatgagccaaggtcgcgccattgcactccagcctgggcgacagagtgacacttctc

SEQ ID NO: 3256 - DNA, 3599 bp, Homo sapiens
gacgtttgtggtggggcgtgttggtccgcgctctcagaactgtgctgggaaggatggtagggcgactggggctcacctccgcaccgttgtaggacccggggtagggttttgagcccgtgggagctgccccacgcggcctcgtcctgccaacggtcggatggcggagacgaaggacgcagcgcagatgttggtgaccttcaaggatgtggctgtgacctttacccgggaggagtggagacagctggacctggcccagaggaccctgtaccgagaggtgatgctggagacctgtgggcttctggtttcactaggtgacagagcacaagttcataccagagagccaaccacttacccgccagtcttatctgagcgggcctttctccggggaagcctgactctggaatcttcaacctcaagtgattcgaggttggggagagctagggatgaggaagggcttttggaaatgcagaaaggtaaagtgacaccggagacagacctccacaaggagacccatcttgggaaagtgagccttgaaggtgaaggtttggggacagatgatggtctgcactccagggcattacaagagtggttatcagcagatgttctccatgaatgtgactcacagcaaccagggaaagacgccttgattcatgcagggacaaacccctacaaatgcaagcagtgtgggaaaggttttaacaggaagtggtatctcgttcgacatcagagggttcacactggaatgaaaccctatgaatgcaatgcatgtgggaaagcctttagccagagctcaactctcattcggcactacctcatccacaccggggagaaaccatacaagtgccttgagtgtgggaaggccttcaaacgcaggtcgtacctcatgcagcaccatccaatccacactggagagaaaccctatgagtgtagtcaatgtcgaaaggccttcacccaccggtctacttttattcgccataataggacccacactggagaaaagccctttgagtgcaaagaatgtgagaaagcctttagcaatagagcccacctaattcaacattacatcatccacactggagagaagccctatgattgcatggcatgtggaaaggccttcagatgcagctcagaactcatacagcaccagcggattcacactggggagaagccctatgaatgcacccagtgtgggaaagcctttcaccggagcacgtacctcattcagcactctgtcatccacactggggagatgccctacaagtgtatcgagtgtgggaaggccttcaaacgcaggtcacaccttctgcagcaccaaagggtccatacatgagagaaccctattgctgcaatgaatacagcaaggcctttacccactgttattttatcattcataatgggacccacactgtaggaagaagtccttcgaatgcaaagaatgtcaggaaacttttcattttttttgtcagctctttcttaactaacacatgagcagtcactttggagagaagccctgtgaatacagtgaatgtaaggatcccttcagtcaccactcagttctcactcattgcagaaggattcataccagggggaaatgtggaaggcattccatcaacatcagagaactcatgctggagaaagacattccaaatataactattaaggacagtctttggccagagcagaaatcttactatctgagaatcataatgaaaagttactacataattgttattgatgtgagaaaactttgtgaccaggttgtcacttgcttgtcctataaagagccatgctggaatttgacccaccttgggattttctctatgaacttatgaaaaccttcagttacaggacagagtgcacagtttcctctcctgtgggaaggagagttgactcttgaggacccccaccctcctgcatcctctctctggaaggctgcatgtattgtagctgtggctgtacttgtacctaaggccctgggttcaagagagttggagaaacccctctagaaacatattggctgtcatcaaagggttctttccaggcctgaggacctaggccccagtttgtcccaaagcaggagtgttttccatgggataaaggacaccctaggtttttcttagcttccagctctttccatacagtcttcactgaagtgtttggtacaaggatctactatgaacttgctgctgtgatagaaaaactgcttaaggttgaaaagagaaatttaagaaattgctgacggaataaaaacataatagaactacaacaccgaaggaaatgaaagaagcaagaaggaaagcaccagaagtgatttggaagagaaatcctaaaatgaatgtgaacaacagagtgatcagaagagtgtagggaattaatagtttctttaaacaagccatctcacaatggaagcctgtgtgtcttgaaattgctgtggttattattcactctgccctttgaagaactgcagaaattcatagggcaatgttaagtgtttgtgtctccaaaaaagatgttggagtcgttaccctcagaacctcaggtaatcatgttagttaatccattaggttagttcctaattgactatgactgtgtccttagaaaaatgggaaatttggtcacagaggcagatgtacagagggaagacgatgtgaagacacaggaagaacatcttcaagccaaggaacacacggggctaccagaagccgagatagaagcatggaacatatgttctagtaagaagtgtctgggttgttttggttttttttctttggagtttttgtggtattaaattatttttaaattatgttttattgtagacctcacaattctttttttttctttttcactcaaactacagcaaaatattatatttctatcctatatttcatgggcttacctctagccaattgtttttaactgccatgtaatattttacatcatgaagctttcatccttgattcaaatcctctgattatggacatgtatttcctccattttcctgctatgaaatatatcaccaccagcttgattcaaccttaaaaataaggtcatcagtattatgttctaaataaacttatggccatacatgagaaatgtaccttgcagctgaatggctaggtcatatggtgatctagtatgtaactggaattatgttatacattgcccttcctctcccataagatggacaaaagtgtttctgtatcactgtgtcccagacaatatttagaattacccagctttccagtttttactttagaagtttaaagtgatatagaatatatctggtatttctcatattgaaatacatttgaacattagttcatatcctttcattgccttttgtttttcctcttctgtcaatggtctactcatatgttggcctgtctttatttgtatcttgactttttattgtgtattttgtttatggtggggtactttattggtgattaatacgattttcaagtatattatatgggctagtcccttgatactattgacactgtatttatcttcagtctcttgttggtatctaactttggttctgaagtttatggaatggaagtatttaattggaaagattaaacatattgattttaatt

SEQ ID NO: 3257 - DNA, 3695 bp, Homo sapiens
gacgtttgtggtggggcgtgttggtccgcgctctcagaactgtgctgggaaggatggtagggcgactggggctcacctccgcaccgttgtaggacccggggtagggttttgagcccgtgggagctgccccacgcggcctcgtcctgccaacggtcggatggcggagacgaaggacgcagcgcagatgttggtgaccttcaaggatgtggctgtgacctttacccgggaggagtggagacagctggacctggcccagaggaccctgtaccgagaggtgatgctggagacctgtgggcttctggtttcactagggcatcgggttcccaaaccagagttggtccacctgctagagcatgggcaggagctgtggatagtgaagagaggcctctcacatgctacctgtgcaggtgacagagcacaagttcataccagagagccaaccacttacccgccagtcttatctgagcgggcctttctccggggaagcctgactctggaatcttcaacctcaagtgattcgaggttggggagagctagggatgaggaagggcttttggaaatgcagaaaggtaaagtgacaccggagacagacctccacaaggagacccatcttgggaaagtgagccttgaaggtgaaggtttggggacagatgatggtctgcactccagggcattacaagagtggttatcagcagatgttctccatgaatgtgactcacagcaaccagggaaagacgccttgattcatgcagggacaaacccctacaaatgcaagcagtgtgggaaaggttttaacaggaagtggtatctcgttcgacatcagagggttcacactggaatgaaaccctatgaatgcaatgcatgtgggaaagcctttagccagagctcaactctcattcggcactacctcatccacaccggggagaaaccatacaagtgccttgagtgtgggaaggccttcaaacgcaggtcgtacctcatgcagcaccatccaatccacactggagagaaaccctatgagtgtagtcaatgtcgaaaggccttcacccaccggtctacttttattcgccataataggacccacactggagaaaagccctttgagtgcaaagaatgtgagaaagcctttagcaatagagcccacctaattcaacattacatcatccacactggagagaagccctatgattgcatggcatgtggaaaggccttcagatgcagctcagaactcatacagcaccagcggattcacactggggagaagccctatgaatgcacccagtgtgggaaagcctttcaccggagcacgtacctcattcagcactctgtcatccacactggggagatgccctacaagtgtatcgagtgtgggaaggccttcaaacgcaggtcacaccttctgcagcaccaaagggtccatacatgagagaaccctattgctgcaatgaatacagcaaggcctttacccactgttattttatcattcataatgggacccacactgtaggaagaagtccttcgaatgcaaagaatgtcaggaaacttttcattttttttgtcagctctttcttaactaacacatgagcagtcactttggagagaagccctgtgaatacagtgaatgtaaggatcccttcagtcaccactcagttctcactcattgcagaaggattcataccagggggaaatgtggaaggcattccatcaacatcagagaactcatgctggagaaagacattccaaatataactattaaggacagtctttggccagagcagaaatcttactatctgagaatcataatgaaaagttactacataattgttattgatgtgagaaaactttgtgaccaggttgtcacttgcttgtcctataaagagccatgctggaatttgacccaccttgggattttctctatgaacttatgaaaaccttcagttacaggacagagtgcacagtttcctctcctgtgggaaggagagttgactcttgaggacccccaccctcctgcatcctctctctggaaggctgcatgtattgtagctgtggctgtacttgtacctaaggccctgggttcaagagagttggagaaacccctctagaaacatattggctgtcatcaaagggttctttccaggcctgaggacctaggccccagtttgtcccaaagcaggagtgttttccatgggataaaggacaccctaggtttttcttagcttccagctctttccatacagtcttcactgaagtgtttggtacaaggatctactatgaacttgctgctgtgatagaaaaactgcttaaggttgaaaagagaaatttaagaaattgctgacggaataaaaacataatagaactacaacaccgaaggaaatgaaagaagcaagaaggaaagcaccagaagtgatttggaagagaaatcctaaaatgaatgtgaacaacagagtgatcagaagagtgtagggaattaatagtttctttaaacaagccatctcacaatggaagcctgtgtgtcttgaaattgctgtggttattattcactctgccctttgaagaactgcagaaattcatagggcaatgttaagtgtttgtgtctccaaaaaagatgttggagtcgttaccctcagaacctcaggtaatcatgttagttaatccattaggttagttcctaattgactatgactgtgtccttagaaaaatgggaaatttggtcacagaggcagatgtacagagggaagacgatgtgaagacacaggaagaacatcttcaagccaaggaacacacggggctaccagaagccgagatagaagcatggaacatatgttctagtaagaagtgtctgggttgttttggttttttttctttggagtttttgtggtattaaattatttttaaattatgttttattgtagacctcacaattctttttttttctttttcactcaaactacagcaaaatattatatttctatcctatatttcatgggcttacctctagccaattgtttttaactgccatgtaatattttacatcatgaagctttcatccttgattcaaatcctctgattatggacatgtatttcctccattttcctgctatgaaatatatcaccaccagcttgattcaaccttaaaaataaggtcatcagtattatgttctaaataaacttatggccatacatgagaaatgtaccttgcagctgaatggctaggtcatatggtgatctagtatgtaactggaattatgttatacattgcccttcctctcccataagatggacaaaagtgtttctgtatcactgtgtcccagacaatatttagaattacccagctttccagtttttactttagaagtttaaagtgatatagaatatatctggtatttctcatattgaaatacatttgaacattagttcatatcctttcattgccttttgtttttcctcttctgtcaatggtctactcatatgttggcctgtctttatttgtatcttgactttttattgtgtattttgtttatggtggggtactttattggtgattaatacgattttcaagtatattatatgggctagtcccttgatactattgacactgtatttatcttcagtctcttgttggtatctaactttggttctgaagtttatggaatggaagtatttaattggaaagattaaacatattgattttaatt

SEQ ID NO: 3258 - DNA, 1146 bp, Homo sapiens
atgttggtgaccttcaaggatgtggctgtgacctttacccgggaggagtggagacagctggacctggcccagaggaccctgtaccgagaggtgatgctggagacctgtgggcttctggtttcactaggtgacagagcacaagttcataccagagagccaaccacttacccgccagtcttatctgagcgggcctttctccggggaagcctgactctggaatcttcaacctcaagtgattcgaggttggggagagctagggatgaggaagggcttttggaaatgcagaaaggtaaagtgacaccggagacagacctccacaaggagacccatcttgggaaagtgagccttgaaggtgaaggtttggggacagatgatggtctgcactccagggcattacaagagtggttatcagcagatgttctccatgaatgtgactcacagcaaccagggaaagacgccttgattcatgcagggacaaacccctacaaatgcaagcagtgtgggaaaggttttaacaggaagtggtatctcgttcgacatcagagggttcacactggaatgaaaccctatgaatgcaatgcatgtgggaaagcctttagccagagctcaactctcattcggcactacctcatccacaccggggagaaaccatacaagtgccttgagtgtgggaaggccttcaaacgcaggtcgtacctcatgcagcaccatccaatccacactggagagaaaccctatgagtgtagtcaatgtcgaaaggccttcacccaccggtctacttttattcgccataataggacccacactggagaaaagccctttgagtgcaaagaatgtgagaaagcctttagcaatagagcccacctaattcaacattacatcatccacactggagagaagccctatgattgcatggcatgtggaaaggccttcagatgcagctcagaactcatacagcaccagcggattcacactggggagaagccctatgaatgcacccagtgtgggaaagcctttcaccggagcacgtacctcattcagcactctgtcatccacactggggagatgccctacaagtgtatcgagtgtgggaaggccttcaaacgcaggtcacaccttctgcagcaccaaagggtccatacatga

SEQ ID NO: 3259 - DNA, 3699 bp, Homo sapiens
gtcctcctcgtggcggtcattttggcctctgtcctgtttgtccagcccgccagtttctgcagtggaggtcgcgactgagggacgggacagagaagtcgcgaaagtgggccagaggttctgcgacaccacctcgggtgagctgcgccaggcccgggatagggactgttgtgttcgaatgcccgccccggtcggccgccgctccccgcctagtccacggagctcaatggcggcagtcgcgctgagggactcggctcagggtatgacctttgaggatgtggccatttatttctcccaagaagagtgggagctccttgatgagtctcagaggttcctgtactgcgatgtgatgctggagaactttgcacatgtaacatccctgggttattgccatggaatggagaatgaggcgatagcttctgagcagagtgtatctatacaggtcaggacttctaagggcaatacacccacccagaaaactcacctcagtgagattaagatgtgtgtcccagtcttgaaagacattttgcctgcggctgagcaccaaaccacatcccctgtgcaaaagtcatacttgggtagcacaagcatgagaggcttctgcttcagtgctgaccttcaccagcatcaaaagcattacaatgaagaagagccctggaaaaggaaggtggatgaggctacatttgtgaccggctgcagattccatgtgttgaattatttcacctgtggggaggccttcccagcccccacggacctactccaacacgaagccactcccagtggtgaggagccacacagtagcagcagcaagcatatacaggcatttttcaatgcaaaaagttattacaagtggggtgaatacagaaaagcttcaagccacaaacacacacttgttcagcatcagagtgtctgttctgaaggagggctttatgagtgtagcaaatgtgagaaagccttcacttgcaagaacacacttgttcagcaccagcaaattcacactggacaaaagatgtttgagtgtagtgaatgtgaggaatcctttagcaaaaagtgccacctaatcttacacaagataattcacactggagaaaggccttatgaatgcagtgatcgtgagaaagcctttatccataaatctgaattcattcaccaccagagacgtcacactggaggagtgcgtcatgagtgtggtgaatgtaggaaaacctttagctacaaatctaacctcattgaacaccagagagttcacactggagaaaggccttatgaatgtggcgagtgcgggaaatcctttagacaaagctctagcctttttcgacaccagagagttcactctggagaaaggccttatcagtgctgtgagtgtgggaaatcctttagacaaatcttcaatctcattcgacatagaagagttcacactggagaaatgccttatcagtgcagtgattgtgggaaatcttttagctgcaaatcggaactcattcaacaccagagaattcacagtggagaaagaccttatgaatgcagagaatgtgggaaatcctttagacaattctctaacctcattcgacaccgcagcattcacactggtgataggccttatgagtgcagtgaatgtgagaaatcctttagccgcaaatttatcctgattcaacaccaaagagttcacactggagaaagaccttatgaatgcagtgaatgtggaaaatcctttacccgcaaatctgacctcattcaacaccggagaattcatactggcacaagaccttatgagtgcagtgaatgtggcaaatcttttagacagcgctctggcctcattcagcaccggagacttcatactggagaaaggccttatgaatgtagtgaatgtggaaagtcttttagccaaagtgctagcctcattcaacaccagagagttcacactggagaaaggccttatgaatgtagtgaatgtgggaaatcctttagccagagctctagcctcattcaacaccagagaggtcacactggagaaagaccttatgagtgcagtcaatgtgggaaaccctttacccacaaatcagaccttattcagcaccaaagagttcacactggagaaaggccttatgaatgcagtgaatgtgggaaatcctttagccgcaaatctaacctcattcgacatcggagagttcacactgaagaaaggccttaaatgtgaagggaatgtgctatttctttattcagtataatagcactggaggagactgtggtagccatcttcgtaaatttaaactttgagcacccacagtggggtattcttcataagtttcaggtatgtgggaagctctgaggaggttcattgtaatttctaatctgccgaggcctatagcctgatttatgtcactgccaatttctgaggctgaagccatttcacatttcacccctaccacctggcaggtgcacaccatgtgcatgagtcacttccccacagtgctcagagaagcaaacctctgtactctcccatttgcttggggaaattattaatagcccaagcatgtagggtcttcatgtcttttctctgactttagagtatacacctgacccagttgtggtccagagaatctgagttgtgctgtcagctttctaaggattacttttttaaggaacattgtcggtctcacatgatgcttgtaatgaatttttccacattctgattcaccagcctggaaactgcttggtgcacattgctttaatttataatgtttttataaaggttttaaaaaaatttacgcacctttaatcttgggtgttctattcattgcatagaatgacttgtaagcagaatagtgatgtcagcatgaaggggtgaatagattttgtggagatctcaaactttctgtactcagaagggacaatgtgatggcagaagacagctctttgttctgtattgctctaattggcctgctgcccaaggcctcaaagtaaagactgccaggctttgtgttcctgtattgtggcctggtgccatttttgtcaggtcagaggtcaccatgaaaaggaggcagttgtgacaatccccagtgcttctgtgaacgtgaattttgttcagttgtccacaggagatccacataattcctagcactggtgaggggaatctgttgcccaggtcctgcaaaggagccaggtgccatggcatataagtcagtgtagactggtgccatttgttgtcagactataggtgtggaggtgaaattacaggttcaacagtaattgggacagaaactccaggtaaatggggagtggagaagactgcagtaaattagatggaatgactcttctaaaagttcatctacaaattttccagtgaatatggttgtgtaggatcagtgcatacagaaattctcaggatcttctgtttactatcgctgagatcattatcagaaaatagtctggccgggcatggtgtaatcctaacactttgggaggccaaggcgggcggattgcctgagctcaggagttcaagaccagcctgggcaacatggtgaaatcccatgtctactaaaatacaaaaaattagccaggcgtggcagcatgcgcctatagtcccagccacttgggaggctgaggcaggagaatcgcttgaacccagaaggcggaagttgcagtgagctgagattgcaccactgcactccagcccaggcaacagagtgagactccgtctcc

SEQ ID NO: 3260 - DNA, 3699 bp, Homo sapiens; identical to SEQ ID NO: 3259

SEQ ID NO: 3261 - DNA, 1525 bp, Homo sapiens
gtcctcctcgtggcggtcattttggcctctgtcctgtttgtccagcccgccagtttctgcagtggaggtcgcgactgagggacgggacagagaagtcgcgaaagtgggccagaggttctgcgacaccacctcgggtgagctgcgccaggcccgggatagggactgttgtgttcgaatgcccgccccggtcggccgccgctccccgcctagtccacggagctcaatggcggcagtcgcgctgagggactcggctcagggtatgacctttgaggatgtggccatttatttctcccaagaagagtgggagctccttgatgagtctcagaggttcctgtactgcgatgtgatgctggagaactttgcacatgtaacatccctggttacctctcatcaaaagcattacaatgaagaagagccctggaaaaggaaggtggatgaggctacatttgtgaccggctgcagattccatgtgttgaattatttcacctgtggggaggccttcccagcccccacggacctactccaacacgaagccactcccagtggtgaggagccacacagtagcagcagcaagcatatacaggcatttttcaatgcaaaaagttattacaagtggggtgaatacagaaaagcttcaagccacaaacacacacttgttcagcatcagagtagagttcacactggagaaaggccttatgaatgtggcgagtgcgggaaatcctttagacaaagctctagcctttttcgacaccagagagttcactctggagaaaggccttatcagtgctgtgagtgtgggaaatcctttagacaaatcttcaatctcattcgacatagaagagttcacactggagaaatgccttatcagtgcagtgattgtgggaaatcttttagctgcaaatcggaactcattcaacaccagagaattcacagtggagaaagaccttatgaatgcagagaatgtgggaaatcctttagacaattctctaacctcattcgacaccgcagcattcacactggtgataggccttatgagtgcagtgaatgtgagaaatcctttagccgcaaatttatcctgattcaacaccaaagagttcacactggagaaagaccttatgaatgcagtgaatgtggaaaatcctttacccgcaaatctgacctcattcaacaccggagaattcatactggcacaagaccttatgagtgcagtgaatgtggcaaatcttttagacagcgctctggcctcattcagcaccggagacttcatactggagaaaggccttatgaatgtagtgaatgtggaaagtcttttagccaaagtgctagcctcattcaacaccagagagttcacactggagaaaggccttatgaatgtagtgaatgtgggaaatcctttagccagagctctagcctcattcaacaccagagaggtcacactggagaaagaccttatgagtgcagtcaatgtgggaaaccctttacccacaaatcagaccttattcagcaccaaagagttcacactgga

SEQ ID NO: 3262 - DNA, 2352 bp, Homo sapiens
agtagcgaccatttccattggcgttagggagtccttggagcgctgtgttgggaccgtggtggtgactggatccaggaggtcgagagtcgttcttctctttgcacagacgtgactctgcagctctttaacggcgcccgctgctctcaacccagcttaccccacgtggtcccatggcggcggccgcgctaaggttccccgttcagggcacagtgacttttgaagacgtggctgtgaaatttacccaggaggaatggaatctccttagtgaggctcagagatgcctgtaccgtgatgtgacgctggagaacctggcacttatgtcctccctgggttgttggtgtggagtggaagatgaggcggcaccttctaagcagagtatttatatacaaagagagactcaggtcaggactcctatggcaggtgtgtctcccaagaaggcccacccctgtgagatgtgtggcccgatcttgggagacattttgcatgtggcagatcatcagggaacacatcacaagcagaaactgcacaggtgtgaggcctgggggaataaattgtatgacagtggaaactttcatcagcaccagaatgagcacattggagagaaaccctacagagggagtgttgaggaggcgttgtttgcgaagaggtgtaagttgcatgtgtcaggggagtcatctgtcttcagtgagagtgggaaagactttttgctcaggtcaggattactccagcaagaggccactcacactgggaagtcaaacagcaaaactgagtgtgtgtctctgtttcatgggggaaaaagccattacagctgtggaggatgcatgaaacattttagcaccaaagatatactcagtcagcacgagagactgctccctacagaagaaccttctgtgtggtgtgaatgtgggaaatcctctagcaaatatgacagcttcagtaatcatcaaggagttcacactagagaaaaaccttatacgtgtgggatatgtgggaaattatttaacagtaagtcccacctccttgtacaccagagaattcacactggagagaagccatatgagtgtgaggtttgtcagaaattttttaggcacaagtaccacctcattgcacaccagagagttcacactggagaaaggccatatgaatgcagtgattgtgggaagtcatttacccacagctctacattccgtgttcataagagagttcacactggtcagaagccttatgagtgcagtgaatgtgggaaatcttttgccgaaagctccagtctcactaaacacaggagagttcacactggagaaaagccttacgggtgcagtgaatgtgaaaaaaaatttaggcaaatctcttcacttcgtcatcatcagagagttcacaaaagaaagggcttatgagtgcagtgagtccagtctcattaaatattggagaatacacacctgagtaagatcctgtgattgcagcaaatgtggaaaatgtttacccaaaggtctgctctccttggatattggagagttcacactagagaagagtccttacaagtaaaataaatttgggcagttttgtagccacacctctgtattccttcaggattatagttaacactgaatgaaggccttactagtgtgacaaatacaggatatttatccagaagtctggctgcataactcacaggagagctgtcatgtgggaggattgctacatgggaggatttgcttgagcctgggaggcagaggttgcagtgagccgagattgcaacactgcagtccagtctggaccacagagtgagaccctgtttcaaaaataaaatatataaatgacatccaataaagtatgcatatttgagctgtaggataagtcttgaattttctttttcttttttttgagacagcctcgctctgtcacccaggctggagtacagtggcataatctcggctcactgcaagccctgcctcctgggttcatgccattctcctgcctcagcctccctaatagctgggactacaggcaaccaccaccactcctaccttttttgtatttttagtagagatggggtttcaccctgttagccaggaagttctcaatctcctgacctcgtgatctgcccgccttggcctctcaaagtgttgggattgcaggcgtgagccactgctcctggcttgaattttcttataatcccatgaaaccatcatcagagtcacaataatgaatttatctaatctatcacctttgtattcacctggagcctttataaagtttttctctatgcagacaaccattgatttactctgctgtataatactttccattttctagaattttctgactgatgtaataaagtgtttcctcttataa

SEQ ID NO: 3263 - DNA, 3698 bp, Homo sapiens
gagtttacctctgcgcgcgtcggggttggtggcggcggctgcggcgagttcctgaggggcgcctgcggggggcgtccgctccgagcgccgaggagccgagcggaggaggcgtcccagggacacgcaggggaggccggccggcctgcacggggcgctcccgcctcgggggccctgtctggcgcctcagcgcgcgccccgatggtcacctgcgcccacctgggccggcgcgcgcggctcccggcagctcagccctctgcctgcccaggaacctgcttttcccaagaggagagaatggctgctgggtacctgccccgctggtcccaggaattagtaacctttgaggacgtgtccatggacttctcccaggaggagtgggagttgctggagcctgctcagaagaacctgtacagagaggtgatgctggagaactacaggaacgtggtctccctggaagccttgaagaaccaatgtactgatgtggggattaaagagggtccactttccccagcacaaacctcacaagtcactagtctttcctcatggacggggtatttactttttcaaccagtggcttcttcccacttggagcaaagagaagccctgtggatagaggaaaaaggaactcctcaagcctcctgttcagattggatgactgtactaagaaaccaagactcaacttacaagaaggtggctttgcaggaggaaccagccagtggtataaatatgataaagcttatcagagaagatgggggatggaagcagttagaggacagccatgaagacccccaggggcttttgagccaaaaggcatcccttcacgtagtggccgttcctcaggagaaggctactgcatggcatggatttggggaaaatggtaatctgagcccagcccttgttttatcacagggaagctctaaagggaaccacttgtgtggcagcgagttagatattacaagcttggcatccgattcagtcttaaaccaccatcagctgggatatgcagatcggagaccttgtgaaagtaatgaatgtggaaatgccatccgccagaacagtcactttattcaacacggggggaagatgtttgtgtatttggaaaatgggcagtcattgaaccacggtatggccctgactatccacaacaaaatcaacacggcagagaaaccctttgagtgccaccagtgtgggaaggtgttcaaccggaggcattctttgagcgaacatcaaagaattcacacgggggagaaaccctacgagtgtcaggagtgtgggcgagcctttacgcacagctccaccctcacgcgccatctgagaactcatactggagagaagccctacgggtgcggtgagtgcgggaaagccttcaacaggatctcatcgctgactcagcatcagaggattcacaccggggaaaagccctataaatgtgaagactgtgggaaatccttctgccagagctcttacctgatcttgcacaagaggacacacaccggagagaagccctacgaatgcagtgaatgtggaaaggccttcagtgaccgttcctctctcaaccagcacgagcgaactcacacgggcgagaacccctatgaatgtaagcagtgtgggagagccttcagccagaggtcttcccttgtgaggcacgagagaactcacactggagagaaaccctacaggtgtcaggaatgtgggaaagccttcagccagagctcatcccttgtcacacatcagaaaactcacagcagccagaaaacctataaaatcattgactgtgggaaagcgttctaccagaacagacatcttattggatattagcaattgcacgctgctttgtaagccactttttagtactctgacacatacatgtggttatcttttgccctgttgtgatggataatttgaaaagaagtgggtttatgtcaccttctcaccttcttataagaaagctctgagaatgggcatttttgtattttgttgttgttgttgagatggagtctgccacccaggctggagtccagtggcgtgatcatacctcactgcagcttcaacttcctgggctcaagtaatcctcccaccccagcctcccaggtagctagtactataggtgtgcaccaccacgcccagcaaatttttaaatttattatagagtgggaggcagggtgcggtggctcatgcctataatcctaacactttaggaggccgaggcgggtggatcatgaggtcaggagatcgagaccatcctggctaacacagtgaaaccctgtctctactaaaaatacaaaaaagtagccgggcgtggtggtgggcgcctgtagtcccaactactcaggaggctgaggcaggagaatggtgtgaacccgggaggtggagcttgcagtgagccgagatcgcaccactgcactccagcctgggagacagagcgagactccgtctcaaaaaaaaaaaaaaaattatagagttggggtcttgctacattgccaagactggtcttgaactcctggggtcaagcatcctcctgtcttggcctcccaaagtgttgggattagaagcatgagccgctgtgcccagcctgacggggccttttagtgggaggagttgccattacactacgtccagtaagctccagactttcggaaaagattggtggacgggaatgctgtcatggatgggatcttgccaagaaccatcacgtgttaatttagttgcttaaacaaaaggtgttctgtttcttaactacttctgtgtctttactttttatttcattgttcattgtttttattttaatattcttttctgggtttatatgagacgagttttcactctgttgctgaggctgaagtgcagtggcgtgatcatagctccctgtagtcagccttcatctcctggactcaagcaatcctcccacctcagcctctccggtagctgggactacacatgtgcaccgctaccacacccagctaaattttttttttgtatttttgtagtgatgggctttcaccaggttgcccaggctggtctcaaactcctgagctcaagcaatccacccaccttggcctcccaaagtgctggtattacaggtgtgagccaccgtgctggtattacgggtgtgagccactgtgctgggattacgggcgtgagctgcccatgctgggattacgggtgtgagccaccgtgctggtattacgggtgtgagccaccgtgctgggattacgggcgtgagccactgtgctgggattacgggcgcgagccactgtgctgggattacaggtgtgagccaccctgctgggattatgggtgcgagccgccgtgctgggattacaggtgtgaaccactgctcctggcctttatttcagcattctgtttcagtgtttcacattggccacttagctagatccgtttgtcttctgcagtactgtgctgatccagagtatatgctaagacggaaagcgctttggaggtaaagtttaaaaaatacaagggcttcaaaatagtactagtaatttgatccattcacaaaaggacaaaggctggacagagacgtgaagaaatgaatcatttacgcaatgattggggtgttccaattatgtgtgattttgtgttttctgccgtttcattttgtattgccataatcattttgacaatgaatacaaatcaaatagcacccaaaattgtgaaggatacggaacctcattgatgag

SEQ ID NO: 3264 - DNA, 8547 bp, Homo sapiens
cgagctctgtctaatcaggcccctgggacgggacgcctctgtcctagccgtgagtgccccgcctgcccctagcggtccctggcgtcccggttcctgtcgcgctcacctgcgccggtagcgaagaaatcgccccgggacatggactcagtggtctttgaggatgtggctgtggacttcaccctggaggagtgggctttgctggattctgctcagagggacctctacagagatgtgatgctggagacctttcagaacctggcctcagtagatgatgaaactcaatttaaggccagtgggtcagtttctcagcaggatatttatggagagaaaatacccaaggaatctaaaatagccacgttcaccagaaatgtttcctgggcctctgttttaggaaaaatttgggacagtcttagcatcgaagatcaaaccacaaaccaggggagaaatctcagtagaaatcatgggttggagagactctgtgaaagtaatgatcaatgtggagaagccctcagccagattccacatcttaatctgtacaagaaaattccacctggagtaaaacagtatgaatacaacacgtacggaaaagtcttcatgcatcgccgcacatccctcaagagtcccatcacagttcacactggacacaaaccatatcagtgccaggaatgtgggcaggcctacagttgtcgttcacacctaagaatgcatgtgagaacccacaatggagagagaccctatgtgtgtaaattatgtgggaaaacctttcctcgtacttcctccctcaatcggcatgtaaggattcacactgctgagaaaacctacgaatgtaagcaatgtgggaaagcctttattgacttctcaagtcttactagtcatctcagaagtcacaccggagagaagccatataagtgtaaggaatgtgggaaagctttcagttattcctcaacgtttcgaagacacacaataacacacactggcgagaagccatataaatgtaaggaatgtgcggaagcctttagttattcctcaacttttcgaagacatatgatttcacacactggagagaagccacataaatgtaaagaatgtggggaggccttcagttattcttcggcttttcgaagacacatgataacacacactggagagaaaccctacgaatgcaaacaatgtgggaaaaccttcatttatctccagtcctttcgaagacatgaaaggattcacactggagagaaaccctacgaatgcaaacagtgtgggaagaccttcatttatccccagtcctttcgaagacatgaaaggactcatggtggagagaaaccctatgaatgcaaccagtgcgggaaagcattcagtcacccctcctcctttcgaggacacatgagggtgcacactggagagaaaccctatgagtgcaagcaatgtgggaaaactttcaattggcccatatctttacgaaaacatatgagaacacatactagagagaaaccctatgaatgtaagcagtgtgggaaagccttcagcttgtctgcttgctttcgagaacatgtgagaatgcaccctgaagacaaatcctatgaatgcaagctatgtgggaaagctttctattgccacatatccttacaaaaacatatgagaagacataccgcagagaaactctataaatgcaagcagtgtgggaaagctttcagttggcctgaacttttgcaacaacatgtgagaacgcacactgtagagaagccctatgaatgtaaggaatgtgggaaggtcttcaaatggccatcatctttaccaatacatatgagactgcacactggagagaaaccttatcaatgtaagcattgtgggaaagcattcaattgttcctcatccttaaggcgacatgtgagaatacacactacagaaaaacagtataagtgtaatgtaggacatcctcctgcaaatgaattcatgtgcagtgcttcagaaaagtcacaccaggagagagatctgatcaaagttgtaaatatggtgttgcctttatgagttccttatcctgaaagtggacactcaaggagtgtgtctgtagttcatttgcaaataaacatttagttgaaaaataattctccaaatactctcagctatcctacatgaatttgaacaggtagtttcttacgattcagtaaataaaactttcatcttagagtgttttggactcatggatgatttgaagtgtatttttaatatgcaagtaggttcaagttttatttaatttcttaaattgtaactgacttagtgtgacaggtattggatattacgtatctattatattttccaccttttttactgggagtatttttattgtttggccagaggagccttattccattttttaagaagtagttggcagaattttgtaattatgcaaagttgtttaaggagtatagcctcaaatgaattgtaatttttaatgtttgcccattgctgtttgtctttgcttgtgattgtgaattggacagtaggctttgacttgtgatgtgacggagaaatccagagttgcagatagttcttctgcattgttgtcagtgtgggtagtgttaggaacttcatttgctggaatgcatttcctttatggttccatgtccaaatttaccaatagcaataacttgaatgaaatttagaatgaagaagaagtaagtcatcgctgagcttttggggtcacattaaatggagatggacagatgcataggggctttgtgaacatcaaccttcagcttattttccagattcttattcctgccaatcaagagtaccatcaaaagaaacacttaagtgcttgatttccactgtgtcagaggtgtagtcttcctcagacatctccattaacttgatattagggatattcctgtgtggtcagtcacctagagtctggatttttctcaaaaccctgcatgacctcttgaccactgattcagactgtcttgtttggcagtctctgagcttctgattctcccgttctgtagatcttaacatatttgcatggggtctaatttatatagtgaacaccttgttatcttaatacttccagtggctctgtgatcctgattccaccacgaaagccacagtgttgcagtcaaagaagaaaaacaacacatgggactttgtaccctattgcatttttaagtgtgcctgccgagtcctatgtgagaacaaataccttcctcatatattagatttagggagatttctgttactcagaactaaatgcagtttcttgatataggttaaattattaggtttgattatgtatcattaaaaataatgtggattttgtttcaaggaaaaccttctgtagatatttcttagaaatatcctgtttagctgggcacagtagctcatgcctgtaatccctgcactttgggaggcttgaggtcaggagtttgagaccagcctggttaacatggtgaaaccctgtctctactaaaaacacaaaaattagccaggcatggtggtgagtacctgtaaccccagctacttgggaggctgagacaggagaagtgcttgaacctaggaggcggaggttgcagtgagccaagatcacaccactgcactccagcctgggagacggggaaagactccatcacacaagcaagaaaagaaaaaaaaatcctatttactgtgctttcaaattagttgtttagagactatattaatttcccagggctgccataacaaagtacaaaaactgggtgacataggaaaacaaactttttgtttctcagttctggacccagaaatccagaaacaaggcattggcaggaccatgctttttctgaagatgctagggaaggatctgtttcagaactcacctagcttctggtagttccttagcttgtggcagcataactctaattttcacatggcattctccctgtgtgtgtgtctctccatgtgacaatatttttatacatacacaccactcattgggttaggccccactctacttcagtatgattttaccttaactaattacattggcaacagctctcttttcgcatactgaggcaccgcgaattaagatttcaacgtaaaaattttaggagacccaattcaacccataacactaagaaatgttattttttgtttaccgagagaattacagatttcaaatcaactttgtaattttgataatttaagcatgttacattttgaatcagtattaccaagtatatacaaatacaggtattttttcatataaatgttatttttaattgctgtatacttaacatttgccattaaaatgattttttttttttgagacagagtctcgctctgtcacccaggctggagtgcagtggcacgaccttagctcactgcaaccttcatctcccaggttcagttgattctcctgcctcagcctcccgagtagttgggattacaggcatgcaccaccacacccagctaatttttttatttttggtagagatggggtttcaccatgttggccaggctggtcttgaactcctgacctcaggtgatctgcccaccttggcctcccaaagtgttgggattacaggcatgagccaccacacccggcctaaaatgatttcttatttgtggttaataacaattaaaaagcggaaataatggttttgtcaaggccctctacccagaaaccaccaggatcacactggtagtcaaagaaaatttgctgtgttgagttgaagtttgaacacatgatcaagaaagggctgtggcttgtatcagagggtgtttaaaaggatttactatcagatttggccttgtgttctgtgattttggtgagcgttcaaggaagccaggctttggtctggattggatgttctcaggtcatgaatataattctctgggaactcccaaagttctcatctacaaagcagaagttaattggagctgaaaactaatcagtaaagccacagcagccagtcatatgggggagaagaggggaatgtttgatggtttttgtggtttagaggtgagttccggaaaaaaagaagacatgtttgacatcctcaaacgagaaaatttttcatgtgttttataggccaaggaggcagaagcttttgttttaatgagccagaaagccccaaaagcctatttaagttttctcaggtatcatttcaacctctgaacttccagaattaactagggaagaggaaaaacatgtaacaccttagagttttattaaagagcaaacaatatccagtaatctccattactttccatgttaacataagttttcataacgctctatagatgaatgtgatttggcagtcacttgtatttcttaacacccacttacccatcattccctcttagatgaaaaaagttaagcacggggacaacagagtcttgtatattcatgtagctcatgatgatggaatcaagtttgaaggcttaacctgtgcttaacctatattgggcattgtcaagacttaaatttagaacactggaaagcaagtataattaattttacaaatagggcatcaaattttacaaagactcctaaggctatatggtattccttttataagacatggaaaaggcaaagataagggaaacgaacaaatcgctggttagaagtaggggatttgagtacatatgggcttaagagtgttctgtcatgattgtagtggtgaaaacaagcatttgcaaaaactcataaggctactcttaaaatagcaaattttgttgtatgtatattttaaagttaaacaataaaaatgctttcagtttattaaagaactcaagaccaggtgcagtggctcatgcctataatcccagcactttgggaagctgaggcgggaggattgcttgtggccaggaggttgaggctgcagtgaactatgatcatgcactgcactctacactgggcgacagagcaagaccctgtctcaaaaaaaaaggaatacaaaacattcctgaaacttgacatgtaagttcgcaataagacttttccctagctgggcgcggtgactcatgcctgtaatctcaacattttgggagactgaggcaagaggatcacttgaagtcaggagctagacaccagtctgggcaacatagcgagacctcaactctaccaaaaaattaaaaagtgagccaggcggggtggtgcacgtctgtggtcccagctacttggcaggctgaagcaggaggatcacttgaggccttgaggagccatgatcgtgccactgcactccagcttgggtgacagagcaagactgtctcaaaaaataaaaataaaaaaacaagacttcccccaccatcttggaattctctggaggaaatgtagggctggttgacaaggacttgtgcctcgtcagaccctgtttgaaacccagtctgaagttttgaaacacccacaagggccatacctgactttatctcacgcacataacaggagagaagaaggaggtcttccagaatctgtctttgagtttacaccaggttcttcccatctgatctttgggaatgctgtggttctgaaacataaaacggggaccctacacttcttcccaggaatatcctgcctgggagcatcctgatcctgtcttcagacaaggggcatccgcatcttgttttctagggcctttcctgaggccacttccagctccaaagttctcatctcaagctcagctctgtgtcttcatgctgggaaacgtctttatggatccccaaactcctcttgctgttgggaacacgtggcagccctgcgttgtgaggtgagagaagaggcagtggcagaacccatgccatggagacacgcccatcagccacagcagctcctgctactgcataaatccataggcacaatcacacgcctcacggtgtcaacatctcccatgacatcacaaagatgcccagctgggacccacctacagtgatggggtgatggggtttcacctataagcgggcaaacaggcactcctcctcactgtccagtcacctgacgtgctttttctgcgcactcaggtcgtgacaccccaggaggtgcctatcgcgccccaagctcctcacgtgcctcctccccacagtccaggacgcgtcttactaacgcctcaccagagcgcatgcgccctcctcaggagcagcctcaaagcgcgcagcctcagcccattggcctgcgggaagtggagttcccgaacagaagcccctcagtctccggaagccccgcccggcagactgttcccaggatgcaacacgggctcgcgtctaaaagagctgtgctttgttggggctatctgggagtttccgccttccatgaagtgcgcaggcgcacttaggcgaggcggggcgactctaggaagtggagacatcaagagtggtactggaagtggcggaagctctcctcttgccctcttcagcttccggtgtggtgggtcccggatatcgcgtggctgtggcaggtagacagcccgtgctccagaggccttcatcttgtgatggcagatgtacttgagtagacacgacagacggggaaggaccctgatggtccgagggaccttccacagcaagtagaaggcactgctgtgaatatgatggcgtcagaggtgactgcaaaaaaggacagggcagctgggcgaggaagagataccagtgatgtcctaactgagctccctgggtctggtagtgaggagctcagtcttagaatatgagccgtgtcaggggctacagcatcatcactcttgtcctgtcgcagactcaggctccctgttctcaggttcttatgtagacagtgagggctcagggaggctcccaccaccaccaccaccagcaccaccactccatcaaaacggctgaaggaccttcctttagggttcgggggatctcctccttccacaagggatggatgtgaagacaactcattctttgatgttcagatggttgtggccctctgatgagatgtgtgcacaccttgccaaatgcatatgtctgttgagcctggacattaagtatttcttgatgttcttctgtgtaacaggtgatgtcctaggtgctgcagtgaacagaagagacaaaatatccttgttcccttgaagctaatgtcgtaggggcccaaaacaaagcaaacaaacaaaaaaaaggaatgcaagtcaagtacactttgtatggacagtggtaattcctaagaaggaaaacaaagatggacttaaggggtgcagagggcctggactatgtgtgtctgtgggatagtctgttactacctctgggactctcatctcttgagtgtgcttgggtgtgtccaaccgtttttcctagtgacaaagtctgggtaattctgtggggacatatattggtgtatctgggaggtcccatgtgtctcagtggtggtccctgttttcaggaaagagtgtctgtgaatgtccatgtgtctcactgcacagctgtgatttttctgtgtctctgtgttttccagtctttgtgtgatgaaatataaaggcctagcaggctcagagttattaatgaattgtacttaagcgttgagaggcatatatttattgcactattaaattcttccaaaatatagtt

SEQ ID NO: 3265 - DNA, 1770 bp, Homo sapiens
cgagctctgtctaatcaggcccctgggacgggacgcctctgtcctagccgtgagtgccccgcctgcccctagcggtccctggcgtcccggttcctgtcgcgctcacctgcgccggtagcgaagaaatcgccccgggacatggactcagtggtctttgaggatgtggctgtggacttcaccctggaggagtgggctttgctggattctgctcagagggacctctacagagatgtgatgctggagacctttcagaacctggcctcagtagatgatgaaactcaatttaaggccagtgggtcagtttctcagcaggatatttatggagagaaaatacccaaggaatctaaaatagccacgttcaccagaaatgtttcctgggcctctgttttaggaaaaatttgggacagtcttagcatcgaagatcaaaccacaaaccaggggagaaatctcagaaatcatgggttggagagactctgtgaaagtaatgatcaatgtggagaagccctcagccagattccacatcttaatctgtacaagaaaattccacctggagtaaaacagtatgaatacaacacgtacggaaaagtcttcatgcatcgccgcacatccctcaagagtcccatcacagttcacactggacacaaaccatatcagtgccaggaatgtgggcaggcctacagttgtcgttcacacctaagaatgcatgtgagaacccacaatggagagagaccctatgtgtgtaaattatgtgggaaaacctttcctcgtacttcctccctcaatcggcatgtaaggattcacactgctgagaaaacctacgaatgtaagcaatgtgggaaagcctttattgacttctcaagtcttactagtcatctcagaagtcacaccggagagaagccatataagtgtaaggaatgtgggaaagctttcagttattcctcaacgtttcgaagacacacaataacacacactggcgagaagccatataaatgtaaggaatgtgcggaagcctttagttattcctcaacttttcgaagacatatgatttcacacactggagagaagccacataaatgtaaagaatgtggggaggccttcagttattcttcggcttttcgaagacacatgataacacacactggagagaaaccctacgaatgcaaacaatgtgggaaaaccttcatttatctccagtcctttcgaagacatgaaaggattcacactggagagaaaccctacgaatgcaaacagtgtgggaagaccttcatttatccccagtcctttcgaagacatgaaaggactcatggtggagagaaaccctatgaatgcaaccagtgcgggaaagcattcagtcacccctcctcctttcgaggacacatgagggtgcacactggagagaaaccctatgagtgcaagcaatgtgggaaaactttcaattggcccatatctttacgaaaacatatgagaacacatactagagagaaaccctatgaatgtaaggaatgtgggaaggtcttcaaatggccatcatctttaccaatacatatgagactgcacactggagagaaaccttatcaatgtaagcattgtgggaaagcattcaattgttcctcatccttaaggcgacatgtgagaatacacactacagaaaaacagtataagtgtaatgtaggacatcctcctgcaaatgaattcatgtgcagtgcttcagaaaagtcacaccaggagagagatctgatcaaagttgtaaatatggtgttgcctttatga

SEQ ID NO: 3266 - DNA, 1632 bp, Homo sapiens
gagtgaccacaggtgtccccgtcgtgctcacctgcaccggctgcgaggagcagggagctcctcaaagagctcaggaacggacaggacatggacacagtggtctttgaagacgtggttgtggatttcacgctggaggagtgggccttgctgaatcctgctcagagaaaactctacagagatgtcatgctggagaccttcaagcacctggcctcagtagataatgaggctcagcttaaagccagtgggtctatttctcagcaggatacttctggagaaaaattatccctcaaacagaaaatagaaaagttcacaagaaagaatatatgggcctcccttttaggaaaaaattgggaagaacatagcgttaaagacaagcacaacaccaaggagagacatttgagcagaaatccaagggtggagagaccatgtaaaagcagtaaaggtaataaacgtggaagaaccttcagaaagactcgaaattgtaatcgtcatctgcgcaagaattgttgtactagtgtaagacggtacgaatgcagtcagtgtggaaaactcttcacccattcctcatccctgataaggcacaaaagagctcactctggacaaaaattatataaatgtaaggaatgtgggaaagccttcagtcgcccttcctacctacagacgcatgagaaaactcacagtggagagaaaccctatgcctgtcaatcttgcgggaagacatttcttcgttcccactctctcactgaacatgtaaggactcacactggagagaaaccctacgaatgtgggcagtgtgggaaaggcttcagttgtcccaaatcctttcgcgcacatgtgatgatgcacgccggagggagaccgtatgagtgcaagcactgtgggaaagccttcaggtgtcagaaatcctttcgagtccatatgatcatgcacgccggagggagaccgtatgagtgcaagcagtgtgggaaagcctactgctgggcaacatcctttcaacgacacgtgagaattcacaacggggagaaaccctataagtgtggaaaatgcgggaaagcattcggttggccctcatccttacacaaacacgcgagaacgcatgctaaaaagaaacctgtgagtgggggcagcgtgggaaagtcttccgcgaggcctcgcccctccacagatgtcaaatcacaaactagagagaaagtctataaatgtgaaacgtgtgggaaaacgtatggttggtcctcatctttacacaaacatgagagaaagcacactggggagaaacctgtaaatgcagccagtgtgggaaaaccttcaggcgggctttgctcttccaaaaatgtaagaacgcagattggacagaagcccagtaaatgcgaaaaatgtgggaaagctttcagttgtcccaaagcctttcaaggtcatgtgagaagtcacacaggaaagaaatcctgtacatctaagtaatgggggaaaacctgtgcaaattaattcacatacatggttcagaaaattcacagcaggagggccgggcgcagtggctcacgcctgtaatcccagcactttgggaggccgaggcaggcggatcacgaggtcaggagatcaagaccatcctggctatggtgaaaccccgtctctact

SEQ ID NO: 3267 - DNA, 6002 bp, Homo sapiens
ctgccacagacccgcgccaggacgaccctgcctccgcggctgtccctagccagggcccaacctggttctattaataactaagcaaactagaacacctcagccggaggctggggtgcgcggctgctgcacctgcagcctgaacccgggggtcctgacacgccgcattttgggctgggaccagctggagccggaagcggaggtgcagtgtggctagccggagaccggaagcggaagcgcgcttgtgtcttgtgagaagagccgcgcttgcagcgtctgggagaatctttcggtctccgcgagaggtgcttcattccacgaaaaaagtataattcaagctcagatttgtgttgaaaccagcctcaagtttcacctatcctcactgatccgtggacttctgtatgatcagggtgctgtcctgagagcgctgcgggataaaggaggagcgtcctgcttcccggctgccctgttgctgtcggagtcacaggatggcggctgtcgtcctgcccccaactgccgctctgtcttccctgttcccagcctctcagcgagaaggacacacagagggcggagagctggttaatgagctcctgaaaagctggctaaagggcttggtgacctttgaggatgtggccgtggagttcacccaggaggagtgggcattgctggaccctgcccaaaggacactgtacagggacgtgatgctggagaactgcaggaacctggcctcactggggaaccaagttgataaacctaggctgatctcccagctggagcaagaagataaagtgatgacagaagagagaggaattctctcaggtacctgtccagatgtggagaatccatttaaagccaaagggttaactcctaagctgcatgtttttcgaaaagaacaatctagaaatatgaaaatggagaggaatcatcttggagcaacactcaacgaatgtaatcagtgttttaaagtcttcagcacaaaatcttcccttacacggcacaggaagattcatactggagaaagaccctatggctgcagtgaatgtgggaaatcctacagcagtagatcttaccttgctgttcataagagaatccacaatggggagaaaccctatgaatgcaatgactgtgggaaaaccttcagcagcagatcttaccttactgttcataagagaatccacaatggggagaaaccctacgaatgcagtgactgtgggaaaaccttcagcaattcctcatacctcagaccgcacttgagaattcacactggagaaaaaccgtacaaatgtaaccagtgttttcgtgagttccgcactcagtcaatcttcacaaggcacaagagagttcatacgggggagggtcattatgtatgtaatcagtgtggaaaggctttcggcacgaggtcatctctttcttcgcactatagcattcatacaggggagtacccttacgaatgccacgattgtgggagaaccttcaggaggaggtcgaatctgacacagcacataagaactcatactggagaaaaaccctacacatgtaatgagtgtgggaaatcctttaccaatagcttttctcttacaattcacaggagaatacataatggagagaaatcctatgagtgcagtgattgtggaaaatcctttaatgttctctcatccgttaagaaacacatgagaactcacactggaaaaaaaccctatgaatgtaattattgcgggaaatccttcacaagtaactcctacctttctgtgcatacgagaatgcataataggcaaatgtgaattcaataactgtgggaaaagcattcattgatctttcatgcctcagataacatgagcaaactctaacaagatgtatgaatcacctgctactgtgtaacaaattaccccccaaaattttgtggcttcaaacaaaaacacttgttatctcaaaatttttgtaggtcaggaattcagaaacaacatagctctatagttcttcaggatatctcaagaggttacagtccagatgtcagcagaactgtaatcatccagaattgttactggtgaagggaccacttccaaatggcttacaagcccgacaagtgcatgctagctgtttccaagggagctgcgcttccaaatcacgtaggcctctcaacagggctgagtttctttatggaagcaacttctccccaaagccagtgatctaaaggagccaacacagaaagcataatgtcttttatgacctagcttcagtgagatatgttttcatgtccctgttacattggtcatacacaccaatcctgatacaatgtggaagaacaccacaggaggtatgaacagtagacatttggaaccatctggaaaacttgccatgaaatcagtggaggaaagccttcagctgaccctcatttttttttttttaagacaatgtctcactctgtcacccagtctggagcgcagtggtgtgatcacagctcactgcagcctctacttcctgggatcaagtaattctcctgccccagcctccaatgtagctgggactacaggtgcatgacaccatgtctggctaatttgtttttttttaaactagagggagggttttgccatgttgcccagactagtctcaaactcctaggttcaagcagtcctttcatcttggcctccagaagtactgggattacaggcatgaaccaccatgcccagccaacttctaaactgatcaatatgggagtagcattcaatcacccacaggttaactcactctagagagaaatcttgtgagtgtaatctgtatggtaaaactttgagctcaaactttccccctaccaaaaaaaaagtatctactggggagctgcccaggtaatgcagtagctgtaggaaagccttcagtgatggcttcagggagtcacatgacaactcacaataaggggaaaccctgtgtgtggcatcaaaaatggaaaaccaggggacactcattccttaagtcacatttcggagatcatacaacagaggaatatgttgagtatacacagtgttgaaaagcctgtgacacaaacagtcatattaccaagcacaagacagtatagtttggtatgctataaaagccttgaatattctctccatttttaagaagtgagattcatactagaaaaaccattgaattccatcagtattagaatgtcatttttccacatttttaggaacctaactcagtgtaagataacaatttatacaatttattttttgagacagggtttcatctgtgcccaggctgtagtgcagtggtgcaatcttggcttattgtaacctctgcctcccaggcttaagggatcctcccacctcagcctcccaagtagctgggactgtaggcatgcaccaccatgcctgtctagtttttgtaaagatggggattcaccatgtttcccaggctgctctcaaactcctgggctcaagtgatccacctgcctcagcctcccaaaatgctgggaatacaggaacgagctaccactctcagccagaacttcttaagataaaggatgagggaatgttttcagtgatacctcttatattaggaaaaatatgtaaatgttccttggatgcaatactcacgagtgtattaatttcagaaaaattttcagtgattcctccctttatgcatgagagaattcatttagaggaagccctaggaacgtaatcaatgttaggatgcctcatctcttaactgagtggccacgcagtaacttagaacaaaaggtgtaagtgctatgaatgtggaattaccttcatcaatgtctcatttgtaggttgggccactagctcgttcattttcagtcttttaatataaacatttatggctatagtggtcctgaaaatcttactacctcgttttatatacagtgtatttattataattctaaaacatcaatacaccaaatattcagaaaggtatttccaaacagctcctgagtgatctagtttgttataatagaaattagacatttgccaggtgtggtggctcacacctataaacctagcattttgggaggctgaggcgggcagatcaccggaggtaaggagcttgagaccagcctggccaacatggtgaaaccccgcttctactaaaaaatacaaaaattagccgggtgtggtggcaggcatctataatcccagctactcaagaggctgaggaaggagaatcacttgaacccgggaaatggaggttgcagtgagccaagatcatgccacttcactccagcctgggcaaaagagtgcaactctgtctcaaaaaaaaaaaaatcagacaatatttgatatatttttttctaatttaatagtattttgccagagtacatggactttgtgattttggttgttttctctttgtgtcctaatatagcaaatactgtttctttttttttttttttttttttttgagacggagtcttgctctgttgtccaggctagaatgcagtggcgcgattgtggctcactgcaagctctgcctcccagattcacgccatcctcctgcctcagcctcccgagtagctgggactacaggtgcccatcaccatgcccggctaatttttcatatttttagtagaaatggggtttcactgtgttagccagtatggtctcaatctcctgacctcgtgatccacctgcctcggcctcccaaagcactgggattacaggcgtgagccaccatgcccggcacaaatactgtttcttaatgttcattctccctacttaaagaaaaagataagttgtcaatgagcagtattgaaaatgtacagtggggccaggcgccatggctcatgcctgtaatcccagcactttgggaggccgaggcaggcggaccacctgaggtcaggagttcaagactagcttggccaacgtggtgaaacctcgtctctactaaaaaaaatacaaaaattagctgggcgtgatgacaggtgcctgtaatcccagctacttgggaggctgaggcaggagaatcgcttgagcctgggaagcggaggttgcagtgagccgagattgcacaaccacactccagcttgggcgacagagtgagactccatctcaaaaaaagatgtacagtgtactaggctttcctgaagcttagacaggctttatcccactctgctggctaaaagaagtaggaataacgcactgggtgagacaccgtctggcttattctcatctattttcttttcattcttttggaaagtggacacaaagcatagagttaaaagagcttttttttttttttttttttttttcttcactgtggtgataaaaaccacagtgcaggggctgggcgtggtggctcacgcctgtaatcccaccactttgggaggccaaggcaggcggatcacctgaggtggggagttcgagaccagcctgatcaacatggagaaaacctgtctctcctaaaaatacaaaattaaccgagcatgttggcgcatgcctgtaatctcagctacttggaaggctgaggcaggagaattgcttcaaactgggcagaggttgcagtgagccaaggttgacccactgcactccagcctgggcaacaagagcaaaactccatctcaaaaaaaaaaaaaaagaaagaaacagtgccgaaaaatcacaatgatttgagttcttcaaaaacctttgattggctgcattggctctgttctgcatattactagacttcttacatgatcacaagtaaccactaattggttaaaaccaaagagagagagagagagagtgtgtgtgtgtgtgtgtgtgtttggttggggggtgttgtgttagcttccaggtgaatgcattatctgttaatcctgtttattgatctgtttttataagtgctccatgattctctgaaaacagtatactatgtatctaatttttggatacaggatggacatacgtactcaaactgtgtttttcaatttgtactgtatttgtttctctcgacctgacttagtgatagaggtatattaaagtcttccactagcatggtagattaacaaa

SEQ ID NO: 3268 - DNA, 5990 bp, Homo sapiens
ctgccacagacccgcgccaggacgaccctgcctccgcggctgtccctagccagggcccaacctggttctattaataactaagcaaactagaacacctcagccggaggctggggtgcgcggctgctgcacctgcagcctgaacccgggggtcctgacacgccgcattttgggctgggaccagctggagccggaagcggaggtgcagtgtggctagccggagaccggaagcggaagcgcgcttgtgtcttgtgagaagagccgcgcttgcagcgtctgggagaatctttcggtctccgcgagagacgaaaaaagtataattcaagctcagatttgtgttgaaaccagcctcaagtttcacctatcctcactgatccgtggacttctgtatgatcagggtgctgtcctgagagcgctgcgggataaaggaggagcgtcctgcttcccggctgccctgttgctgtcggagtcacaggatggcggctgtcgtcctgcccccaactgccgctctgtcttccctgttcccagcctctcagcgagaaggacacacagagggcggagagctggttaatgagctcctgaaaagctggctaaagggcttggtgacctttgaggatgtggccgtggagttcacccaggaggagtgggcattgctggaccctgcccaaaggacactgtacagggacgtgatgctggagaactgcaggaacctggcctcactggggaaccaagttgataaacctaggctgatctcccagctggagcaagaagataaagtgatgacagaagagagaggaattctctcaggtacctgtccagatgtggagaatccatttaaagccaaagggttaactcctaagctgcatgtttttcgaaaagaacaatctagaaatatgaaaatggagaggaatcatcttggagcaacactcaacgaatgtaatcagtgttttaaagtcttcagcacaaaatcttcccttacacggcacaggaagattcatactggagaaagaccctatggctgcagtgaatgtgggaaatcctacagcagtagatcttaccttgctgttcataagagaatccacaatggggagaaaccctatgaatgcaatgactgtgggaaaaccttcagcagcagatcttaccttactgttcataagagaatccacaatggggagaaaccctacgaatgcagtgactgtgggaaaaccttcagcaattcctcatacctcagaccgcacttgagaattcacactggagaaaaaccgtacaaatgtaaccagtgttttcgtgagttccgcactcagtcaatcttcacaaggcacaagagagttcatacgggggagggtcattatgtatgtaatcagtgtggaaaggctttcggcacgaggtcatctctttcttcgcactatagcattcatacaggggagtacccttacgaatgccacgattgtgggagaaccttcaggaggaggtcgaatctgacacagcacataagaactcatactggagaaaaaccctacacatgtaatgagtgtgggaaatcctttaccaatagcttttctcttacaattcacaggagaatacataatggagagaaatcctatgagtgcagtgattgtggaaaatcctttaatgttctctcatccgttaagaaacacatgagaactcacactggaaaaaaaccctatgaatgtaattattgcgggaaatccttcacaagtaactcctacctttctgtgcatacgagaatgcataataggcaaatgtgaattcaataactgtgggaaaagcattcattgatctttcatgcctcagataacatgagcaaactctaacaagatgtatgaatcacctgctactgtgtaacaaattaccccccaaaattttgtggcttcaaacaaaaacacttgttatctcaaaatttttgtaggtcaggaattcagaaacaacatagctctatagttcttcaggatatctcaagaggttacagtccagatgtcagcagaactgtaatcatccagaattgttactggtgaagggaccacttccaaatggcttacaagcccgacaagtgcatgctagctgtttccaagggagctgcgcttccaaatcacgtaggcctctcaacagggctgagtttctttatggaagcaacttctccccaaagccagtgatctaaaggagccaacacagaaagcataatgtcttttatgacctagcttcagtgagatatgttttcatgtccctgttacattggtcatacacaccaatcctgatacaatgtggaagaacaccacaggaggtatgaacagtagacatttggaaccatctggaaaacttgccatgaaatcagtggaggaaagccttcagctgaccctcatttttttttttttaagacaatgtctcactctgtcacccagtctggagcgcagtggtgtgatcacagctcactgcagcctctacttcctgggatcaagtaattctcctgccccagcctccaatgtagctgggactacaggtgcatgacaccatgtctggctaatttgtttttttttaaactagagggagggttttgccatgttgcccagactagtctcaaactcctaggttcaagcagtcctttcatcttggcctccagaagtactgggattacaggcatgaaccaccatgcccagccaacttctaaactgatcaatatgggagtagcattcaatcacccacaggttaactcactctagagagaaatcttgtgagtgtaatctgtatggtaaaactttgagctcaaactttccccctaccaaaaaaaaagtatctactggggagctgcccaggtaatgcagtagctgtaggaaagccttcagtgatggcttcagggagtcacatgacaactcacaataaggggaaaccctgtgtgtggcatcaaaaatggaaaaccaggggacactcattccttaagtcacatttcggagatcatacaacagaggaatatgttgagtatacacagtgttgaaaagcctgtgacacaaacagtcatattaccaagcacaagacagtatagtttggtatgctataaaagccttgaatattctctccatttttaagaagtgagattcatactagaaaaaccattgaattccatcagtattagaatgtcatttttccacatttttaggaacctaactcagtgtaagataacaatttatacaatttattttttgagacagggtttcatctgtgcccaggctgtagtgcagtggtgcaatcttggcttattgtaacctctgcctcccaggcttaagggatcctcccacctcagcctcccaagtagctgggactgtaggcatgcaccaccatgcctgtctagtttttgtaaagatggggattcaccatgtttcccaggctgctctcaaactcctgggctcaagtgatccacctgcctcagcctcccaaaatgctgggaatacaggaacgagctaccactctcagccagaacttcttaagataaaggatgagggaatgttttcagtgatacctcttatattaggaaaaatatgtaaatgttccttggatgcaatactcacgagtgtattaatttcagaaaaattttcagtgattcctccctttatgcatgagagaattcatttagaggaagccctaggaacgtaatcaatgttaggatgcctcatctcttaactgagtggccacgcagtaacttagaacaaaaggtgtaagtgctatgaatgtggaattaccttcatcaatgtctcatttgtaggttgggccactagctcgttcattttcagtcttttaatataaacatttatggctatagtggtcctgaaaatcttactacctcgttttatatacagtgtatttattataattctaaaacatcaatacaccaaatattcagaaaggtatttccaaacagctcctgagtgatctagtttgttataatagaaattagacatttgccaggtgtggtggctcacacctataaacctagcattttgggaggctgaggcgggcagatcaccggaggtaaggagcttgagaccagcctggccaacatggtgaaaccccgcttctactaaaaaatacaaaaattagccgggtgtggtggcaggcatctataatcccagctactcaagaggctgaggaaggagaatcacttgaacccgggaaatggaggttgcagtgagccaagatcatgccacttcactccagcctgggcaaaagagtgcaactctgtctcaaaaaaaaaaaaatcagacaatatttgatatatttttttctaatttaatagtattttgccagagtacatggactttgtgattttggttgttttctctttgtgtcctaatatagcaaatactgtttctttttttttttttttttttttttgagacggagtcttgctctgttgtccaggctagaatgcagtggcgcgattgtggctcactgcaagctctgcctcccagattcacgccatcctcctgcctcagcctcccgagtagctgggactacaggtgcccatcaccatgcccggctaatttttcatatttttagtagaaatggggtttcactgtgttagccagtatggtctcaatctcctgacctcgtgatccacctgcctcggcctcccaaagcactgggattacaggcgtgagccaccatgcccggcacaaatactgtttcttaatgttcattctccctacttaaagaaaaagataagttgtcaatgagcagtattgaaaatgtacagtggggccaggcgccatggctcatgcctgtaatcccagcactttgggaggccgaggcaggcggaccacctgaggtcaggagttcaagactagcttggccaacgtggtgaaacctcgtctctactaaaaaaaatacaaaaattagctgggcgtgatgacaggtgcctgtaatcccagctacttgggaggctgaggcaggagaatcgcttgagcctgggaagcggaggttgcagtgagccgagattgcacaaccacactccagcttgggcgacagagtgagactccatctcaaaaaaagatgtacagtgtactaggctttcctgaagcttagacaggctttatcccactctgctggctaaaagaagtaggaataacgcactgggtgagacaccgtctggcttattctcatctattttcttttcattcttttggaaagtggacacaaagcatagagttaaaagagcttttttttttttttttttttttttcttcactgtggtgataaaaaccacagtgcaggggctgggcgtggtggctcacgcctgtaatcccaccactttgggaggccaaggcaggcggatcacctgaggtggggagttcgagaccagcctgatcaacatggagaaaacctgtctctcctaaaaatacaaaattaaccgagcatgttggcgcatgcctgtaatctcagctacttggaaggctgaggcaggagaattgcttcaaactgggcagaggttgcagtgagccaaggttgacccactgcactccagcctgggcaacaagagcaaaactccatctcaaaaaaaaaaaaaaagaaagaaacagtgccgaaaaatcacaatgatttgagttcttcaaaaacctttgattggctgcattggctctgttctgcatattactagacttcttacatgatcacaagtaaccactaattggttaaaaccaaagagagagagagagagagtgtgtgtgtgtgtgtgtgtgtttggttggggggtgttgtgttagcttccaggtgaatgcattatctgttaatcctgtttattgatctgtttttataagtgctccatgattctctgaaaacagtatactatgtatctaatttttggatacaggatggacatacgtactcaaactgtgtttttcaatttgtactgtatttgtttctctcgacctgacttagtgatagaggtatattaaagtcttccactagcatggtagattaacaaa

SEQ ID NO: 3269 - DNA, 5981 bp, Homo sapiens
ctgccacagacccgcgccaggacgaccctgcctccgcggctgtccctagccagggcccaacctggttctattaataactaagcaaactagaacacctcagccggaggctggggtgcgcggctgctgcacctgcagcctgaacccgggggtcctgacacgccgcattttgggctgggaccagctggagccggaagcggaggtgcagtgtggctagccggagaccggaagcggaagcgcgcttgtgtcttgtgagaagagccgcgcttgcagcgtctgggagaatctttcggtctccgcgagaggtgcttcattccacgaaaaaagtataattcaagctcagatttgtgttgaaaccagcctcaagtttcacctatcctcactgatccgtggacttctgtatgatcagggtgctgtcctgagagcgctgcgggataaaggaggagcgtcctgcttcccggctgccctgttgctgtcggagtcacaggatggcggctgtcgtcctgcccccaactgccgcctctcagcgagaaggacacacagagggcggagagctggttaatgagctcctgaaaagctggctaaagggcttggtgacctttgaggatgtggccgtggagttcacccaggaggagtgggcattgctggaccctgcccaaaggacactgtacagggacgtgatgctggagaactgcaggaacctggcctcactggggaaccaagttgataaacctaggctgatctcccagctggagcaagaagataaagtgatgacagaagagagaggaattctctcaggtacctgtccagatgtggagaatccatttaaagccaaagggttaactcctaagctgcatgtttttcgaaaagaacaatctagaaatatgaaaatggagaggaatcatcttggagcaacactcaacgaatgtaatcagtgttttaaagtcttcagcacaaaatcttcccttacacggcacaggaagattcatactggagaaagaccctatggctgcagtgaatgtgggaaatcctacagcagtagatcttaccttgctgttcataagagaatccacaatggggagaaaccctatgaatgcaatgactgtgggaaaaccttcagcagcagatcttaccttactgttcataagagaatccacaatggggagaaaccctacgaatgcagtgactgtgggaaaaccttcagcaattcctcatacctcagaccgcacttgagaattcacactggagaaaaaccgtacaaatgtaaccagtgttttcgtgagttccgcactcagtcaatcttcacaaggcacaagagagttcatacgggggagggtcattatgtatgtaatcagtgtggaaaggctttcggcacgaggtcatctctttcttcgcactatagcattcatacaggggagtacccttacgaatgccacgattgtgggagaaccttcaggaggaggtcgaatctgacacagcacataagaactcatactggagaaaaaccctacacatgtaatgagtgtgggaaatcctttaccaatagcttttctcttacaattcacaggagaatacataatggagagaaatcctatgagtgcagtgattgtggaaaatcctttaatgttctctcatccgttaagaaacacatgagaactcacactggaaaaaaaccctatgaatgtaattattgcgggaaatccttcacaagtaactcctacctttctgtgcatacgagaatgcataataggcaaatgtgaattcaataactgtgggaaaagcattcattgatctttcatgcctcagataacatgagcaaactctaacaagatgtatgaatcacctgctactgtgtaacaaattaccccccaaaattttgtggcttcaaacaaaaacacttgttatctcaaaatttttgtaggtcaggaattcagaaacaacatagctctatagttcttcaggatatctcaagaggttacagtccagatgtcagcagaactgtaatcatccagaattgttactggtgaagggaccacttccaaatggcttacaagcccgacaagtgcatgctagctgtttccaagggagctgcgcttccaaatcacgtaggcctctcaacagggctgagtttctttatggaagcaacttctccccaaagccagtgatctaaaggagccaacacagaaagcataatgtcttttatgacctagcttcagtgagatatgttttcatgtccctgttacattggtcatacacaccaatcctgatacaatgtggaagaacaccacaggaggtatgaacagtagacatttggaaccatctggaaaacttgccatgaaatcagtggaggaaagccttcagctgaccctcatttttttttttttaagacaatgtctcactctgtcacccagtctggagcgcagtggtgtgatcacagctcactgcagcctctacttcctgggatcaagtaattctcctgccccagcctccaatgtagctgggactacaggtgcatgacaccatgtctggctaatttgtttttttttaaactagagggagggttttgccatgttgcccagactagtctcaaactcctaggttcaagcagtcctttcatcttggcctccagaagtactgggattacaggcatgaaccaccatgcccagccaacttctaaactgatcaatatgggagtagcattcaatcacccacaggttaactcactctagagagaaatcttgtgagtgtaatctgtatggtaaaactttgagctcaaactttccccctaccaaaaaaaaagtatctactggggagctgcccaggtaatgcagtagctgtaggaaagccttcagtgatggcttcagggagtcacatgacaactcacaataaggggaaaccctgtgtgtggcatcaaaaatggaaaaccaggggacactcattccttaagtcacatttcggagatcatacaacagaggaatatgttgagtatacacagtgttgaaaagcctgtgacacaaacagtcatattaccaagcacaagacagtatagtttggtatgctataaaagccttgaatattctctccatttttaagaagtgagattcatactagaaaaaccattgaattccatcagtattagaatgtcatttttccacatttttaggaacctaactcagtgtaagataacaatttatacaatttattttttgagacagggtttcatctgtgcccaggctgtagtgcagtggtgcaatcttggcttattgtaacctctgcctcccaggcttaagggatcctcccacctcagcctcccaagtagctgggactgtaggcatgcaccaccatgcctgtctagtttttgtaaagatggggattcaccatgtttcccaggctgctctcaaactcctgggctcaagtgatccacctgcctcagcctcccaaaatgctgggaatacaggaacgagctaccactctcagccagaacttcttaagataaaggatgagggaatgttttcagtgatacctcttatattaggaaaaatatgtaaatgttccttggatgcaatactcacgagtgtattaatttcagaaaaattttcagtgattcctccctttatgcatgagagaattcatttagaggaagccctaggaacgtaatcaatgttaggatgcctcatctcttaactgagtggccacgcagtaacttagaacaaaaggtgtaagtgctatgaatgtggaattaccttcatcaatgtctcatttgtaggttgggccactagctcgttcattttcagtcttttaatataaacatttatggctatagtggtcctgaaaatcttactacctcgttttatatacagtgtatttattataattctaaaacatcaatacaccaaatattcagaaaggtatttccaaacagctcctgagtgatctagtttgttataatagaaattagacatttgccaggtgtggtggctcacacctataaacctagcattttgggaggctgaggcgggcagatcaccggaggtaaggagcttgagaccagcctggccaacatggtgaaaccccgcttctactaaaaaatacaaaaattagccgggtgtggtggcaggcatctataatcccagctactcaagaggctgaggaaggagaatcacttgaacccgggaaatggaggttgcagtgagccaagatcatgccacttcactccagcctgggcaaaagagtgcaactctgtctcaaaaaaaaaaaaatcagacaatatttgatatatttttttctaatttaatagtattttgccagagtacatggactttgtgattttggttgttttctctttgtgtcctaatatagcaaatactgtttctttttttttttttttttttttttgagacggagtcttgctctgttgtccaggctagaatgcagtggcgcgattgtggctcactgcaagctctgcctcccagattcacgccatcctcctgcctcagcctcccgagtagctgggactacaggtgcccatcaccatgcccggctaatttttcatatttttagtagaaatggggtttcactgtgttagccagtatggtctcaatctcctgacctcgtgatccacctgcctcggcctcccaaagcactgggattacaggcgtgagccaccatgcccggcacaaatactgtttcttaatgttcattctccctacttaaagaaaaagataagttgtcaatgagcagtattgaaaatgtacagtggggccaggcgccatggctcatgcctgtaatcccagcactttgggaggccgaggcaggcggaccacctgaggtcaggagttcaagactagcttggccaacgtggtgaaacctcgtctctactaaaaaaaatacaaaaattagctgggcgtgatgacaggtgcctgtaatcccagctacttgggaggctgaggcaggagaatcgcttgagcctgggaagcggaggttgcagtgagccgagattgcacaaccacactccagcttgggcgacagagtgagactccatctcaaaaaaagatgtacagtgtactaggctttcctgaagcttagacaggctttatcccactctgctggctaaaagaagtaggaataacgcactgggtgagacaccgtctggcttattctcatctattttcttttcattcttttggaaagtggacacaaagcatagagttaaaagagcttttttttttttttttttttttttcttcactgtggtgataaaaaccacagtgcaggggctgggcgtggtggctcacgcctgtaatcccaccactttgggaggccaaggcaggcggatcacctgaggtggggagttcgagaccagcctgatcaacatggagaaaacctgtctctcctaaaaatacaaaattaaccgagcatgttggcgcatgcctgtaatctcagctacttggaaggctgaggcaggagaattgcttcaaactgggcagaggttgcagtgagccaaggttgacccactgcactccagcctgggcaacaagagcaaaactccatctcaaaaaaaaaaaaaaagaaagaaacagtgccgaaaaatcacaatgatttgagttcttcaaaaacctttgattggctgcattggctctgttctgcatattactagacttcttacatgatcacaagtaaccactaattggttaaaaccaaagagagagagagagagagtgtgtgtgtgtgtgtgtgtgtttggttggggggtgttgtgttagcttccaggtgaatgcattatctgttaatcctgtttattgatctgtttttataagtgctccatgattctctgaaaacagtatactatgtatctaatttttggatacaggatggacatacgtactcaaactgtgtttttcaatttgtactgtatttgtttctctcgacctgacttagtgatagaggtatattaaagtcttccactagcatggtagattaacaaa

SEQ ID NO: 3270 - DNA, 3014 bp, Homo sapiens
caggtggccctgaattcattgcctgctcagcaaaataaaggcccagtgtggaagccggaacttgcatttgaagaaggatgggaaggatgggttgaggagggcccatccccagcagcccgagagggaggaggccacggagacttggagcattcccgtttcttccagagcgctgcgggataaaggaggagcgtcctgcttcccggctgccctgttgctgtcggagtcacaggatggcggctgtcatcctgccctcgactgctgctccgtcttccctgttcccagcctctcagcaaaaaggacacacacagggcggagagctggttaatgagctcctgacaagctggctacggggcttggtaaccttcgaggatgtggccgtggagttcacccaggaggagtgggcgttgctggaccctgcccaaaggacactgtacagggatgtgatgctggagaactgcaggaacctggcctcactagggtgtcgtgttaataaacccagtctgatatcccagttggaacaagacaagaaggtggtgacagaggaaagaggaattctaccaagcacctgtccagatttggagactctacttaaagccaaatggttaactcctaagaagaatgttttcagaaaagaacagtctaaaggtgtaaaaacggaaagaagtcatcgtggagtgaaactcaatgaatgtaatcagtgttttaaagtcttcagcacgaaatctaacctaactcagcacaagagaattcatactggagaaaaaccctatgactgtagtcaatgtgggaagtccttcagtagcagatcttaccttactattcataagagaatccataatggggagaaaccctatgaatgcaatcactgtgggaaagcatttagtgatccctcatcccttagactgcatttgagaattcacactggagaaaaaccctatgaatgtaaccagtgttttcacgttttccgcaccagttgtaacctcaaaagccacaagaggattcacacgggggagaatcaccatgaatgtaatcagtgtggaaaagctttcagcacaaggtcctctctcactgggcacaatagcattcatacaggggagaaaccttatgaatgtcacgattgtgggaaaaccttcaggaagagctcctatctgacacagcacgtaagaactcatactggagaaaaaccctatgaatgtaacgagtgtgggaaatccttcagcagtagcttttctcttactgtgcacaagagaatacataccggagagaaaccctacgagtgcagtgactgtggaaaagcctttaataatctctcagctgtgaagaaacacttaagaactcacactggagaaaaaccctatgaatgtaatcattgtgggaaatccttcacaagtaactcctatctttctgtgcacaagagaatacataatagatggatatgaattactgcaggaacttctggaggaaagcactcattgatctttcatccctaagatagtttgagagagctcacactggatatataagttatttgttgcagcataacaaatgatccccgcaaattttgtggcttcaaacacgaaatgtttattctctaacaatttctacagatcaggaattcaagaacagcttatctctgtagttacactgcaggatctctcatgcctttacttacaatcaagatgtcagccaaagctatagtcatctaacatctttactgatgaacagtccacttccaagatgacttattcacatgcctggaaagttgatgttggttgttgtcaggggaccttcagtcattaccatgtaggcctctttacaaggcccagctccttgacaatttggcaataagttctcgccaaggttagtgatccaagagaggaccaatacagaggccaaaatggcttttatgacctatcctcaggaggactgctaagctttcacttatttcctattgtgttggtctcacaacacaccaatcctgatacaatgtgagagactgcagaaggtatgaataccaggaaacagataactcagaagcatctgggaaatttgccatggaattaatgaagaaaagccctcagcacatcatccttctactctaatcaatatgaaatagcattcagtaactcctattaattcactctgaagagaaaccttttgaggacaatctgtatggtaaagctctcagctcgaattctcaccttcatgggcccagaagattatgtactgagagaatcctgaagaatggaacagctgtagaaagccttcagtgctatcagcagggattcatgtgacagctcacactaagggagaaaacctgtgaaggtctcagaaggcttcagtgacagtcatcccttaagacgcactggaaatcacacaatggaacaacactcagaaatgcggaataccctacagcaaaagtgttcacattactgagcaaactatagtgtggtattctgcagtgactatgggaaagccttgaatgttctatcggtttttaagggacttgagaattaattctggagagaatgccccattgaacatcatcaatattggagagctttctgtttttctacatttgttaggaaacttgtgagcattcacactacagagaaacttgaaatataaagaagaagagaaagccttcagtgatgcctctgtgttagggaaaatatggaacttctccctggatgcaaaacctatgagtatattaatattggaaaatttttcagtgattcttctctttcttgtatatgagagaacttatatggagaaacccctaggaatgtaatcagtgttaggatgcctcagcctgaactcttcactgagtggccacaattttcactgggaacaaaaagtataatcactgttttgagtgtgggatatcctttatcagtgtctcatctgtagattggactgctggctcattaatttttttagtctttttttcttttaatataaacatttgtgtatagctgttccctaaaataaacattaacatatttcataatttt

SEQ ID NO: 3271 - DNA, 1822 bp, Homo sapiens
catttactgcaggttcagagctccctccagggtccctgagtacatcatgtgctcctgagagttttaagggaaagccaagtaaagacgtgatgatgttctaaacccaagcaattaataaacgccacggaaatcagtcattcacttaccaagtatttctctgctttctgccatgtcacgggcccatgatcccctggagattgagggaaataagatcacaggagctcccagtctgagtgagaaaaggcagctgctctgtggtactgtgcactggacctgggaatggcctaaggagacaagcattgagggctgagctcagaagccagggagaagagctcagaaccccaggagaggagctcagaaccctgggagaggagctcagaaccctgggagggcttggtaaccttcgaggatgtggccgtggagttcacccaggaggagtgggcgttgctggaccctgcccaaaggacactgtacagggatgtgatgctggagaactgcaggaacctggcctcactagggtgtcgtgttaataaacccagtctgatatcccagttggaacaagacaagaaggtggtgacagaggaaagaggaattctaccaagcacctgtccagatttggagactctacttaaagccaaatggttaactcctaagaagaatgttttcagaaaagaacagtctaaaggtgtaaaaacggaaagaagtcatcgtggagtgaaactcaatgaatgtaatcagtgttttaaagtcttcagcacgaaatctaacctaactcagcacaagagaattcatactggagaaaaaccctatgactgtagtcaatgtgggaagtccttcagtagcagatcttaccttactattcataagagaatccataatggggagaaaccctatgaatgcaatcactgtgggaaagcatttagtgatccctcatcccttagactgcatttgagaattcacactggagaaaaaccctatgaatgtaaccagtgttttcacgttttccgcaccagttgtaacctcaaaagccacaagaggattcacacgggggagaatcaccatgaatgtaatcagtgtggaaaagctttcagcacaaggtcctctctcactgggcacaatagcattcatacaggggagaaaccttatgaatgtcacgattgtgggaaaaccttcaggaagagctcctatctgacacagcacgtaagaactcatactggagaaaaaccctatgaatgtaacgagtgtgggaaatccttcagcagtagcttttctcttactgtgcacaagagaatacataccggagagaaaccctacgagtgcagtgactgtggaaaagcctttaataatctctcagctgtgaagaaacacttaagaactcacactggagaaaaaccctatgaatgtaatcattgtgggaaatccttcacaagtaactcctatctttctgtgcacaagagaatacataatagatggatatgaattactgcaggaacttctggaggaaagcactcattgatctttcatccctaagatagtttgagagagctcacactggatatataagttatttgttgcagcataacaaatgatccccgcaaattttgtggcttcaaacacgaaatgtttattctctaacaatttctacagatcaggaattcaagaacagcttatctctgtagttacactgcaggatctctcatgcctttacttacaatcaagatgtcagccaaagctatagtcatctaacatctttactgatgaacagtccacttccaagatgacttattcacatgcctggaaagttgatgttggttgttgtcag

SEQ ID NO: 3272 - DNA, 2566 bp, Homo sapiens
atcttaacagcgcgttcccgttggcgtctgaggaacagcatctctgccttcctgttcacggtgaccttcgcttggtgtcctcctggcctcagcaacctgacaattctgtcgtgtcccgatcatctttctcaagatgttttctgtcttcatgagtcaaaatttgaagaggaaaggatggtggctgggtggttgacaaattactctcaggactcagtgacctttgaggatgtggctgtggacttcacccaggaggagtggactttgctggatcaaactcagagaaacttatacagagatgtgatgctggagaactataagaatctagttgcagtagattgggagagtcatattaataccaaatggtcagcacctcagcagaattttttgcaggggaaaacatccagtgtggtggaaatggagagaaaccattttggagaggaactgtttgactttaaccaatgtgaaaaagccttgagtgaacactcatgccttaagactcacaggagaacttactttagaaagaaaacctgtgagtgtaatcaatgtgaaaaagccttcagaaaaccctctatctttactttacacaagaaaactgatatcggagaggaacttcctaactgtaatcaatgtgaaacagccttcagccaacatctacatcttgtttgcaagaaaactagccaaaatctacatcttgtttgcaagaaaactcacactcaagagaaaccatataaatgcagtgactgtgaaaaaggcttaccttcctcctcacacctcagagaatgtgtaagaatttatggtggagagagaccatatactcataaggagtatgtcgaaaccttttctcattctacagccctttttgtacacatgcaaactcaagatggagaaaaattctatgaatgtaaagcatgtgggaaacccttcactgagtcgtcatatcttactcaacatttaagaactcatagtagagtgttacctatagaacataagaaatttggcaaagcctttgctttttccccagatcttgctaaacatataagacttagaactagaggaaaacactatgtttgtaatgaatgtggcaaagaatttacttgtttctcaaaactcaacattcacataagggttcacactggagaaaaaccgtatgagtgcaacaaatgtgggaaagccttcactgattcatcaggtcttataaaacacaggcgaactcacactggagaaaagccttatgaatgtaaggaatgtgggaaagcttttgctaactcttcacatcttactgtacatatgagaactcacactggtgagaagccttatcaatgtaaggaatgtggaaaagcctttattaattcctcttcctttaaaagtcacatgcagactcatcctggtgtaaaaccctatgactgtcaacagtgtgggaaagccttcattcgatcctcatttcttattcgacatttgagaagtcacagtgcagaaaggccttttgaatgtgaggaatgtgggaaagcctttagatactcctcgcaccttagtcaacataaaagaatacatacaggggagaggccatataaatgtcaaaagtgtgggcaagccttcagtatctcatcaggccttacagtacacatgagaactcacactggtgaacggccctttgaatgtcaggaatgtgggaaagcctttactcggtccacatatcttattcgacatctaagaagtcatagtgtggagaaaccatataaggaatgtgggcaaacctttagtaattcctcatgccttactgaatgtgtgtgaattggggctgatacttggaaagaatgtggtaaagccactacttcctcacacttactgaacatgtactcattcatagtggcaatgtacacagtcataaggaatgtgggaagccttccttggtgtctcagatcttaacaattccaatagaagagaagacatatgaatgtaaggaatgtgggaaaatcttggctccttccataggccttactattcatgtgtctgtgcatcctaggaaacaaactgaacgtaggaaacctgtcgatgcttacatcttactgagtctgtttgaactcatgctggagagaaatgctatgaatgtgaggaaggtggaaaagctttcattattttcctcgggccttactgagcttgtgagcacattggatataaatgcacgtcctctggctgtaaggaatgtgttgaaacctttcactctgccttataccttaatattcagctgtgatctcacaagtgtgaaaaatcttatgaatgtaaaatgtgtggagattcttctttgtttttagcttccactttgggaacatgtcaaagcacacattgagaagtcccatgagtgaaagagatgttggaaagcccttgaacttggtcgttaggaaacatccacactgaagaggaacctgactgtatggaaggtcaaaaaggctgtattaatttacatgcaaaaagtcacactagaggaatgccatatcagaatgcttttggtaaatatacatgttttaaagaggttatatatcattaataaaaatatctagctggtctg

SEQ ID NO: 3273 - DNA, 3040 bp, Homo sapiens
gttcggtggtgtcccggtgcagccacgcgagagtagaagggtggaaaggggaggtgcccagtgaaatggagcctgtcccgtgcactttcgggcatttcgagcatcttgtgggctctcccaagtcgcggcccctcctctgagagccacagtcaggtctgtcctcaggggtcgaggcggctgcgctggggcctcggcccgggaggaggcggggggcacggcctttccattttccctgctcccctctgcagaagcctcatagggcccggcgcggcggctcacgcctgtcattcccagcgctttgggcggattgggtaggaggattacttgaggccaggagttcaagaccaggcagggcaacatagggagacccccccccccaaccatctctaatggaaaaaaaaaaaaaagtctccacatccagcgttgtgccttttctctataaggaacagcatctctgccttcctgttcacggtgaccttcgcttggtgtcctcctggcctcagcaacctgacaattctgtcgtgtcccgagagatggctaatgaatggcgcttgatgacagatgagtaatgcctgttgctgaaagattgacgatcatctttctcaagatgttttctgtcttcatgagtcaaaatttgaagaggaaaggatggtggctgggtggttgacaaattactctcaggactcagtgacctttgaggatgtggctgtggacttcacccaggaggagtggactttgctggatcaaactcagagaaacttatacagagatgtgatgctggagaactataagaatctagttgcagtagattgggagagtcatattaataccaaatggtcagcacctcagcagaattttttgcaggggaaaacatccagtgtggtggaaatggagagaaaccattttggagaggaactgtttgactttaaccaatgtgaaaaagccttgagtgaacactcatgccttaagactcacaggagaacttactttagaaagaaaacctgtgagtgtaatcaatgtgaaaaagccttcagaaaaccctctatctttactttacacaagaaaactgatatcggagaggaacttcctaactgtaatcaatgtgaaacagccttcagccaacatctacatcttgtttgcaagaaaactagccaaaatctacatcttgtttgcaagaaaactcacactcaagagaaaccatataaatgcagtgactgtgaaaaaggcttaccttcctcctcacacctcagagaatgtgtaagaatttatggtggagagagaccatatactcataaggagtatgtcgaaaccttttctcattctacagccctttttgtacacatgcaaactcaagatggagaaaaattctatgaatgtaaagcatgtgggaaacccttcactgagtcgtcatatcttactcaacatttaagaactcatagtagagtgttacctatagaacataagaaatttggcaaagcctttgctttttccccagatcttgctaaacatataagacttagaactagaggaaaacactatgtttgtaatgaatgtggcaaagaatttacttgtttctcaaaactcaacattcacataagggttcacactggagaaaaaccgtatgagtgcaacaaatgtgggaaagccttcactgattcatcaggtcttataaaacacaggcgaactcacactggagaaaagccttatgaatgtaaggaatgtgggaaagcttttgctaactcttcacatcttactgtacatatgagaactcacactggtgagaagccttatcaatgtaaggaatgtggaaaagcctttattaattcctcttcctttaaaagtcacatgcagactcatcctggtgtaaaaccctatgactgtcaacagtgtgggaaagccttcattcgatcctcatttcttattcgacatttgagaagtcacagtgcagaaaggccttttgaatgtgaggaatgtgggaaagcctttagatactcctcgcaccttagtcaacataaaagaatacatacaggggagaggccatataaatgtcaaaagtgtgggcaagccttcagtatctcatcaggccttacagtacacatgagaactcacactggtgaacggccctttgaatgtcaggaatgtgggaaagcctttactcggtccacatatcttattcgacatctaagaagtcatagtgtggagaaaccatataaggaatgtgggcaaacctttagtaattcctcatgccttactgaatgtgtgtgaattggggctgatacttggaaagaatgtggtaaagccactacttcctcacacttactgaacatgtactcattcatagtggcaatgtacacagtcataaggaatgtgggaagccttccttggtgtctcagatcttaacaattccaatagaagagaagacatatgaatgtaaggaatgtgggaaaatcttggctccttccataggccttactattcatgtgtctgtgcatcctaggaaacaaactgaacgtaggaaacctgtcgatgcttacatcttactgagtctgtttgaactcatgctggagagaaatgctatgaatgtgaggaaggtggaaaagctttcattattttcctcgggccttactgagcttgtgagcacattggatataaatgcacgtcctctggctgtaaggaatgtgttgaaacctttcactctgccttataccttaatattcagctgtgatctcacaagtgtgaaaaatcttatgaatgtaaaatgtgtggagattcttctttgtttttagcttccactttgggaacatgtcaaagcacacattgagaagtcccatgagtgaaagagatgttggaaagcccttgaacttggtcgttaggaaacatccacactgaagaggaacctgactgtatggaaggtcaaaaaggctgtattaatttacatgcaaaaagtcacactagaggaatgccatatcagaatgcttttggtaaatatacatgttttaaagaggttatatatcattaataaaaatatctagctggtctg

SEQ ID NO: 3274 - DNA, 2112 bp, Homo sapiens
aacagcgcgttcccgttggcgtctgaggaacagcatctctgccttcctgttcacggtgaccttcgcttggtgtcctcctggcctcagcaacctgacaattctgtcgtgtcccgattgggagagtcatattaataccaaatggtcagcacctcagcagaattttttgcaggggaaaacatccagtgtggtggaaatggagagaaaccattttggagaggaactgtttgactttaaccaatgtgaaaaagccttgagtgaacactcatgccttaagactcacaggagaacttactttagaaagaaaacctgtgagtgtaatcaatgtgaaaaagccttcagaaaaccctctatctttactttacacaagaaaactgatatcggagaggaacttcctaactgtaatcaatgtgaaacagccttcagccaacatctacatcttgtttgcaagaaaactagccaaaatctacatcttgtttgcaagaaaactcacactcaagagaaaccatataaatgcagtgactgtgaaaaaggcttaccttcctcctcacacctcagagaatgtgtaagaatttatggtggagagagaccatatactcataaggagtatgtcgaaaccttttctcattctacagccctttttgtacacatgcaaactcaagatggagaaaaattctatgaatgtaaagcatgtgggaaacccttcactgagtcgtcatatcttactcaacatttaagaactcatagtagagtgttacctatagaacataagaaatttggcaaagcctttgctttttccccagatcttgctaaacatataagacttagaactagaggaaaacactatgtttgtaatgaatgtggcaaagaatttacttgtttctcaaaactcaacattcacataagggttcacactggagaaaaaccgtatgagtgcaacaaatgtgggaaagccttcactgattcatcaggtcttataaaacacaggcgaactcacactggagaaaagccttatgaatgtaaggaatgtgggaaagcttttgctaactcttcacatcttactgtacatatgagaactcacactggtgagaagccttatcaatgtaaggaatgtggaaaagcctttattaattcctcttcctttaaaagtcacatgcagactcatcctggtgtaaaaccctatgactgtcaacagtgtgggaaagccttcattcgatcctcatttcttattcgacatttgagaagtcacagtgcagaaaggccttttgaatgtgaggaatgtgggaaagcctttagatactcctcgcaccttagtcaacataaaagaatacatacaggggagaggccatataaatgtcaaaagtgtgggcaagccttcagtatctcatcaggccttacagtacacatgagaactcacactggtgaacggccctttgaatgtcaggaatgtgggaaagcctttactcggtccacatatcttattcgacatctaagaagtcatagtgtggagaaaccatataaggaatgtgggcaaacctttagtaattcctcatgccttactgaatgtgtgtgaattggggctgatacttggaaagaatgtggtaaagccactacttcctcacacttactgaacatgtactcattcatagtggcaatgtacacagtcataaggaatgtgggaagccttccttggtgtctcagatcttaacaattccaatagaagagaagacatatgaatgtaaggaatgtgggaaaatcttggctccttccataggccttactattcatgtgtctgtgcatcctaggaaacaaactgaacgtaggaaacctgtcgatgcttacatcttactgagtctgtttgaactcatgctggagagaaatgctatgaatgtgaggaaggtggaaaagctttcattattttcctcgggccttactgagcttgtgagcacattggatataaatgcacgtcctctggctgtaaggaatgtgttgaaacctttcactctgccttataccttaatattcagctgtgatctcacaagtgtgaaaaatcttatgaatgtaaaatgtgtggagattcttctttgtttttagcttccactttgggaacatgtc

SEQ ID NO: 3275 - DNA, 2991 bp, Homo sapiens
catttacaggaggtgagcatgaagtggccaatgggaaaattctaggaggtattgggactcatgaaggttctgtttcggagcccttgagctgccgcttggccagttcccacactgtggagtatgctttcgttttcaacaaatcccagctcttgttcttttgttgcttcattctttctttgctttgctgggcgttttgtctaattctttgttcaaaacgccagtaacctggacagcttgcagtcaagaccccctaccggtgacacttgcgctcttcggggaggtaaacagcatttcctctcagctctgggttggaaaaagccgcagcagctgatgggcccgggaacccgaggccccgccccctaggtggtcctagcctttgcgcgtgcgcggcgtgtctgcgtgggcgcatgcgcataacggccgccatcttaacagcgcgttcccgttggcgtctgaggaacagcatctctgccttcctgttcacggtgaccttcgcttggtgtcctcctggcctcagcaacctgacaattctgtcgtgtcccgatcatctttctcaagatgttttctgtcttcatgagtcaaaatttgaagaggaaaggatggtggctgggtggttgacaaattactctcaggactcagtgacctttgaggatgtggctgtggacttcacccaggaggagtggactttgctggatcaaactcagagaaacttatacagagatgtgatgctggagaactataagaatctagttgcagtagattgggagagtcatattaataccaaatggtcagcacctcagcagaattttttgcaggggaaaacatccagtgtggtggaaatggagagaaaccattttggagaggaactgtttgactttaaccaatgtgaaaaagccttgagtgaacactcatgccttaagactcacaggagaacttactttagaaagaaaacctgtgagtgtaatcaatgtgaaaaagccttcagaaaaccctctatctttactttacacaagaaaactgatatcggagaggaacttcctaactgtaatcaatgtgaaacagccttcagccaacatctacatcttgtttgcaagaaaactagccaaaatctacatcttgtttgcaagaaaactcacactcaagagaaaccatataaatgcagtgactgtgaaaaaggcttaccttcctcctcacacctcagagaatgtgtaagaatttatggtggagagagaccatatactcataaggagtatgtcgaaaccttttctcattctacagccctttttgtacacatgcaaactcaagatggagaaaaattctatgaatgtaaagcatgtgggaaacccttcactgagtcgtcatatcttactcaacatttaagaactcatagtagagtgttacctatagaacataagaaatttggcaaagcctttgctttttccccagatcttgctaaacatataagacttagaactagaggaaaacactatgtttgtaatgaatgtggcaaagaatttacttgtttctcaaaactcaacattcacataagggttcacactggagaaaaaccgtatgagtgcaacaaatgtgggaaagccttcactgattcatcaggtcttataaaacacaggcgaactcacactggagaaaagccttatgaatgtaaggaatgtgggaaagcttttgctaactcttcacatcttactgtacatatgagaactcacactggtgagaagccttatcaatgtaaggaatgtggaaaagcctttattaattcctcttcctttaaaagtcacatgcagactcatcctggtgtaaaaccctatgactgtcaacagtgtgggaaagccttcattcgatcctcatttcttattcgacatttgagaagtcacagtgcagaaaggccttttgaatgtgaggaatgtgggaaagcctttagatactcctcgcaccttagtcaacataaaagaatacatacaggggagaggccatataaatgtcaaaagtgtgggcaagccttcagtatctcatcaggccttacagtacacatgagaactcacactggtgaacggccctttgaatgtcaggaatgtgggaaagcctttactcggtccacatatcttattcgacatctaagaagtcatagtgtggagaaaccatataaggaatgtgggcaaacctttagtaattcctcatgccttactgaatgtgtgtgaattggggctgatacttggaaagaatgtggtaaagccactacttcctcacacttactgaacatgtactcattcatagtggcaatgtacacagtcataaggaatgtgggaagccttccttggtgtctcagatcttaacaattccaatagaagagaagacatatgaatgtaaggaatgtgggaaaatcttggctccttccataggccttactattcatgtgtctgtgcatcctaggaaacaaactgaacgtaggaaacctgtcgatgcttacatcttactgagtctgtttgaactcatgctggagagaaatgctatgaatgtgaggaaggtggaaaagctttcattattttcctcgggccttactgagcttgtgagcacattggatataaatgcacgtcctctggctgtaaggaatgtgttgaaacctttcactctgccttataccttaatattcagctgtgatctcacaagtgtgaaaaatcttatgaatgtaaaatgtgtggagattcttctttgtttttagcttccactttgggaacatgtcaaagcacacattgagaagtcccatgagtgaaagagatgttggaaagcccttgaacttggtcgttaggaaacatccacactgaagaggaacctgactgtatggaaggtcaaaaaggctgtattaatttacatgcaaaaagtcacactagaggaatgccatatcagaatgcttttggtaaatatacatgttttaaagaggttatatatcattaataaaaatatctagctggtctg

SEQ ID NO: 3276 - DNA, 2802 bp, Homo sapiens
ggtcgctggcgcctgtttcctcagagccactttttcctttgtgttgtctggtcgttcactactttgagggaaaagaattttgccgttcgcgttcgattgactccgtccccaagatcctgtagccccacggacctggcgactccaccgtgttcgggtctttctaggaacccaatctgccttcatgaagaaaagacagaggcagaaaggaagatggcttactgcctgacaaattgttatcagtactccgtgacctttgaggatacagctgtggacttcacccaggaggagtggattttactggacccagttcagagaaacttatacagagatgtgatgctggagaattatgagaacgtggccaaagtaggatttcagctctttaaacccagtgtcatctcttggttggaagaagaagagttgagaaccttgcagcaaggagttctccaagactgggcaataaaacatcaaaccagtgtttcagcactgcagcaggagttttggaaaatacaaacttctaatgggatacaaatggacctggtaacctttgacagtgtggctgtggagttcacccaggaagagtggactttactggacccagctcagagaaacctgtacagtgatgtgatgctggagaactacaagaacctgtcctcagtaggttaccagctcttcaaacccagtctgatctcttggctggaggaagaggaagagttgagcacactgccaagagttctccaagaatggaaaatgtgcctgaaaaccaaagggccagccctttggcaagataatttttgtttaaaaacattaaatgggatacagttggcaagaaaccaaaatggagaggaactctatgactgtaagcaatgtgaagatgtcttctgtaaacatccatgccttaagaccaacatgagtactcaaaatagaggcaacacgtctgaatgtattcagtatgcaaaagacctcctttctctatacaataaaacctctaccataaggaaagtttctgtgttcagtaagcatggaaaatctttccgcctgattttaaatgttcaggtccagagaaagtgtacacaagataaatcctttgaaggcactgactatgggaaagccttcatttatcagtcataccttgaagcacacaggaaaactcagagtggagaaaaactcaatgaatggaagcaatgtggggaagcatttactcactccacaagccatgctgtaaatgttgaaacacacattattaaaaacccctatgaatgtaaggaatgtggaaaagattttagataccctacccaccttaataatcacatgcaaacccacattgggataaaaccttataaatgtaagcactgtggcaaaaccttcactgtgccgtcaggctttcttgaacatgtacgaactcacactggagagaagccctatgggtgtaaggaatgtggtaaagcctttggtacatctgcaggccttattgaacatataagatgtcacgccagagagaaaacctttaaatgtgaccactgtgggaaagcctttatttcttacccatctctttttggacatttgagagttcataatggagagaagccatatgagcataaggaatatgggaaggcctttggtacatcctcaggtgttattgaagatagaagaagtaacacaggacagaaacgctttgattgtgaccagtgtgggaaagtctttgtttctttctcatctctttttgctcatttgagaactcacactggtgagaagccctttaagtgttacaaatgtgggaaaccatttacctcttctgcctgtcttcgtattcacatgcgaactcacacagaagagagactctatcaatgtaagaaatgtggtaaagctttcactaagtgctcatatcttaccaaacatttacgaacacacgctggagagaaaccctatgaatgtatgaaatgtgggaaagccttcactgagcgctcataccttactaaacatttacgaagacacagtggagagaagccatatgaatgtaagaaatgtggaaaagccttcacagaacgctcagatcttactaaacatttacgaagacacactggagataagccctatgaatataaggactgtgggaaagcctttgttgtctcctccagtctagttgatcatttaagaactcacactggatataaaccctataaatgtaatgcatgtgaaaaagcttacagtaggtcttgtgtactaactcaacacttaaaaactcatgcagcagagaagacctctgaatgtaacgcatgtggaaattcctttcgaaattccatgtgctttcatgatcgcttaaaaactctcaccaaaataaaaccctataaatgtaaggactgtgggaaagccttcacttgtcattcagatcttactaatcatgtgcgaattcacactggagagaagccctataaatgtaaggaatgtgggaaggccttccgtacatcctcaggacgtattcaacatttaagaactcatatgggagagaaaccctttgaatgtgaccagtgtgggaaagcctttgcttctttctcagctcgtattgcacatttgaaaacacactagagagaagccctgtggatgtgaagaatgtggaaaaacctttgctgtttcctcaagcctaactgaacatgtaaaaattcacaggagaaagtaacactatcaatgtaaggaatgtgagaaagcctgaacagttgaatctttctagatatgtacaaactcacactgtagagaaaccctgtaaatgtaagggatgtaggaaaacactagttcttctctctctct

SEQ ID NO: 3277 - DNA, 4693 bp, Homo sapiens
gttctgcatccccctccctgagccaaccccaggccctttctgcacccacccgagaggaaactagaatttctgtgttctacccggtcctacgtggctgaaactggagcccacgagcctcgcccggccagagtgttgaagcggaagtgacgtcagcgcaccaccgccatcttttccggcgctggctcctctccgtcagtgcggtttcgcctttatggtggtggagtctgcccaggctgtggaccgcaaataaccctgtacaaagaggaatggagattgcctctatccacctagattcataagctggcctgaggtgatcttggcatcaaggaagggatgcacatcatcacaccatcagcttcagagaatggcagccatttatttgtcccgtgggtttttttccagggaaccaatctgcccttttgaagaaaagacaaaggtagaaaggatggtggaggactacctggcaagtggttatcaggattcagtgacgtttgatgatgtggctgtggacttcaccccagaggagtgggctttactggacacaactgagaaatacctctacagagatgtgatgctggagaactacatgaacctggcctctgtggaatgggaaatacaacctagaaccaaacggtcatcacttcagcagggttttttgaagaatcaaatattcagtgggatacaaatgacaagaggctacagtggatggaaactctgtgactgtaagaattgtggagaggtcttcagggaacagttttgccttaagacacacatgagagttcagaatggagggaatacttctgagggtaattgttatggaaaagacaccctcagtgtgcacaaggaagcctctactggacaggaactttccaaatttaatccatgtggaaaagtctttactctaactccaggtcttgctgtacatcttgaagttctcaatgcaagacaaccctacaaatgtaaggaatgtggaaaaggctttaagtattttgcaagccttgataatcatatgggaatccacactgatgagaaactctgtgaatttcaggaatatgggagagctgtcacagcttcttcacacctaaagcagtgtgtagcagttcatacaggaaagaaatccaaaaagactaagaaatgtgggaaatccttcactaatttttctcaactttatgcacctgtgaaaactcataaaggagagaagtcctttgaatgtaaagaatgtggaagatcctttagaaattcctcatgccttaatgatcacattcaaattcacactggaataaaaccacacaagtgtacttactgtgggaaagccttcactagatcaactcaacttactgaacatgtaagaactcacactggaataaaaccctatgaatgtaaggaatgtggccaagcctttgctcagtactcgggcctttctatacacatacgaagtcacagtggaaagaaaccctatcagtgtaaggaatgtgggaaagccttcactacatccacaagtcttattcagcatacaagaattcacacaggagagaagccttatgaatgtgttgaatgtgggaagaccttcattacttcttcccgtcgtagtaaacatttgaaaactcatagtggagaaaagccctttgtatgcaagatatgtgggaaagcatttctatattcctcacgccttaatgttcacctgcgaactcataccggagagaaacccttcgtatgtaaagaatgtgggaaagcatttgctgtttcctcacgcctaagtagacatgaaagaattcacactggggagaaaccctatgaatgcaaggatatgagtgttaccatttagcccatcggttgccatctttaattattggcaatgacaccaaagattatcagatttgtcctaaatgccttttggaggttgtaatgactcatggattggccttagataccatcctgagggtctgaaattaaacctacaggttctgaatacaacatcatggttgcctgagtctgggcatctgtgaagaagggtcatggatggtgaggtcagtactgcaggctgcctcaccttggtgattagattcctaagatcatagcattaacaagttgtgtatgagataaatcatgcagattgaccccagcccctgttggttagtggctgccagtgtggcacatttatgtcaaaatttaccagaagccaagatgatgtaggaccccaaaggtgggttgttaagagatgctcctccaagggtctcttctgatcccacggatcctgcagagcgtgtcaggaatgaaaccatccataactgccagtgccctttcacagctgattatttctgtgtccccttgtaaaatctaagaagtgtgacagccttgcctgttctgccttgtatgtctattttagatggcacaatgtaagtggcaatgtctcttctagtataatccagtctctcttctcacttctgtcaaggtggctgatatagtccatgaatcccactcatgatctctttatcagatgatcgttcagccacactttgaggattctcttcagtacaagttttctaatttttgcattatggataggctgagaattttccaaatctccaagttctggttcctttttccttaacaattttttctgcaattcaggtctccttttgcatttttgctgagaccagctgggtcatggagaccctgacccagcagctctagaggaattaagacaaagacacagaaatagagtgcagagtgggaatcggggctcacagccttcagagctgagagccttgaacagagtttgacccacatatttattgacagtaagcctgtgataaacattatttctatagattatagattagctaaaagtattccttacaagaaagaaagggacaggctctggcttgttatctgcaacaggaacatgtccttaaggcacaaatcactcatggtattgtttgtggtttaggaatgcctgagcagttttccagttttccaccgtgggtgggccaggtgttccttgccctcattcgggtaaaccagcaacctccagcatgggtgtcatagccatcacgagcatgtcacagtgccgcagagattttgtttatgggcagtttctcatggcctgtttatgtccaaatttggggggcctgttctgagcacattttcctgtaagcactcaggaagaatgaagcttcctgtgtcctttaacactttaagtacagatcttagtgatacataaccagttttatctctctcaagctctaccttccgcaaagtgctagaatacagttctgccaagttcttcactacttcgtatcaagggttgtattttctttatttcccaatagcatgttcctcattccccaatgacacctcaccaggatcacccttaccaaccttacttccagcttgcacatcagaatttttccagcctcatttgtcagtttcaaatctgcttcacatttttagtttttttgtttgtttgtttttaatctgccttaatgagctcaggccactatcacaaaataccacagaccaaatggcttacaaatttgttaattttaaataaatgaggttaaaaacaaatttatattctcacatttctcgaggctggaagtctgagatcagagtgccagcatggtcaacttctggcgagagctctcttcctggtatgtaaatgcccacttcctcatgtcttcacaggaaggaaaccaacaaataggtctctctctcctctctcctttctcctctctcctctctcctctttctctctctctccccaccatctctctccttcccctccctccccctccctccccctacccatctcttgacatcatttcacgatacttctaaagagcctattttcaggccgggcgcggtggctcacacctgtaatcccagcactttgggaggccgaggtgggcggatcacgaggtcaggagatcgagactgtcctagttaacacggtgaaaccctgtctctactacaaatacaaaaaattagcctggcgtggtggcgggtacctgcagtcccagctactcgggaggctgaggcaggagaatggcatgaacctgggaggcacaggttgcagtgagccgagatcgcagccactgcattccagcctggacaacagagcgagactctgtctcaaaaacaaaactaaaaaaccctattttcacatacagtcacattgggatttggagcttcaacatatgaattttcagggttatcattcagtccaaagtacttaatatgattcttttccgtttccacatagacaatcacataatctgtaaataatgactcttacttttccactttagtcgttaggttatacctatatatatattttcttgctttactggactaatttcaacctccagcacaccaccaatgaatagcagtaataccagcataattgtctgcagttctgctgagatacgtgctctattttattggcttggctgtaggtttttattttattttttgaagaggctaatctcttacaggaaaggtttctttttatatccagtttttacatgatgaatgatttcccagtatttcataattcatgaggctgaattcctcttgaatttattaaatgcttcctgtgcatcctctgtgatgatcatgtttatttactgctagaactcaagtacctagaactgttcctggccaatgatggtatgtaataaatacttcaatg

SEQ ID NO: 3278 - DNA, 2017 bp, Homo sapiens
tttccggcgctggctcctctccgtcagtgcggtttcgcctttatggtggtggagtctgcccaggctgtggaccgcaaataaccctgtacaaagaggaatggagattgcctctatccacctagattcataagctggcctgaggtgatcttggcatcaaggaagggatgcacatcatcacaccatcagcttcagagaatggcagccatttatttgtcccgtgggtttttttccagggaaccaatctgcccttttgaagaaaagacaaaggtagaaaggatggtggaggactacctggcaagtggttatcaggattcagtgacgtttgatgatgtggctgtggacttcaccccagaggagtgggctttactggacacaactgagaaatacctctacagagatgtgatgctggagaactacatgaacctggcctctgtggacaagaggctacagtggatggaaactctgtgactgtaagaattgtggagaggtcttcagggaacagttttgccttaagacacacatgagagttcagaatggagggaatacttctgagggtaattgttatggaaaagacaccctcagtgtgcacaaggaagcctctactggacaggaactttccaaatttaatccatgtggaaaagtctttactctaactccaggtcttgctgtacatcttgaagttctcaatgcaagacaaccctacaaatgtaaggaatgtggaaaaggctttaagtattttgcaagccttgataatcatatgggaatccacactgatgagaaactctgtgaatttcaggaatatgggagagctgtcacagcttcttcacacctaaagcagtgtgtagcagttcatacaggaaagaaatccaaaaagactaagaaatgtgggaaatccttcactaatttttctcaactttatgcacctgtgaaaactcataaaggagagaagtcctttgaatgtaaagaatgtggaagatcctttagaaattcctcatgccttaatgatcacattcaaattcacactggaataaaaccacacaagtgtacttactgtgggaaagccttcactagatcaactcaacttactgaacatgtaagaactcacactggaataaaaccctatgaatgtaaggaatgtggccaagcctttgctcagtactcgggcctttctatacacatacgaagtcacagtggaaagaaaccctatcagtgtaaggaatgtgggaaagccttcactacatccacaagtcttattcagcatacaagaattcacacaggagagaagccttatgaatgtgttgaatgtgggaagaccttcattacttcttcccgtcgtagtaaacatttgaaaactcatagtggagaaaagccctttgtatgcaagatatgtgggaaagcatttctatattcctcacgccttaatgttcacctgcgaactcataccggagagaaacccttcgtatgtaaagaatgtgggaaagcatttgctgtttcctcacgcctaagtagacatgaaagaattcacactggggagaaaccctatgaatgcaaggatatgagtgttaccatttagcccatcggttgccatctttaattattggcaatgacaccaaagattatcagatttgtcctaaatgccttttggaggttgtaatgactcatggattggccttagataccatcctgagggtctgaaattaaacctacaggttctgaatacaacatcatggttgcctgagtctgggcatctgtgaagaagggtcatggatggtgaggtcagtactgcaggctgcctcaccttggtgattagattcctaagatcatagcattaacaagttgtgtatgagataaatcatgcagattgaccccagcccctgttggttagtggctgccagtgtggcacatttatgtcaaaatttaccagaagccaagatgatgtaggaccccaaaggtgggttgttaagagatgctcctccaagggtctcttctgatcccacggatcctgcagagcgtgtca

SEQ ID NO: 3279 - DNA, 561 bp, Homo sapiens
atcttttccggcgctggctcctctccgtcagtgcggtttcgcctttatggtggtggagtctgcccaggctgtgggactatcagtcctccctgtgcgtccagttcggagaggctgcgcgctctctcggctcactgcaacctctgcaacctctgcctccagggtcaagcagttctcctgcctcagccttccgagtacctgggattacaggaccgcaaataaccctgtacaaagaggaatggagattgcctctatccacctagattcataagctggcctgaggtgatcttggcatcaaggaagggatgcacatcatcacaccatcagcttcagagaatggcagccatttatttgtcccgtgggtttttttccagggaaccaatctgcccttttgaagaaaagacaaaggtagaaaggatggtggaggactacctggcaagtggttatcaggattcagtgacgtttgatgatgtggctgtggacttcaccccagaggagtgggctttactggacacaactgagaaatacctctacagagatgtgatgctggagaactacatgaac

SEQ ID NO: 3280 - DNA, 4413 bp, Homo sapiens
gtcagtgcggtttcgcctttatggtggtggagtctgcccaggctgtggaccgcaaataaccctgtacaaagaggaatggagattgcctctatccacctagattcataagctggcctgaggtgatcttggcatcaaggaagggatgcacatcatcacaccatcagcttcagagaatggcagccatttatttgtcccgtggattcagtgacgtttgatgatgtggctgtggacttcaccccagaggagtgggctttactggacacaactgagaaatacctctacagagatgtgatgctggagaactacatgaacctggcctctgtggaatgggaaatacaacctagaaccaaacggtcatcacttcagcagggttttttgaagaatcaaatattcagtgggatacaaatgacaagaggctacagtggatggaaactctgtgactgtaagaattgtggagaggtcttcagggaacagttttgccttaagacacacatgagagttcagaatggagggaatacttctgagggtaattgttatggaaaagacaccctcagtgtgcacaaggaagcctctactggacaggaactttccaaatttaatccatgtggaaaagtctttactctaactccaggtcttgctgtacatcttgaagttctcaatgcaagacaaccctacaaatgtaaggaatgtggaaaaggctttaagtattttgcaagccttgataatcatatgggaatccacactgatgagaaactctgtgaatttcaggaatatgggagagctgtcacagcttcttcacacctaaagcagtgtgtagcagttcatacaggaaagaaatccaaaaagactaagaaatgtgggaaatccttcactaatttttctcaactttatgcacctgtgaaaactcataaaggagagaagtcctttgaatgtaaagaatgtggaagatcctttagaaattcctcatgccttaatgatcacattcaaattcacactggaataaaaccacacaagtgtacttactgtgggaaagccttcactagatcaactcaacttactgaacatgtaagaactcacactggaataaaaccctatgaatgtaaggaatgtggccaagcctttgctcagtactcgggcctttctatacacatacgaagtcacagtggaaagaaaccctatcagtgtaaggaatgtgggaaagccttcactacatccacaagtcttattcagcatacaagaattcacacaggagagaagccttatgaatgtgttgaatgtgggaagaccttcattacttcttcccgtcgtagtaaacatttgaaaactcatagtggagaaaagccctttgtatgcaagatatgtgggaaagcatttctatattcctcacgccttaatgttcacctgcgaactcataccggagagaaacccttcgtatgtaaagaatgtgggaaagcatttgctgtttcctcacgcctaagtagacatgaaagaattcacactggggagaaaccctatgaatgcaaggatatgagtgttaccatttagcccatcggttgccatctttaattattggcaatgacaccaaagattatcagatttgtcctaaatgccttttggaggttgtaatgactcatggattggccttagataccatcctgagggtctgaaattaaacctacaggttctgaatacaacatcatggttgcctgagtctgggcatctgtgaagaagggtcatggatggtgaggtcagtactgcaggctgcctcaccttggtgattagattcctaagatcatagcattaacaagttgtgtatgagataaatcatgcagattgaccccagcccctgttggttagtggctgccagtgtggcacatttatgtcaaaatttaccagaagccaagatgatgtaggaccccaaaggtgggttgttaagagatgctcctccaagggtctcttctgatcccacggatcctgcagagcgtgtcaggaatgaaaccatccataactgccagtgccctttcacagctgattatttctgtgtccccttgtaaaatctaagaagtgtgacagccttgcctgttctgccttgtatgtctattttagatggcacaatgtaagtggcaatgtctcttctagtataatccagtctctcttctcacttctgtcaaggtggctgatatagtccatgaatcccactcatgatctctttatcagatgatcgttcagccacactttgaggattctcttcagtacaagttttctaatttttgcattatggataggctgagaattttccaaatctccaagttctggttcctttttccttaacaattttttctgcaattcaggtctccttttgcatttttgctgagaccagctgggtcatggagaccctgacccagcagctctagaggaattaagacaaagacacagaaatagagtgcagagtgggaatcggggctcacagccttcagagctgagagccttgaacagagtttgacccacatatttattgacagtaagcctgtgataaacattatttctatagattatagattagctaaaagtattccttacaagaaagaaagggacaggctctggcttgttatctgcaacaggaacatgtccttaaggcacaaatcactcatggtattgtttgtggtttaggaatgcctgagcagttttccagttttccaccgtgggtgggccaggtgttccttgccctcattcgggtaaaccagcaacctccagcatgggtgtcatagccatcacgagcatgtcacagtgccgcagagattttgtttatgggcagtttctcatggcctgtttatgtccaaatttggggggcctgttctgagcacattttcctgtaagcactcaggaagaatgaagcttcctgtgtcctttaacactttaagtacagatcttagtgatacataaccagttttatctctctcaagctctaccttccgcaaagtgctagaatacagttctgccaagttcttcactacttcgtatcaagggttgtattttctttatttcccaatagcatgttcctcattccccaatgacacctcaccaggatcacccttaccaaccttacttccagcttgcacatcagaatttttccagcctcatttgtcagtttcaaatctgcttcacatttttagtttttttgtttgtttgtttttaatctgccttaatgagctcaggccactatcacaaaataccacagaccaaatggcttacaaatttgttaattttaaataaatgaggttaaaaacaaatttatattctcacatttctcgaggctggaagtctgagatcagagtgccagcatggtcaacttctggcgagagctctcttcctggtatgtaaatgcccacttcctcatgtcttcacaggaaggaaaccaacaaataggtctctctctcctctctcctttctcctctctcctctctcctctttctctctctctccccaccatctctctccttcccctccctccccctccctccccctacccatctcttgacatcatttcacgatacttctaaagagcctattttcaggccgggcgcggtggctcacacctgtaatcccagcactttgggaggccgaggtgggcggatcacgaggtcaggagatcgagactgtcctagttaacacggtgaaaccctgtctctactacaaatacaaaaaattagcctggcgtggtggcgggtacctgcagtcccagctactcgggaggctgaggcaggagaatggcatgaacctgggaggcacaggttgcagtgagccgagatcgcagccactgcattccagcctggacaacagagcgagactctgtctcaaaaacaaaactaaaaaaccctattttcacatacagtcacattgggatttggagcttcaacatatgaattttcagggttatcattcagtccaaagtacttaatatgattcttttccgtttccacatagacaatcacataatctgtaaataatgactcttacttttccactttagtcgttaggttatacctatatatatattttcttgctttactggactaatttcaacctccagcacaccaccaatgaatagcagtaataccagcataattgtctgcagttctgctgagatacgtgctctattttattggcttggctgtaggtttttattttattttttgaagaggctaatctcttacaggaaaggtttctttttatatccagtttttacatgatgaatgatttcccagtatttcataattcatgaggctgaattcctcttgaatttattaaatgcttcctgtgcatcctctgtgatgatcatgtttatttactgctagaactcaagtacctagaactgttcctggccaatgatggtatgtaataaatacttcaatg

SEQ ID NO: 3281 - DNA, 566 bp, Homo sapiens
ttttccggcgctggctcctctccgtcagtgcggtttcgcctttatggtggtggagtctgcccaggctgtggtgagttccacctccttggcggtcccggggatagcagggggcggcaaaggaatgattgcgcgctgtcgcctaggagcctctcagatccgcttcacttcactcgcttctccagggactatcagtcctccctgtgcgtccagttcggagaggctgcgcgctctctcggctcactgcaacctctgcaacctctgcctccagggtcaagcagttctcctgcctcagccttccgagtacctgggattacaggaccgcaaataaccctgtacaaagaggaatggagattgcctctatccacctagattcataagctggcctgaggtgatcttggcatcaaggaagggatgcacatcatcacaccatcagcttcagagaatggcagccatttatttgtcccgtgggtttttttccagggaaccaatctgcccttttgaagaaaagacaaaggtagaaaggatggtggaggactacctggcaagtggttatcaggattcagtga

SEQ ID NO: 3282 - DNA, 5543 bp, Homo sapiens
agtgtgccaccgccatctttaccggctgtggctcagcatggtcagtgccgtttaacctttattgtggtggagtccaccccgctgtgggcctcagataaccctgtacaaaggggaatggagattgcctgtatccacctagattcataagctgccctgaggcgatcttggcatcaagaaagacagcattgaggcacatctcaccatcagcttcagaggatgtcagcctttgatatgtcccatgatttctttttctgcttaacttcagaatgggaaatacaacctagaaccaaacggtcatcacttcagcagggttttttgaagaatcaaatattcactgggatacaaatgcagacaagaagctacagtggatggaaactctgtgagaattgtggagaggtcttcagtgaacagttttgccttaagacacacatgagagctcagaatggagggaacacttttgagggtaattgttatggaaaagacagcatcagtgtgcacaaggaagcctctattggacaagaactttccaaatttaatccatgtggaaaagtcttcaccttaactccaggccttgctgtgcatcttgaaattctcaatggaagacaaccctacaaatgtaaggaatgtggaaaaggctttaagtattttgcaagccttgataatcacatgggaatccacattggagagaaactctgtgaatttcaggaatgtgagagagccatcacaacttcctcacacttaaagcagtgtgtagcagttcatactggaaagaaatccgaaaagactaagaactgtgggaaatccttcactaatttttctcaactttctgcacatgcaaaaactcataaaggagagaagtcctttgaatgtaaagaatgtggaagatcctttagaaattcctcatcctttaatgttcacattcaaattcacactggaataaaaccacacaaatgtacggaatgtgggaaagccttcactagatcaactcaccttactcaacatgtaagaactcacactggaataaaaccctatgaatgtaaggaatgtggccaagccttcactcagtacacgggccttgctatacacatacgaaatcacactggagagaaaccctatcagtgtaaggaatgtgggaaagccttcaatagatcttcaacgcttactcaacatagaagaattcacacaggagagaagccttatgaatgtgttgaatgtgggaagaccttcattacttcttcccatcgtagtaaacatttgaaaactcacagtggagaaaggtaaatgcaagatatgtgggaaagaatttctgtattcctcaccccacctgtgaactcctaccagagagaaaccttttgtatgtaaagaatttgggaaagcatttgctctttcctcatgcctaagtatgcatgaaagaattcacactggggagaaatactatgaatgtaaggatatgagtgttgttaccatttagcccattggttgccatctttaattattggcagtgcaaagatcatcagattagtcctaaatgccttttggaggttgtaatggctcacagattggccttagatgcatcccgagggtctgaaattaaacctacaggttctgaatacaacatcatggttacctgagtctgggcatctgtgaagaagggtcatggatggtgaggtcagtactgcaggctgcctcaccttggtgattagattcctaagatcatagcattaacaagttctgtacgagataaatcatgcagattgatcccagcccctgttggttagtggctgccagtgtggcacattcatgtcaaaatttaccagaagccaagatgatgtaggccccagaggtggattgttaaaaagatgctcctccaaggttctcttctgttcccatggatcctgcagagcatgtcaggagtgaaaccatccataactgccagtgccctttcacagctgattatttctatgtccccttcttgtaaaataagaagtgtgacaaccttgactgttctgttctgtcttctctgtccattttaggtggcacaatgtaagtggcagtgtctcttatagtataatccagtctctcttctcacttctgttaagatggctgatatagtccatgaatcccactcatgatctctttatcaaatgattgttcagccacactttgaggattctcttcagtacaagttttctaatttttgcagtatggataggctgagaattttccaaatctccaagttctggttcctttttccttaacaatttcttctgcaattcaggtctccttttgcatttttgccgagaccagctgggtcgtggagaccctaacccagtggctctagaggaattaagacaaagacacagaaatatagtgcagagtgggaatcggggctcacagccttcagagctgagcttgaacagagtttgacccacatatttattgacagtaagcctgtgataaacattattcctatagattgtagatcagctataagtattccttatgagaaagaaagggacaggctctggcttgttatctgcaacaggaatatgtccttaaggcacaaatcactcatgctattgtttgtggtttaggaatgccttgagcagttttccagttttctgccctgggtgggccaggtgttgcttgccctcattctggtaaaccagcagcctccagcatgggcgtcatagccatcacgagcatgtcacagtgctgcagagattttgtttatggccagtttctcattgcctgtttatggccagatttggggggcctgttcccagcacattttcctgtaagcactcaggaataatgaagcttcctgtgtcctttaacactttaattacagatcttagtgatacataccattttatctgtctcaagctctaccttccgtaaaatgctagaatacagttctgccaagttcttcaccactttatatcaagggttgtcttttcttcatttcccaatagcatgttcctcattccccaatgacacctcaccagaataacccttaccaaccttatttccagcttgcacatcagaatttttccagcctctactcatttgtcagtttcaaagctgcttcacatttttagtttttttgtttgtttttaattgcagtacctcacttctcagtaccaatatctgccttagtcagctcagacaaccataagagaataccgcagaccaaatggcttagaaattaatttaattttaaatcaatgaggttaaaaacacaggattttttttttttttttttttttttttttgagatggagttttgctcttgttgcccaggctggagtgcaatggtatgatcttggctcaccgcaacctccacctcctgagttccagtgattctcctgcctcaccctcagtagctgggattattggcatgcaccacaaaccttagctaagtttgtatttttagtagagacagggtttctccatgttggttaggctgatctccatgttggtcagatctgacctttggtgatccacctgccttggcctcccaaagtgctgggattacaggcctgagccaccgtatctggcccaaaacacaaatttatattctcacatatctggaggctggaagtctgagatcagagtgccagcatggtcaacctctagtgagagctctcttcctggcatgtaagtgcccacttcctcatgttttcacacgatggagaccaacaaataggtcggtcggtctcccccctccccgcccccttctcttttcacatacagtcacattgaggtttggaacttcatatgaaatttggggggtcactgtgtgtgtgtgtgtgtgtgtgtgtatgtgtatatatatatacatatatatacacatatgtatgtatacctaactcctaaagtggaacagtaagagtcattatttatagattatctgattctctatgtggaaagagaaaagaatcatattaagtactttggactgaacaatgacccccaaaattcgtatgatgatgaagctctctctaaatattttcttgctttactggactgattttaacccgctgcacaacaccaactaaaagtagtaataccagcatacttgtctttgcagttctggtgagatatgcactctattttgttggtttggctgtaggcttttatttcttttttattttttgaagaggttatgtcctgtcagggaaccagccccgatattcacataggttcttttctattttccctaagtgtcagccaacttgagaaataaagggacagagtacaaaagagagaaattttaaagctgggtgtccggggcagacatcacatgtcggtaggttccgtgatgccccacaagccgcaaaaaccagcaagtttttattagggattttcaaaaggggagggagtgtgcaaataggtgtgggtcacagacatcaagtactttacaaggtaatagaatatcacaaggcaagtggaggcagggcgagatcacaggaccaaggtgaaattaaaattgctaatgaagttttgggcaccattgtcattgataacatcttatcaggagacggttttgagatcaactggtctgactaaaatttattaggtgggaatttcctcttcctaataagcctgggagtgctatgggagactggggtctatttcacccctgcagtctcgaccataagagatggctacacccaggggggccagttcagagacccactcccaggtgtgcattctctttctcaaggatgttccttgctgagaaaaagaattcagtgatatttctcccatttgcttgtgaaagaagagaaatgtggctttgttccacctggctcaccggcggtcagaatttaaggttatctctcttgtttcctaaacattgctgttatcctgttcttttttcaaggtgcccagatttcatattgctcaaacacacatgctgtataatttgtgcagttaatgcaattattacagggtcctgaggtaatatacatcctcctcagctgacaggattgagagattaaagtaaagacaggcataggaaatcacaagggtattgactggggaagtgataagtgtccatgaaatctttacaatttatgtttagagattgcagtaaagacaggcataagaaattataaaagtattaatttggggaactaataaatgtccatgaaaccttcacaatccatgtttttctgccatggcttcagccagtccccccgtttggggtccctgacttcctgcaacaatgtcctgcaggaaaagttttttctttatatccagtttttacatgatgaattatttcccaatatttcatagtttatgaggctgaattcctcttgaatttattaaatgcttccttcacatcctctgtgatgatcatgtttatttactgataaaactcaatacctagaactgcacctagctcatgatggtacctaataaatacttcaatgaaatgatgtggtgatgcatgcctatagttttagctacttgggagggtggcctgagcccaggggttctagaccagcttaggcaacatagcaagaccccatctc

SEQ ID NO: 3283 - DNA, 5706 bp, Homo sapiens
agtgtgccaccgccatctttaccggctgtggctcagcatggtcagtgccgtttaacctttattgtggtggagtccaccccgctgtgattcataagctgccctgaggcgatcttggcatcaagaaagacagcattgaggcacatctcaccatcagcttcagaggatgtcagcctttgatatgtcccatgggttttttcccagggaaccaatctgtccttttgaagaaaagacaaagataggaacgatggtagaggaccaccggtcaaattcttaccaggattcagtgacgtttgatgatgtggctgtggagttcaccccagaggagtgggctttactggacacaactcagaaatacctctacagagatgtgatgctggagaactacatgaacctggcctctgtggatttctttttctgcttaacttcagaatgggaaatacaacctagaaccaaacggtcatcacttcagcagggttttttgaagaatcaaatattcactgggatacaaatgcagacaagaagctacagtggatggaaactctgtgagaattgtggagaggtcttcagtgaacagttttgccttaagacacacatgagagctcagaatggagggaacacttttgagggtaattgttatggaaaagacagcatcagtgtgcacaaggaagcctctattggacaagaactttccaaatttaatccatgtggaaaagtcttcaccttaactccaggccttgctgtgcatcttgaaattctcaatggaagacaaccctacaaatgtaaggaatgtggaaaaggctttaagtattttgcaagccttgataatcacatgggaatccacattggagagaaactctgtgaatttcaggaatgtgagagagccatcacaacttcctcacacttaaagcagtgtgtagcagttcatactggaaagaaatccgaaaagactaagaactgtgggaaatccttcactaatttttctcaactttctgcacatgcaaaaactcataaaggagagaagtcctttgaatgtaaagaatgtggaagatcctttagaaattcctcatcctttaatgttcacattcaaattcacactggaataaaaccacacaaatgtacggaatgtgggaaagccttcactagatcaactcaccttactcaacatgtaagaactcacactggaataaaaccctatgaatgtaaggaatgtggccaagccttcactcagtacacgggccttgctatacacatacgaaatcacactggagagaaaccctatcagtgtaaggaatgtgggaaagccttcaatagatcttcaacgcttactcaacatagaagaattcacacaggagagaagccttatgaatgtgttgaatgtgggaagaccttcattacttcttcccatcgtagtaaacatttgaaaactcacagtggagaaaggtaaatgcaagatatgtgggaaagaatttctgtattcctcaccccacctgtgaactcctaccagagagaaaccttttgtatgtaaagaatttgggaaagcatttgctctttcctcatgcctaagtatgcatgaaagaattcacactggggagaaatactatgaatgtaaggatatgagtgttgttaccatttagcccattggttgccatctttaattattggcagtgcaaagatcatcagattagtcctaaatgccttttggaggttgtaatggctcacagattggccttagatgcatcccgagggtctgaaattaaacctacaggttctgaatacaacatcatggttacctgagtctgggcatctgtgaagaagggtcatggatggtgaggtcagtactgcaggctgcctcaccttggtgattagattcctaagatcatagcattaacaagttctgtacgagataaatcatgcagattgatcccagcccctgttggttagtggctgccagtgtggcacattcatgtcaaaatttaccagaagccaagatgatgtaggccccagaggtggattgttaaaaagatgctcctccaaggttctcttctgttcccatggatcctgcagagcatgtcaggagtgaaaccatccataactgccagtgccctttcacagctgattatttctatgtccccttcttgtaaaataagaagtgtgacaaccttgactgttctgttctgtcttctctgtccattttaggtggcacaatgtaagtggcagtgtctcttatagtataatccagtctctcttctcacttctgttaagatggctgatatagtccatgaatcccactcatgatctctttatcaaatgattgttcagccacactttgaggattctcttcagtacaagttttctaatttttgcagtatggataggctgagaattttccaaatctccaagttctggttcctttttccttaacaatttcttctgcaattcaggtctccttttgcatttttgccgagaccagctgggtcgtggagaccctaacccagtggctctagaggaattaagacaaagacacagaaatatagtgcagagtgggaatcggggctcacagccttcagagctgagcttgaacagagtttgacccacatatttattgacagtaagcctgtgataaacattattcctatagattgtagatcagctataagtattccttatgagaaagaaagggacaggctctggcttgttatctgcaacaggaatatgtccttaaggcacaaatcactcatgctattgtttgtggtttaggaatgccttgagcagttttccagttttctgccctgggtgggccaggtgttgcttgccctcattctggtaaaccagcagcctccagcatgggcgtcatagccatcacgagcatgtcacagtgctgcagagattttgtttatggccagtttctcattgcctgtttatggccagatttggggggcctgttcccagcacattttcctgtaagcactcaggaataatgaagcttcctgtgtcctttaacactttaattacagatcttagtgatacataccattttatctgtctcaagctctaccttccgtaaaatgctagaatacagttctgccaagttcttcaccactttatatcaagggttgtcttttcttcatttcccaatagcatgttcctcattccccaatgacacctcaccagaataacccttaccaaccttatttccagcttgcacatcagaatttttccagcctctactcatttgtcagtttcaaagctgcttcacatttttagtttttttgtttgtttttaattgcagtacctcacttctcagtaccaatatctgccttagtcagctcagacaaccataagagaataccgcagaccaaatggcttagaaattaatttaattttaaatcaatgaggttaaaaacacaggattttttttttttttttttttttttttttgagatggagttttgctcttgttgcccaggctggagtgcaatggtatgatcttggctcaccgcaacctccacctcctgagttccagtgattctcctgcctcaccctcagtagctgggattattggcatgcaccacaaaccttagctaagtttgtatttttagtagagacagggtttctccatgttggttaggctgatctccatgttggtcagatctgacctttggtgatccacctgccttggcctcccaaagtgctgggattacaggcctgagccaccgtatctggcccaaaacacaaatttatattctcacatatctggaggctggaagtctgagatcagagtgccagcatggtcaacctctagtgagagctctcttcctggcatgtaagtgcccacttcctcatgttttcacacgatggagaccaacaaataggtcggtcggtctcccccctccccgcccccttctcttttcacatacagtcacattgaggtttggaacttcatatgaaatttggggggtcactgtgtgtgtgtgtgtgtgtgtgtgtatgtgtatatatatatacatatatatacacatatgtatgtatacctaactcctaaagtggaacagtaagagtcattatttatagattatctgattctctatgtggaaagagaaaagaatcatattaagtactttggactgaacaatgacccccaaaattcgtatgatgatgaagctctctctaaatattttcttgctttactggactgattttaacccgctgcacaacaccaactaaaagtagtaataccagcatacttgtctttgcagttctggtgagatatgcactctattttgttggtttggctgtaggcttttatttcttttttattttttgaagaggttatgtcctgtcagggaaccagccccgatattcacataggttcttttctattttccctaagtgtcagccaacttgagaaataaagggacagagtacaaaagagagaaattttaaagctgggtgtccggggcagacatcacatgtcggtaggttccgtgatgccccacaagccgcaaaaaccagcaagtttttattagggattttcaaaaggggagggagtgtgcaaataggtgtgggtcacagacatcaagtactttacaaggtaatagaatatcacaaggcaagtggaggcagggcgagatcacaggaccaaggtgaaattaaaattgctaatgaagttttgggcaccattgtcattgataacatcttatcaggagacggttttgagatcaactggtctgactaaaatttattaggtgggaatttcctcttcctaataagcctgggagtgctatgggagactggggtctatttcacccctgcagtctcgaccataagagatggctacacccaggggggccagttcagagacccactcccaggtgtgcattctctttctcaaggatgttccttgctgagaaaaagaattcagtgatatttctcccatttgcttgtgaaagaagagaaatgtggctttgttccacctggctcaccggcggtcagaatttaaggttatctctcttgtttcctaaacattgctgttatcctgttcttttttcaaggtgcccagatttcatattgctcaaacacacatgctgtataatttgtgcagttaatgcaattattacagggtcctgaggtaatatacatcctcctcagctgacaggattgagagattaaagtaaagacaggcataggaaatcacaagggtattgactggggaagtgataagtgtccatgaaatctttacaatttatgtttagagattgcagtaaagacaggcataagaaattataaaagtattaatttggggaactaataaatgtccatgaaaccttcacaatccatgtttttctgccatggcttcagccagtccccccgtttggggtccctgacttcctgcaacaatgtcctgcaggaaaagttttttctttatatccagtttttacatgatgaattatttcccaatatttcatagtttatgaggctgaattcctcttgaatttattaaatgcttccttcacatcctctgtgatgatcatgtttatttactgataaaactcaatacctagaactgcacctagctcatgatggtacctaataaatacttcaatgaaatgatgtggtgatgcatgcctatagttttagctacttgggagggtggcctgagcccaggggttctagaccagcttaggcaacatagcaagaccccatctc

SEQ ID NO: 3284 - DNA, 5759 bp, Homo sapiens
agtgtgccaccgccatctttaccggctgtggctcagcatggtcagtgccgtttaacctttattgtggtggagtccaccccgctgtgggcctcagataaccctgtacaaaggggaatggagattgcctgtatccacctagattcataagctgccctgaggcgatcttggcatcaagaaagacagcattgaggcacatctcaccatcagcttcagaggatgtcagcctttgatatgtcccatgggttttttcccagggaaccaatctgtccttttgaagaaaagacaaagataggaacgatggtagaggaccaccggtcaaattcttaccaggattcagtgacgtttgatgatgtggctgtggagttcaccccagaggagtgggctttactggacacaactcagaaatacctctacagagatgtgatgctggagaactacatgaacctggcctctgtggatttctttttctgcttaacttcagaatgggaaatacaacctagaaccaaacggtcatcacttcagcagggttttttgaagaatcaaatattcactgggatacaaatgcagacaagaagctacagtggatggaaactctgtgagaattgtggagaggtcttcagtgaacagttttgccttaagacacacatgagagctcagaatggagggaacacttttgagggtaattgttatggaaaagacagcatcagtgtgcacaaggaagcctctattggacaagaactttccaaatttaatccatgtggaaaagtcttcaccttaactccaggccttgctgtgcatcttgaaattctcaatggaagacaaccctacaaatgtaaggaatgtggaaaaggctttaagtattttgcaagccttgataatcacatgggaatccacattggagagaaactctgtgaatttcaggaatgtgagagagccatcacaacttcctcacacttaaagcagtgtgtagcagttcatactggaaagaaatccgaaaagactaagaactgtgggaaatccttcactaatttttctcaactttctgcacatgcaaaaactcataaaggagagaagtcctttgaatgtaaagaatgtggaagatcctttagaaattcctcatcctttaatgttcacattcaaattcacactggaataaaaccacacaaatgtacggaatgtgggaaagccttcactagatcaactcaccttactcaacatgtaagaactcacactggaataaaaccctatgaatgtaaggaatgtggccaagccttcactcagtacacgggccttgctatacacatacgaaatcacactggagagaaaccctatcagtgtaaggaatgtgggaaagccttcaatagatcttcaacgcttactcaacatagaagaattcacacaggagagaagccttatgaatgtgttgaatgtgggaagaccttcattacttcttcccatcgtagtaaacatttgaaaactcacagtggagaaaggtaaatgcaagatatgtgggaaagaatttctgtattcctcaccccacctgtgaactcctaccagagagaaaccttttgtatgtaaagaatttgggaaagcatttgctctttcctcatgcctaagtatgcatgaaagaattcacactggggagaaatactatgaatgtaaggatatgagtgttgttaccatttagcccattggttgccatctttaattattggcagtgcaaagatcatcagattagtcctaaatgccttttggaggttgtaatggctcacagattggccttagatgcatcccgagggtctgaaattaaacctacaggttctgaatacaacatcatggttacctgagtctgggcatctgtgaagaagggtcatggatggtgaggtcagtactgcaggctgcctcaccttggtgattagattcctaagatcatagcattaacaagttctgtacgagataaatcatgcagattgatcccagcccctgttggttagtggctgccagtgtggcacattcatgtcaaaatttaccagaagccaagatgatgtaggccccagaggtggattgttaaaaagatgctcctccaaggttctcttctgttcccatggatcctgcagagcatgtcaggagtgaaaccatccataactgccagtgccctttcacagctgattatttctatgtccccttcttgtaaaataagaagtgtgacaaccttgactgttctgttctgtcttctctgtccattttaggtggcacaatgtaagtggcagtgtctcttatagtataatccagtctctcttctcacttctgttaagatggctgatatagtccatgaatcccactcatgatctctttatcaaatgattgttcagccacactttgaggattctcttcagtacaagttttctaatttttgcagtatggataggctgagaattttccaaatctccaagttctggttcctttttccttaacaatttcttctgcaattcaggtctccttttgcatttttgccgagaccagctgggtcgtggagaccctaacccagtggctctagaggaattaagacaaagacacagaaatatagtgcagagtgggaatcggggctcacagccttcagagctgagcttgaacagagtttgacccacatatttattgacagtaagcctgtgataaacattattcctatagattgtagatcagctataagtattccttatgagaaagaaagggacaggctctggcttgttatctgcaacaggaatatgtccttaaggcacaaatcactcatgctattgtttgtggtttaggaatgccttgagcagttttccagttttctgccctgggtgggccaggtgttgcttgccctcattctggtaaaccagcagcctccagcatgggcgtcatagccatcacgagcatgtcacagtgctgcagagattttgtttatggccagtttctcattgcctgtttatggccagatttggggggcctgttcccagcacattttcctgtaagcactcaggaataatgaagcttcctgtgtcctttaacactttaattacagatcttagtgatacataccattttatctgtctcaagctctaccttccgtaaaatgctagaatacagttctgccaagttcttcaccactttatatcaagggttgtcttttcttcatttcccaatagcatgttcctcattccccaatgacacctcaccagaataacccttaccaaccttatttccagcttgcacatcagaatttttccagcctctactcatttgtcagtttcaaagctgcttcacatttttagtttttttgtttgtttttaattgcagtacctcacttctcagtaccaatatctgccttagtcagctcagacaaccataagagaataccgcagaccaaatggcttagaaattaatttaattttaaatcaatgaggttaaaaacacaggattttttttttttttttttttttttttttgagatggagttttgctcttgttgcccaggctggagtgcaatggtatgatcttggctcaccgcaacctccacctcctgagttccagtgattctcctgcctcaccctcagtagctgggattattggcatgcaccacaaaccttagctaagtttgtatttttagtagagacagggtttctccatgttggttaggctgatctccatgttggtcagatctgacctttggtgatccacctgccttggcctcccaaagtgctgggattacaggcctgagccaccgtatctggcccaaaacacaaatttatattctcacatatctggaggctggaagtctgagatcagagtgccagcatggtcaacctctagtgagagctctcttcctggcatgtaagtgcccacttcctcatgttttcacacgatggagaccaacaaataggtcggtcggtctcccccctccccgcccccttctcttttcacatacagtcacattgaggtttggaacttcatatgaaatttggggggtcactgtgtgtgtgtgtgtgtgtgtgtgtatgtgtatatatatatacatatatatacacatatgtatgtatacctaactcctaaagtggaacagtaagagtcattatttatagattatctgattctctatgtggaaagagaaaagaatcatattaagtactttggactgaacaatgacccccaaaattcgtatgatgatgaagctctctctaaatattttcttgctttactggactgattttaacccgctgcacaacaccaactaaaagtagtaataccagcatacttgtctttgcagttctggtgagatatgcactctattttgttggtttggctgtaggcttttatttcttttttattttttgaagaggttatgtcctgtcagggaaccagccccgatattcacataggttcttttctattttccctaagtgtcagccaacttgagaaataaagggacagagtacaaaagagagaaattttaaagctgggtgtccggggcagacatcacatgtcggtaggttccgtgatgccccacaagccgcaaaaaccagcaagtttttattagggattttcaaaaggggagggagtgtgcaaataggtgtgggtcacagacatcaagtactttacaaggtaatagaatatcacaaggcaagtggaggcagggcgagatcacaggaccaaggtgaaattaaaattgctaatgaagttttgggcaccattgtcattgataacatcttatcaggagacggttttgagatcaactggtctgactaaaatttattaggtgggaatttcctcttcctaataagcctgggagtgctatgggagactggggtctatttcacccctgcagtctcgaccataagagatggctacacccaggggggccagttcagagacccactcccaggtgtgcattctctttctcaaggatgttccttgctgagaaaaagaattcagtgatatttctcccatttgcttgtgaaagaagagaaatgtggctttgttccacctggctcaccggcggtcagaatttaaggttatctctcttgtttcctaaacattgctgttatcctgttcttttttcaaggtgcccagatttcatattgctcaaacacacatgctgtataatttgtgcagttaatgcaattattacagggtcctgaggtaatatacatcctcctcagctgacaggattgagagattaaagtaaagacaggcataggaaatcacaagggtattgactggggaagtgataagtgtccatgaaatctttacaatttatgtttagagattgcagtaaagacaggcataagaaattataaaagtattaatttggggaactaataaatgtccatgaaaccttcacaatccatgtttttctgccatggcttcagccagtccccccgtttggggtccctgacttcctgcaacaatgtcctgcaggaaaagttttttctttatatccagtttttacatgatgaattatttcccaatatttcatagtttatgaggctgaattcctcttgaatttattaaatgcttccttcacatcctctgtgatgatcatgtttatttactgataaaactcaatacctagaactgcacctagctcatgatggtacctaataaatacttcaatgaaatgatgtggtgatgcatgcctatagttttagctacttgggagggtggcctgagcccaggggttctagaccagcttaggcaacatagcaagaccccatctc

SEQ ID NO: 3285 - DNA, 1438 bp, Homo sapiens
agtgtgccaccgccatctttaccggctgtggctcagcatggtcagtgccgtttaacctttattgtggtggagtccaccccgctgtggattcagtgacgtttgatgatgtggctgtggagttcaccccagaggagtgggctttactggacacaactcagaaatacctctacagagatgtgatgctggagaactacatgaacctggcctctgtggatttctttttctgcttaacttcagaatgggaaatacaacctagaaccaaacggtcatcacttcagcagggttttttgaagaatcaaatattcactgggatacaaatgcagacaagaagctacagtggatggaaactctgtgagaattgtggagaggtcttcagtgaacagttttgccttaagacacacatgagagctcagaatggagggaacacttttgagggtaattgttatggaaaagacagcatcagtgtgcacaaggaagcctctattggacaagaactttccaaatttaatccatgtggaaaagtcttcaccttaactccaggccttgctgtgcatcttgaaattctcaatggaagacaaccctacaaatgtaaggaatgtggaaaaggctttaagtattttgcaagccttgataatcacatgggaatccacattggagagaaactctgtgaatttcaggaatgtgagagagccatcacaacttcctcacacttaaagcagtgtgtagcagttcatactggaaagaaatccgaaaagactaagaactgtgggaaatccttcactaatttttctcaactttctgcacatgcaaaaactcataaaggagagaagtcctttgaatgtaaagaatgtggaagatcctttagaaattcctcatcctttaatgttcacattcaaattcacactggaataaaaccacacaaatgtacggaatgtgggaaagccttcactagatcaactcaccttactcaacatgtaagaactcacactggaataaaaccctatgaatgtaaggaatgtggccaagccttcactcagtacacgggccttgctatacacatacgaaatcacactggagagaaaccctatcagtgtaaggaatgtgggaaagccttcaatagatcttcaacgcttactcaacatagaagaattcacacaggagagaagccttatgaatgtgttgaatgtgggaagaccttcattacttcttcccatcgtagtaaacatttgaaaactcacagtggagaaaggtaaatgcaagatatgtgggaaagaatttctgtattcctcaccccacctgtgaactcctaccagagagaaaccttttgtatgtaaagaatttgggaaagcatttgctctttcctcatgcctaagtatgcatgaaagaattcacactggggagaaatactatgaatgtaaggatatgagtgttgttacca

SEQ ID NO: 3286 - DNA, 1475 bp, Homo sapiens
accggctgtggctcagcatggtcagtgccgtttaacctttattgtggtggagtccaccccgctgtgggcctcagataaccctgtacaaaggggaatggagattgcctgtatccacctagattcataagctgccctgaggcgatcttggcatcaagaaagacagcattgaggcacatctcaccatcagcttcagaggatgtcagcctttgatatgtcccatgggttttttcccagggaaccaatctgtccttttgaagaaaagacaaagataggaacgatggtagaggaccaccggtcaaattcttaccagatttctttttctgcttaacttcagaatgggaaatacaacctagaaccaaacggtcatcacttcagcagggttttttgaagaatcaaatattcactgggatacaaatgacaagaagctacagtggatggaaactctgtgagaattgtggagaggtcttcagtgaacagttttgccttaagacacacatgagagctcagaatggagggaacacttttgagggtaattgttatggaaaagacagcatcagtgtgcacaaggaagcctctattggacaagaactttccaaatttaatccatgtggaaaagtcttcaccttaactccaggccttgctgtgcatcttgaaattctcaatggaagacaaccctacaaatgtaaggaatgtggaaaaggctttaagtattttgcaagccttgataatcacatgggaatccacattggagagaaactctgtgaatttcaggaatgtgagagagccatcacaacttcctcacacttaaagcagtgtgtagcagttcatactggaaagaaatccgaaaagactaagaactgtgggaaatccttcactaatttttctcaactttctgcacatgcaaaaactcataaaggagagaagtcctttgaatgtaaagaatgtggaagatcctttagaaattcctcatcctttaatgttcacattcaaattcacactggaataaaaccacacaaatgtacggaatgtgggaaagccttcactagatcaactcaccttactcaacatgtaagaactcacactggaataaaaccctatgaatgtaaggaatgtggccaagccttcactcagtacacgggccttgctatacacatacgaaatcacactggagagaaaccctatcagtgtaaggaatgtgggaaagccttcaatagatcttcaacgcttactcaacatagaagaattcacacaggagagaagccttatgaatgtgttgaatgtgggaagaccttcattacttcttcccatcgtagtaaacatttgaaaactcacagtggagaaaggtaaatgcaagatatgtgggaaagaatttctgtattcctcaccccacctgtgaactcctaccagagagaaaccttttgtatgtaaagaatttgggaaagcatttgctctttcctcatgcctaagtatgcatg

SEQ ID NO: 3287 - DNA, 1765 bp, Homo sapiens
atctttaccggctgtggctcagcatggtcagtgccgtttaacctttattgtggtggagtccaccccgctgtgggcctcagataaccctgtacaaaggggaatggagattgcctgtatccacctagattcataagctgccctgaggcgatcttggcatcaagaaagacagcattgaggcacatctcaccatcagcttcagaggatgtcagcctttgatatgtcccatggattcagtgacgtttgatgatgtggctgtggagttcaccccagaggagtgggctttactggacacaactcagaaatacctctacagagatgtgatgctggagaactacatgaacctggcctctgtggatttctttttctgcttaacttcagaatgggaaatacaacctagaaccaaacggtcatcacttcagcagggttttttgaagaatcaaatattcactgggatacaaatgcagacaagaagctacagtggatggaaactctgtgagaattgtggagaggtcttcagtgaacagttttgccttaagacacacatgagagctcagaatggagggaacacttttgagggtaattgttatggaaaagacagcatcagtgtgcacaaggaagcctctattggacaagaactttccaaatttaatccatgtggaaaagtcttcaccttaactccaggccttgctgtgcatcttgaaattctcaatggaagacaaccctacaaatgtaaggaatgtggaaaaggctttaagtattttgcaagccttgataatcacatgggaatccacattggagagaaactctgtgaatttcaggaatgtgagagagccatcacaacttcctcacacttaaagcagtgtgtagcagttcatactggaaagaaatccgaaaagactaagaactgtgggaaatccttcactaatttttctcaactttctgcacatgcaaaaactcataaaggagagaagtcctttgaatgtaaagaatgtggaagatcctttagaaattcctcatcctttaatgttcacattcaaattcacactggaataaaaccacacaaatgtacggaatgtgggaaagccttcactagatcaactcaccttactcaacatgtaagaactcacactggaataaaaccctatgaatgtaaggaatgtggccaagccttcactcagtacacgggccttgctatacacatacgaaatcacactggagagaaaccctatcagtgtaaggaatgtgggaaagccttcaatagatcttcaacgcttactcaacatagaagaattcacacaggagagaagccttatgaatgtgttgaatgtgggaagaccttcattacttcttcccatcgtagtaaacatttgaaaactcacagtggagaaaggtaaatgcaagatatgtgggaaagaatttctgtattcctcaccccacctgtgaactcctaccagagagaaaccttttgtatgtaaagaatttgggaaagcatttgctctttcctcatgcctaagtatgcatgaaagaattcacactggggagaaatactatgaatgtaaggatatgagtgttgttaccatttagcccattggttgccatctttaattattggcagtgcaaagatcatcagattagtcctaaatgccttttggaggttgtaatggctcacagattggccttagatgcatcccgagggtctgaaattaaacctacaggttctgaatacaacatcatggttacctgagtctgggcatctgtgaagaag

SEQ ID NO: 3288 - DNA, 2754 bp, Homo sapiens
gccaggttcaaagagcccgcggcgtcttcacgcccctgcgctcagctctagactcagtcgctcgctgagagacgccctggaacgtctgtgtagcctcagtcgctgagagacgccctggaacgtctgtggcagcctctgtcacagtgggacccgcactggcagcgggaggcagagggaggaccctggaacatcccggaagccgggaaatggacgcagtggcctttgaggatgtggctgtgaacttcacccaggaggaatgggctttgctgggtccatcacagaagaatttatacagatatgtgatgcaagaaaccatcaggaacctggactgtataagaatgatatgggaagaacagaatactgaagatcagtacaaaaatcctaggagaaatctaagatgtcatatggtagagagattcagtgaaagtaaagacagtagtcagtgtggagaaacatttagcctcattcgagatagtattgtgaacaacagcatttgtcctggagaagatccatgtcaaagcgctgagtgtgaagaagtcataatgggtcatttatcccttaatagccacatcagagttgattctggacacaaaccacatgagtatcaggaatatggagagaagccacatacacataaacaacgtgggaaagccttcagttaccatcactcctttcagtcgcgtggaaggcctcacactggaaagaaacgctatgagtgtaaggaatgtggaaaaaccttcagttctcgtagaaaccttcgaagacacatggtagtgcaaggtggaaatagaccttataaatgtaagttgtgtgggaaagcttttttttggcccagtttattacgtatgcatgaaagaactcacactggagagaaaccgtatgaatgtaagcagtgttctaaagcctttcctttttacagttcctatcgaagacatgagagaatgcacactggggagaaaccgtatgaatgtaagcagtgttctaaagccttgcctgattccagttcctatataagacatgaaagaactcacactggagagaaaccatatacatgtaaacagtgtgggaaagccttcagtgtttccagttcccttcgaagacatgaaaccactcacagtgcagagaaaccctatgagtgtaagcaatgcgggaaaacatttcatcatcttggaagctttcagatacacatgaaaaggcacactggagatcgacctcataaatgtaagatatgtgggaaaggctttgatcgtcccagtttagttcgatatcatgaacgaattcacactggagagaaaccctatgaatgcaagcagtgtgggaaaacgttatctcatagctcaagctttcgaagacacatgataatgcacactggaggtggacctcataaatgcaagatatgtgggaaagcttttgtttatcctagtgtatgtcaaagacacgaaaagtctcacagtggagagaaaccctatgaatgcaagcagtgtgggaaagcgttatctcatagctcaagctttcgaagacatatggtaatgcatacgggagatgggccgaataaatgcaaggtatgtgggaaagcctttgtttatcccagtgtatgtcaaagacatgaaaagactcactggagagaaacaatatgaatgtaaactattataaagccttctatatttccagttccctttgatatcatgaataaacttacactggacagaaaccctataaatgtaaatgtgggaaagcctttcataatttttattcctttcaaaatcatgaaatatctcacactggagagatgctgtatgatataaggaatgtgggaaagtgatcgatttttttttaacaccattgtcaacataaaacaactcacagagcagaaaaactctgtgagtgtaaaatatgtagggaagccttcagtcattttggtaacttaaaagtacatgaggctgggcacagtggctcacgcctgtaatcccagcacttagggtgggcaaattgcttgacctcaggaatttgaggcctgcctgggcaaaatggtgaaaccatgtctctacaaaaaatagaaaaagtagcaggtgtggtggtatgcccctgtagtcccagctacttgggaggctgaggtgggaagatctcttgagcccaaggggtgggggttgcagtgagccaagatgcactgcaccccagcctgggcgacagagccagaccctgtctcaaaaaaaaaaaaaaagtacatgaaaggattcactctggagagaagtcatatgaatgtaagaaatgtagaaaagcattgagttctctcaggtccttgcatagacataaaaggactcactggagagatactctataaatgtgtgaaatgtagggaagtattctttaatgttatttcatttcagatagaaataattctcattggagataaaccctatgaatgtaaacacatagtaaagccttaattttaagcctcagtttctttcaaatacagttatcccctaatatttgcaggagcgtggttctaccaccccctgggcatacataaatcgacacatgccaagtccttttttaaaaatgacatatttggtacaaaattacccggatgtgatggcacatgcctgtaatcccagctactcaggaggctgaggcaggataatcacttgaatccgggaggcggaggttgcggtgagccaagatcgcgccactgcactccagcctgggcagcaagagcaaaacaacctctgtcacacacacaaaaaaaaaaaaaaa

SEQ ID NO: 3289 - DNA, 2067 bp, Homo sapiens
ctgtcaatcaggcgcacggctggcagtagggtgccaggttcaaagagcccgcggcgtcttcacgcccctgcgctcagctctagactcagtcgctcgctgagagacgccctggaacgtctgtgtagcctcagtcgctgagagacgccctggaacgtctgtggcagcctctgtcacagtgggacccgcactggcagcgggaggcagagggaggaccctggaacatcccggaagccgggaaatggacgcagtggcctttgaggatgtggctgtgaacttcacccaggaggaatgggctttgctgggtccatcacagaagaatttatacagatatgtgatgcaagaaaccatcaggaacctggactgtataagaatgatatgggaagaacagaatactgaagatcagtacaaaaatcctaggagaaatctaagatgtcatatggtagagagattcagtgaaagtaaagacagtagtcagtgtggagaaacatttagcctcattcgagatagtattgtgaacaacagcatttgtcctggagaagatccatgtcaaagcgctgagtgtgaagaagtcataatgggtcatttatcccttaatagccacatcagagttgattctggacacaaaccacatgagtatcaggaatatggagagaagccacatacacataaacaacgtgggaaagccttcagttaccatcactcctttcagtcgcgtggaaggcctcacactggaaagaaacgctatgagtgtaaggaatgtggaaaaaccttcagttctcgtagaaaccttcgaagacacatggtagtgcaaggtggaaatagaccttataaatttcctatcgaagacatgagagaatgcacactggggagaaaccgtatgaatgtaagcagtgttctaaagccttgcctgattccagttcctatataagacatgaaagaactcacactggagagaaacaatatgaatgtaaactattataaagccttctatatttccagttccctttgatatcatgaataaacttacactggacagaaaccctataaatgtaaatgtgggaaagcctttcataatttttattcctttcaaaatcatgaaatatctcacactggagagatgctgtatgatataaggaatgtgggaaagtgatcgatttttttttaacaccattgtcaacataaaacaactcacagagcagaaaaactctgtgagtgtaaaatatgtagggaagccttcagtcattttggtaacttaaaagtacatgaggctgggcacagtggctcacgcctgtaatcccagcacttagggtgggcaaattgcttgacctcaggaatttgaggcctgcctgggcaaaatggtgaaaccatgtctctacaaaaaatagaaaaagtagcaggtgtggtggtatgcccctgtagtcccagctacttgggaggctgaggtgggaagatctcttgagcccaaggggtgggggttgcagtgagccaagatgcactgcaccccagcctgggcgacagagccagaccctgtctcaaaaaaaaaaaaaaagtacatgaaaggattcactctggagagaagtcatatgaatgtaagaaatgtagaaaagcattgagttctctcaggtccttgcatagacataaaaggactcactggagagatactctataaatgtgtgaaatgtagggaagtattctttaatgttatttcatttcagatagaaataattctcattggagataaaccctatgaatgtaaacacatagtaaagccttaattttaagcctcagtttctttcaaatacagttatcccctaatatttgcaggagcgtggttctaccaccccctgggcatacataaatcgacacatgccaagtccttttttaaaaatgacatatttggtacaaaattacccggatgtgatggcacatgcctgtaatcccagctactcaggaggctgaggcaggataatcacttgaatccgggaggcggaggttgcggtgagccaagatcgcgccactgcactccagcctgggcagcaagagcaaaacaacctctgtcacacacac

SEQ ID NO: 3290 - DNA, 2918 bp, Homo sapiens
ggacaggggcaatgttcaacaactccgcggggtcttcctgtttcgtgtccgctgcgtttgggttccggtctccgcttctccagtggccccggtggctccaccgcagcgtctggcgcgctgggacctgcacaggccggagagagccgtaggcaggaccccgggacaccctggaagccaggaaatggactcagtggcctctgaggatgtggctgtgaacttcacacttgaggagtgggctttgctggatccttcccagaagaaactctacagagatgtgatgcgggaaacctttagaaacctggcctgtgtaggaaaaaaatgggaagaccagagcattgaagattggtacaaaaatcaggggagaattttaagaaatcatatggaagagggactcagtgaaagtaaagaatatgatcaatgtggagaagccttcagtcagattctcaatcttaatctgaacaagaaaattcctactatagtaagaccatgtgaatgtagtttgtgtgggaaagtcttcatgcatcattcatcccttagtaggcacatcagatctcaccttggacacaaaccatatgactatcaggaatatggagagaaaccatataaatgtaagcagtgtgggaaagccttcagttcttgtcaatcctttcgaagacatgaaagaactcacactggtgagaaaccctatgcatgtccggaatgtgggaaagccttcatttctctcccaagtgttcgaagacacatgattaagcacactggagatggaccatataaatgtcaggaatgtgggaaagcctttgatcgcccaagtttatttcagatacatgaaagaactcacactggagagaaaccctatgaatgtcaggaatgtgcaaaagctttcatttctcttccaagttttcaaagacacatgattaggcacactggagatggaccttataaatgtcaggaatgtggaaaagcctttgaccgccccagtttatttcgaatacatgaaagaactcatactggagagaaaccccatgaatgtaaacagtgtgggaaggccttcatttctttcacaaattttcaaagtcatatgattaggcacactggggatggaccttataaatgtaaagtatgtgggagagcctttatttttcccagttatgttcgaaagcatgaaagaactcatactggggagaaaccctatgaatgtaataaatgtggtaaaaccttcagttcttccagtaatgttcgaacacatgaaaggactcacactggagagaagccctatgaatgtaaggaatgcgggaaagccttcatttctctcccaagtgtccgaagacacatgataaagcacactggagatggaccttataaatgtcaggtatgtggtagagcctttgactgtcccagttcatttcaaatacacgaaagaactcacactggagagaaaccctatgaatgtcaggtatgtgggaaagccttcatttctcttaaaaggattagaaaacatatgatactgcacactggagatggaccttataaatgtcaggtatgtggtaaagcctttgactgtcctagttctgtccgaacacatgaaagaactcatactggagaaaaaccctatgaatgtaaagaatgtgggaaagcattcaattatgccagttccattagaatacatgaaagaactcataccggagaaaaaccctatgaatgtaagcaatgtggaaaaacgttcagttattccagttcctttcaaagacatgaaagagctcataatggagataaaccttacgtaaagaatgtgggaaagctttcatttatcacacaaccttcgaatacctgtgaaaatgaatagtggaggacaggtctacaagtatctacatatctaaagaatatggaaagtcttcagtttgctttctgggtttcagacttgtttgggagctcacccctttctcctgtttctcacttttggaataggaatctctatcctgtgcctgtctcatattttggaaatacatgactagtttggttttcaccggttcggagctgaagaagaattttgcctcagcatgaattgagtctcatccatatctgagtgatgtgatattgagatgacactttggagtttgagtttaaacattaggcttcatgctggaattaactgagacttttgaggcctttgggatgagatgaatatattttacatgtgatgacatggattttgggggccagaggtgtaatgttttggctgagtgtatgccacctcagattcatatgttgaaaccttacccccgtgccccccctctcccccacaatgtgatggtatttggaggccctgtctctggtggtttttaggattggaggacatcatgaagatggaggccttgtaattgggattagtttcctgataggaatccctagagagctagctttgcccttcaccatgagagggtgcagtgagaagatagctatctttgaaccgggaagcaggcccttaccagacatggactatgccagtgccttgatattggacttcccagcctcccaaaccatgagaaataaatgtttgttgattaattaagctttccaatttatggtattttgttttagcaacccaagctaagacacaatccaattttaaaatggaggaaaggacttgaatagacatttctccaaagaagatacccagatggccaataagcacgtaacaatgctcgacatctttagtcattagggaaatacaaatcaaactcaagacatacatagcatctcattaggattagtagtatcaaagatggaaaacaagaaatactgtcaaggatgtggaatgttggagaacattgtgcactatcactgggaatgtacagtggtataagcctgctgaaaacagtatggcagatccccagattaaaatatagaaataacatatg

SEQ ID NO: 3291 - DNA, 2755 bp, Homo sapiens
acgcgctggcgggaccctcagggctttaccagcaactaccccagtgccggggagggttctgctgcttcgaaagctggtaaggcctgagctctacccttctccaaaagaagagccaagagaaggtccttttctacaaatatcagagccatggctcaggagtcagtgatgttcagtgatgtgtccgtagacttctctcaggaggagtgggaatgcctgaatgatgatcagagagatttatacagagatgtgatgttggagaattacagcaacctggtttcaatggcagggcattctatttctaaaccaaatgtgatctcctacttggagcaagggaaggagccctggttggctgacagagagctaacaagaggccagtggccagtcctggaatcaagatgtgagaccaagaaattatttctgaagaaagaaatttatgaaatagaatcaacccagtgggaaataatggaaaaactcacaagacgtgattttcagtgctccagtttcagagatgattgggaatgtaatcggcagtttaagaaagaactcggctctcaggggggacatttcaatcaattggtattcactcatgaagatctgcccactttgagtcaccatccatccttcacattacagcaaatcattaacagtaaaaagaaattctgtgcatctaaagaatataggaaaacctttagacatggctcacagtttgctacacatgagataattcataccattgagaagccttatgaatgtaaggaatgtggaaagtcctttagacatccctcaagactcactcatcatcagaaaattcatactggcaagaaaccctttgaatgtaaggaatgtggaaaaacctttatttgtggctcagaccttactcgacatcacagaattcacactggtgagaaaccctatgaatgtaaggaatgtgggaaagcctttagtagtggttcaaacttcactcgacatcagagaattcacacaggtgagaagccttatgaatgcaaagaatgcgggaaggcctttagtagtggctcaaactttactcaacatcagagaattcatactggggaaaaaccctatgaatgtaaggaatgtggcaatgcctttagtcagagctcacaacttattaaacatcaaagaatccatacaggtgagaaaccttacgaatgtaaggaatgtgaaaaggcttttcgttctggctcagaccttactagacatcagagaattcatactggggagaaaccctatgaatgtaagatatgtgggaaggcttattctcagagttcacagcttattagtcatcatagaattcatactagtgagaaaccctatgaatatagggaatgtggaaagaactttaattatgacccacaacttattcagcatcaaaatttgtactggtgatgaaacagaatatatgaaatgtgtagggaggcttttaattatggctcaaaacagaatttatcttgttaataattcctctagatagaataatgtagaaacattttatttgtggactacagcttattcagcctgggaaaaataatgttggagaaatactctatgaatagaatatactttggaagcccttaactaaacgcttacttctcttgacatcagataattcagtctagcaatatgatagataattcagtctgtcatactgaaaatgacagcacttttaacacctttctaaccttcttaacgtcagagaatttttgtagaaatgtagtcctgtgattgtcattttttcccctaatttctctaattgttacattcttagtattttaatccatattaaatttatatggctataaatttcatctgtttacatcctgatttgtatactattttaaaaatacctttagtacctgggagaagtgacctctttatttttgaagatggcttattctttttgttctttataacattaaggctttcttattgtaaaaatgttcatgaacgacattttactcaatagagattcttcattatcttcatggtgttttgttgtgttactgtaatatcacttatgaaatcctattggtggatatcgtagtctcctctagatattttgccataatacatgccaaaatacaagtccctgctggacattctccctaagcacatctttgtatcatatcttttaattgcagaagtaatgtgtgaatatattttccttataaaagatgcaaacattacaaaaaggcaaatgtaccctttgaccatatcccaaaggatagtctttatcagttcattatttattgctgatcatttttctgttcatatatacatgcgtgtctcagtaaaaattataaaatgggggataattataatacctacctcataatgctttgtgaggattaaatgaattaagatcgataaagtgcttagaattgtgcctgacatgataaatacatactcactgaatgttagtcatcgttattatattcatcatcatcagtattattatttgtagaaaggctttttaacttctgcagaacttagtcaccattaggcagggtgtttgactgaagaaagaccctttgaaggtaacaagttaagaaaatttcccatcatcatgtacttactattgaacatgaaataatcctaggtgttgggggggaaagtactgtgaataatgtgtgtgaaggactttattccgactaatactctttttgtcgcattatatacccagtaaaaaagaaaagagaacataagcaaaatattggtgcactaatgaggaaaaaaa

SEQ ID NO: 3292 - DNA, 2644 bp, Homo sapiens
gttctgctgcttcgaaagctggtaaggcctgagctctacccttctccaaaagaagagccaagagaaggtccttttctacaaatatcagagccatggctcaggagtcagtgatgttcagtgatgtgtccgtagacttctctcaggaggagtgggaatgcctgaatgatgatcagagagatttatacagagatgtgatgttggagaattacagcaacctggtttcaatggggcattctatttctaaaccaaatgtgatctcctacttggagcaagggaaggagccctggttggctgacagagagctaacaagaggccagtggccagtcctggaatcaagatgtgagaccaagaaattatttctgaagaaagaaatttatgaaatagaatcaacccagtgggaaataatggaaaaactcacaagacgtgattttcagtgctccagtttcagagatgattgggaatgtaatcggcagtttaagaaagaactcggctctcaggggggacatttcaatcaattggtattcactcatgaagatctgcccactttgagtcaccatccatccttcacattacagcaaatcattaacagtaaaaagaaattctgtgcatctaaagaatataggaaaacctttagacatggctcacagtttgctacacatgagataattcataccattgagaagccttatgaatgtaaggaatgtggaaagtcctttagacatccctcaagactcactcatcatcagaaaattcatactggcaagaaaccctttgaatgtaaggaatgtggaaaaacctttatttgtggctcagaccttactcgacatcacagaattcacactggtgagaaaccctatgaatgtaaggaatgtgggaaagcctttagtagtggttcaaacttcactcgacatcagagaattcacacaggtgagaagccttatgaatgcaaagaatgcgggaaggcctttagtagtggctcaaactttactcaacatcagagaattcatactggggaaaaaccctatgaatgtaaggaatgtggcaatgcctttagtcagagctcacaacttattaaacatcaaagaatccatacaggtgagaaaccttacgaatgtaaggaatgtgaaaaggcttttcgttctggctcagaccttactagacatcagagaattcatactggggagaaaccctatgaatgtaagatatgtgggaaggcttattctcagagttcacagcttattagtcatcatagaattcatactagtgagaaaccctatgaatatagggaatgtggaaagaactttaattatgacccacaacttattcagcatcaaaatttgtactggtgatgaaacagaatatatgaaatgtgtagggaggcttttaattatggctcaaaacagaatttatcttgttaataattcctctagatagaataatgtagaaacattttatttgtggactacagcttattcagcctgggaaaaataatgttggagaaatactctatgaatagaatatactttggaagcccttaactaaacgcttacttctcttgacatcagataattcagtctagcaatatgatagataattcagtctgtcatactgaaaatgacagcacttttaacacctttctaaccttcttaacgtcagagaatttttgtagaaatgtagtcctgtgattgtcattttttcccctaatttctctaattgttacattcttagtattttaatccatattaaatttatatggctataaatttcatctgtttacatcctgatttgtatactattttaaaaatacctttagtacctgggagaagtgacctctttatttttgaagatggcttattctttttgttctttataacattaaggctttcttattgtaaaaatgttcatgaacgacattttactcaatagagattcttcattatcttcatggtgttttgttgtgttactgtaatatcacttatgaaatcctattggtggatatcgtagtctcctctagatattttgccataatacatgccaaaatacaagtccctgctggacattctccctaagcacatctttgtatcatatcttttaattgcagaagtaatgtgtgaatatattttccttataaaagatgcaaacattacaaaaaggcaaatgtaccctttgaccatatcccaaaggatagtctttatcagttcattatttattgctgatcatttttctgttcatatatacatgcgtgtctcagtaaaaattataaaatgggggataattataatacctacctcataatgctttgtgaggattaaatgaattaagatcgataaagtgcttagaattgtgcctgacatgataaatacatactcactgaatgttagtcatcgttattatattcatcatcatcagtattattatttgtagaaaggctttttaacttctgcagaacttagtcaccattaggcagggtgtttgactgaagaaagaccctttgaaggtaacaagttaagaaaatttcccatcatcatgtacttactattgaacatgaaataatcctaggtgttgggggggaaagtactgtgaataatgtgtgtgaaggactttattccgactaatactctttttgtcgcattatatacccagt

SEQ ID NO: 3293 - DNA, 584 bp, Homo sapiens
tttaccagcaactaccccagtgccggggagggttctgctgcttcgaaagctgctctacccttctccaaaagaagagccaagagaaggtccttttctacaaatatcagagccatggctcaggagtcagtgatgttcagtgatgtgtccgtagacttctctcaggaggagtgggaatgcctgaatgatgatcagagagatttatacagagatgtgatgttggagaattacagcaacctggtttcaatggcagggcattctatttctaaaccaaatgtgatctcctacttggagcaagggaaggagccctggttggctgacagagagctaacaagaggccagtggccagtcctggaatcaagatgtgagaccaagaaattatttctgaagaaagaaatttatgaaatagaatcaacccagtgggaaataatggaaaaactcacaagacgtgattttcagtgctccagtttcagagatgattgggaatgtaatcggcagtttaagaaagaactcggctctcaggggggacatttcaatcaattggtattcactcatgaagatctgcccactttgagtcaccatccatc

SEQ ID NO: 3294 - DNA, 5197 bp, Homo sapiens
ctcggctttgtgcggcggtggagctctacccttctccaaaagaagagccaagagaaggtccttttctacaaatatcagagccatggctcaggagtcagtgatgttcagtgatgtgtccgtagacttctctcaggaggagtgggaatgcctgaatgatgatcagagagatttatacagagatgtgatgttggagaattacagcaacctggtttcaatggggcattctatttctaaaccaaatgtgatctcctacttggagcaagggaaggagccctggttggctgacagagagctaacaagaggccagtggccagtcctggaatcaagatgtgagaccaagaaattatttctgaagaaagaaatttatgaaatagaatcaacccagtgggaaataatggaaaaactcacaagacgtgattttcagtgctccagtttcagagatgattgggaatgtaatcggcagtttaagaaagaactcggctctcaggggggacatttcaatcaattggtattcactcatgaagatctgcccactttgagtcaccatccatccttcacattacagcaaatcattaacagtaaaaagaaattctgtgcatctaaagaatataggaaaacctttagacatggctcacagtttgctacacatgagataattcataccattgagaagccttatgaatgtaaggaatgtggaaagtcctttagacatccctcaagactcactcatcatcagaaaattcatactggcaagaaaccctttgaatgtaaggaatgtggaaaaacctttatttgtggctcagaccttactcgacatcacagaattcacactggtgagaaaccctatgaatgtaaggaatgtgggaaagcctttagtagtggttcaaacttcactcgacatcagagaattcacacaggtgagaagccttatgaatgcaaagaatgcgggaaggcctttagtagtggctcaaactttactcaacatcagagaattcatactggggaaaaaccctatgaatgtaaggaatgtggcaatgcctttagtcagagctcacaacttattaaacatcaaagaatccatacaggtgagaaaccttacgaatgtaaggaatgtgaaaaggcttttcgttctggctcagaccttactagacatcagagaattcatactggggagaaaccctatgaatgtaagatatgtgggaaggcttattctcagagttcacagcttattagtcatcatagaattcatactagtgagaaaccctatgaatatagggaatgtggaaagaactttaattatgacccacaacttattcagcatcaaaatttgtactggtgatgaaacagaatatatgaaatgtgtagggaggcttttaattatggctcaaaacagaatttatcttgttaataattcctctagatagaataatgtagaaacattttatttgtggactacagcttattcagcctgggaaaaataatgttggagaaatactctatgaatagaatatactttggaagcccttaactaaacgcttacttctcttgacatcagataattcagtctagcaatatgatagataattcagtctgtcatactgaaaatgacagcacttttaacacctttctaaccttcttaacgtcagagaatttttgtagaaatgtagtcctgtgattgtcattttttcccctaatttctctaattgttacattcttagtattttaatccatattaaatttatatggctataaatttcatctgtttacatcctgatttgtatactattttaaaaatacctttagtacctgggagaagtgacctctttatttttgaagatggcttattctttttgttctttataacattaaggctttcttattgtaaaaatgttcatgaacgacattttactcaatagagattcttcattatcttcatggtgttttgttgtgttactgtaatatcacttatgaaatcctattggtggatatcgtagtctcctctagatattttgccataatacatgccaaaatacaagtccctgctggacattctccctaagcacatctttgtatcatatcttttaattgcagaagtaatgtgtgaatatattttccttataaaagatgcaaacattacaaaaaggcaaatgtaccctttgaccatatcccaaaggatagtctttatcagttcattatttattgctgatcatttttctgttcatatatacatgcgtgtctcagtaaaaattataaaatgggggataattataatacctacctcataatgctttgtgaggattaaatgaattaagatcgataaagtgcttagaattgtgcctgacatgataaatacatactcactgaatgttagtcatcgttattatattcatcatcatcagtattattatttgtagaaaggctttttaacttctgcagaacttagtcaccattaggcagggtgtttgactgaagaaagaccctttgaaggtaacaagttaagaaaatttcccatcatcatgtacttactattgaacatgaaataatcctaggtgttgggggggaaagtactgtgaataatgtgtgtgaaggactttattccgactaatactctttttgtcgcattatatacccagtaaaaaagaaaagagaacataagcaaaatattggtgcactaatgaggaaaaaaagtatgaaaagagaaacagcatcatatttaaaaaatggacagagatagaaacatagttacagatttaaaaggttctgttgaatattatgcttttttctaatatgtttgaaaatttaaacaaaatggtttttaaggaaaatatacatcaatattgactccaagaaaattaggactcttcaaagactctcataaacacagagaacagggaaaaattagcatgtgatcagttaactattactaatgaagcaccaaatccagtttctttctaaggaaaactttatcaaatgttcaaggaactatttcagttatatagaagtacacatcttggctcacgcctgtaatcccagcactttgggaggctgagatggaaggatcatttgaggccaggagcttgagaccagcctggccaacatgttgaaaccccatttttactcaaaaatacaaaacttagccaggcatggtggcacatgcctgtaatcccagctactggggaggctgaggcaggagaatcacttgaatgcaggaggtggaggttgcagtgagccaagatcacgccatggcacttcagcctgagcgacagaatgagactattaaaaaaaaaaaaaaaaagtccacagtgtagctttgtttggggttaagttagtgttttgaaatgggccttccctgtgctcaaaacatgctcagcaagcagctccccacgctggacagatcgcatatgtggaaggatgaagtttatgtctgtagaactgttattttatgccccacttccttttttcttagatcctgtgtagacgggtctctctgaacattgtgttactttactttactggcataaggaagtaaaatatttcataataaatttgagaaaagtagagtgagcaaaaatacctgcaaatgagagaattactaaaaatggactgttgtaatgttttgcgttatcaaaatgaaaactgccaaatgagattttgtttactttcttttcttgtgtgcttatgtcttttataaagttcttcatctaaaattatagagatagtgcatttgcacccaaattaatgaaacaataccattaaagagaaagaaaaggggctgggcacagtggcttacgcctgtaatcccagtgctttgggaggccaaggcagggggcagcctggccaatatagtgaaaccccatctctactaaaaatacaaaaattagctgggcgtggtggcatgtgcctgtagtcccagctgctcggaaggctgaggcaggagaatcgcttgaacccgggaggcggaggttgcagtgagctgagatcctgactgcactccagcctgcatgacagagtctcaaaaaatctgtctcaaaaaaaaaaaaaaaaaagaaagaaaaaatgattatctttgcccttctccgttcctcattccctcccctctgtcaattttcttctgaataatatttaaaggttgtgtatattacccatatatttcttcatgctaaaacattaacacacaattattttattatgtttttacagaaaaatggataactatacatttccctgaaatttgcttttttacattcaactgtacattttggattttccttcaatagatgatgatctaacagtctttctgatggttacagtatgttccacagtgttatttaccaatgccttttcaaccactttcccaattgtgatattatggattgtttgcgcttttttgccatctaaaagtaatgctgcaacaaacactttgtattcttgtctgttttatttctataaaataagcttcccaagtcatttccagtgtttttgctttgttttgttttgagacagagtttcactcttgtttcccaggctggagtgcaatggcgcaatcttggcttactgcaatctccgcctcccgggttcaagagattctcctgcctcagcctcccaagtagctggggttacaggtatatgccactacgcctggaaaattttgtatttttagtagagacggcatttttccatgttggtcaggctggtctcgaactcctgacctcaggtgatccaccctcctcggcctcccaaagtgctggcattataggcatgagccaccgcacccggcgtcatttccagtgttttctatgtttcctaggaaggttttgcttctggaagatttcagagggcaagagaataaaggagtggagtgcagtttttcatatatgtgattctgtgagtgtgtatacacagagatttaatattttaatacatcaggaattgattatacgatctaatgcaggatgtcagacttgtttctatccaggaataaaaccagttatgccagaagtaactattattcacctttctcctactgaattaaaatactatcagttgtatattaaatgctcacatctatttctgttctccatattctagcaatccttgacacttttcaatagcttttattacttggaaataaagatgtatgtatatattattaatatatagtttattatttggaaataaagatgtttcttcatgagaa

SEQ ID NO: 3295 - DNA, 5253 bp, Homo sapiens
acgcgctggcgggaccctcagggctttaccagcaactaccccagtgccggggagggttctgctgcttcgaaagctgctctacccttctccaaaagaagagccaagagaaggtccttttctacaaatatcagagccatggctcaggagtcagtgatgttcagtgatgtgtccgtagacttctctcaggaggagtgggaatgcctgaatgatgatcagagagatttatacagagatgtgatgttggagaattacagcaacctggtttcaatggcagggcattctatttctaaaccaaatgtgatctcctacttggagcaagggaaggagccctggttggctgacagagagctaacaagaggccagtggccagtcctggaatcaagatgtgagaccaagaaattatttctgaagaaagaaatttatgaaatagaatcaacccagtgggaaataatggaaaaactcacaagacgtgattttcagtgctccagtttcagagatgattgggaatgtaatcggcagtttaagaaagaactcggctctcaggggggacatttcaatcaattggtattcactcatgaagatctgcccactttgagtcaccatccatccttcacattacagcaaatcattaacagtaaaaagaaattctgtgcatctaaagaatataggaaaacctttagacatggctcacagtttgctacacatgagataattcataccattgagaagccttatgaatgtaaggaatgtggaaagtcctttagacatccctcaagactcactcatcatcagaaaattcatactggcaagaaaccctttgaatgtaaggaatgtggaaaaacctttatttgtggctcagaccttactcgacatcacagaattcacactggtgagaaaccctatgaatgtaaggaatgtgggaaagcctttagtagtggttcaaacttcactcgacatcagagaattcacacaggtgagaagccttatgaatgcaaagaatgcgggaaggcctttagtagtggctcaaactttactcaacatcagagaattcatactggggaaaaaccctatgaatgtaaggaatgtggcaatgcctttagtcagagctcacaacttattaaacatcaaagaatccatacaggtgagaaaccttacgaatgtaaggaatgtgaaaaggcttttcgttctggctcagaccttactagacatcagagaattcatactggggagaaaccctatgaatgtaagatatgtgggaaggcttattctcagagttcacagcttattagtcatcatagaattcatactagtgagaaaccctatgaatatagggaatgtggaaagaactttaattatgacccacaacttattcagcatcaaaatttgtactggtgatgaaacagaatatatgaaatgtgtagggaggcttttaattatggctcaaaacagaatttatcttgttaataattcctctagatagaataatgtagaaacattttatttgtggactacagcttattcagcctgggaaaaataatgttggagaaatactctatgaatagaatatactttggaagcccttaactaaacgcttacttctcttgacatcagataattcagtctagcaatatgatagataattcagtctgtcatactgaaaatgacagcacttttaacacctttctaaccttcttaacgtcagagaatttttgtagaaatgtagtcctgtgattgtcattttttcccctaatttctctaattgttacattcttagtattttaatccatattaaatttatatggctataaatttcatctgtttacatcctgatttgtatactattttaaaaatacctttagtacctgggagaagtgacctctttatttttgaagatggcttattctttttgttctttataacattaaggctttcttattgtaaaaatgttcatgaacgacattttactcaatagagattcttcattatcttcatggtgttttgttgtgttactgtaatatcacttatgaaatcctattggtggatatcgtagtctcctctagatattttgccataatacatgccaaaatacaagtccctgctggacattctccctaagcacatctttgtatcatatcttttaattgcagaagtaatgtgtgaatatattttccttataaaagatgcaaacattacaaaaaggcaaatgtaccctttgaccatatcccaaaggatagtctttatcagttcattatttattgctgatcatttttctgttcatatatacatgcgtgtctcagtaaaaattataaaatgggggataattataatacctacctcataatgctttgtgaggattaaatgaattaagatcgataaagtgcttagaattgtgcctgacatgataaatacatactcactgaatgttagtcatcgttattatattcatcatcatcagtattattatttgtagaaaggctttttaacttctgcagaacttagtcaccattaggcagggtgtttgactgaagaaagaccctttgaaggtaacaagttaagaaaatttcccatcatcatgtacttactattgaacatgaaataatcctaggtgttgggggggaaagtactgtgaataatgtgtgtgaaggactttattccgactaatactctttttgtcgcattatatacccagtaaaaaagaaaagagaacataagcaaaatattggtgcactaatgaggaaaaaaagtatgaaaagagaaacagcatcatatttaaaaaatggacagagatagaaacatagttacagatttaaaaggttctgttgaatattatgcttttttctaatatgtttgaaaatttaaacaaaatggtttttaaggaaaatatacatcaatattgactccaagaaaattaggactcttcaaagactctcataaacacagagaacagggaaaaattagcatgtgatcagttaactattactaatgaagcaccaaatccagtttctttctaaggaaaactttatcaaatgttcaaggaactatttcagttatatagaagtacacatcttggctcacgcctgtaatcccagcactttgggaggctgagatggaaggatcatttgaggccaggagcttgagaccagcctggccaacatgttgaaaccccatttttactcaaaaatacaaaacttagccaggcatggtggcacatgcctgtaatcccagctactggggaggctgaggcaggagaatcacttgaatgcaggaggtggaggttgcagtgagccaagatcacgccatggcacttcagcctgagcgacagaatgagactattaaaaaaaaaaaaaaaaagtccacagtgtagctttgtttggggttaagttagtgttttgaaatgggccttccctgtgctcaaaacatgctcagcaagcagctccccacgctggacagatcgcatatgtggaaggatgaagtttatgtctgtagaactgttattttatgccccacttccttttttcttagatcctgtgtagacgggtctctctgaacattgtgttactttactttactggcataaggaagtaaaatatttcataataaatttgagaaaagtagagtgagcaaaaatacctgcaaatgagagaattactaaaaatggactgttgtaatgttttgcgttatcaaaatgaaaactgccaaatgagattttgtttactttcttttcttgtgtgcttatgtcttttataaagttcttcatctaaaattatagagatagtgcatttgcacccaaattaatgaaacaataccattaaagagaaagaaaaggggctgggcacagtggcttacgcctgtaatcccagtgctttgggaggccaaggcagggggcagcctggccaatatagtgaaaccccatctctactaaaaatacaaaaattagctgggcgtggtggcatgtgcctgtagtcccagctgctcggaaggctgaggcaggagaatcgcttgaacccgggaggcggaggttgcagtgagctgagatcctgactgcactccagcctgcatgacagagtctcaaaaaatctgtctcaaaaaaaaaaaaaaaaaagaaagaaaaaatgattatctttgcccttctccgttcctcattccctcccctctgtcaattttcttctgaataatatttaaaggttgtgtatattacccatatatttcttcatgctaaaacattaacacacaattattttattatgtttttacagaaaaatggataactatacatttccctgaaatttgcttttttacattcaactgtacattttggattttccttcaatagatgatgatctaacagtctttctgatggttacagtatgttccacagtgttatttaccaatgccttttcaaccactttcccaattgtgatattatggattgtttgcgcttttttgccatctaaaagtaatgctgcaacaaacactttgtattcttgtctgttttatttctataaaataagcttcccaagtcatttccagtgtttttgctttgttttgttttgagacagagtttcactcttgtttcccaggctggagtgcaatggcgcaatcttggcttactgcaatctccgcctcccgggttcaagagattctcctgcctcagcctcccaagtagctggggttacaggtatatgccactacgcctggaaaattttgtatttttagtagagacggcatttttccatgttggtcaggctggtctcgaactcctgacctcaggtgatccaccctcctcggcctcccaaagtgctggcattataggcatgagccaccgcacccggcgtcatttccagtgttttctatgtttcctaggaaggttttgcttctggaagatttcagagggcaagagaataaaggagtggagtgcagtttttcatatatgtgattctgtgagtgtgtatacacagagatttaatattttaatacatcaggaattgattatacgatctaatgcaggatgtcagacttgtttctatccaggaataaaaccagttatgccagaagtaactattattcacctttctcctactgaattaaaatactatcagttgtatattaaatgctcacatctatttctgttctccatattctagcaatccttgacacttttcaatagcttttattacttggaaataaagatgtatgtatatattattaatatatagtttattatttggaaataaagatgtttcttcatgagaa

SEQ ID NO: 3296 - DNA, 2441 bp, Homo sapiens
ggaaacgtcgctggcgcggagggatggttcggcgctttaggcgtctgtcacagacctatctgcgggtcgccttcacccagcatctcagaaactgcgcgcgggatgaacattcgggtgtttccggcaggtgacgctgccgagtccccgcagcagggggcgagcaagggactcgcggttgacgggacacggatcctctaaggcccagagtgtcccgagtagcggcagtggggagtgctcagggtacgctaatgatctgtgtcttgtaaagagcatattgctgggcttacatccgtttatcttgtttgactgttattttaataggtcctggttccacaaggataaaacacatctgcagtgcaaatagaagtctgaggaacaggtgtcttatcatggaaggagacctgacctgagacctgccttagaggctggagagtcctgaaagagagtggaccctggagttgctggagcttgtcttgacccttctgcccagagcaggcagggtctgaatgacatctcaatcttcagtgatcagcaatagctgtgtgacaatggagcgtttgagccacatgatggaaaggaaagcttggtgttctcaagagtctgccctttccgaggaagaagaggatacaaccaggcctcttgaaacagtgacatttaaggatgtggctgttgaccttacccaggaggagtgggagcaaatgaaacctgctcaaagaaacttgtatcgagatgtgatgctggagaactacagcaacctagtcacagtgggctgtcaagtcaccaaaccggatgtgatattcaagttggagcaagaagaggagccctgggtgatggaggaagaaatgtttgggaggcactgtccagaagtttgggaagttgatgaacagatcaagaagcaacaggaaacacttgtgaggaaagtcacatccatctccaagaaaattctgataaaggaaaaagtcattgaatgtaaaaaagttgcgaaaatatttcctctgagttcagacattgttacttcaagacaaagcttctatgactgtgactcacttgataagggtttggaacataatttagacttacttagatatgagaaaggctgtgtaagagagaaacagagtaatgagtttgggaaaccattttaccattgtgcatcctatgttgtaaccccctttaagtgtaatcagtgtggacaagacttcagtcataaatttgacctcattagacatgagcgaattcatgctggagagaaaccttacgaatgtaaagaatgtggaaaagccttcagtaggaaggaaaatcttattacacatcagaaaattcatactggggaaaaaccgtataagtgtaatgaatgtggaaaagctttcattcagatgtcaaaccttattagacaccacagaattcatactggggagaaaccttatgcatgtaaggattgttggaaagccttcagtcagaaatcaaatctcattgaacatgagcgaattcacactggagagaaaccctatgaatgtaaggaatgtgggaaatccttcagccagaagcaaaatcttattgagcacgagaaaattcatactggggagaaaccttatgcatgtaatgaatgtggtagagctttttctcgaatgtcatctgttacgctacatatgagaagtcacacaggggagaaaccctataaatgtaataaatgtggaaaagctttctctcaatgctcagtatttattatacatatgagaagtcacactggtgagaaaccctatgtatgtagtgaatgtgggaaagccttctctcagagttcatccctaaccgtacatatgcgaaatcatacagctgagaaaccctatgaatgtaaggaatgtggaaaagccttcagcaggaaagaaaatctcattacacatcagaaaattcacactggagagaaaccttatgaatgcagtgaatgtgggaaagcttttattcagatgtcaaacctcattcgacaccagagaattcatacgggtgagaaaccctatgcatgtacagtatgtggaaaagcctttagtcagaaatcaaacctcactgaacatgagaaaattcatactggagagaaaccttatcattgtaatcaatgtgggaaagctttcagtcagagacaaaatcttcttgagcatgaaaaaattcatactggagagaaaccattcaaatgtaatgaatgtggtaaagccttctctcgaatctcatccctcactcttcatgtgagaagtcacacaggggagaaaccctatgaatgtaataaatgtgggaaagccttttctcagtgctcattacttattatacatatgagaagtcatactggtgagaaaccctttgaatgtaatgaatgtgggaaagcattctctcaaagagcatccctttctatacataagagaggtcatacaggtgagagacaccaagtatattaa

SEQ ID NO: 3297 - DNA, 3774 bp, Homo sapiens
aaacgtcgctggcgcggagggatggttcggcgctttaggcgtctgtcacagacctatctgcgggtcgccttcacccagcatctcagaaactgcgcgcgggatgaacattcgggtgtttccggcaggtgacgctgccgagtccccgcagcagggggcgagcaagggactcgcggttgacgggacacggatcctctaaggcccagagtgtcccgagtagcggcagtggggagtgctcagggtacgctaatgatctgtgtcttgtaaagagcatattgctgggcttacatccgtttatcttgtttgactgttattttaataggaaacagtgacatttaaggatgtggctgttgaccttacccaggaggagtgggagcaaatgaaacctgctcaaagaaacttgtatcgagatgtgatgctggagaactacagcaacctagtcacagtgggctgtcaagtcaccaaaccggatgtgatattcaagttggagcaagaagaggagccctgggtgatggaggaagaaatgtttgggaggcactgtccagaagtttgggaagttgatgaacagatcaagaagcaacaggaaacacttgtgaggaaagtcacatccatctccaagaaaattctgataaaggaaaaagtcattgaatgtaaaaaagttgcgaaaatatttcctctgagttcagacattgttacttcaagacaaagcttctatgactgtgactcacttgataagggtttggaacataatttagacttacttagatatgagaaaggctgtgtaagagagaaacagagtaatgagtttgggaaaccattttaccattgtgcatcctatgttgtaaccccctttaagtgtaatcagtgtggacaagacttcagtcataaatttgacctcattagacatgagcgaattcatgctggagagaaaccttacgaatgtaaagaatgtggaaaagccttcagtaggaaggaaaatcttattacacatcagaaaattcatactggggaaaaaccgtataagtgtaatgaatgtggaaaagctttcattcagatgtcaaaccttattagacaccacagaattcatactggggagaaaccttatgcatgtaaggattgttggaaagccttcagtcagaaatcaaatctcattgaacatgagcgaattcacactggagagaaaccctatgaatgtaaggaatgtgggaaatccttcagccagaagcaaaatcttattgagcacgagaaaattcatactggggagaaaccttatgcatgtaatgaatgtggtagagctttttctcgaatgtcatctgttacgctacatatgagaagtcacacaggggagaaaccctataaatgtaataaatgtggaaaagctttctctcaatgctcagtatttattatacatatgagaagtcacactggtgagaaaccctatgtatgtagtgaatgtgggaaagccttctctcagagttcatccctaaccgtacatatgcgaaatcatacagctgagaaaccctatgaatgtaaggaatgtggaaaagccttcagcaggaaagaaaatctcattacacatcagaaaattcacactggagagaaaccttatgaatgcagtgaatgtgggaaagcttttattcagatgtcaaacctcattcgacaccagagaattcatacgggtgagaaaccctatgcatgtacagtatgtggaaaagcctttagtcagaaatcaaacctcactgaacatgagaaaattcatactggagagaaaccttatcattgtaatcaatgtgggaaagctttcagtcagagacaaaatcttcttgagcatgaaaaaattcatactggagagaaaccattcaaatgtaatgaatgtggtaaagccttctctcgaatctcatccctcactcttcatgtgagaagtcacacaggggagaaaccctatgaatgtaataaatgtgggaaagccttttctcagtgctcattacttattatacatatgagaagtcatactggtgagaaaccctttgaatgtaatgaatgtgggaaagcattctctcaaagagcatccctttctatacataagagaggtcatacaggtgagagacaccaagtatattaaatgaaagaaggcctcttaaattcaacccatgttttacttaaaatatcttggcataagctcaaaaaagccaggatctttatggaaaaattttaatactttgttaaaaggtgtaagactggaataaatggaaagaaataccatatacatagatggaaaaacccagtattataaaaacctcaattctgaaaatctatagactgaatgcagttccaaacaaaatcaactaagaattttctaggatctttcaaaaatgattataaaattcatgtgaaatagaagtgtatgaattgctgcgacaattttgaaaagaatagaggaaacaccctcactgtatgatataaagttatagtcatttaaaaatgtgtgatattagtacattagtaggtaaatgagcagattttaaagaatagaatatccagaagcagattcatgaatatatgtgaactcagtgtatgttagacctgacatcatgaattagtagggaaatgatgacctagtcaataaaattgctgggaatatttgactctccgtattggagaaaataaaattacaacattacgacatactaaaaaatcaatattcttttttttttttttttttttttgagacaagcgtctcactctgtcgcccaggctggagtacggtggtgcaatctcagctcactgcagcctctgctttccgggtttttttgttttgttttgttttgttttttgtatttttagtagagacggggtttcaccatgttggccagggtagtcttgaactcctgacttcaaaagtgatcgccctctttggcctcccaaagtgctggggtttacaggcttgagccactgcacctggccaaaaaattaacattctaaaggatttaaatactggaatttgaaaagccaaactgtgaaaccattgggagaaaatagatgatattgtctatgacgttgaggccaaggagctttttttttttttttttcaagacaaaaggactctgtaattccacttctaggtatatatacatcctatagaaactcacaaataatgcataagaaatatatatataatatatgtatgtatgtatagccagatgcagtggcacatgcctgtaatcccagctacttgggaggctgatagaagaagataacttgaggtcaggagttcaagaccagcctgggaaacatagcaagaccccatctcttaaaaaaaaagaaatatatagacatatatctgcattgaaaacaacctaaatattcatcagtggggtaatggatgaataaaatatgatatattcaaatgatagaatagtatacagcacttaaaagcagtgaaccagatccatattgtgtaacatggatagttaaaacaatgttgaatgaaaaaaatcaaaatacaaatgaaacattgtgtaataatatttatgtaaattggaatgaaatcatttataaagaacaactgtttctattattgaaaattgtatgtaaaactatttaaaatagaatagaaggatacacacccaattattgatagcattgtctctggagattgaatttgaggctgttgattaaaaggagactttagctttgcttgtagtttttataccttaaaaagactggtagcatataaaataaatcttaaaagctaattatacacaatgacaatatgaa

SEQ ID NO: 3298 - DNA, 2378 bp, Homo sapiens
attcgggtgtttccggcaggtgacgctgccgagtccccgcagcagggggcgagcaagggactcgcggttgacgggacacggatcctctaaggcccagagtgtcccgagtagcggcagtggggagtgctcagggtacgctaatgatctgtgtcttgtaaagagcatattgctgggcttacatccgtttatcttgtttgactgttattttaatagcttggtgttctcaagagtctgccctttccgaggaagaagaggatacaaccaggcctcttgaaacagtgacatttaaggatgtggctgttgaccttacccaggaggagtgggagcaaatgaaacctgctcaaagaaacttgtatcgagatgtgatgctggagaactacagcaacctagtcacagtgggctgtcaagtcaccaaaccggatgtgatattcaagttggagcaagaagaggagccctgggtgatggaggaagaaatgtttgggaggcactgtccagaacccagaagaggagagaactgctgtgcgtctgaagtgatggcggagggcttgaagttcaaagatgtggtcatttacttctctcaaaaggagtgggaatgcttgcactctgctcagaaggatttgtaccgagatgtaatgttggaaaattacggcaacctggtcttactggggctttctgatactaagccaaatgtgatctccttattggagcagaagaaagagccctggatggttaagaggaaggagacaaaagaatggtgtccagattgggagtttggaagagaaaccaagaatttatctccaaaggaaaacatttatgaaattagatcaccacaacaggagaaggccagagttatcagagaaatcagatgccaggtggagagacaacagggtcatcaggagggacatttcagaccagctgtaataccatttacttccatgcagtgcacagcccatagagaatatcagtggcttcatactggagagaaatcctgtgaatgcaggaaatgtaagaatgcttttaggtaccagtcatgtcctattcaacatgaaataattcataataaggaaaaagaacctgaatgtggagaatgtaggaaaatctttaatagtggatcagacttgattaagcatcagacgcttcatgaaagcaaaaaacatagtgaaaataacaaatgtgcctttaatcatgattctggaattactcaacctcagagcattaatactggagagaaacctcataaatgtaaggaatgtgggaaagcctttcgttccagctcacaaattagtcagcatcagaggatgcatcttggtgagaaaccctataagtgtagggagtgtgggaaagcctttccatccactgcacagcttaatctacatcagaggatccatactgatgagaaatactatgaaagtaaggcgtgtgggaaggcctttacccgtccctcacacctttttcgacatcaaagaatccatacgggtgagaaaccccataaatgtaaggaatgtggaaaggcttttcgttatgacacacagctgagccttcatcagataatccatactggtgaaagacgctatgaatgcagggagtgtggaaaggtgtacagttgtgcctcacagctgagtctacatcaaagaattcatactggtgagaaaccccatgaatgtaaggaatgtgggaaagcctttatctctgattcacatcttattcgacatcagagtgtccatactggggagaaaccctgtaagtgtaaggaatgtgggaagtcctttcgtcgtggctcagaacttacccgacatcagagagctcatactggtgaaaaaccctatgagtgtaaggaatgtgaaaaggcctttacttgtagcacagaacttgttcgacatcaaaaagttcacactggggagagaccccataagtgtaaggaatgtgggaaggctttcattcgaaggtcagaactcacacatcatgagagaagtcacactggtgagaaaccctacgagtgtaaggagtgtgggaagccctttggtggtggctcagaacttagttgacaccagaaaattcatactggtgagaaaccatatgaatgtcagcagtgtggaaaggccttcattcgggcctcacaccttagtcaacatcaaagaattcattcaggacagaggagtgaatgaagaaatgagggatggctcagaatttgattgacatgagaaagttcatactgatttggaaaaaaaaacttatgattctaagtgtgagacaccttataaatgttaggaattagcagggatttatttatgtttcagaatttattacacatcatgatacaactggtgaaaaattgaagacctccatgaatgtaaagaaagtagggaggcctttttggt

SEQ ID NO: 3299 - DNA, 2232 bp, Homo sapiens
atggttcggcgctttaggcgtctgtcacagacctatctgcgggtcgccttcacccagcatctcagaaactgcgcgcgggatgaacattcgggtgtttccggcaggtgacgctgccgagtccccgcagcagggggcgagcaagggactcgcggttgacgggacacggatcctctaaggcccagagtgtcccgagtagcggcagtggggagtgctcagggtacgctaatgatctgtgtcttgtaaagagcatattgctgggcttacatccgtttatcttgtttgactgttattttaataggtcctggttccacaaggataaaacacatctgcagtgcaaatagaagtctgaggaacaggtgtcttatcatggaaggagacctgacctgagacctgccttagaggctggagagtcctgaaagagagtggaccctggagttgctggagcttgtcttgacccttctgcccagagcaggcagggtctgaatgacatctcaatcttcagtgatcagcaatagctgtgtgacaatggagcgtttgagccacatgatggaaaggaaagcttggtgttctcaagagtctgccctttccgaggaagaagaggatacaaccaggcctcttgaaacagtgacatttaaggatgtggctgttgaccttacccaggaggagtgggagcaaatgaaacctgctcaaagaaacttgtatcgagatgtgatgctggagaactacagcaacctagtcacagtgggctgtcaagtcaccaaaccggatgtgatattcaagttggagcaagaagaggagccctgggtgatggaggaagaaatgtttgggaggcactgtccagaacccagaagaggagagaactgctgtgcgtctgaagtgatggcggagggcttgaagttcaaagatgtggtcatttacttctctcaaaaggagtgggaatgcttgcactctgctcagaaggatttgtaccgagatgtaatgttggaaaattacggcaacctggtcttactggggctttctgatactaagccaaatgtgatctccttattggagcagaagaaagagccctggatggttaagaggaaggagacaaaagaatggtgtccagattgggagtttggaagagaaaccaagaatttatctccaaaggaaaacatttatgaaattagatcaccacaacaggagaaggccagagttatcagagaaatcagatgccaggtggagagacaacagggtcatcaggagggacatttcagaccagctgtaataccatttacttccatgcagtgcacagcccatagagaatatcagtggcttcatactggagagaaatcctgtgaatgcaggaaatgtaagaatgcttttaggtaccagtcatgtcctattcaacatgaaataattcataataaggaaaaagaacctgaatgtggagaatgtaggaaaatctttaatagtggatcagacttgattaagcatcagacgcttcatgaaagcaaaaaacatagtgaaaataacaaatgtgcctttaatcatgattctggaattactcaacctcagagcattaatactggagagaaacctcataaatgtaaggaatgtgggaaagcctttcgttccagctcacaaattagtcagcatcagaggatgcatcttggtgagaaaccctataagtgtagggagtgtgggaaagcctttccatccactgcacagcttaatctacatcagaggatccatactgatgagaaatactatgaaagtaaggcgtgtgggaaggcctttacccgtccctcacacctttttcgacatcaaagaatccatacgggtgagaaaccccataaatgtaaggaatgtggaaaggcttttcgttatgacacacagctgagccttcatcagataatccatactggtgaaagacgctatgaatgcagggagtgtggaaaggtgtacagttgtgcctcacagctgagtctacatcaaagaattcatactggtgagaaaccccatgaatgtaaggaatgtgggaaagcctttatctctgattcacatcttattcgacatcagagtgtccatactggggagaaaccctgtaagtgtaaggaatgtgggaagtcctttcgtcgtggctcagaacttacccgacatcagagagctcatactggtgaaaaaccctatgagtgtaaggaatgtgaaaaggcctttacttgtagcacagaacttgttcgacatcaaaaa

SEQ ID NO: 3300 - DNA, 2003 bp, Homo sapiens
tccgaggccccgagggcgggacgtttcgtcctccctgccgcgcgtgccctgcctaccacgagcggcccgggagtacctgtacctttcagctgcgccggccgcgaggccacggagagctcgccttggagagcccaggagcaggggagacatggactcagtggtctttgaggatgtggctgtggacttcaccctggaggagtgggctttgctggattctgctcagagggacctctacagagatgtgatgctggagaccttccggaacctggcctcagtagatgatgggactcaatttaaagccaatgggtcagtttctctgcaggatatgtacgggcaagaaaaatctaaggaacagacaataccaaacttcacaggaaataattcctgtgcctacactttagaaaaaaattgtgaaggctatggcactgaagaccaccacaaaaatctgagaaatcatatggtggacagattctgtacacataatgaaggtaatcaatatggagaagccatccatcaaatgccagatcttaccctgcacaagaaagtttctgctggagaaaaaccatatgaatgcaccaagtgcaggacagtcttcacgcatctttcttctcttaaaaggcacgtcaagtctcactgtggacgaaaagcacctccaggtgaggaatgtaagcaggcctgcatttgtccctcacacctacacagtcacggaagaactgacactgaggagaagccgtataagtgtcaagcatgtgggcaaactttccaacatcctcgttacctctcccaccacgtaaagactcacacagcagagaaaacctacaaatgcgagcagtgtcggatggcgtttaatgggttcgcaagcttcactagacatgtgagaactcacacaaaagacaggccatataaatgtcaggaatgtgggagagccttcatttatccctcgacatttcaaagacacatgacaacacacactggagagaagccctataaatgtcagcactgtgggaaagccttcacttacccccaggcttttcaaagacatgagaagacgcacacgggagagaagccctatgaatgcaagcagtgtgggaaaacattcagttggtctgaaaccttgcgagtccacatgaggatccacactggggacaaactctataaatgtgaacactgtgggaaggcttttacctcttccagatcattccaaggtcatttgaggacgcacactggagagaaaccttatgagtgtaaacaatgtgggaaagccttcacttggtcctcaacgtttagagaacatgtgagaattcacacgcaagagcagctctataaatgtgaacaatgtgggaaggcttttacctcttccagatcattccgaggtcatttgaggacgcacactggagagaagccttatgagtgtaaacaatgtggaaaaaccttcacttggtcctcaacgtttagagaacatgtgagaattcacacgcaagagcagctccataaatgtgaacactgtgggaaggcctttacctcttccagagcattccaaggtcatttgaggatgcacactggagagaagccttatgagtgtaaacaatgtggaaaaaccttcacttggtcctcaaccttacataatcatgtgaggatgcacactggagagaaacctcacaaatgtaaacaatgtgggatgtccttcaagtggcactcctccttccggaaccatctgaggatgcacacaggacagaaatcccacgaatgtcagtcatactcaaaagccttcagttgccaagtcattctttctaaaaccagtgagagcacacactaaagagaaattctataactttaatggggtaacctcacattaattcatgtataatgctccagaaaattcacaccaggagagaaatcttacaagtatgatattgtctttgtcaatacctcatttgtaaaacagacccattagtcgtgaatttccagctctttcaaaaataaatgtttatgtgagaaaataa

SEQ ID NO: 3301 - DNA, 2000 bp, Homo sapiens
tccgaggccccgagggcgggacgtttcgtcctccctgccgcgcgtgccctgcctaccacgagcggcccgggagtacctgtacctttcagctgcgccggccgcgaggccacggagagctcgccttggagagcccaggagcaggggagacatggactcagtggtctttgaggatgtggctgtggacttcaccctggaggagtgggctttgctggattctgctcagagggacctctacagagatgtgatgctggagaccttccggaacctggcctcagtaggatgtgaaatgtgggaaaggaccaatgggtcagtttctctgcaggatatgtacgggcaagaaaaatctaaggaacagacaataccaaacttcacaggaaataattcctgtgcctacactttagaaaaaaagcggatcacgaggtcaggagatcaatcccagctacctgtgaggcggagaaatcatatggtggacagattctgtacacataatgaaggtaatcaatatggagaagccatccatcaaatgccagatcttaccctgcacaagaaagtttctgctggagaaaaaccatatgaatgcaccaagtgcaggacagtcttcacgcatctttcttctcttaaaaggcacgtcaagtctcactgtggacgaaaagcacctccaggtgaggaatgtaagcaggcctgcatttgtccctcacacctacacagtcacggaagaactgacactgaggagaagccgtataagtgtcaagcatgtgggcaaactttccaacatcctcgttacctctcccaccacgtaaagactcacacagcagagaaaacctacaaatgcgagcagtgtcggatggcgtttaatgggttcgcaagcttcactagacatgtgagaactcacacaaaagacaggccatataaatgtcaggaatgtgggagagccttcatttatccctcgacatttcaaagacacatgacaacacacactggagagaagccctataaatgtcagcactgtgggaaagccttcacttacccccaggcttttcaaagacatgagaagacgcacacgggagagaagccctatgaatgcaagcagtgtgggaaaacattcagttggtctgaaaccttgcgagtccacatgaggatccacactggggacaaactctataaatgtgaacactgtgggaaggcttttacctcttccagatcattccaaggtcatttgaggacgcacactggagagaaaccttatgagtgtaaacaatgtgggaaagccttcacttggtcctcaacgtttagagaacatgtgagaattcacacgcaagagcagctctataaatgtgaacaatgtgggaaggcttttacctcttccagatcattccgaggtcatttgaggacgcacactggagagaagccttatgagtgtaaacaatgtggaaaaaccttcacttggtcctcaacgtttagagaacatgtgagaattcacacgcaagagcagctccataaatgtgaacactgtgggaaggcctttacctcttccagagcattccaaggtcatttgaggatgcacactggagagaagccttatgagtgtaaacaatgtggaaaaaccttcacttggtcctcaaccttacataatcatgtgaggatgcacactggagagaaacctcacaaatgtaaacaatgtgggatgtccttcaagtggcactcctccttccggaaccatctgaggatgcacacaggacagaaatcccacgaatgtcagtcatactcaaaagccttcagttgccaagtcattctttctaaaaccagtgagagcacacactaaagagaaattctataactttaatggggtaacctcacattaattcatgtataatgctccagaaaattcacaccaggagagaaatcttacaagtatgatattgtctttgtcaatacctcatttgtaaaacagacccattagtcgtgaatttccagctctttcaaaaataaatgtttatgtg

SEQ ID NO: 3302 - DNA, 2247 bp, Homo sapiens
gtagtgtgacgctgggccccgtccctgtgaccgggccaggctcggagctgcagggaatccggactttcgggctctctggaaggccggggagaggccagtgtgggaggacctggtggggaggaggccgtgttacaaaccctgcgcggagctgcaccgctgctgccagacactgcgacgccgcgaccttttctactccggactacgtttcccagcggaccccgcgggagttgggccggcggcccctttgtgtcctccgggggcggaggcagctgaggcgcttctttccgggcccgtaagggctgggttccatccaactaagggtagcggtgagacccgagtgcagattccccgagccttcggggcaggaaggagatcttccaccagttctgttctgcaggtcgggagtgggctgaggagtggcgtgtgggtctccggaagctcgtcgcaggccatctgtgtgactccggtgcgagtggagtcatctgaggccactgctatttcccaagagaagagccaggaggaagaaagaatggctgttgggcttcttaaagccatgtaccaggagttggtgaccttcagagatgtggctgtagacttctcccaagaggaatgggattgtctggattcttctcaaagacatctgtacagtaatgtgatgctagagaactacaggatcttggtatcactgggactttgcttttccaaaccaagtgtgatattattgttggaacaaggaaaagcaccctggatggtgaagagagagctgacaaaaggcttgtgctcaggctgggagcctatatgtgagactgaagaattaaccccaaagcaggatttttatgaagaacatcaatcccagaagataatagaaacacttacaagctataaccttgaatactccagtttgagagaagagtggaaatgtgagggctattttgaaaggcaaccaggtaatcagaaggcgtgtttcaaggaagagataatcactcatgaagaacccctttttgatgagagagaacaagaatataaatcttggggaagttttcatcagaacccactgctttgtacacaaaagataatccccaaagaggagaaagtacataaacatgacacacaaaagagaagctttaaaaaaaatttaatggctattaagcccaagagtgtctgtgcagagaagaaacttttgaaatgtaatgactgtgaaaaagtcttcagccagagttcatcccttactcttcatcaaagaattcatactggagagaaaccctataaatgtatagagtgtggaaaagccttcagccagagatcaaatcttgttcaacatcagaggattcatactggagaaaaaccctatgaatgtaaggaatgtaggaaagccttcagtcagaatgcacacctagttcaacatctgcgagttcatactggagaaaaaccttacgaatgtaaggtatgtcgaaaagccttcagccagtttgcctaccttgctcaacatcagagagttcacacgggagagaaaccctatgaatgtatcgaatgtgggaaagcatttagcaacagatcatccattgctcaacaccagagagttcatacaggagagaaaccctatgaatgtaatgtctgtgggaaagcatttagccttcgtgcataccttactgtacatcagagaatacatactggagagagaccctatgaatgtaaggaatgtgggaaggcctttagccagaattcacaccttgctcaacatcagagaattcatactggagaaaaaccttataagtgtcaggaatgtaggaaagcattcagccagattgcctaccttgctcagcatcaaagagttcatactggagagaaaccctatgaatgtattgaatgtgggaaggcttttagcaatgactcgtcccttactcaacatcagcgagttcatactggagagaaaccttatgaatgtactgtttgtggaaaggcttttagttactgtggatcccttgcccaacatcagagaattcatactggagagagaccctatgaatgtaaggaatgcaaaaaaaccttcaggcagcatgcacaccttgctcatcaccagagaattcacattggggagtcactgtcaccacccaacccagtcaatcaccaagtcctatagatcctgagtcctaaatgtttctagaatttatactgttttttatctttaatgttgtcaccttggtctgattcatctcactctgattactaatatagctttcaaacagg

SEQ ID NO: 3303 - DNA, 1964 bp, Homo sapiens
gcttctttccgggcccgtaagggctgggttccatccaactaagggtagcggtgagacccgagtgcagattccccgagccttcggggcaggaaggagatcttccaccagttctgttctgcaggtcgggagtgggctgaggagtggcgtgtgggtctccggaagctcgtcgcaggccatctgtgtgactccggtgcgagtggaggagttggtgaccttcagagatgtggctgtagacttctcccaagaggaatgggattgtctggattcttctcaaagacatctgtacagtaatgtgatgctagagaactacaggatcttggtatcactgggactttgcttttccaaaccaagtgtgatattattgttggaacaaggaaaagcaccctggatggtgaagagagagctgacaaaaggcttgtgctcaggttagtgaagaggaaattggcaaaaatctttgcacgtgacagctcagcttgactcaaaggctgggagcctatatgtgagactgaagaattaaccccaaagcaggatttttatgaagaacatcaatcccagaagataatagaaacacttacaagctataaccttgaatactccagtttgagagaagagtggaaatgtgagggctattttgaaaggcaaccaggtaatcagaaggcgtgtttcaaggaagagataatcactcatgaagaacccctttttgatgagagagaacaagaatataaatcttggggaagttttcatcagaacccactgctttgtacacaaaagataatccccaaagaggagaaagtacataaacatgacacacaaaagagaagctttaaaaaaaatttaatggctattaagcccaagagtgtctgtgcagagaagaaacttttgaaatgtaatgactgtgaaaaagtcttcagccagagttcatcccttactcttcatcaaagaattcatactggagagaaaccctataaatgtatagagtgtggaaaagccttcagccagagatcaaatcttgttcaacatcagaggattcatactggagaaaaaccctatgaatgtaaggaatgtaggaaagccttcagtcagaatgcacacctagttcaacatctgcgagttcatactggagaaaaaccttacgaatgtaaggtatgtcgaaaagccttcagccagtttgcctaccttgctcaacatcagagagttcacacgggagagaaaccctatgaatgtatcgaatgtgggaaagcatttagcaacagatcatccattgctcaacaccagagagttcatacaggagagaaaccctatgaatgtaatgtctgtgggaaagcatttagccttcgtgcataccttactgtacatcagagaatacatactggagagagaccctatgaatgtaaggaatgtgggaaggcctttagccagaattcacaccttgctcaacatcagagaattcatactggagaaaaaccttataagtgtcaggaatgtaggaaagcattcagccagattgcctaccttgctcagcatcaaagagttcatactggagagaaaccctatgaatgtattgaatgtgggaaggcttttagcaatgactcgtcccttactcaacatcagcgagttcatactggagagaaaccttatgaatgtactgtttgtggaaaggcttttagttactgtggatcccttgcccaacatcagagaattcatactggagagagaccctatgaatgtaaggaatgcaaaaaaaccttcaggcagcatgcacaccttgctcatcaccagagaattcacattggggagtcactgtcaccacccaacccagtcaatcaccaagtcctatagatcctgagtcctaaatgtttctagaatttatactgttttttatctttaatgttgtcaccttggtctgattcatctcactctgattactaatatagctttcaaacaggttttcctgtatttatttt

SEQ ID NO: 3304 - DNA, 3844 bp, Homo sapiens
ttgacgcacggagcttgtctgcgccggccagcactggcttctctggactttgcacacctccaggagaagaacccagaaaattgatcagttctaaaaaaccatgccccacttgttggtgactttcagggatgtggccattgacttctctcaggaggaatgggaatgcctggaccctgctcagagggacttgtacagggatgtgatgttggagaactacagcaacctgatctcattggacttggaatccagttgtgtgaccaaaaagttatctccagaaaaggaaatttatgaaatggaatcactccagtgggagaatatggggaaacgtatcaaccatcaccttcaatacaatggtcttggagacaatatggagtgcaaaggcaacttagagggtcaagaagcaagtcaggaagggctttacatgtgtgtcaaaattacctgtgaagaaaaggccactgaaagtcattcaacctcttctacttttcatcggataattcctaccaaggaaaaattgtacaaatgtaaggaatgcagacaaggtttcagctacctgtcatgccttattcaacatgaggaaaatcataatatagaaaaatgctctgaagttaagaaacacaggaatacctttagcaaaaagccaagctatattcaacatcagagaattcagactggtgagaaaccttatgagtgtatggaatgtggaaaggcctttggtcgtacttctgatctcattcaacatcagaaaattcatactaatgaaaaaccttatcagtgtaacgcatgtgggaaagcttttattcgtggttcacagctcactgaacatcagagagttcatacaggagagaaaccatatgaatgtaagaaatgtggaaaagcctttagttattgttcacaatatactcttcatcagagaattcatagtggtgaaaaaccctatgaatgtaaggattgtgggaaggcctttattcttggctctcaacttacttaccatcagagaattcatagtggtgagaaaccttatgagtgtaaggaatgtggaaaggcctttattcttggttcacaccttacataccatcagagagttcatactggtgaaaagccttacatatgtaaagaatgtgggaaagcctttttatgtgcctcccaactgaatgaacatcagagaattcatacaggagagaaaccctatgaatgtaaagaatgcgggaagaccttttttcgtggctcacaacttacttaccacctgagagttcattcaggtgagagaccttataaatgcaaagaatgtgggaaagcctttatttctaattctaatcttattcaacatcaaagaattcataccggagagaagccctacaaatgtaaggaatgtggaaaggcctttatttgtggcaaacaacttagtgaacatcagagaattcatacaggtgagaaaccctttgaatgtaaggaatgtggaaaggcctttattcgtgttgcatatcttactcaacatgagaaaattcatggtgagaaacattatgaatgtaaggaatgtgggaagacctttgtacgtgctacacaacttacatatcatcaaagaattcatacaggtgaaaagccctacaaatgtaaggaatgtgacaaggcctttatttatggctcacaacttagtgaacatcagagaattcacagaggtgaaaaaccttatgaatgtaaacagtgtgggaaggcttttattcgtggctcacaccttactgaacatctgagaactcatactggagagaaaccctatgaatgtaaggaatgtgggagggcctttagtcgtggctcagaacttactctgcatcaaaggatccatactggtgagaaaccctatacatgtgtccagtgtggtaaagactttagatgtccttcacaacttactcaacatacaaggcttcataattgagaaagccttgaatgtgattaaatttaagaaaatcttcatctatttcatatctataatgaatgtagaacatcttgcttctgctcagaatctgctcattcttagaaggcctacattaacatggatgcagaataatttcagaaaccccttaaataattccttaacatctctataaacgctagaatataatgctgaattatatcctttattaagcatcatctccatttcaccatatcctaactgaaatcctatatatttcttgtgtgttcttttctatttgtaaaatactgtaattgtattacaatgactaaattataattaaatacatataattccctttcgatagcatctgatatttgttgttaaaatgattgccattatcatcattacatactgttagagaactcaaatggtgggaatattttatgattacagtaaaaagatgcaaccattctcttatcatgtagcccctttagaacaacagatactttattttagacaaaacctttaaagtatagtaaaggtatgaaggacttctgagcatcagataatccacaccaggaagaaacttccaaaaattgctttagggctgttgttttttgttgttttgttttttaagaaagtgaaagattatttttctacaacaaattccaaaagcaaaagtttttggcccacattttctgattgttactttaagggaaaaagaatttcttaacaaaatgatggccaaggtagttccatatatatacatatattccacatgtgtgtatgtggaatatatacatatattccacatgtgtgtatgtggaatatattccacatgtgtatatattccacgtgtatgtattccacatgtatatattccacatatgtatacattccacgtgtgtatatagtccccatatgtatacattccacgtgtgtatatattccacatatgtatacattccatgtatgtatgcatatatgtattccatatatgtatatattccatataccatatatgtatatattccacatatgtattccatatatatattccatatgtatatgtgtgtgtgtataaaatatatatttgccttaaatggaaatataaacaaaatttaccaactacagtttttcctcatttgaatctaacccatttctgatatactgaatggtaaatttttagagacccagatctcggaggctacattccattttttggtctttttgtcttttttttctttttttttgagacagggtcttgctctccttgttcaggctggagtacagtggcacaatcacagctcactgcagccttgacctcctaggctcaagctatcctccaacctcagcctgccaagtagctgtcaccatagctgttcatcaccatgcctagctcatttaaaaaaaaatttttttagagatggggtctcactatgtttcctcatctggtcttaaacttctaggctcaagcatctacctgcctcagcctccagaagtgctgggattacaaatgtgagccaccacatctggccccattattttatttttggtttgtattatttttatttggccccattattttaaataggaaaaacagtatgttttcagtccattaaaaaatcctaaccaaatttaatttgaattcaacttaatttaagccacctaaatgacctctatcagggatttctgaataatgtaaaacactcaaaagccagttaacagttaattaccagatatgtttgtgcatgcagtgattttgaaaaatataatacatgaattatgctttccttctatgctttaaggaacagatactatagtgacaataaatgtaatacattagtacataatggacgcaaatgacagataaaaacagctttaaataatttgaacttgttaattagaatgttgttgaatgagggctgatggtca

SEQ ID NO: 3305 - DNA, 2049 bp, Homo sapiens
gagcttgtctgcgccggccagcgcttggcccctcccgggccgcagtactcctcgtgtgacacggacatcattaagccagctgagaatcgtgcggttacagctgctgcagtttctttgcagacactggcttctctggactttgcacacctccaggagaagaacccagaaaattgatcagttctaaaaaaccatgccccacttgttggtgactttcagggatgtggccattgacttctctcaggaggaatgggaatgcctggaccctgctcagagggacttgtacagggatgtgatgttggagaactacagcaacctgatctcattggacttggaatccagttgtgtgaccaaaaagttatctccagaaaaggaaatttatgaaatggaatcactccagtgggagaatatggggaaacgtatcaaccatcaccttcaatacaatggtcttggagacaatatggagtgcaaaggcaacttagagggtcaagaagcaagtcaggaagggctttacatgtgtgtcaaaattacctgtgaagaaaaggccactgaaagtcattcaacctcttctacttttcatcggataattcctaccaaggaaaaattgtacaaatgtaaggaatgcagacaaggtttcagctacctgtcatgccttattcaacatgaggaaaatcataatatagaaaaatgctctgaagttaagaaacacaggaatacctttagcaaaaagccaagctatattcaacatcagagaattcagactggtgagaaaccttatgagtgtatggaatgtggaaaggcctttggtcgtacttctgatctcattcaacatcagaaaattcatactaatgaaaaaccttatcagtgtaacgcatgtgggaaagcttttattcgtggttcacagctcactgaacatcagagagttcatacaggagagaaaccatatgaatgtaagaaatgtggaaaagcctttagttattgttcacaatatactcttcatcagagaattcatagtggtgaaaaaccctatgaatgtaaggattgtgggaaggcctttattcttggctctcaacttacttaccatcagagaattcatagtggtgagaaaccttatgagtgtaaggaatgtggaaaggcctttattcttggttcacaccttacataccatcagagagttcatactggtgaaaagccttacatatgtaaagaatgtgggaaagcctttttatgtgcctcccaactgaatgaacatcagagaattcatacaggagagaaaccctatgaatgtaaagaatgcgggaagaccttttttcgtggctcacaacttacttaccacctgagagttcattcaggtgagagaccttataaatgcaaagaatgtgggaaagcctttatttctaattctaatcttattcaacatcaaagaattcataccggagagaagccctacaaatgtaaggaatgtggaaaggcctttatttgtggcaaacaacttagtgaacatcagagaattcatacaggtgagaaaccctttgaatgtaaggaatgtggaaaggcctttattcgtgttgcatatcttactcaacatgagaaaattcatggtgagaaacattatgaatgtaaggaatgtgggaagacctttgtacgtgctacacaacttacatatcatcaaagaattcatacaggtgaaaagccctacaaatgtaaggaatgtgacaaggcctttatttatggctcacaacttagtgaacatcagagaattcacagaggtgaaaaaccttatgaatgtaaacagtgtgggaaggcttttattcgtggctcacaccttactgaacatctgagaactcatactggagagaaaccctatgaatgtaaggaatgtgggagggcctttagtcgtggctcagaacttactctgcatcaaaggatccatactggtgagaaaccctatacatgtgtccagtgtggtaaagactttagatgtccttcacaacttactcaacatacaaggcttcataattgagaaagccttgaatgtgattaaatttaaga

SEQ ID NO: 3306 - DNA, 2275 bp, Homo sapiens
cttgacgcacggagcttgtctgcgccggccagcactggcttctctggactttgcacacctccaggagaagaacccagaaaattgatcagttctaaaaaaccatgccccacttgttggtgactttcagggatgtggccattgacttctctcaggaggaatgggaatgcctggaccctgctcagagggacttgtacagggatgtgatgttggagaactacagcaacctgatctcattggacttggaatccagttgtgtgaccaaaaagttatctccagaaaaggaaatttatgaaatggaatcactccagtgggagaatatggggaaacgtatcaaccatcaccttcaatacaatggtcttggagacaatatggagtgcaaaggcaacttagagggtcaagaagcaagtcaggaagggctttacatgtgtgtcaaaattacctgtgaagaaaaggccactgaaagtcattcaacctcttctacttttcatcggataattcctaccaaggaaaaattgtacaaatgtaaggaatgcagacaaggtttcagctacctgtcatgccttattcaacatgaggaaaatcataatatagaaaaatgctctgaagttaagaaacacaggaatacctttagcaaaaagccaagctatattcaacatcagagaattcagactggtgagaaaccttatgagtgtatggaatgtggaaaggcctttggtcgtacttctgatctcattcaacatcagaaaattcatactaatgaaaaaccttatcagtgtaacgcatgtgggaaagcttttattcgtggttcacagctcactgaacatcagagagttcatacaggagagaaaccatatgaatgtaagaaatgtggaaaagcctttagttattgttcacaatatactcttcatcagagaattcatagtggtgaaaaaccctatgaatgtaaggattgtgggaaggcctttattcttggctctcaacttacttaccatcagagaattcatagtggtgagaaaccttatgagtgtaaggaatgtggaaaggcctttattcttggttcacaccttacataccatcagagagttcatactggtgaaaagccttacatatgtaaagaatgtgggaaagcctttttatgtgcctcccaactgaatgaacatcagagaattcatacaggagagaaaccctatgaatgtaaagaatgcgggaagaccttttttcgtggctcacaacttacttaccacctgagagttcattcaggtgagagaccttataaatgcaaagaatgtgggaaagcctttatttctaattctaatcttattcaacatcaaagaattcataccggagagaagccctacaaatgtaaggaatgtggaaaggcctttatttgtggcaaacaacttagtgaacatcagagaattcatacaggtgagaaaccctttgaatgtaaggaatgtggaaaggcctttattcgtgttgcatatcttactcaacatgagaaaattcatggtgagaaacattatgaatgtaaggaatgtgggaagacctttgtacgtgctacacaacttacatatcatcaaagaattcatacaggtgaaaagccctacaaatgtaaggaatgtgacaaggcctttatttatggctcacaacttagtgaacatcagagaattcacagaggtgaaaaaccttatgaatgtaaacagtgtgggaaggcttttattcgtggctcacaccttactgaacatctgagaactcatactggagagaaaccctatgaatgtaaggaatgtgggagggcctttagtcgtggctcagaacttactctgcatcaaaggatccatactggtgagaaaccctatacatgtgtccagtgtggtaaagactttagatgtccttcacaacttactcaacatacaaggcttcataattgagaaagccttgaatgtgattaaatttaagaaaatcttcatctatttcatatctataatgaatgtagaacatcttgcttctgctcagaatctgctcattcttagaaggcctacattaacatggatgcagaataatttcagaaaccccttaaataattccttaacatctctataaacgctagaatataatgctgaattatatcctttattaagcatcatctccatttcaccatatcctaactgaaatcctatatatttcttgtgtgttcttttctatttgtaaaatactgtaattgtattacaatgactaaattataattaaatacatataattccctttcgatagc

SEQ ID NO: 3307 - DNA, 3275 bp, Homo sapiens
tttctgccttccgggtttgagagtttaggaccctgggttggtggggtcagagggagagggggtaccttcctcccggaccgctgggggtgcagggcgccttgggtgtagcacccagaacaggtttctgatctctaacttggctgtgatcattgtgatggagcaagaaaaaaaactgttggtctcagattctaacagctttatggagagggagagtttgaaaagccctttcacaggagatacaagtatgaataatttggaaactgttcaccacaataattctaaggcagataaacttaaagagaaaccttcagaatggtctaaaagacatagaccacaacattataagcatgaggatgcaaaagaaatgccactgacatgggttcaagatgagatttggtgtcatgattcctatgagagtgatggcaagtcagagaattggggaaattttatagctaaagaggaggaaaaacccaatcaccaggaatgggactcaggagaacataccaatgcctgtgtccagcagaattcatcctttgtagacagaccctataaatgttccgaatgttggaaaagcttcagtaatagttctcatttgcgtactcaccagaggacccactcaggagaaaagccttataaatgctctgagtgtgcaaaatgtttttgtaacagttctcacctgattcagcatctaagaatgcacacaggagagaagccctaccagtgtggtgaatgtgggaaaagcttcagcaatacctcccatcttattatccatgagagaactcacacgggagagaaaccctacaaatgtcccgagtgtgggaagagattcagcagcagctctcaccttattcagcatcacagatcacatacaggtgaaaaaccatatgaatgttctgtctgcggaaaaggcttcagtcacagctatgtcctaatagaacatcagaggactcacactggagaaaaaccttataagtgccctgattgtgggaagagttttagtcagagttccagcctcattcgccaccagcggacacacacaggtgagaagccctacaaatgtcttgagtgtgaaaaaagctttggttgtaattctactctaataaaacatcagagaatacatacaggagaaaagccttatcaatgtccagaatgtgggaagaattttagtcgtagttcaaaccttattacacaccagaaaatgcacacaggagagaaatcctatgaaagttctgaatatgaggaaagtttgggtcagaactgcaatgtgatagaagaatgcagaatccagttaggagagaaaccatatagatgttgtgaatgtgggaagagttttggccttagctcccatctcattagacatcagagaacacatacaggagaaaaaccttacagatgttctgagtgctggaaaactttcagtcagagttccaccctggtgattcaccaaaggacacatacaggagagaaaccttataaatgtcctgattgtggtgaaagcttcagtcagagctttaaccttatcaggcaccggaggacccacataggggaaaaaccttacaaatgtaccagctgtgagaaatgcttcagcagaagtgcctacctcagtcagcatcggaaaattcacgtagaaaagccttttgagtctcccgacgttggggattttcctcatgaatggacttggaaaaactgttcaggggaaatgcccttcatctcttcattttccgtctcaaattcatcttcctgagtcccaaagcctggttggtgatggttttttcttccttgttggaccatgacaatttaggtattctgtgattgttgtgctataaagtttctttgatgtgtttgtcaaaacatttggaaaaagtcaacctcccagtttaaaggatgggaagaccccaatcaccaggttattggatctgtccagtgagagattcatccaccaaggatgaagaaaggaggacttttaaaaatttaaggtaagatagtaatagcttcaaaagaacacatacagagtaatcctgagagtaagcaaaggaaccatgagaaccgaagctagaattgctattgaattactttattttctcttcccttattgggtagagatacatcattactggcctcaggggtttacccaaagaaagggtatttttgagcaaataatgtgatttcctggctattttgttgggggcttaagatttttttttttcaaatgcatttttagtcactaaaaattaactgtcgtaccatctagaactatactgtccagtaccatagcctctagccgtatgtagctatttgtattaagattaattgaaattttaaatccagttcctcagtcacactagccactttctaagtgctcagtagctctgtgtgaccagcggctactgtattggatattatagaaggttctttcattcaagatcatcattcttgacagacccataaatatttcctataaagactgtagaagtgtgttctggagggtttgctctccaaaaagaattgtaatatagagtagaattgggatagagtattgaagacactgggtttagacattggatattttaatgattgtgtgttctaattcatgtgctgccaactgagttatctagtgatatgacctcactgtcttgaccaaagccagaatagaaggcaggattcctgaattctatcttaaaatttgcaatgaagagccttttccctaaattatcccattatgtaattcttggtcagctcaagaactgggttctttttctaataattaactcactaaatctgagccagtgtccaaggacagtttgtcattaaggagtactgagacttcttagctttggtactgacagttttcttttgcctcttgacataattggtatatggatctgataactgaggtcccatcttccctactcattcctatgggaatgatgctttggaaattattagatatatcctattcccttcctcccatttttttcctgctagtgcaaaaggtagatgagtaggaagattaggactcctgagttgcccatgatttcatctaatttttggattcagaatgtattttatgaataatatgcagagatgcatattaggaatgtgaagccagaatgggtcagttgtagctgctgcaaagttctgtagctgatggtcatttaattgcatgggggttattttatctttcatgattgtggtgcacctgatgctggcggggtatttgtgtgtttttgtattgttatttgattacaaaaataaagcaaaaactaacaaataaa

SEQ ID NO: 3308 - DNA, 2516 bp, Homo sapiens
acccaatctatggcttcccttccgttttcgcgtggttcttttgcaagctctggattctctggagtttgaatgtttccagtattggaaccccaccaagtaggactgatcaggtcttacaattctaaaaccatgacctgtaactggggaagacctttgaagttctgtccaacaaagtatatgaagtttcaggaattagtgacattcagggatgtggccatagacttctctcggcaggagtgggaatacctggaccctaatcagagggacttatacagggatgtgatgttggagaactatagaaacctggtatcactgggaggacattccatttctaaaccagttgtggttgatttactggagcgaggaaaagagccctggatgattttgagggaagaaacacagttcacagagatgggggtctcactgggttgctcagctggtctctaactcctgggctcaagcagtcctcctgcattggcttcccaaagtgctgaaaatacagatggagtcttgctctgtcgcacaggctggagtgcagtggcccgatctcagctcactgcaacctccgcctcccaggttcaagcaattctcctgccacagcctccaagtagctgggattacagatttggatttacagtgtgagataatcagctacatagaagtacccacttatgaaacagatatatcctctacacaacttcagagcatatataagagagagaaactctatgaatgtaagaaatgtcagaagaaatttagtagtggttatcaacttattctacatcacaggtttcatgtcattgagagaccctatgaatgcaaagagtgtgggaagaactttcgtagtggctatcaacttactctacatcaaagatttcatactggtgagaaaccctatgaatgtacagaatgtgggaagaactttagaagtggttatcagctgactgtgcatcagagatttcatactggtgagaaaacctatgaatgtaggcagtgtgggaaggcctttatatatgcctcacacattgttcaacatgagagaattcacactggtgggaagccgtatgaatgtcaggagtgtgggagggcctttagtcaaggtggacatcttagaattcatcagagagttcatactggcgaaaaaccatataaatgtaaggaatgtgggaagacttttagtaggcgctcaaatcttgttgaacatgggcagtttcatactgatgagaagccatacatatgtgagaaatgtggaaaggcctttagaagaggtcaccagcttactgtacatcagagagttcacactggtaaaaagccatatgagtgtaaagaatgtgggaagggctataccactgcctcatactttcttctacatcagagaattcataaaggtggaaaaccctatgaatgtaaggagtgtaagaaaacctttactttgtatagaaatcttactcggcatcagaatattcatactggtgagaaactttttgaatgcaagcaatgtgggaagacctatactactggttcaaaactctttcaacatcagaaaactcatactggcgagaaaccctatgaatgcaaggaatgcggaaaggcctttagcttgtatggctaccttaaacaacatcagaaaattcatactggcatgaaacactttgaatgtaaggagtgtaaaaaaacctttactttgtatagaaatcttactcgacatcagaatattcacactggtaagaaactttttgaatgtcaggaatgtgggaaggcctatagtactggctcaaaccttattcaacatcggaaaactcatactggtgagaaaccctataaatgtaaggaatgtggcaagacctttagcttgcatggatatcttaatcaacatcagaaaattcatactggtatgaaaccctatgaatgtaaggtatgtagaaaaacctttactttctatagaaatcttactctacatcaaagtattcatactgatgagaaaccttttgaatgtaaggaatgtgggaagacctttagacgtagttcacaccttactgcacatcagagcattcatgctgataaaaaaccctatgaatgtaaagaatgtggaaaggcctttaaaatgtatggctaccttacccaacatcagaaaattcatactggtggaaaaccttatgaatgtaaagaatgtgggaaggccttcagtcgtgcttcaaaccttgttcaacatgagagaattcatactggtgagaaaccctatgtgtgtaagcagtgtgggaaaaccttcagatatggttcagcccttaaagcccatcagagaattcataggagcataaaagtgtaagaccgtaaagagtacgagcgcgccattcatcatcagacagcccacactggtgagaaatgatggaatgttagtcttataggtatggctttagcaattgagagagttcaaaatgcagatcttgccacattagaaagcattcaatgtcagtcctgttttaatggaatatctgactattcaatggtaaattaag

SEQ ID NO: 3309 - DNA, 2124 bp, Homo sapiens
acccaatctatggcttcccttccgttttcgcgtggttcttttgcaagctctggattctctggagtttgaatgtttccagtattggaaccccaccaagtaggactgatcaggtcttacaattctaaaaccatgacctgtgaggacattccatttctaaaccagttgtggttgatttactggagcgaggaaaagagccctggatgattttgagggaagaaacacagttcacagatttggatttacagtgtgagataatcagctacatagaagtacccacttatgaaacagatatatcctctacacaacttcagagcatatataagagagagaaactctatgaatgtaagaaatgtcagaagaaatttagtagtggttatcaacttattctacatcacaggtttcatgtcattgagagaccctatgaatgcaaagagtgtgggaagaactttcgtagtggctatcaacttactctacatcaaagatttcatactggtgagaaaccctatgaatgtacagaatgtgggaagaactttagaagtggttatcagctgactgtgcatcagagatttcatactggtgagaaaacctatgaatgtaggcagtgtgggaaggcctttatatatgcctcacacattgttcaacatgagagaattcacactggtgggaagccgtatgaatgtcaggagtgtgggagggcctttagtcaaggtggacatcttagaattcatcagagagttcatactggcgaaaaaccatataaatgtaaggaatgtgggaagacttttagtaggcgctcaaatcttgttgaacatgggcagtttcatactgatgagaagccatacatatgtgagaaatgtggaaaggcctttagaagaggtcaccagcttactgtacatcagagagttcacactggtaaaaagccatatgagtgtaaagaatgtgggaagggctataccactgcctcatactttcttctacatcagagaattcataaaggtggaaaaccctatgaatgtaaggagtgtaagaaaacctttactttgtatagaaatcttactcggcatcagaatattcatactggtgagaaactttttgaatgcaagcaatgtgggaagacctatactactggttcaaaactctttcaacatcagaaaactcatactggcgagaaaccctatgaatgcaaggaatgcggaaaggcctttagcttgtatggctaccttaaacaacatcagaaaattcatactggcatgaaacactttgaatgtaaggagtgtaaaaaaacctttactttgtatagaaatcttactcgacatcagaatattcacactggtaagaaactttttgaatgtcaggaatgtgggaaggcctatagtactggctcaaaccttattcaacatcggaaaactcatactggtgagaaaccctataaatgtaaggaatgtggcaagacctttagcttgcatggatatcttaatcaacatcagaaaattcatactggtatgaaaccctatgaatgtaaggtatgtagaaaaacctttactttctatagaaatcttactctacatcaaagtattcatactgatgagaaaccttttgaatgtaaggaatgtgggaagacctttagacgtagttcacaccttactgcacatcagagcattcatgctgataaaaaaccctatgaatgtaaagaatgtggaaaggcctttaaaatgtatggctaccttacccaacatcagaaaattcatactggtggaaaaccttatgaatgtaaagaatgtgggaaggccttcagtcgtgcttcaaaccttgttcaacatgagagaattcatactggtgagaaaccctatgtgtgtaagcagtgtgggaaaaccttcagatatggttcagcccttaaagcccatcagagaattcataggagcataaaagtgtaagaccgtaaagagtacgagcgcgccattcatcatcagacagcccacactggtgagaaatgatggaatgttagtcttataggtatggctttagcaattgagagagttcaaaatgcagatcttgccacattagaaagcattcaatgtcagtcctgttttaatggaatatctgactattcaatggtaaattaag

SEQ ID NO: 3310 - DNA, 342 bp, Homo sapiens
cccttccgttttcgcgtggttcttttgcaagctctggattctctggagtttgaatgtttccagtattggaaccccaccaagtaggactgatcaggtcttacaattctaaaaccatgacctgtgaattagtgacattcagggatgtggccatagacttctctcggcaggagtgggaatacctggaccctaatcagagggacttatacagggatgtgatgttggagaactatagaaacctggtatcactgggaggacattccatttctaaaccagttgtggttgatttactggagcgaggaaaagagccctggatgattttgagggaagaaacacagttcacag

SEQ ID NO: 3311 - DNA, 2266 bp, Homo sapiens
gagtgcgcatgcgcagagcggccaacccgtgagggaacgtttctgacgctaggtcaagggcggtgttcctgtgttcttagggccccaggaggcgagtctgagtggaacctggctggggtaggctgaaaggtgacttcgacgctcttctgaggcctcagacgtgtgtgatgactgccctgtagaatcagtgctgtgaccccgagtaacaacgcgcgcttgagttggtataaactcctgaagtttcaggaattagtgacattcagggatgtggccatagacttctctcggcaggagtgggaatacctggaccctaatcagagggacttatacagggatgtgatgttggagaactatagaaacctggtatcactggatttggatttacagtgtgagataatcagctacatagaagtacccacttatgaaacagatatatcctctacacaacttcagagcatatataagagagagaaactctatgaatgtaagaaatgtcagaagaaatttagtagtggttatcaacttattctacatcacaggtttcatgtcattgagagaccctatgaatgcaaagagtgtgggaagaactttcgtagtggctatcaacttactctacatcaaagatttcatactggtgagaaaccctatgaatgtacagaatgtgggaagaactttagaagtggttatcagctgactgtgcatcagagatttcatactggtgagaaaacctatgaatgtaggcagtgtgggaaggcctttatatatgcctcacacattgttcaacatgagagaattcacactggtgggaagccgtatgaatgtcaggagtgtgggagggcctttagtcaaggtggacatcttagaattcatcagagagttcatactggcgaaaaaccatataaatgtaaggaatgtgggaagacttttagtaggcgctcaaatcttgttgaacatgggcagtttcatactgatgagaagccatacatatgtgagaaatgtggaaaggcctttagaagaggtcaccagcttactgtacatcagagagttcacactggtaaaaagccatatgagtgtaaagaatgtgggaagggctataccactgcctcatactttcttctacatcagagaattcataaaggtggaaaaccctatgaatgtaaggagtgtaagaaaacctttactttgtatagaaatcttactcggcatcagaatattcatactggtgagaaactttttgaatgcaagcaatgtgggaagacctatactactggttcaaaactctttcaacatcagaaaactcatactggcgagaaaccctatgaatgcaaggaatgcggaaaggcctttagcttgtatggctaccttaaacaacatcagaaaattcatactggcatgaaacactttgaatgtaaggagtgtaaaaaaacctttactttgtatagaaatcttactcgacatcagaatattcacactggtaagaaactttttgaatgtcaggaatgtgggaaggcctatagtactggctcaaaccttattcaacatcggaaaactcatactggtgagaaaccctataaatgtaaggaatgtggcaagacctttagcttgcatggatatcttaatcaacatcagaaaattcatactggtatgaaaccctatgaatgtaaggtatgtagaaaaacctttactttctatagaaatcttactctacatcaaagtattcatactgatgagaaaccttttgaatgtaaggaatgtgggaagacctttagacgtagttcacaccttactgcacatcagagcattcatgctgataaaaaaccctatgaatgtaaagaatgtggaaaggcctttaaaatgtatggctaccttacccaacatcagaaaattcatactggtggaaaaccttatgaatgtaaagaatgtgggaaggccttcagtcgtgcttcaaaccttgttcaacatgagagaattcatactggtgagaaaccctatgtgtgtaagcagtgtgggaaaaccttcagatatggttcagcccttaaagcccatcagagaattcataggagcataaaagtgtaagaccgtaaagagtacgagcgcgccattcatcatcagacagcccacactggtgagaaatgatggaatgttagtcttataggtatggctttagcaattgagagagttcaaaatgcagatcttgccacattagaaagcattcaatgtcagtcctgttttaatggaatatctgactattcaatggtaaattaag

SEQ ID NO: 3312 - DNA, 1734 bp, Homo sapiens
tttattttaagaacatcctcttttgtttcagatttggatttacagtgtgagataatcagctacatagaagtacccacttatgaaacagatatatcctctacacaacttcagagcatatataagagagagaaactctatgaatgtaagaaatgtcagaagaaatttagtagtggttatcaacttattctacatcacaggtttcatgtcattgagagaccctatgaatgcaaagagtgtgggaagaactttcgtagtggctatcaacttactctacatcaaagatttcatactggtgagaaaccctatgaatgtacagaatgtgggaagaactttagaagtggttatcagctgactgtgcatcagagatttcatactggtgagaaaacctatgaatgtaggcagtgtgggaaggcctttatatatgcctcacacattgttcaacatgagagaattcacactggtgggaagccgtatgaatgtcaggagtgtgggagggcctttagtcaaggtggacatcttagaattcatcagagagttcatactggcgaaaaaccatataaatgtaaggaatgtgggaagacttttagtaggcgctcaaatcttgttgaacatgggcagtttcatactgatgagaagccatacatatgtgagaaatgtggaaaggcctttagaagaggtcaccagcttactgtacatcagagagttcacactggtaaaaagccatatgagtgtaaagaatgtgggaagggctataccactgcctcatactttcttctacatcagagaattcataaaggtggaaaaccctatgaatgtaaggagtgtaagaaaacctttactttgtatagaaatcttactcggcatcagaatattcatactggtgagaaactttttgaatgcaagcaatgtgggaagacctatactactggttcaaaactctttcaacatcagaaaactcatactggcgagaaaccctatgaatgcaaggaatgcggaaaggcctttagcttgtatggctaccttaaacaacatcagaaaattcatactggcatgaaacactttgaatgtaaggagtgtaaaaaaacctttactttgtatagaaatcttactcgacatcagaatattcacactggtaagaaactttttgaatgtcaggaatgtgggaaggcctatagtactggctcaaaccttattcaacatcggaaaactcatactggtgagaaaccctataaatgtaaggaatgtggcaagacctttagcttgcatggatatcttaatcaacatcagaaaattcatactggtatgaaaccctatgaatgtaaggtatgtagaaaaacctttactttctatagaaatcttactctacatcaaagtattcatactgatgagaaaccttttgaatgtaaggaatgtgggaagacctttagacgtagttcacaccttactgcacatcagagcattcatgctgataaaaaaccctatgaatgtaaagaatgtggaaaggcctttaaaatgtatggctaccttacccaacatcagaaaattcatactggtggaaaaccttatgaatgtaaagaatgtgggaaggccttcagtcgtgcttcaaaccttgttcaacatgagagaattcatactggtgagaaaccctatgtgtgtaagcagtgtgggaaaaccttcagatatggttcagcccttaaagcccatcagagaattcataggagcataaaagtgtaa

SEQ ID NO: 3313 - DNA, 2448 bp, Homo sapiens
acccaatctatggcttcccttccgttttcgcgtggttcttttgcaagctctggattctctggagtttgaatgtttccagtattggaaccccaccaagtaggactgatcaggtcttacaattctaaaaccatgacctgttttcaggaattagtgacattcagggatgtggccatagacttctctcggcaggagtgggaatacctggaccctaatcagagggacttatacagggatgtgatgttggagaactatagaaacctggtatcactggagatgaggtctcgctctgttgcccgggttggtctcaaactcctggtctcaagtgatcctcccacctcggccttccaaaatgctgggattataggcgtgagccaccatgcctagccaatagtagtattattatgtccagtttatttgccaaattggaataatgagttgaagtcacatggccaaagtcacaaggaggacattccatttctaaaccagttgtggttgatttactggagcgaggaaaagagccctggatgattttgagggaagaaacacagttcacagatttggatttacagtgtgagataatcagctacatagaagtacccacttatgaaacagatatatcctctacacaacttcagagcatatataagagagagaaactctatgaatgtaagaaatgtcagaagaaatttagtagtggttatcaacttattctacatcacaggtttcatgtcattgagagaccctatgaatgcaaagagtgtgggaagaactttcgtagtggctatcaacttactctacatcaaagatttcatactggtgagaaaccctatgaatgtacagaatgtgggaagaactttagaagtggttatcagctgactgtgcatcagagatttcatactggtgagaaaacctatgaatgtaggcagtgtgggaaggcctttatatatgcctcacacattgttcaacatgagagaattcacactggtgggaagccgtatgaatgtcaggagtgtgggagggcctttagtcaaggtggacatcttagaattcatcagagagttcatactggcgaaaaaccatataaatgtaaggaatgtgggaagacttttagtaggcgctcaaatcttgttgaacatgggcagtttcatactgatgagaagccatacatatgtgagaaatgtggaaaggcctttagaagaggtcaccagcttactgtacatcagagagttcacactggtaaaaagccatatgagtgtaaagaatgtgggaagggctataccactgcctcatactttcttctacatcagagaattcataaaggtggaaaaccctatgaatgtaaggagtgtaagaaaacctttactttgtatagaaatcttactcggcatcagaatattcatactggtgagaaactttttgaatgcaagcaatgtgggaagacctatactactggttcaaaactctttcaacatcagaaaactcatactggcgagaaaccctatgaatgcaaggaatgcggaaaggcctttagcttgtatggctaccttaaacaacatcagaaaattcatactggcatgaaacactttgaatgtaaggagtgtaaaaaaacctttactttgtatagaaatcttactcgacatcagaatattcacactggtaagaaactttttgaatgtcaggaatgtgggaaggcctatagtactggctcaaaccttattcaacatcggaaaactcatactggtgagaaaccctataaatgtaaggaatgtggcaagacctttagcttgcatggatatcttaatcaacatcagaaaattcatactggtatgaaaccctatgaatgtaaggtatgtagaaaaacctttactttctatagaaatcttactctacatcaaagtattcatactgatgagaaaccttttgaatgtaaggaatgtgggaagacctttagacgtagttcacaccttactgcacatcagagcattcatgctgataaaaaaccctatgaatgtaaagaatgtggaaaggcctttaaaatgtatggctaccttacccaacatcagaaaattcatactggtggaaaaccttatgaatgtaaagaatgtgggaaggccttcagtcgtgcttcaaaccttgttcaacatgagagaattcatactggtgagaaaccctatgtgtgtaagcagtgtgggaaaaccttcagatatggttcagcccttaaagcccatcagagaattcataggagcataaaagtgtaagaccgtaaagagtacgagcgcgccattcatcatcagacagcccacactggtgagaaatgatggaatgttagtcttataggtatggctttagcaattgagagagttcaaaatgcagatcttgccacattagaaagcattcaatgtcagtcctgttttaatggaatatctgactattcaatggtaaattaag

SEQ ID NO: 3314 - DNA, 2226 bp, Homo sapiens
gctctggattctctggagtttgaatgtttccagtattggaaccccaccaagtaggactgatcaggtcttacaattctaaaaccatgacctgttttcaggaattagtgacattcagggatgtggccatagacttctctcggcaggagtgggaatacctggaccctaatcagagggacttatacagggatgtgatgttggagaactatagaaacctggtatcactgggaggacattccatttctaaaccagttgtggttgatttactggagcgaggaaaagagccctggatgattttgagggaagaaacacagttcacagatttggatttacagtgtgagataatcagctacatagaagtacccacttatgaaacagatatatcctctacacaacttcagagcatatataagagagagaaactctatgaatgtaagaaatgtcagaagaaatttagtagtggttatcaacttattctacatcacaggtttcatgtcattgagagaccctatgaatgcaaagagtgtgggaagaactttcgtagtggctatcaacttactctacatcaaagatttcatactggtgagaaaccctatgaatgtacagaatgtgggaagaactttagaagtggttatcagctgactgtgcatcagagatttcatactggtgagaaaacctatgaatgtaggcagtgtgggaaggcctttatatatgcctcacacattgttcaacatgagagaattcacactggtgggaagccgtatgaatgtcaggagtgtgggagggcctttagtcaaggtggacatcttagaattcatcagagagttcatactggcgaaaaaccatataaatgtaaggaatgtgggaagacttttagtaggcgctcaaatcttgttgaacatgggcagtttcatactgatgagaagccatacatatgtgagaaatgtggaaaggcctttagaagaggtcaccagcttactgtacatcagagagttcacactggtaaaaagccatatgagtgtaaagaatgtgggaagggctataccactgcctcatactttcttctacatcagagaattcataaaggtggaaaaccctatgaatgtaaggagtgtaagaaaacctttactttgtatagaaatcttactcggcatcagaatattcatactggtgagaaactttttgaatgcaagcaatgtgggaagacctatactactggttcaaaactctttcaacatcagaaaactcatactggcgagaaaccctatgaatgcaaggaatgcggaaaggcctttagcttgtatggctaccttaaacaacatcagaaaattcatactggcatgaaacactttgaatgtaaggagtgtaaaaaaacctttactttgtatagaaatcttactcgacatcagaatattcacactggtaagaaactttttgaatgtcaggaatgtgggaaggcctatagtactggctcaaaccttattcaacatcggaaaactcatactggtgagaaaccctataaatgtaaggaatgtggcaagacctttagcttgcatggatatcttaatcaacatcagaaaattcatactggtatgaaaccctatgaatgtaaggtatgtagaaaaacctttactttctatagaaatcttactctacatcaaagtattcatactgatgagaaaccttttgaatgtaaggaatgtgggaagacctttagacgtagttcacaccttactgcacatcagagcattcatgctgataaaaaaccctatgaatgtaaagaatgtggaaaggcctttaaaatgtatggctaccttacccaacatcagaaaattcatactggtggaaaaccttatgaatgtaaagaatgtgggaaggccttcagtcgtgcttcaaaccttgttcaacatgagagaattcatactggtgagaaaccctatgtgtgtaagcagtgtgggaaaaccttcagatatggttcagcccttaaagcccatcagagaattcataggagcataaaagtgtaagaccgtaaagagtacgagcgcgccattcatcatcagacagcccacactggtgagaaatgatggaatgttagtcttataggtatggctttagcaattgagagagttcaaaatgcagatcttgccacattagaaagcattcaatgtcagtcctgttttaatggaatatctgactattcaatggtaaattaagaaaaaaaaaaaaaaa

SEQ ID NO: 3315 - DNA, 3229 bp, Homo sapiens
atgccgagagcaacctgggctaacagcaaagagagaagttgggcagagtcagagaggggcccaagagacacaggaaatgggggctcaaaagcggaaagacatatccaggagatagagactggacggggtggggacagggccaaggcccaccgcaggcagaggatgaggctcagaggaacagaaagagccagtctgggaccaggacggaggcttggagacagcaggggcacggacatgccaggggcccgggcccagggccttgctgccgccatgactgaggaatcagaggagacagtcctgtacattgagcaccgctatgtctgctctgagtgcaaccagctgtatggatcactggaagaggtgcttatgcaccaaaactcccacgtgccccagcagcactttgagctggtgggcgtggctgatcccggagtcactgtggccacagacacagcttcaggcacgggcctctatcagacccttgtgcaggagagccagtaccagtgcctggagtgtggtcaactgctgatgtcacccagccagctcctggagcaccaggagctgcacctgaagatgatggcaccccaggaggcagtgccagctgagccatcacctaaggcaccacccctgagctccagcaccatccactacgagtgtgtggattgcaaggctctctttgccagccaggagctctggctgaaccaccggcagacgcacctccgggccacacccaccaaggctcctgcccctgttgtcctggggtccccagttgttctagggcctcctgtgggccaggcccgagtggctgtggagcactcataccgaaaggcagaagagggtggggaaggggcgactgtcccatctgccgctgccaccaccactgaggtagtgactgaggtggagctgctcctctacaagtgctctgagtgctcccagctcttccagctgccggcggatttcctggagcaccaggccactcacttccctgctcctgtacccgagtctcaggagcctgccttacagcaggaggtgcaggcctcgtcacctgcagaggtgcctgtgtctcagcctgaccccttgccagcttctgaccacagttacgagctgcgcaatggtgaagccattgggcgggatcgccgggggcgcagggcccggaggaacaacagtggagaagcaggcggggcagccacacaggagctcttctgctcagcctgtgaccagctctttctctcaccccaccagctacagcagcacctgcggagtcaccgggagggcgtctttaagtgccccctgtgcagtcgtgtcttccctagcccttccagtctggaccagcaccttggagaccatagcagcgagtcacacttcctgtgtgtagactgtggcctggccttcggcacagaggccctcctcctggcccaccggcgagcccacaccccgaatcctctgcattcatgtccatgtgggaagacctttgtcaaccttaccaagttcctttatcaccggcgtactcatggggtagggggtgtccctctgcccacaacaccagtcccaccagaggaacctgtcattggtttccctgagccagccccagcagagactggagagccagaggcccctgagccccctgtgtctgaggagacctcagcagggcccgctgccccaggcacctaccgctgcctcctgtgcagccgtgaatttggaaaggccttgcagctgacccggcaccaacgttttgtgcatcggctggagcggcgccataaatgcagcatttgtggcaagatgttcaagaagaagtctcacgtgcgtaaccacctgcgcacacacacaggggagcggcccttcccctgccctgactgctccaagcccttcaactcacctgccaacctggcccgccaccggctcacacacacaggagagcggccctaccggtgtggggactgtggcaaggctttcacgcaaagctccacactgaggcagcaccgcttggtgcatgcccagcacttcccctaccgctgccaggaatgtggggtgcgttttcaccgtccttaccgcctgctcatgcaccgctaccatcacacaggtgaatacccctacaagtgtcgcgagtgcccccgctccttcttgctgcgtcggctgctggaggtgcaccagctcgtggtccatgccgggcgccagccccaccgctgcccatcctgtggggctgccttcccctcctcactgcggctccgggagcaccgctgtgcagccgctgctgcccaggccccacggcgctttgagtgtggcacctgtggcaagaaagtgggctcagctgctcgactgcaggcacacgaggcggcccatgcagctgctgggcctggagaggtcctggctaaggagccccctgcccctcgagccccacgggccactcgtgcaccagttgcctctccagcagcccttggaagcactgctacagcatcccctgcggcccctgcccgccgccggggtctagagtgcagcgagtgcaagaagctgttcagcacagagacgtcactgcaggtgcaccggcgcatccacacaggtgagcggccatacccatgtccagactgtggcaaagcgttccgtcagagtacccacctgaaagaccaccggcgcctgcacacaggtgagcggccctttgcctgtgaagtgtgtggcaaggcctttgccatctccatgcgcctggcagaacatcgccgcatccacacaggcgaacgaccctactcctgccctgactgtggcaagagctaccgctccttctccaacctctggaagcaccgcaagacccatcagcagcagcatcaggcagctgtgcggcagcagctggcagaggcggaggctgccgttggcctggccgtcatggagactgctgtggaggcgctacccctggtggaagccattgagatctaccctctggccgaggctgagggggtccagatcagtggctgactctgcccgacttcctctttggcacctccattccctgttgctgaaggccctccagcatccccttaagcatctgtacatactgtgtcccttcctcttcccatccccaccaccttgtaagttctaaattggatttattctctcgtgaggggggtgctctggggtccttgacacacataaaggtgcccccccaccttccacctcttagcactggtgaccccaaaaatgaaaccatcaataaagactgagttgccagcagtgtgtagagtgg

SEQ ID NO: 3316 - DNA, 3128 bp, Homo sapiens
aggggcgttgctgagggtagctgggggcgagagcgaggctacggagcaggcgagaggcgacggcgagagctagagcgggcgcagcgttagggtggccgtgcaaggggagccgtggcccgggcccggggcgtgcgagacggcggaagcagcccagggccttgctgccgccatgactgaggaatcagaggagacagtcctgtacattgagcaccgctatgtctgctctgagtgcaaccagctgtatggatcactggaagaggtgcttatgcaccaaaactcccacgtgccccagcagcactttgagctggtgggcgtggctgatcccggagtcactgtggccacagacacagcttcaggcacgggcctctatcagacccttgtgcaggagagccagtaccagtgcctggagtgtggtcaactgctgatgtcacccagccagctcctggagcaccaggagctgcacctgaagatgatggcaccccaggaggcagtgccagctgagccatcacctaaggcaccacccctgagctccagcaccatccactacgagtgtgtggattgcaaggctctctttgccagccaggagctctggctgaaccaccggcagacgcacctccgggccacacccaccaaggctcctgcccctgttgtcctggggtccccagttgttctagggcctcctgtgggccaggcccgagtggctgtggagcactcataccgaaaggcagaagagggtggggaaggggcgactgtcccatctgccgctgccaccaccactgaggtagtgactgaggtggagctgctcctctacaagtgctctgagtgctcccagctcttccagctgccggcggatttcctggagcaccaggccactcacttccctgctcctgtacccgagtctcaggagcctgccttacagcaggaggtgcaggcctcgtcacctgcagaggtgcctgtgtctcagcctgaccccttgccagcttctgaccacagttacgagctgcgcaatggtgaagccattgggcgggatcgccgggggcgcagggcccggaggaacaacagtggagaagcaggcggggcagccacacaggagctcttctgctcagcctgtgaccagctctttctctcaccccaccagctacagcagcacctgcggagtcaccgggagggcgtctttaagtgccccctgtgcagtcgtgtcttccctagcccttccagtctggaccagcaccttggagaccatagcagcgagtcacacttcctgtgtgtagactgtggcctggccttcggcacagaggccctcctcctggcccaccggcgagcccacaccccgaatcctctgcattcatgtccatgtgggaagacctttgtcaaccttaccaagttcctttatcaccggcgtactcatggggtagggggtgtccctctgcccacaacaccagtcccaccagaggaacctgtcattggtttccctgagccagccccagcagagactggagagccagaggcccctgagccccctgtgtctgaggagacctcagcagggcccgctgccccaggcacctaccgctgcctcctgtgcagccgtgaatttggaaaggccttgcagctgacccggcaccaacgttttgtgcatcggctggagcggcgccataaatgcagcatttgtggcaagatgttcaagaagaagtctcacgtgcgtaaccacctgcgcacacacacaggggagcggcccttcccctgccctgactgctccaagcccttcaactcacctgccaacctggcccgccaccggctcacacacacaggagagcggccctaccggtgtggggactgtggcaaggctttcacgcaaagctccacactgaggcagcaccgcttggtgcatgcccagcacttcccctaccgctgccaggaatgtggggtgcgttttcaccgtccttaccgcctgctcatgcaccgctaccatcacacaggtgaatacccctacaagtgtcgcgagtgcccccgctccttcttgctgcgtcggctgctggaggtgcaccagctcgtggtccatgccgggcgccagccccaccgctgcccatcctgtggggctgccttcccctcctcactgcggctccgggagcaccgctgtgcagccgctgctgcccaggccccacggcgctttgagtgtggcacctgtggcaagaaagtgggctcagctgctcgactgcaggcacacgaggcggcccatgcagctgctgggcctggagaggtcctggctaaggagccccctgcccctcgagccccacgggccactcgtgcaccagttgcctctccagcagcccttggaagcactgctacagcatcccctgcggcccctgcccgccgccggggtctagagtgcagcgagtgcaagaagctgttcagcacagagacgtcactgcaggtgcaccggcgcatccacacaggtgagcggccatacccatgtccagactgtggcaaagcgttccgtcagagtacccacctgaaagaccaccggcgcctgcacacaggtgagcggccctttgcctgtgaagtgtgtggcaaggcctttgccatctccatgcgcctggcagaacatcgccgcatccacacaggcgaacgaccctactcctgccctgactgtggcaagagctaccgctccttctccaacctctggaagcaccgcaagacccatcagcagcagcatcaggcagctgtgcggcagcagctggcagaggcggaggctgccgttggcctggccgtcatggagactgctgtggaggcgctacccctggtggaagccattgagatctaccctctggccgaggctgagggggtccagatcagtggctgactctgcccgacttcctctttggcacctccattccctgttgctgaaggccctccagcatccccttaagcatctgtacatactgtgtcccttcctcttcccatccccaccaccttgtaagttctaaattggatttattctctcgtgaggggggtgctctggggtccttgacacacataaaggtgcccccccaccttccacctcttagcactggtgaccccaaaaatgaaaccatcaataaagactgagttgccagcagtgtgtagagtgg

SEQ ID NO: 3317 - DNA, 3070 bp, Homo sapiens
gcgacggcgagagctagagcgggcgcagcgttagggtggccgtgcaaggggagccgtggcccgggcccggggcgtgcgagacggcggaagcagcccagggccttgctgccgccatgactgaggaatcagaggagacagtcctgtacattgagcaccgctatgtctgctctgagtgcaaccagctgtatggatcactggaagaggtgcttatgcaccaaaactcccacgtgccccagcagcactttgagctggtgggcgtggctgatcccggagtcactgtggccacagacacagcttcaggcacgggcctctatcagacccttgtgcaggagagccagtaccagtgcctggagtgtggtcaactgctgatgtcacccagccagctcctggagcaccaggagctgcacctgaagatgatggcaccccaggaggcagtgccagctgagccatcacctaaggcaccacccctgagctccagcaccatccactacgagtgtgtggattgcaaggctctctttgccagccaggagctctggctgaaccaccggcagacgcacctccgggccacacccaccaaggctcctgcccctgttgtcctggggtccccagttgttctagggcctcctgtgggccaggcccgagtggctgtggagcactcataccgaaaggcagaagagggtggggaaggggcgactgtcccatctgccgctgccaccaccactgaggtagtgactgaggtggagctgctcctctacaagtgctctgagtgctcccagctcttccagctgccggcggatttcctggagcaccaggccactcacttccctgctcctgtacccgagtctcaggagcctgccttacagcaggaggtgcaggcctcgtcacctgcagaggtgcctgtgtctcagcctgaccccttgccagcttctgaccacagttacgagctgcgcaatggtgaagccattgggcgggatcgccgggggcgcagggcccggaggaacaacagtggagaagcaggcggggcagccacacaggagctcttctgctcagcctgtgaccagctctttctctcaccccaccagctacagcagcacctgcggagtcaccgggagggcgtctttaagtgccccctgtgcagtcgtgtcttccctagcccttccagtctggaccagcaccttggagaccatagcagcgagtcacacttcctgtgtgtagactgtggcctggccttcggcacagaggccctcctcctggcccaccggcgagcccacaccccgaatcctctgcattcatgtccatgtgggaagacctttgtcaaccttaccaagttcctttatcaccggcgtactcatggggtagggggtgtcccctgcccacaacaccagtcccaccagaggaacctgtcattggtttccctgagccagccccagcagagactggagagccagaggcccctgagccccctgtgtctgaggagacctcagcagggcccgctgccccaggcacctaccgctgcctcctgtgcagccgtgaatttggaaaggccttgcagctgacccggcaccaacgttttgtgcatcggctggagcggcgccataaatgcagcatttgtggcaagatgttcaagaagaagtctcacgtgcgtaaccacctgcgcacacacacaggggagcggcccttcccctgccctgactgctccaagcccttcaactcacctgccaacctggcccgccaccggctcacacacacaggagagcggccctaccggtgtggggactgtggcaaggctttcacgcaaagctccacactgaggcagcaccgcttggtgcatgcccagcacttcccctaccgctgccaggaatgtggggtgcgttttcaccgtccttaccgcctgctcatgcaccgctaccatcacacaggtgaatacccctacaagtgtcgcgagtgcccccgctccttcttgctgcgtcggctgctggaggtgcaccagctcgtggtccatgccgggcgccagccccaccgctgcccatcctgtggggctgccttcccctcctcactgcggctccgggagcaccgctgtgcagccgctgctgcccaggccccacggcgctttgagtgtggcacctgtggcaagaaagtgggctcagctgctcgactgcaggcacacgaggcggcccatgcagctgctgggcctggagaggtcctggctaaggagccccctgcccctcgagccccacgggccactcgtgcaccagttgcctctccagcagcccttggaagcactgctacagcatcccctgcggcccctgcccgccgccggggtctagagtgcagcgagtgcaagaagctgttcagcacagagacgtcactgcaggtgcaccggcgcatccacacaggtgagcggccatacccatgtccagactgtggcaaagcgttccgtcagagtacccacctgaaagacaccggcgcctgcacacaggtgagcggccctttgcctgtgaagtgtgtggcaaggcctttgccatctccatgcgcctggcagaacatcgccgcatccacacaggcgaacgaccctactcctgccctgactgtggcaagagctaccgctccttctccaacctctggaagcaccgcaagacccatcagcagcagcatcaggcagctgtgcggcagcagctggcagaggcggaggctgccgttggcctggccgtcatggagactgctgtggaggcgctacccctggtggaagccattgagatctaccctctggccgaggctgagggggtccagatcagtggctgactctgcccgacttcctctttggcacctccattccctgttgctgaaggccctccagcatccccttaagcatctgtacatactgtgtcccttcctcttcccatccccaccaccttgtaagttctaaattggatttattctctcgtgaggggggtgctctggggtccttgacacacataaaggtgcccccccaccttccacctcttagcactggtgaccccaaaaatgaaaccatcaataaagactgagttgccagcagtgtgtagagtgg

SEQ ID NO: 3318 - DNA, 3598 bp, Homo sapiens
gatgagaagaaggagctgcattggatggaaggcccacccccgagccaccccctctaccacaccatgccaccgccctgcccaggcagccctgggcacaggagcccacagagatgagaggcaagaagacccagggagaaggccactgagatgaggggagagggctacagagatgaagagaaatgaagagaagagagacagccgtcaagactgtccagagaagtgggctgaggcccacaaaccccacaaggacaaggacaggaaaagcccagggataagaaagaaaggcccatggagacaagggagcagcctacagagacaagcaaaaggacctcggagacaaggggcagtaatgtggacatagagacctcccgcgaaggaaaacgggagaagccagagacacaagagagaggcccctggaaacagaaagcactcctcagatatggggagcggtccacagggcagggagagagccaaggagagccgaagaaggtcacagaaacaagggaggcctacagacaccagggtaccaaaaagacaaggatgtggctcatagacacaagagagccactgaggcaggagctgccagcctggagatgcggggcaagcctcccccaatataaatagctcctatagagcccagggccttgctgccgccatgactgaggaatcagaggagacagtcctgtacattgagcaccgctatgtctgctctgagtgcaaccagctgtatggatcactggaagaggtgcttatgcaccaaaactcccacgtgccccagcagcactttgagctggtgggcgtggctgatcccggagtcactgtggccacagacacagcttcaggcacgggcctctatcagacccttgtgcaggagagccagtaccagtgcctggagtgtggtcaactgctgatgtcacccagccagctcctggagcaccaggagctgcacctgaagatgatggcaccccaggaggcagtgccagctgagccatcacctaaggcaccacccctgagctccagcaccatccactacgagtgtgtggattgcaaggctctctttgccagccaggagctctggctgaaccaccggcagacgcacctccgggccacacccaccaaggctcctgcccctgttgtcctggggtccccagttgttctagggcctcctgtgggccaggcccgagtggctgtggagcactcataccgaaaggcagaagagggtggggaaggggcgactgtcccatctgccgctgccaccaccactgaggtagtgactgaggtggagctgctcctctacaagtgctctgagtgctcccagctcttccagctgccggcggatttcctggagcaccaggccactcacttccctgctcctgtacccgagtctcaggagcctgccttacagcaggaggtgcaggcctcgtcacctgcagaggtgcctgtgtctcagcctgaccccttgccagcttctgaccacagttacgagctgcgcaatggtgaagccattgggcgggatcgccgggggcgcagggcccggaggaacaacagtggagaagcaggcggggcagccacacaggagctcttctgctcagcctgtgaccagctctttctctcaccccaccagctacagcagcacctgcggagtcaccgggagggcgtctttaagtgccccctgtgcagtcgtgtcttccctagcccttccagtctggaccagcaccttggagaccatagcagcgagtcacacttcctgtgtgtagactgtggcctggccttcggcacagaggccctcctcctggcccaccggcgagcccacaccccgaatcctctgcattcatgtccatgtgggaagacctttgtcaaccttaccaagttcctttatcaccggcgtactcatggggtagggggtgtccctctgcccacaacaccagtcccaccagaggaacctgtcattggtttccctgagccagccccagcagagactggagagccagaggcccctgagccccctgtgtctgaggagacctcagcagggcccgctgccccaggcacctaccgctgcctcctgtgcagccgtgaatttggaaaggccttgcagctgacccggcaccaacgttttgtgcatcggctggagcggcgccataaatgcagcatttgtggcaagatgttcaagaagaagtctcacgtgcgtaaccacctgcgcacacacacaggggagcggcccttcccctgccctgactgctccaagcccttcaactcacctgccaacctggcccgccaccggctcacacacacaggagagcggccctaccggtgtggggactgtggcaaggctttcacgcaaagctccacactgaggcagcaccgcttggtgcatgcccagcacttcccctaccgctgccaggaatgtggggtgcgttttcaccgtccttaccgcctgctcatgcaccgctaccatcacacaggtgaatacccctacaagtgtcgcgagtgcccccgctccttcttgctgcgtcggctgctggaggtgcaccagctcgtggtccatgccgggcgccagccccaccgctgcccatcctgtggggctgccttcccctcctcactgcggctccgggagcaccgctgtgcagccgctgctgcccaggccccacggcgctttgagtgtggcacctgtggcaagaaagtgggctcagctgctcgactgcaggcacacgaggcggcccatgcagctgctgggcctggagaggtcctggctaaggagccccctgcccctcgagccccacgggccactcgtgcaccagttgcctctccagcagcccttggaagcactgctacagcatcccctgcggcccctgcccgccgccggggtctagagtgcagcgagtgcaagaagctgttcagcacagagacgtcactgcaggtgcaccggcgcatccacacaggtgagcggccatacccatgtccagactgtggcaaagcgttccgtcagagtacccacctgaaagaccaccggcgcctgcacacaggtgagcggccctttgcctgtgaagtgtgtggcaaggcctttgccatctccatgcgcctggcagaacatcgccgcatccacacaggcgaacgaccctactcctgccctgactgtggcaagagctaccgctccttctccaacctctggaagcaccgcaagacccatcagcagcagcatcaggcagctgtgcggcagcagctggcagaggcggaggctgccgttggcctggccgtcatggagactgctgtggaggcgctacccctggtggaagccattgagatctaccctctggccgaggctgagggggtccagatcagtggctgactctgcccgacttcctctttggcacctccattccctgttgctgaaggccctccagcatccccttaagcatctgtacatactgtgtcccttcctcttcccatccccaccaccttgtaagttctaaattggatttattctctcgtgaggggggtgctctggggtccttgacacacataaaggtgcccccccaccttccacctcttagcactggtgaccccaaaaatgaaaccatcaataaagactgagttgcca

SEQ ID NO: 3319 - DNA, 1709 bp, Homo sapiens
agcttcgcgcttgctcacgaacttgcctgcctggctggcgcacccagcccctccttccattccttcttccccctctctgcagcctctgccagcccgcactgcgcatgctttctgacgccccctttggtccagcgtgggaggaggggatggaaatgaggttgggctaagcagcttgcgcgcgctcccttgcctgccctcccccgacgccggacgcgcgccgggcggggcagctccgctggtccgagggcagtgcagcagcggcgacagcggctgcggccgtggccgtggcgggaggagccggaagccccgcccccggggaggggccgtcctgcaggtcccccctctatcctccacggccccatccaagccagggatgaaatttaacggcaagaagggcgcagttgacgcggcgtcaatgaactgagactaagtcaaaagccgggccctccaaccctatccccatcagcctggtcatcaccggcgtcacccccgccccgcgccctgcccctaggttcctgtgccagcaagatgctggagcgaggcgcggagtccgcggccggggctaccgatcctagtcccactggcaaggaaccagtgaccaaagaagctccccaccagggcccaccgcagaagcccagccagtcagctccagggcccaccgcgtccgcgggctcgcctccccggcctcgccggcggcccccgccccagcgcccgcaccgctgccccgactgtgacaaggccttctcgtacccgtccaagctggccacgcaccgcttagcacacggaggcgcccgaccccacccatgcccagactgccccaaggccttctcctacccctccaagctggcagcccaccgcctcacgcacagcggcgcccgcccgcacccgtgcccacactgcccgaagtcctttggccaccgctccaagctggcggctcacctctggacccacgcacccacccgcccctacccgtgccccgactgccccaagtccttctgctacccttccaagctggcggcccaccgccacacgcaccacgccaccgacgcccgcccctatccttgcccgcattgccccaaggctttctcatttccctccaagctggccgcccatcgcctatgtcacgaccccccaaccgcgcccggcagccaggcgactgcctggcaccgatgctccagctgcggccaggcctttggccagagacgcttactgctccttcatcaacgcagccaccaccaggtggagcacaagggggagagagactgagccctcccttggctcactgtccccttctgccgccagccctagccagtaagaggtgggatttctaagaccgactgtatgagctcgcctcttccagatagctggcagagggcagggcaagggattggccatttatactgggctcgagctcagaagcccgaggaactctttgctcccctgctttggggagatctcaaaccatggacgtggagctgtggtttgacagcgctggctctgcttctccccacacacttacatggcaaaggtaaaaagtctgctactatcgtgggttgatgaggattgtgggcaaacaggctctcttgttaaaagtttaaactggtgtctccactttggccatatgacggtatctaagaaattgaaaatacatacatgcttgtctcaactcttccacttgtaggaatttattctataaactcatgaatgtg

SEQ ID NO: 3320 - DNA, 2285 bp, Homo sapiens
agctgtttccctctctctgagggcaactcccctggccctccctccttcggcctggttgcaattctggccggaaacccgctggtgcctgtggcaaataaagtgaggaaggcaggaacctttagacttcccagtgtgaggcaacggcagggctaggactagggtgaggctgttggtgcaagatttaaggaggcgctcactcacaggtgcggaccctgcacttacaggaccctgagagcgagtgcctccttaaatgttgcactccagggtcctcaccgtccttttcctagtcctgggctccgggttctaagcacccagatgctccttcctcaaacggaggtttccgcaagacaggactgggtctctttccttctcagccctgccctcagaattccagcccctaatcaacttttatggagatgcatgccaggccaaagggctgcccctaagctttaggaaggaaactccttaaatgctgttgacttaggagttccgccagtgccccacctgcccagagcctcttgccccagtgccccacctgggtttatggtgcccccctcccagaaatatgagctcaggggtcagaaacccaggtcctgaggtccctcctccccaaggactcaggatcccaggcccccagtcccctcttcccttaagtttaagaagtccaggccaccaccctcttggggacccagcacccaactcacgaagcgcccgaagcggatggagtctccatcctcaatgtactcaggagttctgggccccagcttcccattccactgacgctgcagcccagccccgctgggatccatgagtttggtccccggactgaccagcatagagcagccgcagccccagctccttgatcagctgggcatcccgaggcgctgtttccaggactgggtcgatcagaacggcctcccgggactctctgtcacccagcagatacggggtatcactctgttgcgcaggctggaatgcagtaacacaatcatagctcattgcagacatgaactcctgggccctccaaccctatccccatcagcctggtcatcaccggcgtcacccccgccccgcgccctgcccctaggttcctgtgccagcaagatgctggagcgaggcgcggagtccgcggccggggctaccgatcctagtcccactggcaaggaaccagtgaccaaagaagctccccaccagggcccaccgcagaagcccagccagtcagctccagggcccaccgcgtccgcgggctcgcctccccggcctcgccggcggcccccgccccagcgcccgcaccgctgccccgactgtgacaaggccttctcgtacccgtccaagctggccacgcaccgcttagcacacggaggcgcccgaccccacccatgcccagactgccccaaggccttctcctacccctccaagctggcagcccaccgcctcacgcacagcggcgcccgcccgcacccgtgcccacactgcccgaagtcctttggccaccgctccaagctggcggctcacctctggacccacgcacccacccgcccctacccgtgccccgactgccccaagtccttctgctacccttccaagctggcggcccaccgccacacgcaccacgccaccgacgcccgcccctatccttgcccgcattgccccaaggctttctcatttccctccaagctggccgcccatcgcctatgtcacgaccccccaaccgcgcccggcagccaggcgactgcctggcaccgatgctccagctgcggccaggcctttggccagagacgcttactgctccttcatcaacgcagccaccaccaggtggagcacaagggggagagagactgagccctcccttggctcactgtccccttctgccgccagccctagccagtaagaggtgggatttctaagaccgactgtatgagctcgcctcttccagatagctggcagagggcagggcaagggattggccatttatactgggctcgagctcagaagcccgaggaactctttgctcccctgctttggggagatctcaaaccatggacgtggagctgtggtttgacagcgctggctctgcttctccccacacacttacatggcaaaggtaaaaagtctgctactatcgtgggttgatgaggattgtgggcaaacaggctctcttgttaaaagtttaaactggtgtctccactttggccatatgacggtatctaagaaattgaaaatacatacatgcttgtctcaactcttccacttgtaggaatttattctataaactcatgaatgtg

SEQ ID NO: 3321 - DNA, 2566 bp, Homo sapiens
cctgggagcaggaacctgtaggcagcgcttgagggtagcgggatagcagctgcaagcgcgcgtgggaggcgggggctctgggcggaacaaaaatcacaggatgtcagaggatgtttcccgggaagaactgggataaaggaagggtcccagcaccatggaggacccgaaccctgaagagaacatgaagcagcaggattcacccaaggagagaagtccccagagcccaggaggcaacatctgccacctgggggccccgaagtgcacccgctgcctcatcaccttcgcagattccaagttccaggagcgtcacatgaagcgggagcacccagcggacttcgtggcccagaagctgcagggggtcctcttcatctgcttcacctgcgcccgctccttcccctcctccaaagccctaatcacccaccagcgcagccacggtccagccgccaagcccaccctgccggttgcaaccactactgcccagcccaccttcccttgtcctgactgtggcaagacctttgggcaggctgtttctctgaggcggcaccgccagatgcatgaggtccgtgcccctcctggcaccttcgcctgcacagagtgcggtcaggactttgctcaggaagcagggctgcatcaacactacattcggcatgcccggggggagctctgagtgcagcttaagcctctccacggtgacgggtggctctgtggctggtaggactcacccatgatatggggtgcaggaactctgggggccctgaaggatttgcttccctcccctgggaaggcagagggctcttaataaagaggacccagaagattcttatttagagcttcagtctttggagcacacagggccttcgtgagacagtgaaatcagataataatgagatcttttgttaaaaaaaaaaaatgggaagggagtgcgggagagaaatggtttgtgtctcccttattcccagttaaatacctagctgcagattgtgccatcacccttcattcttcccagatggatgccatgggctatgggagcaaattgccctggacctttgcctgaatgggggcaggaaaggtgaggtgttgctggcctgtaatgccaccaggtgagttccagatgtggagcaacttgggcttttggggatggggcagcaaagttgggagctggaccccaattgagtgggggtagcaattggagtccttgtgtctcttttccaccccctgccatcctcacttagaggggccatggcactagatggcactagtcccccgataatttatgtctcgttgaaataattttgtatatcattctagtcctgaaatatttttttcatatgtgtaggtgaaatggtatgaataagctaacaggaatagtatctaaaaacagaaaacatccatattaaaatgtctaaacagggagctctggcttttgagtgggaatttccagagaacataagggtgtgggcaggtgggggaactcaggccagagttggcctcgctttgtggggaaactggtttggaatcaaacagagataccttctgtttcgggttttatttggccaacactgggagatttcccattaagatcctattttcagctctcttgaaaggcccaacctaggctgacattgtcagcaggggcaggacagaagttacaacaggctggagggagcagtgggtgtcaccctcaactggagatgagtcccaccaggccagttttacccccttagttacctgccctgcacctgcagacaatggtcgatgccttgcatataatacttatagactctgtttatgttgagggatgtttttaaagcccacaggtgaggtggatgtggtagactgatcactgtctctgtttttagctaggcacacagtagctgaaaagactgcatttcccagattcctttgcagctagatgtggccttgtgactgatttctggctaaattcctgggtagaacagtcaagcttaagaaagggacggctgggcacagtggctcacgcctgtaatcccagcactttgtgaggctgaggccggtggatcacctgaggtcaggagtttgagaccagcctggccaacatggtgaaaccctgtctctaccaaaaatacaaaaattagccgggtgtggtggcatatgcctgtaatcccagctacttgggaggctgaggcaggagaattgcttgaacctgggagacaggttgcagtgagccaagatcgtgccattgcacttcagcctgggtgacagagtgagactgtttaaaaaaaaagaaaagaaagggacataccttttttccaccttcctaactgtaatacggaaatggtatccagccatctcagaccataaggataagagcaacacgtgggaagacagagcaacaagataggagcctgggtctctcgtcaatttcaaggagcacagccaccataccagcccacttccatattgctatctaagaaagaaacttctatcttatttaagccaccattattttgggtctctgtcacatgcaacagaatttacagcctaagacaggggtctgcaaactatggccaactctagcctgctgcct

SEQ ID NO: 3322 - DNA, 1468 bp, Homo sapiens
attttgaggaccgggctggtgcgactatactactgccggatggcaaatccgggatctcggctccgagaggctcatctggcaaaagggcgcggaaaccacgggggccctgagactgagtggtccctatcccacttctctctggggcggcgctgtagccagcggctgacaggcgcagcgaaaggcagccctctgctaagggtcccagcaccatggaggacccgaaccctgaagagaacatgaagcagcaggattcacccaaggagagaagtccccagagcccaggaggcaacatctgccacctgggggccccgaagtgcacccgctgcctcatcaccttcgcagattccaagttccaggagcgtcacatgaagcgggagcacccagcggacttcgtggcccagaagctgcagggggtcctcttcatctgcttcacctgcgcccgctccttcccctcctccaaagccctaatcacccaccagcgcagccacggtccagccgccaagcccaccctgccggttgcaaccactactgcccagcccaccttcccttgtcctgactgtggcaagacctttgggcaggctgtttctctgaggcggcaccgccagatgcatgaggtccgtgcccctcctggcaccttcgcctgcacagagtgcggtcaggactttgctcaggaagcagggctgcatcaacactacattcggcatgcccggggggagctctgagtgcagcttaagcctctccacggtgacgggtggctctgtggctggtaggactcacccatgatatggggtgcaggaactctgggggccctgaaggatttgcttccctcccctgggaaggcagagggctcttaataaagaggacccagaagattcttatttagagcttcagtctttggagcacacagggccttcgtgagacagtgaaatcagataataatgagatcttttgttaaaaaaaaaaaatgggaagggagtgcgggagagaaatggtttgtgtctcccttattcccagttaaatacctagctgcagattgtgccatcacccttcattcttcccagatggatgccatgggctatgggagcaaattgccctggacctttgcctgaatgggggcaggaaaggtgaggtgttgctggcctgtaatgccaccaggtgagttccagatgtggagcaacttgggcttttggggatggggcagcaaagttgggagctggaccccaattgagtgggggtagcaattggagtccttgtgtctcttttccaccccctgccatcctcacttagaggggccatggcactagatggcactagtcccccgataatttatgtctcgttgaaataattttgtatatcattctagtcctgaaatatttttttcatatgtgtaggtgaaatggtatgaataagctaacaggaatagtatctaaaaacagaaaacatccatattaaaatgtctaaacaggga

SEQ ID NO: 3323 - DNA, 2327 bp, Homo sapiens
ctggtgcgactatactactgccggatggcaaatccgggatctcggctccgagaggctcatctggcaaaagggcgcggaaaccacgggggccctgagactgagtggtccctatcccacttctctctggggcggcgctgtagccagcggctgacaggcgcagcgaaaggcagccctctgctgtaaggaggaaaactgaggcctgggagcaggaacctgtaggcagcgcttgagggtagcgggatagcagctgcaagcgcgcgtgggaggcgggggctctgggcggaacaaaaatcacaggatgtcagaggatgtttcccgggaagaactgggataaagggtgggtatcactacctgccccaagacacttgagattgggatgacgctggtgtcaaagatcaaggcttccacgctgagttcagggagttagtttgatgcagcaggtcataggtcacaccagtgagaagactctaggggagtcccaaacccaggaaatccagtcctttgggaggtttgaagcttcttttagcaagaactccatcaattagagttcaaggagatagtatgtcgtaggggtcaaaggcaggcaaggagagcctctggcgatgtcaaaggtcatagacttagggtgccctctaagactggtaacagatgaacagcttcacttatgcacgctcctctcctgactagaagggtcccagcaccatggaggacccgaaccctgaagagaacatgaagcagcaggattcacccaaggagagaagtccccagagcccaggaggcaacatctgccacctgggggccccgaagtgcacccgctgcctcatcaccttcgcagattccaagttccaggagcgtcacatgaagcgggagcacccagcggacttcgtggcccagaagctgcagggggtcctcttcatctgcttcacctgcgcccgctccttcccctcctccaaagccctaatcacccaccagcgcagccacggtccagccgccaagcccaccctgccggttgcaaccactactgcccagcccaccttcccttgtcctgactgtggcaagacctttgggcaggctgtttctctgaggcggcaccgccagatgcatgaggtccgtgcccctcctggcaccttcgcctgcacagagtgcggtcaggactttgctcaggaagcagggctgcatcaacactacattcggcatgcccggggggagctctgagtgcagcttaagcctctccacggtgacgggtggctctgtggctggtaggactcacccatgatatggggtgcaggaactctgggggccctgaaggatttgcttccctcccctgggaaggcagagggctcttaataaagaggacccagaagattcttatttagagcttcagtctttggagcacacagggccttcgtgagacagtgaaatcagataataatgagatcttttgttaaaaaaaaaaaatgggaagggagtgcgggagagaaatggtttgtgtctcccttattcccagttaaatacctagctgcagattgtgccatcacccttcattcttcccagatggatgccatgggctatgggagcaaattgccctggacctttgcctgaatgggggcaggaaaggtgaggtgttgctggcctgtaatgccaccaggtgagttccagatgtggagcaacttgggcttttggggatggggcagcaaagttgggagctggaccccaattgagtgggggtagcaattggagtccttgtgtctcttttccaccccctgccatcctcacttagaggggccatggcactagatggcactagtcccccgataatttatgtctcgttgaaataattttgtatatcattctagtcctgaaatatttttttcatatgtgtaggtgaaatggtatgaataagctaacaggaatagtatctaaaaacagaaaacatccatattaaaatgtctaaacagggagctctggcttttgagtgggaatttccagagaacataagggtgtgggcaggtgggggaactcaggccagagttggcctcgctttgtggggaaactggtttggaatcaaacagagataccttctgtttcgggttttatttggccaacactgggagatttcccattaagatcctattttcagctctcttgaaaggcccaacctaggctgacattgtcagcaggggcaggacagaagttacaacaggctggagggagcagtgggtgtcaccctcaactggagatgagtcccaccaggccagttttacccccttagttacctgccctgcacctgcagacaatggtcgatgccttgcatataatacttatag

SEQ ID NO: 3324 - DNA, 859 bp, Homo sapiens
agccctctgctgtaaggaggaaaactgaggcctgggagcaggaacctgtaggcagcgcttgaggaagggtcccagcaccatggaggacccgaaccctgaagagaacatgaagcagcaggattcacccaaggagagaagtccccagagcccaggaggcaacatctgccacctgggggccccgaagtgcacccgctgcctcatcaccttcgcagattccaagttccaggagcgtcacatgaagcgggagcacccagcggacttcgtggcccagaagctgcagggggtcctcttcatctgcttcacctgcgcccgctccttcccctcctccaaagccctaatcacccaccagcgcagccacggtccagccgccaagcccaccctgccggttgcaaccactactgcccagcccaccttcccttgtcctgactgtggcaagacctttgggcaggctgtttctctgaggcggcaccgccagatgcatgaggtccgtgcccctcctggcaccttcgcctgcacagagtgcggtcaggactttgctcaggaagcagggctgcatcaacactacattcggcatgcccggggggagctctgagtgcagcttaagcctctccacggtgacgggtggctctgtggctggtaggactcacccatgatatggggtgcaggaactctgggggccctgaaggatttgcttccctcccctgggaaggcagagggctcttaataaagaggacccagaagattcttatttagagcttcagtctttggagcacacagggccttcgtgagacagtgaaatcagataataatgagatcttttgttaaaaaaaaaaaatgggaagggagtgcgggagagaaa

SEQ ID NO: 3325 - DNA, 830 bp, Homo sapiens
aaaactgaggcctgggagcaggaacctgtaggcagcgcttgagggtagcgggatagcagctgcaagcgcgcgtgggaggcgggggctctgggcggaacaaaaatcacaggatgtcagaggatgtttcccgggaagaactgggataaaggggtcccagcaccatggaggacccgaaccctgaagagaacatgaagcagcaggattcacccaaggagagaagtccccagagcccaggaggcaacatctgccacctgggggccccgaagtgcacccgctgcctcatcaccttcgcagattccaagttccaggagcgtcacatgaagcgggagcacccagcggacttcgtggcccagaagctgcagggggtcctcttcatctgcttcacctgcgcccgctccttcccctcctccaaagccctaatcacccaccagcgcagccacggtccagccgccaagcccaccctgccggttgcaaccactactgcccagcccaccttcccttgtcctgactgtggcaagacctttgggcaggctgtttctctgaggcggcaccgccagatgcatgaggtccgtgcccctcctggcaccttcgcctgcacagagtgcggtcaggactttgctcaggaagcagggctgcatcaacactacattcggcatgcccggggggagctctgagtgcagcttaagcctctccacggtgacgggtggctctgtggctggtaggactcacccatgatatggggtgcaggaactctgggggccctgaaggatttgcttccctcccctgggaaggcagagggctcttaataaagaggacccagaagattctta

SEQ ID NO: 3326 - DNA, 867 bp, Homo sapiens
gcggaaaccacgggggccctgagactgagtggtccctatcccacttctctctggggcggcgctgtagccagcggctgacaggcgcagcgaaaggcagccctctgctggtcccagcaccatggaggacccgaaccctgaagagaacatgaagcagcaggattcacccaaggagagaagtccccagagcccaggaggcaacatctgccacctgggggccccgaagtgcacccgctgcctcatcaccttcgcagattccaagttccaggagcgtcacatgaagcgggagcacccagcggacttcgtggcccagaagctgcagggggtcctcttcatctgcttcacctgcgcccgctccttcccctcctccaaagccctaatcacccaccagcgcagccacggtccagccgccaagcccaccctgccggttgcaaccactactgcccagcccaccttcccttgtcctgactgtggcaagacctttgggcaggctgtttctctgaggcggcaccgccagatgcatgaggtccgtgcccctcctggcaccttcgcctgcacagagtgcggtcaggactttgctcaggaagcagggctgcatcaacactacattcggcatgcccggggggagctctgagtgcagcttaagcctctccacggtgacgggtggctctgtggctggtaggactcacccatgatatggggtgcaggaactctgggggccctgaaggatttgcttccctcccctgggaaggcagagggctcttaataaagaggacccagaagattcttatttagagcttcagtctttggagcacacagggccttcgtgagacagtgaaatcagataataatgagatcttttgttaaaaa

SEQ ID NO: 3327 - DNA, 3074 bp, Homo sapiens
gaaacttgcgagtgtcgcgtctgcagtgtgtggggttcgcggggcggcgggtagagttgagcatttttgtcatctgcaaataattttagccaggtggcaagtgtatggactgtggagtaagaagtacctgcctctgcctctgacttgggttctggcctataggaacaagacattttcagtaatggaagaaggagcttccaggctggggaagatcatcatttccagtggtagcttgacctgagatgatacctgaccaccacttctgggaaggcccagaatagacagaagagagagaacatactagagttgctagcccctaagagttgaacgaaatgggcaaggcccagctgaaataacaggaaacacatgaaaaatgccacgattgtaatgtctgtgaggagagagcaaggcagttcttcaggggaggggtcattgtcattcgaagatgtggctgtgggcttcaccagggaggagtggcagtttttggaccagtctcagaaggtcttgtacaaggaagtaatgttggagaactacatcaacctagtatcaatagggtatcgaggcaccaagccagattcgctcttcaagttggagcaaggagaacccccagggatagcagaaggagcagcccacagtcaaatctgtccaggttttgtaatccagagtagaagatatgcaggaaaagattctgatgcatttggtggatatgggagatcatgcctccatatcaagcgtgacaaaactcttactggagttaaataccatagatgtgttaaacccagcagccctaaatcacagctcaatgacctacaaaaaatttgtgcaggagggaaaccacatgaatgcagtgtgtgcgggagagccttctccaggaaagcacagcttattcaacatcagagaactgaaagaggagagaaaccccatggatgtggtgaatgtgggaaaacattcatgaggaagattcagctcactgagcatcagagaactcacacaggagagaagccccatgaatgtagtgaatgtggaaaagccttctccagaaagtcacagctcatggtccatcagagaacccatacaggagagaaaccctacagatgcagcaaatgcggaaaagccttcagccggaagtgccggctcaatagacatcagcgatcacatactggagagaaactctatgggtgcagtgtgtgtgggaaagccttttctcagaaggcatacctcactgcacaccagagacttcacacaggagataagccttataaatgcagtgattgtggaagaaccttctattttaagtcagacctgaccagacatcagaggattcatacgggagagaaaccttatgaatgtagtgagtgtgaaaaagcctttagaagcaagtcgaagctcattcagcatcagcgtactcacactggagagagaccatattcatgcagagaatgtggcaaagcctttgcccacatgtcagtcctcattaaacatgagaaaactcacataagagagacagccataaattcactgacggtggagaaaccttcctcaaggagtcatacctccttatacatgagcgaactcatacaagagcaaaagactgtgaacacagtacctatagaaatgccttcctcaggaaccccgccattgttaaacaagagtgagcgcctagtgggcagaaatgtagtgattgtggaacaaccttttccaagaaatcaagcctttgtagttaatcaggaatttgaacagagaataagcctcacaaatgaagtgaatgtggccccatcagtaataaattatatcttgtatcttacagatattgtatcagaataaatcttctgataccagaaaggtgggaaaatctttagtaggaatcctccagccattatatcccagagagctcatttagggctgaaacactgtggaggcagtggttgtggaggacatttctgtgagaagtcaaacctgttaaacaccattgaaatcatgttgggtagaaatgcagctgttatgaggaagtctttacctggagatgatatctcaattggtatcaaaagaattcttacaggaatatttatgaaagattgtgatggtgcttttagcgctaaattgtgcctcgtgtgccaaagaaacatagacaactgtagaggcaatggatatggaaaacatttttcgtaaaatatgggagaatttgtagaaaagaaaaactcttgaaagtaagaaatgatggcaactcaccaaattaactcatgtatcatacttttatgtcttgagagtcttggagggacgtgtttaatgaaatcttgaaccccaggaatagtattatgtaatgaaaacctatgaatataacaaatatggaagtaaaattgtgttagttttttatgagtgttgcaccaaactaacacaaatttaatggcttaaaacaacacaaaatcattatcttacagttctggaggactgaagtccaaatgcatctcacggggctacatcaagctgttgacagggctgcttttctttttggaggctctaggggagcgtctttctttgcccttccagcttctagaagctgcccaaattctgtggtttggggcctcctttcaaaaccagcaatggccaatcagtcttacatcactcaaacacttgagtgttctgtctccctcttccatgtttgaggacccttgtgattacactgtgaaaacccagataagccaggataatctccctatcttattatgaggcaagtatgttaagattttattctataatcagagaatcttatgctatgattgttatatgtgagcattatagatgctcttgaaatgttaaaatcacatcagcactggaaaataactcctaaatgtccaaaaagaacatgagatttatggtgcttgaaatgttgctaaacgtaaatttgtatctattctgaaattatataaattaacctacctggccaggcacagtggctcacacctgtaatctcagcactttgggaggccaaggcaggaagatcacttgagcccgcaagtttgagaccaccctgggcaacatagcgagactacctctacaaaaaaaaaaaaaaataa

SEQ ID NO: 3328 - DNA, 512 bp, Homo sapiens
atggccctcgccggccgccatccccgaaacttgcgagtgtcgcgtctgcagtgtgtggggttcgcggggcggcgggtagagttgagcatttttgtcatctgcaaataattttagccaggtggcaagtgtatggactgtggagtaagaagtacctgcctctgcctctgacttgggttctggcctataggaacaagacattttcagtaatggaagaaggagcttccaggctggggaagatcatcatttccagtggtagcttgacctgagatgatacctgaccaccacttctgggaaggcccagaatagacagaagagagagaacatactagagttgctagcccctaagagttgaacgaaatgggcaaggcccaggaaacacatgaaaaatgccacgattgtaatgtctgtgaggagagagcaaggcagttcttcaggggaggggtcattgtcattcgaagatgtggctgtgggcttcaccagggaggagtggcagtttttggaccagtctcaga

SEQ ID NO: 3329 - DNA, 573 bp, Homo sapiens
gtttagagacttcgggtccctgactcgcctccagcagtggagacaggtcatcggtctgttgagcatttttgtcatctgcaaataattttagccaggtggcaagtgtatggactgtggagtaagaagtacctgcctctgcctctgacttggaagccctcatcttctctctcctctccaaaggttctggcctataggaacaagacattttcagtaatggaagaaggagcttccaggctggggaagatcatcatttccagtggtagcttgacctgagatgatacctgaccaccacttctgggaaggcccagaatagacagaagagagagaacatactagagttgctagcccctaagagttgaacgaaatgggcaaggcccagctgaaataacaggaaacacatgaaaaatgccacgattgtaatgtctgtgaggagagagcaaggcagttcttcaggggaggggtcattgtcattcgaagatgtggctgtgggcttcaccagggaggagtggcagtttttggaccagtctcagaaggtcttgtacaaggaagtaatgttggagaactacatcaacc

SEQ ID NO: 3330 - DNA, 523 bp, Homo sapiens
cactcaggagagaaaccctataaatgcagtgactgtgggaaagccttccttacaaagacaatgctcattgtacatcacagaactcacacgggagagagaccctatggctgtgatgagtgttctggcctataggaacaagacattttcagtaatggaagaaggagcttccaggctggggaagatcatcatttccagtggtagcttgacctgagatgatacctgaccaccacttctgggaaggcccagaatagacagaagagagagaacatactagagttgctagcccctaagagttgaacgaaatgggcaaggcccagctgaaataacaggaaacacatgaaaaatgccacgattgtaatgtctgtgaggagagagcaaggcagttcttcaggggaggggtcattgtcattcgaagatgtggctgtgggcttcaccagggaggagtggcagtttttggaccagtctcagaaggtcttgtacaaggaagtaatgttggagaactacatcaacctagtatcaatag

SEQ ID NO: 3331 - DNA, 2758 bp, Homo sapiens
ggggttcgcggggcggcgggtagaggcgagtgtttagagacttcgggtccctgactcgcctccagcagtggagacaggtcatcggtctggtctgcgtgggcttctgggaatgtttcaggggcagggagagcgcgcttttttttttctgttgttcgctagcgcgtgaggtccgtgttgcggggagctctcggggagtcctcgctcggagttcgtttcgcagtcgtgttggagttcccagagtctgggagcccatggtctccgcattggaaccagtgcttgggaggtcttcgttgcacagtagcgctagggcgtcgtggtggggaagcgaatcgtgtcagtgttggagactgctctgggcagttcgtgttcattgcttatcacatgcgtacttaaaaaggggtctgctggtccccttgcttccctgctgctgtatattctgtagaaaatgggttttcaggttcattgcgacccaagtaataacatccccatcattttaaatactcctccagaaaataactctggtttagtgtatttcatgtttaatgttgggatcaggtgtctaggtattggtataattttattcgtctttaataacatcttgtcaacttcgtattcccatattacatgctctttgagagttttttaaattgctgcagtttcatcaagtggttgctttaatttgggtagaattgatgtagatctagatacaacactttcaggaacatgtgatggatttctattaacccaatatttttatttgtttgactatctgtagtgtttttccatacgtatcttggacatttctggttatgcttatttctacatagttaatactttttgttgtaaatcgtgactttttttttgcataagacccctccccctttccttttttgttcctaattttacttagttgacaagaacagaagttaaaaatatatatgtttattctgtcacttcattgtactcatgtcattacatataacttataaattgacgtcttttttctagttgagcatttttgtcatctgcaaataattttagccaggtggcaagtgtatggactgtggagtaagaagtacctgcctctgcctctgacttgggttctggcctataggaacaagacattttcagtaatggaagaaggagcttccaggctggggaagatcatcatttccagtggtagcttgacctgagatgatacctgaccaccacttctgggaaggcccagaatagacagaagagagagaacatactagagttgctagcccctaagagttgaacgaaatgggcaaggcccagctgaaataacaggaaacacatgaaaaatgccacgattgtaatgtctgtgaggagagagcaaggcagttcttcaggggaggggtcattgtcattcgaagatgtggctgtgggcttcaccagggaggagtggcagtttttggaccagtctcagaaggtcttgtacaaggaagtaatgttggagaactacatcaacctagtatcaatagggtatcgaggcaccaagccagattcgctcttcaagttggagcaaggagaacccccagggatagcagaaggagcagcccacagtcaaatctgtccaggttttgtaatccagagtagaagatatgcaggaaaagattctgatgcatttggtggatatgggagatcatgcctccatatcaagcgtgacaaaactcttactggagttaaataccatagatgtgttaaacccagcagccctaaatcacagctcaatgacctacaaaaaatttgtgcaggagggaaaccacatgaatgcagtgtgtgcgggagagccttctccaggaaagcacagcttattcaacatcagagaactgaaagaggagagaaaccccatggatgtggtgaatgtgggaaaacattcatgaggaagattcagctcactgagcatcagagaactcacacaggagagaagccccatgaatgtagtgaatgtggaaaagccttctccagaaagtcacagctcatggtccatcagagaacccatacaggagagaaaccctacagatgcagcaaatgcggaaaagccttcagccggaagtgccggctcaatagacatcagcgatcacatactggagagaaactctatgggtgcagtgtgtgtgggaaagccttttctcagaaggcatacctcactgcacaccagagacttcacacaggagataagccttataaatgcagtgattgtggaagaaccttctattttaagtcagacctgaccagacatcagaggattcatacgggagagaaaccttatgaatgtagtgagtgtgaaaaagcctttagaagcaagtcgaagctcattcagcatcagcgtactcacactggagagagaccatattcatgcagagaatgtggcaaagcctttgcccacatgtcagtcctcattaaacatgagaaaactcacataagagagacagccataaattcactgacggtggagaaaccttcctcaaggagtcatacctccttatacatgagcgaactcatacaagagcaaaagactgtgaacacagtacctatagaaatgccttcctcaggaaccccgccattgttaaacaagagtgagcgcctagtgggcagaaatgtagtgattgtggaacaaccttttccaagaaatcaagcctttgtagttaatcaggaatttgaacagagaataagcctcacaaatgaagtgaatgtggccccatcagtaataaattatatcttgtatcttaca

SEQ ID NO: 3332 - DNA, 2166 bp, Homo sapiens
gtccgcgtttggccggccgtggggaaggaagaaaggagccaaggaggcgaggcatggatccgcagcctcctccacccgcccagggcagcccacctcaccgtggccgaggccggggccgtggccgaggccgtggtcggggccgtggccgtggcagggggggcgctggagcccctagggcgcccctgccctgccccacctgcggccgcctcttccgtttcccctactacctctcccggcaccggctgagccactcggggctccggccccacgcctgcccgctgtgccccaaggccttccgccggccggcccacctttcccgccacctgcgcggccacgggccccagcccccgctgcgctgcgccgcctgcccccgcaccttcccagaaccggcccagctcaggcgccacctggctcaggagcacgcgggcggcgaggtcgagctggccatcgagagggtggccaaggagacggccgaacccagctggggcccgcaggacgagggctcggagccgcccaccaccgctgcagcaggggccacggaggaggaggcggtcgcagcgtggcctgagacgtggcctgcgggggagccttccacgctggctgcgcccaccagcgccgcggagccccgggagtcggagtcggaggaggccgaggccggggcagcagagctgagggccgagctggcgctggcggccgggcggcaggaggagaaacaggtcctgctccaggcagactggacgctgctgtgtctgcgctgccgcgaagccttcgccaccaagggcgagctcaaggcgcacccgtgtctgcgccccgagggcgaacaggaaggggaaggggggcccccgccacgccccaagcgacaccagtgctccatctgcctcaaggccttcgccaggccctggtccctgtcgcgccaccggctggtccactccaccgaccgccctttcgtgtgcccagactgcggcctggccttccgcctcgcctcctacctccgccagcaccgccgcgtccacggccccctcagcctgctggccccgctgcccgcggcgggcaagaaggacgacaaggcctcgggtgcacggaactcagccaaggggccggaggggggcgagggggcggagtgcgggggtgcctcggaagggggagaagggcagaacggaggcgacgccgccccggctcggccccccgccggggagccccgcttctggtgcccagagtgcggcaaaggtttcaggcgccgggcgcacctgcggcagcacggggtgacccactcgggagcgcgccccttccagtgcgtgcgctgccagcgggagttcaagcgcctggccgacctggcgcgccacgcacaggtgcacgcggggggcccagccccgcacccgtgcccccgctgcccgcgccgcttctcgcgcgcctacagcctcctgcgccaccagcgctgccaccgcgcagagctggagagggccgccgcgctgcaggcactgcaggcccaggccccgacgtcgccgccaccgcccccgccgcccctgaaggccgagcaggaggaagaagggctcccgctgcccctcgcaaacattaaggaagagccgccctctccggggaccccaccccagtccccgccggctccccctgtcttcctcagcgcctcctgtttcgacagccaagaccactcagccttcgagatggaggaggaagaggtagacagcaaggctcacctgcgcgggctggggggcctggcctcctgaccttcgccgccctgccctccgccgctccgcctgagctccccggtttgcagaatggaggagggaagttgaaggagccacctcctctgtctacccacccgtccccttcacgcccttgacactaaggagtggggggccctggactgccccttcctcccccatcgcccgcccccagaacccctgatgctggttaggaaccgctcaccccaacatgtgtcttaaggcaggacgacttggaaaaaaaggcggcggacagttggccagagggatggagactggtggggacgcccccgcctccctgtcccccgtttcacacactggacaccatcacctctttggaactgccagaccctgggggtccccagtgagcaaaggtctgtccttgtccctttgtctgtctgtgaataaatgtgagttcgtgaaatcc

SEQ ID NO: 3333 - DNA, 1131 bp, Homo sapiens
cccctcgcacccccgcgcccccagtccccgcgtccccggcgccgccggcccggagctgcccggaagtctcggttccgccgccggcgctcgccaggggaagcccggggccgcccgggacctcggcccgttcctccggacccgagaggccgccgcacgggctgccgctccagatgctgctgctgccgccgcggccaccccaccctcggtcctcctctccggaggccatggacccaccgccccccaaggctccccctttccccaaggcggaaggcccctcctccactccttcctcggcggcggggccccgacccccgcggctgggccgccacctcctcatcgacgccaatggggtcccctacacatacacggtgcagctggaggaggagccccggggcccgccccagcgcgaggcgcccccaggagagcccggccctcgcaagggctacagctgcccggagtgcgcccgtgtctttgccagccctctgcggctgcagagccaccgcgtgtcgcactcggacctcaagcccttcacgtgcggcgcctgcggcaaggccttcaagcgctccagccacctgtcgcggcatcgcgccacgcaccgcgcccgcgccgggccgccgcacacctgcccgctctgcccacgccgcttccaggacgccgcggagctggcgcagcacgtgcgcctccactaagctcgagacccggcctgtgctgccctgcccgtctcagggccaccaagtctgacccacacagcgtcactcactcccacacacaccccctggctctgctgaggttactgccttaccctgggcctcagtttccccaccttccaaagggaggagcatcattccttccttaccccctttctagctgtgtgatgtagaccaaagtcgttgcccctccctgggcctgggaaccagtcggaactgggttccagtccagctgtgctgtgtgagcctgtgcaagtgacatgacctctctaaaccttggttttctgctctctggagcggtgaaccggtggttgtctgcggggaagagatgataaagagcacgggcacggtctggttcatttctgtatctaccccccttccgcccacgcccccgaccctttgctcaataaacattccgcactcc

SEQ ID NO: 3334 - DNA, 1418 bp, Homo sapiens
gtaaactgaactggggctgggcaacaggaaaaaagaagaaaccacagattagagaaatctcggcggtcaggaggcccggggtctaagatgtaaagaggtaaacagatttagggattgattgtctgctggggtgggttgagaggagaaaagggaagaaaagtcgggggactacgtcctcagacctgacctgagtggtgagaggtggacccaggaggagtggcaggtggtggcggggttttgcagagctcagttggaggccctctccgaggcagcttgatggaacgtgggagagccgggctggagtcacagtttttattttgctagggaggtagtcagtggcgcacaaagggtaacaagcagtgatagtggggatgctttccattttaggaaacttttcctaaaaggaagtggcaattttaactaatctcccctccgccgctcccagctgccgctccagatgctgctgctgccgccgcggccaccccaccctcggtcctcctctccggaggccatggacccaccgccccccaaggctccccctttccccaaggcggaaggcccctcctccactccttcctcggcggcggggccccgacccccgcggctgggccgccacctcctcatcgacgccaatggggtcccctacacatacacggtgcagctggaggaggagccccggggcccgccccagcgcgaggcgcccccaggagagcccggccctcgcaagggctacagctgcccggagtgcgcccgtgtctttgccagccctctgcggctgcagagccaccgcgtgtcgcactcggacctcaagcccttcacgtgcggcgcctgcggcaaggccttcaagcgctccagccacctgtcgcggcatcgcgccacgcaccgcgcccgcgccgggccgccgcacacctgcccgctctgcccacgccgcttccaggacgccgcggagctggcgcagcacgtgcgcctccactaagctcgagacccggcctgtgctgccctgcccgtctcagggccaccaagtctgacccacacagcgtcactcactcccacacacaccccctggctctgctgaggttactgccttaccctgggcctcagtttccccaccttccaaagggaggagcatcattccttccttaccccctttctagctgtgtgatgtagaccaaagtcgttgcccctccctgggcctgggaaccagtcggaactgggttccagtccagctgtgctgtgtgagcctgtgcaagtgacatgacctctctaaaccttggttttctgctctctggagcggtgaaccggtggttgtctgcggggaagagatgataaagagcacgggcacggtctggttcatttctgtatctaccccccttccgcccacgcccccgaccctttgctcaataaacattccgcactcc

SEQ ID NO: 3335 - DNA, 1025 bp, Homo sapiens
agattagagaaatctcggcggtcaggaggcccggggtctaagatgtaaagagctgccgctccagatgctgctgctgccgccgcggccaccccaccctcggtcctcctctccggaggccatggacccaccgccccccaaggctccccctttccccaaggcggaaggcccctcctccactccttcctcggcggcggggccccgacccccgcggctgggccgccacctcctcatcgacgccaatggggtcccctacacatacacggtgcagctggaggaggagccccggggcccgccccagcgcgaggcgcccccaggagagcccggccctcgcaagggctacagctgcccggagtgcgcccgtgtctttgccagccctctgcggctgcagagccaccgcgtgtcgcactcggacctcaagcccttcacgtgcggcgcctgcggcaaggccttcaagcgctccagccacctgtcgcggcatcgcgccacgcaccgcgcccgcgccgggccgccgcacacctgcccgctctgcccacgccgcttccaggacgccgcggagctggcgcagcacgtgcgcctccactaagctcgagacccggcctgtgctgccctgcccgtctcagggccaccaagtctgacccacacagcgtcactcactcccacacacaccccctggctctgctgaggttactgccttaccctgggcctcagtttccccaccttccaaagggaggagcatcattccttccttaccccctttctagctgtgtgatgtagaccaaagtcgttgcccctccctgggcctgggaaccagtcggaactgggttccagtccagctgtgctgtgtgagcctgtgcaagtgacatgacctctctaaaccttggttttctgctctctggagcggtgaaccggtggttgtctgcggggaagagatgataaagagcacgggcacggtctggttcatttctgtatctaccccccttccgcccacgcccccgaccctttgctcaataaacattccgcactcc

SEQ ID NO: 3336 - DNA, 1225 bp, Homo sapiens
ctagaccctcttctctcccttcggcttctctctttcggccggcgccgccagttcctggggcacacccagaggtccccttctcgccgccgcctgcaactgcgagggtagcccggggccgcttggagtcgcccggacctgagaggctgctgcactgggcctcagccagccctccggatgctggtgctgccatccccctgccctcagcctctggcattttcctccgttgagaccatggagggccctccccgtcggacttgccgctccccagaacctggaccttcctcctccatcggatctccccaggcttcatctcctccaaggcccaaccactacctgcttattgacactcagggtgtcccctacacagtgctggtggacgaggagtcacagagggagccaggggccagtggggctccaggccagaaaaagtgctacagctgccccgtgtgctcaagggtcttcgagtacatgtcctaccttcagcgacacagcatcacccactcggaggtaaagcccttcgagtgtgacatctgtgggaaggcattcaagcgcgccagccacttggcacggcaccattccattcacctggcgggtggtgggcggccccacggctgcccgctctgccctcgccgcttccgggatgcgggtgagctggcccagcacagccgggtgcactctggggaacgcccgtttcagtgtccacactgccctcgccgctttatggagcagaacacactgcagaaacacacgcggtggaagcatccatgagccgggctgccgggtgccccaggtaccacaggactttgcagggagcctggactcctgtccagacacctggtgagagcctgaggctggtgttcagggccctggacacagacacagagcagccgcatctcaaaggcagagccctgcctgaaggaggaatccgtgagtaatcttcaggtcctccgtgttctggagctgagatgggaatgagcccctacacagaatggagtcctctagcctaaagatatcagctgttccatggcagagccttgactggatggaggtggggagtgtggtgtgtaaagtctctggcctcataaaaggtggctgtgggtcgtcaggaatctgcgccatcttcctggggcttctgcgctgttgttggggaagggaccccagtcctgccttccaccccccaaccaggcctgagactgatcaaacaataaacacgtttcccactctg

SEQ ID NO: 3337 - DNA, 2297 bp, Homo sapiens
caccggtaccgtggtggaagcgcgccctgggctgccgggggcgcggccgcggtggcacttggacccgaggaggcggcagctctaccgtcgcaggactctgcccttccccaagagaggaaccagaaggaggacctatcagcccttgaaattctaaaagtcatgtcccttgggtcagaattgttcagggatgtggccatagtcttctcccaagaagaatggcagtggttggcacctgctcagagggatttgtacagagacgtgatgttggagacctacagcaacctggtctcactgggtcttgccgtttccaaacctgatgtgatctccttcctagagcaaggcaaagagccctggatggtggagagagtggtgtctggaggcctgtgtccagtattggagtccagatatgataccaaggaattatttccaaagcagcatgtttatgaagtcgaatcaccccaatgggagataatggaaagccttacaagttatggtcttgagtgttcaagtttccaagatgattgggaatgcagaaaccagtttgacagacaacagggaaatccagacagacatttccatcagatgatcatcagacatgaagaaatgcccacttttgaccagcatgcatcccttactttttatcagaaaattcatactagagaaaaaccttttgggtataataaatgtagaaaagacttctggcaaaaggaactccttattaatcatcaaggaatttatactaatgagaaaccctataaatgtaaggaatgtgggaaggcctttaaatatggctcacgactaattcaacatgagaatattcattctggtaagaaaccatatgaatgtaaggaatgtggaaaggccttcaattctggttcaaattttatacaacatcagagagttcatactggtgagaaaccgtatgaatgtaaagattgtgagaaggcctttagtcgaagctcacagttgattgaacatcagcgaactcacacaggcgagaaaccctatcagtgtaaggaatgtggcaaggccttcaatcggatctcacatcttaaagtacattatagaattcatactggtgaaaaaccctatgcatgcaaggaatgtgggaaaacctttagtcatcgttctcagttgattcaacatcagactgttcatactggcaggaaactctatgaatgtaaggaatgtgggaaggcttttaatcaaggctcaactcttatacgacatcagagaattcataccggtgagaaaccctatgagtgcaaagtatgtggaaaggcctttagagtgagctcacaactcaagcaacatcagagaattcacactggagagaaaccctaccaatgtaaggtatgtggtagggccttcaaacgggtctcacatcttactgtacattacagaattcatacaggtgaaaagccatatgaatgtaaggaatgtgggaaggcttttagtcattgctcacaattgattcatcatcaggttattcacactgagaaaaagccctatgaatataaggaatgtgagaagaccttgagtcatgattcaactaccgttcaacctcagagaatgcataatagagaaacacatgtgaatataataaatgtagaaaagccttccatcagcagttaccccttactaatcatcagagaatttatgttggcaagcaaccatatgaatggaagtaatggggaaagcccattagcctaggctaattgtgactgtgacttacttctccctcttggagaaagacttgaagaatgtaatgccagtgacaatgccttcattcagaggtaagcctttatcctaagtctgaaaattcatatcaaagaaaattttatggatgtaaattgttcagatcataattgtcaaaaatgctgggaaaggttgggagaaattttatttctaacacattccagaaccacattttctaaccacagtgtagtaattttatcaagagcaaaagttatagttttcttacaagttaaaaaaacagccagattatcatttgcttaacaaagaaatcatgcaattaccataaatggtaatgaaaagaatgaattgagagtttaacatgccaagagatgtgaaatgtggccaaagagatgtgagggtaaggggaaagccaaagctacactggaggaatttttatagcctttgaatgcatgcatatacatgaaaatctgaaagataaactcatatgcactaaacatgctattcaagtctaccaaacatccaggcagtgaaagaagaaagtaacagaaaatgatgaaataaagagaccatcttacaat

SEQ ID NO: 3338 - DNA, 2538 bp, Homo sapiens
actgcgcgtgcgcctcaccgcgctggcaccccggcctggcagcctttggggacctgaaccagctgcgcctgcgcagctcgactttctcaggatactgtccctctcccacagaggagctgaaggagtaggacagaagaactgtcaaattctggaatccttaaagccatgtccaaggatttggtgacatttggggatgtggctgtaaatttctctcaagaggaatgggaatggctgaaccctgctcagaggaatttgtacaggaaagtgatgttggagaactacaggagcttggtatcattgggagtttctgtttctaagccagatgtgatctcattattggagcaaggaaaagagccctggatggtgaagaaggagggaacaagaggcccatgccctgattgggagtatgtatttaaaaacagtgaattttcatcaaagcaagagacatatgaagaatcatccaaagttgtgacagtgggagcaagacatcttagttatagccttgactatcccagtttgagagaagactgtcaaagtgaggactggtataagaaccagctgggaagtcaagaggtacatcttagtcaattaatcatcactcataaagaaatccttccagaagttcaaaataaagaatataacaaatcttggcaaacattccaccaggatacaatctttgatatacaacagagttttcccaccaaagaaaaagcacataagcatgaaccacaaaagaaaagttaccgaaaaaaatctgttgaaatgaaacataggaaagtctatgtagaaaagaaacttttgaaatgtaatgattgtgagaaagtcttcaaccagagctcatcccttactcttcatcagagaattcatactggagagaaaccctatgcatgtgttgaatgtgggaaaacgttcagccagagtgcaaacttggcgcaacataagagaatacatactggagagaaaccctatgaatgtaaagaatgtaggaaagccttcagccagaatgcacacctggcccaacatcagagagttcatactggagagaaaccttatcagtgtaaagaatgtaaaaaagccttcagccagattgcacacctgactcagcatcagagagttcatactggagagagacctttcgaatgtattgaatgtggaaaggcctttagtaatggttcatttcttgctcagcatcagagaattcatacaggagagaaaccttatgtgtgtaatgtgtgtgggaaagcctttagccatcgtggatacctaattgtacatcagagaattcatactggagagagaccctacgaatgtaaggaatgtaggaaagccttcagccagtatgcacaccttgctcaacatcagagagttcatactggagaaaaaccttatgaatgtaaagtatgtaggaaagccttcagccaaattgcataccttgatcaacatcagagggttcatactggagagaaaccctatgaatgtattgaatgtgggaaggcctttagcaatagttcatcacttgcacaacatcagagaagtcatactggagaaaaaccctatatgtgtaaggaatgtaggaaaacatttagccagaatgcaggccttgctcaacatcagagaattcatactggagagaaaccttatgaatgtaatgtttgtgggaaagcatttagctatagtggatctcttactctacatcagagaattcatactggagaaagaccctatgaatgtaaagattgcaggaaatctttcaggcagcgtgcacatcttgctcatcatgagagaattcatactatggagtcattcttgactctttcctctccctcaccctccacatcaaatcagttgccaagacctgtaggtttcatctcctgaatatttctggaatccacctcttgaatccatttccatcccatcatccttgtccaatgcacattaatatatttgacatgggatactcgagtagctttctaattggtctccttgtactcaccattgtctctgtcagatgtccacattgcaaccaaatttgtatttttaaaaatatgtttaatctcatttctccctcattaaaatccctcagtggcatcccatggtttttaagttaaagcacacattcttcaaaatagcctaaaaacctagcctctaacaccttgttccaggttaccttccaaagtttctatcttgtgtcactatccatctcattctctgaatacttatccaggattaagatacatattccaggatcaaaaagacctgggttccaatctttgcacttccatttcctgccctctaatttgggggcagcagtttgtgctttgtaagcttcagtcttatttatagtgtgggaataataatggttctacctcagaagttaatagaagaatgaaataatgcatgtaaattgctcagcagcgtgcctagcataaagtaattactcaaaccataatgtaaagtaaaaagataaccatactatacatagaaagccaatcatctcagccatgattatctcagaaataaaaagagatgcagcagctc

SEQ ID NO: 3339 - DNA, 4916 bp, Homo sapiens
agggctgcggcgcctttgtgagcgcggccgccggccaggatcgagccctggcccgggccctggcccagccccggcctccaaggaccgcgccgaaggaggtgcccactggagggaggaggcgctcgactttctcaggatactgtccctctcccacagaggagctgaaggagtaggacagaagaactgtcaaattctggaatccttaaagccatgtccaaggatttggtgacatttggggatgtggctgtaaatttctctcaagaggaatgggaatggctgaaccctgctcagaggaatttgtacaggaaagtgatgttggagaactacaggagcttggtatcattgggagtttctgtttctaagccagatgtgatctcattattggagcaaggaaaagagccctggatggtgaagaaggagggaacaagaggcccatgccctgattgggagtatgtatttaaaaacagtgaattttcatcaaagcaagagacatatgaagaatcatccaaagttgtgacagtgggagcaagacatcttagttatagccttgactatcccagtttgagagaagactgtcaaagtgaggactggtataagaaccagctgggaagtcaagaggtacatcttagtcaattaatcatcactcataaagaaatccttccagaagttcaaaataaagaatataacaaatcttggcaaacattccaccaggatacaatctttgatatacaacagagttttcccaccaaagaaaaagcacataagcatgaaccacaaaagaaaagttaccgaaaaaaatctgttgaaatgaaacataggaaagtctatgtagaaaagaaacttttgaaatgtaatgattgtgagaaagtcttcaaccagagctcatcccttactcttcatcagagaattcatactggagagaaaccctatgcatgtgttgaatgtgggaaaacgttcagccagagtgcaaacttggcgcaacataagagaatacatactggagagaaaccctatgaatgtaaagaatgtaggaaagccttcagccagaatgcacacctggcccaacatcagagagttcatactggagagaaaccttatcagtgtaaagaatgtaaaaaagccttcagccagattgcacacctgactcagcatcagagagttcatactggagagagacctttcgaatgtattgaatgtggaaaggcctttagtaatggttcatttcttgctcagcatcagagaattcatacaggagagaaaccttatgtgtgtaatgtgtgtgggaaagcctttagccatcgtggatacctaattgtacatcagagaattcatactggagagagaccctacgaatgtaaggaatgtaggaaagccttcagccagtatgcacaccttgctcaacatcagagagttcatactggagaaaaaccttatgaatgtaaagtatgtaggaaagccttcagccaaattgcataccttgatcaacatcagagggttcatactggagagaaaccctatgaatgtattgaatgtgggaaggcctttagcaatagttcatcacttgcacaacatcagagaagtcatactggagaaaaaccctatatgtgtaaggaatgtaggaaaacatttagccagaatgcaggccttgctcaacatcagagaattcatactggagagaaaccttatgaatgtaatgtttgtgggaaagcatttagctatagtggatctcttactctacatcagagaattcatactggagaaagaccctatgaatgtaaagattgcaggaaatctttcaggcagcgtgcacatcttgctcatcatgagagaattcatactatggagtcattcttgactctttcctctccctcaccctccacatcaaatcagttgccaagacctgtaggtttcatctcctgaatatttctggaatccacctcttgaatccatttccatcccatcatccttgtccaatgcacattaatatatttgacatgggatactcgagtagctttctaattggtctccttgtactcaccattgtctctgtcagatgtccacattgcaaccaaatttgtatttttaaaaatatgtttaatctcatttctccctcattaaaatccctcagtggcatcccatggtttttaagttaaagcacacattcttcaaaatagcctaaaaacctagcctctaacaccttgttccaggttaccttccaaagtttctatcttgtgtcactatccatctcattctctgaatacttatccaggattaagatacatattccaggatcaaaaagacctgggttccaatctttgcacttccatttcctgccctctaatttgggggcagcagtttgtgctttgtaagcttcagtcttatttatagtgtgggaataataatggttctacctcagaagttaatagaagaatgaaataatgcatgtaaattgctcagcagcgtgcctagcataaagtaattactcaaaccataatgtaaagtaaaaagataaccatactatacatagaaagccaatcatctcagccatgattatctcagaaataaaaagagatgcagcagctcaggactgagagattgtgaagtttttttttttttaggaatggtaggcatttttctaaaagtaggtgaggagggtatctaacagtaggatttacattagagtccatgatatagggtaagatggtggcttgtatcagcattcactggatatttaacagttctaagatgctaatgtcttattttaaaagtctttttttttgagatggagtcttgctctgttgctcaggcttgagtgcagtagtgcaatcttggctcactgcaacctccgcctcctgtgttcaagtgattctcctgcctcagcctcctgagtagctgggattacaggcctgcaccaccacgcccagctaatttttgtatttttagtagagagagggttttgacatgtcggccaggcttttctctaactcctgacgtccggtgatccgcctgccttggcctcccaaagtgctgggattacatgcgtgagctaccgtgcctggcctaaaaagtcatttttaataagacagtttactgagatgtattcatcatttacatgtaaacaaaggcaaaatcgaaattaaaaagaaatcttgaaacaagtcagtaaccaatgatgagtagaaaataaagtataagtttgaacccctgttctaaatctgggtgaatgaattatatcaaatctatgtcatttaaaataataaaggttgttaaattactaaaatttcaaaactagtgaagaaaagaaaccaaaactgtaggtcagttctcataaactggcccacaaacatgtttgattctgtatgcattaagtttaaaatacatatgaataccttcagcagaccatgtgttttccctttctccaacattcaaaccactccctgattctttacatctgacctcttttaatattacttcctgaccccagaattcttttggcatataatcaatgcagtgatcaattcacatgtgactatagatacaaacagaatgacgaaagtttaatggaggatgaaaaagaagacaaataaatattttatcctttatatggtaagacagattcactatcatactgatgtcagtagcccatgaattaatttacagattctacctaacaaaattctaataaattttgtaaggttttaacatgtatgtgtgaacatacatattcatgctgttacacatataaagaaaattataacaaaagtgacctataccatcagtggtttaacagttttggaaaaatttatcgtgctctatacaacaattcattccatatgtgaaagttactttcaagtgctttatctaaatgtggaacaaacagtgattagaggagtctgtgacacactctaatcatggaatgagactggccttcctaaacatgagattcagaagcctccccacctcctgtcaacaagtcatagatttgactgtataagaactttataaagcttttatatgatcaaagatagtaaaagatacaatattttttaaacctaagaatgggagaaaattattgcagcacatataaactatggaattcatatccttaacataaaattgctcataaaaatcccttaggaaatgacgcttttctccagctcatagtcaaaggatatgaagaggcaacaggtgaccaataaatatgtggtaagtactaaatctccctaggatcagaagaaatacagtttaggccaatgaaatactatttttttcaatatcagattaataaaactgcattgaaagcatacaaaaagagatactatgcactaatttaaaagagcatgagtttgtacaaactctggtaggcaatttgtcaacttcagaattttaattgggaaaagtagaattttattttgaagttcaaaaactcggcacacaatgtctttccctccagattctattatacacatagaacaatgtaaatgattcttaaaaaaaaaaaaaaggtgaggcttttgagtggatgaaataattttgtaaaaggcaaaacagggaagagtgttcatgaattgtagcagaagatgctgcatgttatatgcgaatgaccgaagggttttaaaaatggaatctagtctgcccaaaggatccctagagaagttcaggcttggagttggcttatgtacaggctgtggcttctaagaagacatgatgaaaagcctcttgaagcctttgtatgtgaaagttatgtcagtagcccttgccaaaagcctcctcactctcccctctcttgtataagtaaattgaatgggatccttatttcacaccattaacaagtataagttctaactgaataaaaatctaaatgtaaattactaaagcaaaagtattagaaaaaatatagtgggatatgttaacga

SEQ ID NO: 3340 - DNA, 582 bp, Homo sapiens
gtgagcgcggccgccggccaggatcgagccctggcccgggccctggcccagccccggcctccaaggaccgcgccgaaggagctcgactttctcaggatactgtccctctcccacagaggagctgaaggagtaggacagaagaactgtcaaattctggaatccttaaagccatgtccaaggatttggtgacatttggggatgtggctgtaaatttctctcaagaggaatgggaatggctgaaccctgctcagaggaatttgtacaggaaagtgatgttggagaactacaggagcttggtatcattgggagtttctgtttctaagccagatgtgatctcattattggagcaaggaaaagagccctggatggtgaagaaggagggaacaagaggcccatgccctgattgggagtatgtatttaaaaacagtgaattttcatcaaagcaagagacatatgaagaatcatccaaagttgtgacagtgggagcaagacatcttagttatagccttgactatcccagtttgagagaagactgtcaaagtgaggactggtataagaaccagctgggaagtcaagaggtac

SEQ ID NO: 3341 - DNA, 554 bp, Homo sapiens
actgcgcgtgcgcctcaccgcgctggcaccccggcctggcagcctttggggacctgaaccagctgcgcctgcgcagctcgactttctcaggatactgtccctctcccacagaggagctgaaggagtaggacagaagaactgtcaaattctggaatccttaaagccatgtccaaggatttggtgacatttggggatgtggctgtaaatttctctcaagaggaatgggaatggctgaaccctgctcagaggaatttgtacaggaaagtgatgttggagaactacaggagcttggtatcattgggagtttctgtttctaagccagatgtgatctcattattggagcaaggaaaagagccctggatggtgaagaaggagggaacaagaggcccatgccctgattgggagtatgtatttaaaaacagtgaattttcatcaaagcaagagacatatgaagaatcatccaaagttgtgacagtgggagcaagacatcttagttatagccttgactatcccagtttgagagaagactgtcaaagtgaggactggtataagaa

SEQ ID NO: 3342 - DNA, 2257 bp, Homo sapiens
gtcgtggcgtgaggggcgccgagcgaggggaggcgcgggccacgggagttccgggagttccggcgttgcccggcagtccgcagtcctcggcgggaaggctgtcccggcgcctcaggcagctctgcgtgggccggggtgacttcctcgcgatcccctgcgcgaggtgaagggcagggacctttgccgcgccttccacgcgccgtgccccaccggcgagtggctccatcttcctcagacttatcgctcgcggacaggcgccgtgggtctcccgggcctccgtaccgtcctccttcccagcggctccgggaagcggttccctgtcttcggacgcatttcacccgcgcggggagagcttcccgggaaggttccacggcggccgagggtttccgcgcccgggacgcgtttcggctgaggccgtgggtccagtccacgggttctgcccgcacggtccaatggccggggaggcggaggctcagttggacccatcattgcagggcttggtgatgtttgaggatgtgacggtatatttctccagggaggagtgggggctccttaatgtgacccagaagggcctataccgggatgtgatgctggagaactttgcactcgttagctcactgggacttgcaccttcgagatcccctgtgtttacccagctggaggatgatgaacagtcgtgggtgcccagctgggtggatgtgactccagtcagcagagcagaagccaggagaggttttggtcttgatggtttgtgtagagtggaggatgagagagcccatcctgagcatctaaagagctacagagtcatccagcaccaggacactcatagtgaggggaaaccaagaaggcacactgagcatggggcagctttcccacctggttccagttgtgggcaacagcaagaagtccatgtggcagagaagctgttcaaatgcagtgactgtgggaaggtgttcttaaaggcctttgccctccttgaccatctgataacgcattctgaagagagacccttcagatgcccaacaggcagaagtgctttcaagaagtcagctcatattaacccccgaaaaattcacactggagaaacagcccatgtgtgtaatgaatgtgggaaggccttcagttacccgtctaagctgaggaaacaccagaaggttcacacaggcataaaaccttttaagtgtagtgactgtggtaaaaccttcaaccgcaaagacgcacttgttctacaccagaggattcacactggagaaaggccttacgagtgcagcaaatgtggtaaaaccttcagtgttctgtctaccctcattcggcaccggaaagtgcacattggagaaaggccctatgagtgtacagaatgtgggaagttctttaaatacaataatagcttcattcttcaccagagagttcacactggagaaaggccttttgaatgcaagcaatgtgggaaaggctacgtgacccgttcaggcctctatcagcactggaaagtccacactggggaacggccctatgaatgtagcctgtgtgggaaaaccttcactaccagatcctaccgcaatcggcaccagcagttccacactgaagagaggtcttatgaatgtacagagtgtgggaaggccttcaaacatagttccaccctccttcagcacaagaaagtccatactccagaaaggcgtcaggaggacagggcacatgggaaggtcgttagctgctagcaccgtgttcatcaggaaaggtcttattccagaaaggaggttaaggagagtggccgtgagagtgccatccgaaagaagctaaaccttgcacatcccaacacccaccccagggagagttcccgtgtgtgcctggtgtgtgggacgctttcgggagccacattgcactctgacttgcctggggctgttggcagtgtcacatcactgagtttatccaccgccatccacctctatccaccccataaggtccctacagcaagtgggacagcagaccttgtgctccttgctctaaacagtagagaatcgttaatagtggagcccaaaacaggcctcattccctacccttgactggtttagctgtggacatgacccacctctggccggaggagctgagctggtatctgctgggggcttcctgggaaggtttaccattttcatggaaatggttgacattacacatggtatttgtcatgccctagcatggactgtctcatactgctctggactatgtggtaataaaggctttattgtttaagccgctt

SEQ ID NO: 3343 - DNA, 1042 bp, Homo sapiens
agtcctcggcgggaaggctgtcccggcgcctcaggcagctctgcgtgggccggggtgacttcctcgcgatcccctgcgcgaggtgaagggcagggacctttgccgcgccttccacgcgccgtgccccaccggcgagtggctccatcttcctcagacttatcgctcgcggacaggcgccgtgggtctcccgggcctccgtaccgtcctccttcccagcggctccgggaagcggttccctgtcttcggacgcatttcacccgcgcggggagagcttcccgggaaggttccacggcggccgagggtttccgcgcccgggacgcgtttcggctgaggccgtgggtccagtccacgggttctgcccgcacggtccaatggccggggaggcggagggcttggtgatgtttgaggatgtgacggtatatttctccagggaggagtgggggctccttaatgtgacccagaagggcctataccgggatgtgatgctggagaactttgcactcgttagctcactgggacttgcaccttcgagatcccctgtgtttacccagctggaggatgatgaacagtcgtgggtgcccagctgggtggatgtgactccagtcagcagagcagaagccaggagaggttttggtcttggccccgcatgttcctgcctctctggcctgcgtctcctcattgcccttctctgtatctgtgcagagctgtctactgttggcgactcagtgcgtgtcttgaaatgtgcacatatccttaaacagatggtttgtgtagagtggaggatgagagagcccatcctgagcatctaaagagctacagagtcatccagcaccaggacactcatagtgaggggaaaccaagaaggcacactgagcatggggcagctttcccacctggttccagttgtgggcaacagcaagaagtccatgtggcagagaagctgttcaaatgcagtgactgtgggaaggtgttcttaaaggcctttgccctccttgaccatctgataacgcattctgaagagagacccttcagatgcccaaca

SEQ ID NO: 3344 - DNA, 921 bp, Homo sapiens
cctggttccagttgtgggcaacagcaagaagtccatgtggcagagaagctgttcaaatgcagtgactgtgggaaggtgttcttaaaggcctttgccctccttgaccatctgataacgcattctgaagagagacccttcagatgcccaacaggcagaagtgctttcaagaagtcagctcatattaacccccgaaaaattcacactggagaaacagcccatgtgtgtaatgaatgtgggaaggccttcagttacccgtctaagctgaggaaacaccagaaggttcacacaggcataaaaccttttaagtgtagtgactgtggtaaaaccttcaaccgcaaagacgcacttgttctacaccagaggattcacactggagaaaggccttacgagtgcagcaaatgtggtaaaaccttcagtgttctgtctaccctcattcggcaccggaaagtgcacattggagaaaggccctatgagtgtacagaatgtgggaagttctttaaatacaataatagcttcattcttcaccagagagttcacactggagaaaggccttttgaatgcaagcaatgtgggaaaggctacgtgacccgttcaggcctctatcagcactggaaagtccacactggggaacggccctatgaatgtagcctgtgtgggaaaaccttcactaccagatcctaccgcaatcggcaccagcagttccacactgaagagaggtcttatgaatgtacagagtgtgggaaggccttcaaacatagttccaccctccttcagcacaagaaagtccatactccagaaaggccatttatctgctttaactgtggcaaaaactttaacatgagctcctgccttgcttggcaccagaaacttcaccctggagaaaagccttttgattatagtaaatgtaggaaagtcttcacc

SEQ ID NO: 3345 - DNA, 4130 bp, Homo sapiens
ggaccggaagtggaagtggtcttccaaggcttttttgccgctggtgtcaggagtattttcatattccaataccgataaatctttgaggtttctgggtgtctctggggagcccctgggccagattttcctctagactccagcccatctcttcagagcagctctgcttgagttcacagatgactgccaagcttcagacaccctacagaaaaagggttgagacccagtgtggccatgccagctaattggacctcacctcagaaatcctcagccctggctccagaggatcatggcagctcctatgagtgttaaccttgatgcctgaaagaactggaaattatgaagatagattcagaagtcaaatatgttaactaactgcattgaagagtagaagaaaacaatagcctaggatcagtgtccttcagggatgtggctatcgatttcagcagagaggaatggcggcacctggacccttctcagagaaacctgtaccgggatgtgatgctggagacctacagccacctgctctcagtaggatatcaagttcctgaagcagaggtggtcatgttggagcaaggaaaggaaccatgggcactgcagggtgagaggccacgtcagagctgcccaggagagaaattatgggaccataatcaatgtagaaaaatcctcagttataaacaagtatcctctcaacctcaaaaaatgtatcctggggagaaagcttatgaatgcgccaaatttgaaaagatattcacccagaagtcacagctcaaagtacacctgaaagttcttgcaggagaaaagctctatgtatgcattgaatgtgggaaggcttttgtacagaagccagaatttattatacaccagaaaacccatatgagagagaaaccctttaaatgcaatgaatgtggaaaatccttttttcaagtgtcgtccctcttcaggcatcagagaattcataccggagagaaactctatgaatgcagccagtgtgggaaaggcttctcttataactcagatctcagtatacatgagaaaattcatactggagagagacaccatgaatgcactgactgtggcaaagcattcacacaaaagtccacactcaagatgcatcagaaaatccatacaggcgagagatcctacatctgtattgaatgcggacaggccttcatccagaagacccatttgattgcacaccgaagaattcatactggagaaaaaccatatgagtgcagtaactgtggcaaatccttcatttccaagtcacaacttcaggtacatcaacgtgttcacacaagagtgaagccctatatatgtaccgaatatgggaaggtcttcagcaataattccaacctcgttacacataagaaagttcaaagtagagagaaatcttccatatgtactgagtgtgggaaggcctttacctacaggtcagagttgattattcatcagagaattcacactggagagaaaccttatgaatgcagtgactgtgggaaagccttcactcagaagtcagcactcacagtgcatcagagaattcatacaggagaaaaatcgtatatatgcatgaaatgtggactggccttcattcagaaggcacacttgattgcacatcaaataattcatactggagagaaacctcataaatgtggtcactgtgggaaattgtttacctccaagtcgcaactccatgttcataaacgaattcacacaggagaaaagccctatatgtgcaataaatgtgggaaggcattcaccaaccggtcaaatctcattacacatcagaaaactcatacaggagagaaatcttatatatgttccaaatgtggaaaggccttcacccagaggtcagacttgattacacatcagagaatccatactggggagaagccttatgaatgcaatacttgtggaaaagccttcactcagaagtcacacctcaatatacatcagaaaattcacactggagagagacagtatgaatgccacgaatgtgggaaagccttcaaccagaaatcaatactcattgttcatcagaaaattcatacaggagagaaaccctatgtatgcactgagtgtggaagagctttcatccgcaagtcaaactttattactcatcaaagaattcatactggagagaagccttatgaatgcagtgactgtgggaagtcctttacctccaagtctcagctcctggtgcatcagccagttcacacaggagagaaaccctatgtgtgtgccgagtgcgggaaggcctttagtggcaggtcaaatctcagtaagcaccagaaaactcataccggagaaaagccctacatttgttctgaatgtgggaagacctttcgacagaagtcagagttgattacacatcacagaattcatactggagagaaaccttatgagtgcagtgactgtgggaagtctttcactaaaaaatcacagctccaagtgcatcagcgaattcacactggagagaagccttacgtgtgtgctgagtgtgggaaggcctttactgacaggtccaatttgaataaacatcagacaacacacactggagacaaaccctacaagtgtggcatctgtgggaaaggcttcgttcagaaatcagtgttcagcgtccatcagagcagccacgcttgagagaaacagtgtgagaaaacccccctgagggttgggtctgattgtacactgttgcacgcatgcagcagaaaaatatgtatattattgtaaatagaaatgaccacagcagaatgtcacacatggctgttctggagagggcctctgagaaggcactgaatgaggcgagggacccttcctacattgtcaccatccccagtaaaccttgggtcattattcatactgacaaggaaccgagtcaatttggtgaataggaaaagccttctcatgaaaactacaatagaatactgttaccaaattcttcctaagaaagatcgtattaagttaacgataatcctgtttactgtggattaggtatagtgccaacaaattgaatgataaaacaacataatacgtagttattttgatagtgatgaatcctaagttatgtgagttgttcgttgtggaacacattgtgtaacagactcctgggtgtttttctttctcattcgaatctaccacagttggtcatatccaaccctcattcagtatttctatcaagaaagagatgctacaaaaaaaaaaagaaaaaacctttatgtatacagacgtaaacctcagaatgtatgttgagtccccactgtcatctaccaagacttgcacccccctcattatctaccatgactgtctctcagcctcacgggccctcagcactttgtgttttgacccccagcaccgtgtcttgtgaactcccatcaccttcaagaaagcttccgaggtaagaattttatggtcatctgggacaacttaaatctcccttctgctgtcatagttcttccaactcagttgcctttttttttttttcgtactcatcactgacttgaagcttagtatctggcttccttaaggatgtaactttcatgtaacagattaataacttatatgaaaaccaacacaaccatatgtttagggctggaaagggccatgacgcctggccatttttcctgttttaccttactcttatgtgtgtcacacttcatcaattccggaaacagtttctggagatctcctcattacctcttttacaatcacctcactccagcatggtgtctgttacctcttcccacttgtgacaatgtctagtaaggtccactctccattctgtgtgatgaccacttattacaaccctcagaataggggacagtggtgtgccccctgcaatacaatggtttctatctcctgatacttttattacacctctagcaggatgtcttgtgatcctccttattgatttttccctcacgatgatgaacaattatctcccgttactcacctagcagtatctaactgtccctaacacagcatgtgggaatgccctcaatacggtggatgctgttaactttcttccttcccctcaggcaatggcggtgacttacaatgaaccataatgtccacatttcccaactgtattttggagcctcttctgtccccttctttctaggaccccagtt

SEQ ID NO: 3346 - DNA, 1719 bp, Homo sapiens
ggaccggaagtggaagtggtcttccaaggcttttttgccgctggtgtcaggagtattttcatattccaataccgataaatctttgaggtttctgggtgtctctggggagcccctgggccagattttcctctagactccagcccatctcttcagagcagctctgcttgagttcacagatgactgccaagcttcagacaccctacagaaaaagggttgagacccagtgtggccatgccagctaattggacctcacctcagaaatcctcagccctggctccagaggatcatggcagctcctatgagtgttaaccttgatgcctgaaagaactggaaattatgaagatagattcagaagtcaaatatgttaactaactgcattgaagagtagaagaaaacaatagcctaggatcagtgtccttcagggatgtggctatcgatttcagcagagaggaatggcggcacctggacccttctcagagaaacctgtaccgggatgtgatgctggagacctacagccacctgctctcagtaggatatcaagttcctgaagcagaggtggtcatgttggagcaaggaaaggaaccatgggcactgcagggtgagaggccacgtcagagctgcccaggagagaaattatgggaccataatcaatgtagaaaaatcctcagttataaacaagtatcctctcaacctcaaaaaatgtatcctggggagaaagcttatgaatgcgccaaatttgaaaagatattcacccagaagtcacagctcaaagtacacctgaaagttcttgcaggagaaaagctctatgtatgcattgaatgtgggaaggcttttgtacagaagccagaatttattatacaccagaaaacccatatgagagagaaaccctttaaatgcaatgaatgtggaaaatccttttttcaagtgtcgtccctcttcaggcatcagagaattcataccggagagaaactctatgaatgcagccagtgtgggaaaggcttctcttataactcagatctcagtatacatgagaaaattcatactggagagagacaccatgaatgcactgactgtggcaaagcattcacacaaaagtccacactcaagatgcatcagaaaatccatacaggcgagagatcctacatctgtattgaatgcggacaggccttcatccagaagacccatttgattgcacaccgaagaattcatactggagaaaaaccatatgagtgcagtaactgtggcaaatccttcatttccaagtcacaacttcaggtacatcaacgtgttcacacaagagtgaagccctatatatgtaccgaatatgggaaggtcttcagcaataattccaacctcgttacacataagaaagttcaaagtagagagaaatcttccatatgtactgagtgtgggaaggcctttacctacaggtcagatttgattacacatcacagaattcatactggagagaaaccttatgagtgcagtgactgtgggaagtctttcactaaaaaatcacagctccaagtgcatcagcgaattcacactggagagaagccttacgtgtgtgctgagtgtgggaaggcctttactgacaggtccaatttgaataaacatcagacaacacacactggagacaaaccctacaagtgtggcatctgtgggaaaggcttcgttcagaaatcagtgttcagcgtccatcagagcagccacgcttga

SEQ ID NO: 3347 - DNA, 4028 bp, Homo sapiens
ggaccggaagtggaagtggtcttccaaggcttttttgccgctggtgtcaggagtattttcatattccaataccgataaatctttgaggtttctgggtgtctctggggagcccctgggccagattttcctctagactccagcccatctcttcagagcagctctgcttgagttcacagatgactgccaagcttcagacaccctacagaaaaagggttgagacccagtgtggccatgccagctaattggacctcacctcagaaatcctcagccctggctccagaggatcatggcagctcctatgagggatcagtgtccttcagggatgtggctatcgatttcagcagagaggaatggcggcacctggacccttctcagagaaacctgtaccgggatgtgatgctggagacctacagccacctgctctcagtaggatatcaagttcctgaagcagaggtggtcatgttggagcaaggaaaggaaccatgggcactgcagggtgagaggccacgtcagagctgcccaggagagaaattatgggaccataatcaatgtagaaaaatcctcagttataaacaagtatcctctcaacctcaaaaaatgtatcctggggagaaagcttatgaatgcgccaaatttgaaaagatattcacccagaagtcacagctcaaagtacacctgaaagttcttgcaggagaaaagctctatgtatgcattgaatgtgggaaggcttttgtacagaagccagaatttattatacaccagaaaacccatatgagagagaaaccctttaaatgcaatgaatgtggaaaatccttttttcaagtgtcgtccctcttcaggcatcagagaattcataccggagagaaactctatgaatgcagccagtgtgggaaaggcttctcttataactcagatctcagtatacatgagaaaattcatactggagagagacaccatgaatgcactgactgtggcaaagcattcacacaaaagtccacactcaagatgcatcagaaaatccatacaggcgagagatcctacatctgtattgaatgcggacaggccttcatccagaagacccatttgattgcacaccgaagaattcatactggagaaaaaccatatgagtgcagtaactgtggcaaatccttcatttccaagtcacaacttcaggtacatcaacgtgttcacacaagagtgaagccctatatatgtaccgaatatgggaaggtcttcagcaataattccaacctcgttacacataagaaagttcaaagtagagagaaatcttccatatgtactgagtgtgggaaggcctttacctacaggtcagagttgattattcatcagagaattcacactggagagaaaccttatgaatgcagtgactgtgggaaagccttcactcagaagtcagcactcacagtgcatcagagaattcatacaggagaaaaatcgtatatatgcatgaaatgtggactggccttcattcagaaggcacacttgattgcacatcaaataattcatactggagagaaacctcataaatgtggtcactgtgggaaattgtttacctccaagtcgcaactccatgttcataaacgaattcacacaggagaaaagccctatatgtgcaataaatgtgggaaggcattcaccaaccggtcaaatctcattacacatcagaaaactcatacaggagagaaatcttatatatgttccaaatgtggaaaggccttcacccagaggtcagacttgattacacatcagagaatccatactggggagaagccttatgaatgcaatacttgtggaaaagccttcactcagaagtcacacctcaatatacatcagaaaattcacactggagagagacagtatgaatgccacgaatgtgggaaagccttcaaccagaaatcaatactcattgttcatcagaaaattcatacaggagagaaaccctatgtatgcactgagtgtggaagagctttcatccgcaagtcaaactttattactcatcaaagaattcatactggagagaagccttatgaatgcagtgactgtgggaagtcctttacctccaagtctcagctcctggtgcatcagccagttcacacaggagagaaaccctatgtgtgtgccgagtgcgggaaggcctttagtggcaggtcaaatctcagtaagcaccagaaaactcataccggagaaaagccctacatttgttctgaatgtgggaagacctttcgacagaagtcagagttgattacacatcacagaattcatactggagagaaaccttatgagtgcagtgactgtgggaagtctttcactaaaaaatcacagctccaagtgcatcagcgaattcacactggagagaagccttacgtgtgtgctgagtgtgggaaggcctttactgacaggtccaatttgaataaacatcagacaacacacactggagacaaaccctacaagtgtggcatctgtgggaaaggcttcgttcagaaatcagtgttcagcgtccatcagagcagccacgcttgagagaaacagtgtgagaaaacccccctgagggttgggtctgattgtacactgttgcacgcatgcagcagaaaaatatgtatattattgtaaatagaaatgaccacagcagaatgtcacacatggctgttctggagagggcctctgagaaggcactgaatgaggcgagggacccttcctacattgtcaccatccccagtaaaccttgggtcattattcatactgacaaggaaccgagtcaatttggtgaataggaaaagccttctcatgaaaactacaatagaatactgttaccaaattcttcctaagaaagatcgtattaagttaacgataatcctgtttactgtggattaggtatagtgccaacaaattgaatgataaaacaacataatacgtagttattttgatagtgatgaatcctaagttatgtgagttgttcgttgtggaacacattgtgtaacagactcctgggtgtttttctttctcattcgaatctaccacagttggtcatatccaaccctcattcagtatttctatcaagaaagagatgctacaaaaaaaaaaagaaaaaacctttatgtatacagacgtaaacctcagaatgtatgttgagtccccactgtcatctaccaagacttgcacccccctcattatctaccatgactgtctctcagcctcacgggccctcagcactttgtgttttgacccccagcaccgtgtcttgtgaactcccatcaccttcaagaaagcttccgaggtaagaattttatggtcatctgggacaacttaaatctcccttctgctgtcatagttcttccaactcagttgcctttttttttttttcgtactcatcactgacttgaagcttagtatctggcttccttaaggatgtaactttcatgtaacagattaataacttatatgaaaaccaacacaaccatatgtttagggctggaaagggccatgacgcctggccatttttcctgttttaccttactcttatgtgtgtcacacttcatcaattccggaaacagtttctggagatctcctcattacctcttttacaatcacctcactccagcatggtgtctgttacctcttcccacttgtgacaatgtctagtaaggtccactctccattctgtgtgatgaccacttattacaaccctcagaataggggacagtggtgtgccccctgcaatacaatggtttctatctcctgatacttttattacacctctagcaggatgtcttgtgatcctccttattgatttttccctcacgatgatgaacaattatctcccgttactcacctagcagtatctaactgtccctaacacagcatgtgggaatgccctcaatacggtggatgctgttaactttcttccttcccctcaggcaatggcggtgacttacaatgaaccataatgtccacatttcccaactgtattttggagcctcttctgtccccttctttctaggaccccagtt

SEQ ID NO: 3348 - DNA, 4093 bp, Homo sapiens
tgggagtctgtggtcagtgacagagcctgtagggtcagttatggtgatcggtttctgggtgtctctggggagcccctgggccagattttcctctagactccagcccatctcttcagagcagctctgcttgagttcacagatgactgccaagcttcagacaccctacagaaaaagggttgagacccagtgtggccatgccagctaattggacctcacctcagaaatcctcagccctggctccagaggatcatggcagctcctatgagtgttaaccttgatgcctgaaagaactggaaattatgaagatagattcagaagtcaaatatgttaactaactgcattgaagagtagaagaaaacaatagcctaggatcagtgtccttcagggatgtggctatcgatttcagcagagaggaatggcggcacctggacccttctcagagaaacctgtaccgggatgtgatgctggagacctacagccacctgctctcagtaggatatcaagttcctgaagcagaggtggtcatgttggagcaaggaaaggaaccatgggcactgcagggtgagaggccacgtcagagctgcccaggagagaaattatgggaccataatcaatgtagaaaaatcctcagttataaacaagtatcctctcaacctcaaaaaatgtatcctggggagaaagcttatgaatgcgccaaatttgaaaagatattcacccagaagtcacagctcaaagtacacctgaaagttcttgcaggagaaaagctctatgtatgcattgaatgtgggaaggcttttgtacagaagccagaatttattatacaccagaaaacccatatgagagagaaaccctttaaatgcaatgaatgtggaaaatccttttttcaagtgtcgtccctcttcaggcatcagagaattcataccggagagaaactctatgaatgcagccagtgtgggaaaggcttctcttataactcagatctcagtatacatgagaaaattcatactggagagagacaccatgaatgcactgactgtggcaaagcattcacacaaaagtccacactcaagatgcatcagaaaatccatacaggcgagagatcctacatctgtattgaatgcggacaggccttcatccagaagacccatttgattgcacaccgaagaattcatactggagaaaaaccatatgagtgcagtaactgtggcaaatccttcatttccaagtcacaacttcaggtacatcaacgtgttcacacaagagtgaagccctatatatgtaccgaatatgggaaggtcttcagcaataattccaacctcgttacacataagaaagttcaaagtagagagaaatcttccatatgtactgagtgtgggaaggcctttacctacaggtcagagttgattattcatcagagaattcacactggagagaaaccttatgaatgcagtgactgtgggaaagccttcactcagaagtcagcactcacagtgcatcagagaattcatacaggagaaaaatcgtatatatgcatgaaatgtggactggccttcattcagaaggcacacttgattgcacatcaaataattcatactggagagaaacctcataaatgtggtcactgtgggaaattgtttacctccaagtcgcaactccatgttcataaacgaattcacacaggagaaaagccctatatgtgcaataaatgtgggaaggcattcaccaaccggtcaaatctcattacacatcagaaaactcatacaggagagaaatcttatatatgttccaaatgtggaaaggccttcacccagaggtcagacttgattacacatcagagaatccatactggggagaagccttatgaatgcaatacttgtggaaaagccttcactcagaagtcacacctcaatatacatcagaaaattcacactggagagagacagtatgaatgccacgaatgtgggaaagccttcaaccagaaatcaatactcattgttcatcagaaaattcatacaggagagaaaccctatgtatgcactgagtgtggaagagctttcatccgcaagtcaaactttattactcatcaaagaattcatactggagagaagccttatgaatgcagtgactgtgggaagtcctttacctccaagtctcagctcctggtgcatcagccagttcacacaggagagaaaccctatgtgtgtgccgagtgcgggaaggcctttagtggcaggtcaaatctcagtaagcaccagaaaactcataccggagaaaagccctacatttgttctgaatgtgggaagacctttcgacagaagtcagagttgattacacatcacagaattcatactggagagaaaccttatgagtgcagtgactgtgggaagtctttcactaaaaaatcacagctccaagtgcatcagcgaattcacactggagagaagccttacgtgtgtgctgagtgtgggaaggcctttactgacaggtccaatttgaataaacatcagacaacacacactggagacaaaccctacaagtgtggcatctgtgggaaaggcttcgttcagaaatcagtgttcagcgtccatcagagcagccacgcttgagagaaacagtgtgagaaaacccccctgagggttgggtctgattgtacactgttgcacgcatgcagcagaaaaatatgtatattattgtaaatagaaatgaccacagcagaatgtcacacatggctgttctggagagggcctctgagaaggcactgaatgaggcgagggacccttcctacattgtcaccatccccagtaaaccttgggtcattattcatactgacaaggaaccgagtcaatttggtgaataggaaaagccttctcatgaaaactacaatagaatactgttaccaaattcttcctaagaaagatcgtattaagttaacgataatcctgtttactgtggattaggtatagtgccaacaaattgaatgataaaacaacataatacgtagttattttgatagtgatgaatcctaagttatgtgagttgttcgttgtggaacacattgtgtaacagactcctgggtgtttttctttctcattcgaatctaccacagttggtcatatccaaccctcattcagtatttctatcaagaaagagatgctacaaaaaaaaaaagaaaaaacctttatgtatacagacgtaaacctcagaatgtatgttgagtccccactgtcatctaccaagacttgcacccccctcattatctaccatgactgtctctcagcctcacgggccctcagcactttgtgttttgacccccagcaccgtgtcttgtgaactcccatcaccttcaagaaagcttccgaggtaagaattttatggtcatctgggacaacttaaatctcccttctgctgtcatagttcttccaactcagttgcctttttttttttttcgtactcatcactgacttgaagcttagtatctggcttccttaaggatgtaactttcatgtaacagattaataacttatatgaaaaccaacacaaccatatgtttagggctggaaagggccatgacgcctggccatttttcctgttttaccttactcttatgtgtgtcacacttcatcaattccggaaacagtttctggagatctcctcattacctcttttacaatcacctcactccagcatggtgtctgttacctcttcccacttgtgacaatgtctagtaaggtccactctccattctgtgtgatgaccacttattacaaccctcagaataggggacagtggtgtgccccctgcaatacaatggtttctatctcctgatacttttattacacctctagcaggatgtcttgtgatcctccttattgatttttccctcacgatgatgaacaattatctcccgttactcacctagcagtatctaactgtccctaacacagcatgtgggaatgccctcaatacggtggatgctgttaactttcttccttcccctcaggcaatggcggtgacttacaatgaaccataatgtccacatttcccaactgtattttggagcctcttctgtccccttctttctaggaccccagtt

SEQ ID NO: 3349 - DNA, 2141 bp, Homo sapiens
tggaaagagcttcacctggaagtcacagttcaaggcatcacagaattcataccggagaaaaactatatgaatgtagtgaatgtgggaaaggtttcccttataactcagatctcagtatacatgagaaaattcatactggagagagacaccatgaatgcactgactgtggcaaagcgttcacacaaaagtccacactcaagattcatcagaaaatccatacaggcgagagatcctacatctgtattgaatgcgggcaggccttcatccagaaaacacaattgattgcacaccgaagaattcatagtggagaaaaaccatatgaatgcaataactgtggcaaatccttcatttccaagtcacaacttcaggtacatcaacgtgttcacacaagagtgaagccctatatatgtaccgaatatgggaaggtcttcagcaataattccaacctcattacacatgagaagattcaaagtagagagaaatcttccatatgtactgagtgtgggaaggcctttacctacaggtcagagttgattattcatcagagaattcacactggagagaaaccttatgaatgcagtgactgtgggagagccttcactcagaagtcagcactcacagtgcatcagagaattcatacaggagaaaaatcgtatatatgcatgaaatgtggactggccttcatccggaaggcacacttgattacacatcaaataattcatactggagagaaaccttataaatgtggtcactgtgggaaattgtttacttccaagtcacaactccatgttcataaacgaattcacacaggagaaaagccctatgtatgcaataaatgtgggaaggcattcaccaaccggtcaaatctcattacacatcagaaaactcatacaggagagaaatcttatatatgttccaaatgtggaaaggccttcacccagaggtcagacttgattacacatcagagaatccatactggggagaagccttatgaatgcaatacttgtggaaaagcctttactcagaagtcaaatcttaatatacatcagaaaattcacactggagagagacagtatgaatgccacgaatgtgggaaagccttcaaccagaaatcaatactcattgttcatcagaaaattcatacaggagagaaaccctatgtatgcactgagtgtggaagagctttcatccgcaagtcaaactttattactcatcaaagaattcatactggagagaagccttatgaatgcagtgactgtgggaagtcctttacctccaagtctcagctcctggtgcatcagccagttcacacaggagagaaaccctatgtgtgtgccgagtgtgggaaagcctttagtggcaggtcaaatctcagtaagcaccagaaaactcataccggagaaaagccctacatttgttctgaatgtgggaagacctttcgacagaagtcagagttgattacacatcacagaattcatactggagagaaaccttatgagtgcagtgactgtgggaagtctttcactaaaaaatcacagctccaagtgcatcagcgaattcacactggagagaagccttacgtgtgtgctgagtgtgggaaggcctttagcaacaggtccaatttgaataaacatcagacaacacacactggagacaaaccctacaagtgtggcatctgtgggaaaggcttcgttcagaaatcagtgttcagtgttcatcagagcagccacgcttgagagaaacagtgtgagaaaacccccctgagggttgggtctgattgtacactgttgcacgcatgcagcagaaaaatatgtatattattgtaaatagaaatgaccacatcagaatgtcacacatggctgttctggagagggcctctgagaaggcactgaatgaggcgagggacccttcctacattgtcaccatccccagtaaaccttgggtcattattcatactgacaaggaaccgagtcaatttggtgaataggaaaagccttctcatgaaaactacaatagaatactgttaccaaattcttcataagaaagatcatattatgggaatgataatcctgtttactgtggattaggtatagtgccaacagtttgaatggtaagacaacataatatatatgatagtgatg

SEQ ID NO: 3350 - DNA, 2971 bp, Homo sapiens
gtcaggagattgagaccatcctggccaacatggtgaaaccccgtctctactaaaaatacaaaaattagctgggtgtggtggcacgtgcctgtaatcccagctactcaggaggctgaggcaggagaatcacttgaacccgggaggtggaggttgcagtaagccaagatcgcgccactgcactccagcctggggaacagagcaagactgtctcaaaaaaaaaatgaagtaaattaaaaacaacaaaacccatgttccgtaatcccatatatagtcactccaccgtgcaaagctgactatgcacattgaacaggaatgtgcccttacagggatcagtgtccttcagggatgtggctatcgatttcagcagagaggaatggcggcacctggacctttctcagagaaacctgtaccgggatgtgatgctggagacctacagccacctgctctcagtagggtatcaagttcctaaaccagaggtggtcatgttggagcaaggaaaggaaccatgggcactgcagggtgagaggccacgtcacagctgcccaggagagaaattatgggaccataatcaacatagaaaaatcatcggttataaaccagcttcctctcaagatcaaaaaatttattctggggaaaaatcctatgagtgtgctgaatttggaaagagcttcacctggaagtcacagttcaaggtacatctgaaagttcctacaggagaaaaactctatgtatgtattgaatgtgggagggcttttgtacagaagccagaattcatcacacatcagaaaacccatatgagagagaagccctataagtgcaatgaatgtggaaaatccttttttcaagtatcgtctcttttcaggcatcacagaattcataccggagaaaaactatatgaatgtagtgaatgtgggaaaggtttcccttataactcagatctcagtatacatgagaaaattcatactggagagagacaccatgaatgcactgactgtggcaaagcgttcacacaaaagtccacactcaagattcatcagaaaatccatacaggcgagagatcctacatctgtattgaatgcgggcaggccttcatccagaaaacacaattgattgcacaccgaagaattcatagtggagaaaaaccatatgaatgcaataactgtggcaaatccttcatttccaagtcacaacttcaggtacatcaacgtgttcacacaagagtgaagccctatatatgtaccgaatatgggaaggtcttcagcaataattccaacctcattacacatgagaagattcaaagtagagagaaatcttccatatgtactgagtgtgggaaggcctttacctacaggtcagagttgattattcatcagagaattcacactggagagaaaccttatgaatgcagtgactgtgggagagccttcactcagaagtcagcactcacagtgcatcagagaattcatacaggagaaaaatcgtatatatgcatgaaatgtggactggccttcatccggaaggcacacttgattacacatcaaataattcatactggagagaaaccttataaatgtggtcactgtgggaaattgtttacttccaagtcacaactccatgttcataaacgaattcacacaggagaaaagccctatgtatgcaataaatgtgggaaggcattcaccaaccggtcaaatctcattacacatcagaaaactcatacaggagagaaatcttatatatgttccaaatgtggaaaggccttcacccagaggtcagacttgattacacatcagagaatccatactggggagaagccttatgaatgcaatacttgtggaaaagcctttactcagaagtcaaatcttaatatacatcagaaaattcacactggagagagacagtatgaatgccacgaatgtgggaaagccttcaaccagaaatcaatactcattgttcatcagaaaattcatacaggagagaaaccctatgtatgcactgagtgtggaagagctttcatccgcaagtcaaactttattactcatcaaagaattcatactggagagaagccttatgaatgcagtgactgtgggaagtcctttacctccaagtctcagctcctggtgcatcagccagttcacacaggagagaaaccctatgtgtgtgccgagtgtgggaaagcctttagtggcaggtcaaatctcagtaagcaccagaaaactcataccggagaaaagccctacatttgttctgaatgtgggaagacctttcgacagaagtcagagttgattacacatcacagaattcatactggagagaaaccttatgagtgcagtgactgtgggaagtctttcactaaaaaatcacagctccaagtgcatcagcgaattcacactggagagaagccttacgtgtgtgctgagtgtgggaaggcctttagcaacaggtccaatttgaataaacatcagacaacacacactggagacaaaccctacaagtgtggcatctgtgggaaaggcttcgttcagaaatcagtgttcagtgttcatcagagcagccacgcttgagagaaacagtgtgagaaaacccccctgagggttgggtctgattgtacactgttgcacgcatgcagcagaaaaatatgtatattattgtaaatagaaatgaccacatcagaatgtcacacatggctgttctggagagggcctctgagaaggcactgaatgaggcgagggacccttcctacattgtcaccatccccagtaaaccttgggtcattattcatactgacaaggaaccgagtcaatttggtgaataggaaaagccttctcatgaaaactacaatagaatactgttaccaaattcttcataagaaagatcatattatgggaatgataatcctgtttactgtggattaggtatagtgccaacagtttgaatggtaagacaacataatatatatgatagtgatgaa

SEQ ID NO: 3351 - DNA, 2969 bp, Homo sapiens
ggtgctagaagtcggaccggaagtggaagtggtccccgaaggctatttcgccgctggcgtcaggactattttcacgttttaatgccgagaggtctctgtgacgattttggttcttgggtgtctctggggagtccctgggccagaccttcctccagactccagcccacctcttcggagcagctctgctgagttcacagatgaccactaaacttcaggcaccctagacaaaaagggttgagatccagtgtggccatgccagctagttggacctcaccccagaaatcctcagccctggctccagaggatcatggcagctcctatgagggatcagtgtccttcagggatgtggctatcgatttcagcagagaggaatggcggcacctggacctttctcagagaaacctgtaccgggatgtgatgctggagacctacagccacctgctctcagtagggtatcaagttcctaaaccagaggtggtcatgttggagcaaggaaaggaaccatgggcactgcagggtgagaggccacgtcacagctgcccaggagagaaattatgggaccataatcaacatagaaaaatcatcggttataaaccagcttcctctcaagatcaaaaaatttattctggggaaaaatcctatgagtgtgctgaatttggaaagagcttcacctggaagtcacagttcaaggtacatctgaaagttcctacaggagaaaaactctatgtatgtattgaatgtgggagggcttttgtacagaagccagaattcatcacacatcagaaaacccatatgagagagaagccctataagtgcaatgaatgtggaaaatccttttttcaagtatcgtctcttttcaggcatcacagaattcataccggagaaaaactatatgaatgtagtgaatgtgggaaaggtttcccttataactcagatctcagtatacatgagaaaattcatactggagagagacaccatgaatgcactgactgtggcaaagcgttcacacaaaagtccacactcaagattcatcagaaaatccatacaggcgagagatcctacatctgtattgaatgcgggcaggccttcatccagaaaacacaattgattgcacaccgaagaattcatagtggagaaaaaccatatgaatgcaataactgtggcaaatccttcatttccaagtcacaacttcaggtacatcaacgtgttcacacaagagtgaagccctatatatgtaccgaatatgggaaggtcttcagcaataattccaacctcattacacatgagaagattcaaagtagagagaaatcttccatatgtactgagtgtgggaaggcctttacctacaggtcagagttgattattcatcagagaattcacactggagagaaaccttatgaatgcagtgactgtgggagagccttcactcagaagtcagcactcacagtgcatcagagaattcatacaggagaaaaatcgtatatatgcatgaaatgtggactggccttcatccggaaggcacacttgattacacatcaaataattcatactggagagaaaccttataaatgtggtcactgtgggaaattgtttacttccaagtcacaactccatgttcataaacgaattcacacaggagaaaagccctatgtatgcaataaatgtgggaaggcattcaccaaccggtcaaatctcattacacatcagaaaactcatacaggagagaaatcttatatatgttccaaatgtggaaaggccttcacccagaggtcagacttgattacacatcagagaatccatactggggagaagccttatgaatgcaatacttgtggaaaagcctttactcagaagtcaaatcttaatatacatcagaaaattcacactggagagagacagtatgaatgccacgaatgtgggaaagccttcaaccagaaatcaatactcattgttcatcagaaaattcatacaggagagaaaccctatgtatgcactgagtgtggaagagctttcatccgcaagtcaaactttattactcatcaaagaattcatactggagagaagccttatgaatgcagtgactgtgggaagtcctttacctccaagtctcagctcctggtgcatcagccagttcacacaggagagaaaccctatgtgtgtgccgagtgtgggaaagcctttagtggcaggtcaaatctcagtaagcaccagaaaactcataccggagaaaagccctacatttgttctgaatgtgggaagacctttcgacagaagtcagagttgattacacatcacagaattcatactggagagaaaccttatgagtgcagtgactgtgggaagtctttcactaaaaaatcacagctccaagtgcatcagcgaattcacactggagagaagccttacgtgtgtgctgagtgtgggaaggcctttagcaacaggtccaatttgaataaacatcagacaacacacactggagacaaaccctacaagtgtggcatctgtgggaaaggcttcgttcagaaatcagtgttcagtgttcatcagagcagccacgcttgagagaaacagtgtgagaaaacccccctgagggttgggtctgattgtacactgttgcacgcatgcagcagaaaaatatgtatattattgtaaatagaaatgaccacatcagaatgtcacacatggctgttctggagagggcctctgagaaggcactgaatgaggcgagggacccttcctacattgtcaccatccccagtaaaccttgggtcattattcatactgacaaggaaccgagtcaatttggtgaataggaaaagccttctcatgaaaactacaatagaatactgttaccaaattcttcataagaaagatcatattatgggaatgataatcctgtttactgtggattaggtatagtgccaacagtttgaatggtaagacaacataatatatatgatagtgatgaa

SEQ ID NO: 3352 - DNA, 346 bp, Homo sapiens
atccggcgatgctgggtctggacgagctcgggaggagtggttgtggccattgcacacaggcggatctgaggttcggcgacgccgctggtcgcgacccgggacaggacaacgacaggaacaccgccgagcccgcgttccccccccgcccagagtcatggcggcagcagccgctctgagggcgcctgctcagagcagtgtgacctttgaagacgtggctgtaaacttttccctggaggaatggagtcttcttaatgaggctcagggatgcctgtaccatgatgtgatgctggagaccttgacacttatatcctccctgggatgttggcttcaggtggaagatggtgct

SEQ ID NO: 3353 - DNA, 2265 bp, Homo sapiens
ctagccgtggcagccattttggcctgtcaggtccatccggcgatgctgggtctggacgagctcgggaggagtggttgtggccattgcacacaggcggatctgaggttcggcgacgccgctggtcgcgacccgggacaggacaacgacaggaacaccgccgagcccgcgttccccccccgcccagagtcatggcggcagcagccgctctgagggcgcctgctcagactactgtggatgatgtcagccacattatggtgtaagccctaaagttaagagcagtgtgacctttgaagatgtggctgtaaacttttccctggaggaatggagtcttcttaatgaggctcagagatgcctgtaccgtgacgtgatgctggagaccttgacacttatatcctccctgggttgttggcatggaggggaagatgaggcagcaccttctaagcagagcacgtgtatacatatatacaaagaccagggaggtcatagtggagaaaggccttatgagtgtggggaatataggaaattatttaagaacaagtcctgcctcactgaacccagaagagatcacaaacacaggaatgttcgcactggagaaaggccttatgagtgcagcaaatatgggaaattatttcaccaaaagcctacactccatattcatgagagatttcatactgggcaaaagacctatgagtgcagtgagtgtggaaaatcatttcaccaaagctcttcactcttgcagcgtcagacacttcacactagagaaaggccttatgagtgtattgaatgtgggaaagcctttgctgaaaagtccagtctcattaaccacaggaaagttcactctggagcaaagcgttatgaatgcaatgaatgtgggaagtcctttgcttatacatctagtctcattaaacacaggaggattcacactggagagaggccttatgagtgcagtgaatgtgggagatcctttgctgaaaactccagtcttattaaacacttgagagttcacacaggagaaaggccttatgaatgcgttgagtgtggaaaatcatttcgccgaagctcttcactcttgcagcatcagagagttcacactagagaaaggccttatgaatgtagtgaatgtgggaaatcctttagcttaaggtccaacctcattcaccatcagcgagttcatactggagaaaggcatgagtgcgggcagtgtgggaaatcctttagccgaaaatctagccttattatacatctgagagttcacactggagaaaggccttatgagtgcagtgactgtgggaaatcctttgctgaaaactccagccttattaaacacttgagagttcacactggagaaaggccatatgaatgcattgattgtggaaaatcatttcgccacagttcttcgttccgtcgccatcagagagttcatactggaatgaggccttataagtgaagcaaattttggaaattctcttgcccaggctttttgctccttcaaggccagagagttcacaccagatcaaggtgttatgagtgtgacaaatggggaatattctttagctagaatgctagcttctttacataaaagagtgctcccactgaagaagtgccttttgagtgcaatgaatgtgagaaagccttcagccctctctcattggttaccacaatatttacatgaggaaaataccacagatgtggaggtaatattattttttcttcaatataacactggaggaaaccccttatgaggatgccatctgcctaaattgaatgtcatacatcaaatagctgcatacattccaggtatgtgggaactgcatagtatttttcgacctgcccaggtctcttgctagacttctgtgacttacagttctcttctaaaaagcatttcacctttaccacttggcaggtgcccacagtacatcattcgcctaactcatcatgatccagaagtaactttgattttgtttcattcaacagagggattttttagtatcctcagcactcattctattctcatttctttctctccaatgagttaggccatgaacctgactcatttttggcacagaggactcttctgataacttgaaaaaatggactacctttttcagggatcttttggatctcacagagttcttaagatggaattttccagcctgccagtcatgaatctcagacagcctgccacctattgccctgatttgtgttataataaaggccttgttgcttaagacaccttcagtctttgcaggagggcatggaagctcc

SEQ ID NO: 3354 - DNA, 1958 bp, Homo sapiens
ctcgggaggagtggttgtggccattgcacacaggcggatctgaggttcggcgacgccgctggtcgcgacccgggacaggacaacgacaggaacaccgccgagcccgcgttccccccccgcccagagtcatggcggcagcagccgctctgagggcgcctgctcaggttgttggcatggaggggaagatgaggcagcaccttctaagcagagcacgtgtatacatatatacaaagaccagggaggtcatagtggagaaaggccttatgagtgtggggaatataggaaattatttaagaacaagtcctgcctcactgaacccagaagagatcacaaacacaggaatgttcgcactggagaaaggccttatgagtgcagcaaatatgggaaattatttcaccaaaagcctacactccatattcatgagagatttcatactgggcaaaagacctatgagtgcagtgagtgtggaaaatcatttcaccaaagctcttcactcttgcagcgtcagacacttcacactagagaaaggccttatgagtgtattgaatgtgggaaagcctttgctgaaaagtccagtctcattaaccacaggaaagttcactctggagcaaagcgttatgaatgcaatgaatgtgggaagtcctttgcttatacatctagtctcattaaacacaggaggattcacactggagagaggccttatgagtgcagtgaatgtgggagatcctttgctgaaaactccagtcttattaaacacttgagagttcacacaggagaaaggccttatgaatgcgttgagtgtggaaaatcatttcgccgaagctcttcactcttgcagcatcagagagttcacactagagaaaggccttatgaatgtagtgaatgtgggaaatcctttagcttaaggtccaacctcattcaccatcagcgagttcatactggagaaaggcatgagtgcgggcagtgtgggaaatcctttagccgaaaatctagccttattatacatctgagagttcacactggagaaaggccttatgagtgcagtgactgtgggaaatcctttgctgaaaactccagccttattaaacacttgagagttcacactggagaaaggccatatgaatgcattgattgtggaaaatcatttcgccacagttcttcgttccgtcgccatcagagagttcatactggaatgaggccttataagtgaagcaaattttggaaattctcttgcccaggctttttgctccttcaaggccagagagttcacaccagatcaaggtgttatgagtgtgacaaatggggaatattctttagctagaatgctagcttctttacataaaagagtgctcccactgaagaagtgccttttgagtgcaatgaatgtgagaaagccttcagccctctctcattggttaccacaatatttacatgaggaaaataccacagatgtggaggtaatattattttttcttcaatataacactggaggaaaccccttatgaggatgccatctgcctaaattgaatgtcatacatcaaatagctgcatacattccaggtatgtgggaactgcatagtatttttcgacctgcccaggtctcttgctagacttctgtgacttacagttctcttctaaaaagcatttcacctttaccacttggcaggtgcccacagtacatcattcgcctaactcatcatgatccagaagtaactttgattttgtttcattcaacagagggattttttagtatcctcagcactcattctattctcatttctttctctccaatgagttaggccatgaacctgactcatttttggcacagaggactcttctgataacttgaaaaaatggactacctttttcagggatcttttggatctcacagagttcttaagatggaattttccagcctgccagtcatgaatctcagacagcctgccacctattgccct

SEQ ID NO: 3355 - DNA, 2215 bp, Homo sapiens
agccgtggcagccattttggcctgtcaggtccatccggcgatgctgggtctggacgagctcgggaggagtggttgtggccattgcacacaggcggatctgaggttcggcgacgccgctggtcgcgacccgggacaggacaacgacaggaacaccgccgagcccgcgttccccccccgcccagagtcatggcggcagcagccgctctgagggcgcctgctcagagcagtgtgacctttgaagatgtggctgtaaacttttccctggaggaatggagtcttcttaatgaggctcagagatgcctgtaccgtgacgtgatgctggagaccttgacacttatatcctccctgggttgttggcatggaggggaagatgaggcagcaccttctaagcagagcacgtgtatacatatatacaaagaccagggaggtcatagtggagaaaggccttatgagtgtggggaatataggaaattatttaagaacaagtcctgcctcactgaacccagaagagatcacaaacacaggaatgttcgcactggagaaaggccttatgagtgcagcaaatatgggaaattatttcaccaaaagcctacactccatattcatgagagatttcatactgggcaaaagacctatgagtgcagtgagtgtggaaaatcatttcaccaaagctcttcactcttgcagcgtcagacacttcacactagagaaaggccttatgagtgtattgaatgtgggaaagcctttgctgaaaagtccagtctcattaaccacaggaaagttcactctggagcaaagcgttatgaatgcaatgaatgtgggaagtcctttgcttatacatctagtctcattaaacacaggaggattcacactggagagaggccttatgagtgcagtgaatgtgggagatcctttgctgaaaactccagtcttattaaacacttgagagttcacacaggagaaaggccttatgaatgcgttgagtgtggaaaatcatttcgccgaagctcttcactcttgcagcatcagagagttcacactagagaaaggccttatgaatgtagtgaatgtgggaaatcctttagcttaaggtccaacctcattcaccatcagcgagttcatactggagaaaggcatgagtgcgggcagtgtgggaaatcctttagccgaaaatctagccttattatacatctgagagttcacactggagaaaggccttatgagtgcagtgactgtgggaaatcctttgctgaaaactccagccttattaaacacttgagagttcacactggagaaaggccatatgaatgcattgattgtggaaaatcatttcgccacagttcttcgttccgtcgccatcagagagttcatactggaatgaggccttataagtgaagcaaattttggaaattctcttgcccaggctttttgctccttcaaggccagagagttcacaccagatcaaggtgttatgagtgtgacaaatggggaatattctttagctagaatgctagcttctttacataaaagagtgctcccactgaagaagtgccttttgagtgcaatgaatgtgagaaagccttcagccctctctcattggttaccacaatatttacatgaggaaaataccacagatgtggaggtaatattattttttcttcaatataacactggaggaaaccccttatgaggatgccatctgcctaaattgaatgtcatacatcaaatagctgcatacattccaggtatgtgggaactgcatagtatttttcgacctgcccaggtctcttgctagacttctgtgacttacagttctcttctaaaaagcatttcacctttaccacttggcaggtgcccacagtacatcattcgcctaactcatcatgatccagaagtaactttgattttgtttcattcaacagagggattttttagtatcctcagcactcattctattctcatttctttctctccaatgagttaggccatgaacctgactcatttttggcacagaggactcttctgataacttgaaaaaatggactacctttttcagggatcttttggatctcacagagttcttaagatggaattttccagcctgccagtcatgaatctcagacagcctgccacctattgccctgatttgtgttataataaaggccttgttgcttaagacaccttcagtctttgcaggagggcatggaagctccaa

SEQ ID NO: 3356 - DNA, 1697 bp, Homo sapiens
gccattttggcctgtcaggtccatccggcgatgctgggtctggacgagctcgggaggagtggttgtggccattgcacacaggcggatctgaggttcggcgacgccgctggtcgcgacccgggacaggacaacgacaggaacaccgccgagcccgcgttccccccccgcccagagtcatggcggcagcagccgctctgagggcgcctgctcagagcagtgtgacctttgaagacgtggctgtaaacttttccctggaggaatggagtcttcttaatgaggctcagggatgcctgtaccatgatgtgatgctggagaccttgacacttatatcctccctgaaagggtgcactcgccagcagttttgcaacaggagcacactgaacaaagaagacagggtcatttataacctgaggcgttcaccctcctgccggtttccattgcctggaacaggacctcatattctgtatgtgtcctgattggctagcaacttagaaccttttaagaggcaaaggtagaggagaacaaagaaaggaggaagtaacttgtggaatgctgagaaaggtaaaaacacttttaaataaggaagaggaacaggctatgacctaatgcttgcttggagcagtataagcatgtcagggcaaatatttaggctaaattgtcagagctaagaacataaagtacattgatttctttattatggctagcagatatttaagaatgctagcacaagtctttcaataaatttcgcttttaagagaagttactatttattcctaattagatggggaggaaagtctttgaagaggaaactgtactttacttttaacaatattccccctctttttatttcataattcctcttcaaacttatttaatgttttgacttaattgctttttttgtccttctaagagaagtaatttttttttaatagggaggaggagagttagcagttaactctgtaacagtggcagagacaagtttttgtataaaactttgaaggtagggaatattataacagcctacaagaataagtacactaataacaagagtgaacaaggtgagaattgaagttaaaatttctttttattcactgaactaatgttttattattttagaaaaggggttatttattttacaattcttggcaaatttatcggatagggctgttaaccttggtagcgcttttgttatagttctatcaggggcagtattattaggaacaaaggtacaatactgagttttgtataaaacatttaatttattggtctttgtggggaattagacgcattaccactctgttacaactgaggcattaattttgtagcttcaccaacattaattggtttgctttcatgacactgctgaggaatcaattctttctgcagaggttctgagttttaattatgacacaaacatctcctttttctgctaattatttaaagctattttatttttctacgccatctggctagtagatcctaattgcttagctatctgtttgatggtatcctcagtgtaatttatgaattgttggtgattgtaacatagcttagtctacatttttttatagttaccagaatgatgtggatttaaattctgcagctatttgattttgtgctttaaacttatcgggcacttctcacaggaccttaatagcatttatgtaaacctgaggattaaaggactcatacgtttt

SEQ ID NO: 3357 - DNA, 1802 bp, Homo sapiens
aaagtcaagccaggacttccggcgtcctagccgtggcagccattttggcctgtcaggtccatccggcgatgctgggtctggacgagcccgggacaggacaacgacaggaacaccgccgagcccgcgttccccccccgcccagagtcatggcggcagcagccgctctgagggcgcctgctcagagcagtgtgacctttgaagatgtggctgtaaacttttccctggaggaatggagtcttcttaatgaggctcagagatgcctgtaccgtgacgtgatgctggagaccttgacacttatatcctccctgggttgttggcatggaggggaagatgaggcagcaccttctaagcagagcacgtgtatacatatatacaaagaccagggaggtcatagtggagaaaggccttatgagtgtggggaatataggaaattatttaagaacaagtcctgcctcactgaacccagaagagatcacaaacacaggaatgttcgcactggagaaaggccttatgagtgcagcaaatatgggaaattatttcaccaaaagcctacactccatattcatgagagatttcatactgggcaaaagacctatgagtgcagtgagtgtggaaaatcatttcaccaaagctcttcactcttgcagcgtcagacacttcacactagagaaaggccttatgagtgtattgaatgtgggaaagcctttgctgaaaagtccagtctcattaaccacaggaaagttcactctggagcaaagcgttatgaatgcaatgaatgtgggaagtcctttgcttatacatctagtctcattaaacacaggaggattcacactggagagaggccttatgagtgcagtgaatgtgggagatcctttgctgaaaactccagtcttattaaacacttgagagttcacacaggagaaaggccttatgaatgcgttgagtgtggaaaatcatttcgccgaagctcttcactcttgcagcatcagagagttcacactagagaaaggccttatgaatgtagtgaatgtgggaaatcctttagcttaaggtccaacctcattcaccatcagcgagttcatactggagaaaggcatgagtgcgggcagtgtgggaaatcctttagccgaaaatctagccttattatacatctgagagttcacactggagaaaggccttatgagtgcagtgactgtgggaaatcctttgctgaaaactccagccttattaaacacttgagagttcacactggagaaaggccatatgaatgcattgattgtggaaaatcatttcgccacagttcttcgttccgtcgccatcagagagttcatactggaatgaggccttataagtgaagcaaattttggaaattctcttgcccaggctttttgctccttcaaggccagagagttcacaccagatcaaggtgttatgagtgtgacaaatggggaatattctttagctagaatgctagcttctttacataaaagagtgctcccactgaagaagtgccttttgagtgcaatgaatgtgagaaagccttcagccctctctcattggttaccacaatatttacatgaggaaaataccacagatgtggaggtaatattattttttcttcaatataacactggaggaaaccccttatgaggatgccatctgcctaaattgaatgtcatacatcaaatagctgcatacattccaggtatgtgggaactgcatagtatttttcgacctgcccaggtctcttgctagacttctgtgacttacagttctcttctaaaaagcatttcacctttacc

SEQ ID NO: 3358 - DNA, 865 bp, Homo sapiens
gtagcggccacgttgatctgcgatacgcgtgtttgcccagtgagtggccccggactgctacgtgggactgcggtgaatgaacccagaaggtggagaggaaccgttctcggtgcacagaggcggctctgcagcccggtgagggcgcctgctgctcccgggcagtgctttccccaagtagtccgatggctgcggctgcgccgaggcgccctactcagggcacagtgacttttgaagacgtggctgtgaaatttacccaggaggaatggaatctccttagtgaggctcagagatgcctgtaccgtgatgtgactctggagaacctggcacttatgtcctccctgggttgttggtgtggagtggaagatgaggcggcaccttctaagcagagtatttatatacaaagagagactcaggtcaggactcctgtgacaggtgtgtctcccaagaaggcccacccctgtgagatgtgtggcccgatcttgggagacattttgcatgtggcagatcatcagggaacacatcacaagcagaaactgcacaggtgtgaggcctgggggaataaattgtatgacagtggaaactttcatcagcaccagaatgagcacattggagagaaaccctacagagggagtgttgaggaggcgttgtttgtgaagaggtcagggcactgtgacctttgaagatgtggctgtgaacttttcccaggaggagtggtgtcttcttagtgaggctcagaggtgcttgtaccgtgatgtgatgctagagaacctggctctcatatcctcgctgggttgttggtgtggatcaaaagatgaggaggcaccttgtaagcagagaatttctgtacaaagagagtctcagagca

SEQ ID NO: 3359 - DNA, 6843 bp, Homo sapiens
gtggcccctgagtgctgggtgggaccgcggtgactgaacctagaaggtggagaggaatcgtcctcggtgcccagaggcggctctgcagccccgtgacggcgaccactgctcccgggccgtgcttccccaagtagtccgatggcagcggctgtgccgaggcgcccaactcagcagggcactgtgacctttgaagatgtggctgtgaacttttcccaggaggagtggtgtcttcttagtgaggctcagaggtgcttgtaccgtgatgtgatgctagagaacctggctctcatatcctcgctgggttgttggtgtggatcaaaagatgaggaggcaccttgtaagcagagaatttctgtacaaagagagtctcagagcaggactcctagggcaggtgtttctcctaagaaggctcacccctgtgaaatgtgtggcctcatcttggaggatgtttttcactttgctgaccaccaggaaactcatcacaagcagaagctgaacaggagtggagcatgtggaaaaaacttggatgacactgcataccttcatcagcaccagaagcagcatattggagagaaattctacagaaagagtgtcagagaagcatcgtttgtaaagaaacgtaagctcagggtgtcacaggagccatttgtcttccgcgagtttgggaaggacgttctgcccagttcaggattgtgccaagaagaagctgctgtagagaagacagacagtgaaactatgcatggcccaccctttcaggagggaaaaactaattacagttgtggaaaacgcacaaaagccttcagcaccaaacactcagttattccacaccagaaacttttcactagagatggatgttatgtgtgcagtgattgtggaaaatcctttagcagatatgtcagcttcagtaatcatcagcgagatcacactgcaaaaggaccttatgattgtggagagtgtgggaaatcttatagtcgaaagagcagccttattcaacatcagcgagtccacactggacagacagcttatccctgtgaggagtgcgggaaatcttttagtcagaagggcagccttattagccatcagcttgttcacactggagaagggccttatgagtgtagagaatgtgggaaatcttttggtcaaaagggtaacctcattcaacatcagcaaggtcacactggagagagagcttatcactgtggggaatgtgggaaatcttttcgtcagaagttctgctttattaaccatcagcgtgttcacactggagaaaggccttacaagtgtggagaatgtgggaaatcttttggtcaaaagggcaacctcgttcaccatcagcgaggtcatactggagaaaggccctatgagtgcaaggaatgtgggaaatcatttaggtacagatcccacctcactgaacaccagagacttcacactggggaaagaccttacaattgtagggaatgtgggaaattatttaacaggaagtatcatcttctggttcatgagagagttcacactggagaaaggccatatgcgtgtgaggtatgtgggaaattatttggcaataagcacagcgtgactatacatcagaggattcacactggagaaaggccgtatgaatgcagtgaatgtgggaaatcatttctttccagctctgcgcttcatgttcataaaagagttcattctggacaaaagccttataagtgcagtgaatgtggaaaatccttttctgaatgttccagtctcattaaacacaggagaattcacactggagaaaggccttatgaatgcaccaaatgtggaaaaacatttcagcgaagctctaccctccttcatcatcagagttcacacaggagaaaggccttatgagtgcagtgaatatgggaaatcgtttgctgaagcatcccgtctcgttaaacacaggagagttcatactggagaaaggccttatgagtgctgtcaatgtggaaaacatcagaatgtctgctgtcctcggtcttaagcgacttcgtgttgagatggagtcttgttctgtcacccaggctggagtgcagtggtgcagtcttggctcgctgcaacttgggcctcctgggttcatgcaatcctcctacctcagcctcctgagtagctgggattatgagtacacaccaccacgcccagctaatttttgtgtttttagtggagatggggttttaccatgttggccaggctggtctcaaactcctgacctcaagtgatccacccaccttgactcccaaagtgctgaaattacaggcatgagcctctgcacctggccttcattcttttcgtattgcttagaatatgacatgctgaaccaggcatggtggctcatgcttgtaaacctgatgctttgggaggacaaggtggttcattggaggccaggagttagagatcagcctgggcaacatagccagacctcctctctacaaaaagaaaaaagaatgacatgcttcttgtttttgtctgttataaatgaaactgctatatttgaatgcagttgttcatgtaggtatgtttcactatggtaatatggtggtgtgcagtgcctgagtcacgtgatagattaaagtacaactcttttttgagacagagtctcactctgtcacccaggcgggagttaggtggcatgatttcggctcactgcaacctctgcctcccaagttcaactgattcttctgcctcagcctcccgagtagcagggattaccggtgtgcaccaccatgcctggataacttttttttttatttctattagcaatggggtttcaccatgctggccaggcttgttatgaactgacctcaagtgatctgcctgcctcagcttctcaggtgtgacctactgtgcttggcctaatgtacaactttttaagcaatgccaaactatgacttaagaatgaaattattgctcatttgtatatctatctaccatcagtgtccaagaatttctgttctatcttaccaagagggagtatggttagtatttgaaattgtttattattttaataagtggttataacttttgagtcagtggtttatgttttgcattttttttgttttgagacaaagtctcgctctgtctcccaggctagagtaccgtggcacaatctcagctcattgcaacctctgcttcctgggctcaagcactctgcccacctcagcctccagagtagctggaaatacaggtatgcaccaccacaactggataacttttgtattttctgtagagagggttttacctttttgcccagtctgatcgcgaactcctgggctcaggcgatccacttgcctaggctccaaaagtgcttggtctacaggggtgaggcaccctgcctggcctcacctgtaggcttgttttttaaaatgaattttatctatttcccatttcattaatatatttaaaaataatgaaataacaaagacgtatgttggacttcattcattcttcagtgatgtcactttgctgcaaggaatatttggttttcttttttttttttttttccagatggagtctagctctgtctcctaagctacagtgaagtggcatgatctcggcccactgcaacctccacctcctgtgttcaagcgattctgcctcagcctcctgagtagctgggactacaggcatgtgccattatacctggctaattttatttatttattttagtagagatggggtttcaccatgttacccaggctgctctctaccttctgagctcaagtgatccacctgcctcggcctcccaaagtgctgggattacaggtgtcagccactgtacctggctgaatacttggttttcagtaccacaagaactatgagctggttatccacttcatgtggaatcataagcgtcccaaagtgacaatacatatagattgccaggcagtgaaacagttaagatgccaccatagctttcttttcaacatctttctaagattaccttactatttcttttgttccaagtttgtacttcctcacagttctcacatatggaaaggatacacactttgtagaaacaagaactttatgttatccaagttctaggatagccatgagctccaattatctcagagctctgagtcctctactcaatacccattgagatttatgtgttctgaggcttttgtcttctagctacttacttcattctccatgggtaacgtcattcatccacattaactaatttcctcactccaagctcttttctagagataatctccagtccctgtgcagaaactgtcattgcactttctgctgaaatggcagtttcttctcagcaaggtgagattatggaatccagaatcttttttcaggggtcacatgcccatttccccacttgcatgaatgtcgacactgcagccacagttttggccgtaaatgtgaatttggcaagtaaccactgttcccagggaaatgtcccaatcagaagaagattatctgggacactgatactgacagggagatgggacattctgagggacccggaggcagggtgccacctcctcaacttccctgagggctgcctagaatctgtttcctctcactctgaattattcttcctcttatggctgaccaaaaacatggaacctcacaaagtccactgtaacagctttatatttgtgaagtgaagaacatgaagacagtttcaagcaaagttattgagtggacactttgtgttttttttgagaagtctcactctttcacccaggctggagtgcagtggcacgatctcggctcactgcaactccacctcccgggttcacgccattctcttgcctcagcctcctgagtagctgggaccacaagcgcccaccacgtcagcttaatttttttgttttgtttcttgagacagagtcttgctctcttgcccaggttggagtgccgtgtcgcaatctcagctcactgcaacttctacctcctggattcaagcacttctccttgcctcagccacctctttagctgggattacaggtgcgtgccaccacacccagctaatttttgtatttttagcagagaccaggtttcaccatgttggtcaggctggtctcaaactcctgacctcgtgatccacccacctcggcctcccaaagtgctggaattacaggcgtgagccactgcacctggcctgtattcttttctttagtagagacggggttttactgtatttgccaggatggtctcgatctccagacctcgtgatccgcccgccttagcctcccaaagtgctgggattataggcgtgagccaacacgccctggccacttcttgtctttgcaacattttttagatatgtatttgtgttttttggggagcttaatttgctaatggaatctctgttattttcctaacatgcttggtggatacaagagttaagacttcctgtcccgtttagtgtaacaaaagaaagttaagaaatgtggataaaagattgtaagttagaaatggcaagataatcagctatatgaagaatcttggccaggtgtggtggctgaggcctgtaatcccaccactttgggaggctgaggtgggcggatcacaaggtcaggagttcaagaccaccctggccaatattgtgaattcctgtctctactaaaaatacaaaaattagtcgggcatggtggcgggtgcctgtagtcccagctactcgggaggctgaggccagaaaatcggttgaacctgggaggtggaaggtgcactgagccaatatcacaccagtgcactccaacctggtgacagagagacacatcatctcaaaaaaaaaaaaaaaactcaatccataaatgttatactttataactttataacagcatgttatatgggcttagatattatccctaaatttttttttttttttttttttttgagacagagtctcactctgtcacccaggctgaagtgcaatggcatggtctcggctcactgcaacctccgcctcccaggttcaagtgattctcttgcctcagcctcccgagtagctgggcctataggttccctccaccacgcccagctaatttttgtatttttagtagagatgggctttcactacgttagccaggctggtctcaaactcctgacctcatgatccacccccctcggcctcctaaagtgctgggattacaggcatctgccaccgcactcggcttatccctagaaatcctatgatagcatgatgtataggcacctaaaggcatggcacttgagaaatgtgaataagattgtaagttacaaatagcaaggtacagtcagatgttaacagtctcagcccctaaatgtcaccttgtattacagcatgttatataagcacatacaggcacatacatgaaatagtgatacttcattctcagtaatatcttcatccttctcactggaaagatctttgatgatttttaatcaacataggagtttcaatgatatctagaagtttaaaagggctcgttcaaacaaattatgaccacacacactgaagagtatgtttgtctcttgtggtgtaaatttttttttattacaccaaattatgttcacacaaaacctttgtaatcagggggaattaaagagccttcctggaaaatggaggttgcaatcagccgagatggtgccatcgcactctagcctggggaatagagtgagatcctgcctcaaaaaaaacaaaaaaattctttattttctccataaactacagtttatataagcaaaagtttcagtactaagcaattttagtctctgcagtctcttgtcttgaattaatacaacttttgttaattctcttatgaagttaatcttcctgcttgtatgtgaattaaatatatgtcaaactttttttgtacaaaa

SEQ ID NO: 3360 - DNA, 2791 bp, Homo sapiens
ctcttgtagcggccacgttgatctgcgatacgcgtgtttgcccagtgagtggccccggactgctacgtgggactgcggtgaatgaacccagaaggtggagaggaaccgttctcggtgcacagaggcggctctgcagcccggtgagggcgcctgctgctcccgggcagtgctttccccaagtagtccgatggctgcggctgcgccgaggcgccctactcaggagcaacttggcgaggttcagactcttggagccagaagctacatgacccctaaacgggcactgtgacctttgaagatgtggctgtgaacttttcccaggaggagtggtgtcttcttagtgaggctcagaggtgcttgtaccgtgatgtgatgctagagaacctggctctcatatcctcgctgggttgttggtgtggatcaaaagatgaggaggcaccttgtaagcagagaatttctgtacaaagagagtctcagagcaggactcctagggcaggtgtttctcctaagaaggctcacccctgtgaaatgtgtggcctcatcttggaggatgtttttcactttgctgaccaccaggaaactcatcacaagcagaagctgaacaggagtggagcatgtggaaaaaacttggatgacactgcataccttcatcagcaccagaagcagcatattggagagaaattctacagaaagagtgtcagagaagcatcgtttgtaaagaaacgtaagctcagggtgtcacaggagccatttgtcttccgcgagtttgggaaggacgttctgcccagttcaggattgtgccaagaagaagctgctgtagagaagacagacagtgaaactatgcatggcccaccctttcaggagggaaaaactaattacagttgtggaaaacgcacaaaagccttcagcaccaaacactcagttattccacaccagaaacttttcactagagatggatgttatgtgtgcagtgattgtggaaaatcctttagcagatatgtcagcttcagtaatcatcagcgagatcacactgcaaaaggaccttatgattgtggagagtgtgggaaatcttatagtcgaaagagcagccttattcaacatcagcgagtccacactggacagacagcttatccctgtgaggagtgcgggaaatcttttagtcagaagggcagccttattagccatcagcttgttcacactggagaagggccttatgagtgtagagaatgtgggaaatcttttggtcaaaagggtaacctcattcaacatcagcaaggtcacactggagagagagcttatcactgtggggaatgtgggaaatcttttcgtcagaagttctgctttattaaccatcagcgtgttcacactggagaaaggccttacaagtgtggagaatgtgggaaatcttttggtcaaaagggcaacctcgttcaccatcagcgaggtcatactggagaaaggccctatgagtgcaaggaatgtgggaaatcatttaggtacagatcccacctcactgaacaccagagacttcacactggggaaagaccttacaattgtagggaatgtgggaaattatttaacaggaagtatcatcttctggttcatgagagagttcacactggagaaaggccatatgcgtgtgaggtatgtgggaaattatttggcaataagcacagcgtgactatacatcagaggattcacactggagaaaggccgtatgaatgcagtgaatgtgggaaatcatttctttccagctctgcgcttcatgttcataaaagagttcattctggacaaaagccttataagtgcagtgaatgtggaaaatccttttctgaatgttccagtctcattaaacacaggagaattcacactggagaaaggccttatgaatgcaccaaatgtggaaaaacatttcagcgaagctctaccctccttcatcatcagagttcacacaggagaaaggccttatgagtgcagtgaatatgggaaatcgtttgctgaagcatcccgtctcgttaaacacaggagagttcatactggagaaaggccttatgagtgctgtcaatgtggaaaacatcagaatgtctgctgtcctcggtcttaagcgacttcgtgttgagatggagtcttgttctgtcacccaggctggagtgcagtggtgcagtcttggctcgctgcaacttgggcctcctgggttcatgcaatcctcctacctcagcctcctgagtagctgggattatgagtacacaccaccacgcccagctaatttttgtgtttttagtggagatggggttttaccatgttggccaggctggtctcaaactcctgacctcaagtgatccacccaccttgactcccaaagtgctgaaattacaggcatgagcctctgcacctggccttcattcttttcgtattgcttagaatatgacatgctgaaccaggcatggtggctcatgcttgtaaacctgatgctttgggaggacaaggtggttcattggaggccaggagttagagatcagcctgggcaacatagccagacctcctctctacaaaaagaaaaaagaatgacatgcttcttgtttttgtctgttataaatgaaactgctatatttgaatgcagttgttcatgtaggtatgtttcactatgcctggataacttttttttttatttctattagcaatggggtttcaccatgctggccaggcttgttatgaactgacctcaagtgatctgcctgcctcagcttctcaggtgtgacctactgtgcttggcctaatgtacaactttttaagc

SEQ ID NO: 3361 - DNA, 1538 bp, Homo sapiens
ttatttgtcggagaggctcctgagcgctaggtcggcactgcggtgactgaacccagaaggcggagaacagttgtcctctgctgcacagaggcgactctggagctctgtgacggcgccaagcgtgacccacccctgggccaggatagggaccgtcatgcccatatctcctggctggtcaccctctcctcccaaccctgctttaaaccacgtggttcgatggcggtggtggccacgctgaggctctctgctcagggcacagtgacttttgaagacgtggctgtgaaatttacccaggaggaatggaatctccttagtgaggctcagagatgcctgtaccgtgatgtgactctggagaacctggcacttatgtcctccctgggttgttggtgtggagtggaagatgaggcggcaccttctaagcagagtatttatatacaaagagagactcaggtcaggactcctgtgacaggtgtgtctcccaagaaggcccacccctgtgagatgtgtggcccgatcttgggagacattttgcatgtggcagatcatcagggaacacatcacaagcagaaactgcacaggtgtgaggcctgggggaataaattgtatgacagtggaaactttcatcagcaccagaatgagcacattggagagaaaccctacagagggagtgttgaggaggcgttgtttgtgaagaggtgtaagttgcatgtgtcaggggagtcatctgtcttcagtgagagtgggaaggactttttgcccaggtcaggattactccagcaggaggccagtcacactggggagaagtcaaacagcaaaactgagtgtgtgtctccctttcagtgtgggggagctcactatagccatggagattccatgaaacattttagcaccaaacatatactcagtcagcaccagagacttctccctcgagaagaatgttatgtgtgctgtgaatgtgggaaatcctttagcaaatatgttagcttcagtaatcatcagagagttcacagtggaaaaagaccttatgaatgtggagaatgtgagaaatcttttagtcaaaagagcagcctcattcaacatcagcaatttcacactggaggaaaaccttatgggtgtgaagaatgtgggaaatattttagcttagaaggatatcttaggcgccatcaaaaagttcacgctggaaaagggccttatgagtgtggagaatgtgggaaatcttttagttcaaacgtgaaccttaagagtcatcagcgcattcacactggagagagaccttacaagtgtggagaatgtgagaaatcttttagtcggaagcccagccttagttaccatcagcgctttgggaggccgaggtgggtggatcacaaggacaggaaggagttcaagaccagcctgggcaatatagtgaaatcctgtctcttctaaaaatataaaaattagccgggcatggtggcgcacctgtagccgcagctactcaggaggctgaggcaggaaaattgcttgaaccccgggaggtagaggttgcagtgagctgagat

SEQ ID NO: 3362 - DNA, 2610 bp, Homo sapiens
agaggaatcgtcctcggtgcccagaggcggctctgcagccccgtgacggcgaccactgctcccgggccgtgcttccccaagtagtccgatggcagcggctgtgccgaggcgcccaactcagcagggcactgtgacctttgaagatgtggctgtgaacttttcccaggaggagtggtgtcttcttagtgaggctcagaggtgcttgtaccgtgatgtgatgctagagaacctggctctcatatcctcgctgggttgttggtgtggatcaaaagatgaggaggcaccttgtaagcagagaatttctgtacaaagagagtctcagagcaggactcctagggcaggtgtttctcctaagaaggctcacccctgtgaaatgtgtggcctcatcttggaggatgtttttcactttgctgaccaccaggaaactcatcacaagcagaagctgaacaggagtggagcatgtggaaaaaacttggatgacactgcataccttcatcagcaccagaagcagcatattggagagaaattctacagaaagagtgtcagagaagcatcgtttgtaaagaaacgtaagctcagggtgtcacaggagccatttgtcttccgcgagtttgggaaggacgttctgcccagttcaggattgtgccaagaagaagctgctgtagagaagacagacagtgaaactatgcatggcccaccctttcaggagggaaaaactaattacagttgtggaaaacgcacaaaagccttcagcaccaaacactcagttattccacaccagaaacttttcactagagatggatgttatgtgtgcagtgattgtggaaaatcctttagcagatatgtcagcttcagtaatcatcagcgagatcacactgcaaaaggaccttatgattgtggagagtgtgggaaatcttatagtcgaaagagcagccttattcaacatcagcgagtccacactggacagacagcttatccctgtgaggagtgcgggaaatcttttagtcagaagggcagccttattagccatcagcttgttcacactggagaagggccttatgagtgtagagaatgtgggaaatcttttggtcaaaagggtaacctcattcaacatcagcaaggtcacactggagagagagcttatcactgtggggaatgtgggaaatcttttcgtcagaagttctgctttattaaccatcagcgtgttcacactggagaaaggccttacaagtgtggagaatgtgggaaatcttttggtcaaaagggcaacctcgttcaccatcagcgaggtcatactggagaaaggccctatgagtgcaaggaatgtgggaaatcatttaggtacagatcccacctcactgaacaccagagacttcacactggggaaagaccttacaattgtagggaatgtgggaaattatttaacaggaagtatcatcttctggttcatgagagagttcacactggagaaaggccatatgcgtgtgaggtatgtgggaaattatttggcaataagcacagcgtgactatacatcagaggattcacactggagaaaggccgtatgaatgcagtgaatgtgggaaatcatttctttccagctctgcgcttcatgttcataaaagagttcattctggacaaaagccttataagtgcagtgaatgtggaaaatccttttctgaatgttccagtctcattaaacacaggagaattcacactggagaaaggccttatgaatgcaccaaatgtggaaaaacatttcagcgaagctctaccctccttcatcatagagttcacacaggagaaaggccttatgagtgcagtgaatatgggaaatcgtttgctgaagcatcccgtctcgttaaacacaggagagttcatactggagaaaggccttatgagtgctgtcaatgtggaaaacatcagaatgtctgctgtcctcggtcttaagcgacttcgtgttgagatggagtcttgttctgtcacccaggctggagtgcagtggtgcagtcttggctcgctgcaacttgggcctcctgggttcatgcaatcctcctacctcagcctcctgagtagctgggattatgagtacacaccaccacgcccagctaatttttgtgtttttagtggagatggggttttaccatgttggccaggctggtctcaaactcctgacctcaagtgatccacccaccttgactcccaaagtgctgaaattacaggcatgagcctctgcacctggccttcattcttttcgtattgcttagaatatgacatgctgaaccaggcatggtggctcatgcttgtaaacctgatgctttgggaggacaaggtggttcattggaggccaggagttagagatcagcctgggcaacatagccagacctcctctctacaaaaagaaaaaagaatgacatgcttcttgtttttgtctgttataaatgaaactgctatatttgaatgcagttgttcatgtaggtatgtttcactatggtaatatggtggtgtgcagtgcctgagtcacgtgatagattaaagtacaactcttttttgagacagagtctcactctgtcacccaggcgggagttaggtggcatgatttcggctcactg

SEQ ID NO: 3363 - DNA, 1637 bp, Homo sapiens
cgtgcgtgcgcgcgcagatgtgggccccgcgggagcagctactgggctggactgcggaagctctgcctgccaaggattctgcctggccctgggaagagaagcctagatatctggttccagtggcagatggggcactggccagaggggttaggaggatttggactctccttgggagtcgctgtgatacggccttcaattatagttgtctttccttcttggatttccaccacttccctgaaaccacgagctggaagctgagaccagctggtcactgctgggcctgctaggagcccacacggaagctgcccacagccagacaccagagcctcaaaggccgccatcttgaaaaaccaaccctgacctccacaatgattgattttcaaatgttgaaccagctttgcagaactataataaacccaagtgtgataccctgtctcaagtattgtggtgatcaaataggaccagtgactttcgaggatgtggctgtgcttttcactgaggcagagtggaagagactgagccttgagcagaggaacctatacaaagaagtgatgctggaaaatctcaggaatctggtctcattggaatcaaagccagaagtccatacctgcccttcttgccctctggcctttggcagtcagcagttcctcagccaagatgagctacacaatcatcctattccaggtttccatgcaggaaatcaactccacccaggaaatccctgcccagaggatcagccacagtcacaacatccttctgataaaaatcacaggggggctgaagcagaagatcaacgagtggaaggaggcgtcagacccttgttttggagtacaaatgaaaggggggctttagtgggtttctctagcctgttccagagaccaccaataagctcttggggaggcaacagaatattagagatacagctcagtccagcccagaatgcaagctctgaggaagtagacagaatttccaagagggcagaaaccccagggtttggagcagtcacgtttggggagtgtgcactagcttttaaccagaagtcaaacctgttcagacagaaggcagtcacagcagaaaaatcttcagacaaaaggcagtcacaggtgtgcagggagtgtgggcgaggctttagcaggaagtcacagctcatcatacaccagaggacacacacaggagaaaagccttatgtctgcggagagtgtgggcgaggctttatagttgagtcagtcctccgcaaccacctgagtacacactccggggagaaaccttatgtgtgcagccattgtgggcgaggctttagctgcaagccatacctcatcagacatcagaggacacacacaagggagaaatcgtttatgtgcacagtgtgtgggcgaggctttcgtgaaaagtcagagctcattaagcaccagcagaggtgtcaagtgacggtccccttggaggaatggtctttgcatctgactacttccttctgcaactgtgttcttccattagcttccatgacactctcctgctttatttttttctacatctctagcctttgctgtttcctctcctaccccacctttagattttactcagagttcagtctccagccctacaatctgagggacacctttaccaggtccccttcctaa

SEQ ID NO: 3364 - DNA, 3368 bp, Homo sapiens
cggtgcgcattctaatccgtttcacacacggtgctgctacctcgtttgcttcgtgcgtgcgtgcgcgcgcagatgtgggccccgcgggagcagctactgggctggactgcggaagctctgcctgccaaggattctgcctggccctgggaagagaagcctagatatctgggaccagtgactttcgaggatgtggctgtgcttttcactgaggcagagtggaagagactgagccttgagcagaggaacctatacaaagaagtgatgctggaaaatctcaggaatctggtctcattggcagaatcaaagccagaagtccatacctgcccttcttgccctctggcctttggcagtcagcagttcctcagccaagatgagctacacaatcatcctattccaggtttccatgcaggaaatcaactccacccaggaaatccctgcccagaggatcagccacagtcacaacatccttctgataaaaatcacaggggggctgaagcagaagatcaacgagtggaaggaggcgtcagacccttgttttggagtacaaatgaaaggggggctttagtgggtttctctagcctgttccagagaccaccaataagctcttggggaggcaacagaatattagagatacagctcagtccagcccagaatgcaagctctgaggaagtagacagaatttccaagagggcagaaaccccagggtttggagcagtcacgtttggggagtgtgcactagcttttaaccagaagtcaaacctgttcagacagaaggcagtcacagcagaaaaatcttcagacaaaaggcagtcacaggtgtgcagggagtgtgggcgaggctttagcaggaagtcacagctcatcatacaccagaggacacacacaggagaaaagccttatgtctgcggagagtgtgggcgaggctttatagttgagtcagtcctccgcaaccacctgagtacacactccggggagaaaccttatgtgtgcagccattgtgggcgaggctttagctgcaagccatacctcatcagacatcagaggacacacacaagggagaaatcgtttatgtgcacagtgtgtgggcgaggctttcgtgaaaagtcagagctcattaagcaccagagaattcacacgggggataagccttatgtgtgcagagattgaggccgaggctttgtaaggagatcatgtctcaacacacaccagaggatacattcagatgagaagccttttgtttgcagagagtgtgggcgaggctttcgtgctaaatcaactctcctcctacaccagtggacacattcagaggtgaaacctcacgtgtgtgaggagtgtgggcatggatttagccagaagtcgtcgctcaaatcacatcggagaacacactcaggggagaagccttatgtgtgtggggaatgtgggcggggatttagccggaggatagtcctcaatggacactggaggacacacacgggagagaagccttacacgtgctttgagtgtgggcgaaactttagcctcaagtccgctcttagtgtacatcagaggatacactctggggagaagccttatgcatgcacggagtgtgggcaaggctttatcacgaaatcacagctcatcagacaccagaggacacacacaggagaaaagccttatgtctgcggagagtgtgggcgaggctttatagctcagtcaaccctccactaccaccggagtacacactccaaggaaaaaccttatgtgtgcagccagtgtgggcgaggcttttgtgataaatcaactctcctcgcacacgagcagacacattcaggggagaagccttatgtgtgtggggaatgtgggcggggatttggccggaagatactcctcaacagacactggaggacacacacaggagagaaaccttacgcatgcatcgagtgtgggcgaaactttagccacaagtccactctcagcttacatcagaggatacactcgggggagaagccttatgcatgcgtggagtgtgggcaaagctttaggagaaagtcacagctcatcatacaccagaagatacactcggggaaaagctttagaggtgcaaggagtgaggatgtgattttagcaacaagtcagccatcagccacaccagcggaaatgcttagggagaagccttgtttgtaaggtaatgtggacagagctgtacgtggacatcattacttgtcacgtgtcagaggacacactcgggagaaaccttcatggagtgagagtaaggtgttggctggaagtggccccttaagagatacttggagtcaaatctatccactgtacgcccaccccactcttgttctaagagctttggggacagtcttttgaccccttacattcctttagatgtgaagatgacagagatctaacttctgagagcagaggtgtcaagtgacggtccccttggaggaatggtctttgcatctgactacttccttctgcaactgtgttcttccattagcttccatgacactctcctgctttatttttttctacatctctagcctttgctgtttcctctcctaccccacctttagattttactcagagttcagtctccagccctacaatctgagggacacctttaccaggtccccttcctaaccctccagtcccaaatccaagattctttaaccacactctaaaagttcttcagactcaggacttaaacatagccacgccaccttggccttcaatgacagggatctagcaatgctgcatcatcagccttccaataccaggtttaagggtattttaaacacagctcctcttaaatcctccaatctcagtacccagtgttttagccatgctcgggtggctaaattacatccaggaatggtgccagggcctttagccatttgtctctcctcacactccagggcccatatggcccaggttctgacagtttgccttactcccttgggctggggctagccctacctgataccctgtgtcaatgagtgtaccttggagagctatccactcaggccccagtgcctctatttgctaagggactctgccacagaaaagaaggggagagatgttcatgtaacctcaaaatacttaggcttggttttgatgctagagaggaaaaaggacttggagagagagaaggaatggctggtccagaggcttttgtccactccctctcactggaagtggttgatctccagggaatccccaaggttagcctgcttaggggaagggctaggggtacctggaatgtaggatctcccccatgcctggcctaccaccctaatgtgtctggaattggtgggttcttggtcttgctgacttcaagaatgaagccgtggaccctcacggtgagtgttacaattctt

SEQ ID NO: 3365 - DNA, 917 bp, Homo sapiens
gcattctaatccgtttcacacacggtgctgctacctcgtttgcttcgtgcgtgcgtgcgcgcgcagatgtgggccccgcgggagcagctactgggctggactgcggaagctctgcctgccaaggattctgcctggccctgggaagagaagcctagatatctgggaccagtgactttcgaggatgtggctgtgcttttcactgaggcagagtggaagagactgagccttgagcagaggaacctatacaaagaagtgatgctggaaaatctcaggaatctggtctcattggaatcaaagccagaagtccatacctgcccttcttgccctctggcctttggcagtcagcagttcctcagccaagatgagctacacaatcatcctattccaggtttccatgcaggaaatcaactccacccaggaaatccctgcccagaggatcagccacagtcacaacatccttctgataaaaatcacaggggggctgaagcagaagatcaacgagtggaaggaggcgtcagacccttgttttggattctggaactgggaagtccaagatcagggctcctgcccctggacctgaacctggatctttggctttgatgttggaccttgtgtgtggatatgaactttgaacctgcaccttggaactaaacctctgacttggatttgttctgcattttggaactcaccttagacctgaaccttggtcatgaaatggatctgaatcattcttgggtcttggacatgggacttggacctccatgtgtatcttggacttaggaccatgatctggaccttgtaaattgacttggactttggacttggaccttggactagaatttgtccctggctgtggacctcgtctttggatctggatctggacctggtcttggatgttggacctagatgcaggcctt

SEQ ID NO: 3366 - DNA, 4703 bp, Homo sapiens
ggtgctgctacctcgtttgcttcgtgcgtgcgtgcgcgcgcagatgtgggccccgcgggagcagctactgggctggactgcggaagctctgcctgccaaggattctgcctggccctgggaagagaagcctagatatctgggaccagtgactttcgaggatgtggctgtgcttttcactgaggcagagtggaagagactgagccttgagcagaggaacctatacaaagaagtgatgctggaaaatctcaggaatctggtctcattggcagaatcaaagccagaagtccatacctgcccttcttgccctctggcctttggcagtcagcagttcctcagccaagatgagctacacaatcatcctattccaggtttccatgcaggaaatcaactccacccaggaaatccctgcccagaggatcagccacagtcacaacatccttctgataaaaatcacaggggggctgaagcagaagatcaacgagtggaaggaggcgtcagacccttgttttggagtacaaatgaaaggggggctttagtgggtttctctagcctgttccagagaccaccaataagctcttggggaggcaacagaatattagagatacagctcagtccagcccagaatgcaagctctgaggaagtagacagaatttccaagagggcagaaaccccagggtttggagcagtcacgtttggggagtgtgcactagcttttaaccagaagtcaaacctgttcagacagaaggcagtcacagcagaaaaatcttcagacaaaaggcagtcacaggtgtgcagggagtgtgggcgaggctttagcaggaagtcacagctcatcatacaccagaggacacacacaggagaaaagccttatgtctgcggagagtgtgggcgaggctttatagttgagtcagtcctccgcaaccacctgagtacacactccggggagaaaccttatgtgtgcagccattgtgggcgaggctttagctgcaagccatacctcatcagacatcagaggacacacacaagggagaaatcgtttatgtgcacagtgtgtgggcgaggctttcgtgaaaagtcagagctcattaagcaccagagaattcacacgggggataagccttatgtgtgcagagattgaggccgaggctttgtaaggagatcatgtctcaacacacaccagaggatacattcagatgagaagccttttgtttgcagagagtgtgggcgaggctttcgtgctaaatcaactctcctcctacaccagtggacacattcagaggtgaaacctcacgtgtgtgaggagtgtgggcatggatttagccagaagtcgtcgctcaaatcacatcggagaacacactcaggggagaagccttatgtgtgtggggaatgtgggcggggatttagccggaggatagtcctcaatggacactggaggacacacacgggagagaagccttacacgtgctttgagtgtgggcgaaactttagcctcaagtccgctcttagtgtacatcagaggatacactctggggagaagccttatgcatgcacggagtgtgggcaaggctttatcacgaaatcacagctcatcagacaccagaggacacacacaggagaaaagccttatgtctgcggagagtgtgggcgaggctttatagctcagtcaaccctccactaccaccggagtacacactccaaggaaaaaccttatgtgtgcagccagtgtgggcgaggcttttgtgataaatcaactctcctcgcacacgagcagacacattcaggggagaagccttatgtgtgtggggaatgtgggcggggatttggccggaagatactcctcaacagacactggaggacacacacaggagagaaaccttacgcatgcatcgagtgtgggcgaaactttagccacaagtccactctcagcttacatcagaggatacactcgggggagaagccttatgcatgcgtggagtgtgggcaaagctttaggagaaagtcacagctcatcatacaccagaagatacactcggggaaaagctttagaggtgcaaggagtgaggatgtgattttagcaacaagtcagccatcagccacaccagcggaaatgcttagggagaagccttgtttgtaaggtaatgtggacagagctgtacgtggacatcattacttgtcacgtgtcagaggacacactcgggagaaaccttcatggagtgagagtaaggtgttggctggaagtggccccttaagagatacttggagtcaaatctatccactgtacgcccaccccactcttgttctaagagctttggggacagtcttttgaccccttacattcctttagatgtgaagatgacagagatctaacttctgagagcagaggtgtcaagtgacggtccccttggaggaatggtctttgcatctgactacttccttctgcaactgtgttcttccattagcttccatgacactctcctgctttatttttttctacatctctagcctttgctgtttcctctcctaccccacctttagattttactcagagttcagtctccagccctacaatctgagggacacctttaccaggtccccttcctaaccctccagtcccaaatccaagattctttaaccacactctaaaagttcttcagactcaggacttaaacatagccacgccaccttggccttcaatgacagggatctagcaatgctgcatcatcagccttccaataccaggtttaagggtattttaaacacagctcctcttaaatcctccaatctcagtacccagtgttttagccatgctcgggtggctaaattacatccaggaatggtgccagggcctttagccatttgtctctcctcacactccagggcccatatggcccaggttctgacagtttgccttactcccttgggctggggctagccctacctgataccctgtgtcaatgagtgtaccttggagagctatccactcaggccccagtgcctctatttgctaagggactctgccacagaaaagaaggggagagatgttcatgtaacctcaaaatacttaggcttggttttgatgctagagaggaaaaaggacttggagagagagaaggaatggctggtccagaggcttttgtccactccctctcactggaagtggttgatctccagggaatccccaaggttagcctgcttaggggaagggctaggggtacctggaatgtaggatctcccccatgcctggcctaccaccctaatgtgtctggaattggtgggttcttggtcttgctgacttcaagaatgaagccgtggaccctcacgttctggaactgggaagtccaagatcagggctcctgcccctggacctgaacctggatctttggctttgatgttggaccttgtgtgtggatatgaactttgaacctgcaccttggaactaaacctctgacttggatttgttctgcattttggaactcaccttagacctgaaccttggtcatgaaatggatctgaatcattcttgggtcttggacatgggacttggacctccatgtgtatcttggacttaggaccatgatctggaccttgtaaattgacttggactttggacttggaccttggactagaatttgtccctggctgtggacctcgtctttggatctggatctggacctggtcttggatgttggacctagatgcaggccttgatttgatttggaacatggacttggtccttgcacatggcccaacacccgcgtctttggaactgcatcttggaccttggatctgaaatttaaacagggaggtgaccttcatttcttgtatttgactttataactggaaattcaatctctacctggatcttggacctggatctcagaccttgctttttattgggccatggatcttataccttaaacatggaaattgtacctggatttggacctttgacttggacctggatctggacccagggataagatttggacctcacttgcaaattttggtaatgaaattttcctttgctcctgtagtccttggacctaggcttcagtcatggatttagaccttagacgtgaccatcagaccttagagttgaacctaaattcctggtccccagtcctataactcagaatgattatgcataaccttggacttagaacttagatctggatcttagagctgatacttgacctggtactggatatttaaccttggacttcagacatggatttaatctgggccttgggatgatttaagatctagaagtggacctagaattagaccttggacttatgtgcctgagcctggactttggaagtggactttgggccttgtaactcaaccttgaatatgagcctcaaatgtagactgtgggccaggcacagtggctcacatctgtaatcccagcactttgggtggaaagctgaggcaggtggatcacttgagctcaggaattcaagaccagcctggggaacatggtgaaaacctggctctacaaaaaataaaaaaattagccaggcttggtggcacacacctgtagttccaggtactcaggaggctgaggcaggaggttcacttgggcccaggaggcagaggttgcagtgagctgagcttgtacagctgcactccagcctggaggacagagtgagactctgtctcaagaaaaaaaaataaaaaataaataaataaataagagaaaa

SEQ ID NO: 3367 - DNA, 1885 bp, Homo sapiens
gccctgctcctggccccttggccggccgggctgtttctggccatgggtcgctcccgccggacaggcgcgcaccgagcgcactctctagcccggcagatgaaggcgaagcggcggcggccggacttggatgagattcaccgcgagctgcggcctcagggatccgcacgaccccagcccgacccaaacgccgagttcgaccccgacctgccagggggcggtctgcaccgctgtctggcctgcgcgaggtacttcatcgattccaccaacctgaagacccacttccgatccaaagaccacaagaaaaggtatgaaggagtaaggagaggattgatggatgggtgctcagcagatagggctctcacctggtcagctcccaactcctgtttttctttctcccaggctgaagcagctgagcgtcgagccctacagtcaggaagaggcggagagggcagcgggtatgggatcctatgtgccccccaggcggctggcagtgcccacggaagtgtccactgaggtccctgagatggatacctctacctgacatggcctgaagatgcagggcagaggaattgcccatggacagtgacgcaaggactaggctgggagggagcgtgccaaccccttttgcctctgggtttggggagcggagggcctcttcttggtgccctgccccaaataaaggaactggacaaagagaacttgcctccaactctaacttccaggccgctgtctcaaactcctgccctggaagggcttctctactactttctgtacaccaggcctagggtgtctactccccacttggtctatctctgccttccctctgaggtcctagcatctgaactggagcacccagatggaggcctgatgcagtgtggggtggcgggagtgggatcagattactctgtcctgcttctgacagagactgatccccagaaaagaaggcttctgagattgcacccccctcccgagtcacctacccccagcatccaagtgagagtctctcttcttcgttacggggcccgtggcacccgccgctgccccaccatcttccagacggcatagcaggagccacccaggccgaggacagctagcactgtagccacaactcctgccagcagactccggggctctgccttcagctcaccagctacctgcatctggaggtgcacagagggtgtgcctcaggggtcagttgagactgccaggaaggtggggagtgggaaagggctgagtagatgtagctaggggaaggagacatggacgccggtcctgccccagggagattccaccccaatccctttcgcctcactgcccatctgggcctgcctgctcaggcggcagggaacgtgacagcctggctgttgggggtgtcaacccagctatggtagggggaggaaggggtcagtcgtgccagaaaccgttgatcaggggtacttacctgtaacacccggaagtaaccaggggtcaagcgtcgaaatcgcatggtgggcggcactggtctccctggcggcctgtagggtgggagcggacgtgaagaccagtggtcttcatgacaccaagaagtggaaactagggtagaggggtctctgaccttccacatacgcaagacccaagctctcagaggatgctcacccgcgcctgcctgcccaggtctggcagggggcggagcaactggacctttaaatctggtcccttcccccactgcctaccatcctgccagccttagaagcagctgtcaaaagagatcagcatcaggcttgagcggcacctcccccactctccgaggaggcgggtccggttaggcaggagaggccttggctggcagtgctcaggagtcccaggcctggaccaggtactgggcgggcctccctcagccctggtc

SEQ ID NO: 3368 - DNA, 1862 bp, Homo sapiens
gagcctgcctagccccccggcgtggcctgacgtagctgatcggcccggaagtgctcacacgtgtgctccctgccctgctcctggccccttggccggccgggctgtttctggccatgggtcgctcccgccggacaggcgcgcaccgagcgcactctctagcccggcagatgaaggcgaagcggcggcggccggacttggatgagattcaccgcgagctgcggcctcagggatccgcacgaccccagcccgacccaaacgccgagttcgaccccgacctgccagggggcggtctgcaccgctgtctggcctgcgcgaggtacttcatcgattccaccaacctgaagacccacttccgatccaaagaccacaagaaaaggctgaagcagctgagcgtcgagccctacagtcaggaagaggcggagagggcagcgggtatgggatcctatgtgccccccaggcggctggcagtgcccacggaagtgtccactgaggtccctgagatggatacctctacctgacatggcctgaagatgcagggcagaggaattgcccatggacagtgacgcaaggactaggctgggagggagcgtgccaaccccttttgcctctgggtttggggagcggagggcctcttcttggtgccctgccccaaataaaggaactggacaaagagaacttgcctccaactctaacttccaggccgctgtctcaaactcctgccctggaagggcttctctactactttctgtacaccaggcctagggtgtctactccccacttggtctatctctgccttccctctgaggtcctagcatctgaactggagcacccagatggaggcctgatgcagtgtggggtggcgggagtgggatcagattactctgtcctgcttctgacagagactgatccccagaaaagaaggcttctgagattgcacccccctcccgagtcacctacccccagcatccaagtgagagtctctcttcttcgttacggggcccgtggcacccgccgctgccccaccatcttccagacggcatagcaggagccacccaggccgaggacagctagcactgtagccacaactcctgccagcagactccggggctctgccttcagctcaccagctacctgcatctggaggtgcacagagggtgtgcctcaggggtcagttgagactgccaggaaggtggggagtgggaaagggctgagtagatgtagctaggggaaggagacatggacgccggtcctgccccagggagattccaccccaatccctttcgcctcactgcccatctgggcctgcctgctcaggcggcagggaacgtgacagcctggctgttgggggtgtcaacccagctatggtagggggaggaaggggtcagtcgtgccagaaaccgttgatcaggggtacttacctgtaacacccggaagtaaccaggggtcaagcgtcgaaatcgcatggtgggcggcactggtctccctggcggcctgtagggtgggagcggacgtgaagaccagtggtcttcatgacaccaagaagtggaaactagggtagaggggtctctgaccttccacatacgcaagacccaagctctcagaggatgctcacccgcgcctgcctgcccaggtctggcagggggcggagcaactggacctttaaatctggtcccttcccccactgcctaccatcctgccagccttagaagcagctgtcaaaagagatcagcatcaggcttgagcggcacctcccccactctccgaggaggcgggtccggttaggcaggagaggccttggctggcagtgctcaggagtcccaggcctggaccaggtactgggcgggcctccctcagccctggtc

SEQ ID NO: 3369 - DNA, 3506 bp, Homo sapiens
agtcccggggagcgcaccggaagttctcgcctggcccaggcgcggggtccaagatggtggcgctaggagccgcgacccagtgatagcggccgtggaggggcccccgaccgagcgggaggttgggggtagcctggagattctgaagacaggaataagatgaaggaatggaaatcaaagatggaaatttctgaagaaaagaagtcagcaagggctgcatccgaaaaactccaaagacaaatcacccaggaatgtgagttagttgaaaccagtaattctgaggacagattattgaagcactgggtaagccctttaaaggatgcaatgagacatctcccttcccaagagagcggtatcagggaaatgcatattatcccccagaaagccattgtgggagagattggccatggatgtaatgaaggagaaaaaatactttctgcaggagaaagctcccatagatatgaggttagtggccaaaacttcaaacagaagtcaggattaactgaacatcagaaaattcataatataaataagacctatgaatgtaaggaatgtgaaaaaaccttcaacaggagttcaaacctgatcatacatcagagaattcatacaggaaataagccatatgtgtatgtagcaaatgtgggaaatcttttaggggcagctcagatcttattagacaccatcgtgttcatactggagagaaaccctatgaatgtagtgaatgtgggaaagcctttagccagaggtcacaccttgttacacaccagaaaatccatactggagagaagccctatcagtgcactgaatgtgggaaagccttcaggcggcgttcactccttattcaacatcggagaattcatagtggtgagaaaccctatgaatgtaaggaatgtgggaagctcttcatttggcgcacagctttcctcaaacatcagagcctgcatactggagagaaacttgaatgtgagaaaaccttcagccaggatgaggagcttaggggagagcagaaaattcaccaggaagcgaaagcttattggtgtaatcagtgtggtagggctttccagggcagctcagacctcatcagacatcaggtaactcatacaagagagaaaccatatgaatgcaaagaatgtgggaaaactttcaatcagagctcagaccttctgagacatcatagaattcacagtggagaaaaaccttatgtatgcaacaaatgtgggaaatcttttaggggtagctcagatcttattaaacaccatcgtattcatactggagagaaaccctatgaatgtagtgaatgtgggaaagccttcagccagaggtcacaccttgctacacaccagaaaatccatactggagagaaaccctatcagtgcagtgaatgtgggaatgccttcaggcggcgttccctccttattcaacatcggagacttcatagtggtgagaaaccctatgaatgtaaggaatgtgggaaactcttcatgtggcacacggctttcctcaaacatcagagactgcatgctggagagaaacttgaagaatgtgagaaaaccttcagcaaggatgaggagcttagaaaagagcagagaactcaccaggaaaagaaagtttattggtgtaatcagtgtagtaggaccttccagggcagctcagatctcatcagacatcaggtaactcatacaagagagaaaccatatgaatgtaaagaatgtgggaaaactcaatcagagctcagaccttctgagacatcatagaattcacagtggagaaaaaccttacgtatgcaataaatgtggggaatcttttaggagcagctcagatcttattaaacaccatcgtgttcatactggagagaaacctcatgaatgtagtgaatgtgggaaagtctttagccagaggtcccaccttgtcacacaccagaaaatccacactggagagaagccctatcagtgcactgaatgtgaaaaagccttcaggcggcgttcactccttattcaacgtcggagaattcatagtggtgagaaaccctatgaatgtaaggaatgtgggaaactcttcatgtggcacacagctttcctcaaacatcagagactgcatgctggagagaaacttgaagaacgtgagaaaaccttcagcaaggatgaggagcttaggggagagcagaaaattcaccaagaagagaaagcttattggtgtaatcagtgtggtagggctttccagggcagctcagacctcatcggacatcaggtaactcatacaggagagaaaccatatgaatgtaaagaatgtgggaaaactttcaatcagagctcagaccttctgagacatcatagaattcacagtggagaaaaaccttatgtatgcaacaaatgtgggaaatcttttaggggcagctcagatcttattagacaccatcgtgttcatactggagagaaaccctatgaatgccctgaatgttggaaggccttcagtcagaactcacaccttgtcagtcatcaaagaattcataccagagagaaaccctttgaatgtagcaactgtggtaaggccttcagtgggtggacagcttttcttaagcaccagaaacttcacattggaaaggaatttgaagactgtaagagtctacaaacaggacctattctaataggtagcagaaacctaatgaatgcagtaaaactaggaaaagtctgatggagaccacatcttattgcactacaaatgagttttattagaaaaaaaccatgggaaggtgggaaagcagagaaaatacctactggatttttcaaacgtaagtataatcaagtggaaaagccaaaagctcttggacataatcaccttttttttttctgtctcagaactgacactagaatatggtcccaacgatacaattttttaaattatttattttttaacatacaaagagatgaggtctcactatgttgcccaggctggacttgaactcttgggctcaagcactcctccctcctcagcctcccaaagggttgggattaccggcatgagccactgcaccagccccaggggtctaattacttgagaatgttttaagggatgtctatcattattaaaatcattataaatcactttggcaacaaccccaaaactaaattattcatggaaagagccatttcaatcttgacttcctagtcgagtgacaagtttaaatgtgggaaaaaaccctgtgaaagtaatgagtgtaggccaggtgcggtggctcgtacctgtaatccagcactttgggaagccaaggtgggcagatcacgaggtcacgagttgatcatgaggagttactatgcccagccaacatactaaaaccccgtctctactaaaaataacaaaaattagccaggcatggtggggcacgcctgtagtcccaggtacttgcgaggctagggcaggagaatcacttgaacctgggaggtggaggttgcggtgagccaagatcatgccactgcactccagcctgggcaacaagtgcgaaactccatctc

SEQ ID NO: 3370 - DNA, 915 bp, Homo sapiens
atgaatgtaaagaatgtgggaaaaaatcagagctcagaccttctgagacatcatagaattcacagtggagaaaaaccttgtgtatgtagcaaatgtgggaaatcttttaggggcagctcagatcttattagacaccatcgtgttcatactggagagaaaccctatgaatgtagtgaatgtgggaaagcctttagccagaggtcacaccttgttacacaccagaaaatccatactggagagaagccctatcagtgcactgaatgtgggaaagccttcaggcggcgttcactccttattcaacatcggagaattcatagtggtgagaaaccctatgaatgtaaggaatgtgggaagctcttcatttggcgcacagctttcctcaaacatcagagcctgcatactggagagaaacttgaatgtgagaaaaccttcagccaggatgaggagcttaggggagagcagaaaattcaccaggaagcgaaagcttattggtgtaatcagtgtggtagggctttccagggcagctcagacctcatcagacatcaggtaactcatacaagagagaaaccatatgaatgcaaagaatgtgggaaaactttcaatcagagctcagaccttctgagacatcatagaattcacagtggagaaaaaccttatgtatgcaacaaatgtgggaaatcttttaggggtagctcagatcttattaaacaccatcgtattcatactggagagaaaccctatgaatgtagtgaatgtgggaaagccttcagccagaggtcacaccttgctacacaccagaaaatccatactggagagaaaccctatcagtgcatggaatgtgggaaactcttcatgtggcacacggctttcctcaaacatcagagactgcatgctggagagaaacttgaagaatgt

SEQ ID NO: 3371 - DNA, 4878 bp, Homo sapiens
agtcccggggagcgcaccggaagttctcgcctggcccaggcgcggggtccaagatggtggcgctaggagccgcgacccagtgatagcggccgtggaggggcccccgaccgagcgggaggttgggggtagcctggagattctgaagacaggaataagatgaaggaatggaaatcaaagatggaaatttctgaagaaaagaagtcagcaagggctgcatccgaaaaactccaaagacaaatcacccaggaatgtgagttagttgaaaccagtaattctgaggacagattattgaagcactgggtaagccctttaaaggatgcaatgagacatctcccttcccaagagagcggtatcagggaaatgcatattatcccccagaaagccattgtgggagagattggccatggatgtaatgaaggagaaaaaatactttctgcaggagaaagctcccatagatatgaggttagtggccaaaacttcaaacagaagtcaggattaactgaacatcagaaaattcataatataaataagacctatgaatgtaaggaatgtgaaaaaaccttcaacaggagttcaaacctgatcatacatcagagaattcatacaggaaataagccatatgtgtgtaatgaatgtgggaaagactctaatcaaagttcaaatcttattatacatcagagaattcatacaggaaagaaaccttatatatgtcatgaatgtggaaaagacttcaatcagagctccaatctggtgagacataagcaaattcacagtggtgggaatccctatgagtgcaaagagtgtgggaaggcttttaagggaagctcaaaccttgtcctgcaccagagaatccacagtagggggaagccatatttatgcaataaatgtgggaaggctttcagtcaaagcacagatcttattatacatcacagaattcacactggagagaaaccctatgaatgttatgactgtggacagatgttcagtcaaagttcacaccttgtcccacatcagagaattcacactggagagaaacccctcaaatgtaatgaatgtgaaaaagccttcaggcagcattctcaccttactgaacaccagagactccacagtggagagaaaccctatgaatgtcacagatgtgggaagaccttcagtgggcgcacagcttttcttaaacatcagagattgcatgctggagagaaaattgaagaatgtgagaaaaccttcagcaaggatgaggagcttagggaagagcagagaattcaccaggaagagaaagcttattggtgtaatcagtgtggtaggaatttccagggcacctcagacctcatcagacatcaggtaactcatacaggagagaaaccatatgaatgtaaagaatgtgggaaaactttcaatcagagctcagaccttctgagacatcatagaattcacagtggagaaaaaccttgtgtatgtagcaaatgtgggaaatcttttaggggcagctcagatcttattagacaccatcgtgttcatactggagagaaaccctatgaatgtagtgaatgtgggaaagcctttagccagaggtcacaccttgttacacaccagaaaatccatactggagagaagccctatcagtgcactgaatgtgggaaagccttcaggcggcgttcactccttattcaacatcggagaattcatagtggtgagaaaccctatgaatgtaaggaatgtgggaagctcttcatttggcgcacagctttcctcaaacatcagagcctgcatactggagagaaacttgaatgtgagaaaaccttcagccaggatgaggagcttaggggagagcagaaaattcaccaggaagcgaaagcttattggtgtaatcagtgtggtagggctttccagggcagctcagacctcatcagacatcaggtaactcatacaagagagaaaccatatgaatgcaaagaatgtgggaaaactttcaatcagagctcagaccttctgagacatcatagaattcacagtggagaaaaaccttatgtatgcaacaaatgtgggaaatcttttaggggtagctcagatcttattaaacaccatcgtattcatactggagagaaaccctatgaatgtagtgaatgtgggaaagccttcagccagaggtcacaccttgctacacaccagaaaatccatactggagagaaaccctatcagtgcagtgaatgtgggaatgccttcaggcggcgttccctccttattcaacatcggagacttcatagtggtgagaaaccctatgaatgtaaggaatgtgggaaactcttcatgtggcacacggctttcctcaaacatcagagactgcatgctggagagaaacttgaagaatgtgagaaaaccttcagcaaggatgaggagcttagaaaagagcagagaactcaccaggaaaagaaagtttattggtgtaatcagtgtagtaggaccttccagggcagctcagatctcatcagacatcaggtaactcatacaagagagaaaccatatgaatgtaaagaatgtgggaaaactcaatcagagctcagaccttctgagacatcatagaattcacagtggagaaaaaccttacgtatgcaataaatgtggggaatcttttaggagcagctcagatcttattaaacaccatcgtgttcatactggagagaaacctcatgaatgtagtgaatgtgggaaagtctttagccagaggtcccaccttgtcacacaccagaaaatccacactggagagaagccctatcagtgcactgaatgtgaaaaagccttcaggcggcgttcactccttattcaacgtcggagaattcatagtggtgagaaaccctatgaatgtaaggaatgtgggaaactcttcatgtggcacacagctttcctcaaacatcagagactgcatgctggagagaaacttgaagaacgtgagaaaaccttcagcaaggatgaggagcttaggggagagcagaaaattcaccaagaagagaaagcttattggtgtaatcagtgtggtagggctttccagggcagctcagacctcatcggacatcaggtaactcatacaggagagaaaccatatgaatgtaaagaatgtgggaaaactttcaatcagagctcagaccttctgagacatcatagaattcacagtggagaaaaaccttatgtatgcaacaaatgtgggaaatcttttaggggcagctcagatcttattagacaccatcgtgttcatactggagagaaaccctatgaatgccctgaatgttggaaggccttcagtcagaactcacaccttgtcagtcatcaaagaattcataccagagagaaaccctttgaatgtagcaactgtggtaaggccttcagtgggtggacagcttttcttaagcaccagaaacttcacattggaaaggaatttgaagactgtaagagtctacaaacaggacctattctaataggtagcagaaacctaatgaatgcagtaaaactaggaaaagtctgatggagaccacatcttattgcactacaaatgagttttattagaaaaaaaccatgggaaggtgggaaagcagagaaaatacctactggatttttcaaacgtaagtataatcaagtggaaaagccaaaagctcttggacataatcaccttttttttttctgtctcagaactgacactagaatatggtcccaacgatacaattttttaaattatttattttttaacatacaaagagatgaggtctcactatgttgcccaggctggacttgaactcttgggctcaagcactcctccctcctcagcctcccaaagggttgggattaccggcatgagccactgcaccagccccaggggtctaattacttgagaatgttttaagggatgtctatcattattaaaatcattataaatcactttggcaacaaccccaaaactaaattattcatggaaagagccatttcaatcttgacttcctagtcgagtgacaagtttaaatgtgggaaaaaaccctgtgaaagtaatgagtgtaggccaggtgcggtggctcgtacctgtaatccagcactttgggaagccaaggtgggcagatcacgaggtcacgagttgatcatgaggagttactatgcccagccaacatactaaaaccccgtctctactaaaaataacaaaaattagccaggcatggtggggcacgcctgtagtcccaggtacttgcgaggctagggcaggagaatcacttgaacctgggaggtggaggttgcggtgagccaagatcatgccactgcactccagcctgggcaacaagtgcgaaactccatctcaaaaaaaaaaaaaagtctaactcttctgcttgtctttacaatgctgtacagtgagagctaatgtttataaggataaacaggatacttacagggatttgaaggtaatttaattcagtggtttccaactttttaatcaccaaggccttctttttactcccctatgtcctgtgtcttaaaagattatgtttaccaaactgcatttattaaagaattatattttgctacataaaggcatgtacaacacaaatcatgcttctgactggcaccatgtaggcagacctaggtactaaaattccagcccaaagcaaataatttaccattttcattagtctttttattccttttgtgggcaaacatatcgtctatgttaggctttttgaaatattaactatgacttgtaaactccagattaaaaactaaccaattcatctttgatggagcttgaatcaaactaagggtattggacttttgaaagattgaaatttttgttacagtatggaatgtttttaactgaatgttgaaataaaagttatttaagaatta

SEQ ID NO: 3372 - DNA, 2783 bp, Homo sapiens
gacacgcgctttcaaccggcggagacactggcagggccagaaacgcgcgcagcgggggcgggaggtcggtaagctccccgcccctgcccgagaccccgccccggcccggccccgcctttttctctgcctcccctccctgcacgtacgggccccgcccctcgcgcgacgttttttgttgacccggaaacggattctccggagccgaggtccgctcggatttgtcttcttagtgcttggatggtgtgagtgaaaacccagaggaatacatttggtggctgagctagtacaatgccatcaccggattccatgaccttcgaggatatcattgtagacttcactcaagaagagtgggccctgctggacacatcccagagaaagctgtttcaagatgtgatgttggagaacatcagtcatctggtctctattggcaaacagctctgcaaatcagttgtgctttcccaattggagcaagtagagaaactttcaacacaaagaataagcttactgcaaggtagagaagttggcattaaacatcaagagataccattcattcaacatatctatcagaagggcacgtccaccatcagcacaatgagatctcatactcaagaggatccttttctatgcaatgacttaggagaagatttcactcaacatatagcattgactcaaaatgtgattacctacatgagaacgaaacactttgtaagcaaaaagtttgggaaaatcttcagtgactggttatcctttaatcaacacaaggaaattcacaccaaatgtaaatcatatggaagtcatctatttgattatgcctttatccaaaactctgcccttagaccacacagtgtgactcacactagagagataacattggaatgtcgtgtgtgtgggaaaacctttagcaaaaattctaatcttaggcgacatgagatgattcacactggagagaaaccacacggatgtcatctatgtgggaaagcctttactcattgctctgatcttcgaaaacatgagagaactcacactggagagaagccatatggatgtcatctatgtgggaaagccttcagtaaaagttctaaccttagacgacatgagatgattcacactagagaaaaagcacagatatgccatctatgtgggaaagccttcactcattgctctgaccttagaaaacatgagagaactcacttaggagataaaccatatggatgtctcctatgtgggaaggctttcagtaaatgttcttaccttagacaacatgaaagaactcacaatggagagaaaccatatgaatgtcatctatgtggaaaagccttctctcattgttctcaccttagacaacatgagcgaagtcacaatggagagaaaccacatggatgtcatctatgtgggaaagcattcactgaatcttctgtgcttaaacgacatgagagaattcacactggagagaaaccatatgagtgccatgtatgtgggaaagccttcactgaatcttctgacctcagacgacatgagagaactcacactggagaaaaaccatatgaatgccatctatgcggaaaagccttcaatcactcttctgtccttagacgacatgagagaactcacactggagagaaaccatatgaatgcaatatatgtggtaaagccttcaatagaagttacaactttagacttcatagaagagttcacactggagagaaaccatatgtatgtcctctatgtgggaaagcctttagtaaattttttaaccttagacaacatgagagaactcacactaaaaaagcaatgaatatgtaagaatcatcagctgtagcgttaacactaaatacaccaaggacaaacatactacaggaatattatgtctgtaatcagtgtggaaaagcctttatttatatttaccactttgctcaacctaaatgaattcaaggtagagagaatccagatgtatttaatgtttatggcacaaacttcagactctaggctgaccatatacaacgtgagagaatgaaactatagatcaaaggaatgtggaggagtcttcatccacagctctgttaaataaatgggagaaatcacatcacgaaaattctgtgcctgtcgtcagtgtgaaaatgcctttgctgataatttatcctctaaacaaatgagtaaaatccacaggcaagcaaccatatgtctgtaattgctgtgcactctcattcagctaagcaccaattttggtgtgtgcaagaaaattcattataaggtaactgataaaaacaggaaatatgtgaaaatattttttattaggtggatgaggcctcttgaacaattccagacattcatagtggagaagttattcaatgaaaactcatgagaaatccttttcttaatacagcagcacttctataatagatcagaattcacatggtgtagaactctcaatgacatgaatggagggtagtcctcagtaaattactcattccttagtcaataccagcatttttccagtgagaaaactatcttgacaggatagtggaaaaaccttcaggcagcttttatgtcaaaaaagtgagacagggatgaaaactctaaaaagccattgatgagatgtatagctgggggacaaaacataaagccatcaagcacgtgcttgagaaaaaaattataattttgaataaagactttctacttaaaatatgtgggttgaaatgtacaattctgaaataacctgggaatattgaatgcagaattatgtaagaagtaataagattaaattagtactgtcaaaaatacaa

SEQ ID NO: 3373 - DNA, 1593 bp, Homo sapiens
gacacgcgctttcaaccggcggagacactggcagggccagaaacgcgcgcagcgggggcgggaggtcggtaagctccccgcccctgcccgagaccccgccccggcccggccccgcctttttctctgcctcccctccctgcacgtacgggccccgcccctcgcgcgacgttttttgttgacccggaaacggattctccggagccgaggtccgctcggatttgtcttcttagtgcttggatggtgtgagtgaaaacccagaggaatacatttggtggctgagctagtacaatgccatcaccggattccatgaccttcgaggatatcattgtagacttcactcaagaagagtgggccctgctggacacatcccagagaaagctgtttcaagatgtgatgttggagaacatcagtcatctggtctctattggagaagatttcactcaacatatagcattgactcaaaatgtgattacctacatgagaacgaaacactttgtaagcaaaaagtttgggaaaatcttcagtgactggttatcctttaatcaacacaaggaaattcacaccaaatgtaaatcatatggaagtcatctatttgattatgcctttatccaaaactctgcccttagaccacacagtgtgactcacactagagagataacattggaatgtcgtgtgtgtgggaaaacctttagcaaaaattctaatcttaggcgacatgagatgattcacactggagagaaaccacacggatgtcatctatgtgggaaagcctttactcattgctctgatcttcgaaaacatgagagaactcacactggagagaagccatatggatgtcatctatgtgggaaagccttcagtaaaagttctaaccttagacgacatgagatgattcacactagagaaaaagcacagatatgccatctatgtgggaaagccttcactcattgctctgaccttagaaaacatgagagaactcacttaggagataaaccatatggatgtctcctatgtgggaaggctttcagtaaatgttcttaccttagacaacatgaaagaactcacaatggagagaaaccatatgaatgtcatctatgtggaaaagccttctctcattgttctcaccttagacaacatgagcgaagtcacaatggagagaaaccacatggatgtcatctatgtgggaaagcattcactgaatcttctgtgcttaaacgacatgagagaattcacactggagagaaaccatatgagtgccatgtatgtgggaaagccttcactgaatcttctgacctcagacgacatgagagaactcacactggagaaaaaccatatgaatgccatctatgcggaaaagccttcaatcactcttctgtccttagacgacatgagagaactcacactggagagaaaccatatgaatgcaatatatgtggtaaagccttcaatagaagttacaactttagacttcatagaagagttcacactggagagaaaccatatgtatgtcctctatgtgggaaagcctttagtaaattttttaaccttagacaacatgagagaactcacactaaaaaagcaatgaatatgtaa

SEQ ID NO: 3374 - DNA, 2868 bp, Homo sapiens
aaacggattctccggagccgaggtccgctcgggtgagtgccctccgctttttgtggccaaacccagccacgcagttcccttcctgcggcgtcctccacacccggggtctgctggtctccgcggatgtcacaggctcggcaaccgccctcctgtcggcggggagtcccgcgacgcccggaaatgctccgaagcctgtcgcccagctgccagatctgcgtctgtgtccggttccgtcactgaggtcgcccctgtccggcccttccaccctagttctcttcaccgtccgcccatcctatcgcgcgcggcctcagatttgtcttcttagtgcttggatggtgtgagtgaaaacccagaggaatacatttggtggctgagctagtacaatgccatcaccggattccatgaccttcgaggatatcattgtagacttcactcaagaagagtgggccctgctggacacatcccagagaaagctgtttcaagatgtgatgttggagaacatcagtcatctggtctctattggcaaacagctctgcaaatcagttgtgctttcccaattggagcaagtagagaaactttcaacacaaagaataagcttactgcaaggtagagaagttggcattaaacatcaagagataccattcattcaacatatctatcagaagggcacgtccaccatcagcacaatgagatctcatactcaagaggatccttttctatgcaatgacttaggagaagatttcactcaacatatagcattgactcaaaatgtgattacctacatgagaacgaaacactttgtaagcaaaaagtttgggaaaatcttcagtgactggttatcctttaatcaacacaaggaaattcacaccaaatgtaaatcatatggaagtcatctatttgattatgcctttatccaaaactctgcccttagaccacacagtgtgactcacactagagagataacattggaatgtcgtgtgtgtgggaaaacctttagcaaaaattctaatcttaggcgacatgagatgattcacactggagagaaaccacacggatgtcatctatgtgggaaagcctttactcattgctctgatcttcgaaaacatgagagaactcacactggagagaagccatatggatgtcatctatgtgggaaagccttcagtaaaagttctaaccttagacgacatgagatgattcacactagagaaaaagcacagatatgccatctatgtgggaaagccttcactcattgctctgaccttagaaaacatgagagaactcacttaggagataaaccatatggatgtctcctatgtgggaaggctttcagtaaatgttcttaccttagacaacatgaaagaactcacaatggagagaaaccatatgaatgtcatctatgtggaaaagccttctctcattgttctcaccttagacaacatgagcgaagtcacaatggagagaaaccacatggatgtcatctatgtgggaaagcattcactgaatcttctgtgcttaaacgacatgagagaattcacactggagagaaaccatatgagtgccatgtatgtgggaaagccttcactgaatcttctgacctcagacgacatgagagaactcacactggagaaaaaccatatgaatgccatctatgcggaaaagccttcaatcactcttctgtccttagacgacatgagagaactcacactggagagaaaccatatgaatgcaatatatgtggtaaagccttcaatagaagttacaactttagacttcatagaagagttcacactggagagaaaccatatgtatgtcctctatgtgggaaagcctttagtaaattttttaaccttagacaacatgagagaactcacactaaaaaagcaatgaatatgtaagaatcatcagctgtagcgttaacactaaatacaccaaggacaaacatactacaggaatattatgtctgtaatcagtgtggaaaagcctttatttatatttaccactttgctcaacctaaatgaattcaaggtagagagaatccagatgtatttaatgtttatggcacaaacttcagactctaggctgaccatatacaacgtgagagaatgaaactatagatcaaaggaatgtggaggagtcttcatccacagctctgttaaataaatgggagaaatcacatcacgaaaattctgtgcctgtcgtcagtgtgaaaatgcctttgctgataatttatcctctaaacaaatgagtaaaatccacaggcaagcaaccatatgtctgtaattgctgtgcactctcattcagctaagcaccaattttggtgtgtgcaagaaaattcattataaggtaactgataaaaacaggaaatatgtgaaaatattttttattaggtggatgaggcctcttgaacaattccagacattcatagtggagaagttattcaatgaaaactcatgagaaatccttttcttaatacagcagcacttctataatagatcagaattcacatggtgtagaactctcaatgacatgaatggagggtagtcctcagtaaattactcattccttagtcaataccagcatttttccagtgagaaaactatcttgacaggatagtggaaaaaccttcaggcagcttttatgtcaaaaaagtgagacagggatgaaaactctaaaaagccattgatgagatgtatagctgggggacaaaacataaagccatcaagcacgtgcttgagaaaaaaattataattttgaataaagactttctacttaaaatatgtgggttgaaatgtacaattctgaaataacctgggaatattgaatgcagaattatgtaagaagtaataagattaaattagtactgtc

SEQ ID NO: 3375 - DNA, 1826 bp, Homo sapiens
ggcggagagggctgagggcgggtcgcttccggcggcttttcccgcagctcctgcgtaaaggagcatgagagcgtgggagttttgcagtggccgtggcgttcttcgtcgcgtctcggtcgggcgtcgctttctgcagctcctgtcagggagcgcgaggcctgttattaaccgcggagcgctttgtcacgaagtccctgtggcgtcttgaagaaggcattccccacccgccaaatggcgtccatgcccccgacgcccgaggcccagggaccaatactctttgaggatctggctgtgtatttttctcaagaggagtgcgtgactctgcaccctgcccagaggtccctcagcaaagatggtacaaaagagtctttggaggatgcggctttgatgggagaggaaggcaagcctgagattaatcagcagttaagcctagagtctatggaacttgacgagcttgccttagaaaagtaccccattgctgcaccccttgtcccttacccagaaaaatcctctgaggatggagttggaaaccctgaagcgaaaatattaagtggaactcccacttacaagagaagggtcatcagccttttagttaccattgaaaaccacaccccattagtagaactctctgaatatttaggaaccaacacactttctgaaattcttgattctccctgggaaggagccaaaaatgtgtacaaatgtcctgagtgtgaccaaaacttcagcgatcattcatacctagttttgcatcagaaaattcattcaggagagaaaaaacataaatgtggtgactgtggaaagatcttcaatcatagagccaacctgaggacacacaggagaatccatactggtgagaaaccttataagtgtgccaagtgcagtgccagctttcgccagcactctcatctatcccgacacatgaatagccacgtaaaggagaagccctatacatgtagcatatgtggtagaggttttatgtggctcccaggattggcacagcatcagaaaagccacagtgctgaaaacacctacgaatctactaactgtgataaacattttaatgagaaaccaaatcttgctttgcctgaggaaacattcgtatcaggcccccagtaccagcacactaagtgcatgaagagcttcaggcagtccttatatcctgccctttccgagaagagccacgacgaggactctgaacgctgcagcgatgatggggacaatttcttctcattctcaaaattcaagcccttacagtgtcctgactgtgacatgacctttccttgtttctctgagcttatttcccatcagaacattcatacagaggaaaggccccataagtgcaaaacatgcgaggaaagttttgctttggactcagaacttgcatgccaccagaagagccacatgctagcggaaccttttaaatgtaccgtgtgtgggaaaactttcaagtcgaatttgcatctcattactcataagcgaactcacataaaaaacaccacgtaaagtaaatataacaaattgttattagtgattgggcttttcagtatctgtatggtgggaagcagttactgtatatgtcccaggcaatgtgctaagcactttacacacattcccatgtaatacttaattctcagcacaaccgtgatttaggcagtatcatttccattttataagtagggatgcaaaatccgtgtcactaaactagtgaatgaacccaggatttgaactcagttactgtacaactgtgagccagaagaagatacacaacttttgtttaaattcaattttcattaaaatgaaggctcttgctaaagttattttaa

SEQ ID NO: 3376 - DNA, 3115 bp, Homo sapiens
gtgggcgggacttccggcgtccagtcttcgtccgccgttaggttgcggctgctgtggttgccaacgctacactgggtagaacgccagacaggggccacttttcgagaccgagtagagacggacagtgaggaggataggacccacttacacgcttttatgtcagccgcgatcccacccccacaagcgtctgcaaaacccttcctggggccttggcgacagccctgtgtcctcacggcgcgcagaggcggcgccgcgaaccttgtgtgcattttacacgacggcggggactgaggtccctcgcagcccagagccggagcccggggtcggccgagcccgcaggaccggcttcctcgccgactctcacggcctcacccagccccctgggcccatggcggcgccggcgttggcattagtatcatttgaagacgtggttgtgaccttcactggagaggaatgggggcacctggacctggcccagaggaccctgtaccaggaggtgatgctggagacctgcaggctcctggtctcactggggcatcctgttcccaaaccagagctgatctatctactggaacatggacaggaactgtggacagtgaagagaggcctctcccaaagcacctgcgcaggtgaaaaagcaaaacccaagattacagagcctactgcttctcagctggccttctctgaggaatcctctttccaggaacttctggcacagagatcctcaagagattccaggttggggcaagctagagatgaggaaaagctaataaaaattcaggaagggaacttgaggccaggaacaaacccccacaaagagatatgccctgagaagttgagttataaacatgatgatttggagccagatgatagtctgggcttaagggttttacaggaacgagtcactccacaagatgctctccatgagtgtgactctcaaggaccaggaaaagaccccatgactgatgcaaggaataacccttacacatgcacggaatgtgggaaagggtttagcaagaagtgggcccttgttcggcatcaacagattcatgctggagtgaagccctatgagtgcaatgagtgtgggaaagcctgtcgttatatggctgatgtcattcgacatatgaggcttcatactggggaaaaaccatacaagtgtattgagtgtgggaaagccttcaaacgcaggtttcacctcacggagcaccagcgtattcacaccggagataagccctatgagtgcaaagaatgtggcaaagcattcacccaccgctcttcttttatccagcataatatgactcacactcgagaaaaaccctttttatgcaaagaatgtgggaaagctttttactacagctcctcatttgctcaacatatgaggattcatactggaaagaaactctatgagtgcggtgaatgtggaaaggccttcacgcaccgctccacatttatccagcacaatgtgacccacacaggagaaaaaccatttttatgtaaagaatgtggaaaaaccttttgcctcaactcatccttcactcagcacatgaggattcacactggagagaaaccctatgagtgcggtgaatgtggaaaggcctttactcatcgctccactttcatccgacataagaggacccataccggagagaagccctttgagtgcaaagaatgtgggaaggccttttgtgacagctcttccttaattcaacatatgaggattcacactggtgagaagccttatgagtgcagtgaatgtggaaaggcttttacacaccactctgtttttattcgacataataggacccacagtggacaaaaacccttggagtgcaaagaatgtgcaaaagccttttactatagctcttccttcactcgacacatgaggattcacactggagagaagccctatgtttgtagagaatgtggaaaggcttttacccaacctgcaaattttgttcggcataataggatccacactggagaaaaaccttttgaatgcaaagaatgtgagaaagccttctgtgacaactttgctttaactcagcacatgagaactcacactggagagaaaccctttgaatgcaatgaatgtggaaagaccttcagccacagttcatcgttcactcaccatcgaaagattcataccagagtttaaaagatacaggaaggcctattacaagtgtgtttgtctttagtgaactcatagtggtgacatacctttccttttgagtataactattgagggaaatattttggccagagagatgtcttagtatctgataatttatactaactagaaacagaattgtccctgtgaaatctttttatggcaggtaatcacttgtcatccaaagaattatattaaagattcacccagtttagagccttacactgtacctgagaataatcgaggggagagacctggtggttaacatgcatttaggtaaaatgtcaggaacaactttcctcttattaatactataaatccatctcaagcatattttaaaataatgagagatggaggaaacaatctagaagataaaagaaaaagatgtgcataacttgttttcagtttccctgtttatgacagtttgtcatttggcgggttgggggatggagcagggaataagacattgaaaaagtctcatcccctttgtgtgttttacatatatatatctctaagtccagagccaggagagttggaccattgagggcagctctgccaacatttagtaaaagtattcattgttccaaaactgtcatctctacccttgagggagtgtgtctttgtgagaaatataaaggcttgagtcatgaaatacttaacacatgtgcacatgtacacatgtacatttatatgcagtgaattgttactcgtggtagttaggttctgtgaattttctgtgcacactgaattagtgaatgctgaatgattgttgctaggggaaatacagcgttagcttctgtgagcctctgatccaaacatttttatcaaccagtcaacacataaccttcttctatgggtatttgtttgtttgtttgtttaaagacactttatcagtgtttcttgaataattataattattctttataataaaaatattttaattatagc

SEQ ID NO: 3377 - DNA, 1327 bp, Homo sapiens
taggttgcggctgctgtggttgccaacgctacactgggtagaacgccagacaggggccacttttcgagaccgagtagagacggacagtgaggaggataggacccacttacacgcttttatgtcagccgcgatcccacccccacaagcgtctgcaaaacccttcctggggccttggcgacagccctgtgtcctcacggcgcgcagaggcggcgccgcgaaccttgtgtgcattttacacgacggcggggactgaggtccctcgcagcccagagccggagcccggggtcggccgagcccgcaggaccggcttcctcgccgactctcacggcctcacccagccccctgggcccatggcggcgccggcgttgtgctcggagagcatcactctaggtgccgtctttgaagaaggactctctaggtcctgctgttgttttaggggatcattccagcggaagtctggccctaccaaaagctgggagagggaatgagagcctcgagggcaagaggcattagtatcatttgaagacgtggttgtgaccttcactggagaggaatgggggcacctggacctggcccagaggaccctgtaccaggaggtgatgctggagacctgcaggctcctggtctcactggggcatcctgttcccaaaccagagctgatctatctactggaacatggacaggaactgtggacagtgaagagaggcctctcccaaagcacctgcgcagcttccttctcacttctgtggaagagttatcatcctggccatggctaatttctccagcagaatctagattacactttctgccttctcaggtgtattagccatctactattaatatgtaacaatattaccacaaaccctgcagctgaaaacatcacttatttattatctcccacctatggattgggagtccaggcacagcttagctgggtcctctcaggcgtgtcataggcagctcatagctcatcatcaccatcagctcacttcttcaaatcaagccactgtgtgagactccagcaagacggatgttccagtcttataaaattacatatattttatcatgtacattccatcatctttgccatattctatactttagaagcaaatcgaggtcctgccaacattttaacaggggaactacaaaagggtgtgaacactatgacttggggatcatgagaagccatacgtgaatctctcagctgcatcagggaacatgcttcttcacttacttcctacctcttctatattttcatcccctctctactcaacattaaaaaaaaatgatgatgtttctgatacctgggggagactttttttttttt

SEQ ID NO: 3378 - DNA, 924 bp, Homo sapiens
tacacatgcacggaatgtgggaaagggtttagcaagaagtgggcccttgttcggcatcaacagattcatgctggagtgaagccctatgagtgcaatgagtgtgggaaagcctgtcgttatatggctgatgtcattcgacatatgaggcttcatactggggaaaaaccatacaagtgtattgagtgtgggaaagccttcaaacgcaggtttcacctcacggagcaccagcgtattcacaccggagataagccctatgagtgcaaagaatgtggcaaagcattcacccaccgctcctcatttgctcaacatatgaggattcatactggaaagaaactctatgagtgcggtgaatgtggaaaggccttcacgcaccgctccacatttatccagcacaatgtgacccacacaggagaaaaaccatttttatgtaaagaatgtggaaaaaccttttgcctcaactcatccttcactcagcacatgaggattcacactggagagaaaccctatgagtgcggtgaatgtggaaaggcctttactcatcgctccactttcatccgacataagaggacccataccggagagaagccctttgagtgcaaagaatgtgggaaggccttttgtgacagctcttccttaattcaacatatgaggattcacactggtgagaagccttatgagtgcagtgaatgtggaaaggcttttacacaccactctgtttttattcgacataataggacccacagtggacaaaaacccttggagtgcaaagaatgtgcaaaagccttttactatagctcttccttcactcgacacatgaggattcacactggagagaagccctatgtttgtagagaatgtggaaaggcttttacccaacctgcaaattttgttcggcataataggatccacactggagaaaaacct

SEQ ID NO: 3379 - DNA, 2724 bp, Homo sapiens
aaagccccagcctcagcattagtatcatttgaagacgtggttgtgaccttcactggagaggaatgggggcacctggacctggcccagaggaccctgtaccaggaggtgatgctggagacctgcaggctcctggtctcactggggcatcctgttcccaaaccagagctgatctatctactggaacatggacaggaactgtggacagtgaagagaggcctctcccaaagcacctgcgcaggtgaaaaagcaaaacccaagattacagagcctactgcttctcagctggccttctctgaggaatcctctttccaggaacttctggcacagagatcctcaagagattccaggttggggcaagctagagatgaggaaaagctaataaaaattcaggaagggaacttgaggccaggaacaaacccccacaaagagatatgccctgagaagttgagttataaacatgatgatttggagccagatgatagtctgggcttaagggttttacaggaacgagtcactccacaagatgctctccatgagtgtgactctcaaggaccaggaaaagaccccatgactgatgcaaggaataacccttacacatgcacggaatgtgggaaagggtttagcaagaagtgggcccttgttcggcatcaacagattcatgctggagtgaagccctatgagtgcaatgagtgtgggaaagcctgtcgttatatggctgatgtcattcgacatatgaggcttcatactggggaaaaaccatacaagtgtattgagtgtgggaaagccttcaaacgcaggtttcacctcacggagcaccagcgtattcacaccggagataagccctatgagtgcaaagaatgtggcaaagcattcacccaccgctcttcttttatccagcataatatgactcacactcgagaaaaaccctttttatgcaaagaatgtgggaaagctttttactacagctcctcatttgctcaacatatgaggattcatactggaaagaaactctatgagtgcggtgaatgtggaaaggccttcacgcaccgctccacatttatccagcacaatgtgacccacacaggagaaaaaccatttttatgtaaagaatgtggaaaaaccttttgcctcaactcatccttcactcagcacatgaggattcacactggagagaaaccctatgagtgcggtgaatgtggaaaggcctttactcatcgctccactttcatccgacataagaggacccataccggagagaagccctttgagtgcaaagaatgtgggaaggccttttgtgacagctcttccttaattcaacatatgaggattcacactggtgagaagccttatgagtgcagtgaatgtggaaaggcttttacacaccactctgtttttattcgacataataggacccacagtggacaaaaacccttggagtgcaaagaatgtgcaaaagccttttactatagctcttccttcactcgacacatgaggattcacactggagagaagccctatgtttgtagagaatgtggaaaggcttttacccaacctgcaaattttgttcggcataataggatccacactggagaaaaaccttttgaatgcaaagaatgtgagaaagccttctgtgacaactttgctttaactcagcacatgagaactcacactggagagaaaccctttgaatgcaatgaatgtggaaagaccttcagccacagttcatcgttcactcaccatcgaaagattcataccagagtttaaaagatacaggaaggcctattacaagtgtgtttgtctttagtgaactcatagtggtgacatacctttccttttgagtataactattgagggaaatattttggccagagagatgtcttagtatctgataatttatactaactagaaacagaattgtccctgtgaaatctttttatggcaggtaatcacttgtcatccaaagaattatattaaagattcacccagtttagagccttacactgtacctgagaataatcgaggggagagacctggtggttaacatgcatttaggtaaaatgtcaggaacaactttcctcttattaatactataaatccatctcaagcatattttaaaataatgagagatggaggaaacaatctagaagataaaagaaaaagatgtgcataacttgttttcagtttccctgtttatgacagtttgtcatttggcgggttgggggatggagcagggaataagacattgaaaaagtctcatcccctttgtgtgttttacatatatatatctctaagtccagagccaggagagttggaccattgagggcagctctgccaacatttagtaaaagtattcattgttccaaaactgtcatctctacccttgagggagtgtgtctttgtgagaaatataaaggcttgagtcatgaaatacttaacacatgtgcacatgtacacatgtacatttatatgcagtgaattgttactcgtggtagttaggttctgtgaattttctgtgcacactgaattagtgaatgctgaatgattgttgctaggggaaatacagcgttagcttctgtgagcctctgatccaaacatttttatcaaccagtcaacacataaccttcttctatgggtatttgtttgtttgtttgtttaaagacactttatcagtgtttcttgaataattataattattctttataataaaaatattttaattatagc

SEQ ID NO: 3380 - DNA, 2548 bp, Homo sapiens
gcgcacaaacccggaagcggatcgcgtggagtgaaggtcctaccacggcgcgtgagttttgctctgccttggattaagtctgcacttcccaggtccccggcgcttctgcccctgggacgtgggatccccacggacctggaaattctcgcctgtcttcccttcacccagagcaaattgagacgtcccggattgattcctaaagactcatgttatgtgaagaagcagctcagaagaggaaaggaaaggagccaggcatggctcttcctcagatatctcttccaaacgcatgatgaaggaggtcttgtcaacagggcaaggcaatacagaagtgatccacacagggacattgcaaagatatcaaagttatcacattggagatttttgcttccaggaaattgagaaagaaattcatgatattgagtttcagtgtcaagaagatgaaagaaatggccatgaagcacccatgacaaaaataaaaaagttgactggtagcacagaccaacatgatcacaggcatgctggaaacaagcctattaaagatcagcttggatcaagcttttattcacatctgcctgaactccacataattcagatcaaaggtaaaattggtaatcaatttgagaagtctaccagtgatgctccctcggtttcaacatcccaaagaatttctcctaggccccaaatccatatttctaataactatgggaataattccccgaattcttcactactcccacaaaaacaggaagtatacatgagagaaaaatctttccaatgtaatgagagtggcaaagcctttaattgtagctcactcttaaggaaacaccagataccccatttaggagacaaacaatataaatgtgatgtatgtggcaagctctttaatcacaagcaataccttacatgccattgtagatgtcacactggagagaaaccttacaagtgtaatgagtgtggaaagtccttcagtcaggtatcatcccttacatgccatcgtagacttcacactgcagtaaaatctcacaagtgtaatgagtgtggcaagatctttggtcaaaattcagcccttgtaattcataaggcaattcatactggagaaaaaccttacaagtgtaatgaatgtgacaaagcttttaatcagcaatcaaaccttgcacgtcatcgtagaattcatactggagagaaaccttacaaatgtgaagaatgtgacaaagttttcagtcggaaatcaacccttgagtcacataagagaattcatactggagagaaaccatacaaatgtaaggtttgtgacacagctttcacatggaattctcagctggcaagacataaaagaattcacactggagagaaaacttacaagtgtaatgagtgtggcaagaccttcagtcacaagtcatcccttgtatgccatcatagacttcatggtggagagaaatcttacaaatgtaaggtctgtgacaaggcttttgcgtggaattcacacctggtaagacatactagaattcatagtggaggaaaaccttacaagtgtaatgaatgtgggaagacctttggtcaaaattcagatcttctaattcataagtcaattcatactggagagcaaccttacaaatatgaagaatgtgaaaaggttttcagttgtggatcaacccttgagacacataagataattcacaccggagagaaaccatacaaatgtaaggtttgtgacaaggcttttgcgtgtcattcctatctggcaaaacatactagaattcatagtggagagaaaccttacaagtgtaatgagtgcagcaagaccttccgtctgaggtcataccttgcaagccatcgcagagttcatagtggtgagaaaccttacaagtgtaatgagtgcagcaagaccttcagtcagaggtcataccttcattgccatcgtagacttcatagtggtgagaaaccttacaagtgtaatgagtgtggcaagaccttcagtcacaagccatcccttgttcaccatcgtagacttcatactggagagaaatcttacaaatgtacggtttgtgacaaggctttcgtgcgtaattcatacctggcaagacataccagaattcacactgcagagaaaccttacaagtgtaatgaatgtgggaaggcttttaatcaacaatcacaactttcacttcatcatagaattcatgctggggagaaactttacaaatgtgaaacatgtgacaaagttttcagtcgcaaatcacaccttaaaagacataggagaattcatcctggaaagaaaccatacaaatgtaaggtttgtgacaagacttttgggagtgattcacacctgaaacaacatactggacttcacactggagagaaaccttacaagtgtaatgagtgtggcaaagcctttagcaagcagtcaacacttattcaccatcaggcagttcatggtgtagggaaacttgactaatgtaatgattgtcacaaagtcttcagtaacgctacaaccattgcaaatcattggagaatctataatgaataaagatctaacaagtgtaataaa

SEQ ID NO: 3381 - DNA, 6187 bp, Homo sapiens
gtagttctgcgcgttcacgtccccgatcgggccgtgtccgccgcggccctgcgaggtccgagggactcattctgatgaaggaaagagcgtccctgtgcagctgcgtgtccttcagttctttggctctgattccgtgtctggcttcatctaagtggcctggtccatgggcagtgaagaaatgtaaagtgcaatagccctctggaacaagacaattcatgtgagataagaaagaagagcccacaagaccaaggatgtattctcagtttacagaccactgaccagaggccactccagggtgtcaggactaagagaagtcacaaaacagcagatttcccaagagcagcggaaaatgatccagtcacagatatcatttgaggatgtggctgtggatttcacgctggaggaatggcagctacttaatcctactcagaagaacttgtacagagatgtgatgttggagaactatagcaatctggttttcttggaagtctggctagataatcccaaaatgtggctccgagataatcaagacaaccttaaaagtatggagagaggccataaatatgatgtttttggaaaaatatttaattcaagcataaacattgttcatgtaggactgcgatcccataaatgtggcacaggagaaaaaagtttgaaatgtccttttgatttgcttattccaaaaaataattgtgaaagaaagaaaattgatgaactcaataagaaattattgttctgtatcaaacctggcagaacccatggtgggataaaatactgtgattgcagtacatgtagaaaatccagcaacgaagagccatggctcactgctaatcacataacacacacaggagtctatttatgcatggaatgtggcagattttttaacaagaagtcacaacttgttatacaccagagaactcatacaggagagaagccctatcaatgcagtgagtgtggaaaagccttttcacagaagtcactgctcacggttcatcaaagaactcactcaggagaaaaaccgcatgggtgcagcgaatgtcagaaagcttttagtaggaagtcactcctcattttacatcagagaattcatactggagagaagccgtatggatgcagtgaatgtggaaaagccttcagtaggaagtcgcagcttaaaagacatcagataacgcacacaatagagaaaccctacagttgcagtgagtgtgggaaagcattctcccagaaattaaaactcatcacacatcagagagcgcacacaggagagaaaccctatccatgtagtcactgtggaaaagccttcttttggaagtcgcagctgattactcatcagaggacccacacagggaagaaaccttacggatgtggtgagtgtcaaaaagccttcagcaggaactcacttctcattaggcatcagaggattcatacaggagagaagccctacgaatgcaacgaatgtggtgaagccttcatcagaaaaccacagctgattaaacatcagataactcacacaggagagaagaactatcgatgcagtgattgtgaggaggccttctttaagaagtcagagttaataagacatcaaaaaattcacttaggagagaaaccatatggatgcattcaatgtgggaaaaccttctttgggaagtcccagctcctaacgcatcacagaacacacactggggagaagccttatgaatgcagtgagtgtgggaaggccttcacccagaagtcaagcctgatatcacatcagagaacacatacaggtgagaaaccctatgaatgcagtgaatgcaggaaaaccttcagtgagaagtcaagtctcattcatcatcagagaacccatactggagaaaagccctttgaatgtagtgaatgtaggaaagcttttgcctggaagccacagcttcttaggcatcagagaattcatacaggggagaaaccctatgaatgcagtgaatgtgggaaagcatttgttcagaaagtgcagctcattaagcatcaaagaaatcacacaggagagaaaacctatggatgcagcgattgtgcaaaagctttctttgagaaggcacagctgattatacatcagagaattcatacaggagagagaccatataaatgtggtgaatgtgggaaatctttcacaagaaagtcacaccttatgaggcatcagaggattcatacaggagataaatactatggatgcaatgagtgtgggaccaccttcaacaggaagtcgcagcttatgatacatcagagaaatcatataatataaaaatcatgactttggcgaatgcagaaaggttgctatcaagtgtcatactttctgacacttttgaggatgcatgtgggagagaaaccctattgaggcagtgactgttgaaaaagcttgaattgaggagtcaagagtcactaagcagaatttagaaagagaagtttttaaaaagcaaacagtgtaaaaaaagtcatctcccagaagacactactcgttacatattggatgactcattgaggtgaaaaccttattagtgttgtgatagtagagaagcttttagtcaaaagtcagtttattaaatgtttagaatacctaaacaggaagaaaattctattgttttttataacaaagtggaagatttcaagaaaggacaactcactgtacacttgagaataatacctacagaggttcatactgaagagtagtctcaataatgtaaagaatttgacaagcatgatgctattgaaatagttctgtaaggaagtggtgttctttatacatcaattattacaaaaagcagtgaattgtaagtgtgaggtgtgtttacttagatgtgaagagttctccttactgctgtgatggaataacaagggtcagatttcctctcctgccttaaacaactggaagctatacaatacgtataataggtaatggtttttagacataggacaagcacaggtttgtgatcctcaggagactgcagacagagtgaggtgagcaccatggtttctcagcctgcccccgcatggcagttcctaggttgcagttcagggaagggaaacaataaatctcgctgaattgaagagacaggactggcagttggggaggccacagcagctagaatttccaggggaaagtactggagagatgggatccttctagatacagggctcaagaagtctgctgggagtcccctgagtcctttgacttagtactgacttgcactgaggccaggaaaagaagcactggaaagcagcaggctgaacaattcctggaactcatgcagggctgggaatagtttatgttctcagcagccagagtggaaacagagtggaaacacatggagcatcaggtagaattctcagaaaggttttgttttagtagtgcagctaattaactctagattaaaagctactctggacctacagtgtccggcatccaaaaaaactaatgtgttatgcaaagaagcaataaaatatgacttataaccaggagaaaaatcagtagaaacccagaaaagacagaggtgatggaattagtagacaaggatattaaaagagctattgtaaatataaagtagaggaaaacataagattgatgaaacctgaggtataagagatatttttactggccaaaatggaacttctagggatgaaatcaacttctgattttgttaaaatcccgagtggagagattagatacagaaaaagaagaaaaaatcaatgaacttgaagagtaagaataaaaactaccaaagtgatatacagagagaaaaaaagacttagagaagaggaagagaataggaaaaccattacagtagtgtaatatatgtttaactggagtcccagaaggagaggagaaaatgaagaggcatgaagaagtatttgaataaataatggctaaagattttccaaatctggtgaaaacaatacccccacatattcaagaagctcaaatgacctgaagtagaataaacataatttacatcacagcagtgcacctcagagtcacattcatgaaaagcactgataaacagaatacttttaaaacaccttgagaaaaaaagataatacatacacatgaacaaagaatggcagcatatttctggtgagaactatgcaagctataagacaatggagtattatctctaaattccttaatgaaataaacaacaaaccctgcaacctagaattctgttactgtcaaaaacgttttcaaaaatgaaggcaaaataaagactgtttctgagaaactaaatcaaaggtaattttattacctgtagacctgtctttgggaaacattaaaggatgtttgagggcagcaggaaaataatacaaaacttaagtttgggtctgtacaaaggaatgaagttctgaaaatggtgaatatgtgggtaaatataaaagatatttctctctttttaaaatctttttaaaagggaattggctgcttaaagccaaagtaatgataacgtatttggagtttatttagaagtaaagtgtgatgacgataacacttaagtgtgaatttttaaatatagttgagtagactgcatcatctgagttagaagcctattccttcagggctcggggtagcttgaatttgtagcaggcacatgacagaaattgtatgtattgtggatctgcatgtgtgctgagtattccctatttctttgatcccttttcccccattttctgctctgctcccccctgaggctgtcttctagagactggggtttcttcataggtttgaacagtgggagataccagaggtgggaggagaaaaagttatttattaccgttcccttcctcctgcctggaccatggtagcttctgtgttcccgtaaggatacagcttcctttgggaagccccatctatggctgtagatctctcggtttcagttgacaccattccctctccatgatcttcagacttaactactactgggtgcttccccaacccactggttgggtgtctttaattgtgaacacatatttgtaaatagtgcctttattaattgttcttgagttaatattctgagtgtgccatttattttctgtgccatctgttaaatgatgagcatttaataaaattgtgataatcagttatcagtacaagtgccgcatagtgcataggctgaaatgtctcaagattccccacactacatatcagtattttctatctgtatctggacaatgcagtagaaattataacaaatacaaagttctttgtgcttttctgctgcatatgtcagtggctctggagattgttaccatctgctacatatataaatagacttgcagttattactaagctcctcttcagtaatagaaagacttatgaagtcttttactacctctgggttagccaaacaaccttcaaaaagcattgttatttaggttaaatatctgtggacaagaaacaagataatcagttactgagtgaagaaagacgggaatgatgtcccatacttcccagctctctaaagtgttatgctgtacaattaaaatacccctgacccatcatctgctaccattcgttgtggataattcatgtaatctctaacctgtgggcaagtctttacccttcagtagtcaagattacgttagagacttcgtccacgaatccacaccacctttcccatcagttctcaccggaaatatgctgccaaaaagaaaatcagcttttctaagatcaagccagagttgcttctcttacaaccttacggcgctaatgcattaagttgaagtcgactgccaaagaggcccagcagagggcagcacccccatcatttttttgaatttctcccttaggaattttgccttcctttgtcttctgtccaccaggccttctctccagctggacacaaacctcctttgaagggaaataattgccgttaggcttcacagtagtgctttttcctttcacttggatttgcattttaacctgcatttcgaagatttttatacatgttttctatttccgacaatgccaggaggcttcattgacgttgtagtctgtgttaataaacttgtgtatcactctgctctgatcttttaggaattaacttgcaaatgaaatgaatatgttgggactttggcataatttgaatatagcattgtgtgagttgtgattgtctcttcctaattgtgctgtaataacctgtgtatgagaataaaatgatttccacca

SEQ ID NO: 3382 - DNA, 6156 bp, Homo sapiens
gtagttctgcgcgttcacgtccccgatcgggccgtgtccgccgcggccctgcgaggtccgaggggcaatagccctctggaacaagacaattcatgtgagataagaaagaagagcccacaagaccaaggatgtattctcagtttacagaccactgaccagaggccactccagggtgtcaggactaagagaagtcacaaaacagcagatttcccaagagcagcggaaaatgatccagtcacagatatcatttgaggatgtggctgtggatttcacgctggaggaatggcagctacttaatcctactcagaagaacttgtacagagatgtgatgttggagaactatagcaatctggttttcttgggttttcaaattctcaaacctgatgcaatgttcaaactggaacaacaagatccatggataataggtcaagaaatcctaaatcagaacttttcagaagtctggctagataatcccaaaatgtggctccgagataatcaagacaaccttaaaagtatggagagaggccataaatatgatgtttttggaaaaatatttaattcaagcataaacattgttcatgtaggactgcgatcccataaatgtggcacaggagaaaaaagtttgaaatgtccttttgatttgcttattccaaaaaataattgtgaaagaaagaaaattgatgaactcaataagaaattattgttctgtatcaaacctggcagaacccatggtgggataaaatactgtgattgcagtacatgtagaaaatccagcaacgaagagccatggctcactgctaatcacataacacacacaggagtctatttatgcatggaatgtggcagattttttaacaagaagtcacaacttgttatacaccagagaactcatacaggagagaagccctatcaatgcagtgagtgtggaaaagccttttcacagaagtcactgctcacggttcatcaaagaactcactcaggagaaaaaccgcatgggtgcagcgaatgtcagaaagcttttagtaggaagtcactcctcattttacatcagagaattcatactggagagaagccgtatggatgcagtgaatgtggaaaagccttcagtaggaagtcgcagcttaaaagacatcagataacgcacacaatagagaaaccctacagttgcagtgagtgtgggaaagcattctcccagaaattaaaactcatcacacatcagagagcgcacacaggagagaaaccctatccatgtagtcactgtggaaaagccttcttttggaagtcgcagctgattactcatcagaggacccacacagggaagaaaccttacggatgtggtgagtgtcaaaaagccttcagcaggaactcacttctcattaggcatcagaggattcatacaggagagaagccctacgaatgcaacgaatgtggtgaagccttcatcagaaaaccacagctgattaaacatcagataactcacacaggagagaagaactatcgatgcagtgattgtgaggaggccttctttaagaagtcagagttaataagacatcaaaaaattcacttaggagagaaaccatatggatgcattcaatgtgggaaaaccttctttgggaagtcccagctcctaacgcatcacagaacacacactggggagaagccttatgaatgcagtgagtgtgggaaggccttcacccagaagtcaagcctgatatcacatcagagaacacatacaggtgagaaaccctatgaatgcagtgaatgcaggaaaaccttcagtgagaagtcaagtctcattcatcatcagagaacccatactggagaaaagccctttgaatgtagtgaatgtaggaaagcttttgcctggaagccacagcttcttaggcatcagagaattcatacaggggagaaaccctatgaatgcagtgaatgtgggaaagcatttgttcagaaagtgcagctcattaagcatcaaagaaatcacacaggagagaaaacctatggatgcagcgattgtgcaaaagctttctttgagaaggcacagctgattatacatcagagaattcatacaggagagagaccatataaatgtggtgaatgtgggaaatctttcacaagaaagtcacaccttatgaggcatcagaggattcatacaggagataaatactatggatgcaatgagtgtgggaccaccttcaacaggaagtcgcagcttatgatacatcagagaaatcatataatataaaaatcatgactttggcgaatgcagaaaggttgctatcaagtgtcatactttctgacacttttgaggatgcatgtgggagagaaaccctattgaggcagtgactgttgaaaaagcttgaattgaggagtcaagagtcactaagcagaatttagaaagagaagtttttaaaaagcaaacagtgtaaaaaaagtcatctcccagaagacactactcgttacatattggatgactcattgaggtgaaaaccttattagtgttgtgatagtagagaagcttttagtcaaaagtcagtttattaaatgtttagaatacctaaacaggaagaaaattctattgttttttataacaaagtggaagatttcaagaaaggacaactcactgtacacttgagaataatacctacagaggttcatactgaagagtagtctcaataatgtaaagaatttgacaagcatgatgctattgaaatagttctgtaaggaagtggtgttctttatacatcaattattacaaaaagcagtgaattgtaagtgtgaggtgtgtttacttagatgtgaagagttctccttactgctgtgatggaataacaagggtcagatttcctctcctgccttaaacaactggaagctatacaatacgtataataggtaatggtttttagacataggacaagcacaggtttgtgatcctcaggagactgcagacagagtgaggtgagcaccatggtttctcagcctgcccccgcatggcagttcctaggttgcagttcagggaagggaaacaataaatctcgctgaattgaagagacaggactggcagttggggaggccacagcagctagaatttccaggggaaagtactggagagatgggatccttctagatacagggctcaagaagtctgctgggagtcccctgagtcctttgacttagtactgacttgcactgaggccaggaaaagaagcactggaaagcagcaggctgaacaattcctggaactcatgcagggctgggaatagtttatgttctcagcagccagagtggaaacagagtggaaacacatggagcatcaggtagaattctcagaaaggttttgttttagtagtgcagctaattaactctagattaaaagctactctggacctacagtgtccggcatccaaaaaaactaatgtgttatgcaaagaagcaataaaatatgacttataaccaggagaaaaatcagtagaaacccagaaaagacagaggtgatggaattagtagacaaggatattaaaagagctattgtaaatataaagtagaggaaaacataagattgatgaaacctgaggtataagagatatttttactggccaaaatggaacttctagggatgaaatcaacttctgattttgttaaaatcccgagtggagagattagatacagaaaaagaagaaaaaatcaatgaacttgaagagtaagaataaaaactaccaaagtgatatacagagagaaaaaaagacttagagaagaggaagagaataggaaaaccattacagtagtgtaatatatgtttaactggagtcccagaaggagaggagaaaatgaagaggcatgaagaagtatttgaataaataatggctaaagattttccaaatctggtgaaaacaatacccccacatattcaagaagctcaaatgacctgaagtagaataaacataatttacatcacagcagtgcacctcagagtcacattcatgaaaagcactgataaacagaatacttttaaaacaccttgagaaaaaaagataatacatacacatgaacaaagaatggcagcatatttctggtgagaactatgcaagctataagacaatggagtattatctctaaattccttaatgaaataaacaacaaaccctgcaacctagaattctgttactgtcaaaaacgttttcaaaaatgaaggcaaaataaagactgtttctgagaaactaaatcaaaggtaattttattacctgtagacctgtctttgggaaacattaaaggatgtttgagggcagcaggaaaataatacaaaacttaagtttgggtctgtacaaaggaatgaagttctgaaaatggtgaatatgtgggtaaatataaaagatatttctctctttttaaaatctttttaaaagggaattggctgcttaaagccaaagtaatgataacgtatttggagtttatttagaagtaaagtgtgatgacgataacacttaagtgtgaatttttaaatatagttgagtagactgcatcatctgagttagaagcctattccttcagggctcggggtagcttgaatttgtagcaggcacatgacagaaattgtatgtattgtggatctgcatgtgtgctgagtattccctatttctttgatcccttttcccccattttctgctctgctcccccctgaggctgtcttctagagactggggtttcttcataggtttgaacagtgggagataccagaggtgggaggagaaaaagttatttattaccgttcccttcctcctgcctggaccatggtagcttctgtgttcccgtaaggatacagcttcctttgggaagccccatctatggctgtagatctctcggtttcagttgacaccattccctctccatgatcttcagacttaactactactgggtgcttccccaacccactggttgggtgtctttaattgtgaacacatatttgtaaatagtgcctttattaattgttcttgagttaatattctgagtgtgccatttattttctgtgccatctgttaaatgatgagcatttaataaaattgtgataatcagttatcagtacaagtgccgcatagtgcataggctgaaatgtctcaagattccccacactacatatcagtattttctatctgtatctggacaatgcagtagaaattataacaaatacaaagttctttgtgcttttctgctgcatatgtcagtggctctggagattgttaccatctgctacatatataaatagacttgcagttattactaagctcctcttcagtaatagaaagacttatgaagtcttttactacctctgggttagccaaacaaccttcaaaaagcattgttatttaggttaaatatctgtggacaagaaacaagataatcagttactgagtgaagaaagacgggaatgatgtcccatacttcccagctctctaaagtgttatgctgtacaattaaaatacccctgacccatcatctgctaccattcgttgtggataattcatgtaatctctaacctgtgggcaagtctttacccttcagtagtcaagattacgttagagacttcgtccacgaatccacaccacctttcccatcagttctcaccggaaatatgctgccaaaaagaaaatcagcttttctaagatcaagccagagttgcttctcttacaaccttacggcgctaatgcattaagttgaagtcgactgccaaagaggcccagcagagggcagcacccccatcatttttttgaatttctcccttaggaattttgccttcctttgtcttctgtccaccaggccttctctccagctggacacaaacctcctttgaagggaaataattgccgttaggcttcacagtagtgctttttcctttcacttggatttgcattttaacctgcatttcgaagatttttatacatgttttctatttccgacaatgccaggaggcttcattgacgttgtagtctgtgttaataaacttgtgtatcactctgctctgatcttttaggaattaacttgcaaatgaaatgaatatgttgggactttggcataatttgaatatagcattgtgtgagttgtgattgtctcttcctaattgtgctgtaataacctgtgtatgagaataaaatgatttccacc

SEQ ID NO: 3383 - DNA, 4364 bp, Homo sapiens
gatctgcgcatgcgcactcgaggcaaggcggccactcccagaagtctccggggctcgagcggtgggtgggaggcgcggtccaagtggtcgctgccgtatttctcgtaggtttttaggattctggactccatttctcaccggtacctgcggtcctgactgttctggcttggactacatattacaaaggcaacggagaaaacttggacccctggctccggttccgggaccttttggttccacctgaagaaggcggcgcaggtcactgcgggagcctctgcagccccagcccgccgcccgcgtggtaccctgcgtggcggtgagagtggggctgcaggaggcgctcagagcgcggaggcccccaggcgggccgggcgagtctcccgcctcctcaggccctagggtgctggagctgcggaggaggggcccgtctctaggagacaggcggggagcgtgagagaccgcgcagcggcgacaggaccggcttgcctgtgtgacgtgggtgcagttgcgggactgtgaggggtcttggttcttttgactttgctcttctggtagagaaacgccaaggactgatcaactcttgccagtctcaaaccatgtcctatggatcaataacattcggggatgtggccatagacttctctcatcaggagtgggaatatctcagcctggttcagaagaccttgtaccaggaggtgatgatggagaactatgacaacttagtctcattggcaggacattccgtatctaagccagatttaatcaccttattggagcaaggaaaagagccatggatgattgtgagggaagaaacaagaggagagtgtacagatttggattcaagatgtgaaataatcagcgatgggaaaatgcagctttataggaaacactcatgtgttactctccatcagagaattcataatggacagaaaccatatgagtgtaagcaatgtcagaagtcctttagtcatcttacagaactcatggtacatcaaacaattcatactagtgaggaacctgatcaatgtgaaaagtttaggaaggcatttagccatcttacagaccttagaaagcatcagaaaattaatgctcgtgagaaaccttatgaatgtgaagaatgtgggaaggtcttcagttatcctgcaaaccttgctcaacatgggaaagttcatgttgagaaaccctatgaatgtaaagagtgtggggaagcttttaggactagccgtcaacttactgtacatcatagatttcattatggtgagaaaccctacgaatgtaaggaatgtggcaaggcctttagtgtgtatggacgacttagtcgacatcagagtattcacactggtgagaagccctttgaatgtaacaaatgtgggaagtcctttaggctcaaagcaggccttaaagtacatcagagtattcatactggagagaagccacatgaatgtaaggaatgtggaaaggcctttcgtcagttttcccaccttgtgggtcataaaagaattcatactggagaaaaaccctatgaatgcaaggaatgcgggaagggctttacatgtaggtatcaacttaccatgcatcagagaatttattcaggggagaaacactatgaatgtaaagaaaatggggaggcttttagtagtggccatcaacttactgcacctcatacatttgaaagtgttgagaaaccttataagtgtgaggaatgtgggaaagcctttagtgtgcatggacgacttactcgacatcagggtattcatagtggtaagaaaccctatgaatgtaacaaatgtgggaagtcctttaggctcaattcatcccttaaaatacatcaaaatattcataccggtgagaaaccctacaaatgtaaggaatgtgggaaggccttcagtcagcgtgcacaccttgcccatcataacagaattcatactggttacaaaccctttgaatgtaaagaatgtgggaagtcctttcgttgtgcctcatatcttgttatacatgagagaattcatacaggagagaaaccctatgtatgtcaagagtgtgggaagggttttagttatagccataaactcactatacatcgcagagttcatactggtgagaaaccttatgaatgtaaggaatgtgggaaggcctttagtgtatctggacaacttactcagcatctgagtattcacagtggtaagaaaccctttgaatgcaacaaatgcgggaagtcttttaggttcatttctgtacttaaagcccatcagaatattcatagcgctgagaaaccctacgaatgtaaggaatgtggcaaggcctttcgtcatgccacaagcctcatatatcatgaccgaactcatgctggtgaaaagtcctatgaatgtaaagaatgtggggaaacttttagtcatgcttcacatcttattattcatgagagaattcataccagtgataaaccctatgaatgtaaaagatgtgggaaggcatttcactgtgcctcatatcttgttagacatgaaagcgttcatgctgatggaaatccctatatgtgtgaagagtgtgggaaagcttttaatagtagccatgaacttagtatacatcatagagttcatactggtgagaaaccctttaaatgtaacaaatgcagaaggtcctttaggcttagatccatccttgaagtacatcagagaattcatatttgatagagaaattgtggcatatacaggtagtaaagaaagcacattgtgtcaatggatttatcccactgaacaatttgaatgaagacaatgtggaatggctttgagatacagttcagtttttattaggcatcaatttgtattggtgtgaacttttcaaaatgtaaatcatatatgcagtttctttggtatgacctgtgttaactcagattcagagaatttataatgtatttttttaataacataagaaaacttttctgatattcctctagttttggattgccaaaatattcacagtagaggaaaactgagaaaacgtaggaaaccattctttatacttgcatgtaaacatcttccagcaacaatcatttattgttaaacctggaaaaagccattacacaggaaacctctgttgatataagcgatgatgggaaaggctatttagccactctgcatatttaatgctcatgatcaacatctgcttcctatagctgggatgatatgggggaagatatttatcccttctggggatcatatataaatgatgatagtagtacctacagtatagtgctgttagaattacatgagttagatgtggaggtcagagtggaagcaggtgtgagagggtcccgcagaagaaaacatggctgccaaagtgtttgagtccatcggcaagtttggcctggccttagctgttgcaggaggcatggtgaactctgccttatgtaatgtggatgctgggcacagagctgccatctttgaccaattccgtggagtacagaacattgtggtaggggaagggactcactttctcatcccatgtgtacaaaaaccaattatctttgactgctgttctcaaccacgtagtgcgccagtcatcactggtagcaaagatttacagaatgtcaacatcacactgtgcatcctcttccggcccatcactagccagcttcctcgcatcttcaccagcattggagaggactacgatgagtgtgtgctgccgttcattaccacggagatcctcaagtcactggtggctcgctttgatgctggagaactaatcacccagagggagctggtctccagccaggtgagcaacaaccttatggagtgagcagccacctttgggctcattctggacgacgtgtctttgacacatctgaccttcttgaaggagttaacagacaggtggccccccaggaagcagagagcgccagatttgtggtggaaaaggcggccatcatctctgctgagggtgactccaaggcagctgagctgatcgccaactcactggccactgcaggggacggccagagcgagctgtgcaagctggaagctgcagaagacattgcataccagctctcatgctctcggaacatcacctgcctgccggcagggcagtccgtgctcctccagctgccctagtgaggccccagcctacctgcacctccgtgaggcaactgggccacagccccgatgattcgtaacaccacctttcgccctcaccccagaaatcactgaaatttcatgattggcttaaagtgaaggaagtaaaggtaaaatcacttcagatctctaaaaaacaaagaattacatgagttagtacatgaaaaaattatgggaaactacatgaaatatactgttacgttcaataaacattagcttctgtatataataatatca

SEQ ID NO: 3384 - DNA, 4013 bp, Homo sapiens
attgacccttggctccaggttccctgctgcttcctgtgccttcctcagcctagtacgactacaacagagaaatggtcccaatgggaaatcagatactgagtcttagatgaagatttccagtgagaagaaacagataggatgagaagcttagaagagtaattgcccttaagaaaggtcttggttcttttgactttgctcttctggtagagaaacgccaaggactgatcaactcttgccagtctcaaaccatgtcctatggatcaataacattcggggatgtggccatagacttctctcatcaggagtgggaatatctcagcctggttcagaagaccttgtaccaggaggtgatgatggagaactatgacaacttagtctcattgggacattccgtatctaagccagatttaatcaccttattggagcaaggaaaagagccatggatgattgtgagggaagaaacaagaggagagtgtacagatttggattcaagatgtgaaataatcagcgatgggaaaatgcagctttataggaaacactcatgtgttactctccatcagagaattcataatggacagaaaccatatgagtgtaagcaatgtcagaagtcctttagtcatcttacagaactcatggtacatcaaacaattcatactagtgaggaacctgatcaatgtgaaaagtttaggaaggcatttagccatcttacagaccttagaaagcatcagaaaattaatgctcgtgagaaaccttatgaatgtgaagaatgtgggaaggtcttcagttatcctgcaaaccttgctcaacatgggaaagttcatgttgagaaaccctatgaatgtaaagagtgtggggaagcttttaggactagccgtcaacttactgtacatcatagatttcattatggtgagaaaccctacgaatgtaaggaatgtggcaaggcctttagtgtgtatggacgacttagtcgacatcagagtattcacactggtgagaagccctttgaatgtaacaaatgtgggaagtcctttaggctcaaagcaggccttaaagtacatcagagtattcatactggagagaagccacatgaatgtaaggaatgtggaaaggcctttcgtcagttttcccaccttgtgggtcataaaagaattcatactggagaaaaaccctatgaatgcaaggaatgcgggaagggctttacatgtaggtatcaacttaccatgcatcagagaatttattcaggggagaaacactatgaatgtaaagaaaatggggaggcttttagtagtggccatcaacttactgcacctcatacatttgaaagtgttgagaaaccttataagtgtgaggaatgtgggaaagcctttagtgtgcatggacgacttactcgacatcagggtattcatagtggtaagaaaccctatgaatgtaacaaatgtgggaagtcctttaggctcaattcatcccttaaaatacatcaaaatattcataccggtgagaaaccctacaaatgtaaggaatgtgggaaggccttcagtcagcgtgcacaccttgcccatcataacagaattcatactggttacaaaccctttgaatgtaaagaatgtgggaagtcctttcgttgtgcctcatatcttgttatacatgagagaattcatacaggagagaaaccctatgtatgtcaagagtgtgggaagggttttagttatagccataaactcactatacatcgcagagttcatactggtgagaaaccttatgaatgtaaggaatgtgggaaggcctttagtgtatctggacaacttactcagcatctgagtattcacagtggtaagaaaccctttgaatgcaacaaatgcgggaagtcttttaggttcatttctgtacttaaagcccatcagaatattcatagcgctgagaaaccctacgaatgtaaggaatgtggcaaggcctttcgtcatgccacaagcctcatatatcatgaccgaactcatgctggtgaaaagtcctatgaatgtaaagaatgtggggaaacttttagtcatgcttcacatcttattattcatgagagaattcataccagtgataaaccctatgaatgtaaaagatgtgggaaggcatttcactgtgcctcatatcttgttagacatgaaagcgttcatgctgatggaaatccctatatgtgtgaagagtgtgggaaagcttttaatagtagccatgaacttagtatacatcatagagttcatactggtgagaaaccctttaaatgtaacaaatgcagaaggtcctttaggcttagatccatccttgaagtacatcagagaattcatatttgatagagaaattgtggcatatacaggtagtaaagaaagcacattgtgtcaatggatttatcccactgaacaatttgaatgaagacaatgtggaatggctttgagatacagttcagtttttattaggcatcaatttgtattggtgtgaacttttcaaaatgtaaatcatatatgcagtttctttggtatgacctgtgttaactcagattcagagaatttataatgtatttttttaataacataagaaaacttttctgatattcctctagttttggattgccaaaatattcacagtagaggaaaactgagaaaacgtaggaaaccattctttatacttgcatgtaaacatcttccagcaacaatcatttattgttaaacctggaaaaagccattacacaggaaacctctgttgatataagcgatgatgggaaaggctatttagccactctgcatatttaatgctcatgatcaacatctgcttcctatagctgggatgatatgggggaagatatttatcccttctggggatcatatataaatgatgatagtagtacctacagtatagtgctgttagaattacatgagttagatgtggaggtcagagtggaagcaggtgtgagagggtcccgcagaagaaaacatggctgccaaagtgtttgagtccatcggcaagtttggcctggccttagctgttgcaggaggcatggtgaactctgccttatgtaatgtggatgctgggcacagagctgccatctttgaccaattccgtggagtacagaacattgtggtaggggaagggactcactttctcatcccatgtgtacaaaaaccaattatctttgactgctgttctcaaccacgtagtgcgccagtcatcactggtagcaaagatttacagaatgtcaacatcacactgtgcatcctcttccggcccatcactagccagcttcctcgcatcttcaccagcattggagaggactacgatgagtgtgtgctgccgttcattaccacggagatcctcaagtcactggtggctcgctttgatgctggagaactaatcacccagagggagctggtctccagccaggtgagcaacaaccttatggagtgagcagccacctttgggctcattctggacgacgtgtctttgacacatctgaccttcttgaaggagttaacagacaggtggccccccaggaagcagagagcgccagatttgtggtggaaaaggcggccatcatctctgctgagggtgactccaaggcagctgagctgatcgccaactcactggccactgcaggggacggccagagcgagctgtgcaagctggaagctgcagaagacattgcataccagctctcatgctctcggaacatcacctgcctgccggcagggcagtccgtgctcctccagctgccctagtgaggccccagcctacctgcacctccgtgaggcaactgggccacagccccgatgattcgtaacaccacctttcgccctcaccccagaaatcactgaaatttcatgattggcttaaagtgaaggaagtaaaggtaaaatcacttcagatctctaaaaaacaaagaattacatgagttagtacatgaaaaaattatgggaaactacatgaaatatactgttacgttcaataaacattagcttctgtatataataatatca

SEQ ID NO: 3385 - DNA, 8743 bp, Homo sapiens
gcaatgatgttgtccactgggcatgtactgaccaatgtggcaggtctgagaacatagctgaagctgaaaataggaaagctgggggcaaggaagagccttgaatcttgaggtgggacgttgactctaagatgtccttgagcagtggagcctccggagggaaaggagtggatgcaaacccggttgagacatacgacagtggggatgaatgggacattggagtagggaatctcatcattgacctggacgccgatctggaaaaggaccagcagaaactggaaatgtcaggctcaaaggaggtggggataccggctcccaatgctgtggccacactaccagacaacatcaagtttgtgaccccagtgccaggtcctcaagggaaggaaggcaaatcaaaatccaaaaggagtaagagtggcaaagacactagcaaacccactccagggacttccctgttcactccaagtgagggggcagctagcaagaaagaggtgcaggggcgctcaggagatggtgccaatgctggaggcctggttgctgctattgctcccaagggctcagagaaggcggctaaggcatcccgcagtgtagccggttccaaaaaggagaaggagaacagctcatctaagagcaagaaggagagaagcgaaggagtggggacttgttcagaaaaggatcctggggtcctccagccagttcccttgggaggacggggtggtcagtatgatggaagtgcaggggtggatacaggagctgtggagccacttgggagtatagctattgagcctggggcagcgctcaatcctttgggaactaaaccggagccagaggaaggggagaatgagtgtcgcctgctaaagaaagtcaagtctgaaaagatggagtcccctgtttccacaccagcagtgctgccaatacaccttttggtgccagtggtcaacaatgacatctcatctccctgtgagcagatcatggttcgtacccgatcagttggggtcaacacatgtgatgtggctctggccacagagcctgagtgcttgggcccctgtgaacctggaactagcgtcaaccttgaaggcatcgtgtggcaggaaacagaagatgggatgttggtggtaaatgtaacgtggaggaacaagacatatgtaggtacactccttgactgcacacgacatgattgggcacccccaaggttctgtgactccccgaccagtgacctggaaatgcgcaatggccggggtagaggcaaacgcatgcgtcccaacagtaatacacctgtcaatgagacagccacagcctctgacagcaaagggaccagtaacagcagcaaaacccgggcaggagccaatagcaaaggccgtcggggcagccagaattcttcagagcaccgcccacctgccagcagcacttctgaggatgtcaaggccagcccttcctcagctaataagcggaaaaacaaacccctttcagacatggagctgaattctagctcagaggactccaaagggagcaagcgtgtccgtactaattccatgggctcagccactggcccccttcctgggacaaaggtagaacccactgttctggacagaaactgcccctcccccgtcctaattgactgtccccacccaaactgcaacaagaagtacaagcacatcaatggacttaagtaccaccaagctcatgcccatacagatgatgacagcaagccggaagcggatggggacagtgagtacggagaggaacctattctccatgcagatcttgggagctgcaacggtgcatctgtctcacaaaaaggttccttgtcccctgcccgctcagctacccccaaagttcgacttgtagagccccatagcccttctccttcaagcaaattcagcacaaaaggcctctgtaagaaaaagttgagtggggaaggggacacagaccttggggccttatccaatgatggctctgatgatggaccctcagtgatggatgaaacaagcaatgatgcctttgattctttagaaaggaagtgtatggaaaaagaaaaatgtaaaaaaccctctagtttaaaacctgaaaagattccttccaagagcctaaagtcagcccgtcccattgcccctgccatccccccacagcaaatctacaccttccagacagccaccttcacagcagcgagcccaggctcttcctcaggcttgaccgccacagtggcacaagccatgcccaacagtccccaactcaagcccattcagcccaagcccactgttatgggagaacctttcacagtcaaccctgccttgactccagccaaggacaagaaaaagaaagacaaaaaaaagaaggaatcttcaaaggaacttgaaagtcctctgacccctgggaaggtgtgtcgagcagaggaaggcaaaagcccattcagggaatcttcaggagatgggatgaaaatggaggggctcctaaatggctcatcagacccccaccaaagccgactggctagcatcaaggctgaagccgacaagatctacagtttcacggacaatgcccccagcccttccattggaggcagtagccgccttgaaaacactacccctactcagcccctgactcccttacatgtggtgacccagaatggagctgaagccagctcagtcaaaaccaacagccctgcatactctgacatctctgatgctggggaggatggggagggcaaggtagacagtgtcaaatcaaaggacgccgaacagttggttaaagaaggggctaagaaaactctttttccccctcagcctcagagcaaagactcaccatattaccaaggctttgagagttactattctccaagttatgcacagtccagccctggggctctgaaccccagcagccaggcaggagtggagagccaggccctgaagacaaaaagggatgaggaacctgagagcatagaagggaaagtgaagaacgatatctgtgaagaaaagaagcccgagctgagcagttccagtcagcagccctcggtcatccagcagcgtcccaatatgtacatgcagtccctgtactacaaccagtatgcctatgtacccccctatggctacagcgaccagagttaccacacccaccttctgagcactaacacggcttaccggcagcagtacgaagaacagcagaaacgccagagcttagagcagcagcagcggggagtggacaagaaggcagagatgggcctgaaggagcgggaggcagcactcaaggaagagtggaagcaaaagccgtcaattccaccaactctcaccaaggcccccagcctgacagacctggtgaaatcaggacctggcaaggccaaggagccaggggctgacccagccaaatcagtcatcattcccaagttagatgactcttcaaaactcccgggccaggcccctgaaggccttaaagtgaagctgagtgatgccagccacctaagcaaggaggcctctgaggccaagacaggtgctgagtgtggtcgacaggcagagatggatccaatactctggtaccgacaggaggcagagccccggatgtggacatatgtttatcctgccaagtactcagacatcaagtcagaggatgagcggtggaaggaggagcgggaccgcaaattgaaggaggaaaggagtcggagtaaggactctgtccccaaggaagatgggaaggaaagcacaagtagtgactgcaagctgcccacgtcagaggagtctcgccttgggagcaaggagccccggccaagtgtccatgtgcctgtgtcctccccacttacccagcaccagtcctacatcccctacatgcacggctattcctacagtcagtcctacgaccccaaccaccccagctaccggagcatgcctgctgtgatgatgcagaactacccaggttcctacctgccttccagctactctttttccccatatggcagcaaggtctcaggtggtgaagatgctgacaaggcacgagccagccccagtgtgacttgtaaatccagctcagagtccaaagccctggacatcttgcagcagcatgccagtcactacaagagcaagtctcccacgataagtgataaaacttctcaggagagagatcgaggaggctgtggggtggttgggggtggtggcagctgtagcagcgtcgggggagcaagtgggggtgaacggagtgttgaccggccccgcacctctccttcccagcgcctgatgtccacacaccaccaccaccaccacttggggtactcattgctcccagcacagtacaacttaccctatgcagcagggctttcttctacagccattgttgccagccaacaaggctcaactccctcactctacccaccccccaggaggtgagaatgacaccaagtgcccggataaagtcagcttcacgggcccggactggcttacccaaggaggtgctgaaggtgccgtttagacatcagttaaatggtgttgatcatcctgtttgccgtttccaccatgactgaaggcagacccttggctatctcacctccaccagacctccggactacctgaccctacctcttcctcaggagctggagagctggtacttagcaaaaatatttattctctcagccacagttatgactattgtggcctctgtggagatgaaggcacgggaagcaaccaggggaacatggcctcagcccagagaagccactgctctgttccccaagcccttggtctgctgctggagcagtaccagcccccccgcccaccagggagggacccccacccccaagcactgggtaaggtctgaagacagcacagcagccatacccctcaccatcattaccaccatcaccagattctgcatctccctagtgctttgcaccctgggaattggcagcatgtggaggaactagaatctcaggaaagaaattgggggttgttttctacataattgtgaaaacaaggtcttcaaatgtggagacttctccccatttacatgagcacatataaacgctcacaacctagcctggaaaggaagaccaaggcatctgccccaacatggccttgagctgcctgtgaggcagggggcaggggttccaacaccagcacagggctccccagggacactgggagcaagctggtgctggagcatgaatgacgtctgtgaagtagaacctgcgtccccactaagtcctgctgcttcttattccccaactccttgcccttttcccttccctcctaaccccttggtgcctttcccagggggatccccacactggtcttgcctcttcttttccactgcttggctcttaagcctcaggcagataaactagtattccccccagcttggggaaccttggagtctgccaggtcaccttagggcaaggcccagaaggcagcccctgggagcacccagcagttcttggagatgtcctgtcatctagccatctgatatcttcctcatttgaggccacagatatatacagcccaattcctctgtctacaagtacatgattttatatagctcagtctataacctccatgtgggccaatataagctgtgtttcttggtaacacatattttgtttgaggggccactggccatgggaggttatttgttccttagaccctggaataacacatccaagccattacttattagagtctcagaatgtactcagtggagctgtgctttgaggcagccaacatttctctgctctccttagaaatgcagtctcccaatggaagctttatactctttgtactgggaaagtgaggatgatttggtagctttattggggtcatgtcttccccaaggtgtggggagcttagcttacttggcttttgaggtatcatccctctgttctcccctcctatctttccatgaccctctggattgagagagagagataaagactgacagacaccagtgtaggctggaaaagggagtgtgtgaccagagtgccaaaagtgactaggagcaggaacttggctccgactcagtttggaaaatgggaaataggggacagtaagcacaatgcccagtagtagttgatttccaaggaccctggaaccctacacttgagaggcttagggtcaccatctgctcaagaggatcccctctgatctacaggccttttccctaggtttctgcctcctcgtttttgttcaagttgggttctgagtcctccccaaaaaccattgttttagacctcttggcagggccccaaaacagcctccctcatacccatcattccctctgccttctgctgccctcatgggcagtgctctgagcagtgacctccctttcctccgtggaagtagctagtgcagacaccgtcatcccaccccacctgagtcaccccaaccaagagggtgactgaatttcagcctgattatgccctcctggggctcctgtgaggtggagccaaggttccctctctgttcctgtttgtttttaaatattgttgtgtgttttgtatctgtggcactggcctgcagcatactctgtatatattgtaaagaaaccgttaggagtaattttcttttgcattgggcaggcatggccctgcattcctgccctttccactcattctgtaacacagaggacgaacttctgtattagctgggcagccttgggttctccagaagagaacaggtttttcttttcctttttaatttttcttcttaaacatttggctctttgatcctcatatccaagtctcccctgaagagtaggagctgctcagaagagcaggtgaaagccaccatggcagatcctgatgcctgccgggcctagtcttccctctgaaataacatgaagcagcagctgtggagattcttgacaagtgctgagtgaaagatttgctgcccacctctacatggggaggagaaacacaggtgggagctacctgtggcatccatgacctagtcagagggatgagatgctcagcaggggtccccatcctatcccaccccacaaacaaaggctggaaaaatttgctaccaagggccaagaccaccagaccaagcctgtttatgagccacccctgcccaggccctcacagacattgctcacggggcttcccatagaggagaagctaaagagggagggggcctcatccccagatagatcaggcaaggcttggagagctgctctttaggatccacatcaactacttcctcattttaaggtatggcagttcccttcatccccttttcctgccttgtacatgtacatgtatgaaatttccttctcttaccgaactctctccacacatcacaaggtcaaagaaccacacgcttagaagggtaagagggcaccctatgaaatgaaatggtgatttcttgagtctcttttttccacgtttaaggggccatggcaggacttagagttgcgagttaagactgcagagggctagagaattatttcatacaggctttgaggccacccatgtcacttatcccgtataccctctcaccatccccttgtctactctgatgcccccaagatgcaactgggcagctagttggccccataattctgggcctttgttgtttgttttaattacttgggcatcccaggaagctttccagtgatctcctaccatgggcccccctcctgggatcaagcccctcccaggccctgtccccagcccctcctgccccagcccacccgcttgccttggtgctcagccctcccattgggagcaggttggggcgagctggaggcccgggctggaggggcagtgttgctgttcatagattttgttccattggcgttgctctgttgaatttaatttcagtcttcctgattcttcccttctgtaaagtgtacattaccaagttccttgtttttttatatatatatataaatatatatatatacaaactgtactctttttgcctttgtacattcaggcaagaagagaaaataaatctttttaagagacaatcacaaatctgtgagggctgctggttatttctcctggagtttgctgctgagctgcctcttccttcctcccaattttcctgttctccctcagctctcctgatcttcctggccctgctccatatgcatcctcagcttcactttccctggctgatggcaagctgttgaatccagtgtccagactacctgccttgtaacccttttctgcccagcattgttttctggcttggccactggcttagcccaggagctttactctgtgccctggcctcccctctcttcacctttagatttccattcaccgaagtggctttggacccctgggtactctgggacctgtttcctggaggccctggcttgggacactcacctgtgaaactatgcagctgggagctctctgcctaagagtttgcactatttaaacctgcctgggagttaggacggatggttttaggaatgaccggaaaactacccctaaaactcccccgacattccagcctctagaatgctctgatccagagctcagtggatgattcccagctggtggactcctgtggctaccccatcagaacaagggctaagggtttatgggtcaagagtatttgatcagaattttaaagggtggtatactctgaaacacagcccaaccaaaccattgtttggccgctttctcttttcctctaccttcctcatccccacttttttccctttctctctacttcctcttcttaattggctttggaattgaaatatatttttaaattatttgttgtatttattgaataaagtttttaatgtccctgttctt

SEQ ID NO: 3386 - DNA, 2134 bp, Homo sapiens
agacccggaagcggatcgcgtgggtagaaggtcacaccgcagcgcgtcagtttccctttgtttagattcaatctgggcttcccagctcccccgcgcttctgtacccgggatctgagagtcaacacagaccttgaaatccccgcaccgctccctccaccccgtgtaaattcaggcgtctccgtgagagtccggcgctcgcttccctgtgtgttaaaatcgctcggcgacgggtcctgtccccgctcgttctgccttgggccagacacaggagtgttgccatgttgtccaaactggtctcgaaattctggagtcaagcagtctgcctgcctcgttctccaaacgtgctgggattacaggcatgagccactacgcctggccaagtattcggtatttataaaatctacagtagtacacagttatgtcgtaggccatcacattcggtcaccacacactcactgactcatccagagcaatttctagtcctgcaagcgccattcatggattgacttataaacagtcatgctatgtgatgaagaagcccagaagaggaaagcaaaggagtcagggatggctcttcctcagggacgcttgacattcatggacgtggccatcgaattctctcaggaggagtggaaatccctggaccctggacagagggctttatacagggacgtgatgttggagaactacaggaacctggtctttctggggaggagctgtgtattgggaagcaatgcagaaaacaagcctattaaaaatcaacttggattaacccttgaggcacatctgtctgaattgcagctgtttcaagccggaaggaaaatttacagaagtaatcaagttgaaaagtttacaaaccatcgttcctcagtttcaccacttcaaaaaatttcttctagtttcacaacacacatttttaataaatatagaaatgatcttattgatttcccattactcccacaagaagagaaagcatacattagaggaaaatcttatgaatatgaatgtagtgaagatggtgaagtttttagagtccgtgcaagccttactaaccatcaagtaatccatactgcagagaaaccttacaaatgtactgaatgtggcaaggtcttcagtcgcaattcacaccttgtagaacattggagaattcatactggacagaagccttacaaatgtagtgaatgtgacaaggtgtttaatcgcaattcaaaccttgcacgacatcaaagaattcatactggagagaagcctcacaaatgtaacgaatgtggcaaagcttttagagagtgttcgggacttactacccatcttgtaatccatactggagagaaaccttacaaatgtaatgagtgtggcaagaacttcaggcacaaattttctctaaccaatcatcagagaagtcacacggcggaaaaaccttacaaatgtaatgaatgtggcaaggtctttagtctgctttcataccttgcacggcatcaaataattcatagtacagagaagccctacaaatgtaacgaatgtggaagagcatttcacaagcgtccgggccttatggcccatcttctaatccatactggagagaaaccttacaaatgtaatgaatgtgacaaagtctttgggcgcaaattatacctaaccaaccatcagagaattcatactggagagagaccttacaagtgtaatgcatgtggcaaggtcttcaatcaaaatccacacctttcacgacatcggaaaattcatgctggagagaattcactgcgtaccttacagatggaatgaatgtggcaaaatctttagttagaattcacacctagcacaacattggaggactcaggagaaaaaccttacaaatatcataaatgtggcaaagaatttagtttgcattgaagcctcatcactcatctcttgatccacactgaaaggaaaccctacaaatgtaaagttaataacatatataaataatctataaagagagaacagttatatcagaatagagcatttaatgaaaactaccagtatagcatattcttgagtaggattcacatttaactgctggcaccgtaatttgtaactctttgatttagaatgtacatacttctcatgttttaagtaataaagtttaaagttttttttt

SEQ ID NO: 3387 - DNA, 2119 bp, Homo sapiens
aggcagctttaacctgggtgtgggtgaggatgacactgtgatgctcctagaggtggttcatgaggaatggacgaataagtggttggaactgatatgagaacacatagctgaagaagagacacaggagtgttgccatgttgtccaaactggtctcgaaattctggagtcaagcagtctgcctgcctcgttctccaaacgtgctgggattacaggcatgagccactacgcctggccaagtattcggtatttataaaatctacagtagtacacagttatgtcgtaggccatcacattcggtcaccacacactcactgactcatccagagcaatttctagtcctgcaagcgccattcatggattgacttataaacagtcatgctatgtgatgaagaagcccagaagaggaaagcaaaggagtcagggatggctcttcctcagggacgcttgacattcatggacgtggccatcgaattctctcaggaggagtggaaatccctggaccctggacagagggctttatacagggacgtgatgttggagaactacaggaacctggtctttctgggaatctgtcttcctgacctaagtattatttccatgttgaagcaaaggagagagcccttgattctgcaaagtcaagttaaaatagtaaaaaatacagatggaagggaatgtgtcagaagcgtgaacacagggaggagctgtgtattgggaagcaatgcagaaaacaagcctattaaaaatcaacttggattaacccttgaggcacatctgtctgaattgcagctgtttcaagccggaaggaaaatttacagaagtaatcaagttgaaaagtttacaaaccatcgttcctcagtttcaccacttcaaaaaatttcttctagtttcacaacacacatttttaataaatatagaaatgatcttattgatttcccattactcccacaagaagagaaagcatacattagaggaaaatcttatgaatatgaatgtagtgaagatggtgaagtttttagagtccgtgcaagccttactaaccatcaagtaatccatactgcagagaaaccttacaaatgtactgaatgtggcaaggtcttcagtcgcaattcacaccttgtagaacattggagaattcatactggacagaagccttacaaatgtagtgaatgtgacaaggtgtttaatcgcaattcaaaccttgcacgacatcaaagaattcatactggagagaagcctcacaaatgtaacgaatgtggcaaagcttttagagagtgttcgggacttactacccatcttgtaatccatactggagagaaaccttacaaatgtaatgagtgtggcaagaacttcaggcacaaattttctctaaccaatcatcagagaagtcacacggcggaaaaaccttacaaatgtaatgaatgtggcaaggtctttagtctgctttcataccttgcacggcatcaaataattcatagtacagagaagccctacaaatgtaacgaatgtggaagagcatttcacaagcgtccgggccttatggcccatcttctaatccatactggagagaaaccttacaaatgtaatgaatgtgacaaagtctttgggcgcaaattatacctaaccaaccatcagagaattcatactggagagagaccttacaagtgtaatgcatgtggcaaggtcttcaatcaaaatccacacctttcacgacatcggaaaattcatgctggagagaattcactgcgtaccttacagatggaatgaatgtggcaaaatctttagttagaattcacacctagcacaacattggaggactcaggagaaaaaccttacaaatatcataaatgtggcaaagaatttagtttgcattgaagcctcatcactcatctcttgatccacactgaaaggaaaccctacaaatgtaaagttaataacatatataaataatctataaagagagaacagttatatcagaatagagcatttaatgaaaactaccagtatagcatattcttgagtaggattcacatttaactgctggcaccgtaatttgtaactctttgatttagaatgtacatacttctcatgttttaagtaataaagtttaaagttttttttt

SEQ ID NO: 3388 - DNA, 2263 bp, Homo sapiens
agacccggaagcggatcgcgtgggtagaaggtcacaccgcagcgcgtcagtttccctttgtttagattcaatctgggcttcccagctcccccgcgcttctgtacccgggatctgagagtcaacacagaccttgaaatccccgcaccgctccctccaccccgtgtaaattcaggcgtctccgtgagagtccggcgctcgcttccctgtgtgttaaaatcgctcggcgacgggtcctgtccccgctcgttctgccttgggccagacacaggagtgttgccatgttgtccaaactggtctcgaaattctggagtcaagcagtctgcctgcctcgttctccaaacgtgctgggattacaggcatgagccactacgcctggccaagtattcggtatttataaaatctacagtagtacacagttatgtcgtaggccatcacattcggtcaccacacactcactgactcatccagagcaatttctagtcctgcaagcgccattcatggattgacttataaacagtcatgctatgtgatgaagaagcccagaagaggaaagcaaaggagtcagggatggctcttcctcagggacgcttgacattcatggacgtggccatcgaattctctcaggaggagtggaaatccctggaccctggacagagggctttatacagggacgtgatgttggagaactacaggaacctggtctttctgggaatctgtcttcctgacctaagtattatttccatgttgaagcaaaggagagagcccttgattctgcaaagtcaagttaaaatagtaaaaaatacagatggaagggaatgtgtcagaagcgtgaacacagggaggagctgtgtattgggaagcaatgcagaaaacaagcctattaaaaatcaacttggattaacccttgaggcacatctgtctgaattgcagctgtttcaagccggaaggaaaatttacagaagtaatcaagttgaaaagtttacaaaccatcgttcctcagtttcaccacttcaaaaaatttcttctagtttcacaacacacatttttaataaatatagaaatgatcttattgatttcccattactcccacaagaagagaaagcatacattagaggaaaatcttatgaatatgaatgtagtgaagatggtgaagtttttagagtccgtgcaagccttactaaccatcaagtaatccatactgcagagaaaccttacaaatgtactgaatgtggcaaggtcttcagtcgcaattcacaccttgtagaacattggagaattcatactggacagaagccttacaaatgtagtgaatgtgacaaggtgtttaatcgcaattcaaaccttgcacgacatcaaagaattcatactggagagaagcctcacaaatgtaacgaatgtggcaaagcttttagagagtgttcgggacttactacccatcttgtaatccatactggagagaaaccttacaaatgtaatgagtgtggcaagaacttcaggcacaaattttctctaaccaatcatcagagaagtcacacggcggaaaaaccttacaaatgtaatgaatgtggcaaggtctttagtctgctttcataccttgcacggcatcaaataattcatagtacagagaagccctacaaatgtaacgaatgtggaagagcatttcacaagcgtccgggccttatggcccatcttctaatccatactggagagaaaccttacaaatgtaatgaatgtgacaaagtctttgggcgcaaattatacctaaccaaccatcagagaattcatactggagagagaccttacaagtgtaatgcatgtggcaaggtcttcaatcaaaatccacacctttcacgacatcggaaaattcatgctggagagaattcactgcgtaccttacagatggaatgaatgtggcaaaatctttagttagaattcacacctagcacaacattggaggactcaggagaaaaaccttacaaatatcataaatgtggcaaagaatttagtttgcattgaagcctcatcactcatctcttgatccacactgaaaggaaaccctacaaatgtaaagttaataacatatataaataatctataaagagagaacagttatatcagaatagagcatttaatgaaaactaccagtatagcatattcttgagtaggattcacatttaactgctggcaccgtaatttgtaactctttgatttagaatgtacatacttctcatgttttaagtaataaagtttaaagttttttttt

SEQ ID NO: 3389 - DNA, 2723 bp, Homo sapiens
tcaatctgggcttcccagctcccccgcgcttctgtacccgggatctgagagtcaacacagaccttgaaatccccgcaccgctccctccaccccgtgtaaattcaggcgtctccgtgagagtccggcgctcgcttccctgtgtgttaaaatcgctcggcgacgggtcctgtccccgctcgttctgccttgggccagacacaggagtgttgccatgttgtccaaactggtctcgaaattctggagtcaagcagtctgcctgcctcgttctccaaacgtgctgggattacaggcatgagccactacgcctggccaagtattcggtatttataaaatctacagtagtacacagttatgtcgtaggccatcacattcggtcaccacacactcactgactcatccagagcaatttctagtcctgcaagcgccattcatggattgacttataaacagtcatgctatgtgatgaagaagcccagaagaggaaagcaaaggagtcagggatggctcttcctcagggacgcttgacattcatggacgtggccatcgaattctctcaggaggagtggaaatccctggaccctggacagagggctttatacagggacgtgatgttggagaactacaggaacctggtctttctggggaggagctgtgtattgggaagcaatgcagaaaacaagcctattaaaaatcaacttggattaacccttgaggcacatctgtctgaattgcagctgtttcaagccggaaggaaaatttacagaagtaatcaagttgaaaagtttacaaaccatcgttcctcagtttcaccacttcaaaaaatttcttctagtttcacaacacacatttttaataaatatagaaatgatcttattgatttcccattactcccacaagaagagaaagcatacattagaggaaaatcttatgaatatgaatgtagtgaagatggtgaagtttttagagtccgtgcaagccttactaaccatcaagtaatccatactgcagagaaaccttacaaatgtactgaatgtggcaaggtcttcagtcgcaattcacaccttgtagaacattggagaattcatactggacagaagccttacaaatgtagtgaatgtgacaaggtgtttaatcgcaattcaaaccttgcacgacatcaaagaattcatactggagagaagcctcacaaatgtaacgaatgtggcaaagcttttagagagtgttcgggacttactacccatcttgtaatccatactggagagaaaccttacaaatgtaatgagtgtggcaagaacttcaggcacaaattttctctaaccaatcatcagagaagtcacacggcggaaaaaccttacaaatgtaatgaatgtggcaaggtctttagtctgctttcataccttgcacggcatcaaataattcatagtacagagaagccctacaaatgtaacgaatgtggaagagcatttcacaagcgtccgggccttatggcccatcttctaatccatactggagagaaaccttacaaatgtaatgaatgtgacaaagtctttgggcgcaaattatacctaaccaaccatcagagaattcatactggagagagaccttacaagtgtaatgcatgtggcaaggtcttcaatcaaaatccacacctttcacgacatcggaaaattcatgctggagagaattcactgcgtaccttacagatggaatgaatgtggcaaaatctttagttagaattcacacctagcacaacattggaggactcaggagaaaaaccttacaaatatcataaatgtggcaaagaatttagtttgcattgaagcctcatcactcatctcttgatccacactgaaaggaaaccctacaaatgtaaagttaataacatatataaataatctataaagagagaacagttatatcagaatagagcatttaatgaaaactaccagtatagcatattcttgagtaggattcacatttaactgctggcaccgtaatttgtaactctttgatttagaatgtacatacttctcatgttttaagtaataaagtttaaagtttttttttagttttttcttttttttttgagacgaagtctcgctgtattacccaggctggagtgcagtggcatgatcttggctcactgcaacctccgtctcccggattcaagcaattctcctgcctcagcctcctgagtagctgggattacaggcatgtgccactactgcccggctaatttttgtatttttagtcgagacggggtttccctccgttggccaggccggtttcaaactcctgacctcaagtgatccactggccttggcctcccaaagtgctgggattataggtgtgagccacagcgcccggcctagtttaaatttttcttagtgtgaatgaattacatcctttctaccagcgttgtttaatcttacctcaggaggatactttatagtagagaataataacccattatgattttaaggttgaagcagccagaaaagtgtgtgtgtgtgtatgtgtgtgagacataaaacaacatacgcttctgggtgcaatatacttaagtaagtatgatgttgagtaattacacttagtacttgagttagtttctctgtactctggtgtaggatgtttatgtgggtaaagtcaaaatcactttaatagtacaatttcagccttgtacaccctcaaatgtgtgtgagtgttaaagagtatgccctgta

SEQ ID NO: 3390 - DNA, 3153 bp, Homo sapiens
aatgctgtgtatttacttgaactcatacatcagaagatagtgatcttaacacattatgtttgggaagtttaaaatatctcttccaaatgcttgatgaaaaaggtgggaggatcacttgagccagggagttgaaggctgcagtgagccctgtttttgccaccacactccagcttggagaggtgaggggctgtcctctggatggcaattgatgaaggatgagtctgtgccctgaaggggagatcagtccagcccagctccccactgctgcctcgtgtgtggtggcttctccaggagagaggattgattcctaaagactcatgttacgtgaggaagcagctcagaagaggaaaggaaaggagccaggcatggctcttcctcagggacgcttgactttccgggatgtggctatagaattctcattggcagagtggaaatgcctgaacccttcacagagggctttgtacagggaagtgatgttggagaactacaggaacctggaggctgtggatatctcttccaaatgcatgatgaaggaggtcttgtcaacagggcaaggcaatacagaagtgatccacacagggacattgcaaagacatgaaagtcatcacattggagatttttgcttccaggaaattgagaaagaaattcatgacattgagtttcagtgtcaagaagatgaaagaaatggccttgaagcacccatgacaaaaataaaaaagttgactggtagcacagaccaacatgatcacaggcatgctggaaacaagcctattaaagatcagcttggatcaagcttttattcacatctgcctgaactccacatatttcagatcaaaggtgaaattggtaatcaacttgagaagtctactaatgatgctccctcagtttcaacattccaaagaatttcctgtaggccccaaacccagatttctaataactatgggaataatcccctgaattcttcattactcccacaaaaacaggaagtacacatgagagaaaaatctttccaatgtaataagagtggcaaagcctttaattgtagctcactcttaaggaaacaccagataccccatttaggagacaaacaatataaatgtgatgtatgtggcaagctctttaatcacgagcaataccttgcatgccatgatagatgtcacactgttgagaaaccttacaagtgtaaagagtgtggcaagaccttcagtcaggagtcatcccttacctgccatcgtagacttcatactggagtaaaacgttacaattgtaatgagtgtggcaagatctttggtcaaaattcagcccttctaattgataaggcaattgatactggagaaaatccttacaagtgtaatgaatgtgacaaggcttttaatcaacaatcacaactttcacatcatagaattcatactggagagaaaccttacaaatgtgaagaatgtgacaaagttttcagtcggaaatcaaccattgagacacataagagaattcatactggagagaaaccatacagatgtaaggtttgtgacacagctttcacgtggcattcacagctggctcgacatagaagaattcatactgcaaagaaaacttataaatgtaatgagtgtggcaagaccttcagtcacaagtcatcccttgtatgccatcatagacttcatggtggagagaaatcttacaaatgtaaggtttgtgacaaggcttttgtgtggagttcacaactggcaaaacatactagaattgactgtggagaaaaaccttacaagtgtaatgaatgtgggaagacctttggtcaaaattcagatcttttaattcataagtcaattcatactggggagcaaccttacaaatgtgatgaatgtgaaaaggttttcagtcgtaaatcaagccttgagacacataagataggtcatactggagagaaaccatacaaatgtaaggtttgtgacaaggcttttgcgtgtcattcctatctggcaaaacatactagaattcatagtggagagaaaccttacaagtgtaatgagtgcagcaagaccttcagtcacaggtcataccttgtatgccatcatagagttcatagtggtgagaaaccttacaagtgtaatgagtgcagcaagaccttcagtcgcaggtcatcccttcattgccatcgtagacttcatagtggtgagaaaccttacaagtgtaatgagtgtggcaataccttccgtcactgctcatcccttatataccatcgtagacttcatactggagagaaatcttacaaatgtacaatttgtgacaaggctttcgtgcgtaattcactcctgtcaagacataccagaattcacactgcagagaaaccttacaagtgtaatgaatgtgggaaggcttttaatcaacaatcacacctttcacgtcatcatagaattcatactggagagaaaccttagaaatgtgaagcatgtgacaaagtttccatttggaaatcacaccttaaagacataggagaatttatactggagagaaagcttacaaatgtaaggtttctgacaagacttgggagtgattcacacctggaacaacatactggacttcacactggagagaaaccttacaagtgtaatgagtgtggcaaagcctttggcaagcagtcaacacttattcaccatcaggcaattcatggtgtagggaaacttgactaatgtaatgattgtcacaaagtcttcagtaatgctacaacgattacaaatcattggagaatccataatgaagagagatcttacaagtgtaataaatgtggcaaatttttcagagatcgttcacatattgcaggtcatcggtgaactcatactggagagaaaccttacaaatgtcatgactgtgccaaggtcttcagtcaagcttcatcctatgcaaaacataggagaatttatacaggagagaaacctcacaagtgtgatgattgtggcaaagcctttgcttcacgttcacacgtcattagacatcagagaatctatactggacagaaatcttacaaatgtcatcagtgtggcaaggtcttcagtccaagatcactccatgcagaacatcagaaaattcatttttgagataaccgttcccaatgaaatgagtatagcaaaccatcaagcattaattgacattggagtc

SEQ ID NO: 3391 - DNA, 4380 bp, Homo sapiens
aaacccggaagcggatcgggtggagtgtaggtcatatcgccgcgttgactagataacgaaggacaatgcatatatacaaaattgctgtattgcctggtgatatgcagctgtacctgtgacatcataattgcaccctccgacatgatatctcttccaaatgcttgatgaaaaaggtgggaggatcacttgagccagggagttgaaggctgcagtgagccctgtttttgccaccacactccagcttgggattgattcctaaagactcatgttacgtgaggaagcagctcagaagaggaaaggaaaggagccaggcatggctcttcctcagatatctcttccaaatgcatgatgaaggaggtcttgtcaacagggcaaggcaatacagaagtgatccacacagggacattgcaaagacatgaaagtcatcacattggagatttttgcttccaggaaattgagaaagaaattcatgacattgagtttcagtgtcaagaagatgaaagaaatggccttgaagcacccatgacaaaaataaaaaagttgactggtagcacagaccaacatgatcacaggcatgctggaaacaagcctattaaagatcagcttggatcaagcttttattcacatctgcctgaactccacatatttcagatcaaaggtgaaattggtaatcaacttgagaagtctactaatgatgctccctcagtttcaacattccaaagaatttcctgtaggccccaaacccagatttctaataactatgggaataatcccctgaattcttcattactcccacaaaaacaggaagtacacatgagagaaaaatctttccaatgtaataagagtggcaaagcctttaattgtagctcactcttaaggaaacaccagataccccatttaggagacaaacaatataaatgtgatgtatgtggcaagctctttaatcacgagcaataccttgcatgccatgatagatgtcacactgttgagaaaccttacaagtgtaaagagtgtggcaagaccttcagtcaggagtcatcccttacctgccatcgtagacttcatactggagtaaaacgttacaattgtaatgagtgtggcaagatctttggtcaaaattcagcccttctaattgataaggcaattgatactggagaaaatccttacaagtgtaatgaatgtgacaaggcttttaatcaacaatcacaactttcacatcatagaattcatactggagagaaaccttacaaatgtgaagaatgtgacaaagttttcagtcggaaatcaaccattgagacacataagagaattcatactggagagaaaccatacagatgtaaggtttgtgacacagctttcacgtggcattcacagctggctcgacatagaagaattcatactgcaaagaaaacttataaatgtaatgagtgtggcaagaccttcagtcacaagtcatcccttgtatgccatcatagacttcatggtggagagaaatcttacaaatgtaaggtttgtgacaaggcttttgtgtggagttcacaactggcaaaacatactagaattgactgtggagaaaaaccttacaagtgtaatgaatgtgggaagacctttggtcaaaattcagatcttttaattcataagtcaattcatactggggagcaaccttacaaatgtgatgaatgtgaaaaggttttcagtcgtaaatcaagccttgagacacataagataggtcatactggagagaaaccatacaaatgtaaggtttgtgacaaggcttttgcgtgtcattcctatctggcaaaacatactagaattcatagtggagagaaaccttacaagtgtaatgagtgcagcaagaccttcagtcacaggtcataccttgtatgccatcatagagttcatagtggtgagaaaccttacaagtgtaatgagtgcagcaagaccttcagtcgcaggtcatcccttcattgccatcgtagacttcatagtggtgagaaaccttacaagtgtaatgagtgtggcaataccttccgtcactgctcatcccttatataccatcgtagacttcatactggagagaaatcttacaaatgtacaatttgtgacaaggctttcgtgcgtaattcactcctgtcaagacataccagaattcacactgcagagaaaccttacaagtgtaatgaatgtgggaaggcttttaatcaacaatcacacctttcacgtcatcatagaattcatactggagagaaaccttagaaatgtgaagcatgtgacaaagtttccatttggaaatcacaccttaaagacataggagaatttatactggagagaaagcttacaaatgtaaggtttctgacaagacttgggagtgattcacacctggaacaacatactggacttcacactggagagaaaccttacaagtgtaatgagtgtggcaaagcctttggcaagcagtcaacacttattcaccatcaggcaattcatggtgtagggaaacttgactaatgtaatgattgtcacaaagtcttcagtaatgctacaacgattacaaatcattggagaatccataatgaagagagatcttacaagtgtaataaatgtggcaaatttttcagagatcgttcacatattgcaggtcatcggtgaactcatactggagagaaaccttacaaatgtcatgactgtgccaaggtcttcagtcaagcttcatcctatgcaaaacataggagaatttatacaggagagaaacctcacaagtgtgatgattgtggcaaagcctttgcttcacgttcacacgtcattagacatcagagaatctatactggacagaaatcttacaaatgtcatcagtgtggcaaggtcttcagtccaagatcactccatgcagaacatcagaaaattcatttttgagataaccgttcccaatgaaatgagtatagcaaaccatcaagcattaattgacattggagtcaattcagcattgacttgagtttgtgttgacttaacattgagttcaagcctttattgacattcaagtgtttatgttaagaggatggggccaggtgtggtggctccgacctgtaatcccagcacgtcgggaggccaaggcacataggtcacttgaggtcaggagtttgaaaccagcatggccaacagatgtgagccacttttctcagcctgttttttgtttcttattttctattatttttttgagccagtactttttaaagagatagtacttttttcagttagtactttttgaaagggatatatcatagtaatttttaaaagggatatgaggccaggcacggaggctcatgcctataatcccagcactttgggaggccgaggcaggcagatcacggggtcaggagatcgagactttcctggctaacagggtgaatccctgtctctactaaaaatacaaaaaattagctgggcatggtggctggcgcctgtagtcccagctactccagatgctgaggcaggagaatggcatgaacctgtgaggcggagcttgcagggagtcgagatcgcaccactgggctccagcctgggcgacagagtgagagtctatctcaaaaaaaaaaaaaaaaaaaaggatatcaaagcctcggtacgtggtggctcatccctgcaatcagagtactttggtcgacccatgtgaactggtcacctaaggtcacaatttcaaaagcaccctaacatggtgaaaccccatctctactaaaaatacaaaagttagccgggggtgttggtgtgcacctttagttccagctacttgggaggctggggcatgagaattgcttaaacctaggaggtagaagttgcagtgaaccaaaattgtgccactatactgcagcctgggtggcagagtgagtctccatctcaaacaaacaaaaaataacaaaaaaagacctcaaaaatgcttttcttctcgtataatggacttccttctttttctttctggttcctcttcatttctctctttattttttatttatttatttatttattttgcagtttgagtttgagataaatctaagttataaaagttgtatttcttaatacataatgacttctgaaagatgcctttgcagcatcctataatcagctcacatcattcgtttctgtacttgtatattttccagttattttccggttgaccccagaattcgttagatttttttaaaaaacaatttcaaaatagttgctgttttaaattagttgcatccagttcatatcaatgtctgcatgctttctagtctttgttatttattgaaaacctttggtacctaaacttaagtttgattgtttcagtgtgtacttggtaaatatgtcagtggccttttaactaaacatcaaaatgtactttaa

SEQ ID NO: 3392 - DNA, 4417 bp, Homo sapiens
agattaacgcaaacccggaagcggatcgggtggagtgtaggtcatatcgccgcgatatctcttccaaatgcttgatgaaaaaggtgggaggatcacttgagccagggagttgaaggctgcagtgagccctgtttttgccaccacactccagcttgggattgattcctaaagactcatgttacgtgaggaagcagctcagaagaggaaaggaaaggagccaggcatggctcttcctcagggacgcttgactttccgggatgtggctatagaattctcattggcagagtggaaatgcctgaacccttcacagagggctttgtacagggaagtgatgttggagaactacaggaacctggaggctgtggatatctcttccaaatgcatgatgaaggaggtcttgtcaacagggcaaggcaatacagaagtgatccacacagggacattgcaaagacatgaaagtcatcacattggagatttttgcttccaggaaattgagaaagaaattcatgacattgagtttcagtgtcaagaagatgaaagaaatggccttgaagcacccatgacaaaaataaaaaagttgactggtagcacagaccaacatgatcacaggcatgctggaaacaagcctattaaagatcagcttggatcaagcttttattcacatctgcctgaactccacatatttcagatcaaaggtgaaattggtaatcaacttgagaagtctactaatgatgctccctcagtttcaacattccaaagaatttcctgtaggccccaaacccagatttctaataactatgggaataatcccctgaattcttcattactcccacaaaaacaggaagtacacatgagagaaaaatctttccaatgtaataagagtggcaaagcctttaattgtagctcactcttaaggaaacaccagataccccatttaggagacaaacaatataaatgtgatgtatgtggcaagctctttaatcacgagcaataccttgcatgccatgatagatgtcacactgttgagaaaccttacaagtgtaaagagtgtggcaagaccttcagtcaggagtcatcccttacctgccatcgtagacttcatactggagtaaaacgttacaattgtaatgagtgtggcaagatctttggtcaaaattcagcccttctaattgataaggcaattgatactggagaaaatccttacaagtgtaatgaatgtgacaaggcttttaatcaacaatcacaactttcacatcatagaattcatactggagagaaaccttacaaatgtgaagaatgtgacaaagttttcagtcggaaatcaaccattgagacacataagagaattcatactggagagaaaccatacagatgtaaggtttgtgacacagctttcacgtggcattcacagctggctcgacatagaagaattcatactgcaaagaaaacttataaatgtaatgagtgtggcaagaccttcagtcacaagtcatcccttgtatgccatcatagacttcatggtggagagaaatcttacaaatgtaaggtttgtgacaaggcttttgtgtggagttcacaactggcaaaacatactagaattgactgtggagaaaaaccttacaagtgtaatgaatgtgggaagacctttggtcaaaattcagatcttttaattcataagtcaattcatactggggagcaaccttacaaatgtgatgaatgtgaaaaggttttcagtcgtaaatcaagccttgagacacataagataggtcatactggagagaaaccatacaaatgtaaggtttgtgacaaggcttttgcgtgtcattcctatctggcaaaacatactagaattcatagtggagagaaaccttacaagtgtaatgagtgcagcaagaccttcagtcacaggtcataccttgtatgccatcatagagttcatagtggtgagaaaccttacaagtgtaatgagtgcagcaagaccttcagtcgcaggtcatcccttcattgccatcgtagacttcatagtggtgagaaaccttacaagtgtaatgagtgtggcaataccttccgtcactgctcatcccttatataccatcgtagacttcatactggagagaaatcttacaaatgtacaatttgtgacaaggctttcgtgcgtaattcactcctgtcaagacataccagaattcacactgcagagaaaccttacaagtgtaatgaatgtgggaaggcttttaatcaacaatcacacctttcacgtcatcatagaattcatactggagagaaaccttagaaatgtgaagcatgtgacaaagtttccatttggaaatcacaccttaaagacataggagaatttatactggagagaaagcttacaaatgtaaggtttctgacaagacttgggagtgattcacacctggaacaacatactggacttcacactggagagaaaccttacaagtgtaatgagtgtggcaaagcctttggcaagcagtcaacacttattcaccatcaggcaattcatggtgtagggaaacttgactaatgtaatgattgtcacaaagtcttcagtaatgctacaacgattacaaatcattggagaatccataatgaagagagatcttacaagtgtaataaatgtggcaaatttttcagagatcgttcacatattgcaggtcatcggtgaactcatactggagagaaaccttacaaatgtcatgactgtgccaaggtcttcagtcaagcttcatcctatgcaaaacataggagaatttatacaggagagaaacctcacaagtgtgatgattgtggcaaagcctttgcttcacgttcacacgtcattagacatcagagaatctatactggacagaaatcttacaaatgtcatcagtgtggcaaggtcttcagtccaagatcactccatgcagaacatcagaaaattcatttttgagataaccgttcccaatgaaatgagtatagcaaaccatcaagcattaattgacattggagtcaattcagcattgacttgagtttgtgttgacttaacattgagttcaagcctttattgacattcaagtgtttatgttaagaggatggggccaggtgtggtggctccgacctgtaatcccagcacgtcgggaggccaaggcacataggtcacttgaggtcaggagtttgaaaccagcatggccaacagatgtgagccacttttctcagcctgttttttgtttcttattttctattatttttttgagccagtactttttaaagagatagtacttttttcagttagtactttttgaaagggatatatcatagtaatttttaaaagggatatgaggccaggcacggaggctcatgcctataatcccagcactttgggaggccgaggcaggcagatcacggggtcaggagatcgagactttcctggctaacagggtgaatccctgtctctactaaaaatacaaaaaattagctgggcatggtggctggcgcctgtagtcccagctactccagatgctgaggcaggagaatggcatgaacctgtgaggcggagcttgcagggagtcgagatcgcaccactgggctccagcctgggcgacagagtgagagtctatctcaaaaaaaaaaaaaaaaaaaaggatatcaaagcctcggtacgtggtggctcatccctgcaatcagagtactttggtcgacccatgtgaactggtcacctaaggtcacaatttcaaaagcaccctaacatggtgaaaccccatctctactaaaaatacaaaagttagccgggggtgttggtgtgcacctttagttccagctacttgggaggctggggcatgagaattgcttaaacctaggaggtagaagttgcagtgaaccaaaattgtgccactatactgcagcctgggtggcagagtgagtctccatctcaaacaaacaaaaaataacaaaaaaagacctcaaaaatgcttttcttctcgtataatggacttccttctttttctttctggttcctcttcatttctctctttattttttatttatttatttatttattttgcagtttgagtttgagataaatctaagttataaaagttgtatttcttaatacataatgacttctgaaagatgcctttgcagcatcctataatcagctcacatcattcgtttctgtacttgtatattttccagttattttccggttgaccccagaattcgttagatttttttaaaaaacaatttcaaaatagttgctgttttaaattagttgcatccagttcatatcaatgtctgcatgctttctagtctttgttatttattgaaaacctttggtacctaaacttaagtttgattgtttcagtgtgtacttggtaaatatgtcagtggccttttaactaaacatcaaaatgtactttaa

SEQ ID NO: 3393 - DNA, 4517 bp, Homo sapiens
agattaacgcaaacccggaagcggatcgggtggagtgtaggtcatatcgccgcgttgactagataacgaaggacaatgcatatatacaaaattgctgtattgcctggtgatatgcagctgtacctgtgacatcataattgcaccctccgacatgatatctcttccaaatgcttgatgaaaaaggtgggaggatcacttgagccagggagttgaaggctgcagtgagccctgtttttgccaccacactccagcttgggattgattcctaaagactcatgttacgtgaggaagcagctcagaagaggaaaggaaaggagccaggcatggctcttcctcagggacgcttgactttccgggatgtggctatagaattctcattggcagagtggaaatgcctgaacccttcacagagggctttgtacagggaagtgatgttggagaactacaggaacctggaggctgtggatatctcttccaaatgcatgatgaaggaggtcttgtcaacagggcaaggcaatacagaagtgatccacacagggacattgcaaagacatgaaagtcatcacattggagatttttgcttccaggaaattgagaaagaaattcatgacattgagtttcagtgtcaagaagatgaaagaaatggccttgaagcacccatgacaaaaataaaaaagttgactggtagcacagaccaacatgatcacaggcatgctggaaacaagcctattaaagatcagcttggatcaagcttttattcacatctgcctgaactccacatatttcagatcaaaggtgaaattggtaatcaacttgagaagtctactaatgatgctccctcagtttcaacattccaaagaatttcctgtaggccccaaacccagatttctaataactatgggaataatcccctgaattcttcattactcccacaaaaacaggaagtacacatgagagaaaaatctttccaatgtaataagagtggcaaagcctttaattgtagctcactcttaaggaaacaccagataccccatttaggagacaaacaatataaatgtgatgtatgtggcaagctctttaatcacgagcaataccttgcatgccatgatagatgtcacactgttgagaaaccttacaagtgtaaagagtgtggcaagaccttcagtcaggagtcatcccttacctgccatcgtagacttcatactggagtaaaacgttacaattgtaatgagtgtggcaagatctttggtcaaaattcagcccttctaattgataaggcaattgatactggagaaaatccttacaagtgtaatgaatgtgacaaggcttttaatcaacaatcacaactttcacatcatagaattcatactggagagaaaccttacaaatgtgaagaatgtgacaaagttttcagtcggaaatcaaccattgagacacataagagaattcatactggagagaaaccatacagatgtaaggtttgtgacacagctttcacgtggcattcacagctggctcgacatagaagaattcatactgcaaagaaaacttataaatgtaatgagtgtggcaagaccttcagtcacaagtcatcccttgtatgccatcatagacttcatggtggagagaaatcttacaaatgtaaggtttgtgacaaggcttttgtgtggagttcacaactggcaaaacatactagaattgactgtggagaaaaaccttacaagtgtaatgaatgtgggaagacctttggtcaaaattcagatcttttaattcataagtcaattcatactggggagcaaccttacaaatgtgatgaatgtgaaaaggttttcagtcgtaaatcaagccttgagacacataagataggtcatactggagagaaaccatacaaatgtaaggtttgtgacaaggcttttgcgtgtcattcctatctggcaaaacatactagaattcatagtggagagaaaccttacaagtgtaatgagtgcagcaagaccttcagtcacaggtcataccttgtatgccatcatagagttcatagtggtgagaaaccttacaagtgtaatgagtgcagcaagaccttcagtcgcaggtcatcccttcattgccatcgtagacttcatagtggtgagaaaccttacaagtgtaatgagtgtggcaataccttccgtcactgctcatcccttatataccatcgtagacttcatactggagagaaatcttacaaatgtacaatttgtgacaaggctttcgtgcgtaattcactcctgtcaagacataccagaattcacactgcagagaaaccttacaagtgtaatgaatgtgggaaggcttttaatcaacaatcacacctttcacgtcatcatagaattcatactggagagaaaccttagaaatgtgaagcatgtgacaaagtttccatttggaaatcacaccttaaagacataggagaatttatactggagagaaagcttacaaatgtaaggtttctgacaagacttgggagtgattcacacctggaacaacatactggacttcacactggagagaaaccttacaagtgtaatgagtgtggcaaagcctttggcaagcagtcaacacttattcaccatcaggcaattcatggtgtagggaaacttgactaatgtaatgattgtcacaaagtcttcagtaatgctacaacgattacaaatcattggagaatccataatgaagagagatcttacaagtgtaataaatgtggcaaatttttcagagatcgttcacatattgcaggtcatcggtgaactcatactggagagaaaccttacaaatgtcatgactgtgccaaggtcttcagtcaagcttcatcctatgcaaaacataggagaatttatacaggagagaaacctcacaagtgtgatgattgtggcaaagcctttgcttcacgttcacacgtcattagacatcagagaatctatactggacagaaatcttacaaatgtcatcagtgtggcaaggtcttcagtccaagatcactccatgcagaacatcagaaaattcatttttgagataaccgttcccaatgaaatgagtatagcaaaccatcaagcattaattgacattggagtcaattcagcattgacttgagtttgtgttgacttaacattgagttcaagcctttattgacattcaagtgtttatgttaagaggatggggccaggtgtggtggctccgacctgtaatcccagcacgtcgggaggccaaggcacataggtcacttgaggtcaggagtttgaaaccagcatggccaacagatgtgagccacttttctcagcctgttttttgtttcttattttctattatttttttgagccagtactttttaaagagatagtacttttttcagttagtactttttgaaagggatatatcatagtaatttttaaaagggatatgaggccaggcacggaggctcatgcctataatcccagcactttgggaggccgaggcaggcagatcacggggtcaggagatcgagactttcctggctaacagggtgaatccctgtctctactaaaaatacaaaaaattagctgggcatggtggctggcgcctgtagtcccagctactccagatgctgaggcaggagaatggcatgaacctgtgaggcggagcttgcagggagtcgagatcgcaccactgggctccagcctgggcgacagagtgagagtctatctcaaaaaaaaaaaaaaaaaaaaggatatcaaagcctcggtacgtggtggctcatccctgcaatcagagtactttggtcgacccatgtgaactggtcacctaaggtcacaatttcaaaagcaccctaacatggtgaaaccccatctctactaaaaatacaaaagttagccgggggtgttggtgtgcacctttagttccagctacttgggaggctggggcatgagaattgcttaaacctaggaggtagaagttgcagtgaaccaaaattgtgccactatactgcagcctgggtggcagagtgagtctccatctcaaacaaacaaaaaataacaaaaaaagacctcaaaaatgcttttcttctcgtataatggacttccttctttttctttctggttcctcttcatttctctctttattttttatttatttatttatttattttgcagtttgagtttgagataaatctaagttataaaagttgtatttcttaatacataatgacttctgaaagatgcctttgcagcatcctataatcagctcacatcattcgtttctgtacttgtatattttccagttattttccggttgaccccagaattcgttagatttttttaaaaaacaatttcaaaatagttgctgttttaaattagttgcatccagttcatatcaatgtctgcatgctttctagtctttgttatttattgaaaacctttggtacctaaacttaagtttgattgtttcagtgtgtacttggtaaatatgtcagtggccttttaactaaacatcaaaatgtactttaa

SEQ ID NO: 3394 - DNA, 2337 bp, Homo sapiens
ctcggccgccgtaggccggcttggaggctgggggagggcccagaagtggaataattcaggaaagtgcaggttctgggaagtctcggtgggttccccgcaaaatcagagatggcatctcactatgttgcccaggctgatcttgaactcctgacctcaagtgatcctctctccttggcctcctaaagtgctgggattccaggtgtgagccacttcacccagccacatttatccatcttgtaaaatattgctttgttttttggtgcatttcaaacccacaggtcctgacttcaggagcaagacacttcaagtgaggtgaggaggaggttccaggacctggataccatcctttgcagggatgtaattcaccagagaccaagatttctagccagaaattgagggcagctcaaggagagactacagacacagcatcctacttactggctatttcccagtaacaaaagaaaatgatcaagtcccaggaatcactgaccctggaggatgtggctgtggagttcacttgggaggagtggcagctcctcggccctgctcagaaggacctgtaccgagacgtgatgttggagaactatagcaacctcgtgtcagtggggtatcaagccagcaaaccagatgcactcttcaagttggaacaaggagagccatggacagtagaaaatgaaatccacagccaaatctgtccagaaatcaagaaagttgacaatcatctacagatgcactcacaaaagcaaagatgtctgaagagagtggaacaatgccataaacataatgcatttggaaacatcattcatcagaggaaaagtgattttcctttaaggcaaaatcatgatacatttgacttacatgggaaaatactgaaatcaaatttaagtttagtcaaccagaacaaaaggtatgaaatcaagaattctgtgggggttaatggagatgggaaatccttccttcatgccaagcatgaacaatttcataatgaaatgaacttccccgaaggtggaaattctgtgaatacaaattcacaattcattaagcatcagcgaactcaaaacatagataaaccccatgtatgcactgagtgtgggaaggctttcctcaagaagtctcgcctcatctatcatcagagagttcacactggggagaaacctcatggatgcagtatatgtgggaaagccttctccagaaagtccgggctcactgaacaccagagaaaccacacaggagagaaaccctatgaatgcactgaatgtgacaaagcattccgctggaaatcacagctcaatgcacaccagaaaattcatacaggagagaagtcatatatatgcagtgattgtggaaaaggcttcatcaagaagtctcggctcattaatcatcagagagttcatacaggagagaaaccacatggatgcagcctgtgtgggaaggccttctccaaaaggtccaggctcactgaacaccagagaactcatacaggagagaaaccctatgaatgcactgaatgtgacaaagcattccgctggaaatcacagctcaatgcacatcagaaagctcacacaggagagaagtcatatatatgccgtgattgtggaaaaggcttcattcagaagggaaatctcattgtacatcagcgaattcatactggagaaaaaccctatatatgcaatgaatgtggaaaaggcttcatccaaaagggcaacctccttattcatcgacgtactcacactggagagaaaccctatgtatgcaatgaatgtgggaaaggcttcagccagaagacatgtttaatatcccatcagagatttcacacaggaaagacaccctttgtatgtactgagtgtggaaaatcctgctcacacaagtcaggtctcattaaccaccagagaattcacacaggagagaaaccctatacatgcagtgactgtgggaaagctttcagagataaatcatgtctcaacagacatcggagaactcatacaggggagagaccgtatggatgctctgattgtgggaaagctttctcccacttgtcatgccttgtttatcataagggaatgctgcatgcaagagagaaatgtgtaggttcagtcaaattggaaaatccttgctcagagagtcatagcttatcacatacacgtgatctcatacaggataaagactctgttaacatggtgactctgcagatgccttctgtggcagctcagacctcattaactaacagtgcgttccaagcagagagcaaagtagccattgtgagccagcctgttgccagaagttcagtctcagcagatagtagaatttgcacagaataaaaaccatatgaatgcagtg

SEQ ID NO: 3395 - DNA, 2229 bp, Homo sapiens
ctcggccgccgtaggccggcttggaggctgggggagggcccagaagtggaataattcaggaaagtgcaggttctgggaagtctcggtgggttccccgcaaaatcaggcttgagtgcagtggcgcaatcgtggctcactgcagcctccatctcccggggctcaggtgattttcccacctcagctttcccgagtagctgggactacagagatggcatctcactatgttgcccaggctgatcttgaactcctgacctcaagtgatcctctctccttggcctcctaaagtgctgggattccaggtgtgagccacttcacccagccacatttatccatcttgtaaaatattgctttgttttttggtgcatttcaaagaatcactgaccctggaggatgtggctgtggagttcacttgggaggagtggcagctcctcggccctgctcagaaggacctgtaccgagacgtgatgttggagaactatagcaacctcgtgtcagtggggtatcaagccagcaaaccagatgcactcttcaagttggaacaaggagagccatggacagtagaaaatgaaatccacagccaaatctgtccagaaatcaagaaagttgacaatcatctacagatgcactcacaaaagcaaagatgtctgaagagagtggaacaatgccataaacataatgcatttggaaacatcattcatcagaggaaaagtgattttcctttaaggcaaaatcatgatacatttgacttacatgggaaaatactgaaatcaaatttaagtttagtcaaccagaacaaaaggtatgaaatcaagaattctgtgggggttaatggagatgggaaatccttccttcatgccaagcatgaacaatttcataatgaaatgaacttccccgaaggtggaaattctgtgaatacaaattcacaattcattaagcatcagcgaactcaaaacatagataaaccccatgtatgcactgagtgtgggaaggctttcctcaagaagtctcgcctcatctatcatcagagagttcacactggggagaaacctcatggatgcagtatatgtgggaaagccttctccagaaagtccgggctcactgaacaccagagaaaccacacaggagagaaaccctatgaatgcactgaatgtgacaaagcattccgctggaaatcacagctcaatgcacaccagaaaattcatacaggagagaagtcatatatatgcagtgattgtggaaaaggcttcatcaagaagtctcggctcattaatcatcagagagttcatacaggagagaaaccacatggatgcagcctgtgtgggaaggccttctccaaaaggtccaggctcactgaacaccagagaactcatacaggagagaaaccctatgaatgcactgaatgtgacaaagcattccgctggaaatcacagctcaatgcacatcagaaagctcacacaggagagaagtcatatatatgccgtgattgtggaaaaggcttcattcagaagggaaatctcattgtacatcagcgaattcatactggagaaaaaccctatatatgcaatgaatgtggaaaaggcttcatccaaaagggcaacctccttattcatcgacgtactcacactggagagaaaccctatgtatgcaatgaatgtgggaaaggcttcagccagaagacatgtttaatatcccatcagagatttcacacaggaaagacaccctttgtatgtactgagtgtggaaaatcctgctcacacaagtcaggtctcattaaccaccagagaattcacacaggagagaaaccctatacatgcagtgactgtgggaaagctttcagagataaatcatgtctcaacagacatcggagaactcatacaggggagagaccgtatggatgctctgattgtgggaaagctttctcccacttgtcatgccttgtttatcataagggaatgctgcatgcaagagagaaatgtgtaggttcagtcaaattggaaaatccttgctcagagagtcatagcttatcacatacacgtgatctcatacaggataaagactctgttaacatggtgactctgcagatgccttctgtggcagctcagacctcattaactaacagtgcgttccaagcagagagcaaagtagccattgtgagccagcctgttgccagaagttcagtctcagcagatagtagaatttgcacagaataaaaaccatatgaatgcagtg

SEQ ID NO: 3396 - DNA, 930 bp, Homo sapiens
aaaaggtccaggctcactgaacaccagagaactcatacaggagagaaaccctatgaatgcactgaatgtgacaaagcattccgctggaaatcacagctcaatgcacatcagaaagctcacacaggagagaagtcatatatatgccgtgattgtggaaaaggcttcattcagaagggaaatctcattgtacatcagcgaattcatactggagaaaaaccctatatatgcaatgaatgtggaaaaggcttcatccaaaagggcaacctccttattcatcgacgtactcacactggagagaaaccctatgtatgcaatgaatgtgggaaaggcttcagccagaagacatgtttaatatcccatcagagatttcacacaggaaagacaccctttgtatgtactgagtgtggaaaatcctgctcacacaagtcaggtctcattaaccaccagagaattcacacaggagagaaaccctatacatgcagtgactgtgggaaagctttcagagataaatcatgtctcaacagacatcggagaactcatacaggggagagaccgtatggatgctctgattgtgggaaagctttctcccacttgtcatgccttgtttatcataagggaatgctgcatgcaagagagaaatgtgtaggttcagtcaaattggaaaatccttgctcagagagtcatagcttatcacatacacgtgatctcatacaggataaagactctgttaacatggtgactctgcagatgccttctgtggcagctcagacctcattaactaacagtgcgttccaagcagagagcaaagtagccattgtgagccagcctgttgccagaagttcagtctcagcagatagtagatttgcacagaataaaaaccatatgaatgcagtgaatgtggtagtgctttcagtgatcaattacatcata

SEQ ID NO: 3397 - DNA, 4676 bp, Homo sapiens
atagagcggcgcccgcagtctgaactcgcgatcccgggcaggctccgtggtcctcgcctcgcttcacggtctttaccgctcagcttcccggagtccgcgcaggagcgcgtctgaataggaagcgttttcggacgtggatgcggcgttttgtcgctgccagtggtgtctggagaggttcgggctcggtcctcaggtcctggctcccagaagcaaaataactcaagtgaagcaatgaaggaagaagaaggaggttgctggccttggatatcataatttctggggacaactttaagtggacactaatatttctgactaggaaaacttcaaaaacttcatggcaaatgcagaagagacaaagacgtatagtccatgttatccactattttctgagcacagaagaaaatgatcaagacccaggaatcactgaccctggaggatgtggctgtggaattcagctgggaggagtggcagctcctggacactgctcagaagaacctgtaccgggatgtgatggtggagaactataaccacctagtatcactggggtatcaaactagcaaaccagatgtactctccaagttggcacatggacaagaaccatggacaacagatgctaaaattcagaataaaaattgtccaggaatcgggaaagttgacagtcatctgcaagagcactctccaaaccaaagacttctgaagagcgtgcagcaatgcaatggacagaatacacttagaaatattgtacatctcagcaagacacattttcctatagtgcaaaatcatgatacatttgacttgtacagaaaaaatttgaaatcaagtttaagtttaatcaaccagaagagaagacatggaataaataaccctgttgagtttattggaggtgagaaaacacttctacatggtaagcatgaacgtacgcatactaaaactagattttctgaaaatgcaaaatgtatccatactaaattccaagtcttcaagcatcagaggactcagaaaattgagaaaccccatgcatgcattgaatgtgagcaaaccttccttaggaagtctcagctcatttaccatgagaacatttgtatacaagagaatcctggaagtggtcaatgtgagaaattatccagaagtgtcctgttcactaagcatctgaaaactaatacaacagacaaaatctgtatacccaatgaatatagaaaaggctctactgtgaagagtagtctcattacacatcaacaaacccatacagaagagaaatcctatatgtgcagtgagtgtggaaagggctttacaatgaagcgctatctaattgctcatcagcgaactcatagtggagagaaaccttatgtgtgcaaagaatgtggaaaaggtttcactgtgaagagcaatctcattgtacatcagcgaactcatacaggggagaaaccctatatatgcagtgaatgtggaaaaggcttcaccatgaagcgctatcttgttgtacatcagcgaactcatactggagagaaaccctatatgtgcagtgaatgtggaaaaggctttaccgtgaagagcaatctcattgtacatcagcgctcccacacaggagaaaaatcttacatatgcagcgaatgtggaaaaggcttcactgtcaaacgcactctcgttatacatcagcgaactcatacaggagagaaatcttacatatgcaatgaatgtggtaaaggcttcaccacaaagcgcactcttattatacatcagcgaactcatacaggagaaaaaccctatgaatgcaatgaatgtggtaaagccttcagccagaaaatatgcctcatacaacatgagagatgtcatacaggaaagactccctttgtatgtaccgagtgcggaaaatcctattcacacaaatatggcctcattacccatcagagaattcacacaggagagaaaccttatgagtgcaatgaatgtggaaaagccttcaccacaaagtcagtactcaatgtacatcaaagaacgcatacaggagagaggccgtatggatgcagtgattgtgagaaagccttctcccacttatcaaaccttgtcaaacataagaaaatgcacacaagagaaatgggtagaatcagtcaagttgaaaactcctgtaatggagagtcacagctccttccttataagtgaactcatgcagaagaaaaccctactagtgccgtgactatggaaatgccttttgtggcaactcagacttcattaaacatcagtgtgtttctagccaattggaacataaacatggtgctgcctgttgacagatgtgtgtctgtcctcaggaggtgaaataatttgccctagagatcaatttgatgaatacagtaaataaggtagtgcctttagtggtcttttacctcatattttctgtcaatgaaaatacgttgaataaactatattaatgtggagatgttttgagcaataatttctgctcatatgtctgaaaagtatacagagataaattctgtgaatacaaagactaagaaaagtcttctgtggaaagatagactttattatcaggtttcatcatagatttcaacgtaagtgagcttattgttgatagaaacatgatgaccatgacaaagtctttactcagaaatatgacctcagtgagtgtcaaagtttacactggaaaataactttaaggtgacagtattgatggcaggatttcagcgacgcactctgcttcatcatttgtcaggagatcacatagaaagtaaaattgttccgaacatgctatcaaataaatgtggaacacctttagcaaactatcaacagctcatgaaggcatgaaatgtggtgaaaatgatgaatatttgagtgctttttcttaataagtataaccttaaacatcagctaatacacctggtgtgcattttcagtcaggataccttaatcctcatttctagttgccttgccaatgattccataatatactgtctcattactgtttatttttactgttgtgtaaaattgtggtataatgagaaatacatttggtctttgttcctggttcctggcatagagctcctaaaacgcttagaatttcatgagtgataagagttttttggttttgttttgtttttgctgttgttgttattcatagcactgcccttttaattacacctgattatactactgaagtgacttatggttgctcccctagacagcctcagaatggggctgttctctaggaagatcaagtaactagaggatggagactttgtgccccatttctcccacctcctggaaggggaggggtgctggagattagattagacaatgagattaagagaactccaaatagcccaagagggtggtgcacccccaacttcataggggtagaggctcctgagattaggagaaccctttttaggctttactctatgtacctcttcatttgagtgttcatttgcgtcctttataaccagtaaaacaaagtacgctgttttcttgagttttgtgagccctgtagcaaattatcaaacctgagtagggcagtgggaactcggaatttatcaccattcagaactgcaggttgtccttgtgagtggcatctgatgtgggggaagtcttggactgagccccttaacttgtggagtctgcactaatttagactgcactaactaacttgcactgcactaacttggactgcactaacttgtggagtctgcactaacttggagaagttagtgtcagaattgaattatagaacacccagttgttcagaattgaattgtagaacacccaattggtgtgggagaattagagaatttatttgtgtcagaaaatactccagaacaaccaccccatattatgattagctcttttcctttctttggctctgagcttaattgtacattaagcaaacttaagtagaaaagaaactgaatatgttaaatatattaacaacatatttggacttgcttaactaagattatagagatgatcagtttataaaaccaccttcaacttaaataaatttgaactcgaaattgcaaaagcagtctagaggctttgctagtatccttcaaccaatttctagtaaaaatatcctatataaccataattatcaaaaccagaaaaacaacattggtaggatactataaagtactaatcttattttggatttgacgaatttttacatgtttttttcttttttagtttgtactctaagaagttgtattacatgtacagattcgtgtaaccactgcaaccacataaaactaatgaacacaaagtccctcatgctacctttttatgcttacactccatccaaacctaactctgccaaccacttttctcctatcagtataatttcatcatttcatgaatatgataaaaataaaattgtttttgtaaatggtttttataaattttatataaataagttatatgaatttttattgatagagagtatgtaagcttttggcatttttgtcactcagcaaattactcctaaggtttatatgagttgatgaatagttgttttattatttttttttaccaccatgtatctaaccagatgaaagttgtttatatttgagagtagtatacatatttgatgtagtagtttatccattcacctatgagatatatttgcactgttttcctggttttaagtgctataaataaagatgctgtgaaatcta

SEQ ID NO: 3398 - DNA, 1290 bp, Homo sapiens
ctcagcttcccggagtccgcgcaggagcgcgtctgaataggaagcgttttcggacgtggatgcggcgttttgtcgctgccagtggtgtctggagaggttcgggctcggtcctcaggtcctggctcccagaagcaaaataactcaagtgaagcaatgaaggaagaagaaggaggttgctggccttggatatcataatttctggggacaactttaagtggacactaatatttctgactaggaaaacttcaaaaacttcatggcaaatgcagaagagacaaagacgtatagtccatgttatccactattttctgagcacagaagaaaatgatcaagacccaggaatcactgaccctggaggatgtggctgtggaattcagctgggaggagtggcagctcctggacactgctcagaagaacctgtaccgggatgtgatggtggagaactataaccacctagtatcactggggtatcaaactagcaaaccagatgtactctccaagttggcacatggacaagaaccatggacaacagatgctaaaattcagaataaaaattgtccaggaatcgggaaagttgacagtcatctgcaagagcactctccaaaccaaagacttctgaagagcgtgcagcaatgcaatggacagaatacacttagaaatattgtacatctcagcaagacacattttcctatagtgcaaaatcatgatacatttgacttgtacagaaaaaatttgaaatcaagtttaagtttaatcaaccagaagagaagacatggaataaataaccctgttgagtttattggagagacagggtctcttgagaggccgaggcaggcggatcacttgaggtcagaagttcaagaccagcctggccaacgtggcgaaaccctgtgtctactaaaaatacacacaaaaaattagctgggtatggtgctgggctgttgggagccgaaggcccatgggatgtgaccaactcagcattccactggaggctatatgatcaaacagcaaactttatcatgaatgcacgatgtgggcaaactcatgactgcttccgctgccagaaggtttgctgagggcaatcgcttcctggtgctgagctccttgaggttatctactgggacatctagagaatgccatcttgcaaaccctactctggactgagtagctgaccccttcttccacccgccttctcactatctcttttgcctaataaatatggagggctgtgtaaagctcagggcccttgtccactagaggcaaggtgtcccctgatcccttcttccaaat

SEQ ID NO: 3399 - DNA, 3611 bp, Homo sapiens
atgaccgcacaggaatccctaacactggaggatgtggctgtggacttcacctgggaggagtggcagttcctgagccctgctcagaaggacctgtaccgggacgtgatgttggagaactacagcaacctggtggcagtggggtatcaagccagcaaaccagatgcactctccaaattggaacgaggagaagaaacttgcacaacagaagatgaaatctactctcgaatctgttctgattcaggaggtgcatcaggaggtgcatatgcagaaatcaggaaaattgatgatcctctgcagcatcacttgcaaaatcaaagtattcagaagagtgtgaaacagtgccatgaacagaatatgtttggaaatattgttaatcagaacaaaggtcatttcctgctgaagcaagattgtgatacgtttgacttacatgaaaaacctttaaaatcaaatttaagttttgaaaaccagaaaaggagctctggcctaaagaactctgctgagtttaatagagatgggaaatccctttttcatgctaaccataaacaattttatactgaaatgaagtttcctgcaattgcaaaacctattaataagtcccagttcattaagcaacagagaactcacaacatagagaatgcccatgtatgcagtgaatgtgggaaagccttcctcaagttgtctcagtttattgatcatcagagagttcacactggagaaaaacctcatgtatgcagtatgtgtgggaaagctttctccagaaaatccagactaatggaccatcagagaactcatacagaactgaaacattatgaatgcactgaatgtgacaaaaccttcctcaagaaatcacagctcaatatacatcagaaaactcatatgggagggaaaccttacacatgtagccaatgtgggaaagccttcatcaagaagtgtcggctcatttatcatcaacgaactcatacaggagagaaaccccatggatgcagtgtatgtgggaaggccttctctacaaagttcagtctcactacacatcagaaaactcatacaggagaaaaaccttatatatgtagtgaatgtggaaaaggcttcattgagaagaggcgtcttactgcacatcatcgaactcatactggtgagaaaccctttatatgcaataaatgtgggaaaggcttcaccttgaagaacagtcttatcacacatcagcaaactcatacaggagagaaattatatacatgtagtgaatgtggaaaaggcttttcaatgaagcactgtctcatggtacatcaacgaactcatactggagagaaaccttataaatgcaatgagtgtggaaagggcttcgctttgaagagcccactcatcagacatcagcgaacacatactggagagaaaccctatgtatgcaccgaatgtcgaaaaggtttcaccatgaagagtgacctcattgtacatcagcgaactcatactgcagagaagccatatatatgcaatgattgtggaaaaggcttcactgtgaagagccgccttattgtgcatcagcgaactcatactggagaaaaaccctatgtatgtggtgagtgtggaaaaggctttccagcaaagatccggctaatgggacatcaacgaactcatacaggagagaaaccttatatttgcaatgagtgtggaaaaggcttcactgagaagagtcatctcaatgtacatcggcgcactcatacaggagagaaaccctatgtatgcagtgaatgtggcaaaggcttaactgggaaaagcatgctcattgcacatcagcgaactcatactggggagaaaccttatatatgcaatgaatgtggaaagggcttcaccatgaagagtactctcagtatacatcagcaaactcatactggagagaagccatacaaatgcaatgaatgtgataaaaccttcaggaagaagacatgcctcatacaacatcagcgatttcacacaggaaagacttcctttgcatgtactgaatgtggaaaattctctttgcgcaaaaatgatcttattacacatcagagaattcacacaggagagaaaccgtacaaatgcagtgactgcgggaaagccttcactacaaaatcagggctcaatgttcatcaaagaaaacatacaggagagaggccctatggatgtagtgattgtgggaaagcttttgcgcacttgtctatccttgttaaacacaggagaattcacaggtagtcattttgggaaagcctcttgccagatgtaggcccttaagatatctgcaaagaagagtaatttcatgaatgcagactacatggttgtttatttagtgatcagttacttcatgttttgtgtcagagaaaacatgtacaaaacatttgagaaaatattttaggacattatgtctaaaaattgtatactgagaaaaatcctatgaatgtggcagactataaaagcctttggtgggaagataaaccccctcagaagtgatcatagatcatgaataaactactaattcgtggaaatgtaataattataggaacgtctttgcccaaaaataaaacttcaacagattgagagagttcacactggagaaatactttcctctggcaaacccctgtggcagggttttcagtaaaatgttttgcctcatcgtgtgctaggaaataatgcagaaaaaacttatgaaaacattcaatgtagaagacttttaggaaaatatcagagaatttaatgaaggaaagaagccttggcaaaatgatggatgagagctttctgtcacaattctaaccttaacagataatatgcctcatgtgcatttgggaacaggatagcttgagccatattcctagttgccttgtcactgattttatacattttaaattgtgacttcctctaatcacgaactaaaatttaatattgtatataataccggagtattttatgcctgcctcattttattatatgattagctcctgcatttctttggttctaagtttgtgttatttcagaataactaaagtacttcagaatgaaactggatacagtatattcagttcataagtgtaattgaccatacttgaatatgtttaagtttataagtaacatcaggtgttatgaaattaatataaataagatgtttttgtaagtttttattttgaaataagtttagattcacaaaatcttaccaaaatattccagagttcttgcccttaacccagcttcttccaaagataacaacttacataagcatagttcattaccaaatacaggaaagtgaaattgttacaatactgttaactacagaatttatttggaaatcaccagttttaacatgcatgcatttttgtttgttttttatatgtagctttaagaaatcttaacacatatattgattcatgtcaccaccaccgtaatcgagattcagaatgttgcatcaatgcaaactccctcatgctccttgtttatagtcacaacctctcctcagccctaacccttggcaatcagaaatcttttcatctttagttttgtcattagtagcatgttataaaaatggaatcatacagcatgtacccttttggtattggctatttcaactaaagcagattaacctgaaatcc

SEQ ID NO: 3400 - DNA, 4033 bp, Homo sapiens
ggatagtcgccgtcaggcactgaggaggccgagagatgaggccggagcccaccaagttctgggaagttctttctgacacaagtaagataacatctctgccatgcccacaggtgctgagaacaagagaaatcaagtgaaggaaggaggcggagtttccaagacttgggtgtcatcatttctggggacatccttgattggagattgaagtttttgaaccgaaatttagagctgattcagaagagacaaatacagaacgtccaagttagcagtcatttcccaaatttaggagacaatgatgcaggcccaggaatccctaacactggaggatgtggctgtggacttcacctgggaggagtggcagttcctgagccctgctcagaaggacctgtaccgggacgtgatgttggagaactacagcaacctggtggcagtggggtatcaagccagcaaaccagatgcactctccaaattggaacgaggagaagaaacttgcacaacagaagatgaaatctactctcgaatctgttctgaaatcaggaaaattgatgatcctctgcagcatcacttgcaaaatcaaagtattcagaagagtgtgaaacagtgccatgaacagaatatgtttggaaatattgttaatcagaacaaaggtcatttcctgctgaagcaagattgtgatacgtttgacttacatgaaaaacctttaaaatcaaatttaagttttgaaaaccagaaaaggagctctggcctaaagaactctgctgagtttaatagagatgggaaatccctttttcatgctaaccataaacaattttatactgaaatgaagtttcctgcaattgcaaaacctattaataagtcccagttcattaagcaacagagaactcacaacatagagaatgcccatgtatgcagtgaatgtgggaaagccttcctcaagttgtctcagtttattgatcatcagagagttcacactggagaaaaacctcatgtatgcagtatgtgtgggaaagctttctccagaaaatccagactaatggaccatcagagaactcatacagaactgaaacattatgaatgcactgaatgtgacaaaaccttcctcaagaaatcacagctcaatatacatcagaaaactcatatgggagggaaaccttacacatgtagccaatgtgggaaagccttcatcaagaagtgtcggctcatttatcatcaacgaactcatacaggagagaaaccccatggatgcagtgtatgtgggaaggccttctctacaaagttcagtctcactacacatcagaaaactcatacaggagaaaaaccttatatatgtagtgaatgtggaaaaggcttcattgagaagaggcgtcttactgcacatcatcgaactcatactggtgagaaaccctttatatgcaataaatgtgggaaaggcttcaccttgaagaacagtcttatcacacatcagcaaactcatacaggagagaaattatatacatgtagtgaatgtggaaaaggcttttcaatgaagcactgtctcatggtacatcaacgaactcatactggagagaaaccttataaatgcaatgagtgtggaaagggcttcgctttgaagagcccactcatcagacatcagcgaacacatactggagagaaaccctatgtatgcaccgaatgtcgaaaaggtttcaccatgaagagtgacctcattgtacatcagcgaactcatactgcagagaagccatatatatgcaatgattgtggaaaaggcttcactgtgaagagccgccttattgtgcatcagcgaactcatactggagaaaaaccctatgtatgtggtgagtgtggaaaaggctttccagcaaagatccggctaatgggacatcaacgaactcatacaggagagaaaccttatatttgcaatgagtgtggaaaaggcttcactgagaagagtcatctcaatgtacatcggcgcactcatacaggagagaaaccctatgtatgcagtgaatgtggcaaaggcttaactgggaaaagcatgctcattgcacatcagcgaactcatactggggagaaaccttatatatgcaatgaatgtggaaagggcttcaccatgaagagtactctcagtatacatcagcaaactcatactggagagaagccatacaaatgcaatgaatgtgataaaaccttcaggaagaagacatgcctcatacaacatcagcgatttcacacaggaaagacttcctttgcatgtactgaatgtggaaaattctctttgcgcaaaaatgatcttattacacatcagagaattcacacaggagagaaaccgtacaaatgcagtgactgcgggaaagccttcactacaaaatcagggctcaatgttcatcaaagaaaacatacaggagagaggccctatggatgtagtgattgtgggaaagcttttgcgcacttgtctatccttgttaaacacaggagaattcacaggtagtcattttgggaaagcctcttgccagatgtaggcccttaagatatctgcaaagaagagtaatttcatgaatgcagactacatggttgtttatttagtgatcagttacttcatgttttgtgtcagagaaaacatgtacaaaacatttgagaaaatattttaggacattatgtctaaaaattgtatactgagaaaaatcctatgaatgtggcagactataaaagcctttggtgggaagataaaccccctcagaagtgatcatagatcatgaataaactactaattcgtggaaatgtaataattataggaacgtctttgcccaaaaataaaacttcaacagattgagagagttcacactggagaaatactttcctctggcaaacccctgtggcagggttttcagtaaaatgttttgcctcatcgtgtgctaggaaataatgcagaaaaaacttatgaaaacattcaatgtagaagacttttaggaaaatatcagagaatttaatgaaggaaagaagccttggcaaaatgatggatgagagctttctgtcacaattctaaccttaacagataatatgcctcatgtgcatttgggaacaggatagcttgagccatattcctagttgccttgtcactgattttatacattttaaattgtgacttcctctaatcacgaactaaaatttaatattgtatataataccggagtattttatgcctgcctcattttattatatgattagctcctgcatttctttggttctaagtttgtgttatttcagaataactaaagtacttcagaatgaaactggatacagtatattcagttcataagtgtaattgaccatacttgaatatgtttaagtttataagtaacatcaggtgttatgaaattaatataaataagatgtttttgtaagtttttattttgaaataagtttagattcacaaaatcttaccaaaatattccagagttcttgcccttaacccagcttcttccaaagataacaacttacataagcatagttcattaccaaatacaggaaagtgaaattgttacaatactgttaactacagaatttatttggaaatcaccagttttaacatgcatgcatttttgtttgttttttatatgtagctttaagaaatcttaacacatatattgattcatgtcaccaccaccgtaatcgagattcagaatgttgcatcaatgcaaactccctcatgctccttgtttatagtcacaacctctcctcagccctaacccttggcaatcagaaatcttttcatctttagttttgtcattagtagcatgttataaaaatggaatcatacagcatgtacccttttggtattggctatttcaactaaagcagattaacctgaaatccatccaagttgttctgcatatcattgttctgtttttattggccactaataatctatgatacgaatataccactatttgtttattcacccactgaaggacattagttttgttcccggtttttcttactgttacaaataaaaatcctatgaacatttgtacac

SEQ ID NO: 3401 - DNA, 2058 bp, Homo sapiens
atgaccgcacaggaatccctaacactggaggatgtggctgtggacttcacctgggaggagtggcagttcctgagccctgctcagaaggacctgtaccgggacgtgatgttggagaactacagcaacctggtggcagtggggtatcaagccagcaaaccagatgcactctccaaattggaacgaggagaagaaacttgcacaacagaagatgaaatctactctcgaatctgttctgattcaggaggtgcatcaggaggtgcatatgcagaaatcaggaaaattgatgatcctctgcagcatcacttgcaaaatcaaagtattcagaagagtgtgaaacagtgccatgaacagaatatgtttggaaatattgttaatcagaacaaaggtcatttcctgctgaagcaagattgtgatacgtttgacttacatgaaaaacctttaaaatcaaatttaagttttgaaaaccagaaaaggagctctggcctaaagaactctgctgagtttaatagagatgggaaatccctttttcatgctaaccataaacaattttatactgaaatgaagtttcctgcaattgcaaaacctattaataagtcccagttcattaagcaacagagaactcacaacatagagaatgcccatgtatgcagtgaatgtgggaaagccttcctcaagttgtctcagtttattgatcatcagagagttcacactggagaaaaacctcatgtatgcagtatgtgtgggaaagctttctccagaaaatccagactaatggaccatcagagaactcatacagaactgaaacattatgaatgcactgaatgtgacaaaaccttcctcaagaaatcacagctcaatatacatcagaaaactcatatgggagggaaaccttacacatgtagccaatgtgggaaagccttcatcaagaagtgtcggctcatttatcatcaacgaactcatacaggagagaaaccccatggatgcagtgtatgtgggaaggccttctctacaaagttcagtctcactacacatcagaaaactcatacaggagaaaaaccttatatatgtagtgaatgtggaaaaggcttcattgagaagaggcgtcttactgcacatcatcgaactcatactggtgagaaaccctttatatgcaataaatgtgggaaaggcttcaccttgaagaacagtcttatcacacatcagcaaactcatacaggagagaaattatatacatgtagtgaatgtggaaaaggcttttcaatgaagcactgtctcatggtacatcaacgaactcatactggagagaaaccttataaatgcaatgagtgtggaaagggcttcgctttgaagagcccactcatcagacatcagcgaacacatactggagagaaaccctatgtatgcaccgaatgtcgaaaaggtttcaccatgaagagtgacctcattgtacatcagcgaactcatactgcagagaagccatatatatgcaatgattgtggaaaaggcttcactgtgaagagccgccttattgtgcatcagcgaactcatactggagaaaaaccctatgtatgtggtgagtgtggaaaaggctttccagcaaagatccggctaatgggacatcaacgaactcatactggggagaaaccttatatatgcaatgaatgtggaaagggcttcaccatgaagagtactctcagtatacatcagcaaactcatactggagagaagccatacaaatgcaatgaatgtgataaaaccttcaggaagaagacatgcctcatacaacatcagcgatttcacacaggaaagacttcctttgcatgtactgaatgtggaaaattctctttgcgcaaaaatgatcttattacacatcagagaattcacacaggagagaaaccgtacaaatgcagtgactgcgggaaagccttcactacaaaatcagggctcaatgttcatcaaagaaaacatacaggagagaggccctatggatgtagtgattgtgggaaagcttttgcgcacttgtctatccttgttaaacacaggagaattcacaggtag

SEQ ID NO: 3402 - DNA, 2698 bp, Homo sapiens
aaacgctgggaacgcctccgaccctggatagtcgccgtcaggcactgaggaggccgagagatgaggccggagcccaccaagttctgggaagaatccctaacactggaggatgtggctgtggacttcacctgggaggagtggcagttcctgagccctgctcagaaggacctgtaccgggacgtgatgttggagaactacagcaacctggtggcagtggggtatcaagccagcaaaccagatgcactctccaaattggaacgaggagaagaaacttgcacaacagaagatgaaatctactctcgaatctgttctgaaatcaggaaaattgatgatcctctgcagcatcacttgcaaaatcaaagtattcagaagagtgtgaaacagtgccatgaacagaatatgtttggaaatattgttaatcagaacaaaggtcatttcctgctgaagcaagattgtgatacgtttgacttacatgaaaaacctttaaaatcaaatttaagttttgaaaaccagaaaaggagctctggcctaaagaactctgctgagtttaatagagatgggaaatccctttttcatgctaaccataaacaattttatactgaaatgaagtttcctgcaattgcaaaacctattaataagtcccagttcattaagcaacagagaactcacaacatagagaatgcccatgtatgcagtgaatgtgggaaagccttcctcaagttgtctcagtttattgatcatcagagagttcacactggagaaaaacctcatgtatgcagtatgtgtgggaaagctttctccagaaaatccagactaatggaccatcagagaactcatacagaactgaaacattatgaatgcactgaatgtgacaaaaccttcctcaagaaatcacagctcaatatacatcagaaaactcatatgggagggaaaccttacacatgtagccaatgtgggaaagccttcatcaagaagtgtcggctcatttatcatcaacgaactcatacaggagagaaaccccatggatgcagtgtatgtgggaaggccttctctacaaagttcagtctcactacacatcagaaaactcatacaggagaaaaaccttatatatgtagtgaatgtggaaaaggcttcattgagaagaggcgtcttactgcacatcatcgaactcatactggtgagaaaccctttatatgcaataaatgtgggaaaggcttcaccttgaagaacagtcttatcacacatcagcaaactcatacaggagagaaattatatacatgtagtgaatgtggaaaaggcttttcaatgaagcactgtctcatggtacatcaacgaactcatactggagagaaaccttataaatgcaatgagtgtggaaagggcttcgctttgaagagcccactcatcagacatcagcgaacacatactggagagaaaccctatgtatgcaccgaatgtcgaaaaggtttcaccatgaagagtgacctcattgtacatcagcgaactcatactgcagagaagccatatatatgcaatgattgtggaaaaggcttcactgtgaagagccgccttattgtgcatcagcgaactcatactggagaaaaaccctatgtatgtggtgagtgtggaaaaggctttccagcaaagatccggctaatgggacatcaacgaactcatacaggagagaaaccttatatttgcaatgagtgtggaaaaggcttcactgagaagagtcatctcaatgtacatcggcgcactcatacaggagagaaaccctatgtatgcagtgaatgtggcaaaggcttaactgggaaaagcatgctcattgcacatcagcgaactcatactggggagaaaccttatatatgcaatgaatgtggaaagggcttcaccatgaagagtactctcagtatacatcagcaaactcatactggagagaagccatacaaatgcaatgaatgtgataaaaccttcaggaagaagacatgcctcatacaacatcagcgatttcacacaggaaagacttcctttgcatgtactgaatgtggaaaattctctttgcgcaaaaatgatcttattacacatcagagaattcacacaggagagaaaccgtacaaatgcagtgactgcgggaaagccttcactacaaaatcagggctcaatgttcatcaaagaaaacatacaggagagaggccctatggatgtagtgattgtgggaaagcttttgcgcacttgtctatccttgttaaacacaggagaattcacaggtagtcattttgggaaagcctcttgccagatgtaggcccttaagatatctgcaaagaagagtaatttcatgaatgcagactacatggttgtttatttagtgatcagttacttcatgttttgtgtcagagaaaacatgtacaaaacatttgagaaaatattttaggacattatgtctaaaaattgtatactgagaaaaatcctatgaatgtggcagactataaaagcctttggtgggaagataaaccccctcagaagtgatcatagatcatgaataaactactaattcgtggaaatgtaataattataggaacgtctttgcccaaaaataaaacttcaacagattgagagagttcacactggagaaatactttcctctggcaaacccctgtggcagggttttcagtaaaatgttttgcctcatcgtgtgcta

SEQ ID NO: 3403 - DNA, 4020 bp, Homo sapiens
ccgtcaggcactgaggaggccgagagatgaggccggagcccaccaagttctgggaacccacaggtgctgagaacaagagaaatcaagtgaaggaaggaggcggagtttccaagacttgggtgtcatcatttctggggacatccttgattggagattgaagtttttgaaccgaaatttagagctgattcagaagagacaaatacagaacgtccaagttagcagtcatttcccaaatttaggagacaatgatgcaggcccaggaatccctaacactggaggatgtggctgtggacttcacctgggaggagtggcagttcctgagccctgctcagaaggacctgtaccgggacgtgatgttggagaactacagcaacctggtggcagtggggtatcaagccagcaaaccagatgcactctccaaattggaacgaggagaagaaacttgcacaacagaagatgaaatctactctcgaatctgttctgattcaggaggtgcatcaggaggtgcatatgcagaaatcaggaaaattgatgatcctctgcagcatcacttgcaaaatcaaagtattcagaagagtgtgaaacagtgccatgaacagaatatgtttggaaatattgttaatcagaacaaaggtcatttcctgctgaagcaagattgtgatacgtttgacttacatgaaaaacctttaaaatcaaatttaagttttgaaaaccagaaaaggagctctggcctaaagaactctgctgagtttaatagagatgggaaatccctttttcatgctaaccataaacaattttatactgaaatgaagtttcctgcaattgcaaaacctattaataagtcccagttcattaagcaacagagaactcacaacatagagaatgcccatgtatgcagtgaatgtgggaaagccttcctcaagttgtctcagtttattgatcatcagagagttcacactggagaaaaacctcatgtatgcagtatgtgtgggaaagctttctccagaaaatccagactaatggaccatcagagaactcatacagaactgaaacattatgaatgcactgaatgtgacaaaaccttcctcaagaaatcacagctcaatatacatcagaaaactcatatgggagggaaaccttacacatgtagccaatgtgggaaagccttcatcaagaagtgtcggctcatttatcatcaacgaactcatacaggagagaaaccccatggatgcagtgtatgtgggaaggccttctctacaaagttcagtctcactacacatcagaaaactcatacaggagaaaaaccttatatatgtagtgaatgtggaaaaggcttcattgagaagaggcgtcttactgcacatcatcgaactcatactggtgagaaaccctttatatgcaataaatgtgggaaaggcttcaccttgaagaacagtcttatcacacatcagcaaactcatacaggagagaaattatatacatgtagtgaatgtggaaaaggcttttcaatgaagcactgtctcatggtacatcaacgaactcatactggagagaaaccttataaatgcaatgagtgtggaaagggcttcgctttgaagagcccactcatcagacatcagcgaacacatactggagagaaaccctatgtatgcaccgaatgtcgaaaaggtttcaccatgaagagtgacctcattgtacatcagcgaactcatactgcagagaagccatatatatgcaatgattgtggaaaaggcttcactgtgaagagccgccttattgtgcatcagcgaactcatactggagaaaaaccctatgtatgtggtgagtgtggaaaaggctttccagcaaagatccggctaatgggacatcaacgaactcatacaggagagaaaccttatatttgcaatgagtgtggaaaaggcttcactgagaagagtcatctcaatgtacatcggcgcactcatacaggagagaaaccctatgtatgcagtgaatgtggcaaaggcttaactgggaaaagcatgctcattgcacatcagcgaactcatactggggagaaaccttatatatgcaatgaatgtggaaagggcttcaccatgaagagtactctcagtatacatcagcaaactcatactggagagaagccatacaaatgcaatgaatgtgataaaaccttcaggaagaagacatgcctcatacaacatcagcgatttcacacaggaaagacttcctttgcatgtactgaatgtggaaaattctctttgcgcaaaaatgatcttattacacatcagagaattcacacaggagagaaaccgtacaaatgcagtgactgcgggaaagccttcactacaaaatcagggctcaatgttcatcaaagaaaacatacaggagagaggccctatggatgtagtgattgtgggaaagcttttgcgcacttgtctatccttgttaaacacaggagaattcacaggtagtcattttgggaaagcctcttgccagatgtaggcccttaagatatctgcaaagaagagtaatttcatgaatgcagactacatggttgtttatttagtgatcagttacttcatgttttgtgtcagagaaaacatgtacaaaacatttgagaaaatattttaggacattatgtctaaaaattgtatactgagaaaaatcctatgaatgtggcagactataaaagcctttggtgggaagataaaccccctcagaagtgatcatagatcatgaataaactactaattcgtggaaatgtaataattataggaacgtctttgcccaaaaataaaacttcaacagattgagagagttcacactggagaaatactttcctctggcaaacccctgtggcagggttttcagtaaaatgttttgcctcatcgtgtgctaggaaataatgcagaaaaaacttatgaaaacattcaatgtagaagacttttaggaaaatatcagagaatttaatgaaggaaagaagccttggcaaaatgatggatgagagctttctgtcacaattctaaccttaacagataatatgcctcatgtgcatttgggaacaggatagcttgagccatattcctagttgccttgtcactgattttatacattttaaattgtgacttcctctaatcacgaactaaaatttaatattgtatataataccggagtattttatgcctgcctcattttattatatgattagctcctgcatttctttggttctaagtttgtgttatttcagaataactaaagtacttcagaatgaaactggatacagtatattcagttcataagtgtaattgaccatacttgaatatgtttaagtttataagtaacatcaggtgttatgaaattaatataaataagatgtttttgtaagtttttattttgaaataagtttagattcacaaaatcttaccaaaatattccagagttcttgcccttaacccagcttcttccaaagataacaacttacataagcatagttcattaccaaatacaggaaagtgaaattgttacaatactgttaactacagaatttatttggaaatcaccagttttaacatgcatgcatttttgtttgttttttatatgtagctttaagaaatcttaacacatatattgattcatgtcaccaccaccgtaatcgagattcagaatgttgcatcaatgcaaactccctcatgctccttgtttatagtcacaacctctcctcagccctaacccttggcaatcagaaatcttttcatctttagttttgtcattagtagcatgttataaaaatggaatcatacagcatgtacccttttggtattggctatttcaactaaagcagattaacctgaaatccatccaagttgttctgcatatcattgttctgtttttattggccactaataatctatgatacgaatataccactatttgtttattcacccactgaaggacattagttttgttcccggtttttcttactgttacaaataaaaatcctatgaacatttgtacaca

SEQ ID NO: 3404 - DNA, 3046 bp, Homo sapiens
actcccggaagcagattgcgccagggaaaggccttatcgctgtgtgtgtgtttcagtctacgtggattaaacattacttcgctccgtctgcctggattaaacgtgcactttgcagtcctcacttctccgtaccagtgatctggggatcgctacggaccttaaaatacccatagccccttcgcccctgcaacaggcacttctccccacgtttgatgtgtgaataattacattgactgagaaagaaacccagaagaggaagaagaggaaggaaaaggagtcagtgatggctactcaggggcatttgacattcaaggatgtagccatagaattctctcaggaggagtggaaatgcctggagcctgtgcagaaagctttgtacaaggatgtgatgttggagaactataggaacctggtcttcctaggtatctctcctaaatgtgtgatcaaggaattaccaccaacagagaacagtaatacaggagaaaggttccaaacagtggcactggaaagacatcaaagctatgatattgaaaatttatacttcagggaaatacagaaacatctacatgaccttgaatttcaatggaaagatggtgaaacaaatgataaagaagtgccagtgccccatgaaaacaatcttactggtaaaagagatcaacatagtcaaggggatgtagaaaacaatcatattgaaaaccagcttacatcaaactttgagtcacgtctggctgaactgcagaaagttcaaactgaagggagactttatgaatgtaatgaaacggagaagacaggtaataatggttgtttagtttctccacacattagggaaaaaacgtatgtatgtaatgaatgtggcaaagcctttaaagcgtcttccagccttattaatcatcagaggatacatactacagagaaaccttacaaatgcaatgagtgtggcaaagcctttcatcgggcctcactactaactgtacacaaggtagtccatacaagagggaaatcatatcaatgtgatgtatgtggcaagatcttcagaaaaaattcatattttgtaagacaccaaaggagtcacactggacagaaaccctacatatgtaatgaatgtggcaagtcctttagtaaaagttcccaccttgcagttcatcagagaattcataccggtgaaaaaccttacaaatgtaatctgtgtgggaaatcctttagtcagcgtgtccatcttagacttcatcagacagttcatactggagagagacccttcaaatgtaatgagtgtggcaaaacctttaaacggagctcaaacctcactgtacatcaggtaatccatgcaggaaagaaaccatataaatgtgatgtatgtggcaaggcattcagacatagatcaaatcttgtatgtcaccggagaatccacagtggagagaaacaatacaaatgcaatgaatgtggcaaggtcttcagtaaacgttcaagtcttgcagtgcatcgacgaattcacactgtagagaaaccttgcaaatgcaatgaatgtggcaaggtcttcagtaaacgttcaagtcttgcagtgcatcagagaattcatactggacagaaaacttacaaatgcaataaatgtggcaaggtgtacagtaagcattcacatcttgcagtgcattggagaattcataccggcgagaaagcttataaatgcaatgaatgtggcaaagttttcagcatacattcacgacttgcagctcatcagagaattcatactggagagaaaccttacaaatgcaatgaatgtggcaaggtcttcagtcaacattcacgtcttgcagtgcatcggagaattcatactggagagaaaccttacaaatgcaaagaatgtggcaaggtcttcagtgaccgttcagcttttgcaaggcatcggagaattcatactggagagaagccttacaaatgcaaagaatgtggcaaggtcttcagtcaatgttcacgtcttacagtgcatcggagaattcatagtggagagaaaccttacaaatgcaatgaatgcggcaaggtctacagtcagtattcacatcttgtagggcatcgaagagttcatactggagagaaaccatacaaatgtcatgaatgtggcaaagcctttaatcagggctccacactcaatagacatcagagaattcataccggagagaaaccttacaaatgcaatcagtgtgggaattcctttagtcagcgtgtccatcttagacttcatcagactgttcatactggagacagaccttacaaatgtaatgagtgtggcaaaacctttaaacggagctcaaacctcactgcacatcagataattcatgcaggaaagaaaccatataaatgtgatgaatgtggcaaggtattcaggcatagttcacatcttgtaagtcaccagagaatccacactggagagaaaagatacaaatgtattgaatgtggcaaagcctttgggcggttgttttccctcagcaaacaccaaagaattcattctggcaaaaaaccttataaatgtaatgagtgtgggaaatcttttatttgtcgctcaggcctcactaaacatcgaataagacatactggagagagccttacaactaaactcaatgtgacaaggccttagacgttgtcctagtttctggaatcaccgaataattcctacttactgatataccttgtatatttaccccttctcttgaaatccctgtggaattgtaatctccagtattggaggtggggcccattgggaggtgattgaatcatggaagtggatttctcaaactgagaaagatgtagcgtcatccccttggtgctgtcctggcaatagtgacttctcttgaggtctggctgtttagaagtgcatagcacttccctgtcgcttgccctcattctcaccatgtgaaataccgacacccgctttgccttccaccatgattttaaccttcctgaggcttccctagagggtgatcagatgccagcaccatgttttcatttaagccttcagaaatatgagccaattaaactcttttctttatacatt

SEQ ID NO: 3405 - DNA, 4335 bp, Homo sapiens
cagggaaaggccttatcgctgtgtgtgtgtttcagtctacgtggattaaacattacttcgctccgtctgcctggattaaacgtgcactttgcagtcctcacttctccgtaccagtgatctggggatcgctacggaccttaaaatacccatagccccttcgcccctgcaacaggcacttctccccacgtttgatgtgtgaataattacattgactgagaaagaaacccagaagaggaagaagaggaaggaaaaggagtcagtgatggctactcaggggcatttgacattcaaggatgtagccatagaattctctcaggaggagtggaaatgcctggagcctgtgcagaaagctttgtacaaggatgtgatgttggagaactataggaacctggtcttcctaggtatctctcctaaatgtgtgatcaaggaattaccaccaacagagaacagtaatacaggagaaaggttccaaacagtggcactggaaagacatcaaagctatgatattgaaaatttatacttcagggaaatacagaaacatctacatgaccttgaatttcaatggaaagatggtgaaacaaatgataaagaagtgccagtgccccatgaaaacaatcttactggtaaaagagatcaacatagtcaaggggatgtagaaaacaatcatattgaaaaccagcttacatcaaactttgagtcacgtctggctgaactgcagaaagttcaaactgaagggagactttatgaatgtaatgaaacggagaagacaggtaataatggttgtttagtttctccacacattagggaaaaaacgtatgtatgtaatgaatgtggcaaagcctttaaagcgtcttccagccttattaatcatcagaggatacatactacagagaaaccttacaaatgcaatgagtgtggcaaagcctttcatcgggcctcactactaactgtacacaaggtagtccatacaagagggaaatcatatcaatgtgatgtatgtggcaagatcttcagaaaaaattcatattttgtaagacaccaaaggagtcacactggacagaaaccctacatatgtaatgaatgtggcaagtcctttagtaaaagttcccaccttgcagttcatcagagaattcataccggtgaaaaaccttacaaatgtaatctgtgtgggaaatcctttagtcagcgtgtccatcttagacttcatcagacagttcatactggagagagacccttcaaatgtaatgagtgtggcaaaacctttaaacggagctcaaacctcactgtacatcaggtaatccatgcaggaaagaaaccatataaatgtgatgtatgtggcaaggcattcagacatagatcaaatcttgtatgtcaccggagaatccacagtggagagaaacaatacaaatgcaatgaatgtggcaaggtcttcagtaaacgttcaagtcttgcagtgcatcgacgaattcacactgtagagaaaccttgcaaatgcaatgaatgtggcaaggtcttcagtaaacgttcaagtcttgcagtgcatcagagaattcatactggacagaaaacttacaaatgcaataaatgtggcaaggtgtacagtaagcattcacatcttgcagtgcattggagaattcataccggcgagaaagcttataaatgcaatgaatgtggcaaagttttcagcatacattcacgacttgcagctcatcagagaattcatactggagagaaaccttacaaatgcaatgaatgtggcaaggtcttcagtcaacattcacgtcttgcagtgcatcggagaattcatactggagagaaaccttacaaatgcaaagaatgtggcaaggtcttcagtgaccgttcagcttttgcaaggcatcggagaattcatactggagagaagccttacaaatgcaaagaatgtggcaaggtcttcagtcaatgttcacgtcttacagtgcatcggagaattcatagtggagagaaaccttacaaatgcaatgaatgcggcaaggtctacagtcagtattcacatcttgtagggcatcgaagagttcatactggagagaaaccatacaaatgtcatgaatgtggcaaagcctttaatcagggctccacactcaatagacatcagagaattcataccggagagaaaccttacaaatgcaatcagtgtgggaattcctttagtcagcgtgtccatcttagacttcatcagactgttcatactggagacagaccttacaaatgtaatgagtgtggcaaaacctttaaacggagctcaaacctcactgcacatcagataattcatgcaggaaagaaaccatataaatgtgatgaatgtggcaaggtattcaggcatagttcacatcttgtaagtcaccagagaatccacactggagagaaaagatacaaatgtattgaatgtggcaaagcctttgggcggttgttttccctcagcaaacaccaaagaattcattctggcaaaaaaccttataaatgtaatgagtgtgggaaatcttttatttgtcgctcaggcctcactaaacatcgaataagacatactggagagagccttacaactaaactcaatgtgacaaggccttagacgttgtcctagtttctggaatcaccgaataattcctacttactgatataccttgtatatttaccccttctcttgaaatccctgtggaattgtaatctccagtattggaggtggggcccattgggaggtgattgaatcatggaagtggatttctcaaactgagaaagatgtagcgtcatccccttggtgctgtcctggcaatagtgacttctcttgaggtctggctgtttagaagtgcatagcacttccctgtcgcttgccctcattctcaccatgtgaaataccgacacccgctttgccttccaccatgattttaaccttcctgaggcttccctagagggtgatcagatgccagcaccatgttttcatttaagccttcagaaatatgagccaattaaactcttttctttatacattagccagcctcaggtttttttttgtagcaatgcagttatgacctaatacatttacacatgcagtaaatatacctaagttttaagctagtattcactactcactaggtgtaagaatttgtatatatattccaggatgtatacatcctggagaaaaatcacagaagtgtaatacgtgtggcaagaattctactcaaaagccagaacttgtaaatctaggtaattaaaagggcatagatgtatgaaatgaaatgagggtggcaaaacctttactagagttcaatcactacttgtcataagagagtttatactgaaaggaaatcatataaatgtatgtgtcagaggctttccccaggcattggaactcactaggcatcagaatatacatctttgagaggaaccacagaaatgtaatgtgcatgctaaggtttttacccgaacatcaaaatggaaagagtattcatactagagacaaccttccaaataaatggttttaaaaaatgaaatgttcaaagacctggaatcaacccaaatgcttatcagtgatagactgaataaagaaaatgtggtacatatacaccatgggatactatgcagccatagaaaggaatgagatcatgtccattgcagcgatgtggatggagctggaagccattatcctcaggaaactaacacaggaacagaaaatcaaacagcacatgttctcacttaaaagtggaagctgaacaatgagaacacatatacccagggaggggagcaacacacactggggcctgctgatgggggtgggaagggcagggaagtggagcatcaggacaaatagctaatgcatttttgccttaataccaggtgatgggttggtagatgcagcaaaccaccatggcacacattttcctatgtaacaaatttgcaaattgtgcacatgtacccagaacttaaagtgagacaaaaccaatgtccacgcctttgcagtttgattgaacgtataaaggagaaaaatcctgtaagtatgctgaacatgaaaggacctggaagcagtagtgtgtcttcagcctttaccaaattatccctacttgagagaaaacttggaaatgtaatcaatgtggcacaaatttcaaccagttttttaaacagactacacatctttgaaatcatactagggataaccaaatctgcttctccaagattggcctggaatattattacagaataactaccagacaacatttgttaaaactcaggacagtatgtattttaaaggagcaagtgcatgtgtgaaaatggctcattcagtttataaaatattacattaaa

SEQ ID NO: 3406 - DNA, 9109 bp, Homo sapiens
ggcggcggcggcggcggcggcggcggcattgtgcgcgcaccagcagcccggcccgggaggagcaggacgcgccggggccgcctcctcccgcacggacccatgaaccagccgggcggcgcggcggctccgcaggctgacggagccagtgcagccggaaggaaaagcactgcgagcagggagcgcttgaagcgcagccagaagagcaccaaggtggagggcccagagccagtgccagccgaggcctcgctgagtgccgagcaaggaacgatgacggaggtgaaggtgaagacagagctgcccgatgactacatccaggaggtgatctggcagggcgaggccaaggaggagaagaaggcggtcagcaaggatgggaccagcgacgtgcctgccgagatctgcgtggtgatcggcggcgtccgcaaccagcagacccttgggtcttacgaatgcggaatctgtggcaagaagtacaagtattacaactgcttccagacccacgtgcgggcgcaccgagacaccgaagccacctcaggggagggagcctcccaaagcaacaatttcaggtacacatgtgatatctgcgggaagaagtacaaatactacagctgtttccaagagcaccgagacctgcacgcagtggatgtgtttagtgtggaaggggcccctgagaaccgggcagaccccttcgaccaaggtgtcgtggccacggacgaggtgaaggaggagcccccggagccattccagaaaatcgggccaatgaacaatattacatcagacatttttaagaagaaagaagttaggcagtgccaaaagagagaaactggcaattacacctgtgaattctgcggcaaacagtacaagtactacactccctaccaggagcatgtggccttacacgcccccatcaaaagcgctttcagtcggagagtagaaggcaaagcacaaaaccactttgaagagacgaacagcagttcgcagaactccagcgaaccctacacctgcggcgcctgtgggatccagttccagttctacaacaacctgttggagcacatgcagtcccatgcagctgacaatgaaaacaacattgcctccaaccagtcccgatcgccacctgctgttgtagaagagaagtggaaacctcaggcccagaggaacagtgccaataacaccactaccagtggtttaacacccaacagcatgatccccgaaaaggagcggcagaacatcgcagagcggctgttgagggtcatgtgtgccgacctgggtgcactgagcgtggtcagcgggaaggagttcctgaagttggcccagaccttagtagacagtggtgcccgctatggggccttctcggtcactgaaatcctgggcaacttcaacacgctggcgctgaagcacctgccacgcatgtacaaccaggtgaaggtgaaagtgacctgtgccttgggcagcaatgcctgcctaggcatcggtgtcacctgccactcccagagtgttggccctgactcctgctacatcctcacagcctaccaggccgagggcaaccacatcaagagctatgtgcttggtgtgaagggtgcggacattcgcgacagcggtgaccttgtgcaccactgggtgcagaacgtgctgtcggagttcgtgatgtcggagatcaggacagtgtacgtgacggattgccgggtgagcacgtccgccttctccaaggccggcatgtgccttcgctgctcagcctgtgccttgaactcggtggtgcagagcgtgctgagcaagcggacactgcaggcccgcagcatgcacgaggtcatcgagctgctcaacgtgtgcgaggacctggcgggctccacgggcctggccaaggagaccttcgggtcgctggaggagacgtctccaccaccctgctggaactcggtgacggactcactgttgctggtgcatgagcgctatgagcagatctgcgagttctacagccgggccaagaagatgaacctcatccagagcctcaacaagcacctgctcagcaacctggcggccatcctgacgccggtgaagcaggcagtcatcgagctgagcaacgagagccagcccaccctgcagctggtgctgcccacctacgtcaggctggagaagctgttcacggccaaggccaacgacgcaggcactgtcagcaagctctgccacctcttcctggaggcgctcaaggagaacttcaaggtgcacccggcccacaaggtggccatgatcctggacccgcagcagaagctgcggcctgtgccaccctaccagcacgaggagatcatcggcaaggtctgtgagctcatcaacgaggtgaaggagtcctgggccgaggaggccgacttcgagcccgctgccaagaagccccgctctgctgccgtcgagaaccccgcagctcaggaagatgatcggctaggcaaaaatgaagtgtacgattacctgcaggagcccctcttccaggctacccctgatctcttccagtactggtcgtgcgttacccaaaagcacacaaaactcgccaagctcgccttctggctcctggcggttccggccgtgggcgccagaagcgggtgtgtaaatatgtgtgaacaagcgcttctaatcaaacggaggcggctgctcagtccagaagatatgaataaactcatgtttctgaaatccaacatgctttaagacttgacttcgggggaaaaaaaaagaaaaagagaagataacattagaaaaaaaccacacaacactgtcacaaagaaaaggaatttaagttctaaacactgtggacctcattataaatgccccctggaaacttaagtgctttttttatatgtgtgtgtgtgcgtgtatgtacacagccacacgtgtgtgcacgtgtctgaacacgtgctgtggttgtgggggtgtgggggggtctctgtgctcatctccatggccagagaaactttgcacacacgcacacacacacacacacacacacacacacacacgaccctggtgcgtgtacatacgcctgtgcttggacgggtgtgcattgaactgggcgtgtcaggaaagctgagcgattgggaaagagggagatgtttcacctccttttctcagtaagggggctttagaagactccgctttcaggtgtgcagattggcagaaagctgatgttgtgaaatgttcaggcagctgagatctgaagtgacttgacgctctctgtccttcaccccggtcctccttttccctctttgaccctcttccagccctcctaccctcctgatcccattgtgcacccccccacacactcggctgctctgctgtggactctccacactgcatcagatggacggtttctgcactggactttgtttcttgttcaccttcagggcattgagctgctgcctttgagataccccttgggtgtcccggggcagccgccttagaaacacacctatctatctccccaaatcaggaaaggagacttaaagagtataaagctgacattttgctttttaatataagagaggagaaaaagacatttttcagagaagtatagatactgtctccactccctaataatttctctccctaacattttagcaatttttaccttgtttgggggttcattttgtttcttcagatttgatttagactctgctaggaggcactgaatgtctataacttatgttttggagttttgtttttttacttgccccttttgttcctcaagtcacactgtaaactagctcatctctgtggtgtactcagtatcctacagtctttcttggccttccctgtacagttcagttttcacatattcgaacggccaagaccaggttcttggctgtgctatttggagaccaggcgttggggaggattcacgggttccacagctgcggggtttggtggccgtaggggaagcagtggtttgggagttctgaatgtaagcgccagagctgccctcctggtccgctgtgcgtggtacccagtgtgcatcacactactcaccccctcccggaccctggcagtccacagcgactccgaagtcagcccatagtcacatccaccacacctcagacctgccacagcctctcctcacttcccaggaccctgaggcttccaggagctctgctgcccacagccctcggggtcctcactcacacctccgacttccaggacggcagtgagcatggtgccttgtggccccaacagttgatgttccgagggtgggatggtgtttggccatgttcgactcgatgctgtgaaagatgtcttcaggcttttctctcctgttcccccagctgtgagcaaattaggttctacacacacagttcggatgccaagggtgacaccccattcccttcacaagaggcggttctgtcacaaatcagcactccacccccaccacacctctcagtgaatgaagtgctggtggtctcactcccctggtgacccttagccgtgggatggggtggttacactaaggcttcaagctgagaatggccatcatggcgggaggctgtttgcaaaggcaccttctgtcatcctggggttggctaagtcaactccaccccttcccaataataaagcatcactcaactgtgagatacctcgactacaaaaagcactgtaccacagccctctccccctgggtccatgacaggagcagggagtaaagttgattgcaaacctcatgaaggcttaggatcatggacctggaacatagtgtttgggggccaagcctgcacactttgcctcatgagaactcacccagctctccccttgaaacttggacacactgaaatggatcaaagtgggccatttccacatttgctccagcaaactgtggtctcaggaactaccatgccatttcctctcctggagaagttctaggtattacctccacaacatttccaactgggggactgagcccacttatcagagaagagccgccatccacactggagcaggaacagggagaaatccagacaggaacctcatgtcacttcctagggaatatgggaagaaacatcagcagactttatgatgtcagttgggcctttggaggcattctggaaggtggcctcagcatcactgatgattgacagatgctacagcaaaaggtccctctagcgttgcttgactgctggggaagggacagtgaccggcactttgacccacacaaggataggagctgcctactttgtgtggtaggtgagagcagagcctgggagcccatcctccctctacttggagcaaagttgtgctggtgatgccccattattgggccagttgattagaaaataggcatttcactttcttggaaagccatcggactaagcccagatgtgcatttagagcactcagcattcttctctttgaagcatgggatgtctgtcctccaggaagagatttgatcttaggttgttacctccctttcacttcttttccacctcaattcaatacttaggggttggcttgcctctgcaggtttgatgtgaatgccactgggtactcagaaagctgtcctctggggctgccttgtccagttagataacaagatagcagatgattgtttcttgcaacctctggttccctccggaaactggtgtcaccaacaggaaaggctgtaccaaggtgccctcttctcagacaggctgttctcagagtgcaaatcctgctgcaactaacagcttaataaaacccaaagatctcacaggtccagccactggcccctttatctccaacaatatccacctcaccaaattctagttcagccaaaggattgagacaggctcttccagttcatctcctggtgtccagcctgaccttcacatctggaaggattttgtcgtctgcctcccagttctgggtccactgtaggtctttccatcacaagcctttgggggatctgggaccaggaatttgggccgtttctaccatattctcagcagcctaaggtggtggcctgctgatgtggagactactcaccttgagccatgtggtccccaggacagaaatggcctttgttttgacatacatggacccaaaaggggaggtgaagaaaacacacctccacctggcaagtttttctccctcatctgaggtcagttgcttcaccaacaaagcccaagccaagaactgcagcgttgagggttgtccctcggagtggagtagcccaaggaatctcaggtccaccaagagcattggtaccatctgggccacgggtggatgcctttgttctggcacagttctccacttcccgattcctggctcagccagccaggcctccctctaatggcatttagtaaccaggaaacaaaacacatgccacctgagcaaaactgcctgcacttcatctctggaggttcgctgcacagaggccacctgccgcatcaccagtgaggaagctttgccaccatcctgcttggcagcttcacacttgacatctgaggattggtttttggctggaaaaagggtaccagggtttcctggcaaggacaggagagcagtgcagtgacacagatgagaagctgtgagtctccaggattcaaggaagccaccaggtgtgcaggctgggaagagacatctctttcagtttgaccctttatctcctgcacttttaaagaaacaccagagaaaaaatctacaaggcgtgtttccactgaagctgaacctctgcctttaggagtcccctatatttgagcaaggccacctgcttcccctggacttgagctggactccttgaagagtgggcttctggagagatgttaggaatatagcacatgctctctgggggccacagggtcattgggaaggtttgaaatgaagatgggatgtggctggaacagcctgtgagatggctccattggggacactcccctcatcttgtcatcacgatggatatgctggaagaggaggtgtcccagtgagccgcccgaagttcatagctttgccctcgccttggcaacagcggcaatgcctctatctctgggatgcatcttaaggagggctcctaacaaggccgatgatttagacagaacaagagactaagtaaggtccggctatcccgtggagccagtagtaggtgggagctcctgtccccgccagccctgctccagcccccgtgtccagctgggccagtggaagaactgggaaggaggaagcccctccctttcactgtggctaatgtttgctaggccagttatggtgaaccaatgatacagtgttttccctcttaacgttcccctcctggttttgccttttcagggttttctgggggattttgttgtagtagttgcttttcttcctctctcatttgggtttgaggattgtggtcgggggagccctggctttcaccaaaggagcccagtggtttctgtggaagaggcgcccactcccactttaatgagggtgaagattgtcaggtcactgtttgacatattcatgccccgtcccttccccccccacccccccgcccacccaccacgggtgtcgctttaaagagtcaattcttgtacagagaaggatttgctaggtttgcatttgggtgttagcatcacgacccacgagggccctgcccaaccgtgcgtcccatggggcaccttgactcttcaaaccaaaattccttaaaggggcacagcccagccttgtccgcaacctcaggggcctgggattcctgtggcgcttcctgaattccaggttggcacagatgatgaggtctgagaccagccggaaggaggggctcctgccataacccaggtgccagccggtctccgcctaggaccttccctcccgcccagccagggtgggcggcatcctacgcggtgaaacgagctcatggactgacccggggctgggcctcgccagccaggagagagcgagggccgcacggcagggctggcccaggcagctcgtccagggccattcagatcccaagcatcaggaaatcattttgtacaaccacccgaagcagagatattttttaagaagcgtaaattattttcagttgttttctgatcctgcctttttcttttccccacaacttcacgccagtgagtcgttcacatcaggtaaatcttgagaaagccttggtgccctcctccccaccccccactcagtaaccacgtgcgtgcacccccgcatcctttctcagtagttaagacgttctaggcaataccatagacacatctgactgtgtctctctctttgagtgcaagaaactcaagtcatcttaaaaaaaaaaaaatacaaaaaaaatttacaaaaaaacaaacacaaaaaaaatatcttttttaggccagagttttctacaggtattaatgaatatttttcttaatccttataagttttatgtgtttaatatttcttaataccggtagcattaatttatacttttgtagcaacacaatatttttataaacagccggtgcttggctcaagtcttcacgaggggtttaggcagggccatcttggggaccctgtgtaccatgtactgtatttaaaaaaaaaaaaagttacctattgtcacacttgctgtgttaattaacaaaagatgttgtgtgcggtctcctgtatcggtgtggatccaacagctctccagggagtcacattgcatgggggttgagttgacggttcttgtgatatgtaaacccccgagaccaaacttgagggtttatttagggttttctgtttgtcctttgggtttttgtttcactttgttttggtgccgtttctccatttacagccaaatcagtttcatgatgttcaaaacatttactgatgtcaaatggaggaaaggaacagaaaaaaagatttttacaaagtaataaaatttaaaactgagctgtttaatgttgctgtttttacctgtctgttcttgtccaaaagtggaacattcccagggagaagaggaaggttccactcggttctttaagtcgccaaaagccccagcccgggattcagtacctcccctgccccccgaattcttgcagcactatttcccagttggttgatgccaaggcaaaaagataacttttaacagttagagaggatcagttgcttaaatgatttcatgtcagtgttgtatttatggttttacaataaaacaacctttagg

SEQ ID NO: 3407 - DNA, 1156 bp, Homo sapiens
gcgccggggccgcctcctcccgcacggacccatgaaccagccgggcggcgcggcggctccgcaggctgacggagccagtgcagccggaaggaaaagcactgcgagcagggagcgcttgaagcgcagccagaagagcaccaaggtggagggcccagagccagtgccagccgaggcctcgctgagtgccgagcaaggaacgatgacggaggtgaaggtgaagacagagctgcccgatgactacatccaggaggtgatctggcagggcgaggccaaggaggagaagaaggcggtcagcaaggatgggaccagcgacgtgcctgccgagatctgcgtggtgatcggcggcgtccgcaaccagcagacccttgggtcttacgaatgcggaatctgtggcaagaagtacaagtattacaactgcttccagacccacgtgcgggcgcaccgagacaccgaagccacctcaggggagggagcctcccaaagcaacaatttcaggtacacatgtgatatctgcgggaagaagtacaaatactacagctgtttccaagagcaccgagacctgcacgcagtggatgtgtttagtgtggaaggggcccctgagaaccgggcagaccccttcgaccaaggtgtcgtggccacggacgaggtgaaggaggagcccccggagccattccagaaaatcgggccaatgaacaatattacatcagacatttttaagaagaaagaagttaggcagtgccaaaagagagaaactggcaattacacctgtgaattctgcggcaaacagtacaagtactacactccctaccaggagcatgtggccttacacgcccccatcagtactgcccccgggtgggagccaccggatgatccagacacgggctctgagtgttcacatccagaggtctccccatctccacgcttcgtggcagcgaagacccagacgaaccagtcggggaaaaaagctccggcctccgtggtccgatgtgccaccctcttacaccgcacccctccagccacccaaacccagacgttccgcactccaaattcgggatctccggcgagcaaggcaaccgcagaaagcgctttcagtcggagagtagaaggcaaagcacaaaaccactttgaagagacgaacagcagttcgcagaactcc

SEQ ID NO: 3408 - DNA, 3018 bp, Homo sapiens
ggcggcggcggcggcggcggcggcggcattgtgcgcgcaccagcagcccggcccgggaggagcaggacgcgccggggccgcctcctcccgcacggacccatgaaccagccgggcggcgcggcggctccgcaggctgacggagccagtgcagccggaaggaaaagcactgcgagcagggagcgcttgaagcgcagccagaagagcaccaaggtggagggcccagagccagtgccagccgaggcctcgctgagtgccgagcaaggaacgatgacggaggtgaaggtgaagacagagctgcccgatgactacatccaggaggtgatctggcagggcgaggccaaggaggagaagaaggcggtcagcaaggatgggaccagcgacgtgcctgccgagatctgcgtggtgatcggcggcgtccgcaaccagcagacccttgatggaaaagcgcccgaaggcagcccccacggtggatctgtgcgaagccggtattcagggacctggatttttgaccaagcattgagatatgcatctgggtcttacgaatgcggaatctgtggcaagaagtacaagtattacaactgcttccagacccacgtgcgggcgcaccgagacaccgaagccacctcaggggagggagcctcccaaagcaacaatttcaggtacacatgtgatatctgcgggaagaagtacaaatactacagctgtttccaagagcaccgagacctgcacgcagtggatgtgtttagtgtggaaggggcccctgagaaccgggcagaccccttcgaccaaggtgtcgtggccacggacgaggtgaaggaggagcccccggagccattccagaaaatcgggccaaaaactggcaattacacctgtgaattctgcggcaaacagtacaagtactacactccctaccaggagcatgtggccttacacgcccccatcagtactgcccccgggtgggagccaccggatgatccagacacgggctctgagtgttcacatccagaggtctccccatctccacgcttcgtggcagcgaagacccagacgaaccagtcggggaaaaaagctccggcctccgtggtccgatgtgccaccctcttacaccgcacccctccagccacccaaacccagacgttccgcactccaaattcgggatctccggcgagcaaggcaaccgcagcagaaagcgctttcagtcggagagtagaaggcaaagcacaaaaccactttgaagagacgaacagcagttcgcagaactccagcgaaccctacacctgcggcgcctgtgggatccagttccagttctacaacaacctgttggagcacatgcagtcccatgcagctgacaatgaaaacaacattgcctccaaccagtcccgatcgccacctgctgttgtagaagagaagtggaaacctcaggcccagaggaacagtgccaataacaccactaccagtggtttaacacccaacagcatgatccccgaaaaggagcggcagaacatcgcagagcggctgttgagggtcatgtgtgccgacctgggtgcactgagcgtggtcagcgggaaggagttcctgaagttggcccagaccttagtagacagtggtgcccgctatggggccttctcggtcactgaaatcctgggcaacttcaacacgctggcgctgaagcacctgccacgcatgtacaaccaggtgaaggtgaaagtgacctgtgccttgggcagcaatgcctgcctaggcatcggtgtcacctgccactcccagagtgttggccctgactcctgctacatcctcacagcctaccaggccgagggcaaccacatcaagagctatgtgcttggtgtgaagggtgcggacattcgcgacagcggtgaccttgtgcaccactgggtgcagaacgtgctgtcggagttcgtgatgtcggagatcaggacagtgtacgtgacggattgccgggtgagcacgtccgccttctccaaggccggcatgtgccttcgctgctcagcctgtgccttgaactcggtggtgcagagcgtgctgagcaagcggacactgcaggcccgcagcatgcacgaggtcatcgagctgctcaacgtgtgcgaggacctggcgggctccacgggcctggccaaggagaccttcgggtcgctggaggagacgtctccaccaccctgctggaactcggtgacggactcactgttgctggtgcatgagcgctatgagcagatctgcgagttctacagccgggccaagaagatgaacctcatccagagcctcaacaagcacctgctcagcaacctggcggccatcctgacgccggtgaagcaggcagtcatcgagctgagcaacgagagccagcccaccctgcagctggtgctgcccacctacgtcaggctggagaagctgttcacggccaaggccaacgacgcaggcactgtcagcaagctctgccacctcttcctggaggcgctcaaggagaacttcaaggtgcacccggcccacaaggtggccatgatcctggacccgcagcagaagctgcggcctgtgccaccctaccagcacgaggagatcatcggcaaggtctgtgagctcatcaacgaggtgaaggagtcctgggccgaggaggccgacttcgagcccgctgccaagaagccccgctctgctgccgtcgagaaccccgcagctcaggaagatgatcggctaggcaaaaatgaagtgtacgattacctgcaggagcccctcttccaggctacccctgatctcttccagtactggtcgtgcgttacccaaaagcacacaaaactcgccaagctcgccttctggctcctggcggttccggccgtgggcgccagaagcgggtgtgtaaatatgtgtgaacaagcgcttctaatcaaacggaggcggctgctcagtccagaagatatgaataaactcatgtttctgaaatccaacatgctttaagacttgacttcgggggaaaaaaaaagaaaaagagaagataacattagaaaaaaa

SEQ ID NO: 3409 - DNA, 942 bp, Homo sapiens
gcgccggggccgcctcctcccgcacggacccatgaaccagccgggcggcgcggcggctccgcaggctgacggagccagtgcagccggaaggaaaagcactgcgagcagggagcgcttgaagcgcagccagaagagcaccaaggtggagggcccagagccagtgccagccgaggcctcgctgagtgccgagcaaggaacgatgacggaggtgaaggtgaagacagagctgcccgatgactacatccaggaggtgatctggcagggcgaggccaaggaggagaagaaggcggtcagcaaggatgggaccagcgacgtgcctgccgagatctgcgtggtgatcggcggcgtccgcaaccagcagacccttgggtcttacgaatgcggaatctgtggcaagaagtacaagtattacaactgcttccagacccacgtgcgggcgcaccgagacaccgaagccacctcaggggagggagcctcccaaagcaacaatttcaggtacacatgtgatatctgcgggaagaagtacaaatactacagctgtttccaagagcaccgagacctgcacgcagtggatgaccccttcgaccaaggtgtcgtggccacggacgaggtgaaggaggagcccccggagccattccagaaaatcgggccaatgaacaatattacatcagacatttttaagaagaaagaagttaggcagtgccaaaagagagaaactggcaattacacctgtgaattctgcggcaaacagtacaagtactacactccctaccaggagcatgtggccttacacgcccccatcaccacccaaacccagacgttccgcactccaaattcgggatctccggcgagcaaggcaaccgcagaaagcgctttcagtcggagagtagaaggcaaagcacaaaaccactttgaagagacgaacagcagttcgcagaactc

SEQ ID NO: 3410 - DNA, 2233 bp, Homo sapiens
agagaggctgtagggaccgacggccggccagctaatgcttccgtcttggccaccttgcgagcgctcgggttgagtttcccgggcttccctgactcggctacctgttctggaggtcaggctttgggcccttgcagaggtcgccgaggggcccgcgccgccgccagagcctgggcccagtccccagtcttcagagacgccctcgaccttcctgctccgaggagctggcctgatgtcctcgggtcgcgctccgcaggttcttactttttcaaacctagagggcagtgcatgaagccaggggtcatcagccatgctccagacagtgtggttccagggcttgggcaggaacctgttgtttcaggagccagtaacctttgaggatgtggctgtgtacttcacccagaatgaatgggccagcctgcaccctacgcagagggccctatacagggaggtgatgctggagaattatgcaaatgtgacttccttgtcagcatttccattccccaaaccagatctgatattccagctggagcaaggagaagcagcatggggcccagatccctggacacttgctgggggagaggccctgagaggcatgtgcacaggctggagtgcaatggcgtgatcttcactcaccgcaacctctgccttccaggtggtaaaaccaagactgagaatgaggaaaaaactgcacagctaaacatttctaaagaatcagagtcccacagactgatagtggagggactgctgatggacgttccccagcaccctgacttcaaggacaggttagagaagtcacagctacatgatacagggaataaaacaaagataggggattgcacagatttgacagtccaggatcatgaatcttccaccactgaaagggaggagatagccaggaaattggaagaaagtagtgtcagcacacatctcattacaaagcagggttttgccaaagaacaggtgttttataaatgtggtgagtgtggcagttactacaacccacattcagactttcacctgcatcagagagttcacactaatgagaagccctacacatgcaaagaatgtgggaaaaccttcagatataactcaaaactgtcacggcatcagaaaatccacactggagagaaaccatactcatgtgaggaatgtggacaagccttcagtcaaaattcccaccttcttcagcatcagaagctccatggtggacagaggccctatgaatgtactgactgtggtaaaaccttcagttataattcaaaactgattcggcatcagagaatccatactggggagaagccctttaaatgtaaggaatgtgggaaagccttcagttgtagctatgactgcatcatccatgaacgaattcacaatggggagaagccctatgaatgtaaggagtgtgggaagagtttgagttctaattcagttctgattcagcatcagagaatccacactggggagaaaccttatgaatgtaaagagtgtggcaaggccttccaccgcagttcggtatttcttcagcaccagaggttccacactggggaacaactctacaaatgtaatgaatgttggaaaactttcagctgtagctcccgcttcatagtgcatcagagaatccacaatggggagaaaccctatgaatgccaggaatgtgggaagacattcagtcaaaagatcactctggttcagcatcagcgagttcacactggggagaaaccttatgagtgtaaggagtgcgggaaagccttcagatggaatgcaagtttcatccagcatcagaagtggcatactaggaagaaactcatcaatggaacagggctatccgcagttaagccctactgtccctgcgccatcctctctcctctgcctccccaacatacctgctctgccctagccccaccagggcctcccttatcttcttcacatgcagtggtacttcctccctctgtgcctttcttcctgctgcttccctcatctgaaaaggccaacccttcacctgtccaaatagcacatttttttcaggatctcgcttttcctgggaagtcatcccttcagagcccgaatcctttgtctcactccctgtaagccccgtcacgttctcaaaatcctttgcacctcaagttagggattccactggtctcctgattgtgtctattgatattcctctggtcttgtcttgtataagttgttactgttttcctaacttcattttaaattctcacgcttaagg

SEQ ID NO: 3411 - DNA, 4033 bp, Homo sapiens
agagaggctgtagggaccgacggccggccagctaatgcttccgtcttggccaccttgcgagcgctcgggttgagtttcccgggcttccctgactcggctacctgttctggaggtcaggctttgggcccttgcagaggtcgccgaggggcccgcgccgccgccagagcctgggcccagtccccagtcttcagagacgccctcgaccttcctgctccgaggagctggcctgatgtcctcgggtcgcgctccgcaggttcttactttttcaaacctagagggcagtgcatgaagccaggggtcatcagccatgctccagacagtgtggttccagggcttgggcaggaacctgttgtttcaggagccagtaacctttgaggatgtggctgtgtacttcacccagaatgaatgggccagcctgcaccctacgcagagggccctatacagggaggtgatgctggagaattatgcaaatgtgacttccttgtcagcatttccattccccaaaccagatctgatattccagctggagcaaggagaagcagcatggggcccagatccctggacacttgctgggggagaggccctgagaggcatgtgcacaggtggtaaaaccaagactgagaatgaggaaaaaactgcacagctaaacatttctaaagaatcagagtcccacagactgatagtggagggactgctgatggacgttccccagcaccctgacttcaaggacaggttagagaagtcacagctacatgatacagggaataaaacaaagataggggattgcacagatttgacagtccaggatcatgaatcttccaccactgaaagggaggagatagccaggaaattggaagaaagtagtgtcagcacacatctcattacaaagcagggttttgccaaagaacaggtgttttataaatgtggtgagtgtggcagttactacaacccacattcagactttcacctgcatcagagagttcacactaatgagaagccctacacatgcaaagaatgtgggaaaaccttcagatataactcaaaactgtcacggcatcagaaaatccacactggagagaaaccatactcatgtgaggaatgtggacaagccttcagtcaaaattcccaccttcttcagcatcagaagctccatggtggacagaggccctatgaatgtactgactgtggtaaaaccttcagttataattcaaaactgattcggcatcagagaatccatactggggagaagccctttaaatgtaaggaatgtgggaaagccttcagttgtagctatgactgcatcatccatgaacgaattcacaatggggagaagccctatgaatgtaaggagtgtgggaagagtttgagttctaattcagttctgattcagcatcagagaatccacactggggagaaaccttatgaatgtaaagagtgtggcaaggccttccaccgcagttcggtatttcttcagcaccagaggttccacactggggaacaactctacaaatgtaatgaatgttggaaaactttcagctgtagctcccgcttcatagtgcatcagagaatccacaatggggagaaaccctatgaatgccaggaatgtgggaagacattcagtcaaaagatcactctggttcagcatcagcgagttcacactggggagaaaccttatgagtgtaaggagtgcgggaaagccttcagatggaatgcaagtttcatccagcatcagaagtggcatactaggaagaaactcatcaatggaacagggctatccgcagttaagccctactgtccctgcgccatcctctctcctctgcctccccaacatacctgctctgccctagccccaccagggcctcccttatcttcttcacatgcagtggtacttcctccctctgtgcctttcttcctgctgcttccctcatctgaaaaggccaacccttcacctgtccaaatagcacatttttttcaggatctcgcttttcctgggaagtcatcccttcagagcccgaatcctttgtctcactccctgtaagccccgtcacgttctcaaaatcctttgcacctcaagttagggattccactggtctcctgattgtgtctattgatattcctctggtcttgtcttgtataagttgttactgttttcctaacttcattttaaattctcacgcttaaggaccatgtttgattagtttcttttatcccccggtaggaaatggcagtacttattctttatcgtgtccacatttgggctgtattatcagtctgcatctctcttctggggctactggagttggaagagtttgcagaacattttggggtttagggcatatggcattatgattatgatgagatggggcattataattagagactaggagaaatgcaaagcctatgggagaacataatcagataaagtgtccaatgattgctttcaagagcttttttttttttagggggtggggggtggtgccggagtttcactcttgtcacccaggctgtttgcagtggtgtgatcttggctcactgcaacctctgcctccagggttcaagtgattctcatgcctcagcctcccgagtagctgggaccacaggcatgcaccaccacgccccgctaattttgtatttttagtagagacagggtttcaccatgttggccaggctggtctcaaaatcctgacctcaggtgattcacctgcctcagtctcccaagtgctgggattacaggcatgagccactgcatctggcctgctttcaggagttaaggagggccatttggtggaccaggggcaaggctcactgaaagaatgtaagacttggaattttttattaccttgatagtataaaaaattatgagggtccttttatgcaaaaagaaaatgaagtgatgagttggcattgatagcaataatgtaaaattatgtctttgagctttattggaaggggatatggtttttcaatttgggttccttctctattttcattttccttttttttttgagacaggttcttgttctgtcatccaggctggattgcagtagtgcgatcatggatcactgcagtgtgttgaccttccaggctcaagcaatcctcccacctcagcttcccaagaagctgggaggtagtgcagcctcccagtttctcagagggctgaggtgggaggattgcttgagccctgggggcatacaccaccacacccagctaatttttgtattttttgtagagacagagttttgccatgttgcccaggctggtctcaaaactcctggactcaaatgatcctcccacttcagcctcccaaagtgctgggattacaggcttgagccaccatgtccagcctctattccttttcatatctgttgaatttcagtacccactcatatatgtaggtacaaaaagtgacttggacttgtaccctttagggtagatgcctgagtatagtaatctctaaagctgtacatggatggaacttgttggcatcacactggtgagcaccagaggcaaagaagagaaacctgaccatgacttgctgtagtttctcagaagtgagtccattcctgatgagttactatgcaggcccttggatatgtcctcacacctactccagatttccctatgattaaatctgaattttattggtggcacttttaaattagttttataaagaactgttttgatgacaccaagaaatgttttcagtgtgcagattgctattgtttgaatatccccagcaaaattcttgttgaaacttaatccccattgtaacagtactgggtggggggtctttaagaggtgatcaggattagccaagttcatcagggtggagcctccatgatgggactggtggctttatgaggagaggaagagcaactggaactgggacacatgcttgctctgtcttgccttttgatgcctcctgccatgtcatgatgcagcaagtaagcccttaccagatgcctgcacctttatattggacttcttagccttcagaactgtgaactaaataaacctctattctgtataaatt

SEQ ID NO: 3412 - DNA, 1749 bp, Homo sapiens
atgctccagacagtgtggttccagggcttgggcaggaacctgttgtttcaggagccagtaacctttgaggatgtggctgtgtacttcacccagaatgaatgggccagcctgcaccctacgcagagggccctatacagggaggtgatgctggagaattatgcaaatgtgacttccttgtcagcatttccattccccaaaccagatctgatattccagctggagcaaggagaagcagcatggggcccagatccctggacacttgctgggggagaggccctgagaggcatgtgcacaggtggtaaaaccaagactgagaatgaggaaaaaactgcacagctaaacatttctaaagaatcagagtcccacagactgatagtggagggactgctgatggacgttccccagcaccctgacttcaaggacaggttagagaagtcacagctacatgatacagggaataaaacaaagataggggattgcacagatttgacagtccaggatcatgaatcttccaccactgaaagggaggagatagccaggaaattggaagaaagtagtgtcagcacacatctcattacaaagcagggttttgccaaagaacaggtgttttataaatgtggtgagtgtggcagttactacaacccacattcagactttcacctgcatcagagagttcacactaatgagaagccctacacatgcaaagaatgtgggaaaaccttcagatataactcaaaactgtcacggcatcagaaaatccacactggagagaaaccatactcatgtgaggaatgtggacaagccttcagtcaaaattcccaccttcttcagcatcagaagctccatggtggacagaggccctatgaatgtactgactgtggtaaaaccttcagttataattcaaaactgattcggcatcagagaatccatactggggagaagccctttaaatgtaaggaatgtgggaaagccttcagttgtagctatgactgcatcatccatgaacgaattcacaatggggagaagccctatgaatgtaaggagtgtgggaagagtttgagttctaattcagttctgattcagcatcagagaatccacactggggagaaaccttatgaatgtaaagagtgtggcaaggccttccaccgcagttcggtatttcttcagcaccagaggttccacactggggaacaactctacaaatgtaatgaatgttggaaaactttcagctgtagctcccgcttcatagtgcatcagagaatccacaatggggagaaaccctatgaatgccaggaatgtgggaagacattcagtcaaaagatcactctggttcagcatcagcgagttcacactggggagaaaccttatgagtgtaaggagtgcgggaaagccttcagatggaatgcaagtttcatccagcatcagaagtggcatactaggaagaaactcatcaatggaacagggctatccgcagttaagccctactgtccctgcgccatcctctctcctctgcctccccaacatacctgctctgccctagccccaccagggcctcccttatcttcttcacatgcagtggtacttcctccctctgtgcctttcttcctgctgcttccctcatctgaaaaggccaacccttcacctgtccaaatagcacatttttttcaggatctcgcttttcctgggaagtcatcccttcagagcccgaatcctttgtctcactccctgtaagccccgtcacgttctcaa

SEQ ID NO: 3413 - DNA, 1359 bp, Homo sapiens
aatgcttccgtcttggccaccttgcgagcgctcgggttgagtttcccgggcttccctgactcggctacctgttctggaggtcaggctttgggcccttgcagaggtcgccgaggggcccgcgccgccgccagagcctgggcccagtccccagtcttcagagacgccctcgaccttcctgctccgaggagctggcctgatgtcctcgggtcgcgctccgcaggttcttactttttcaaacctagagggcagtgcatgaagccaggggtcatcagccatgctccagacagtgtggttccagggcttgggcaggaacctgttgtttcaggagccagtaacctttgaggatgtggctgtgtacttcacccagaatgaatgggccagcctgcaccctacgcagagggccctatacagggaggtgatgctggagaattatgcaaatgtaatgaatgttggaaaactttcagctgtagctcccgcttcatagtgcatcagagaatccacaatggggagaaaccctatgaatgccaggaatgtgggaagacattcagtcaaaagatcactctggttcagcatcagcgagttcacactggggagaaaccttatgagtgtaaggagtgcgggaaagccttcagatggaatgcaagtttcatccagcatcagaagtggcatactaggaagaaactcatcaatggaacagggctatccgcagttaagccctactgtccctgcgccatcctctctcctctgcctccccaacatacctgctctgccctagccccaccagggcctcccttatcttcttcacatgcagtggtacttcctccctctgtgcctttcttcctgctgcttccctcatctgaaaaggccaacccttcacctgtccaaatagcacatttttttcaggatctcgcttttcctgggaagtcatcccttcagagcccgaatcctttgtctcactccctgtaagccccgtcacgttctcaaaatcctttgcacctcaagttagggattccactggtctcctgattgtgtctattgatattcctctggtcttgtcttgtataagttgttactgttttcctaacttcattttaaattctcacgcttaaggaccatgtttgattagtttcttttatcccccggtaggaaatggcagtacttattctttatcgtgtccacatttgggctgtattatcagtctgcatctctcttctggggctactggagttggaagagtttgcagaacattttggggtttagggcatatggcattatgattatgatgagatggggcattataattagagactaggagaaatgcaaagcctatgggagaacataatcagataaagtgtccaa

SEQ ID NO: 3414 - DNA, 4153 bp, Homo sapiens
agagaggctgtagggaccgacggccggccagctaatgcttccgtcttggccaccttgcgagcgctcgggttgagtttcccgggcttccctgactcggctacctgttctggaggtcaggctttgggcccttgcagaggtcgccgaggggcccgcgccgccgccagagcctgggcccagtccccagtcttcagagacgccctcgaccttcctgctccgaggagctggcctgatgtcctcgggtcgcgctccgcaggttcttactttttcaaacctagagggcagtgcatgaagccaggggtcatcagccatgctccagacagtgtggttccagggcttgggcaggaacctgttgtttcaggagccagtaacctttgaggatgtggctgtgtacttcacccagaatgaatgggccagcctgcaccctacgcagagggccctatacagggaggtgatgctggagaattatgcaaatgtgacttccttgtacccaactgcagggggctttcctctggatacagagagaactgagaaggttcctggtgcactgtcttcattccttccatcttccagttccctggagctgatcttggccctattgcctatgtcagcatttccattccccaaaccagatctgatattccagctggagcaaggagaagcagcatggggcccagatccctggacacttgctgggggagaggccctgagaggcatgtgcacaggtggtaaaaccaagactgagaatgaggaaaaaactgcacagctaaacatttctaaagaatcagagtcccacagactgatagtggagggactgctgatggacgttccccagcaccctgacttcaaggacaggttagagaagtcacagctacatgatacagggaataaaacaaagataggggattgcacagatttgacagtccaggatcatgaatcttccaccactgaaagggaggagatagccaggaaattggaagaaagtagtgtcagcacacatctcattacaaagcagggttttgccaaagaacaggtgttttataaatgtggtgagtgtggcagttactacaacccacattcagactttcacctgcatcagagagttcacactaatgagaagccctacacatgcaaagaatgtgggaaaaccttcagatataactcaaaactgtcacggcatcagaaaatccacactggagagaaaccatactcatgtgaggaatgtggacaagccttcagtcaaaattcccaccttcttcagcatcagaagctccatggtggacagaggccctatgaatgtactgactgtggtaaaaccttcagttataattcaaaactgattcggcatcagagaatccatactggggagaagccctttaaatgtaaggaatgtgggaaagccttcagttgtagctatgactgcatcatccatgaacgaattcacaatggggagaagccctatgaatgtaaggagtgtgggaagagtttgagttctaattcagttctgattcagcatcagagaatccacactggggagaaaccttatgaatgtaaagagtgtggcaaggccttccaccgcagttcggtatttcttcagcaccagaggttccacactggggaacaactctacaaatgtaatgaatgttggaaaactttcagctgtagctcccgcttcatagtgcatcagagaatccacaatggggagaaaccctatgaatgccaggaatgtgggaagacattcagtcaaaagatcactctggttcagcatcagcgagttcacactggggagaaaccttatgagtgtaaggagtgcgggaaagccttcagatggaatgcaagtttcatccagcatcagaagtggcatactaggaagaaactcatcaatggaacagggctatccgcagttaagccctactgtccctgcgccatcctctctcctctgcctccccaacatacctgctctgccctagccccaccagggcctcccttatcttcttcacatgcagtggtacttcctccctctgtgcctttcttcctgctgcttccctcatctgaaaaggccaacccttcacctgtccaaatagcacatttttttcaggatctcgcttttcctgggaagtcatcccttcagagcccgaatcctttgtctcactccctgtaagccccgtcacgttctcaaaatcctttgcacctcaagttagggattccactggtctcctgattgtgtctattgatattcctctggtcttgtcttgtataagttgttactgttttcctaacttcattttaaattctcacgcttaaggaccatgtttgattagtttcttttatcccccggtaggaaatggcagtacttattctttatcgtgtccacatttgggctgtattatcagtctgcatctctcttctggggctactggagttggaagagtttgcagaacattttggggtttagggcatatggcattatgattatgatgagatggggcattataattagagactaggagaaatgcaaagcctatgggagaacataatcagataaagtgtccaatgattgctttcaagagcttttttttttttagggggtggggggtggtgccggagtttcactcttgtcacccaggctgtttgcagtggtgtgatcttggctcactgcaacctctgcctccagggttcaagtgattctcatgcctcagcctcccgagtagctgggaccacaggcatgcaccaccacgccccgctaattttgtatttttagtagagacagggtttcaccatgttggccaggctggtctcaaaatcctgacctcaggtgattcacctgcctcagtctcccaagtgctgggattacaggcatgagccactgcatctggcctgctttcaggagttaaggagggccatttggtggaccaggggcaaggctcactgaaagaatgtaagacttggaattttttattaccttgatagtataaaaaattatgagggtccttttatgcaaaaagaaaatgaagtgatgagttggcattgatagcaataatgtaaaattatgtctttgagctttattggaaggggatatggtttttcaatttgggttccttctctattttcattttccttttttttttgagacaggttcttgttctgtcatccaggctggattgcagtagtgcgatcatggatcactgcagtgtgttgaccttccaggctcaagcaatcctcccacctcagcttcccaagaagctgggaggtagtgcagcctcccagtttctcagagggctgaggtgggaggattgcttgagccctgggggcatacaccaccacacccagctaatttttgtattttttgtagagacagagttttgccatgttgcccaggctggtctcaaaactcctggactcaaatgatcctcccacttcagcctcccaaagtgctgggattacaggcttgagccaccatgtccagcctctattccttttcatatctgttgaatttcagtacccactcatatatgtaggtacaaaaagtgacttggacttgtaccctttagggtagatgcctgagtatagtaatctctaaagctgtacatggatggaacttgttggcatcacactggtgagcaccagaggcaaagaagagaaacctgaccatgacttgctgtagtttctcagaagtgagtccattcctgatgagttactatgcaggcccttggatatgtcctcacacctactccagatttccctatgattaaatctgaattttattggtggcacttttaaattagttttataaagaactgttttgatgacaccaagaaatgttttcagtgtgcagattgctattgtttgaatatccccagcaaaattcttgttgaaacttaatccccattgtaacagtactgggtggggggtctttaagaggtgatcaggattagccaagttcatcagggtggagcctccatgatgggactggtggctttatgaggagaggaagagcaactggaactgggacacatgcttgctctgtcttgccttttgatgcctcctgccatgtcatgatgcagcaagtaagcccttaccagatgcctgcacctttatattggacttcttagccttcagaactgtgaactaaataaacctctattctgtataaatt

SEQ ID NO: 3415 - DNA, 2192 bp, Homo sapiens
agctaatgcttccgtcttggccaccttgcgagcgctcgggttgagtttcccgggcttccctgactcggctacctgttctggaggtcaggctttgggcccttgcagaggtcgccgaggggcccgcgccgccgccagagcctgggcccagtccccagtcttcagagacgccctcgaccttcctgctccgaggagctggcctgatgtcctcgggtcgcgctccgcaggttcttactttttcaaacctagagggcagtgcatgaagccaggggtcatcagccatgctccagacagtgtggttccagcagcatttccattccccaaaccagatctgatattccagctggagcaaggagaagcagcatggggcccagatccctggacacttgctgggggagaggccctgagaggcatgtgcacaggtggtaaaaccaagactgagaatgaggaaaaaactgcacagctaaacatttctaaagaatcagagtcccacagactgatagtggagggactgctgatggacgttccccagcaccctgacttcaaggacaggttagagaagtcacagctacatgatacagggaataaaacaaagataggggattgcacagatttgacagtccaggatcatgaatcttccaccactgaaagggaggagatagccaggaaattggaagaaagtagtgtcagcacacatctcattacaaagcagggttttgccaaagaacaggtgttttataaatgtggtgagtgtggcagttactacaacccacattcagactttcacctgcatcagagagttcacactaatgagaagccctacacatgcaaagaatgtgggaaaaccttcagatataactcaaaactgtcacggcatcagaaaatccacactggagagaaaccatactcatgtgaggaatgtggacaagccttcagtcaaaattcccaccttcttcagcatcagaagctccatggtggacagaggccctatgaatgtactgactgtggtaaaaccttcagttataattcaaaactgattcggcatcagagaatccatactggggagaagccctttaaatgtaaggaatgtgggaaagccttcagttgtagctatgactgcatcatccatgaacgaattcacaatggggagaagccctatgaatgtaaggagtgtgggaagagtttgagttctaattcagttctgattcagcatcagagaatccacactggggagaaaccttatgaatgtaaagagtgtggcaaggccttccaccgcagttcggtatttcttcagcaccagaggttccacactggggaacaactctacaaatgtaatgaatgttggaaaactttcagctgtagctcccgcttcatagtgcatcagagaatccacaatggggagaaaccctatgaatgccaggaatgtgggaagacattcagtcaaaagatcactctggttcagcatcagcgagttcacactggggagaaaccttatgagtgtaaggagtgcgggaaagccttcagatggaatgcaagtttcatccagcatcagaagtggcatactaggaagaaactcatcaatggaacagggctatccgcagttaagccctactgtccctgcgccatcctctctcctctgcctccccaacatacctgctctgccctagccccaccagggcctcccttatcttcttcacatgcagtggtacttcctccctctgtgcctttcttcctgctgcttccctcatctgaaaaggccaacccttcacctgtccaaatagcacatttttttcaggatctcgcttttcctgggaagtcatcccttcagagcccgaatcctttgtctcactccctgtaagccccgtcacgttctcaaaatcctttgcacctcaagttagggattccactggtctcctgattgtgtctattgatattcctctggtcttgtcttgtataagttgttactgttttcctaacttcattttaaattctcacgcttaaggaccatgtttgattagtttcttttatcccccggtaggaaatggcagtacttattctttatcgtgtccacatttgggctgtattatcagtctgcatctctcttctggggctactggagttggaagagtttgcagaacattttggggtttagggcatatggcattatgattatgatgagatggggcattataatt

SEQ ID NO: 3416 - DNA, 1869 bp, Homo sapiens
atgctccagacagtgtggttccagggcttgggcaggaacctgttgtttcaggagccagtaacctttgaggatgtggctgtgtacttcacccagaatgaatgggccagcctgcaccctacgcagagggccctatacagggaggtgatgctggagaattatgcaaatgtgacttccttgtacccaactgcagggggctttcctctggatacagagagaactgagaaggttcctggtgcactgtcttcattccttccatcttccagttccctggagctgatcttggccctattgcctatgtcagcatttccattccccaaaccagatctgatattccagctggagcaaggagaagcagcatggggcccagatccctggacacttgctgggggagaggccctgagaggcatgtgcacaggtggtaaaaccaagactgagaatgaggaaaaaactgcacagctaaacatttctaaagaatcagagtcccacagactgatagtggagggactgctgatggacgttccccagcaccctgacttcaaggacaggttagagaagtcacagctacatgatacagggaataaaacaaagataggggattgcacagatttgacagtccaggatcatgaatcttccaccactgaaagggaggagatagccaggaaattggaagaaagtagtgtcagcacacatctcattacaaagcagggttttgccaaagaacaggtgttttataaatgtggtgagtgtggcagttactacaacccacattcagactttcacctgcatcagagagttcacactaatgagaagccctacacatgcaaagaatgtgggaaaaccttcagatataactcaaaactgtcacggcatcagaaaatccacactggagagaaaccatactcatgtgaggaatgtggacaagccttcagtcaaaattcccaccttcttcagcatcagaagctccatggtggacagaggccctatgaatgtactgactgtggtaaaaccttcagttataattcaaaactgattcggcatcagagaatccatactggggagaagccctttaaatgtaaggaatgtgggaaagccttcagttgtagctatgactgcatcatccatgaacgaattcacaatggggagaagccctatgaatgtaaggagtgtgggaagagtttgagttctaattcagttctgattcagcatcagagaatccacactggggagaaaccttatgaatgtaaagagtgtggcaaggccttccaccgcagttcggtatttcttcagcaccagaggttccacactggggaacaactctacaaatgtaatgaatgttggaaaactttcagctgtagctcccgcttcatagtgcatcagagaatccacaatggggagaaaccctatgaatgccaggaatgtgggaagacattcagtcaaaagatcactctggttcagcatcagcgagttcacactggggagaaaccttatgagtgtaaggagtgcgggaaagccttcagatggaatgcaagtttcatccagcatcagaagtggcatactaggaagaaactcatcaatggaacagggctatccgcagttaagccctactgtccctgcgccatcctctctcctctgcctccccaacatacctgctctgccctagccccaccagggcctcccttatcttcttcacatgcagtggtacttcctccctctgtgcctttcttcctgctgcttccctcatctgaaaaggccaacccttcacctgtccaaatagcacatttttttcaggatctcgcttttcctgggaagtcatcccttcagagcccgaatcctttgtctcactccctgtaagccccgtcacgttctcaa

SEQ ID NO: 3417 - DNA, 2030 bp, Homo sapiens
ttgcaacatcccatgaatcagtggagagggtgaatgacagcagctagtgtgccaagaatatctgcaatgctagtggcaggagacagaggggaagaggcggcaagtgtaggagacgagacagatcagtctcattgtggttctctcttagctccgcaggttcttactttttcaaacctagagggcagtgcatgaagccaggggtcatcagccatgctccagacagtgtggttccagggcttgggcaggaacctgttgtttcaggagccagtaacctttgaggatgtggctgtgtacttcacccagaatgaatgggccagcctgcaccctacgcagagggccctatacagggaggtgatgctggagaattatgcaaatgtgacttccttgtcagcatttccattccccaaaccagatctgatattccagctggagcaaggagaagcagcatggggcccagatccctggacacttgctgggggagaggccctgagaggcatgtgcacagagtttcacttttgttgcccaggctggagtgcaatggcgtgatcttcactcaccgcaacctctgccttccaggtggtaaaaccaagactgagaatgaggaaaaaactgcacagctaaacatttctaaagaatcagagtcccacagactgatagtggagggactgctgatggacgttccccagcaccctgacttcaaggacaggttagagaagtcacagctacatgatacagggaataaaacaaagataggggattgcacagatttgacagtccaggatcatgaatcttccaccactgaaagggaggagatagccaggaaattggaagaaagtagtgtcagcacacatctcattacaaagcagggttttgccaaagaacaggtgttttataaatgtggtgagtgtggcagttactacaacccacattcagactttcacctgcatcagagagttcacactaatgagaagccctacacatgcaaagaatgtgggaaaaccttcagatataactcaaaactgtcacggcatcagaaaatccacactggagagaaaccatactcatgtgaggaatgtggacaagccttcagtcaaaattcccaccttcttcagcatcagaagctccatggtggacagaggccctatgaatgtactgactgtggtaaaaccttcagttataattcaaaactgattcggcatcagagaatccatactggggagaagccctttaaatgtaaggaatgtgggaaagccttcagttgtagctatgactgcatcatccatgaacgaattcacaatggggagaagccctatgaatgtaaggagtgtgggaagagtttgagttctaattcagttctgattcagcatcagagaatccacactggggagaaaccttatgaatgtaaagagtgtggcaaggccttccaccgcagttcggtatttcttcagcaccagaggttccacactggggaacaactctacaaatgtaatgaatgttggaaaactttcagctgtagctcccgcttcatagtgcatcagagaatccacaatggggagaaaccctatgaatgccaggaatgtgggaagacattcagtcaaaagatcactctggttcagcatcagcgagttcacactggggagaaaccttatgagtgtaaggagtgcgggaaagccttcagatggaatgcaagtttcatccagcatcagaagtggcatactaggaagaaactcatcaatggaacagggctatccgcagttaagccctactgtccctgcgccatcctctctcctctgcctccccaacatacctgctctgccctagccccaccagggcctcccttatcttcttcacatgcagtggtacttcctccctctgtgcctttcttcctgctgcttccctcatctgaaaaggccaacccttcacctgtccaaatagcacatttttttcaggatctcgcttttcctgggaagtcatcccttcagagcccgaatcctttgtctcactccctgtaagccccgtcacgttctcaa

SEQ ID NO: 3418 - DNA, 697 bp, Homo sapiens
gaaaggcggggcgggtctggccacggggcgaccgagatggcggcctccgggggcctagagggaccctgggcgtgcactcgcccttccggctcggcctttagttagtgaccagctcctcggcgttctgcagagcgtgggtttcagcgagttctacgtgccagctcttgaggatcttgcttgtccaaacccagaagacagtgcatgaagccaggggacatccgccatgctccaaacaacttggcctcaggagtcagtgacctttgaggatgtggctgtttacttcacccagaatcaatgggccagcctcgaccctgcgcagagggccctgtacggggaggtgatgctggagaattatgcaaatgtggcttctctggtagcgtttccattccccaaacctgctctgatctcccacctggagagaggggaagcaccatggggcccagatccctgggacaccgagattctgagaggcatcagtcaaggtggtgagtcctggatcaaaaatgaagggctagttataaagcaggaagcctctgaagaaacagagttgcacagaatgccagtaggaggacttctcaggaacgtttctcagcactttgattttaaaaggaaggcactgaagcagactttcaatctaaatccaaatctgatacttcgaggtggatcagttgaggtcaggagtttgagaccagcctga

SEQ ID NO: 3419 - DNA, 6378 bp, Homo sapiens
ggggcgggtctggccacggggcgaccgagatggcggcctccgggggcctagagggaccctgggcgtgcactcgcccttccggctcggcctttagttagtgaccagctcctcggcgttctgcagagcgtgggtttcagcgagttctacgtgccaggtccgcccggtgccggcttcctcgctgcccctggcggctcgtcagcccccactacccctgaacttggtcccaatggcggcccgcccctccttcacccggaccgtgggcatctgggcctcgccgaagccgtcaaggtggctgctcgggcttctagagcccgtgtccagccctttgccaccgaggcctgatcctcttttctgccctaaagaacttgccctgacagcctctggctcccgctcttgaggatcttgcttgtccaaacccagaagacagtgcatgaagccaggggacatccgccatgctccaaacaacttggcctcaggagtcagtgacctttgaggatgtggctgtttacttcacccagaatcaatgggccagcctcgaccctgcgcagagggccctgtacggggaggtgatgctggagaattatgcaaatgtggcttctctggtagcgtttccattccccaaacctgctctgatctcccacctggagagaggggaagcaccatggggcccagatccctgggacaccgagattctgagaggcatcagtcaaggtggtgagtcctggatcaaaaatgaagggctagttataaagcaggaagcctctgaagaaacagagttgcacagaatgccagtaggaggacttctcaggaacgtttctcagcactttgattttaaaaggaaggcactgaagcagactttcaatctaaatccaaatctgatacttcgaggtggaatgaagttctatgaatgtaaagaatgtgggaaaatcttccgatataactcaaagcttattcggcatcagatgagtcatactggggaaaagccctttaagtgtaaggagtgtggcaaagctttcaagtccagctatgattgtattgtacatgagaaaaaccacattggagaagggccctatgaatgtaaggagtgtggcaaaggtttgagttccaacacagccttgactcaacatcagaggatccacactggagagaaaccctatgaatgtaaagagtgtggaaaggctttccgtaggagtgcggcatacctgcagcatcagagattacacacgggagagaaactctataaatgtaaggaatgttggaaagctttcggttgtaggtcactttttattgtccatcagagaattcatactggggagaaaccttatcaatgtaaggagtgtggcaaagccttcacccagaaaatagcctccattcagcatcagagagttcacactggggagaagccttatgaatgtaaggtgtgtgggaaagccttcaaatggtatggaagttttgttcagcatcagaaattgcaccctgtggagaagaagccagtcaaggtccttgggccatccctggtcagtccccagtgctcctctccagccatacctcctgttcttctccagggatcctgttctgcttcagccgtagctgtgccttcactgacctttccacatgctgtgctcattcctacctctgggaattttttcatgctgctgcctacatctggaataccttcttcatctgcccaaatagtgcgtgtcttccagggtcttactcccactgtgaaaccttccccagttattctcaccccttcttctcactcctcatgagctttatcttggcagtcttacggctcttatgcctagcaaatctccagcctaattttatatatttttttgagaaagggtcttgctctgtcacccaggctagagtgcggtggtgtgatcttggctcactgcaacctccccctcctgggttcaagcgattctcctccttcagactctcgaatagctgggattacaggcacgcctcaccacgcccagctaatttctgtatttttagaagagatggggtttcgccatcttggccaggctggtctcaaacacctgacctcaagtgatccgcctgccttggccccccaaagtgctgggattacaggagtgagccactgtgcccagcctccaacctaatttgagtttcatttgtatttttttcatcaccttacatgtgttaacagctgtttcaacataaactccattataatctatatacatttaaagaccgtgtttacataatctcttctgggtagaaaatggaaatacttaacctttgcattggtccctttcaggcttgaacaacagtggctgtatctgcatcgtggggttgctggtggtagaacactttggtgttaggaaagtttggaaaagaggatatccctgtattaggccattatgattagagataagcagcctgggagaaacatacaagacctgtggctactggtagagaattggaataagcttccaacaatggactgtagagattaatggagattgtttagtgggcccatggctaggtggggtattaatacagttgaagttatgttgcccttggcacagatctttgagaatctcatacatctgtgaaaaagataatgtgaaataaacagtaaaaaaaaaaagtatgttgatggcagtgagagtaatcatgtctttaaacgtgaagtttttttttctttagttttgctcttgatagctagatgtttcttttaacttttatttcgtaagtaaatatacacaaaggcattcatctttgttgaatctgttgtgcagatttttcttgatgagcattctgtttttttttctttgtgagcactggcttctatattttatttcatatttatgaattataaatatgaatttaattactaaagaaataaaaataatggtgtaaagccaactcgaggggaatctgaataagcttccaaaatttttttttttaagaaataaagggagctgtgtagtgggtcagtggctaggtaggttagtgaagtggaatttggggttgctcttggaagtggccttgatgaggatcctttacaactattcagaggactgtgtgaagtagttactggaaaaagaacttgaattatgcatttattggcattaatgtaaacagtaagtcctaagctttgatggaagggtccatacattttttttttttttttgctgatgttgctatctagatgtttctctatagcaattaatagcaaaacctttacattcttggtttttaaactttaccatgtgtctgaattacatagtgtgcttgtaaaaagaagagttttctctcttgcacaaattctgattttggctatctgtggtgatggccagatctttagcatggaccatactttgagagatatgcttcaaacagaaaatgcccacccctcctcctttacccagcataaactctatggttaattcttaaaataatgccttacagtctccattaactcccttgcccttctcttgctttgtcatgctcgcttggcaaaacctcatctctgactaaatgcagttctttgccttctctgttcctgcaccaaaaatgatcaggagaaagcatattaccaggctgaactgtcactttaaattcatgaccagtaacttcatggaggcccttaacgtttcctgatggtcatactacaatttttggagtccacttaactcccctgctttcctaggccactactttatactttctctcttctgtaacttccaaagcatccctctcagttctcatgctcagctgatggttatgtttctgccttcggcgagagaacagcaagctccagaaagtggctgcgccttcagccccgtgctagaatgagaacatatggagccaacttgagttcggaagggctgtggccacctcgtttcgcccatctacttttcaccttgccgtatctgattcttcaccaccgtattctcagtcacttccactaaacagtgccagtgttttaaggttctgtcacactcagtaacccacttctggttcctcattccgtgtcagtgatcagcagtagactgaagaatctaccttagatttgctccatactattaattagcttacaaaatgtctaagaggagctaagctgggatgccacataggcagaagccaggaaaaatgaccaaccacagaaccaagtggttccagtggaaactcagcagctgctggtgcctgctactggactgccaccccccattgaagagactggaccaccaggaaggtcgtttcacattctgtagtaaaaatacccctacaatcattttggtagggtcttctgtcttcagccagggtgtacctgctcggtgggagttggttatatatgtatgtccaagttgcaggggcttctgggaaatacaggttttggattctgcctgggaagagagtcatagtatgaagaagtctgaaaatggggaagggattttcagaatatgttgagcagctgtaaaatatcagatacccattataggcattgaaggttacctaaatgacagaaggatgcactatattcatgggtaggaaagattagtttcatcaagatttcaatttttatcaattcataaattaaaaacaatataaaaattccagaggggtgtgtgtatagagaggcaaaggacacagagtagctaacctagttttgaagaacaagatggggggttttatgctaccagatattatatacaatgatcatcaaacacagaacaaagcaaaaaacaaactccccaaacccaagttgaaacaaaaaaaacccccagactgtaatagtattattattattttttaagatggaatcttgctctgttgctcaggctggagtgcagtggtgcaatcttggctcactgcaacctacacctcccgggttcaagtgattctcttgcctcagcctcctgagtagtgtgtgccaccacgcccagctaattttttaatttttagtagagacagggtttcaccatgttggccaggctggtcttgaactcctggcagcctcaagtgatccacccacctcggtctcccaaagtgttgggattacaggcgtgagccactgcacctggcctgtaacatgatttgctgaaatttttaaaaatcttaaataatgtactgtttagaaatatacatattttatacaaaattataaagaaagcatagagaggtaagcattagtggcacagctgagaaaatataaaaggtagttctgtctctatcctgtctcctttattctgctactgctctcattctgtctcatcccaggaatccagtcccaagtgctgcctgccaatcgtccagcaccctccacctttgccacctatttcttgttgtaaaacagatgtttgtttctaaaatataatgaattaatgattatcaaagtacaggcatacctcattttattgcagtttgttttattgtgtcttgcggatattgcattttttacaaactgaaggtttgtggcaggcctgtgttgagcaagactatcagtgccattttttttcaacagcatgtgctcatttcatttttctgtgtcttacacagaaacttaaaatatttcaaacttttcattatatgtgttttggtgattagtgacttttatgtttctattgtaattgttttggggtgccacagactgcatccatctaagacagtgagcttagttgatgtgtgtgtgtgtgttctgattactccactaactgatggttccccatctctctccctctcctcagacctcactattctctcagacacaacagtattgaaattagaccaattgataaccttacaaacacctttaagtgtttaagtgaaaaagtcacatgcctctcactttaaatcaaaagctagaaatgattaagcttagtgaggaaggctaatgtcaacagctgagataggccaaaagctagactgcttctgccaaacagtcaagttgtgaatgcaaaagaaaagttcttgaaggaaatgaaaagtacttctccagggaacacatgaacgataataaagtggccaggtgcagtggctgacacctagaatcccagcacttcggggagccaaagcgggaggatcccctgaagccaggagtccgagaccagcttgggccacaaagtgagacccctgtctctacaaaaaattaaaaatttagctgggtgtggttgtgcatgcctgtagtccgatctacttgggaggctgaagtgagaggatccctttagccagggagttcgagactgcagtgagctatgattgtgccactgcactctagcctgtgtgacagaatgaaaccaaaaaaagtgaaacagcattattactgatatggagaaagttttaggggtctggatcaaaccaaccacaaattcccttaagccaaaacctaatccagagcaa

SEQ ID NO: 3420 - DNA, 1979 bp, Homo sapiens
gaaaggcggggcgggtctggccacggggcgaccgagatggcggcctccgggggcctagagggaccctgggcgtgcactcgcccttccggctcggcctttagttagtgaccagctcctcggcgttctgcagagcgtgggtttcagcgagttctacgtgccagctcttgaggatcttgcttgtccaaacccagaagacagtgcatgaagccaggggacatccgccatgctccaaacaacttggcctcaggagtcagtgacctttgaggatgtggctgtttacttcacccagaatcaatgggccagcctcgaccctgcgcagagggccctgtacggggaggtgatgctggagaattatgcaaatgtggcttctctggtagcgtttccattccccaaacctgctctgatctcccacctggagagaggggaagcaccatggggcccagatccctgggacaccgagattctgagaggcatcagtcaaggtggtgagtcctggatcaaaaatgaagggctagttataaagcaggaagcctctgaagaaacagagttgcacagaatgccagtaggaggacttctcaggaacgtttctcagcactttgattttaaaaggaaggcactgaagcagactttcaatctaaatccaaatctgatacttcgaggtggaatgaagttctatgaatgtaaagaatgtgggaaaatcttccgatataactcaaagcttattcggcatcagatgagtcatactggggaaaagccctttaagtgtaaggagtgtggcaaagctttcaagtccagctatgattgtattgtacatgagaaaaaccacattggagaagggccctatgaatgtaaggagtgtggcaaaggtttgagttccaacacagccttgactcaacatcagaggatccacactggagagaaaccctatgaatgtaaagagtgtggaaaggctttccgtaggagtgcggcatacctgcagcatcagagattacacacgggagagaaactctataaatgtaaggaatgttggaaagctttcggttgtaggtcactttttattgtccatcagagaattcatactggggagaaaccttatcaatgtaaggagtgtggcaaagccttcacccagaaaatagcctccattcagcatcagagagttcacactggggagaagccttatgaatgtaaggtgtgtgggaaagccttcaaatggtatggaagttttgttcagcatcagaaattgcaccctgtggagaagaagccagtcaaggtccttgggccatccctggtcagtccccagtgctcctctccagccatacctcctgttcttctccagggatcctgttctgcttcagccgtagctgtgccttcactgacctttccacatgctgtgctcattcctacctctgggaattttttcatgctgctgcctacatctggaataccttcttcatctgcccaaatagtgcgtgtcttccagggtcttactcccactgtgaaaccttccccagttattctcaccccttcttctcactcctcatgagctttatcttggcagtcttacggctcttatgcctagcaaatctccagcctaattttatatatttttttgagaaagggtcttgctctgtcacccaggctagagtgcggtggtgtgatcttggctcactgcaacctccccctcctgggttcaagcgattctcctccttcagactctcgaatagctgggattacaggcacgcctcaccacgcccagctaatttctgtatttttagaagagatggggtttcgccatcttggccaggctggtctcaaacacctgacctcaagtgatccgcctgccttggccccccaaagtgctgggattacaggagtgagccactgtgcccagcctccaacctaatttgagtttcatttgtatttttttcatcaccttacatgtgttaacagctgtttcaacataaactccattataatct

SEQ ID NO: 3421 - DNA, 565 bp, Homo sapiens
ctcttctcctgaggttctttcttttgggtccacgtcatcgtccctctcttgaggatcttgcttgtccaaacccagaagacagtgcatgaagccaggggacatccgccatgctccaaacaacttggcctcaggagtcagtgacctttgaggatgtggctgtttacttcacccagaatcaatgggccagcctcgaccctgcgcagagggccctgtacggggaggtgatgctggagaattatgcaaatgtggcttctctggtagcgtttccattccccaaacctgctctgatctcccacctggagagaggggaagcaccatggggcccagatccctgggacaccgagattctgagaggcatcagtcaaggtggtgagtcctggatcaaaaatgaagggctagttataaagcaggaagcctctgaagaaacagagttgcacagaatgccagtaggaggacttctcaggaacgtttctcagcactttgattttaaaaggaaggcactgaagcagactttcaatctaaatccaaatctgatacttcgaggtggaatgaagttctatgaatg

SEQ ID NO: 3422 - DNA, 1823 bp, Homo sapiens
acttccggtcgcggcgggctggcggcggtgcaggctttgtcggctgatctgtggggcccgcgccggcggggtccagtcagcggctgcagggtcgggctcgcgccgtcctctccccgcccgcgccggattctaatgtaggaactggtgagaagaaggtgactgaagcctggatttctgaggatgaaaactcacataggacgacgtcagacagactcacggtgatggagctcccctctcccgagtctgaggaagtccacgagcccagattaggggagctcttgggaaatccagaaggtcagagcctggggagttccccctctcaggacaggggctgcaagcaggtgacagtgacccattggaagatccagacaggagagacagctcaagtgtgcaccaagtcaggaagaaaccatattctgaattcagaccttcttctgcttcagagagagctcatagagggggaagccaatccttgcaatatctgtggcaaaaccttcacgtttaattcggacctagttaggcatcggatttcgcatgctggggagaaaccttacacgtgcgatcagtgtgggaaaggctttggccagagctcacaccttatggagcatcagagaattcacactggagagagactctacgtctgtaatgtgtgtgggaaagacttcattcactattcaggtctcattgagcatcagcgcgttcattcaggagaaaagcccttcaaatgtgcgcagtgtgggaaggcgttttgtcacagttcagacctgattaggcaccagagagttcacaccagagagagaccttttgaatgcaaagagtgtgggaaaggcttcagtcagagctccttacttattcgccatcagaggattcacacgggagaaaggccctatgagtgcaatgaatgtgggaaatccttcataaggagctcgagcctcattcgccattatcagatccacacagaagtgaaacagtatgaatgcaaagaatgtgggaaggcattccgtcatcgctcagaccttattgaacaccagagaattcacaccggagagagaccctttgaatgcaatgagtgtgggaaagcctttattcggagttcaaagctcattcagcatcagaggatccatactggggagaggccttacgtatgcaatgagtgtgggaagcgcttcagccagacgtcaaacttcacccagcatcagagaattcacactggagagaaactctatgaatgtaacgagtgtgggaaagctttctttctgagttcataccttattcgacaccagaaaatccacactggagagagagtgtatgaatgtaaggaatgtgggaaagcgtttctccagaaagcccatctcactgagcaccagaagatccactctggggacaggcccttcgaatgtaaagactgtgggaaagccttcatccagagctccaagctgcttctgcaccagattattcacactggagaaaagccctatgtgtgcagttattgtggaaaggctttattcagaggtcaaacttccttcaacaccagaaaattcatactgaagagaagctctatgaatgtagtcagtatgggagagattttaactcaactacaaacgttaaaaataatcaaagggttcaccaagagggactctccttgagtaaggcccccatacatttgggtgagaggtctgtagataagggggaacacacaggtaacttataaaataattactttcccgcccagtgagtgatgtttggaaatgcgtggaattaggattcatgtggtttctaagatttggacatgtcagaattttgtgagtcatggatggggctgc

SEQ ID NO: 3423 - DNA, 2733 bp, Homo sapiens
ggacgggggcgggcaacgccttagccgcagccccggctggctccggagcccggccgccttgccagggcacagtccgccgagagggccgggcggggtccgcaggccgctgcccgccccgctagggcgtccaggagcggggccttggctagtcagtctcccggacgcagccacggccgcccccgcgaggctgcggcgtctctccagcgagcccgcctcgggcccgagcctggggtcttgtccctgaggagcgccgtattctaatgtaggaactggtgagaagaaggtgactgaagcctggatttctgaggatgaaaactcacataggacgacgtcagacagactcacggtgatggagctcccctctcccgagtctgaggaagtccacgagcccagattaggggagctcttgggaaatccagaaggtcagagcctggggagttccccctctcaggacaggggctgcaagcaggtgacagtgacccattggaagatccagacaggagagacagctcaagtgtgcaccaagtcaggaagaaaccatattctgaattcagaccttcttctgcttcagagagagctcatagagggggaagccaatccttgcaatatctgtggcaaaaccttcacgtttaattcggacctagttaggcatcggatttcgcatgctggggagaaaccttacacgtgcgatcagtgtgggaaaggctttggccagagctcacaccttatggagcatcagagaattcacactggagagagactctacgtctgtaatgtgtgtgggaaagacttcattcactattcaggtctcattgagcatcagcgcgttcattcaggagaaaagcccttcaaatgtgcgcagtgtgggaaggcgttttgtcacagttcagacctgattaggcaccagagagttcacaccagagagagaccttttgaatgcaaagagtgtgggaaaggcttcagtcagagctccttacttattcgccatcagaggattcacacgggagaaaggccctatgagtgcaatgaatgtgggaaatccttcataaggagctcgagcctcattcgccattatcagatccacacagaagtgaaacagtatgaatgcaaagaatgtgggaaggcattccgtcatcgctcagaccttattgaacaccagagaattcacaccggagagagaccctttgaatgcaatgagtgtgggaaagcctttattcggagttcaaagctcattcagcatcagaggatccatactggggagaggccttacgtatgcaatgagtgtgggaagcgcttcagccagacgtcaaacttcacccagcatcagagaattcacactggagagaaactctatgaatgtaacgagtgtgggaaagctttctttctgagttcataccttattcgacaccagaaaatccacactggagagagagtgtatgaatgtaaggaatgtgggaaagcgtttctccagaaagcccatctcactgagcaccagaagatccactctggggacaggcccttcgaatgtaaagactgtgggaaagccttcatccagagctccaagctgcttctgcaccagattattcacactggagaaaagccctatgtgtgcagttattgtgggaaaggctttattcagaggtcaaacttccttcaacaccagaaaattcatactgaagagaagctctatgaatgtagtcagtatgggagagattttaactcaactacaaacgttaaaaataatcaaagggttcaccaagagggactctccttgagtaaggcccccatacatttgggtgagaggtctgtagataagggggaacacacaggtaacttataaaataattactttcccgcccagtgagtgatgtttggaaatgcgtggaattaggattcatgtggtttctaagatttggacatgtcagaattttgtgagtcatggatggggctgcttttgcagtgggtgccacctgccactgtgcagccctactcggctcagcccttctcctcagctgtgagcactgtcctcaggagagtcacagggcttgacacctgactctgagctggaacagtaggggcagggagaagacaggtctcaagaaaaggtttttaagaagtttcatccccagttaagcagagtccatccttgacttaaatcccttattacagcacaactgtgtatctaatcttacgatttaggagaatgttacctaggacattttgatgtgttaagttgaagaaaggtaactcgtgtatgaaccccgagccatttccctgttgtcctgaggaggaactccaggcctcccatcgtgtgccctaaggcctcctgcgtcctggagccctgcctcccactgcctgacttcctgccacacggttaatgctgcagcaacaccgactgcttcatcttccctgtgctccacgtggcttcctacctctctcgcctttgttcttgttgaagggtctcttctcagctaattaactctgaatcatggttcaagacaagcctcaggcatcatgtcaatgggtgtttccctcaagcttagttggcagcactctccacacttctgtggctcagtgattactgctattactatatttacttgcatatgtcagaatgatgtgatagactatctctgtcactatgctgttgggttcctgaggacagtgatcatatctgattgatttccatgtgtccactgtctagcacagggcaataaaaaatacacccctaaa

SEQ ID NO: 3424 - DNA, 3947 bp, Homo sapiens
aggggcagaggaaacactttccacctcttggatatggattttatcctgccctgattcaggagatccccatctgttaagtaaggggaaagatgattttgttgtcttttgtttcagattctaatgtaggaactggtgagaagaaggtgactgaagcctggatttctgaggatgaaaactcacataggacgacgtcagacagactcacggtgatggagctcccctctcccgagtctgaggaagtccacgagcccagattaggggagctcttgggaaatccagaaggtcagagcctggggagttccccctctcaggacaggggctgcaagcaggtgacagtgacccattggaagatccagacaggagagacagctcaagtgtgcaccaagtcaggaagaaaccatattctgaattcagaccttcttctgcttcagagagagctcatagagggggaagccaatccttgcaatatctgtggcaaaaccttcacgtttaattcggacctagttaggcatcggatttcgcatgctggggagaaaccttacacgtgcgatcagtgtgggaaaggctttggccagagctcacaccttatggagcatcagagaattcacactggagagagactctacgtctgtaatgtgtgtgggaaagacttcattcactattcaggtctcattgagcatcagcgcgttcattcaggagaaaagcccttcaaatgtgcgcagtgtgggaaggcgttttgtcacagttcagacctgattaggcaccagagagttcacaccagagagagaccttttgaatgcaaagagtgtgggaaaggcttcagtcagagctccttacttattcgccatcagaggattcacacgggagaaaggccctatgagtgcaatgaatgtgggaaatccttcataaggagctcgagcctcattcgccattatcagatccacacagaagtgaaacagtatgaatgcaaagaatgtgggaaggcattccgtcatcgctcagaccttattgaacaccagagaattcacaccggagagagaccctttgaatgcaatgagtgtgggaaagcctttattcggagttcaaagctcattcagcatcagaggatccatactggggagaggccttacgtatgcaatgagtgtgggaagcgcttcagccagacgtcaaacttcacccagcatcagagaattcacactggagagaaactctatgaatgtaacgagtgtgggaaagctttctttctgagttcataccttattcgacaccagaaaatccacactggagagagagtgtatgaatgtaaggaatgtgggaaagcgtttctccagaaagcccatctcactgagcaccagaagatccactctggggacaggcccttcgaatgtaaagactgtgggaaagccttcatccagagctccaagctgcttctgcaccagattattcacactggagaaaagccctatgtgtgcagttattgtgggaaaggctttattcagaggtcaaacttccttcaacaccagaaaattcatactgaagagaagctctatgaatgtagtcagtatgggagagattttaactcaactacaaacgttaaaaataatcaaagggttcaccaagagggactctccttgagtaaggcccccatacatttgggtgagaggtctgtagataagggggaacacacaggtaacttataaaataattactttcccgcccagtgagtgatgtttggaaatgcgtggaattaggattcatgtggtttctaagatttggacatgtcagaattttgtgagtcatggatggggctgcttttgcagtgggtgccacctgccactgtgcagccctactcggctcagcccttctcctcagctgtgagcactgtcctcaggagagtcacagggcttgacacctgactctgagctggaacagtaggggcagggagaagacaggtctcaagaaaaggtttttaagaagtttcatccccagttaagcagagtccatccttgacttaaatcccttattacagcacaactgtgtatctaatcttacgatttaggagaatgttacctaggacattttgatgtgttaagttgaagaaaggtaactcgtgtatgaaccccgagccatttccctgttgtcctgaggaggaactccaggcctcccatcgtgtgccctaaggcctcctgcgtcctggagccctgcctcccactgcctgacttcctgccacacggttaatgctgcagcaacaccgactgcttcatcttccctgtgctccacgtggcttcctacctctctcgcctttgttcttgttgaagggtctcttctcagctaattaactctgaatcatggttcaagacaagcctcaggcatcatgtcaatgggtgtttccctcaagcttagttggcagcactctccacacttctgtggctcagtgattactgctattactatatttacttgcatatgtcagaatgatgtgatagactatctctgtcactatgctgttgggttcctgaggacagtgatcatatctgattgatttccatgtgtccactgtctagcacagggcaataaaaaatacacccctaaatctatgtgtaattggcatctctcttgctttgtcctttctatactgccattctaaaaattttcagctgttggctgttttttttgttgtttgttcattttgtatcagtataatctacgattctgttagaagtatcttctcagccctgctactgtctgctgctcctacttagaagttgcaggcaatatcctgtgcacatccacgccctcctgtgtgccaccttacagctcatgcagaactgtctacttgatctggagggcattgacacctggctcagctggaacagtggggacaggaggaggcaggtctcaagagaaggtctttacttacttgtctgtatctttctgtctcactcgaaaggcacagtctcaatgcgctacgtaactcttctgttgtagcagttctgaggttgaactgagctcttgtcattttccatgctctctggctcattgtgtcatttcaaaatgtattgatatctataaggaatagtcctcaatgttgggaaaacagatgagcaacccactaccctgaagtcatccaccgtgtagtggggaagacggagatcacagtagggtgagttaagtatgtgccctcaggtgtgaaggagcacaggtgagggggtgcctgctgtggcacagagctgggaaggccttacagaagaggtgacatttcagctgggccagagatcagtagagagcagctgaagaagaaaatagggtccaggagaggaatctgcagaaacatggagccatgacagatggctttttggctaggactgttcgaaagcaggcgaggtaaatggacagtggacagccgcctcgccaaactgttagtctttacctctgaatttcatctggacatgaaccccaaagtccagttttgtaacgatataatttttttctcatgaggccatattttgagttcttaaatactaccaaccctgaacgtctcaggacaaataattcaaaaaagagatctacattttctggaaaatcagcattactagagatgtttcaaatgtagattttaccagaccattttaatcaactttattgagattcaattttcatatagtaaaacgcctatttaagtgtacaaggttttgaaaaatctatacacctgtgtaaccaccaccacctgtgtaaccaccaccgccagaaccaaaaacgtttctgtcacccaaagaagttcccttttgccttttcctagttaagcccactccagccccagataaccactttctatcctcatagattagtgttgcttggtttagagcctcatacaaatggattcatttactatgtgttcttttgcgtctgatgtctcactttggcatgtttttagactcatccaagct

SEQ ID NO: 3425 - DNA, 2612 bp, Homo sapiens
tctcgcgacttccggtcgcggcgggctggcggcggtgcaggctttgtcggctgatctgtggggcccgcgccggcggggtccagtcagcggctgcagggtcgggctcgcgccgtcctctccccgcccgcgccggattctaatgtaggaactggtgagaagaaggtgactgaagcctggatttctgaggatgaaaactcacataggacgacgtcagacagactcacggtgatggagctcccctctcccgagtctgaggaagtccacgagcccagattaggggagctcttgggaaatccagaaggtcagagcctggggagttccccctctcaggacaggggctgcaagcaggtgacagtgacccattggaagatccagacaggagagacagctcaagtgtgcaccaagtcaggaagaaaccatattctgaattcagaccttcttctgcttcagagagagctcatagagggggaagccaatccttgcaatatctgtggcaaaaccttcacgtttaattcggacctagttaggcatcggatttcgcatgctggggagaaaccttacacgtgcgatcagtgtgggaaaggctttggccagagctcacaccttatggagcatcagagaattcacactggagagagactctacgtctgtaatgtgtgtgggaaagacttcattcactattcaggtctcattgagcatcagcgcgttcattcaggagaaaagcccttcaaatgtgcgcagtgtgggaaggcgttttgtcacagttcagacctgattaggcaccagagagttcacaccagagagagaccttttgaatgcaaagagtgtgggaaaggcttcagtcagagctccttacttattcgccatcagaggattcacacgggagaaaggccctatgagtgcaatgaatgtgggaaatccttcataaggagctcgagcctcattcgccattatcagatccacacagaagtgaaacagtatgaatgcaaagaatgtgggaaggcattccgtcatcgctcagaccttattgaacaccagagaattcacaccggagagagaccctttgaatgcaatgagtgtgggaaagcctttattcggagttcaaagctcattcagcatcagaggatccatactggggagaggccttacgtatgcaatgagtgtgggaagcgcttcagccagacgtcaaacttcacccagcatcagagaattcacactggagagaaactctatgaatgtaacgagtgtgggaaagctttctttctgagttcataccttattcgacaccagaaaatccacactggagagagagtgtatgaatgtaaggaatgtgggaaagcgtttctccagaaagcccatctcactgagcaccagaagatccactctggggacaggcccttcgaatgtaaagactgtgggaaagccttcatccagagctccaagctgcttctgcaccagattattcacactggagaaaagccctatgtgtgcagttattgtgggaaaggctttattcagaggtcaaacttccttcaacaccagaaaattcatactgaagagaagctctatgaatgtagtcagtatgggagagattttaactcaactacaaacgttaaaaataatcaaagggttcaccaagagggactctccttgagtaaggcccccatacatttgggtgagaggtctgtagataagggggaacacacaggtaacttataaaataattactttcccgcccagtgagtgatgtttggaaatgcgtggaattaggattcatgtggtttctaagatttggacatgtcagaattttgtgagtcatggatggggctgcttttgcagtgggtgccacctgccactgtgcagccctactcggctcagcccttctcctcagctgtgagcactgtcctcaggagagtcacagggcttgacacctgactctgagctggaacagtaggggcagggagaagacaggtctcaagaaaaggtttttaagaagtttcatccccagttaagcagagtccatccttgacttaaatcccttattacagcacaactgtgtatctaatcttacgatttaggagaatgttacctaggacattttgatgtgttaagttgaagaaaggtaactcgtgtatgaaccccgagccatttccctgttgtcctgaggaggaactccaggcctcccatcgtgtgccctaaggcctcctgcgtcctggagccctgcctcccactgcctgacttcctgccacacggttaatgctgcagcaacaccgactgcttcatcttccctgtgctccacgtggcttcctacctctctcgcctttgttcttgttgaagggtctcttctcagctaattaactctgaatcatggttcaagacaagcctcaggcatcatgtcaatgggtgtttccctcaagcttagttggcagcactctccacacttctgtggctcagtgattactgctattactatatttacttgcatatgtcagaatgatgtgatagactatctctgtcactatgctgttgggttcctgaggacagtgatcatatctgattgatttccatgtgtccactgtctagcacagggcaataaaaaatacacccctaaa

SEQ ID NO: 3426 - DNA, 5871 bp, Homo sapiens
gcaccacagaccagtctgtcctggtgttggatgttaaaagtggagccacaaagaagccatcttatgtgggacaggcttgggtgtgagaccagagctgtgggtagcagcatgttgggtcaggatgaggggcagaggaaacactttccacctcttggatatggattttatcctgccctgattcaggagatccccatctgttaagtaaggggaaagatgattttgttgtcttttgtttcagattctaatgtaggaactggtgagaagaaggtgactgaagcctggatttctgaggatgaaaactcacataggacgacgtcagacagactcacggtgatggagctcccctctcccgagtctgaggaagtccacgagcccagattaggggagctcttgggaaatccagaaggtcagagcctggggagttccccctctcaggacaggggctgcaagcaggtgacagtgacccattggaagatccagacaggagagacagctcaagtgtgcaccaagtcaggaagaaaccatattctgaattcagaccttcttctgcttcagagagagctcatagagggggaagccaatccttgcaatatctgtggcaaaaccttcacgtttaattcggacctagttaggcatcggatttcgcatgctggggagaaaccttacacgtgcgatcagtgtgggaaaggctttggccagagctcacaccttatggagcatcagagaattcacactggagagagactctacgtctgtaatgtgtgtgggaaagacttcattcactattcaggtctcattgagcatcagcgcgttcattcaggagaaaagcccttcaaatgtgcgcagtgtgggaaggcgttttgtcacagttcagacctgattaggcaccagagagttcacaccagagagagaccttttgaatgcaaagagtgtgggaaaggcttcagtcagagctccttacttattcgccatcagaggattcacacgggagaaaggccctatgagtgcaatgaatgtgggaaatccttcataaggagctcgagcctcattcgccattatcagatccacacagaagtgaaacagtatgaatgcaaagaatgtgggaaggcattccgtcatcgctcagaccttattgaacaccagagaattcacaccggagagagaccctttgaatgcaatgagtgtgggaaagcctttattcggagttcaaagctcattcagcatcagaggatccatactggggagaggccttacgtatgcaatgagtgtgggaagcgcttcagccagacgtcaaacttcacccagcatcagagaattcacactggagagaaactctatgaatgtaacgagtgtgggaaagctttctttctgagttcataccttattcgacaccagaaaatccacactggagagagagtgtatgaatgtaaggaatgtgggaaagcgtttctccagaaagcccatctcactgagcaccagaagatccactctggggacaggcccttcgaatgtaaagactgtgggaaagccttcatccagagctccaagctgcttctgcaccagattattcacactggagaaaagccctatgtgtgcagttattgtgggaaaggctttattcagaggtcaaacttccttcaacaccagaaaattcatactgaagagaagctctatgaatgtagtcagtatgggagagattttaactcaactacaaacgttaaaaataatcaaagggttcaccaagagggactctccttgagtaaggcccccatacatttgggtgagaggtctgtagataagggggaacacacaggtaacttataaaataattactttcccgcccagtgagtgatgtttggaaatgcgtggaattaggattcatgtggtttctaagatttggacatgtcagaattttgtgagtcatggatggggctgcttttgcagtgggtgccacctgccactgtgcagccctactcggctcagcccttctcctcagctgtgagcactgtcctcaggagagtcacagggcttgacacctgactctgagctggaacagtaggggcagggagaagacaggtctcaagaaaaggtttttaagaagtttcatccccagttaagcagagtccatccttgacttaaatcccttattacagcacaactgtgtatctaatcttacgatttaggagaatgttacctaggacattttgatgtgttaagttgaagaaaggtaactcgtgtatgaaccccgagccatttccctgttgtcctgaggaggaactccaggcctcccatcgtgtgccctaaggcctcctgcgtcctggagccctgcctcccactgcctgacttcctgccacacggttaatgctgcagcaacaccgactgcttcatcttccctgtgctccacgtggcttcctacctctctcgcctttgttcttgttgaagggtctcttctcagctaattaactctgaatcatggttcaagacaagcctcaggcatcatgtcaatgggtgtttccctcaagcttagttggcagcactctccacacttctgtggctcagtgattactgctattactatatttacttgcatatgtcagaatgatgtgatagactatctctgtcactatgctgttgggttcctgaggacagtgatcatatctgattgatttccatgtgtccactgtctagcacagggcaataaaaaatacacccctaaatctatgtgtaattggcatctctcttgctttgtcctttctatactgccattctaaaaattttcagctgttggctgttttttttgttgtttgttcattttgtatcagtataatctacgattctgttagaagtatcttctcagccctgctactgtctgctgctcctacttagaagttgcaggcaatatcctgtgcacatccacgccctcctgtgtgccaccttacagctcatgcagaactgtctacttgatctggagggcattgacacctggctcagctggaacagtggggacaggaggaggcaggtctcaagagaaggtctttacttacttgtctgtatctttctgtctcactcgaaaggcacagtctcaatgcgctacgtaactcttctgttgtagcagttctgaggttgaactgagctcttgtcattttccatgctctctggctcattgtgtcatttcaaaatgtattgatatctataaggaatagtcctcaatgttgggaaaacagatgagcaacccactaccctgaagtcatccaccgtgtagtggggaagacggagatcacagtagggtgagttaagtatgtgccctcaggtgtgaaggagcacaggtgagggggtgcctgctgtggcacagagctgggaaggccttacagaagaggtgacatttcagctgggccagagatcagtagagagcagctgaagaagaaaatagggtccaggagaggaatctgcagaaacatggagccatgacagatggctttttggctaggactgttcgaaagcaggcgaggtaaatggacagtggacagccgcctcgccaaactgttagtctttacctctgaatttcatctggacatgaaccccaaagtccagttttgtaacgatataatttttttctcatgaggccatattttgagttcttaaatactaccaaccctgaacgtctcaggacaaataattcaaaaaagagatctacattttctggaaaatcagcattactagagatgtttcaaatgtagattttaccagaccattttaatcaactttattgagattcaattttcatatagtaaaacgcctatttaagtgtacaaggttttgaaaaatctatacacctgtgtaaccaccaccacctgtgtaaccaccaccgccagaaccaaaaacgtttctgtcacccaaagaagttcccttttgccttttcctagttaagcccactccagccccagataaccactttctatcctcatagattagtgttgcttggtttagagcctcatacaaatggattcatttactatgtgttcttttgcgtctgatgtctcactttggcatgtttttagactcatccaagctgttttgtgtttcagtagttctccttgctgaatagtattccattgtgtggataagccatcatttgtttattcatccatgtgttaatgggtttccagtctcggctcttaaaactatgagcatttgtgtaaaagtatgtatttgcacatgtgtttttatttctcttgggtaagtacctaggactttaattgctgtgttgtaagtgtcttagttcattcaggctgccataacaaaataccatcaactgggaggcttataaacaacagaaatttatgttttacagttctggaggctgggaagtccaagatgagggtgtcaacatttggtgtctagtgagggcctgcttccttttaagtagatgtctttttactgtgactgcacgtggtggaaagggactagcaagcttaccccattcatgagggctctccccttgtgattctgtcccctccccaagaccccacctcatatcatcttatgggttaggaatttgacatgaattgtgcaaggatgtaaacattcagtccattgcaatacgtgtttctaacttcctaagaaattgtcacacagccctctgtagtggttgaatcattttacactattactacattatgggaagattccagttgctccatatctttgctaacacttggcattgtcagtctcttaaaatttaatccactctagcctccttatgattttaatttgtatttgcccactgaataatgtatgtctatgatttcatctgcttattgcttttccgtgtcgtcttttgtgatgtgtctgttcgtgccttttgcctgtttttaagttgggatgcttattgttgactcaagttctttccatattctgcatgaaaaacatacatgtaatatatagaattctttgtctccatttgtgacaaatattgtgaatattttcatgtttggtttgcctgttcattttcttaatggtgtcttttgaatattttttattaagccaccactcctggccaactgtagttgaactcaggtattggaagggcttccgttttgttcttttcccatttttttttttttgacttctagatcctttgcattttcgtataaaatttgaagtcaacttctatcaacttcaggccaggcccgtggctcatgcctgtataatcccagcactttgggaggccgaggcaggcggatcacttgaggtcaggagttcaaaaccagcctggccaagatggtgaaaccccatctctactaaaaatacaaaaaaattagccaggcgtggtggcaggcgcctgtagaatcccagctactcgggaggctgaggcaggagaattgcttgaacctgggaggtggaggtttcagtgagctgagatcgtggcattgcactctagcctgggcaaccaagagtgaaactgtctcaaaaaacaacttttatcaatgtctgcaaaaagaaagtcttctgggatttatagatcaatttagggagaaatgacattttaacaattctgagttttccaattgttgaacatggtgtactgccccatttatttagatctgttaatttctctcagtttgcagctctcacattttgttaaattcatgtatttaatatttctgcatgctattgcaagtggtaaggttttcaaaaagctgttttctagttattgctagtatatagaaatgcattagacttgtacattgatcttgtatcaagcaacttagatcagttaacttattctagtagcttttttctagattctttagcattttctatgtagataatcatgtcatctgtgaataaagtattttacttttccaattt

SEQ ID NO: 3427 - DNA, 4232 bp, Homo sapiens
accgccgagccgccgccattgctggaagcgttcccgccctgctctgcgagttccctcagttgtcctcagttcggccgccaggtatgtctttgcaagactccactctttccagagaggggaaaccagagggagagattatggctgctgtgtttttctcagttggacgcctgagccctgaagttacccagccagatgaagatcttcaccttcaggcagaagaaacacaattggtaaaggaatcggtgacatttaaggatgtggctatagacttcacattggaggagtggaggttgatggaccctacacagaggaacctgcacaaggatgtgatgctagagaattacaggaatctggtctccctggggcttgcagtttccaaaccagacatgatatctcatttggagaatgggaaaggaccatgggtgacggtgagagaaatttcaagaattccctatcctgacatggagcccaaacctgcaaccaagaaggctacacgaacaaaggctatttctgaagatttatcacaggaggccatactagagaaacttacagagaatggtctgtgggattccagaatggaagggttatggaaatggaatgataggatattgagattacaaaataatcaggagaatcatttgagtcaaagaataattccactcaagaagactcccactagtcaaagaggctttagatttgaatctattcttattccagaaccaggcattgccacagaagagcttcacagcagatgccaaacacaagaggaaaatttcacagagaatttaaatttgattacagatacccatttggggaagataatttgcaaggagatgaaaggcagcaaagccataaggcagacttcagaactaactttggggaaaaaatccaataataaggaaaaaccctacaaatgtagtacatgcgaaaaggcctttcattatagatcattgctcattcaacatcaaagaactcatactaaagaaaaaccttatgaatgtaatgaatgtgggaaaacattcagccagccttcatatctcagtcagcacaaaaaaatccacactggagaaaaaccctataaatgtaatgaatgtggaaaggccttcattgcttcttcatcacttatggtacatcagagaattcacactaaagagaaaccttatcagtgtaatgtgtgtgggaaatcttttagccagtgtgcccgtcttaatcagcaccagagaattcaaactggagagaaaccctataaatgtagtgaatgcgggaaagcttttagtgataaatcaaaacttgcaagacatcaggaaactcacaatggtgagaaaccctacaaatgtgatgattgtgggaaagcctttaggaacaagtcatatcttagtgtacatcagaagacccacactgaagagaaaccatatcagtgcaacgagtgtgggaagtcttttaagaataccacaatttttaatgtgcatcagaggattcatactggagagaaaccttttagatgtaacgaatgtggaaaagcctatagaagtaattcaagccttatcgtacatataagaactcacactggggaaaaaccctatgaatgtaatgaatgtgggaaagcattcaaccgcatcgcaaatttcacagaacatcagcgaattcacacaggagaaaaaccctataaatgtaatgaatgtgggaaagcattcattaattattcatgccttactgtacaccacagaatgcatacaggagagaaaccttataaatgtactgaatgtggaaaggccttcatgcgttcttcttctctaattatacatcagcgtattcatactgaagagaaaccttatctgtgcaatgaatgtggggagtctttcagaataaaatcacacttaactgtacatcagagaattcacactggagagaaaccatataaatgtactgactgcgagagggcattcaccaaaatggtaaatctcaaggagcatcagaaaattcatactggagtgaaaccctataaatgttatgactgtggaaagtcctttaggactaaatcataccttattgtacatcagaggacccatactggagaaaaaccatataaatgtaatgaatgtgagaaagccttcactaatacatcacagcttaccgtgcaccaacgaaggcatactggagagaagccctataaatgcaatgaatgtggaaaggttttcacaagtaactcaggctttaatacacatcaaagaacacatactggagagaaaccatttaaatgtaatgactgtgggaaagcatttagccagatggtacatgtcacagaacatcagaaaatccatagtggagagaagccctataagtgtgatgtctgtggaaaagccttcaggaggggttcttaccttacagtgcattggagaacacacactggagaaaaaccctacacctgtaaggaatgtggaaagggttgtattactctatcacagctaaccctacatcagagaattcatactggggagaggccctataaatgtgaagaatgtggaaaagccttcagaactaactcagactttactgtacacttgaggatgcatactggagaaaaaccctataaatgtaatgaatgtggaaaagccttcaggagtagttcgagccttactgtacatcaaagaatacatcaaagagaaactcagttaatataaagaacaataagtcattcacctagatgtcaactccacaagatgaatcttataaactatattttatgaatataggaaaatcttcattaggaatttatcagaaagtatacagagaaactataagcaattatgtgggaaatcatttaataatattaaatcttagaagttataaggaaactctcactagaggaaaataatgaacaaatgaaagtgttcatccagatttcatactttactcatttaacaaattatctttagttaattgcctatatatgtatttgcctatttttctattcatttatctgtcttttcttataaacctggaggtgctttttatatatttttgatattaatcctttgtcattatgtagcagatgtttttcttaatctagcatttgtctttatactttatagtaatgcacaacatttttataggaaaatatttgtatcatttcctttttagattttttattttactcattttacttaaaagagatctccttaatccctaggttatacgtagtatcctaaatgtgtttttaagatttttatgattttattttttacacttaagtctttaatccctctggactggatggttcttcataggagagcaactgtaggtgatcattatcctgtgaaaatattttgaacctaaaaagcactcagggaaatgcaaattgaaatgctcagtgagatgaaacttccccttcatggatctggcaaaaattaagagatcttttgctagctattggggtttgggaaaccatgtactattacttaaaggttgtgtaacatacttccaccagcagtccaacaatatatgtttaaaaatttaaaacatatatactcttagacccagcagtctcacttttggaatctgtccgttagaaataaaagcagcatcaatgcataagaatgtaaataaacatgtttgttgaagtactgtttgtagaggggggcaaagccccaactgcaaacaaagtgaatgcccattaatagggaactggttagataaattgtgacatacccatattatggaacagtgtgagagtaattttaaaaacgacttatatctatgctagctgatttcaatgtatttccacaatgtattgataaataattgctttataacaaatgtatatatacaatatatcatttttgttaaaataatcacacccatttattttgtgtttatgtgtgtgtgtgtggttagatgcacatggagacaggtatggaagaatatacaccaggctgttaatattgattaccttgaggggagtgagaaaaggagaagtagagataagggaaggggagactgtaaaaacagaaaaatgtaaatgctgcctttatggtataaaactgtaaatgtaatattatgtaattatgtgaacttttgagagagatgaaaggatggtctccaaaaaattaatgatggttatttctgttttagtggttcatcaattttttgttttttactttcttttctgtgtttttaagttaattttttccttgcaatgaacctgtaatatttacattaaaaggaaaaatatt

SEQ ID NO: 3428 - DNA, 594 bp, Homo sapiens
attgctggaagcgttcccgccctgctctgcgagttccctcagttgtcctcagttcggccgccaggtactcgttgtcccgggcgcctggcctcggttgcccgccgcccctcccttggcgcttggctcccggcggcgtccggggcgtggccgttccctctagagcccctgtccctgagcggacccgcccactcctgagaggcgattggggctgggcctccttcccgagtgtgggttcagtctccagctggcctccctcacaggtatgtctttgcaagactccactctttccagagaggggaaaccagagggagagattatggctgctgtgtttttctcagttggacgcctgagccctgaagttacccagccagatgaagatcttcaccttcaggcagaagaaacacaattggtaaaggaatcggtgacatttaaggatgtggctatagacttcacattggaggagtggaggttgatggaccctacacagaggaacctgcacaaggatgtgatgctagagaattacaggaatctggtctccctggggcttgcagtttccaaaccagacatgatatctcatttggagaatgggaaagg

SEQ ID NO: 3429 - DNA, 1672 bp, Homo sapiens
gcgtcttgcaccaaagggaggtcgggatctcggttttccggccccgagagggaccaggtgcctccgccatagcttctgtcgctccatcgcccgcactgtgactggactgttagagggatccgtggagaggaggccaggacacctggaagccgggaaatggattcagtggtctttgaggatgtagatgtgaacttcacccaggaggagtgggctttgctggatccttcccagaagaatctctacagagatgtgatgcaggaaaccttcaggaacctggcttctgaaaaaaatggaaagatcagaaaattgaagatgagtacaaaaatcccaggagaaacctaagaggtcttatgggagagagactcttagaaagtaagaaagatcatcagcatggagaaattttgacccaggttccagatgacatgctgaagaagaaaactccccgagtaaaatcatgtggagaagtcagcgtgggtcatgcatcccttaataggcaccacagagctgacactggacacaagccatatgagtatcaggaatatggacagaagccatataaatgtacatactgtaagaaagccttcagtgatctcccctactttcgaacacatgaatgggctcacactggggggaaaccttatgattgtgaggaatgtggaaaaagctttatttcccgttcaagcattcgaagacacaggataatgcacagtggagatggaccctacaaatgtaacttttgtgggaaagccttgatgtgtctcagtttgtatcttatccacaaacgaactcacactggagagaaaccatatgaatgtaaacagtgtggtaaagcctttagtcattctggtagccttcgaatacatgaaagaactcacactggagagaagccttatgaatgcagtgagtgtgggaaagcattccatagttccacatgcctccatgcacataaaataactcacactggggagaagccgtatgaatgtaaacagtgtgggaaagcctttgtttctttcaattccgttcgatatcatgaaagaactcacactggagagaagccctatgaatgtaagcaatgtgggaaagccttcagatctgcctcgcaccttcgaacacatggaaggactcacactggagagaaaccctatgaatgtaaacaatgtggtaaagcctttggatgtgcctcgagcgttaaaatccatgaaaggactcacactggagaaaaaccctgtagctccaacacttcgaaaggccaaggcgagaagattgcttaattcacataagattcctagaagccaccgaatccaatcatggtaaaaatgtgtttccctcaaatcatgggaaccatcgcaaaattattctgaagcttctgcagtcactgtcatttgacagcattcagaaataaatgccagtagcccaggagcaaaaatttttgggagtagtttagctggggcctcactcagatacctaggacacagagttggaaataactcttaagagagacacacctccagtaagaccttaagacagttctgtcataaaaaaaatacgaggtttggccgggtgcagtggctcatgcctataatcccagcactttgggaggccgaggcaggcggaccacgaggtcagtagttcgagaccagcctggtcaatatggtgaaaccccatctctact

SEQ ID NO: 3430 - DNA, 1322 bp, Homo sapiens
tttcctgactcccaggcgtcttgcaccaaagggaggtcgggatctcggttttccggccccgagagggaccaggtgcctccgccatagcttctgtcgctccatcgcccgcactgtgactggactgttagagggatccgtggagaggaggccaggacacctggaagccgggaaatggattcagtggtctttgaggatgtagatgtgaacttcacccaggaggagtgggctttgctggatccttcccagaagaatctctacagagatgtgatgcaggaaaccttcaggaacctggcttctgtaggaaaaaaatggaaagatcagaaaattgaagatgagtacaaaaatcccaggagaaacctaagaggtcttatgggagagagactcttagaaagtaagaaagatcatcagcatggagaaattttgacccaggttccagatgacatgctgaagaagaaaactccccgagtaaaatcatgtggagaagtcagcgtgggtcatgcatcccttaataggcaccacagagctgacactggacacaagccatatgagtatcaggaatatggacagaagccatataaatgtacatactgtaagaaagccttcagtgatctcccctactttcgaacacatgaatgggctcacactggggggaaaccttatgattgtgaggaatgtggaaaaagctttatttcccgttcaagcattcgaagacacaggataatgcacagtggagatggaccctacaaatgtaacttttgtgggaaagccttgatgtgtctcagtttgtatcttatccacaaacgaactcacactggagagaaaccatatgaatgtaaacagtgtggtaaagcctttagtcattctggtagccttcgaatacatgaaagaactcacactggagagaagccttatgaatgcagtgagtgtgggaaagcattccatagttccacatgcctccatgcacataaaataactcacactggggagaagccgtatgaatgtaaacagtgtgggaaagcctttgtttctttcaattccgttcgatatcatgaaagaactcacactggagagaagccctatgaatgtaagcaatgtgggaaagccttcagatctgcctcgcaccttcgaacacatggaaggactcacactggagagaaaccctatgaatgtaaacaatgtggtaaagcctttggatgtgcctcgagcgttaaaatccatgaaaggactcacactggagaaaaaccctgtagctccaacacttcgaaaggccaaggcgagaagattgcttaattcacataagattcctagaagccaccgaatcc

SEQ ID NO: 3431 - DNA, 1532 bp, Homo sapiens
gctttcctgactcccaggcgtcttgcaccaaagggaggtcgggatctcggttttccggccccgagagggaccaggtgcctccgccatagcttctgtcgctccatcgcccgcactgtgactggactgttagagggatccgtggagaggaggccaggacacctggaagccgggaaatggattcagtggtctttgaggatgtagatgtgaacttcacccaggaggagtgggctttgctggatccttcccagaagaatctctacagagatgtgatgcaggaaaccttcaggaacctggcttctgaaaaaaatggaaagatcagaaaattgaagatgagtacaaaaatcccaggagaaacctaagaggtcttatgggagagagactcttagaaagtaagaaagatcatcagcatggagaaattttgacccaggttccagatgacatgctgaagaagaaaactccccgagtaaaatcatgtggagaagtcagcgtgggtcatgcatcccttaataggcaccacagagctgacactggacacaagccatatgagtatcaggaatatggacagaagccatataaatgtacatactgtaagaaagccttcagtgatctcccctactttcgaacacatgaatgggctcacactggggggaaaccttatgattgtgaggaatgtggaaaaagctttatttcccgttcaagcattcgaagacacaggataatgcacagtggagatggaccctacaaatgtaacttttgtgggaaagccttgatgtgtctcagtttgtatcttatccacaaacgaactcacactggagagaaaccatatgaatgtaaacagtgtggtaaagcctttagtcattctggtagccttcgaatacatgaaagaactcacactggagagaagccttatgaatgcagtgagtgtgggaaagcattccatagttccacatgcctccatgcacataaaataactcacactggggagaagccgtatgaatgtaaacagtgtgggaaagcctttgtttctttcaattccgttcgatatcatgaaagaactcacactggagagaagccctatgaatgtaagcaatgtgggaaagccttcagatctgcctcgcaccttcgaacacatggaaggactcacactggagagaaaccctatgaatgtaaacaatgtggtaaagcctttggatgtgcctcgagcgttaaaatccatgaaaggactcacactggagaaaaaccctgtagctccaacacttcgaaaggccaaggcgagaagattgcttaattcacataagattcctagaagccaccgaatccaatcatgaaattatgtgtaccatttcagtcttagaaagtggagttggtcgctgtacgcaagacagacattggggctggactcaccatcagtggccccgaaaaggttgttgtcgggataccagatttcctactccgagaggccccgggtccctctgccacaacttctgtcgctctgccgcctgcaccgtgacccgcactattcacgggagccc

SEQ ID NO: 3432 - DNA, 1122 bp, Homo sapiens
ggtttccgggtttggtgcggcctttgtctctcgctgcagtcagagctccaggtctggttcttctcctaaaggcccaggctgtgtggccccgtgtcctgcaggtattgggagatccacagctaagacaccgggacctcctggaagccaaaaatgggaccattgcaatttagagatgtggccatagaattctctctggaggagtggcattgcctggacactgcacagcggaatttatataggaatgtgatgttagagaactacagtaacctggtcttccttggtattactgtttctaagccagacctgatcacctgtctggagcaaggaagaaaacctttgaccatgaagagaaatgagatgatagccaaaccctcagtgagcttccttcaagttcacagtgagagccaaagtcctcttcatgacatataagagactgcacagtgtggctgcttttccataatttttgggacgcacaaatgtctgcatgattttgagaaactaaaattactctcaaagttctctttgcatcagatctgaaatgtctgagagtaatagtttctgttgaatttttttttgttcatttttctgcacagtccattctgtttttattactatctaggcttgaaatatatagtttgaaattatgacatccttcctctttgttattttcctcatgattgctttggctattcaaagtttattttagtttcatgtaaatttttgaattgtattttccattattgtgaaaatagtaccactgcaattttaataggaagtttattgaatctatagattactttggataatatggcacttcaataatattcatgttttcaattcatagacaaaatattttaaaatttatttgtatcttttctaacttttcctttttttattgtaaagatttacctccttggttaatattttcctcagaaatttattatttaaggtatagtcaataaaattttcttcctctattttgtcagatagtttaagtgtatgaaaccatagatatacttgtatgttaattttatattttgctaatttactgagtgtatttattagtttagagaggttttaatgtactgtttatggttttttaaatataagattacttatttt

SEQ ID NO: 3433 - DNA, 1777 bp, Homo sapiens
ggacggtttccgggtttggtgcggcctttgtctctcgctgcagtcagagctccaggtctggttcttctcctaaaggcccaggctgtgtggccccgtgtcctgcaggtattgggagatccacagctaagacaccgggacctcctggaagccaaaaatgggaccattgcaatttagagatgtggccatagaattctctctggaggagtggcattgcctggacactgcacagcggaatttatataggaatgtgatgttagagaactacagtaacctggtcttccttggtattactgtttctaagccagacctgatcacctgtctggagcaaggaagaaaacctttgaccatgaagagaaatgagatgatagccaaaccctcagtaatgtgttctcattttgcccaagacctttggccagagcagagcatgaaagattctttccaaaaagtggtactgagaagatatgaaaaatgtgaacatgacaatttacagttaaaaaaaggatgtataagtgtggatgagtgtaaggtgcacaaagaaggttataatgaacttaaccaatgtttgacaactaccccaagaaaaatatgtcaatgtgataaatatgtgaaagtccttcatcaatttccaaattcaaacggacaaaagagaggacatactgggaaaaaacctttcaaatatatagaatgtggcaaagcttttaagcagttctcaactcttactacacataagaaaattcatactggagggaaaccctacaaatgtgaagaatgtggcaaagcctttaaccactcttgtagccttactagacataagaaaattcatactggagagaaaccctacaaatgtgaagaatgtggcaaagcctttaagcactcctccactcttactacacataagagaaatcatactggagagaaaccctacaagtgtgataaatgtggcaaagcctttatgtcatcctcaacccttagtaaacatgagataattcatacggaaaagaaaccctacaaatgtgaagaatgtggcaaagccttcaaccggtcctcaacccttactacacataagataattcatactggagaaaaaccctacaaatgtgaagaatgtgacaaagcctttaagtactcctatacccttactacacataaaagaattcatactgaagacaaaccctacaaatgtgaagaatgtggcaaagcctttaagtactcctctacccttactacacataagagaattcatactggagagaaaccctacaaatgtgaagaatgtggcaaagccttcaagcggtcttcagaccttactacgcataagataattcatactggagagaaaccctacaaatgtgaagaatgtggcaaagcttttaagtactcctctaaccttactacacataagaaaattcatactggagagagaccctacaaatgtgaagaatgtggcaaagccttcaaccagtcctcaatccttactacacataggagaattcatactggagagaaattctacaaatgtgaagaatgtggcaaagccttcaagcggtcctcacaccttactacacataagataattcatactggagagaaattctacaaatgtgaagaatgtgacaaagcttttaagcatttctctaaccttactacacataagaaaattcatactggaaaaaaaccctacagatgtgaagaatgtggcaaagcctttaagcactcctctaaacttactacacataagagatttcatactggagagaaaccctacagatgtgaataa

SEQ ID NO: 3434 - DNA, 6088 bp, Homo sapiens
ggtttccgggtttggtgcggcctttgtctctcgctgcagtcagagctccaggtctggttcttctcctaaaggcccaggctgtgtggccccgtgtcctgcaggtattgggagatccacagctaagacaccgggacctcctggaagccaaaaatgggaccattgcaatttagagatgtggccatagaattctctctggaggagtggcattgcctggacactgcacagcggaatttatataggaatgtgatgttagagaactacagtaacctggtcttccttggtattactgtttctaagccagacctgatcacctgtctggagcaaggaagaaaacctttgaccatgaagagaaatgagatgatagccaaaccctcagtaatgtgttctcattttgcccaagacctttggccagagcagagcatgaaagattctttccaaaaagtggtactgagaagatatgaaaaatgtgaacatgacaatttacagttaaaaaaaggatgtataagtgtggatgagtgtaaggtgcacaaagaaggttataatgaacttaaccaatgtttgacaactaccccaagaaaaatatgtcaatgtgataaatatgtgaaagtccttcatcaatttccaaattcaaacggacaaaagagaggacatactgggaaaaaacctttcaaatatatagaatgtggcaaagcttttaagcagttctcaactcttactacacataagaaaattcatactggagggaaaccctacaaatgtgaagaatgtggcaaagcctttaaccactcttgtagccttactagacataagaaaattcatactggagagaaaccctacaaatgtgaagaatgtggcaaagcctttaagcactcctccactcttactacacataagagaaatcatactggagagaaaccctacaagtgtgataaatgtggcaaagcctttatgtcatcctcaacccttagtaaacatgagataattcatacggaaaagaaaccctacaaatgtgaagaatgtggcaaagccttcaaccggtcctcaacccttactacacataagataattcatactggagaaaaaccctacaaatgtgaagaatgtgacaaagcctttaagtactcctatacccttactacacataaaagaattcatactgaagacaaaccctacaaatgtgaagaatgtggcaaagcctttaagtactcctctacccttactacacataagagaattcatactggagagaaaccctacaaatgtgaagaatgtggcaaagccttcaagcggtcttcagaccttactacgcataagataattcatactggagagaaaccctacaaatgtgaagaatgtggcaaagcttttaagtactcctctaaccttactacacataagaaaattcatactggagagagaccctacaaatgtgaagaatgtggcaaagccttcaaccagtcctcaatccttactacacataggagaattcatactggagagaaattctacaaatgtgaagaatgtggcaaagcttttaagtgctcctctaaccttactacacataagaaaattcatactggagagagaccctacaaatgtgaagaatgtggcaaagccttcaaccagtcctcaatccttactacacatgagagaatcatactggagagaaattctacaaatgtgaagaatgtggcaaagccttcaagcggtcctcacaccttactacacataagataattcatactggagagaaattctacaaatgtgaagaatgtgacaaagcttttaagcatttctctaaccttactacacataagaaaattcatactggaaaaaaaccctacagatgtgaagaatgtggcaaagcctttaagcactcctctaaacttactacacataagagatttcatactggagagaaaccctacagatgtgaataatgtggtaaagcttttcacctatcctcacaccttactgcacataagataattcatactggagagaaaccatgtgaatgtgatgaatggggaaaatcttttaaccagccctcaatttctaactaagaattgatatgaaatataaactctacaaatataaagaatgtgacagattttttaaggaacttctcaacctttattacacataattcatactggaaagaaaccctacaagtgtgaagaatgtggcaaagcatataacaagttctgtctttttttttttttttttgagatggagtttcaactcttgtcacccagtctggtgtgcaatagcacagtctcggctcactgcaacctccgccttctgggttcaatccattctcctgcctcaacctcccaagtaagggggattacaggtgcccacccccatgcccagctaacttttgtatttttagtagagacaaggttacaccatgtttgtcaggctggtatccaacccctgacctcacatgatccacccacctcagcctcctaaagtgttgcaattacaggcatgagccaccatgcctggccacaagttcttactattaagagacatggtgataattcattctgaagaggaactctacaaacctgaaagatgtgacagtgcttttttcaacacttccatcctttctatacataaaaaatttatactagtgtgaaaccctagaaatatataaaatgtgaaacagcctttatatggttgccacatttgatagtaagataattcatactggcaaaattcctacaagcatgaagaatgtggcaaaacctttaatcaatgtgtacatcttattttgcaggaaagctattatccttgagaaaaattgtacaaatataaagaatatggaaaacccattaatgcctactcacatcttactcaacataagaaggttcatagttaatgaaagcattaaaagtgcaattactgtcaaaaaatctttcagaaaatataagcctttaaagtgaagaagagtatttattctgaagacaaccattacaaatatacaggaggtttattacacacattttgtactagaggaaaatcctgaagcagttgctcaagctttgctcaacatcagagaacttatattggagaagggtcctgcaaatgtaatgaatttggaaacactttaaaaaaaaaaaactacagcttagaaaacagcagagtttatactaaaatatatttttgcagatgcagtaaacatgaaaaaatatttaattcaaaattaattgtatgtaaatatcagaatttacagaataactaaggcactgacacttcagacattacattaaataagagtgttgagtatataaatgaattcacaactaaagttgttaaatttgtatataagtttgtataaattagtatataactttaaaaggagattttttgaagctttgtatttacattgaaagtatatttgtttccttgaaaacaatttttttgaaaagtgaatgatgtaatacagctttcaaattatgctgttactttattatattcacgtgaaagtatgtgatcaattgttgctgcatcagagatattagagattctttatgagttgggcattctttatgaccttttctataaaacagtaaggacattaaaatgtaagatgcatgacgaaaatataagtggagaggctcattgtagttaacctatattaagtaatgtttaaggtaggtgttcagagtaatacttttctacattatactgagagaaagaaattataaattaaagtatatcaattattttactaattttactgttacgtaataaaatgcaatatatttaaaaattgttagatgatgtgtgaacttaacttatattttatttacttacttaacttttcttttgagatggagtcttgctctgtcacccaggctggagggcagcagtgcagtctcagcacaatgactgcaacctccacctcccaagttcaagaaattctcctgcctcagcctcccgagtagtggggactacaggtgcgtgacaccacgcctggctaatttttatatttttaatagacatggggtttccccatattggtcaggctagtctcaaactcctgagctcaagcgatccacccacctcaggctctcaaagtgttgggattataggtgtgagccaatatgtccagcctaattttattttattttttaccatcttaaaactattgtgcatttaatgaagcattattatgccactaactttaacctatccggccttactcaaatggtgtaagcaaaagatggaagaagtatactatttggtatgtagtggaatgtcatcactagtaatcactttgccagtaaactgcaaatgaagaatattgttcccgttagttaaatttttaatcttttttcttaatttattattactatctgtgagtatatagtatgtgtatatatgtcttatagagaatattttgattcaggcatacaatatgtagtaattacattagggtaaataaggtatctgtcacctctagcatttatcctttctaatccaaacagtgtaattatacacttttagttacttttaaatgtccaattaaattgtaattgactacagggtgatttttatggtcataataaaaattatacagaaatataaatagaatatgggctggacgcagtggctcatgcctgtaatcccagcactttggtaggcgacgtcgggcagatcatgaggtcaggagttcaagaccagcctgaccaacattgtgaaactctctactaaaacaacaaaaattagttgggcatggtggtgcacccgtattcctagctactcgggaagctgaggcaggagaatggcttgaacctgggaggtggaggtttcagtgagctgagatagcaccactgcactccagcctgggtgacagacggacactccatctcaaaaagaaagaaaaaagccaggacagtggcttacacctgtaatcccagcactttgggaggcccaggcaggtggatcatgaggtcaggagatcaagaccatcctggctaacacgttgaaaccctgtctctactaaaaataaattagctgggcgtggtggtgggcgcctgtagtcccagctactccagaggctgaggcgggagaatggtgtaacccaggaggcagaggttgcagtgagccgagatcgtgccactgcactccagcctgggcaacagagcaagactccgtcacaaaaaaaaaaagaaaaaatacggccatgtgcagtgcctcatgcctattatcccagcaatttcggaggctgaggcaggtgtgttgcttgagctcaggagttcaagaccagcctcgccaatgtggtgaaaccctgtctctactaaaaatagaaaaattagccagtcatggtggcgcacacctggaggctgaggtaggagaatcacttgaacttgggaggtggagattgcagtgagccaagattgtgctgctgcactccagcctgggtgacagagtgatgagactcctcaaaggaaaaaaaattacatttctgagtcctgaaaaattattaataaatatttgttatatagtttctttgaacatgtggtcactctgcctgcaaacgtaaagacttttaattttcatagagtgaaatatacacatattcctctgaagataaaccttaggtgtaagaaaattatgaaatgagtgtttggtaaatatgcatttgtacatattttcagaagaaaacgcaattattggaacaaaataagtttttaggtgattaatggaaaactaaacaccttgaatatgctgaaagcaaatgtatactttctgctttgtatggaatttattaatataaaattttatggcttatggctcggattctccccagaatccgtgtattaaagcacaggcaactttgtctccagaaataacactcttgagtacaacaataaaagccctcttcaaacacactcaaaaaattatttttaacgcttattttaataaaaatttaaccaaaattgaataattggatacatttttattgttctatgtgtgtgtgaatgtataaaatgacacataaaggaataataatttaagccagaaaaaaagatgttagttaatatttgtaatgaataaaactggaaagtagttatta

SEQ ID NO: 3435 - DNA, 5746 bp, Homo sapiens
aggtctggttcttctcctaaaggcccaggctgtgtggccccgtgtcctgcaggtattgggagatccacagctaagacaccgggacctcctggaagccaaaaatgggaccattgcaatttagagatgtggccatagaattctctctggaggagtggcattgcctggacactgcacagcggaatttatataggaatgtgatgttagagaactacagtaacctggtcttccttggtattactgtttctaagccagacctgatcacctgtctggagcaaggaagaaaacctttgaccatgaagagaaatgagatgatagccaaaccctcagtaatgtgttctcattttgcccaagacctttggccagagcagagcatgaaagattctttccaaaaagtggtactgagaagatatgaaaaatgtgaacatgacaatttacagttaaaaaaaggatgtataagtgtggatgagtgtaaggtgcacaaagaaggttataatgaacttaaccaatgtttgacaactaccccaagaaaaatatgtcaatgtgataaatatgtgaaagtccttcatcaatttccaaattcaaacggacaaaagagaggacatactgggaaaaaacctttcaaatatatagaatgtggcaaagcttttaagcagttctcaactcttactacacataagaaaattcatactggagggaaaccctacaaatgtgaagaatgtggcaaagcctttaaccactcttgtagccttactagacataagaaaattcatactggagagaaaccctacaaatgtgaagaatgtggcaaagcctttaagcactcctccactcttactacacataagagaaatcatactggagagaaaccctacaagtgtgataaatgtggcaaagcctttatgtcatcctcaacccttagtaaacatgagataattcatacggaaaagaaaccctacaaatgtgaagaatgtggcaaagccttcaaccggtcctcaacccttactacacataagataattcatactggagaaaaaccctacaaatgtgaagaatgtgacaaagcctttaagtactcctatacccttactacacataaaagaattcatactgaagacaaaccctacaaatgtgaagaatgtggcaaagcctttaagtactcctctacccttactacacataagagaattcatactggagagaaaccctacaaatgtgaagaatgtggcaaagccttcaagcggtcttcagaccttactacgcataagataattcatactggagagaaaccctacaaatgtgaagaatgtggcaaagcttttaagtactcctctaaccttactacacataagaaaattcatactggagagagaccctacaaatgtgaagaatgtggcaaagccttcaaccagtcctcaatccttactacacataggagaattcatactggagagaaattctacaaatgtgaagaatgtggcaaagcttttaagtgctcctctaaccttactacacataagaaaattcatactggagagagaccctacaaatgtgaagaatgtggcaaagccttcaaccagtcctcaatccttactacacatgagagaatcatactggagagaaattctacaaatgtgaagaatgtggcaaagccttcaagcggtcctcacaccttactacacataagataattcatactggagagaaattctacaaatgtgaagaatgtgacaaagcttttaagcatttctctaaccttactacacataagaaaattcatactggaaaaaaaccctacagatgtgaagaatgtggcaaagcctttaagcactcctcaatttctaactaagaattgatatgaaatataaactctacaaatataaagaatgtgacagattttttaaggaacttctcaacctttattacacataattcatactggaaagaaaccctacaagtgtgaagaatgtggcaaagcatataacaagttctgtctttttttttttttttttgagatggagtttcaactcttgtcacccagtctggtgtgcaatagcacagtctcggctcactgcaacctccgccttctgggttcaatccattctcctgcctcaacctcccaagtaagggggattacaggtgcccacccccatgcccagctaacttttgtatttttagtagagacaaggttacaccatgtttgtcaggctggtatccaacccctgacctcacatgatccacccacctcagcctcctaaagtgttgcaattacaggcatgagccaccatgcctggccacaagttcttactattaagagacatggtgataattcattctgaagaggaactctacaaacctgaaagatgtgacagtgcttttttcaacacttccatcctttctatacataaaaaatttatactagtgtgaaaccctagaaatatataaaatgtgaaacagcctttatatggttgccacatttgatagtaagataattcatactggcaaaattcctacaagcatgaagaatgtggcaaaacctttaatcaatgtgtacatcttattttgcaggaaagctattatccttgagaaaaattgtacaaatataaagaatatggaaaacccattaatgcctactcacatcttactcaacataagaaggttcatagttaatgaaagcattaaaagtgcaattactgtcaaaaaatctttcagaaaatataagcctttaaagtgaagaagagtatttattctgaagacaaccattacaaatatacaggaggtttattacacacattttgtactagaggaaaatcctgaagcagttgctcaagctttgctcaacatcagagaacttatattggagaagggtcctgcaaatgtaatgaatttggaaacactttaaaaaaaaaaaactacagcttagaaaacagcagagtttatactaaaatatatttttgcagatgcagtaaacatgaaaaaatatttaattcaaaattaattgtatgtaaatatcagaatttacagaataactaaggcactgacacttcagacattacattaaataagagtgttgagtatataaatgaattcacaactaaagttgttaaatttgtatataagtttgtataaattagtatataactttaaaaggagattttttgaagctttgtatttacattgaaagtatatttgtttccttgaaaacaatttttttgaaaagtgaatgatgtaatacagctttcaaattatgctgttactttattatattcacgtgaaagtatgtgatcaattgttgctgcatcagagatattagagattctttatgagttgggcattctttatgaccttttctataaaacagtaaggacattaaaatgtaagatgcatgacgaaaatataagtggagaggctcattgtagttaacctatattaagtaatgtttaaggtaggtgttcagagtaatacttttctacattatactgagagaaagaaattataaattaaagtatatcaattattttactaattttactgttacgtaataaaatgcaatatatttaaaaattgttagatgatgtgtgaacttaacttatattttatttacttacttaacttttcttttgagatggagtcttgctctgtcacccaggctggagggcagcagtgcagtctcagcacaatgactgcaacctccacctcccaagttcaagaaattctcctgcctcagcctcccgagtagtggggactacaggtgcgtgacaccacgcctggctaatttttatatttttaatagacatggggtttccccatattggtcaggctagtctcaaactcctgagctcaagcgatccacccacctcaggctctcaaagtgttgggattataggtgtgagccaatatgtccagcctaattttattttattttttaccatcttaaaactattgtgcatttaatgaagcattattatgccactaactttaacctatccggccttactcaaatggtgtaagcaaaagatggaagaagtatactatttggtatgtagtggaatgtcatcactagtaatcactttgccagtaaactgcaaatgaagaatattgttcccgttagttaaatttttaatcttttttcttaatttattattactatctgtgagtatatagtatgtgtatatatgtcttatagagaatattttgattcaggcatacaatatgtagtaattacattagggtaaataaggtatctgtcacctctagcatttatcctttctaatccaaacagtgtaattatacacttttagttacttttaaatgtccaattaaattgtaattgactacagggtgatttttatggtcataataaaaattatacagaaatataaatagaatatgggctggacgcagtggctcatgcctgtaatcccagcactttggtaggcgacgtcgggcagatcatgaggtcaggagttcaagaccagcctgaccaacattgtgaaactctctactaaaacaacaaaaattagttgggcatggtggtgcacccgtattcctagctactcgggaagctgaggcaggagaatggcttgaacctgggaggtggaggtttcagtgagctgagatagcaccactgcactccagcctgggtgacagacggacactccatctcaaaaagaaagaaaaaagccaggacagtggcttacacctgtaatcccagcactttgggaggcccaggcaggtggatcatgaggtcaggagatcaagaccatcctggctaacacgttgaaaccctgtctctactaaaaataaattagctgggcgtggtggtgggcgcctgtagtcccagctactccagaggctgaggcgggagaatggtgtaacccaggaggcagaggttgcagtgagccgagatcgtgccactgcactccagcctgggcaacagagcaagactccgtcacaaaaaaaaaaagaaaaaatacggccatgtgcagtgcctcatgcctattatcccagcaatttcggaggctgaggcaggtgtgttgcttgagctcaggagttcaagaccagcctcgccaatgtggtgaaaccctgtctctactaaaaatagaaaaattagccagtcatggtggcgcacacctggaggctgaggtaggagaatcacttgaacttgggaggtggagattgcagtgagccaagattgtgctgctgcactccagcctgggtgacagagtgatgagactcctcaaaggaaaaaaaattacatttctgagtcctgaaaaattattaataaatatttgttatatagtttctttgaacatgtggtcactctgcctgcaaacgtaaagacttttaattttcatagagtgaaatatacacatattcctctgaagataaaccttaggtgtaagaaaattatgaaatgagtgtttggtaaatatgcatttgtacatattttcagaagaaaacgcaattattggaacaaaataagtttttaggtgattaatggaaaactaaacaccttgaatatgctgaaagcaaatgtatactttctgctttgtatggaatttattaatataaaattttatggcttatggctcggattctccccagaatccgtgtattaaagcacaggcaactttgtctccagaaataacactcttgagtacaacaataaaagccctcttcaaacacactcaaaaaattatttttaacgcttattttaataaaaatttaaccaaaattgaataattgg

SEQ ID NO: 3436 - DNA, 5963 bp, Homo sapiens
ttccgggtttggtgcggcctttgtctctcgctgcagtcagagctccaggtctggttcttctcctaaaggcccaggctgtgtggccccgtgtcctgcaggtattgggagatccacagctaagacaccgggacctcctggaagccaaaaatgggaccattgcaatttagagatgtggccatagaattctctctggaggagtggcattgcctggacactgcacagcggaatttatataggaatgtgatgttagagaactacagtaacctggtcttccttggtattactgtttctaagccagacctgatcacctgtctggagcaaggaagaaaacctttgaccatgaagagaaatgagatgatagccaaaccctcagtaatgtgttctcattttgcccaagacctttggccagagcagagcatgaaagattctttccaaaaagtggtactgagaagatatgaaaaatgtgaacatgacaatttacagttaaaaaaaggatgtataagtgtggatgagtgtaaggtgcacaaagaaggttataatgaacttaaccaatgtttgacaactaccccaagaaaaatatgtcaatgtgataaatatgtgaaagtccttcatcaatttccaaattcaaacggacaaaagagaggacatactgggaaaaaacctttcaaatatatagaatgtggcaaagcttttaagcagttctcaactcttactacacataagaaaattcatactggagggaaaccctacaaatgtgaagaatgtggcaaagcctttaaccactcttgtagccttactagacataagaaaattcatactggagagaaaccctacaaatgtgaagaatgtggcaaagcctttaagcactcctccactcttactacacataagagaaatcatactggagagaaaccctacaagtgtgataaatgtggcaaagcctttatgtcatcctcaacccttagtaaacatgagataattcatacggaaaagaaaccctacaaatgtgaagaatgtggcaaagccttcaaccggtcctcaacccttactacacataagataattcatactggagaaaaaccctacaaatgtgaagaatgtgacaaagcctttaagtactcctatacccttactacacataaaagaattcatactgaagacaaaccctacaaatgtgaagaatgtggcaaagcctttaagtactcctctacccttactacacataagagaattcatactggagagaaaccctacaaatgtgaagaatgtggcaaagccttcaagcggtcttcagaccttactacgcataagataattcatactggagagaaaccctacaaatgtgaagaatgtggcaaagcttttaagtactcctctaaccttactacacataagaaaattcatactggagagagaccctacaaatgtgaagaatgtggcaaagccttcaaccagtcctcaatccttactacacataggagaattcatactggagagaaattctacaaatgtgaagaatgtggcaaagcttttaagtgctcctctaaccttactacacataagaaaattcatactggagagagaccctacaaatgtgaagaatgtggcaaagccttcaaccagtcctcaatccttactacacatgagagaatcatactggagagaaattctacaaatgtgaagaatgtggcaaagccttcaagcggtcctcacaccttactacacataagataattcatactggagagaaattctacaaatgtgaagaatgtgacaaagcttttaagcatttctctaaccttactacacataagaaaattcatactggaaaaaaaccctacagatgtgaagaatgtggcaaagcctttaagcactcctctaaacttactacacataagagatttcatactggagagaaaccctacagatgtgaataatgtggtaaagcttttcacctatcctcacaccttactgcacataagataattcatactggagagaaaccatgtgaatgtgatgaatggggaaaatcttttaaccagccctcaatttctaactaagaattgatatgaaatataaactctacaaatataaagaatgtgacagattttttaaggaacttctcaacctttattacacataattcatactggaaagaaaccctacaagtgtgaagaatgtggcaaagcatataacaagttctgtctttttttttttttttttgagatggagtttcaactcttgtcacccagtctggtgtgcaatagcacagtctcggctcactgcaacctccgccttctgggttcaatccattctcctgcctcaacctcccaagtaagggggattacaggtgcccacccccatgcccagctaacttttgtatttttagtagagacaaggttacaccatgtttgtcaggctggtatccaacccctgacctcacatgatccacccacctcagcctcctaaagtgttgcaattacaggcatgagccaccatgcctggccacaagttcttactattaagagacatggtgataattcattctgaagaggaactctacaaacctgaaagatgtgacagtgcttttttcaacacttccatcctttctatacataaaaaatttatactagtgtgaaaccctagaaatatataaaatgtgaaacagcctttatatggttgccacatttgatagtaagataattcatactggcaaaattcctacaagcatgaagaatgtggcaaaacctttaatcaatgtgtacatcttattttgcaggaaagctattatccttgagaaaaattgtacaaatataaagaatatggaaaacccattaatgcctactcacatcttactcaacataagaaggttcatagttaatgaaagcattaaaagtgcaattactgtcaaaaaatctttcagaaaatataagcctttaaagtgaagaagagtatttattctgaagacaaccattacaaatatacaggaggtttattacacacattttgtactagaggaaaatcctgaagcagttgctcaagctttgctcaacatcagagaacttatattggagaagggtcctgcaaatgtaatgaatttggaaacactttaaaaaaaaaaaactacagcttagaaaacagcagagtttatactaaaatatatttttgcagatgcagtaaacatgaaaaaatatttaattcaaaattaattgtatgtaaatatcagaatttacagaataactaaggcactgacacttcagacattacattaaataagagtgttgagtatataaatgaattcacaactaaagttgttaaatttgtatataagtttgtataaattagtatataactttaaaaggagattttttgaagctttgtatttacattgaaagtatatttgtttccttgaaaacaatttttttgaaaagtgaatgatgtaatacagctttcaaattatgctgttactttattatattcacgtgaaagtatgtgatcaattgttgctgcatcagagatattagagattctttatgagttgggcattctttatgaccttttctataaaacagtaaggacattaaaatgtaagatgcatgacgaaaatataagtggagaggctcattgtagttaacctatattaagtaatgtttaaggtaggtgttcagagtaatacttttctacattatactgagagaaagaaattataaattaaagtatatcaattattttactaattttactgttacgtaataaaatgcaatatatttaaaaattgttagatgatgtgtgaacttaacttatattttatttacttacttaacttttcttttgagatggagtcttgctctgtcacccaggctggagggcagcagtgcagtctcagcacaatgactgcaacctccacctcccaagttcaagaaattctcctgcctcagcctcccgagtagtggggactacaggtgcgtgacaccacgcctggctaatttttatatttttaatagacatggggtttccccatattggtcaggctagtctcaaactcctgagctcaagcgatccacccacctcaggctctcaaagtgttgggattataggtgtgagccaatatgtccagcctaattttattttattttttaccatcttaaaactattgtgcatttaatgaagcattattatgccactaactttaacctatccggccttactcaaatggtgtaagcaaaagatggaagaagtatactatttggtatgtagtggaatgtcatcactagtaatcactttgccagtaaactgcaaatgaagaatattgttcccgttagttaaatttttaatcttttttcttaatttattattactatctgtgagtatatagtatgtgtatatatgtcttatagagaatattttgattcaggcatacaatatgtagtaattacattagggtaaataaggtatctgtcacctctagcatttatcctttctaatccaaacagtgtaattatacacttttagttacttttaaatgtccaattaaattgtaattgactacagggtgatttttatggtcataataaaaattatacagaaatataaatagaatatgggctggacgcagtggctcatgcctgtaatcccagcactttggtaggcgacgtcgggcagatcatgaggtcaggagttcaagaccagcctgaccaacattgtgaaactctctactaaaacaacaaaaattagttgggcatggtggtgcacccgtattcctagctactcgggaagctgaggcaggagaatggcttgaacctgggaggtggaggtttcagtgagctgagatagcaccactgcactccagcctgggtgacagacggacactccatctcaaaaagaaagaaaaaagccaggacagtggcttacacctgtaatcccagcactttgggaggcccaggcaggtggatcatgaggtcaggagatcaagaccatcctggctaacacgttgaaaccctgtctctactaaaaataaattagctgggcgtggtggtgggcgcctgtagtcccagctactccagaggctgaggcgggagaatggtgtaacccaggaggcagaggttgcagtgagccgagatcgtgccactgcactccagcctgggcaacagagcaagactccgtcacaaaaaaaaaaagaaaaaatacggccatgtgcagtgcctcatgcctattatcccagcaatttcggaggctgaggcaggtgtgttgcttgagctcaggagttcaagaccagcctcgccaatgtggtgaaaccctgtctctactaaaaatagaaaaattagccagtcatggtggcgcacacctggaggctgaggtaggagaatcacttgaacttgggaggtggagattgcagtgagccaagattgtgctgctgcactccagcctgggtgacagagtgatgagactcctcaaaggaaaaaaaattacatttctgagtcctgaaaaattattaataaatatttgttatatagtttctttgaacatgtggtcactctgcctgcaaacgtaaagacttttaattttcatagagtgaaatatacacatattcctctgaagataaaccttaggtgtaagaaaattatgaaatgagtgtttggtaaatatgcatttgtacatattttcagaagaaaacgcaattattggaacaaaataagtttttaggtgattaatggaaaactaaacaccttgaatatgctgaaagcaaatgtatactttctgctttgtatggaatttattaatataaaattttatggcttatggctcggattctccccagaatccgtgtattaaagcacaggcaactttgtctccagaaataacactcttgagtacaacaataaaagccctcttcaaacacactcaaaaaattatttttaacgcttattttaataaaaatttaaccaaaattgaataattggata

SEQ ID NO: 3437 - DNA, 6087 bp, Homo sapiens
tcctgctccgtcccagtcaccctgaactggtccccgggtcctcagcctggaatcaccccttgagaaggaccccagagtcctcggcgcccagtccgtcccccgaggcagggcactgaaggggttaagtcccctggggctggattccgccttccggcttttcccagaccccagagccggtccctggaacactgcagtcctgagctctgggatggagcccgagactgcgctgtggggcccggatctgcagggtccggaacagagccccaacgatgctcacagaggtgccgagagtgaaaacgaagaggagagccctcggcaggaaagttctggggaggagatcatcatgggagacccggctcagagtccagaatccaaggactcaacagagatgtccctggagagatcctcccaggacccctctgtcccccagaaccccccaaccccactgggtcactccaatcccttggaccaccagatccccctggaccccccagccccggaggtagtccctaccccatctgactggaccaaggcctgcgaggccagctggcagtggggcgctctcaccacatggaacagccccccagtcgtccccgccaacgagcccagcctgcgggagctggtgcagggccgcccggcgggggcggagaagccctacatctgcaacgagtgcggcaagagcttcagccagtggtccaagctgctgcggcaccagcgcatccacacgggagagcggcccaacacctgctccgagtgcggcaagagcttcacgcagagctcgcacctggtgcagcaccagcgcacgcacaccggcgagaagccctacaagtgccccgactgcggcaagtgcttcagctggagctccaacctggtgcagcaccagcgcacgcacacgggagagaagccctacaagtgcacggagtgcgagaaagccttcacccagagcaccaacctcatcaagcaccagcgatcccacaccggcgagaagccctacaagtgcggcgagtgccgccgggctttctaccgcagctcggacctcatccagcaccaggccacccacacaggcgagaaaccctacaagtgccccgagtgcgggaagcgcttcggccagaaccacaacctcctcaagcaccagaagatccacgcgggcgagaagccataccgctgcaccgagtgcgggaagagcttcatccagagctcggagctgacccagcaccagcgcacgcacacaggcgagaagccctacgagtgcctagagtgcggcaagagcttcggccacagctccaccctcatcaagcaccagcggactcacctgcgcgaggacccgttcaagtgcccagtgtgcggcaagaccttcaccctgagcgccacgttgctgcggcaccagcgcacgcacacgggcgagcggccctacaagtgcccagagtgcggcaagagcttcagcgtcagctccaacctcatcaaccaccagcgcatccaccgcggcgagcggccctacatctgcgccgactgcggcaagagcttcatcatgagctccacccttatccgccaccagcgcatccacaccggtgagaagccctacaagtgttccgactgcggcaagagcttcatccgcagctcccaccttatccagcaccgccgcacgcacaccggcgagaagccctacaagtgccccgagtgcggcaagagcttcagccagagctccaaccttattacccacgtccgcacgcacatggacgagaacctgttcgtgtgctccgactgcgggaaggccttcctggaagcccacgagctggagcagcaccgggtgatccatgagagggggaagaccccagcgcgtagggcccagggcgacagcctgctggggctcggggacccctccctgctgaccccgccgccgggagccaagccgcacaagtgtctcgtgtgcggaaagggcttcaacgacgagggcatcttcatgcaacatcagaggatccacatcggagaaaacccctacaaaaatgcagacggcctcatcgcacacgcagcccccaaacctcctcagttacgatccccaaggctccctttcagagggaattcctaccccggggctgcggagggcagagcggaggcccccggacagccccttaagccgccggagggtcaggagggcttcagccagaggcgggggctgctgtcctccaagacctacatctgctcccactgcggagagagcttcctggatcgctctgtgctcctccagcatcagctcacccacggcaacgaaaagccctttctctttcctgattatagaattggcctaggggaaggcgcagggcccagccccttcttaagtgggaagccctttaaatgccctgaatgcaaacaaagctttggcctcagctctgagctgctgctgcaccagaaagtccatgcaggcgggaagagctcccagaagagtccagagctggggaagagctcttccgtcctcctggagcatctcaggagccccctgggggccagaccctaccgctgctcagattgcagggcctccttcctcgaccgcgtggccctcacccggcaccaagaaacccacacccaggaaaaaccccccaatcccgaggacccccctccagaggcagtcaccctgtccacagatcaggaaggtgagggcgagacccctacccccacagagagcagcagccatggggaagggcaaaaccccaaaaccctagtggaagaaaagccctatctgtgccccgagtgtggagccggcttcacagaagtcgcagccctcctgctccataggagctgccacccaggtgtctccctgtgaaatgggtctggagaccaggggcctcgctctctccagagaggaacactggattttttcccccaaaaaaattacatggggaagggaggataaccctatcagatggtagtggagtggaggagaaagaaccctgggaaaaaatagtgcttttacatcagtgatgagaaaccctataaaattgttggtgggaagcacttataaggcagtagagaaaaactgttgggttagaaaccctataaatatgtaggaaaaaaaaaagccctttaagtctgtagcagaaaaaccctataaaccatagtggataaaagccctattaattgtaggaagaggtcccaatatgtctctgaacaaccctataaaattgtatcaaaatccttaggaaaatcctatagggtcggggaagtaccgcaatggcactgacccgggagtaacgaccctcagatgatgcagaaaacacctctccctcactgttccacaatgttctctcccagcagccctggacagttctcatggaggaagatgctcagctgggggagtggtgtgggaactgggtggaactgaaaaggaagaaaataggagaaaaataagtgaccaggagctctggagcccccagaggagataagacagagactaggaagaaaaggtcccactcactgcactggggtccttggggtttgaggacaatgttagatgcattgtgtgttttagggaaagaggcctatggaatcccttatcaaaaccccaaaatggggaagaaaaaacaaattggcaagcctttttaaaggctgaagtttggggtgcagaaacatggtcagtataagaatactgagaaaccaccacaaaaattagggggaagcagggggcagtttctgttagattgctttgaggggagcaaaccaaggtggggaaactgctcacatggaacccagctaactccaggccccttcttgcttccggaagcttgcgaaactgcaagtagcaggcaggtcccagctctcagagtgcaagggttctccccacaccaggcaggaccaccctttctccctgcccagccagggacttctactctgcaaggcctccagggatggcggttgcctcccaccacattctcaggtctcaccttcaggaggtttttcctgaaatctaactgccgccagtggcagctcatttcctcaaattctgtcctcagtggagagggagaaccgctgctagtcgacctccaaagaataaagcccttcagagacttagggcctgcgtgtgggcctccccagccttctccaagtcatcagggccacagaatttcttagaaagctttgattagccagcaacttgattttaaacttcagctattcatctttgttggtagcaaggctgccccgcaggataaggcagccctcctccctggtggggatccagacaccccacagactgagccacaggtccctgaagagtccgcagaggccgtatcaccctcttcaccctggtacctggagccctccagggttgtgagatccagcccaatctcagccttgagatggatgggatggattccactcacttggctcccctctcctccttagccagaaaccttcagaaggaaacagaaggatgagaaagcctcccttgccaggcccatctcacctcccacaccacacagttacacattcataaacagccaagcctgctcacaggcctgggcatatgtggctggggagagactgttgccctatgagatggtggaagacagaaaactcttgaatgaaacatctgtaacaagactcccactccctaatcctggagaccccttcaaaaggagaggactctgctcagcgctgggtcagaaaggaagtgcttgccaaccccagtaatgcgctgtcctggagtaagaggactgagatgccagctgtggggcccgtcaggagtcacgtctcaagagaggggtgacccagatttttgcaaagctgtggaagagacctctaattccatgacctaaagtttcacacaacctttatgcaaatccttcgccatttgtctatcctggccccagcaggatgaccctcacatttaaaaggatcaaaatctcaaacattgtgggaggaaaacgccaggcctgctggggagagggagaaggcaggcctcaggattgtgcggagaaccatgttgccatctgcataacgccccagcctatccaagtgccaggaagggaagcactactgaggggggtgctgcctgtgggtctcttcctaacagaacgccaacgaagggggtgccctgtaagaatgagaagtctgccaagtctaaggagatgtccccctccccaagatggtagcagaaactgaagttgtaaagacaaacctctcgcaaagccagaagcagatgctctcaaaaacaggcctaaggaatctgttcccagaagaggcctggggagcagcttttggggctcagaggccagtctggggggaggcaggcagtgtgactgaaggccggcgcaggcctgtttcggactagggtgtagcatatttagtaggatgctcacatgttgtagggatgggtgagggctaaggggcttggctcttgtacgggatggatgatgtgagcgcacagttcgtagggtcaggcgtcttgcggtaggaaaggggcagggttcgatacctctggggtgtggcgtgttctctcttgcccacctccccaagctcctttaaccaggagcttccctcccagagtgagctacgtcttgggaggattgaagcagggaggtggcagtggctagagttgctcagatcggctcagatgaaggcccaggggtcaaagcatttgctcaccacaactgagtctggaaggcactgtgcagccaaaccctcttgtccaatcacatgcaggccccaggcccctcagaaacgccctggtggagggaggagcccaacagatagggtcagggagtcagtggggaaagcagaggggagagcttagagtgaaacttgaaactgctatggacatggaggtcagatgggaacttggaactgggcatgaatcctgaatggtggggaaacttgaagccatcacagccaagaggtggggttccatgacctgccctgaggtcagcagctcccagactcctttgccctcactagggaagccccagtcaccggacttgtccccatggagtgaagagaggccccatttttgagtgttgtgtgtccaaaacagtgttgtgtcactggtggtcatgttgcttagttgaagagaataaagggaataagatttcctgggtg

SEQ ID NO: 3438 - DNA, 3016 bp, Homo sapiens
caacgagttgtagccgcggagagcaggcgtcgatgctggcgcccaaagcctccagcctgagagtcgcctcactcgtgtgacgacagagtttcactcctgttacccaggctggaggacaatgatgtgatctcgggtcaccacaacctccgcctcccggattcaagcgattctcatgcctcagcctcccgagtagctcagattacaggcatgtgccaccacgcccggctaattttgtattttcagtcgagacggggtttccccatgttggtcaggctagtcttgaattcccgacctcaggtgatctgttcgcctcggcctcccaaagtgctgggattacaggcgtgaaccactgcacccggcgaggcattttttactgtctacagaaacttattgtaattcatttttcctcactccagtagtaagaattataccaaattgaaaagatatgaatgagtatcctaaaaaaagaaaaaggaagactctacacccttctcgttattcagattcctctggaataagcagaattgcagatggattcaatggaattttctctgatcattgttacagtgtctgttctatgagacagccagatttaaaatattttgacaacaaagatgatgattctgataccgagacgtcaaatgacttgccaaaatttgcagatggaatcaaggccagaaacagaaatcagaactacctggttcccagtcctgtacttagaattctagaccacactgccttttctacagaaaaatctgctgatattgtaatttgtgatgaagagtgtgactcacctgaatcagtcaaccagcaaacccaagaggagagtcctatagaagttcacactgctgaagatgttccaattgctgtagaagtgcatgcgatttctgaggattatgatatagagacagaaaacaattcctctgagagtctccaagaccaaactgatgaagaaccgccagctaaactttgtaaaattcttgacaagagccaagctttgaatgtgactgcccagcagaaatggcctttactgagagctaatagcagtggcctctataaatgtgaactttgtgagtttaacagcaaatatttttctgacttaaagcagcatatgatcctgaagcataaacgtactgattcaaatgtgtgtcgagtatgcaaggaaagtttctctaccaatatgcttctgatagaacatgccaaactgcatgaagaggatccctacatttgtaaatactgtgattataagacagtaatttttgagaacctcagccagcacattgcagacacccattttagtgatcacctctattggtgtgaacagtgtgatgtacagttctcctcaagcagtgaactctacctacatttccaggagcacagctgtgatgaacagtacttgtgtcagttctgtgaacatgaaactaatgatccagaagacttgcatagccatgtggtaaatgagcatgcatgtaaattaatagagttaagtgataagtataacaatggtgaacatggacagtatagcctcttaagcaaaattacctttgacaaatgtaaaaacttctttgtatgtcaagtatgtggttttcggagtagacttcacacaaatgttaacaggcatgttgctattgaacatacaaaaatttttcctcatgtttgtgatgactgtgggaaaggcttttcaagtatgctagaatattgcaagcatttaaattcacatttatctgaagggatttatttatgtcaatattgtgaatattcaacaggacaaattgaagatcttaaaattcatctagatttcaagcattcagctgacttgcctcataaatgtagtgactgcttgatgaggtttggaaatgaaagggaattaataagtcaccttccagtccatgagacaacttgattattctctttaacttacagaatgttagtttaaaataataaattcatcctttttttggagatgattaaatggatgattgtaaacacaacttatgaaatctgcctttaacaagtaacttttttaaattataaaattttattggcattgctccattttctgtatataaatatatctttaatgtggtattttcaattgcgtgatagtttgtagtttcaaccactcttggtgactgtcatcctgtttcttccatattctctgatttcatgaattgaaaagaaacaaatgtattgaagaagtgagctacagttttccttccttaaccatgggtgctagtaactttttaaaactcaagacaagattagttttttatgtgtgaagtcattaaattattacacgaccagaactaaaatgcaatatacagttaagtccacggatactcccattaatgagaaataacactaggaagccactattacaggaagaaaagatttggttttcatggcagtctgtttttttaaaaaaaaatttttgagccactatctattgttgaatattttaagatgggatgagggaggaactaataagggcttacacaataaaaaataactatatcataactcattcataacttgatgtttcattttctgttgaggaaccataaattcattcacagacttaatatttttttcttagagatggtctcgttctgttgtccaggatggagtgcagtggttgatcatagctcccgggctgtagtctcccaggctcgagcaatcctcccacttcaccctcctgcatagctaggactacaggcatgtggcaccatgcccgctaagtttttaaatttcttgtagagatgagatctcgctatgttgcccaggccagtctcaaactcctggactcaagcaatcctcccaccttggccttccaaatcactgggattataggcatgagccattatgcctgactcttgcccaaatttctgatgtcaaattgttcattgacagaaaacccactgaagtatttaaagttaggaagatctgggagataggggttgctggcatgaaaatgtataacttacaacatttattaataaaatgataaattagcatc

SEQ ID NO: 3439 - DNA, 1117 bp, Homo sapiens
ctcagattacaggcatgtgccaccacgcccggctaattttgtattttcagtcgagacggggtttccccatgttggtcaggctagtcttgaattcccgacctcaggtgatctgttcgcctcggcctcccaaagtgctgggattacaggcgtgaaccactgcacccggcgaggcattttttactgtctacagaaacttattgtaattcatttttcctcactccagtagtaagaattataccaaattgaaaagatatgaatgagtatcctaaaaaaagaaaaaggaagactctacacccttctcgttattcagattcctctggaataagcagaattgcagatggattcaatggaattttctctgatcattgttacagtgtctgttctatgagacagccagatttaaaatattttgacaacaaagatgatgattctgataccgagacgtcaaatgacttgccaaaatttgcagatggaatcaaggccagaaacagaaatcagaactacctggttcccagtcctgtacttagaattctagaccacactgccttttctacagaaaaatctgctgatattgtaatttgtgatgaagagtgtgactcacctgaatcagtcaaccagcaaacccaagaggagagtcctatagaagttcacactgctgaagatgttccaattgctgtagaagtgcatgcgatttctgaggattatgatatagagacagaaaacaattcctctgagagtctccaagaccaaactgatgaagaaccgccagctaaactttgtaaaattcttgacaagagccaagctttgaatgtgactgcccagcagaaatggcctttactgagagctaatagcagtggcctctataaatgtgaactttgtgagtttaacagcaaatatttttctgacttaaagcagcatatgatcctgaagcataaacgtactgattcaaatgtgtgtcgagtatgcaaggaaagtttctctaccaatatgcttctgatagaacatgccaaactgcatgaagaggatccctacatttgtaaatactgtgattataagacagtaatttttgagaacctcagccagcacattgcagacacccattttagtgatcacctct

SEQ ID NO: 3440 - DNA, 584 bp, Homo sapiens
gccgcctctgcgtgggccggccgggagggcctcgggggactgactgtgaattgagatggttactcaaggaatgattgtttacattgttaggcattttttactgtctacagaaacttattgtaattcatttttcctcactccagtagtaagaattataccaaattgaaaagatatgaatgagtatcctaaaaaaagaaaaaggaagactctacacccttctcgttattcagattcctctggaataagcagaattgcagatggattcaatggaattttctctgatcattgttacagtgtctgttctatgagacagccagatttaaaatattttgacaacaaagatgatgattctgataccgagacgtcaaatgacttgccaaaatttgcagatggaatcaaggccagaaacagaaatcagaactacctggttcccagtcctgtacttagaattctagaccacactgccttttctacagaaaaatctgctgatattgtaatttgtgatgaagagtgtgactcacctgaatcagtcaaccagcaaacccaagaggagagtcctatagaagttcacactgctgaagatg

SEQ ID NO: 3441 - DNA, 1730 bp, Homo sapiens
gcattttttactgtctacagaaacttattgtaattcatttttcctcactccagtagtaagaattataccaaattgaaaagatatgaatgagtatcctaaaaaaagaaaaaggaagactctacacccttctcgttattcagattcctctggaataagcagaattgcagatggattcaatggaattttctctgatcattgttacagtgtctgttctatgagacagccagatttaaaatattttgacaacaaagatgatgattctgataccgagacgtcaaatgacttgccaaaatttgcagatggaatcaaggccagaaacagaaatcagaactacctggttcccagtcctgtacttagaattctagaccacactgccttttctacagaaaaatctgctgatattgtaatttgtgatgaagagtgtgactcacctgaatcagtcaaccagcaaacccaagaggagagtcctatagaagttcacactgctgaagatgttccaattgctgtagaagtgcatgcgatttctgaggattatgatatagagacagaaaacaattcctctgagagtctccaagaccaaactgatgaagaaccgccagctaaactttgtaaaattcttgacaagagccaagctttgaatgtgactgcccagcagaaatggcctttactgagagctaatagcagtggcctctataaatgtgaactttgtgagtttaacagcaaatatttttctgacttaaagcagcatatgatcctgaagcataaacgtactgattcaaatgtgtgtcgagtatgcaaggaaagtttctctaccaatatgcttctgatagaacatgccaaactgcatgaagaggatccctacatttgtaaatactgtgattataagacagtaatttttgagaacctcagccagcacattgcagacacccattttagtgatcacctctattggtgtgaacagtgtgatgtacagttctcctcaagcagtgaactctacctacatttccaggagcacagctgtgatgaacagtacttgtgtcagttctgtgaacatgaaactaatgatccagaagacttgcatagccatgtggtaaatgagcatgcatgtaaattaatagagttaagtgataagtataacaatggtgaacatggacagtatagcctcttaagcaaaattacctttgacaaatgtaaaaacttctttgtatgtcaagtatgtggttttcggagtagacttcacacaaatgttaacaggcatgttgctattgaacatacaaaaatttttcctcatgtttgtgatgactgtgggaaaggcttttcaagtatgctagaatattgcaagcatttaaattcacatttatctgaagggatttatttatgtcaatattgtgaatattcaacaggacaaattgaagatcttaaaattcatctagatttcaagcattcagctgacttgcctcataaatgtagtgactgcttgatgaggtttggaaatgaaagggaattaataagtcaccttccagtccatgagacaacttgattattctctttaacttacagaatgttagtttaaaataataaattcatcctttttttggagatgattaaatggatgattgtaaacacaacttatgaaatctgcctttaacaagtaacttttttaaattataaaattttattggcattgctccattttctgtatataaatatatctttaatgtggtattttc

SEQ ID NO: 3442 - DNA, 1228 bp, Homo sapiens
gccgcggagcctaggccaggggcctggcgctcagggcgtggggcgcgcggggagggagaggggtcggcccagcacagcgtccgggagcgctagggccggagcagcgctgcccgccgccgtgcgtccgcgggaaggaccgcgcggcccctccgcctgcgctctcggccgccgccgcctctgcgtgggccggccgggagggcctcgggggactgactgacagagtttcactcctgttacccaggctggaggacaatgatgtgatctcgggtcaccacaacctccgcctcccggattcaagcgattctcatgcctcagcctcccgagtagctcagattacaggcatgtgccaccacgcccggctaattttgtattttcagtcgagacggggtttccccatgttggtcaggctagtcttgaattcccgacctcaggtgatctgttcgcctcggcctcccaaagtgctgggattacaggcgtgaaccactgcacccggcgaggcattttttactgtctacagaaacttattgtaattcatttttcctcactccagtagtaagaattataccaaattgaaaagatatgaatgagtatcctaaaaaaagaaaaaggaagactctacacccttctcgttattcagattcctctggaataagcagaattgcagatggattcaatggaattttctctgatcattgttacagtgtctgttctatgagacagccagatttaaaatattttgacaacaaagatgatgattctgataccgagacgtcaaatgacttgccaaaatttgcagatggaatcaaggccagaaacagaaatcagaactacctggttcccagtcctgtacttagaattctagaccacactgccttttctacagaaaaatctgctgatattgtaatttgtgatgaagagtgtgactcacctgaatcagtcaaccagcaaacccaagaggagagtcctatagaagttcacactgctgaagatgttccaattgctgtagaagtgcatgcgatttctgaggattatgatatagagacagaaaacaattcctctgagagtctccaagaccaaactgatgaagaaccgccagctaaactttgtaaaattcttgacaagagccaagctttgaatgtgactgcccagcagaaatggcctttactgagagctaatagcagtggcctctataaatgtgaactttgtgagtttaacagcaaatattttt

SEQ ID NO: 3443 - DNA, 564 bp, Homo sapiens
aaataggaaaatgatttttttcttgaaaattatttatattctgatctgtgtgatgagtacttttttctggaagccaggaggccgatacatatttgtgacaatatttttttaaaggaaatgtctccgcctttagcttgaaaactacctaaaaatacttccaatgattgaaaagatatgaatgagtatcctaaaaaaagaaaaaggaagactctacacccttctcgttattcagattcctctggaataagcagaattgcagatggattcaatggaattttctctgatcattgttacagtgtctgttctatgagacagccagatttaaaatattttgacaacaaagatgatgattctgataccgagacgtcaaatgacttgccaaaatttgcagatggaatcaaggccagaaacagaaatcagaactacctggttcccagtcctgtacttagaattctagaccacactgccttttctacagaaaaatctgctgatattgtaatttgtgatgaagagtgtgactcacctgaatcagtcaaccagcaaacccaagaggagagtcctata

SEQ ID NO: 3444 - DNA, 2033 bp, Homo sapiens
acctcacctcgtcacctccccgccctctcggcgggcccctgaggtgcgcggcgcaggcgcggagcgtggcggccagggcagtgcggccgcggagcctaggccaggggcctggcgctcagggcgtggggcgcgcggggagggagaggggtcggcccagcacagcgtccgggagcgctagggccggagcagcgctgcccgccgccgtgcgtccgcgggaaggaccgcgcggcccctccgcctgcgctctcggccgccgccgcctctgcgtgggccggccgggagggcctcgggggactgactggcattttttactgtctacagaaacttattgtaattcatttttcctcactccagtagtaagaattataccaaattgaaaagatatgaatgagtatcctaaaaaaagaaaaaggaagactctacacccttctcgttattcagattcctctggaataagcagaattgcagatggattcaatggaattttctctgatcattgttacagtgtctgttctatgagacagccagatttaaaatattttgacaacaaagatgatgattctgataccgagacgtcaaatgacttgccaaaatttgcagatggaatcaaggccagaaacagaaatcagaactacctggttcccagtcctgtacttagaattctagaccacactgccttttctacagaaaaatctgctgatattgtaatttgtgatgaagagtgtgactcacctgaatcagtcaaccagcaaacccaagaggagagtcctatagaagttcacactgctgaagatgttccaattgctgtagaagtgcatgcgatttctgaggattatgatatagagacagaaaacaattcctctgagagtctccaagaccaaactgatgaagaaccgccagctaaactttgtaaaattcttgacaagagccaagctttgaatgtgactgcccagcagaaatggcctttactgagagctaatagcagtggcctctataaatgtgaactttgtgagtttaacagcaaatatttttctgacttaaagcagcatatgatcctgaagcataaacgtactgattcaaatgtgtgtcgagtatgcaaggaaagtttctctaccaatatgcttctgatagaacatgccaaactgcatgaagaggatccctacatttgtaaatactgtgattataagacagtaatttttgagaacctcagccagcacattgcagacacccattttagtgatcacctctattggtgtgaacagtgtgatgtacagttctcctcaagcagtgaactctacctacatttccaggagcacagctgtgatgaacagtacttgtgtcagttctgtgaacatgaaactaatgatccagaagacttgcatagccatgtggtaaatgagcatgcatgtaaattaatagagttaagtgataagtataacaatggtgaacatggacagtatagcctcttaagcaaaattacctttgacaaatgtaaaaacttctttgtatgtcaagtatgtggttttcggagtagacttcacacaaatgttaacaggcatgttgctattgaacatacaaaaatttttcctcatgtttgtgatgactgtgggaaaggcttttcaagtatgctagaatattgcaagcatttaaattcacatttatctgaagggatttatttatgtcaatattgtgaatattcaacaggacaaattgaagatcttaaaattcatctagatttcaagcattcagctgacttgcctcataaatgtagtgactgcttgatgaggtttggaaatgaaagggaattaataagtcaccttccagtccatgagacaacttgattattctctttaacttacagaatgttagtttaaaataataaattcatcctttttttggagatgattaaatggatgattgtaaacacaacttatgaaatctgcctttaacaagtaacttttttaaattataaaattttattggcattgctccattttctgtatataaatatatctttaatgtggtattttcaa

SEQ ID NO: 3445 - DNA, 3264 bp, Homo sapiens
gggcaggggcgcatccctcgccacccgcggtcgcccagcacgccgggacgcgcgtggccatccagctccccgggggcgttggggggctccgcgggcctgggcctcgggattcgcccgccgcttccccggggagccgctgctgcaaagccaggttggggcgccgggcccggccagcgccctctaggcagcggaagtgcagcttgctttacatccgtcctccccgcctcgcagagttgggagaaggcagggtggggggtgtggaaaaataaaaggaaaagtccttgcaccatgtagatcagcgtcccccactttggcatcccggccggccggggacctcccagtctgcggccatgaacgcgagcagcgagggcgagagcttcgcgggctcggtgcaaattccaggtggcacaacggtgctggtggagctgactcccgacatccatatctgcggcatctgcaagcagcagtttaacaacctggatgcctttgtagctcacaagcaaagtggctgccagctgacaggcacatccgcagcagcccccagcacggtccagtttgtatcggaggaaacagtgcctgccacccagactcagaccaccaccagaaccatcacctcggagacccagacaatcacagtttcagctccagaatttgtttttgaacatggctatcaaacttacctgcccacggaaagtaatgaaaaccagacagccactgtcatctctctccctgccaagtcacgcaccaaaaagcccacaacaccacctgctcagaaaaggcttaactgttgctatccaggttgccaattcaagactgcttatggcatgaaggacatggagcggcatttaaaaattcacacgggagacaaaccccataagtgtgaagtctgtggcaagtgctttagccggaaagacaagctgaaaactcacatgcggtgccacacgggcgtgaagccctacaagtgtaagacgtgtgactacgccgctgccgacagcagcagcctcaacaagcacctgaggatccactcggacgagcggcccttcaaatgccagatctgcccctacgccagccgcaactccagccagctcactgtccacctgcgatcccacacgggggacgcccccttccagtgctggctctgtagcgccaagttcaaaatcagctcggacttgaaaaggcacatgcgggtgcactcgggggagaagcctttcaagtgcgagttctgcaatgtccgctgcaccatgaaggggaacctcaagtcgcacatccgtatcaagcacagcgggaataacttcaagtgtcctcattgcgacttcctgggtgacagcaaagccaccctccggaagcacagccgcgtgcaccagtcggagcatcctgagaagtgctcggaatgcagctactcctgctccagcaaggccgccctgcgcatccacgagcgtatccactgcaccgaccgccctttcaagtgcaactactgcagcttcgacaccaaacagcccagcaacctgagcaagcacatgaagaagttccatggggacatggttaagactgaggctctagagaggaaggacaccggcaggcagagcagccggcaggtggccaagctggatgccaagaagagtttccactgcgatatatgcgatgcctccttcatgcgggaggactcgctccgcagccacaagagacagcacagtgagtacagtgagagtaagaactcggacgtgaccgttctccagtttcagatcgaccccagcaagcagcccgccacgcccctcactgtgggacacctccaggtgcccctccagcccagccaagtgccccagttcagcgagggaagagtcaaaatcatcgttgggcatcaggtgccccaggcgaacaccatcgtccaggctgccgccgctgcagtgaacatcgtcccgcctgccttggtggcccagaacccagaggaactcccagggaacagccggctgcagatcctgcgccaggtcagtctgatcgccccccctcagtcctcgcggtgtccgagcgaggcgggcgcaatgacccagccggctgtcctgctgaccacccacgagcagacggacggagccactctgcaccagactctcatccccacggcctcaggtggcccccaggaaggctctggcaatcaaactttcattaccagttcgggtattacttgcactgactttgaaggcctaaacgccttgattcaggaggggacagcagaagtgacagtggtgagcgatggaggccagaacatcgcagtggccaccacagcgccaccggtcttctcctcctcttcccagcaagaactacccaagcagacctactccatcattcaaggggcagcccatccagctttgctctgtcccgccgactccattccagattagtgcttaaaaaaacaaaaggagtgggggaaaggaattgagaaaaagaaatcttaagtagaattctctaaaaggtttgctcttaatgttttctttgttttgttttgtttttgagacggagtctcgctctgtttcccaggctggagtgcagtggcgctatcttggctcactgcaacgtccgcctcccaggttcaagcgattctcatgcctcagccctccgagtagctgggaccacaggtgtacgacatcatgactggctaatttttgtatatttagtagagacggggtttcatcatgttgaactcctgacctcaagtgatctgcccacctcagcctcccaaagtgctgggattacaggtgtgagccaccatgcctggccgtggtttgctcttaatgtttttaaggatggttgtgaatccccctggccccataataaattgtaattttatactgcttactataatttttttaacactgtaacaactttgagaccacctctgaatcgtcgcattataactgttgtagaatcttaaatgttaccaagatgattccaatgaggggttggaattaaatgcattaagtagtgaattcatgtgtttgtttccaacttgattttccaactctaataaaggtttctgtccatcttattacatttgtgtagtaaatggtacttcccagcctctcttttgccccattctggaatactccccagagtttgggggtgttcatgttttatacatgtaagtctgttggcatgaaggaccattttctacataatatgacatggatacttgacccaaaaaaaaatgtttagtgctaatgagcagaaaatgaatggttccataataaattgatatctgattaaaatata

SEQ ID NO: 3446 - DNA, 2876 bp, Homo sapiens
cgcagagttgggagaaggcagggtggggggtgtggaaaaataaaaggaaaagtccttgcaccatgtagatcagcgtcccccactttggcatcccggccggccggggacctcccagtctgcggccatgaacgcgagcagcgagggcgagagcttcgcgggctcggtgcaaattccaggtggcacaacggtgctggtggagctgactcccgacatccatatctgcggcatctgcaagcagcagtttaacaacctggatgcctttgtagctcacaagcaaagtggctgccagctgacaggcacatccgcagcagcccccagcacggtccagtttgtatcggaggaaacagtgcctgccacccagactcagaccaccaccagaaccatcacctcggagacccagacaatcacaggttgccaattcaagactgcttatggcatgaaggacatggagcggcatttaaaaattcacacgggagacaaaccccataagtgtgaagtctgtggcaagtgctttagccggaaagacaagctgaaaactcacatgcggtgccacacgggcgtgaagccctacaagtgtaagacgtgtgactacgccgctgccgacagcagcagcctcaacaagcacctgaggatccactcggacgagcggcccttcaaatgccagatctgcccctacgccagccgcaactccagccagctcactgtccacctgcgatcccacacgggggacgcccccttccagtgctggctctgtagcgccaagttcaaaatcagctcggacttgaaaaggcacatgcgggtgcactcgggggagaagcctttcaagtgcgagttctgcaatgtccgctgcaccatgaaggggaacctcaagtcgcacatccgtatcaagcacagcgggaataacttcaagtgtcctcattgcgacttcctgggtgacagcaaagccaccctccggaagcacagccgcgtgcaccagtcggagcatcctgagaagtgctcggaatgcagctactcctgctccagcaaggccgccctgcgcatccacgagcgtatccactgcaccgaccgccctttcaagtgcaactactgcagcttcgacaccaaacagcccagcaacctgagcaagcacatgaagaagttccatggggacatggttaagactgaggctctagagaggaaggacaccggcaggcagagcagccggcaggtggccaagctggatgccaagaagagtttccactgcgatatatgcgatgcctccttcatgcgggaggactcgctccgcagccacaagagacagcacagtgagtacagtgagagtaagaactcggacgtgaccgttctccagtttcagatcgaccccagcaagcagcccgccacgcccctcactgtgggacacctccaggtgcccctccagcccagccaagtgccccagttcagcgagggaagagtcaaaatcatcgttgggcatcaggtgccccaggcgaacaccatcgtccaggctgccgccgctgcagtgaacatcgtcccgcctgccttggtggcccagaacccagaggaactcccagggaacagccggctgcagatcctgcgccaggtcagtctgatcgccccccctcagtcctcgcggtgtccgagcgaggcgggcgcaatgacccagccggctgtcctgctgaccacccacgagcagacggacggagccactctgcaccagactctcatccccacggcctcaggtggcccccaggaaggctctggcaatcaaactttcattaccagttcgggtattacttgcactgactttgaaggcctaaacgccttgattcaggaggggacagcagaagtgacagtggtgagcgatggaggccagaacatcgcagtggccaccacagcgccaccggtcttctcctcctcttcccagcaagaactacccaagcagacctactccatcattcaaggggcagcccatccagctttgctctgtcccgccgactccattccagattagtgcttaaaaaaacaaaaggagtgggggaaaggaattgagaaaaagaaatcttaagtagaattctctaaaaggtttgctcttaatgttttctttgttttgttttgtttttgagacggagtctcgctctgtttcccaggctggagtgcagtggcgctatcttggctcactgcaacgtccgcctcccaggttcaagcgattctcatgcctcagccctccgagtagctgggaccacaggtgtacgacatcatgactggctaatttttgtatatttagtagagacggggtttcatcatgttgaactcctgacctcaagtgatctgcccacctcagcctcccaaagtgctgggattacaggtgtgagccaccatgcctggccgtggtttgctcttaatgtttttaaggatggttgtgaatccccctggccccataataaattgtaattttatactgcttactataatttttttaacactgtaacaactttgagaccacctctgaatcgtcgcattataactgttgtagaatcttaaatgttaccaagatgattccaatgaggggttggaattaaatgcattaagtagtgaattcatgtgtttgtttccaacttgattttccaactctaataaaggtttctgtccatcttattacatttgtgtagtaaatggtacttcccagcctctcttttgccccattctggaatactccccagagtttgggggtgttcatgttttatacatgtaagtctgttggcatgaaggaccattttctacataatatgacatggatacttgacccaaaaaaaaatgtttagtgctaatgagcagaaaatgaatggttccataataaattgatatctgattaaaatata

SEQ ID NO: 3447 - DNA, 2545 bp, Homo sapiens
tgtagatcagcgtcccccactttggcatcccggccggccggggacctcccagtctgcggccatgaacgcgagcagcgagggcgagagcttcgcgggctcggtgcaaattccaggtggcacaacggtgctggtggagctgactcccgacatccatatctgcggcatctgcaagcagcagtttaacaacctggatgcctttgtagctcacaagcaaagtggctgccagctgacaggcacatccgcagcagcccccagcacggtccagtttgtatcggaggaaacagtgcctgccacccagactcagaccaccaccagaaccatcacctcggagacccagacaatcacagtttcagctccagaatttgtttttgaacatggctatcaaacttacctgcccacggaaagtaatgaaaaccagacagccactgtcatctctctccctgccaagtcacgcaccaaaaagcccacaacaccacctgctcagaaaaggcttaactgttgctatccaggttgccaattcaagactgcttatggcatgaaggacatggagcggcatttaaaaattcacacgggagacaaaccccataagtgtgaagtctgtggcaagtgctttagccggaaagacaagctgaaaactcacatgcggtgccacacgggcgtgaagccctacaagtgtaagacgtgtgactacgccgctgccgacagcagcagcctcaacaagcacctgaggatccactcggacgagcggcccttcaaatgccagatctgcccctacgccagccgcaactccagccagctcactgtccacctgcgatcccacacggcttcagaacttgatgatgatgttccaaaagcaaactgcctctccactgaaagcactgacactccgaaggcccctgtcatcactcttccctcagaggcaagggaacaaatggccacccttggagagaggacgttcaactgttgctacccaggttgccacttcaaaactgtccatggcatgaaagacttggaccgccatctcagaatccacacgggagacaaaccgcacaagtgtgagttctgtgacaagtgcttcagccggaaggacaacctgaccatgcacatgcggtgccacaccagtgtgaagccacacaagtgtcacctgtgtgactacgctgccgtggacagcagtagcctcaagaagcacctgcggatccactctgatgagcggccgtacaaatgccagctctgcccctatgccagccgcaactccagccagctcaccgtccacctgcgatctcacacgggggatacccccttccagtgctggctctgtagcgccaagttcaaaatcagctcggacttgaaaaggcacatgatcgtgcactcgggggagaagcctttcaagtgcgagttctgcgacgtccgctgcaccatgaaggcgaatctcaaatcgcacatccgcatcaagcacaccttcaaatgtctgcactgtgccttccagggccgggaccgggctgacctcctggagcacagccggctgcaccaggccgaccacccggagaagtgtccagagtgcagctactcctgctccagcgcggccgccctgcgcgtgcacagcagagtccactgtaaggaccgtcccttcaagtgtgacttctgcagcttcgacacgaagcggcccagcagcctggccaagcacgtcgacaaggtgcacagggacgaggccaagacggagaaccgggcccctctgggcaaggaagggctcagagagggcagctcccagcacgtggccaagatcgtgacgcagagggccttccgctgtgagacctgcggcgcctccttcgtcagggatgactctctgagatgccacaagaagcagcacagtgatcagagtgagaacaagaactcagacttggtcaccttcccaccggaaagcggtgcctcgggacagctcagcaccctggtctccgtggggcagctcgaggctcccctagagcccagccaagacctctagctcagccgaagagggtggtcagctgtcggaacttctgaccagtgctgttgcccagccctccagaggtgaggccactgagagacaggctttgggcaccacttctggggctggccgctccaacttcacaggccttcagaggcgatggctgggcgacagtgacgaaagcaaagcaaagcagggctgtggagacactcctcgcatttgtctcttccctccaaggattatctgagcaagtcgacttgttcattcaaaggcggggtctgccaagccctgctctatccaatggggatagcttctacgtaacggattccaattttaaaactgatccatctctgatggaattattaaacttagacgatatagaaaactaaaactaatctctagagtggaaagggttaaagtgaggaaggtgtacgtgaagggtctggggttgctggaaaacttctatttcataacctgggtgatcgttctaagagtgtttgccttatatgtttgtgtggtttcttttacctgttgtcttacaataaaaaaggcagactcatggta

SEQ ID NO: 3448 - DNA, 3040 bp, Homo sapiens
ccccgcctcgcagagttgggagaaggcagggtggggggtgtggaaaaataaaaggaaaagtccttgcaccatgtagatcagcgtcccccactttggcatcccggccggccggggacctcccagtctgcggccatgaacgcgagcagcgagggcgagagcttcgcgggctcggtgcaaagtggcacaacggtgctggtggagctgactcccgacatccatatctgcggcatctgcaagcagcagtttaacaacctggatgcctttgtagctcacaagcaaagtggctgccagctgacaggcacatccgcagcagcccccagcacggtccagtttgtatcggaggaaacagtgcctgccacccagactcagaccaccaccagaaccatcacctcggagacccagacaatcacagtttcagctccagaatttgtttttgaacatggctatcaaacttacctgcccacggaaagtaatgaaaaccagacagccactgtcatctctctccctgccaagtcacgcaccaaaaagcccacaacaccacctgctcagaaaaggcttaactgttgctatccaggttgccaattcaagactgcttatggcatgaaggacatggagcggcatttaaaaattcacacgggagacaaaccccataagtgtgaagtctgtggcaagtgctttagccggaaagacaagctgaaaactcacatgcggtgccacacgggcgtgaagccctacaagtgtaagacgtgtgactacgccgctgccgacagcagcagcctcaacaagcacctgaggatccactcggacgagcggcccttcaaatgccagatctgcccctacgccagccgcaactccagccagctcactgtccacctgcgatcccacacgggggacgcccccttccagtgctggctctgtagcgccaagttcaaaatcagctcggacttgaaaaggcacatgcgggtgcactcgggggagaagcctttcaagtgcgagttctgcaatgtccgctgcaccatgaaggggaacctcaagtcgcacatccgtatcaagcacagcgggaataacttcaagtgtcctcattgcgacttcctgggtgacagcaaagccaccctccggaagcacagccgcgtgcaccagtcggagcatcctgagaagtgctcggaatgcagctactcctgctccagcaaggccgccctgcgcatccacgagcgtatccactgcaccgaccgccctttcaagtgcaactactgcagcttcgacaccaaacagcccagcaacctgagcaagcacatgaagaagttccatggggacatggttaagactgaggctctagagaggaaggacaccggcaggcagagcagccggcaggtggccaagctggatgccaagaagagtttccactgcgatatatgcgatgcctccttcatgcgggaggactcgctccgcagccacaagagacagcacagtgagtacagtgagagtaagaactcggacgtgaccgttctccagtttcagatcgaccccagcaagcagcccgccacgcccctcactgtgggacacctccaggtgcccctccagcccagccaagtgccccagttcagcgagggaagagtcaaaatcatcgttgggcatcaggtgccccaggcgaacaccatcgtccaggctgccgccgctgcagtgaacatcgtcccgcctgccttggtggcccagaacccagaggaactcccagggaacagccggctgcagatcctgcgccaggtcagtctgatcgccccccctcagtcctcgcggtgtccgagcgaggcgggcgcaatgacccagccggctgtcctgctgaccacccacgagcagacggacggagccactctgcaccagactctcatccccacggcctcaggtggcccccaggaaggctctggcaatcaaactttcattaccagttcgggtattacttgcactgactttgaaggcctaaacgccttgattcaggaggggacagcagaagtgacagtggtgagcgatggaggccagaacatcgcagtggccaccacagcgccaccggtcttctcctcctcttcccagcaagaactacccaagcagacctactccatcattcaaggggcagcccatccagctttgctctgtcccgccgactccattccagattagtgcttaaaaaaacaaaaggagtgggggaaaggaattgagaaaaagaaatcttaagtagaattctctaaaaggtttgctcttaatgttttctttgttttgttttgtttttgagacggagtctcgctctgtttcccaggctggagtgcagtggcgctatcttggctcactgcaacgtccgcctcccaggttcaagcgattctcatgcctcagccctccgagtagctgggaccacaggtgtacgacatcatgactggctaatttttgtatatttagtagagacggggtttcatcatgttgaactcctgacctcaagtgatctgcccacctcagcctcccaaagtgctgggattacaggtgtgagccaccatgcctggccgtggtttgctcttaatgtttttaaggatggttgtgaatccccctggccccataataaattgtaattttatactgcttactataatttttttaacactgtaacaactttgagaccacctctgaatcgtcgcattataactgttgtagaatcttaaatgttaccaagatgattccaatgaggggttggaattaaatgcattaagtagtgaattcatgtgtttgtttccaacttgattttccaactctaataaaggtttctgtccatcttattacatttgtgtagtaaatggtacttcccagcctctcttttgccccattctggaatactccccagagtttgggggtgttcatgttttatacatgtaagtctgttggcatgaaggaccattttctacataatatgacatggatacttgacccaaaaaaaaatgtttagtgctaatgagcagaaaatgaatggttccataataaattgatatctgattaaaatata

SEQ ID NO: 3449 - DNA, 2278 bp, Homo sapiens
ggcaggggcgcatccctcgccacccgcggtcgcccagcacgccgggacgcgcgtggccatccagctccccgggggcgttggggggctccgcgggcctgggcctcgggattcgcccgccgcttccccggggagccgctgctgcaaagccaggttggggcgccgggcccggccagcgccctctaggcagcggaagtgcagcttgctttacatccgtcctccccgcctcgcagagttgggagaaggcagggtggggggtgtggaaaaataaaaggaaaagtccttgcaccatgtagatcagcgtcccccactttggcatcccggccggccggggacctcccagtctgcggccatgaacgcgagcagcgagggcgagagcttcgcgggctcggtgcaaattccaggtggcacaacggtgctggtggagctgactcccgacatccatatctgcggcatctgcaagcagcagtttaacaacctggatgcctttgtagctcacaagcaaagtggctgccagctgacaggcacatccgcagcagcccccagcacggtccagtttgtatcggaggaaacagtgcctgccacccagactcagaccaccaccagaaccatcacctcggagacccagacaatcacagtttcagctccagaatttgtttttgaacatggctatcaaacttacctgcccacggaaagtaatgaaaaccagacagccactgtcatctctctccctgccaagtcacgcaccaaaaagcccacaacaccacctgctcagaaaaggcttaactgttgctatccaggtaaaggcagcattatgtcctacttgtgtagaggcttaggaagatatccatcagaaataatttcagatgtacagaaaagttgcaaaaattgtaccaaaaaaaattccccaaatgttaccattttattatatttgctttgtcattctttgtatatatacaaattacttcagtgtgtatttcctaaaaaccagaatattcttttaaataaccacaggacaatcatcaagtcagatttcgtcatcaagtgtcattttatgtctttcatttcctctaatcaagaacagttaagcatttatctttcattcaggttatgcagttttggcaggaaccacaaaatgacggtgtgtttttcccggtcatcacatatttttcccattaccgtggtgttaactcttgtcacttggttaaggatgtttctaccagttttctccatgctaaaactttcctttttttttttaggttgccaattcaagactgcttatggcatgaaggacatggagcggcatttaaaaattcacacgggagacaaaccccataagtgtgaagtctgtggcaagtgctttagccggaaagacaagctgaaaactcacatgcggtgccacacgggcgtgaagccctacaagtgtaagacgtgtgactacgccgctgccgacagcagcagcctcaacaagcacctgaggatccactcggacgagcggcccttcaaatgccagatctgcccctacgccagccgcaactccagccagctcactgtccacctgcgatcccacacgggggacgcccccttccagtgctggctctgtagcgccaagttcaaaatcagctcggacttgaaaaggcacatgcgggtgcactcgggggagaagcctttcaagtgcgagttctgcaatgtccgctgcaccatgaaggggaacctcaagtcgcacatccgtatcaagcacagcgggaataacttcaagtgtcctcattgcgacttcctgggtgacagcaaagccaccctccggaagcacagccgcgtgcaccagtcggagcatcctgagaagtgctcggaatgcagctactcctgctccagcaaggccgccctgcgcatccacgagcgtatccactgcaccgaccgccctttcaagtgcaactactgcagcttcgacaccaaacagcccagcaacctgagcaagcacatgaagaagttccatggggacatggttaagactgaggctctagagaggaaggacaccggcaggcagagcagccggcaggtggccaagctggatgccaagaagagtttccactgcgatatatgcgatgcctccttcatgcgggaggactcgctccgcagccacaagagacagcacagtgagtacagtgagagtaagaactcggacgtgaccgttctccagtttcagatcgaccccagcaagcagcccgccacgcccctcactgtgggacacctccaggtgcccctccagcccagccaagtgccc

SEQ ID NO: 3450 - DNA, 2234 bp, Homo sapiens
ctgcgcttctgaaattttaatgggcaaacgaatcacctggggatctcgttaaaatgcagacacggtttctcaaactttaatgtgcatgcgaatcacctggggatcttgttaaaatgcagattctgattcagcgggtctggggtagagcccgagagtctgcatttctaacgagctcccaggtggcgcgggctgcccgggagcggaccgcaagtccgcgggactcctggggtcttggctccaggccaatcagccgtcaggactcttgataaatcgccctgctcggctgatgagcagaattgccgggacatgcgcgttccggccgaaggggggtaatttccgaactccgggaattcgttgtgtgaagtaggccactcctagggacgcgcggggagcccggtcctcgcgccatgtcgcggcgcaagcaggccaagccccagcacctcaactccgaggagccgcggcctgcgcgccgggagtgtgcggaggtggccccgcaggtggcgggggagccggcttcagaacttgatgatgatgttccaaaagcaaactgcctctccactgaaagcactgacactccgaaggcccctgtcatcactcttccctcagaggcaagggaacaaatggccacccttggagagaggacgttcaactgttgctacccaggttgccacttcaaaactgtccatggcatgaaagacttggaccgccatctcagaatccacacgggagacaaaccgcacaagtgtgagttctgtgacaagtgcttcagccggaaggacaacctgaccatgcacatgcggtgccacaccagtgtgaagccacacaagtgtcacctgtgtgactacgctgccgtggacagcagtagcctcaagaagcacctgcggatccactctgatgagcggccgtacaaatgccagctctgcccctatgccagccgcaactccagccagctcaccgtccacctgcgatctcacacgggggatacccccttccagtgctggctctgtagcgccaagttcaaaatcagctcggacttgaaaaggcacatgatcgtgcactcgggggagaagcctttcaagtgcgagttctgcgacgtccgctgcaccatgaaggcgaatctcaaatcgcacatccgcatcaagcacaccttcaaatgtctgcactgtgccttccagggccgggaccgggctgacctcctggagcacagccggctgcaccaggccgaccacccggagaagtgtccagagtgcagctactcctgctccagcgcggccgccctgcgcgtgcacagcagagtccactgtaaggaccgtcccttcaagtgtgacttctgcagcttcgacacgaagcggcccagcagcctggccaagcacgtcgacaaggtgcacagggacgaggccaagacggagaaccgggcccctctgggcaaggaagggctcagagagggcagctcccagcacgtggccaagatcgtgacgcagagggccttccgctgtgagacctgcggcgcctccttcgtcagggatgactctctgagatgccacaagaagcagcacagtgatcagagtgagaacaagaactcagacttggtcaccttcccaccggaaagcggtgcctcgggacagctcagcaccctggtctccgtggggcagctcgaggctcccctagagcccagccaagacctctagctcagccgaagagggtggtcagctgtcggaacttctgaccagtgctgttgcccagccctccagaggtgaggccactgagagacaggctttgggcaccacttctggggctggccgctccaacttcacaggccttcagaggcgatggctgggcgacagtgacgaaagcaaagcaaagcagggctgtggagacactcctcgcatttgtctcttccctccaaggattatctgagcaagtcgacttgttcattcaaaggcggggtctgccaagccctgctctatccaatggggatagcttctacgtaacggattccaattttaaaactgatccatctctgatggaattattaaacttagacgatatagaaaactaaaactaatctctagagtggaaagggttaaagtgaggaaggtgtacgtgaagggtctggggttgctggaaaacttctatttcataacctgggtgatcgttctaagagtgtttgccttatatgtttgtgtggtttcttttacctgttgtcttacaataaaaaaggcagactcatggta

SEQ ID NO: 3451 - DNA, 710 bp, Homo sapiens
aggacccctcagaggctgttttcgggatgcgcgggcacccgagtctccggcctccttggcactgggcttcggctgcgcgcctggaaggtggcttcttgccttggggttacgtttcaaatgcgttgtccagggaaggcctcaccgaggagcggacgttcgagcgaagacccgaaggatgggagggagcgagctgtgcagcttcagaacttgatgatgatgttccaaaagcaaactgcctctccactgaaagcactgacactccgaaggcccctgtcatcactcttccctcagaggcaagggaacaaatggccacccttggagagaggacgttcaactgttgctacccaggttgccacttcaaaactgtccatggcatgaaagacttggaccgccatctcagaatccacacggccagctgctgagaagagaaataagacctgctgaagcaaaggagtgccataatctatgccaggattacaaactgcagcccatgggcaactcagcctgttggcatgctccttcatttacctattgcttgcagctttctggccttacaagaggtagttgttacagggactgtagggtgcacaaagcctaaaatactatctttttgttttgtttttttctctgagacagagtcctgctctgtcacccaggctagaatgcagtggtgcaatctcagttcattgcgacccctgcctcccaggttc

SEQ ID NO: 3452 - DNA, 762 bp, Homo sapiens
ggattcctctagccactcctctcaagagctagtcaacgagtttgcctcccaaacacgctggaaggatgctcagaggacccctcagaggctgttttcgggatgcgcgggcacccgagtctccggcctccttggcactgggcttcggctgcgcgcctggaaggtggcttcttgccttggggttacgtttcaaatgcgttgtccagggaaggcctcaccgaggagcggacgttcgagcgaagacccgaaggatgggagggagcgagctgtgcagcttcagaacttgatgatgatgttccaaaagcaaactgcctctccactgaaagcactgacactccgaaggcccctgtcatcactcttccctcagaggcaagggaacaaatggccacccttggagagaggacgttcaactgttgctacccaggttgccacttcaaaactgtccatggcatgaaagacttggaccgccatctcagaatccacacgggagacaaaccgcacaagtgtgagttctgtgacaagtgcttcagccggaaggacaacctgaccatgcacatgcggtgccacaccagtgtgaagccacacaagtgtcacctgtgtgactacgctgccgtggacagcagtagcctcaagaagcacctgcggatccactctgatgagcggccgtacaaatgccagctctgcccctatgccagccgcaactccagccagctcaccgtccacctgcgatctcacacgggggatacccccttccagtgctggctc

SEQ ID NO: 3453 - DNA, 445 bp, Homo sapiens
agagaggacgttcaactgttgctacccaggttgccacttcaaaactgtccatggcatgaaagacttggaccgccatctcagaatccacacgggagacaaaccgcacaagtgtgagttctgtgacaagtgcttcagccggaaggacaacctgaccatgcacatgcggtgccacaccagtgtgaagccacacaagtgtcacctgtgtgactacgctgccgtggacagcagtagcctcaagaagcacctgcggatccactctgatgagcggccgtacaaatgccagctctgcccctatgccagccgcaactccagccagctcaccgtccacctgcgatctcacacggggccgggaccgggctgacctcctggagcacagccggctgcaccaggccgaccacccggagaagtgtccagagtgcagctactcctgctccagcgcggccgc

SEQ ID NO: 3454 - DNA, 2922 bp, Homo sapiens
gtggaaaaataaaaggaaaagtccttgcaccatgtagatcagcgtcccccactttggcatcccggccggccggggacctcccagtctgcggccatgaacgcgagcagcgagggcgagagcttcgcgggctcggtgcaaattccaggtggcacaacggtgctggtggagctgactcccgacatccatatctgcggcatctgcaagcagcagtttaacaacctggatgcctttgtagctcacaagcaaagtggctgccagctgacaggcacatccgcagcagcccccagacaatcacagtttcagctccagaatttgtttttgaacatggctatcaaacttacctgcccacggaaagtaatgaaaaccagacagccactgtcatctctctccctgccaagtcacgcaccaaaaagcccacaacaccacctgctcagaaaaggcttaactgttgctatccaggttgccaattcaagactgcttatggcatgaaggacatggagcggcatttaaaaattcacacgggagacaaaccccataagtgtgaagtctgtggcaagtgctttagccggaaagacaagctgaaaactcacatgcggtgccacacgggcgtgaagccctacaagtgtaagacgtgtgactacgccgctgccgacagcagcagcctcaacaagcacctgaggatccactcggacgagcggcccttcaaatgccagatctgcccctacgccagccgcaactccagccagctcactgtccacctgcgatcccacacgggggacgcccccttccagtgctggctctgtagcgccaagttcaaaatcagctcggacttgaaaaggcacatgcgggtgcactcgggggagaagcctttcaagtgcgagttctgcaatgtccgctgcaccatgaaggggaacctcaagtcgcacatccgtatcaagcacagcgggaataacttcaagtgtcctcattgcgacttcctgggtgacagcaaagccaccctccggaagcacagccgcgtgcaccagtcggagcatcctgagaagtgctcggaatgcagctactcctgctccagcaaggccgccctgcgcatccacgagcgtatccactgcaccgaccgccctttcaagtgcaactactgcagcttcgacaccaaacagcccagcaacctgagcaagcacatgaagaagttccatggggacatggttaagactgaggctctagagaggaaggacaccggcaggcagagcagccggcaggtggccaagctggatgccaagaagagtttccactgcgatatatgcgatgcctccttcatgcgggaggactcgctccgcagccacaagagacagcacagtgagtacagtgagagtaagaactcggacgtgaccgttctccagtttcagatcgaccccagcaagcagcccgccacgcccctcactgtgggacacctccaggtgcccctccagcccagccaagtgccccagttcagcgagggaagagtcaaaatcatcgttgggcatcaggtgccccaggcgaacaccatcgtccaggctgccgccgctgcagtgaacatcgtcccgcctgccttggtggcccagaacccagaggaactcccagggaacagccggctgcagatcctgcgccaggtcagtctgatcgccccccctcagtcctcgcggtgtccgagcgaggcgggcgcaatgacccagccggctgtcctgctgaccacccacgagcagacggacggagccactctgcaccagactctcatccccacggcctcaggtggcccccaggaaggctctggcaatcaaactttcattaccagttcgggtattacttgcactgactttgaaggcctaaacgccttgattcaggaggggacagcagaagtgacagtggtgagcgatggaggccagaacatcgcagtggccaccacagcgccaccggtcttctcctcctcttcccagcaagaactacccaagcagacctactccatcattcaaggggcagcccatccagctttgctctgtcccgccgactccattccagattagtgcttaaaaaaacaaaaggagtgggggaaaggaattgagaaaaagaaatcttaagtagaattctctaaaaggtttgctcttaatgttttctttgttttgttttgtttttgagacggagtctcgctctgtttcccaggctggagtgcagtggcgctatcttggctcactgcaacgtccgcctcccaggttcaagcgattctcatgcctcagccctccgagtagctgggaccacaggtgtacgacatcatgactggctaatttttgtatatttagtagagacggggtttcatcatgttgaactcctgacctcaagtgatctgcccacctcagcctcccaaagtgctgggattacaggtgtgagccaccatgcctggccgtggtttgctcttaatgtttttaaggatggttgtgaatccccctggccccataataaattgtaattttatactgcttactataatttttttaacactgtaacaactttgagaccacctctgaatcgtcgcattataactgttgtagaatcttaaatgttaccaagatgattccaatgaggggttggaattaaatgcattaagtagtgaattcatgtgtttgtttccaacttgattttccaactctaataaaggtttctgtccatcttattacatttgtgtagtaaatggtacttcccagcctctcttttgccccattctggaatactccccagagtttgggggtgttcatgttttatacatgtaagtctgttggcatgaaggaccattttctacataatatgacatggatacttgacccaaaaaaaaatgtttagtgctaatgagcagaaaatgaatggttccataataaattgatatctgattaaaat

SEQ ID NO: 3455 - DNA, 2104 bp, Homo sapiens
gatgggaatgtggagcagaccctcgtccactccggaggccgagggtcctccgggcttccgaaggaagccgacctcaacgctggacgcttcttggagaatgattgcgttgagtggagatgtggtctgtctataaaaggccgggagggaacaatatctgttaccactcagtccgtctctaaagagacactctttaccgctgaaaacctcaagagtgagcactcccacgcccccgtctctggtcctacctgggtccaaggccgatgtgaagtggacaagtccagtaaggcaggcatcatgccacagcagctcctgatcaccctgcctaccgaggccagcacctgggtgaagctgcaacatccaaagaaggccgtggagggggcgcccctgtgggaggatgtgactaaaatgtttgaaggagaagctctgctgtctcaggatgctgaggacgtaaagacccagagagaaagtttagaggatgaagtgacccctggactcccgacagcagaatcccaggaattgttgactttcaaggacatatctattgacttcacccaggaagagtgggggcagctggctcctgctcaccagaatctataccgagaggtgatgctggagaactacagcaacttggtgtcagtgggatatcaactttccaaacctagtgtgatatcccagttagagaaaggagaagagccatggatggcagagaaagaaggcccaggagatcccagttcagacttgaagagtaaaatagaaaccattgagtcaactgcaaagagtaccatttcacaggagcgcttatatcatggcattatgatggaaagtttcatgagggatgatataatttattccacgttgagaaaagtctccacatatgatgatgtcttagaaaggcaccaggaaacttgtatgagagatgtgagacaagccatcttgacccataagaagagagtccaagaaactaacaaatttggggaaaatatcattgtgcattcaaatgttattattgaacagaggcaccataaatatgatacacctacaaagcggaacacatacaaattagatttgattaatcatccaacaagttacataagaacaaaaacctatgaatgtaatatatgtgaaaaaatcttcaaacaacctattcaccttactgaacatatgagaattcatactggtgagaaacctttcagatgtaaggaatgtggaagggcctttagtcaaagtgcatccctcagtacacaccagagaatccatactggtgagaaaccctttgaatgtgaggaatgtgggaaagccttcagacatcgctcatcacttaatcagcatcatagaactcacactggggagaaaccctatgtatgtgataaatgtcagaaagctttcagccagaacattagcttggttcaacatttgaggactcattctggagagaaaccttttacttgcaatgaatgtgggaaaacctttagacagattagacaccttagtgaacatataagaattcataccggggagaagccctatgcatgcactgcatgttgtaaaacctttagtcatagagcgtatctaacacatcaccagagaatccatactggggagagaccctacaaatgtaaagaatgtggaaaagcctttaggcagaggatacaccttagcaaccataaaactgttcatacaggagtgaaagcatatgaatgcaaccgctgtggaaaagcctataggcatgattcatcctttaaaaaacatcagagacatcacactggagaaaaaccttacgaatgtaacgaatgtggaaaagccttcagctataactcttcacttagtcgacatcatgaaatacacaggaggaacgccttccgaaataaggtgtaaaaacagatatttgacttgagaacaaaagccaagtgtaaattggtgatttagagtgctttaaaatttcaggactcagatatgaggaattgatgtaatgatgccaacttttaatttttcccattgtaaataaacattacattgacaggtattgactactaacacctctaaaaagtacttaagattaaaatctggtccttaaaattaaatgaattcagcattatgaaaaatt

SEQ ID NO: 3456 - DNA, 2871 bp, Homo sapiens
gggcgcgcgctgcttcccgggagagggcgggctccgtggcagccccctgtgggcggagccggcggccggggctcacaacccgccggaagacgcgcgggttgtggcagctgcagcgggaccgcgtggggtgggccccgggaccgccagggctgcagcgagagcggccggcggtgcaagcggccgggagggcgcggccggaggcagaggccaggcgagacacccggctgcggcctaagaggccaggctgggtgggcttggctgcagccgccagccccgtgttaaagcggcagccagggaggtgtatcctccccggggtctgcaagacgccggctcagggcatccctcccattccggccctcaaagcctcgctcctgggggcgctgctgggaaagcccacccgcctgggcgggcccttgatgggaatgtggagcagaccctcgtccactccggaggccgagggtcctccgggcttccgaaggaagccgacctcaacgctggacgcttcttggagaatgattgcgttgagtggagatgtggtctgtctataaaaggccgggagggaacaatatctgttaccactcagtccgtctctaaagagacactctttaccgctgaaaacctcaagagtgagcactcccacgcccccgtctctggtcctacctgggtccaaggccgatgtgattctggagttctggagacaagtgcttctggatccctcttcccttcccttttgctcctctaaagagtatggagacatgaactcaaacctaactaactggctgcctcccaaagaaagtgcttgatttaaaggggagtttgttttccagaattgttaaagtcacatcagtctctaggaacccccaggtcctggtgctgcagggacacaccagagtcctgagggcaggtgattggaatctgagcaacaccccacaactgtgaagcgtctcatcaagagcttctggcaatttcctcaccagaagtggacaagtccagtaaggcaggcatcatgccacagcagctcctgatcaccctgcctaccgaggccagcacctgggtgaagctgcaacatccaaagaaggccgtggagggggcgcccctgtgggaggatgtgactaaaatgtttgaaggagaagctctgctgtctcaggatgctgaggacgtaaagacccagagagaaagtttagaggatgaagtgacccctggactcccgacagcagaatcccaggaattgttgactttcaaggacatatctattgacttcacccaggaagagtgggggcagctggctcctgctcaccagaatctataccgagaggtgatgctggagaactacagcaacttggtgtcagtgggatatcaactttccaaacctagtgtgatatcccagttagagaaaggagaagagccatggatggcagagaaagaaggcccaggagatcccagttcagacttgaagagtaaaatagaaaccattgagtcaactgcaaagagtaccatttcacaggagcgcttatatcatggcattatgatggaaagtttcatgagggatgatataatttattccacgttgagaaaagtctccacatatgatgatgtcttagaaaggcaccaggaaacttgtatgagagatgtgagacaagccatcttgacccataagaagagagtccaagaaactaacaaatttggggaaaatatcattgtgcattcaaatgttattattgaacagaggcaccataaatatgatacacctacaaagcggaacacatacaaattagatttgattaatcatccaacaagttacataagaacaaaaacctatgaatgtaatatatgtgaaaaaatcttcaaacaacctattcaccttactgaacatatgagaattcatactggtgagaaacctttcagatgtaaggaatgtggaagggcctttagtcaaagtgcatccctcagtacacaccagagaatccatactggtgagaaaccctttgaatgtgaggaatgtgggaaagccttcagacatcgctcatcacttaatcagcatcatagaactcacactggggagaaaccctatgtatgtgataaatgtcagaaagctttcagccagaacattagcttggttcaacatttgaggactcattctggagagaaaccttttacttgcaatgaatgtgggaaaacctttagacagattagacaccttagtgaacatataagaattcataccggggagaagccctatgcatgcactgcatgttgtaaaacctttagtcatagagcgtatctaacacatcaccagagaatccatactggggagagaccctacaaatgtaaagaatgtggaaaagcctttaggcagaggatacaccttagcaaccataaaactgttcatacaggagtgaaagcatatgaatgcaaccgctgtggaaaagcctataggcatgattcatcctttaaaaaacatcagagacatcacactggagaaaaaccttacgaatgtaacgaatgtggaaaagccttcagctataactcttcacttagtcgacatcatgaaatacacaggaggaacgccttccgaaataaggtgtaaaaacagatatttgacttgagaacaaaagccaagtgtaaattggtgatttagagtgctttaaaatttcaggactcagatatgaggaattgatgtaatgatgccaacttttaatttttcccattgtaaataaacattacattgacaggtattgactactaacacctctaaaaagtacttaagattaaaatctggtccttaaaattaaatgaattcagcattatgaaaaattcataacagtttttttctgatttcatggtggattaataaattattcttcatgggta

SEQ ID NO: 3457 - DNA, 1976 bp, Homo sapiens
ggccgcgcagtgccggaacccggctgcagcggtgggaaggcgggggcgtgccggcccagcggggagagggggctgctgagagtaaatacttggcgcctccagctgctggccaaggagacagatggagctcaagttgggagatacgccctgagagccgatgatagacacaagtccagatctcggattttgatactgtatgttccctgggttcctgagagaggacattgaggagtaggagtcggcgattaaggagatcggtacaattgggaagcctcctgtcagagcttccagcaatttcctcatcagaggtggacaagccctatgggctaagacagagggtcctcagaaaggagtgcggacgccgtcatgctgcagcagctcctgatcaccctgcccaccgaggccagcacctgggtgaagttgcgtcatccaaaggcggccacggagcgggtggccctgtgggaggatgtgactaagatgtttaaagcagaaggaactgttaaccttcaaggacgtatctgtggacttcactcaggaggagtgggggcagctggcccctgctcaccggaatctgtaccgggaggtgatgctggagaactatgggaacctggtctcagtgggatgtcagctttccaaacctggcgtgatttcccagttggagaaaggagaagaaccatggctgatggagagagatatttcaggagttccaagttcagacttgaagagcaaaacaaaaaccaaagagtcagccttacagaatgatatttcgtgggaagaactacattgtggcctaatgatggaaagatttacaaaaggaagcagcatgtattccaccttgggaagaatctccaaatgtaataagctagaaagccaacaagagaaccaaagaatgggtaaggggcaaatccccctgatgtgcaagaaaacattcactcaggagagaggccaagagtctaatagatttgagaaaagaattaatgtgaagtcagaagttatgccaggaccaataggtcttccaagaaaaagagatcgtaaatatgacacacctggaaagagaagcagatacaacatagatttagttaatcattcaaggagttatacaaaaatgaaaacctttgagtgtaatatttgtgaaaaaatcttcaaacagcttattcaccttactgaacacatgagaattcataccggggagaaacctttcagatgtaaggaatgtggaaaagcctttagccaaagttcatctcttattccgcatcagagaattcatactggtgagaaaccctatgaatgtaaggagtgtgggaaaaccttcagacatccttcatcgcttactcaacatgttagaattcataccggggaaaagccctatgaatgtagggtatgtgagaaagccttcagccagagcattggactgatccagcatttgagaactcatgttagagagaaaccttttacatgcaaagactgtggaaaagcgtttttccagattagacaccttaggcaacatgagattattcatactggtgtgaaaccctatatttgtaatgtatgtagtaaaaccttcagccatagtacatacctaactcaacaccagagaactcatactggagaaagaccatataaatgtaaggaatgtgggaaagcctttagccagagaatacatctttctatccatcagagagtccatactggagtaaaaccttatgaatgcagtcattgtgggaaagcctttaggcatgattcatcctttgctaaacatcagagaattcatactggagaaaaaccttatgattgtaatgagtgtggaaaagccttcagctgtagttcatcccttattagacactgcaaaacacatttaagaaataccttcagcaatgttgtgtgaaatatactaaacatcaaagaatctatgttggagcacaagattctaaatcagtggttccctgatccctcaaaaatccatttgtttttggatt

SEQ ID NO: 3458 - DNA, 2109 bp, Homo sapiens
ggccgcgcagtgccggaacccggctgcagcggtgggaaggcgggggcgtgccggcccagcggggagaggcatctgcaggggctgctgagagtaaatacttggcgcctccagctgctggccaaggagacagatggagctcaagttgggagatacgccctgagagccgatgatagacacaagtccagatctcggattttgatactgtatgttccctgggttcctgagagaggacattgaggagtaggagtcggcgattaaggagatcggtacaattgggaagcctcctgtcagagcttccagcaatttcctcatcagaggtggacaagccctatgggctaagacagagggtcctcagaaaggagtgcggacgccgtcatgctgcagcagctcctgatcaccctgcccaccgaggccagcacctgggtgaagttgcgtcatccaaaggcggccacggagcgggtggccctgtgggaggatgtgactaagatgtttaaagcagaagctctgctgtctcaggatgctgatgagacccagggcgaaagtttagagagtagagtgacccttggatccctgacagcagaatcccaggaactgttaaccttcaaggacgtatctgtggacttcactcaggaggagtgggggcagctggcccctgctcaccggaatctgtaccgggaggtgatgctggagaactatgggaacctggtctcagtgggatgtcagctttccaaacctggcgtgatttcccagttggagaaaggagaagaaccatggctgatggagagagatatttcaggagttccaagttcagacttgaagagcaaaacaaaaaccaaagagtcagccttacagaatgatatttcgtgggaagaactacattgtggcctaatgatggaaagatttacaaaaggaagcagcatgtattccaccttgggaagaatctccaaatgtaataagctagaaagccaacaagagaaccaaagaatgggtaaggggcaaatccccctgatgtgcaagaaaacattcactcaggagagaggccaagagtctaatagatttgagaaaagaattaatgtgaagtcagaagttatgccaggaccaataggtcttccaagaaaaagagatcgtaaatatgacacacctggaaagagaagcagatacaacatagatttagttaatcattcaaggagttatacaaaaatgaaaacctttgagtgtaatatttgtgaaaaaatcttcaaacagcttattcaccttactgaacacatgagaattcataccggggagaaacctttcagatgtaaggaatgtggaaaagcctttagccaaagttcatctcttattccgcatcagagaattcatactggtgagaaaccctatgaatgtaaggagtgtgggaaaaccttcagacatccttcatcgcttactcaacatgttagaattcataccggggaaaagccctatgaatgtagggtatgtgagaaagccttcagccagagcattggactgatccagcatttgagaactcatgttagagagaaaccttttacatgcaaagactgtggaaaagcgtttttccagattagacaccttaggcaacatgagattattcatactggtgtgaaaccctatatttgtaatgtatgtagtaaaaccttcagccatagtacatacctaactcaacaccagagaactcatactggagaaagaccatataaatgtaaggaatgtgggaaagcctttagccagagaatacatctttctatccatcagagagtccatactggagtaaaaccttatgaatgcagtcattgtgggaaagcctttaggcatgattcatcctttgctaaacatcagagaattcatactggagaaaaaccttatgattgtaatgagtgtggaaaagccttcagctgtagttcatcccttattagacactgcaaaacacatttaagaaataccttcagcaatgttgtgtgaaatatactaaacatcaaagaatctatgttggagcacaagattctaaatcagtggttccctgatccctcaaaaatccatttgtttttggatttccaaaaacgaacattaaaaaaaaatggtttggcacaa

SEQ ID NO: 3459 - DNA, 2381 bp, Homo sapiens
agcttggccgcgcagtgccggaacccggctgcagcggtgggaaggcgggggcgtgccggcccagcggggagaggcatctgcaggggctgctgagagtaaatacttggcgcctccagctgctggccaaggagacagatggagctcaagttgggagatacgccctgagagccgatgatagacacaagtccagatctcggattttgatactgtatgttccctgggttcctgagagaggacattgaggagtaggagtcggcgattaaggagatcggtacaattgggaagcctcctgtcagagcttccagcaatttcctcatcagaggtggacaagccctatgggctaagacagagggtcctcagaaaggagtgcggacgccgtcatgctgcagcagctcctgatcaccctgcccaccgaggccagcacctgggtgaagttgcgtcatccaaaggcggccacggagcgggtggccctgtgggaggatgtgactaagatgtttaaagcagaagctctgctgtctcaggatgctgatgagacccagggcgaaagtttagagagtagagtgacccttggatccctgacagcagaatcccaggaactgttaaccttcaaggacgtatctgtggacttcactcaggaggagtgggggcagctggcccctgctcaccggaatctgtaccgggaggtgatgctggagaactatgggaacctggtctcagtgggtaaggatgggctcctcttgaaaatagaacgtacctattggatgaaaacctttgtttctaaattaagtgctttgtttgggctttcggttctgtattagaggttttgtgtttccttctgaacacccagtcaggattgctatgctcttttctgctctgttctttctactctactctgctttctttagaaggcccgaataccaaagaaccatatttaaattcttgggatggctctgtgacctcagcatatacagtcttttcttccccataagcaggatgtcagctttccaaacctggcgtgatttcccagttggagaaaggagaagaccatggctgatggagagagatatttcaggagttccaagttcagacttgaagagcaaaacaaaaaccaaagagtcagccttacagaatgatatttcgtgggaagaactacattgtggcctaatgatggaaagatttacaaaaggaagcagcatgtattccaccttgggaagaatctccaaatgtaataagctagaaagccaacaagagaaccaaagaatgggtaaggggcaaatccccctgatgtgcaagaaaacattcactcaggagagaggccaagagtctaatagatttgagaaaagaattaatgtgaagtcagaagttatgccaggaccaataggtcttccaagaaaaagagatcgtaaatatgacacacctggaaagagaagcagatacaacatagatttagttaatcattcaaggagttatacaaaaatgaaaacctttgagtgtaatatttgtgaaaaaatcttcaaacagcttattcaccttactgaacacatgagaattcataccggggagaaacctttcagatgtaaggaatgtggaaaagcctttagccaaagttcatctcttattccgcatcagagaattcatactggtgagaaaccctatgaatgtaaggagtgtgggaaaaccttcagacatccttcatcgcttactcaacatgttagaattcataccggggaaaagccctatgaatgtagggtatgtgagaaagccttcagccagagcattggactgatccagcatttgagaactcatgttagagagaaaccttttacatgcaaagactgtggaaaagcgtttttccagattagacaccttaggcaacatgagattattcatactggtgtgaaaccctatatttgtaatgtatgtagtaaaaccttcagccatagtacatacctaactcaacaccagagaactcatactggagaaagaccatataaatgtaaggaatgtgggaaagcctttagccagagaatacatctttctatccatcagagagtccatactggagtaaaaccttatgaatgcagtcattgtgggaaagcctttaggcatgattcatcctttgctaaacatcagagaattcatactggagaaaaaccttatgattgtaatgagtgtggaaaagccttcagctgtagttcatcccttattagacactgcaaaacacatttaagaaataccttcagcaatgttgtgtgaaatatactaaacatcaaagaatctatgttggagcacaagattctaaatcagtggttccctgatccctcaaaaatccatttgtttttggatttccaaaaacgaacattaaaaaaaaatggtttggc

SEQ ID NO: 3460 - DNA, 6183 bp, Homo sapiens
gctgggagtagactcctggctcatgccagctgcgccctcttttctctacctccttcctcttccccccttctcctttccctctttcccttccctcccacctcccgggaaccctggctgagtgtgcgtgtgtgggagcgcgagagccccccgacagccaccccttggggcgcgcggctgcagttagggccttggcccctccaccagaggaaggtgctgccacgtgtctgctccttctgaacctccaggtttctgctacgttgccccatggaggacacacccccctcactcagctgctccgactgtcagcgccactttcccagcctcccagagctctctcggcaccgagaactgctccatccatctcccaaccaggacagtgaggaggctgacagcatccctcggccctaccgttgtcagcagtgtgggcggggctaccgtcaccccgggagcctggttaaccatcgtcggacccacgagactggccttttcccctgtaccacctgtggcaaggacttctccaatcccatggctctcaagagccatatgaggacacatgctcctgagggccgccgcaggcacaggcccccacgccccaaggaagccactccacacctccagggtgagacggtgtccactgactcctggggccaaaggcttggctctagtgaaggctgggaaaaccagacaaaacatacagaagagacacctgactgtgaatctgtacctgaccccagggcagcttcgggtacgtgggaagatctgcccaccagacaaagagaaggcttggcaagccacccaggtcctgaggatggtgcagacggctggggaccctccactaactctgccagagcccctcctctccccatcccagccagcagccttcttagcaacttggaacagtatctggctgaatcagtagtgaacttcacagggggccaggagcccacccagtcccctcctgctgaggaggagcggcggtacaaatgtagtcagtgtggcaagacctacaagcacgccgggagcctcaccaaccaccgccagagccacacgctgggcatctacccctgtgccatctgtttcaaggagttctctaacctcatggctctgaagaaccactctcgactgcatgcccagtatcggccttaccactgtccccactgcccccgtgtcttccggctcccccgggagctgctggaacaccagcagtcccatgagggtgaaaggcaggagccacgctgggaggagaaagggatgcccaccaccaatgggcacacagatgagagcagccaggaccagctccccagtgcacagatgctgaatggctctgcggagctcagcacctctggggagctggaggacagtggcctggaggaataccggcctttccgctgtggggactgtggccgtacttaccgccatgctgggagcctcatcaaccatcgaaagagccaccagacaggtgtctacccctgctcactctgttctaagcagctgttcaatgcggctgccctcaaaaaccatgtgcgggctcatcacaggcccaggcaaggagttggggaaaatgggcagccatcagtcccaccagctcccctgctgctggctgagaccacccacaaagaggaagaggaccccaccaccaccctggaccatcggccctataagtgcagtgagtgtggtcgtgcttaccgccaccgggggagcctggtgaaccatcgccacagccatcggactggagagtaccagtgctcactctgtccccgcaagtaccccaatctcatggccctgcgcaaccacgtgcgggtacattgcaaggctgctcgccgaagtgcagacatcggggctgagggtgcccccagccacctcaaggtagaactcccgcctgacccagtggaggcagaggcagccccgcacacagatcaggaccatgtgtgcaaacatgaagaagaggccacggacatcaccccagcagcagacaagacagcagcacatatctgtagcatctgtgggctgctctttgaagacgctgagagccttgaacgtcatggcctgactcatggggcaggggaaaaggaaaatagcagaacagagaccacaatgtcacctcctagggcctttgcctgccgagactgtggaaagagctatcgccactcaggcagccttatcaaccacaggcagacccaccagacaggagacttcagttgtggggcctgtgccaagcacttccacaccatggctgccatgaagaaccacttgcgccggcacagtcggcggcggagcaggcggcatcggaagcgggctggcggtgccagcggtgggagagaagccaaactcctggcagcggagagctggacccgggagctagaagacaatgaaggcctggagtctccccaagacccttcaggggaaagtcctcatggggctgaaggcaacctggaaagtgatggggactgtttgcaggctgaatctgaaggggacaaatgtgggcttgagagggatgagacccatttccagggtgataaagagagcggaggcactggggaaggactggaaaggaaggatgccagtttacttgacaacttggacatcccaggtgaggaaggtggtggcactcacttctgcgatagcctcactggggtggatgaagaccagaagccagccactggccaacccaactcctcttcccactctgccaatgctgtcactggctggcaggctggggccgctcacacatgctctgactgtgggcattctttcccccatgccactggcctgctgagccacaggccctgccacccaccaggcatctatcagtgctccctctgcccgaaggagtttgactctctgcctgccctccgcagccacttccagaaccataggcctggggaggcgacctcagcacagcctttcctctgctgcctctgtggcatgatcttccctgggcgggctggctacaggcttcaccggcgccaggcccacagctcctctggcatgactgagggctcagaggaggagggggaagaggaaggagtggcagaggcagcccctgcacgcagtccaccactgcagctctcggaagcagagctgctgaatcagctgcagcgggaggtggaagcgctggacagtgcagggtatgggcacatctgtggctgctgtggtcagacctacgatgacctggggagcctggagcgtcaccaccaaagtcagagttctgggactactgcagacaaggctcccagccccttgggagtggcaggtgatgccatggagatggtcgtggacagtgtcttggaggacatagtgaattctgtctctggagagggtggagatgccaagtctcaagagggagcaggcacccccttgggagacagcctctgcatccagggtggggaaagtttgttggaggctcagccccgccccttccgctgcaaccagtgtggcaagacctatcgccatgggggcagcctggtgaaccaccgcaagatccaccagactggagactttctctgccctgtctgctcccgctgctaccccaacctggctgcctaccgtaatcatctgcggaaccaccctcgctgcaaaggctctgagccccaggttgggcccatcccagaggcagcaggtagcagtgagctgcaggttgggcccatcccagaaggaggcagcaacaagccccagcacatggcagaggaggggccggggcaagcagaagtcgagaagctccaggaagaacttaaagtggagcccctggaggaagtggccagggtgaaagaagaggtgtgggaggagaccactgtgaagggggaggagatagagcccaggctggagactgccgagaagggctgccagactgaagccagctctgagcggcccttcagctgcgaggtgtgtggccgatcctacaagcacgccggcagcctcatcaaccaccggcagagccaccagaccggccactttggctgtcaggcctgctccaagggcttctcaaacctcatgtccctcaagaaccaccggcgcatccatgcagatccccgacgtttccgctgcagcgagtgtgggaaggccttccgcctgcggaaacagctggccagccaccagcgggtccacatggaacggcgtgggggtgggggcacccgaaaggcgactcgggaagatcggcccttccgctgtgggcagtgcgggcggacctatcgccacgccggcagcctcctgaaccaccggcgcagccacgagacgggccagtacagctgccccacctgccccaagacctactccaaccgcatggccctgaaggaccaccagaggctgcactcagagaatcggcggcgacgggctggacggtccaggcgcacagctgtgcgttgcgccctctgtggccgcagcttccctggccggggatctttggagcggcacctgcgggagcatgaggagacagaaagggagccagccaatggccagggaggcctggatggcacagcggccagtgaggcgaacctgactggcagccagggactagagacccaattgggtggtgctgagccagtaccccacttggaggatggagtcccaaggccaggggagcgcagtcagagccccatcagggcagcaagctcagaagccccagagccactgtcctggggtgcagggaaggcaggtgggtggccggtaggtgggggactggggaatcatagtggaggctgggttcctcagttcctaactaggtcagaggagccagaggacagtgtccacaggagtccttgccacgctggtgactgccagctcaatggacctactctgagtcacatggatagctgggacaacagagacaacagctctcagctgcagccagggagccactcctcttgcagccagtgtggcaagacttactgccagtcaggcagcctcttgaaccacaacaccaacaagacagaccgacactattgcctgctctgctccaaggagttcttaaatcctgtggccacaaagagccacagccacaaccacatagacgcccagacctttgcctgtcctgactgtggcaaagcctttgagtcccaccaggaactggccagccacctgcaggctcatgcccggggccacagccaggtgccagcccagatggaggaggccagagatcccaaagccgggactggggaggaccaggtggttctccctggtcaagggaaagcccaggaggccccatcagaaacccccagaggcccaggagagagtgtggagagagccaggggaggacaagcggtgacgtccatggcggctgaggacaaggagcggcccttccgctgcacccagtgcgggcgctcctaccgccatgctggcagcctgctgaaccaccagaaggcccacaccacagggttgtacccgtgctccctctgtcccaaacttctccctaacctgctgtctcttaagaaccacagcaggacccacacggaccccaagcgccactgctgcagcatctgtggcaaggcctttcggacagctgcccggctggagggccacgggcgggtccatgcaccccgggaggggcctttcacctgcccccattgtccccgccacttccgccgccgaatcagcttcgtgcagcaccagcagcagcaccaggaggagtggacggtggccggctccggagccccagtggcaccagtgacgggcagaggggacttgccattgccccctccacccacccccacgaccccactcctggatccttcaccccagtggcctgcagacctcagcttctccctctgaacttcaagtctccaaagatcagaatctgggggagggagcgcgtgcagggaggggcttgatctccacattttctcaggagtagttcgggcatccccatatcttctcctctccccttgtgaagaggacccagatctggcttctttcccaaggagggggtggggtgttcctcgcgtccctgtccttgaaggacctccttcccccagcctcatcaccgtgctcttctcagcgccaccctcagcagccagattgcaacaccagggagaggcggatgcagagccccaccggtgggaaagttgcctgtggaagggagccttttgctacaatttgtaacttattttctaaagtctattttgtaacaatttatttaagtttaaaaaaaggaaaactgctgccccccaaaaaaagaaattttcaaaacaa

SEQ ID NO: 3461 - DNA, 7604 bp, Homo sapiens
gagcagattcctactgttcttaaaggacagtaatgccttttgagtctggtctgaagaacataacaggtctgtgatcagaagtaggttgcatctctctcaactttaatttccttagctatacctgtagggatgacttaagcctaggggagctcctatatttgggaagcttgtgcacagggaagccttaaatgatggtgcctgcagattggatctagtagaaattaggtccttgggcatggatgcttggggaacctctcagtgacctcaggtgaacttgttgctcgtagagccaagaggcgaagttaattcaggccttccttttgaccactgccccctcttcctaggccttggcccctccaccagaggaaggtgctgccacgtgtctgctccttctgaacctccaggtttctgctacgttgccccatggaggacacacccccctcactcagctgctccgactgtcagcgccactttcccagcctcccagagctctctcggcaccgagaactgctccatccatctcccaaccaggacagtgaggaggctgacagcatccctcggccctaccgttgtcagcagtgtgggcggggctaccgtcaccccgggagcctggttaaccatcgtcggacccacgagactggccttttcccctgtaccacctgtggcaaggacttctccaatcccatggctctcaagagccatatgaggacacatgctcctgagggccgccgcaggcacaggcccccacgccccaaggaagccactccacacctccagggtgagacggtgtccactgactcctggggccaaaggcttggctctagtgaaggctgggaaaaccagacaaaacatacagaagagacacctgactgtgaatctgtacctgaccccagggcagcttcgggtacgtgggaagatctgcccaccagacaaagagaaggcttggcaagccacccaggtcctgaggatggtgcagacggctggggaccctccactaactctgccagagcccctcctctccccatcccagccagcagccttcttagcaacttggaacagtatctggctgaatcagtagtgaacttcacagggggccaggagcccacccagtcccctcctgctgaggaggagcggcggtacaaatgtagtcagtgtggcaagacctacaagcacgccgggagcctcaccaaccaccgccagagccacacgctgggcatctacccctgtgccatctgtttcaaggagttctctaacctcatggctctgaagaaccactctcgactgcatgcccagtatcggccttaccactgtccccactgcccccgtgtcttccggctcccccgggagctgctggaacaccagcagtcccatgagggtgaaaggcaggagccacgctgggaggagaaagggatgcccaccaccaatgggcacacagatgagagcagccaggaccagctccccagtgcacagatgctgaatggctctgcggagctcagcacctctggggagctggaggacagtggcctggaggaataccggcctttccgctgtggggactgtggccgtacttaccgccatgctgggagcctcatcaaccatcgaaagagccaccagacaggtgtctacccctgctcactctgttctaagcagctgttcaatgcggctgccctcaaaaaccatgtgcgggctcatcacaggcccaggcaaggagttggggaaaatgggcagccatcagtcccaccagctcccctgctgctggctgagaccacccacaaagaggaagaggaccccaccaccaccctggaccatcggccctataagtgcagtgagtgtggtcgtgcttaccgccaccgggggagcctggtgaaccatcgccacagccatcggactggagagtaccagtgctcactctgtccccgcaagtaccccaatctcatggccctgcgcaaccacgtgcgggtacattgcaaggctgctcgccgaagtgcagacatcggggctgagggtgcccccagccacctcaaggtagaactcccgcctgacccagtggaggcagaggcagccccgcacacagatcaggaccatgtgtgcaaacatgaagaagaggccacggacatcaccccagcagcagacaagacagcagcacatatctgtagcatctgtgggctgctctttgaagacgctgagagccttgaacgtcatggcctgactcatggggcaggggaaaaggaaaatagcagaacagagaccacaatgtcacctcctagggcctttgcctgccgagactgtggaaagagctatcgccactcaggcagccttatcaaccacaggcagacccaccagacaggagacttcagttgtggggcctgtgccaagcacttccacaccatggctgccatgaagaaccacttgcgccggcacagtcggcggcggagcaggcggcatcggaagcgggctggcggtgccagcggtgggagagaagccaaactcctggcagcggagagctggacccgggagctagaagacaatgaaggcctggagtctccccaagacccttcaggggaaagtcctcatggggctgaaggcaacctggaaagtgatggggactgtttgcaggctgaatctgaaggggacaaatgtgggcttgagagggatgagacccatttccagggtgataaagagagcggaggcactggggaaggactggaaaggaaggatgccagtttacttgacaacttggacatcccaggtgaggaaggtggtggcactcacttctgcgatagcctcactggggtggatgaagaccagaagccagccactggccaacccaactcctcttcccactctgccaatgctgtcactggctggcaggctggggccgctcacacatgctctgactgtgggcattctttcccccatgccactggcctgctgagccacaggccctgccacccaccaggcatctatcagtgctccctctgcccgaaggagtttgactctctgcctgccctccgcagccacttccagaaccataggcctggggaggcgacctcagcacagcctttcctctgctgcctctgtggcatgatcttccctgggcgggctggctacaggcttcaccggcgccaggcccacagctcctctggcatgactgagggctcagaggaggagggggaagaggaaggagtggcagaggcagcccctgcacgcagtccaccactgcagctctcggaagcagagctgctgaatcagctgcagcgggaggtggaagcgctggacagtgcagggtatgggcacatctgtggctgctgtggtcagacctacgatgacctggggagcctggagcgtcaccaccaaagtcagagttctgggactactgcagacaaggctcccagccccttgggagtggcaggtgatgccatggagatggtcgtggacagtgtcttggaggacatagtgaattctgtctctggagagggtggagatgccaagtctcaagagggagcaggcacccccttgggagacagcctctgcatccagggtggggaaagtttgttggaggctcagccccgccccttccgctgcaaccagtgtggcaagacctatcgccatgggggcagcctggtgaaccaccgcaagatccaccagactggagactttctctgccctgtctgctcccgctgctaccccaacctggctgcctaccgtaatcatctgcggaaccaccctcgctgcaaaggctctgagccccaggttgggcccatcccagaggcagcaggtagcagtgagctgcaggttgggcccatcccagaaggaggcagcaacaagccccagcacatggcagaggaggggccggggcaagcagaagtcgagaagctccaggaagaacttaaagtggagcccctggaggaagtggccagggtgaaagaagaggtgtgggaggagaccactgtgaagggggaggagatagagcccaggctggagactgccgagaagggctgccagactgaagccagctctgagcggcccttcagctgcgaggtgtgtggccgatcctacaagcacgccggcagcctcatcaaccaccggcagagccaccagaccggccactttggctgtcaggcctgctccaagggcttctcaaacctcatgtccctcaagaaccaccggcgcatccatgcagatccccgacgtttccgctgcagcgagtgtgggaaggccttccgcctgcggaaacagctggccagccaccagcgggtccacatggaacggcgtgggggtgggggcacccgaaaggcgactcgggaagatcggcccttccgctgtgggcagtgcgggcggacctatcgccacgccggcagcctcctgaaccaccggcgcagccacgagacgggccagtacagctgccccacctgccccaagacctactccaaccgcatggccctgaaggaccaccagaggctgcactcagagaatcggcggcgacgggctggacggtccaggcgcacagctgtgcgttgcgccctctgtggccgcagcttccctggccggggatctttggagcggcacctgcgggagcatgaggagacagaaagggagccagccaatggccagggaggcctggatggcacagcggccagtgaggcgaacctgactggcagccagggactagagacccaattgggtggtgctgagccagtaccccacttggaggatggagtcccaaggccaggggagcgcagtcagagccccatcagggcagcaagctcagaagccccagagccactgtcctggggtgcagggaaggcaggtgggtggccggtaggtgggggactggggaatcatagtggaggctgggttcctcagttcctaactaggtcagaggagccagaggacagtgtccacaggagtccttgccacgctggtgactgccagctcaatggacctactctgagtcacatggatagctgggacaacagagacaacagctctcagctgcagccagggagccactcctcttgcagccagtgtggcaagacttactgccagtcaggcagcctcttgaaccacaacaccaacaagacagaccgacactattgcctgctctgctccaaggagttcttaaatcctgtggccacaaagagccacagccacaaccacatagacgcccagacctttgcctgtcctgactgtggcaaagcctttgagtcccaccaggaactggccagccacctgcaggctcatgcccggggccacagccaggtgccagcccagatggaggaggccagagatcccaaagccgggactggggaggaccaggtggttctccctggtcaagggaaagcccaggaggccccatcagaaacccccagaggcccaggagagagtgtggagagagccaggggaggacaagcggtgacgtccatggcggctgaggacaaggagcggcccttccgctgcacccagtgcgggcgctcctaccgccatgctggcagcctgctgaaccaccagaaggcccacaccacagggttgtacccgtgctccctctgtcccaaacttctccctaacctgctgtctcttaagaaccacagcaggacccacacggaccccaagcgccactgctgcagcatctgtggcaaggcctttcggacagctgcccggctggagggccacgggcgggtccatgcaccccgggaggggcctttcacctgcccccattgtccccgccacttccgccgccgaatcagcttcgtgcagcaccagcagcagcaccaggaggagtggacggtggccggctccggtagggggcatgaagggtcccaggaggaggtgggcacacagtggagggggaagtccagccccaaagtcggtgggggagcaaggagtgagaggagagagccccggggattctaagaggtgggtgggggcttggctatggggtgagagaagtagcttgaggatgtgctgagctgagcacccgcaagtcaggtataacaaatagcagggtgggttgggcagcacgtgggggcgtggtcaggccgaggctgctacctgggctcctccattacactgtagccagaatggaatggtctttctgttcaggggaaggtcactgggtaccccctggctgctgtgtctggaaaccctcctgagtcagccagtaaagtaatgacttccagagaaaaagaggaagccattggtttggtctaggttccattctttcctggagcaggccgggtgccagggaacaagggatggggcatgggctccacggcttccctgctgacttggccacggaaactggttcactggttggcaccctactccctgtccctctttccctgcgccttgtctctgctgctcctctccttggaaactagacctctggtccttccctgtcagtgttgctcccatctcttctctaacctttattcagccccttttccctctgctgccaacggcctttttaggatccaaccaaaccaccctttctacctgcgcaccctgccaccctctgcacacctttaactggaggactgagtcacagataattgtttccttgaagtccaggcccagctgcagcaacaacagtcattagcccgtgtcacatccctgatcagagggcatctccgtggggaatcgcctccacccagcactgctggaagccgcagctgccagggagtggggcggccggttccctcagcaggacctgggctggcctctccacctcccctagtagaggcggacccattccatctagtggccaccgagggtgggtggccctgagatggtgggcccttgacaggccttgtcagagcagagggcaggtgggagtcacctgaaagctgaaggaatggctttaaggatagaagatttctcatgacctcaagggatatgagggaggagccagtttgccagggctgggaaaataattaggaggcctagaatccctgttctcatctgggcctccggggccaggggcaggggaatggcctgcagggctgggagggggtacacgctgtgcggggtctgcccctcagttggtgacctcctctctctctccccccaggagccccagtggcaccagtgacgggcagaggggacttgccattgccccctccacccacccccacgaccccactcctggatccttcaccccagtggcctgcagacctcagcttctccctctgaacttcaagtctccaaagatcagaatctgggggagggagcgcgtgcagggaggggcttgatctccacattttctcaggagtagttcgggcatccccatatcttctcctctccccttgtgaagaggacccagatctggcttctttcccaaggagggggtggggtgttcctcgcgtccctgtccttgaaggacctccttcccccagcctcatcaccgtgctcttctcagcgccaccctcagcagccagattgcaacaccagggagaggcggatgcagagccccaccggtgggaaagttgcctgtggaagggagccttttgctacaatttgtaacttattttctaaagtctattttgtaacaatttatttaagtttaaaaaaaggaaaactgctgccccccaaaaaaagaaattttc

SEQ ID NO: 3462 - DNA, 1077 bp, Homo sapiens
tagagctgggagtagactcctggctcatgccagctgcgccctcttttctctacctccttcctcttccccccttctcctttccctctttcccttccctcccacctcccgggaaccctggctgagtgtgcgtgtgtgggagcgcgagagccccccgacagccaccccttggggcgcgcggctgcagttagggtaagggtcccagtgcgcaggcgcgctcttgttcgcggtccccaactgacgcgcccgcggcgggaaggagagggggccgccggtgcgaggccttggcccctccaccagaggaaggtgctgccacgtgtctgctccttctgaacctccaggtttctgctacgttgccccatggaggacacacccccctcactcagctgctccgactgtcagcgccactttcccagcctcccagagctctctcggcaccgagaactgctccatccatctcccaaccaggacagtgaggaggctgacagcatccctcggccctaccgttgtcagcagtgtgggcggggctaccgtcaccccgggagcctggttaaccatcgtcggacccacgagactggccttttcccctgtaccacctgtggcaaggacttctccaatcccatggctctcaagagccatatgaggacacatgctcctgagggccgccgcaggcacaggcccccacgccccaaggaagccactccacacctccagggtgagacggtgtccactgactcctggggccaaaggcttggctctagtgaaggctgggaaaaccagacaaaacatacagaagagacacctgactgtgaatctgtacctgaccccagggcagcttcgggtacgtgggaagatctgcccaccagacaaagagaaggcttggcaagccacccaggtcctgaggatggtgcagacggctggggaccctccactaactctgccagagcccctcctctccccatcccagccagcagccttcttagcaacttggaacagtatctggctgaatcagtagtgaacttcacagggggccaggagcccacccagtcccctcctgctgaggaggagcggcggtacaaa

SEQ ID NO: 3463 - DNA, 579 bp, Homo sapiens
gagcggcggtacaaatgtagtcagtgtggcaagacctacaagcacgccgggagcctcaccaaccaccgccagagccacacgctgggcatctacccctgtgccatctgtttcaaggagttctctaacctcatggctctgaagaaccactctcgactgcatgcccagtatcggccttaccactgtccccactgcccccgtgtcttccggctcccccgggagctgctggaacaccagcagtcccatgaggcagctcggcccttcagctgcgaggtgtgtggccgatcctacaagcacgccggcagcctcatcaaccaccggcagagccaccagaccggccactttggctgtcaggcctgctccaagggcttctcaaacctcatgtccctcaagaaccaccggcgcatccatgcagatccccgacgtttccgctgcagcgagtgtgggaaggccttccgcctgcggaaacagctggccagccaccagcgggtccacatggaacggcatcggcccttccgctgtgggcagtgcgggcggacctatcgccacgccggcagcctcctgaaccaccggcgcagccac

SEQ ID NO: 3464 - DNA, 3649 bp, Homo sapiens
ctctgcagccgctggactggacacaaagcgtgagagacagagacaccatctctgctgatttgtacctaactggttcctgttgctgagagcccacgtgtcacagaagccagggcagaggccccacactgctgtctgcatttcccaggtatcctgagccaagcaggatactcctcctcagaggagtaggcaatagaagcgcctgaacatcatggcacaagtggactcccaggacaggtggggagaggcgtctcctctcagcagcttgactgaggaagctcatgacacccagatgctgagcatgaacttagagagtgacgatgaagatggtggggaggccgaaaaagagggcaccgctgacccggtggcctgtccaaggggcagctccccagtaacacacgaaaatcctgacttgccatggccccatccactgggcaaagaggaagagaaattctctgactcctccagtgctgggggcatggggcagaaaccagtggaaatgtctgggaaagccagttggagcagagatgtgacaaagatcaacgagacccagggttccccgggagcaagcagagctctgggttcccttcccagtggtctcgcacacaaattgttaggtcagatgcaacctcttggggaccgactacctgcgggtgatgatggatactcgggggcaaaccaggacgcagtcttggatgtcccacccagcttccccagcaatggaaagtatctctgtgcgcacaaaagtgtagacacgtccgcagggaactcttctctgttgtgtttccccaggccggggagcaactgggaccttcccacgcaagagacacatacaccagcccaggcgtcggccaccccagccagcctggctgccgcggtcctggcaaaagcgcggaacagcaggaaagtacagaaccaggcgggccggcgcgagggcggagaggctgaggcgcgtccctacaggtgcctgcggggcgggcgggcctttcagaagcccagcaagccgctgagccccgcggagacgcgcggcggcgccgccaagcgctacgcgtgcgagctatgcgggaaggcctactcccaccgcggcacactccagcagcacaggcgcctgcacacgggcgagcggccctaccagtgctccttctgcgacaaggcctacacctggtcctccgaccaccggaagcacatccgcacccacacaggcgagaaaccctacccgtgtccagactgcgggaaggccttcgtgcgctcttcggacctgcgcaaacaccagcgcaacatgcacagcaacaataagcccttcccgtgctccgagtgcggcctgaccttcaacaagccgctgtcgctgctgcgccaccagcgcacgcacctgggcgccaagcccttccgctgccccgcctgcgaccgggagttcgctgtggccagccgcatggtggagcaccagcgcgtgcactcgggcgagcggcccttcccctgccccacctgcggcaagtgcttcaccaagtcctccaatctgtccgagcaccagacgctgcacaccggccagaggcctttcaagtgcgctgactgcggcgtggccttcgcgcagccctcgcgcctcgtgcgccaccagcgcatccacactggcgagaggccctttccttgcacgcagtgtggccaggcctttgcccgctcttcgaccctgaagcggcaccaacagatccactccggggagaagggattcctctgtgccgagtgcggcagggccttccgcattgcctctgagttggcccagcacatacgaatgcacaacggagagaggccctaccagtgtgaggactgcggccaggccttcaccaggtccaatcacctccaacgacaccgagccaagcacggcacctgcaagaaggagcccatcccttcctcctctgacgagtgaagatagcatcgtcgacctcactacttggaaccttcccaggtgggcccactcacatggtattgccagcctcactggtcagcctcgcctcccagcaggtcgcgggtcatcagtggtccatttgattatttatttgatcccttgaacagaaagtcaccaccgagagagcacccaggtgggtggtttcacatcagtggttctgagtgtccgaggtcataagcaattggaaaagggaaagacaaagtagtgggagctgatcaaacgttgagttccttgggttggggaacctgaatcaatcagaaactgcttctagaattacatgctgggcactgggccgggctccagggataaggtggggaaaaagactaacctgtcctaccctcaaagccatatgcaaatactgaaaagaaggcctgaggggctggtcctctttagagaaagatgctttttggtttttatataaataaaggaatccccagaagtggtccctatgatgaactcccccaaagcaacgccgtttttggaggaactcaaacccagtccaacatcccatcatttcacttgactgcagaaatggctttacccttaggatatatctttatgagtcttggctttgaagtggagaagggctttatcttagagaaggtggtttatgtcatattccagttattctagaagttcaggacagccttagcatctgaaaaagaagcccattcctctttatagtggaatttagtaagtagatctaacccgagtctcacccacagaattcatataaattcatatatgccttctctctggctgcctcttttcctgtttgcactctgagggcttaagtcatatgtgatatttacaaagcaattggcccatttacagagagacatatataatttctccacaaagccttgaccatggttcatgaaaccgtttgggttcatttaaatttgtctgaatcattagtcttgacttgaagtgaacaaaacaccctttgcccaagtgccattggcttgtctgcatttcaaaatcattaaaaccaggtatggaagcctacgtgctcacagttatctaatgaggttatttcaaagtttgcattactaacagccattctgcaaagtgtattgatgtgtatagtgatctgtataaagtcagtagttcttagctgaacctcaactgtgaggaatctatgactccacagatgtccttggtgcacataggcaaacggcacttctcatcttactgaagttaaataagatattccataagaaggtatagtgccctttttgggggagtacctttagtatattcctaaaattgccaccaaagaatgccaaatctgaatttctcttggtttccacctgatttggaactagggtgtgacctctaaatagcattctcatgacacatgggggcgccaaagagaagtaagagagatagctagatagctagatagctagatagtcttgtgtcttgtttgaccaaggtaaccgtaataaaagagtccatccccatcctttactgttgatgtgaccttgggcttcagtttctgcatctgcattggcaaaatagaagtgatagtagtaggtaaaagttagagtgatcctactatatgacggaaactttggctggatgcaagagctttaaattggtagaaaagtcacaagatgagcttgtgactatgaagagagcaaaagctaacttttttttcctagataatcaataaaatatttgaagactgaa

SEQ ID NO: 3465 - DNA, 5988 bp, Homo sapiens
gcggggagccggcggttatctgggcggcggagcgctcacaatgtggcaggagacagaaaagataagatgctcccaagtcccttgcagctctcttcagaagaaaaatcactagtgctctgctcttgccataataccaaacctttttgactcatgctttggtgctgcaacactggaagaattgcacacagtttccaggaatatctttttttcatttgagtgattctttgtggatgagaaaagatttgagtcttaataattaccttgttttaaagctatttctttatagtctgaactgtttaataaattgggccacttaccaatgagccacacagccagttcttgtcaggagctggttgaaaactgtgctgtgcatgtagcaggaatggcacaagaagatagccgtcgtggtcaagtgccatcttccttttatcatggtgccaaccaagaacttgacctgtccaccaaagtgtacaaaagggaatcaggaagtccttattctgtgttagtggacaccaagatgagcaaaccgcatctccatgaaacagaagaacagccatatttcagggagacaagagcagtgtctgacgtgcatgctgttaaggaagaccgggagaattctgatgacacagaggaggaagaggaagaagtctcttacaaaagggagcagatcatagtggaggtaaaccttaataatcaaacattaaatgtatctaaaggggaaaagggtgtctcttctcagtccaaagagactcctgttcttaagacaagcagtgaggaggaagaggaagagagtgaggaagaggccacagatgacagcaatgactatggagagaatgaaaagcagaagaaaaaggagaagatagtagagaaagtcagcgttacacaaaggagaaccaggagagctgcctctgttgccgcagctaccacttcccctactcccagaactacaagaggtcgtaggaagagtgtagagccacctaagcgtaagaagcgggccacaaaggagcccaaagcaccagtccagaaagctaagtgtgaagagaaagagactctgacctgtgagaagtgccccagggtatttaacactcgctggtacctggagaagcacatgaacgttactcataggcgcatgcagatttgtgataaatgtggcaagaagtttgtcctggaaagtgagctgtcccttcaccagcaaacagactgtgaaaaaaacattcagtgtgtttcctgtaacaaatcgttcaagaaactctggtcccttcatgaacatatcaagatcgtccatggatatgcagaaaagaaattttcctgtgaaatttgtgagaagaaattctataccatggctcatgtgcggaaacacatggttgcacacacaaaagacatgccatttacatgcgaaacctgtggaaaatcattcaaacgcagtatgtcactcaaggtgcactccttgcagcattctggagagaagccctttagatgcgagaactgtgacgaaaggtttcagtacaagtaccagctacgctcccacatgagcattcatattgggcacaaacagttcatgtgccagtggtgtggcaaggatttcaacatgaagcagtacttcgacgaacacatgaaaacacacactggagagaaaccctttatctgtgaaatctgtggcaaaagcttcaccagccgccccaacatgaagagacaccgcagaactcacacaggcgagaagccctatccatgtgatgtgtgtggccagcggttccgcttctcgaacatgcttaaggcccacaaggagaagtgctttcgggtgaccagccccgtgaatgtgccacctgctgtccagatcccacttacaacttccccagccaccccagttccttctgtggtgaacacagccacaaccccaacccctccaatcaatatgaatcctgtaagcactcttccccctcggcccatcccccaccccttctcacacctgcacatccacccacaccctcaccacccacaccaccttcccatccctccagtccctcacctcccgccacctccagctctctttaagagtgagcctttaaatcatagaggccagagtgaggacaactttctgcggcacctggcagagaagaacagttcagcacagcatcattaacatccgtctccttagtgtgttctccaggagacacgtccccatgtgtgagcgtgcacagagggagtcggtgagcatttccttagttctcagactctcctccgcctctaccaagagcttcgccagtgtcactgaatcaacagatccaagggaatgaacaagaagactaccttgagctcacagagggactgtcatctaaaccaggggaaccactgaactaaagcccaatttgcttgcattttctgatgacttttataagtttcaaatactcagacttgtggaattttataatttcatatcagctgatgaggtatgcttgcttttatatcccagacttctcctcaaagaggggataggcctggtttcctttgtactaatcgggaaggctgtgagattaatccagagcattaattgtatcactgtgtatggtaaggaattcttttcagcttttggtgccagctacagagttgagctggccatgtttcacagtatatcaagcattatagagaaagacagaaattttcttctttgtgtagctctcctaacgcactctttattttactacagaaattattttagagtttttgtatagacttctttggtagtctgtttctaaaatgaaatgtatttcaataagcagtgtaattttttcagtgtagctgaacctatgttgtaaaatagaaaaaaatttttataatcatcaaaatgtgattcttaaagatgcatataacttctataattcaaagctattcttacatccgtacaactcaaaaggtgcttcagagactagatgtatctgagagggtctccagaccaggttactgcaaaaatgaggttttgctttcaggatttggcgtaaatacttggtagttttgacatctctgcttaacactcaagagaggctccctaatgtgctcctgtcctccatgttctgcttggcttcgttagtgcattacatgaaatgatttgcaggggatggggccttttccagggaagtcacctaaagcttgcatgttttgaaaatttgaataaggctgtttgctgacaggaggaggaagtagtggagatcatttcatctcagtcacgtctgtttctcacttcccttaggaattgtgttgatgtttaacttttatgggatgacaaattgaaatcgctcattttgaggttgctttatttttctagaattgttataagaagctaaaatagtaaacttaaaatcacaaacatgacattgctgatagtggctgagaaattcagatgagaagacaaattggttatgaattttgaaatatctattatatgtaaaatgtggatatgttcacaaccttgagctattttaacacagtttaaatatagtgagggaaaactcctaagttttactgccctgtcctctgcaaattatgtaataccagcattcttaggcgataaagagagcagcacctctagtacctttaggcagattactttttcaagtttggggaacttcaaaagaccataatcaaccaggagcttattataggaaaggctgaacagaagggctagtgtattgattacacttaacagatcatatttatccagactcagtatagcttaaaattttgtatttctttatctgagagaactgagttcccaggctaaatcacttacctcccaccccctctccaattttttttttaagagacaaggtcttgctatgttgcccaggctagagtgcagtggctattcacaggtgcagttatagcacactacagcctccaactcttgggttcaagcaaccctgcctcagctaaccaagtagctgggactacaggtgcatgctaccatgcccagtccattttttaatcttgaaatttcttcatttttctttcttcggtttcttaaaatctttgcctgaatcagaacgctggcttttatttatttttttatttttaatattaaatgtgcagatatgcttcgagcacttttctaactaatgagctctgtggtaagaaaaaatgaactctttcaattgagattaagtccatatttttcaaacatcacgttctctattggctttttggtttagtgtttctaaattttctccttctgattttgcctgtcttatataatgagcataggaaaattttggaatgaggcagaaaagtatatcaagacatacttcctggttttggatgtaagttttaaagaatggtatttttaatatttgtacacattctttgagcacccaggtacccaagccaataaggaaagttaattccttgcatatgactgttatatctttagtggttgtctccctctccctccacagtctccttggcattccatgacaagtttgtcaacctacacttttatatagacatatcattatttcatggtcaagcctgtagtattaaaatgatttttttaaaagatgtaaactgtgcttagttaattggttatattttgttctgttttttttttttttttttttttttttttgaggcagagtcttgttctgttgcctgggctggagtgcagtggcgtgatcttggctcactgcaacccccgccccccgggttcaagtgattctcctgcctcagcctcccgagtagctggaattacaggcatgcgccagcacgcccggctaagttttgtatttttggcagagatggggtttcaccatattggccaggctggtctcaaactcctgaccttgtgatccgcccacctcagcctccgaaagtgctgggattacaggcgtgagccaccacgtccaactgccttattttgttctgaataaatttacagtattgggcagcaattctggattctagacttgagaccacagaatcaaccatttcatgaggttgtactgtaattatacactggaatattcaggtagtcatctttgatttttcattcaagtaaatatagccataagaaaatatctgctatacaggaaaaccagtattaagcaaataccaccatccttaacagaaacaaaaatatatatatatattatttttaaaaattagcattgtcatacagtacaattcttagtgaagtgtattgtggaacaatttagaaacttcctttttttcccctagattaaggatactttccttgacttgagacttgtggtcttcaggaaaactactcagaatataatgactcctcatcagtatcatattgtatataaataatgaaatgcattaagaatattcacaacattgaacccaggaggcggagcttgcagtgagccgagattgcgccactgcgctccagcctgggcaacagagcgagactccatctcaaaaaaaaaaaaaaaaagaatattcacaacattaatgcttctgaatagaagaactgcaggattaagccttaaacatatatgtgcaacacgtttaacatgcttaagactcaaactcagggttgaaaatttggttggggtcctctttgtaagataaaagttgcattatgtggtatgttctcttccatatatgctacagcaccccatgaattcttcaaaactttttacctacttgttatctgtttatgaaaaaaagaattatggagaagtttgagttctcagcccttatctgtacatgtctgttaaagacaacaaaggctgcatttaagcattatatagataacaaattgaggctgtctctcgttacttagttttactgtcttcaaaggcttgtatcattgctagggttaagacttatttgaggatgagttggcattgtattttttgtgtgtgtgggttggtttgtatttgtttcgtttttatttttctattttctctcatagatttatcagtaaaatataaactcttccttagccttaataaaggctgctgctttctcaaa

SEQ ID NO: 3466 - DNA, 4701 bp, Homo sapiens
ggagcggcggccacgtagcgctgcggcggcagcggcagcggccgaggccgggtctgaggagcggccctgaggacagacgttgggcagggggggaggggctggcccagccggcggttgtgactcgagcgccgcggctgcaggcccccgccgcagggatggaccgccgaggcggcggccggggcggcggaggcggaggcggccggcccggataagatgctcccaagtcccttgcagctctcttcagaagaaaaatcactagtgctctgctcttgccataataccaaacctttttgactcatgctttggtgctgcaacactggaagaattgcacacagtttccaggaatatctttttttcatttgagtgattctttgtggatgagaaaagatttgagtcttaataattaccttgttttaaagctatttctttatagtctgaactgtttaataaattgggccacttaccaatgagccacacagccagttcttgtcaggagctggttgaaaactgtgctgtgcatgtagcaggaatggcacaagaagatagccgtcgtggtcaagtgccatcttccttttatcatggtgccaaccaagaacttgacctgtccaccaaagtgtacaaaagggaatcaggaagtccttattctgtgttagtggacaccaagatgagcaaaccgcatctccatgaaacagaagaacagccatatttcagggagacaagagcagtgtctgacgtgcatgctgttaaggaagaccgggagaattctgatgacacagaggaggaagaggaagaagtctcttacaaaagggagcagatcatagtggaggtaaaccttaataatcaaacattaaatgtatctaaaggggaaaagggtgtctcttctcagtccaaagagactcctgttcttaagacaagcagtgaggaggaagaggaagagagtgaggaagaggccacagatgacagcaatgactatggagagaatgaaaagcagaagaaaaaggagaagatagtagagaaagtcagcgttacacaaaggagaaccaggagagctgcctctgttgccgcagctaccacttcccctactcccagaactacaagaggtcgtaggaagagtgtagagccacctaagcgtaagaagcgggccacaaaggagcccaaagcaccagtccagaaagctaagtgtgaagagaaagagactctgacctgtgagaagtgccccagggtatttaacactcgctggtacctggagaagcacatgaacgttactcataggcgcatgcagatttgtgataaatgtggcaagaagtttgtcctggaaagtgagctgtcccttcaccagcaaacagactgtgaaaaaaacattcagtgtgtttcctgtaacaaatcgttcaagaaactctggtcccttcatgaacatatcaagatcgtccatggatatgcagaaaagaaattttcctgtgaaatttgtgagaagaaattctataccatggctcatgtgcggaaacacatggttgcacacacaaaagacatgccatttacatgcgaaacctgtggaaaatcattcaaacgcagtatgtcactcaaggtgcactccttgcagcattctggagagaagccctttagatgcgagaactgtgacgaaaggtttcagtacaagtaccagctacgctcccacatgagcattcatattgggcacaaacagttcatgtgccagtggtgtggcaaggatttcaacatgaagcagtacttcgacgaacacatgaaaacacacactggagagaaaccctttatctgtgaaatctgtggcaaaagcttcaccagccgccccaacatgaagagacaccgcagaactcacacaggcgagaagccctatccatgtgatgtgtgtggccagcggttccgcttctcgaacatgcttaaggcccacaaggagaagtgctttcgggtgaccagccccgtgaatgtgccacctgctgtccagatcccacttacaacttccccagccaccccagttccttctgtggtgaacacagccacaaccccaacccctccaatcaatatgaatcctgtaagcactcttccccctcggcccatcccccaccccttctcacacctgcacatccacccacaccctcaccacccacaccaccttcccatccctccagtccctcacctcccgccacctccagctctctttaagagtgagcctttaaatcatagaggccagagtgaggacaactttctgcggcacctggcagagaagaacagttcagcacagcatcattaacatccgtctccttagtgtgttctccaggagacacgtccccatgtgtgagcgtgcacagagggagtcggtgagcatttccttagttctcagactctcctccgcctctaccaagagcttcgccagtgtcactgaatcaacagatccaagggaatgaacaagaagactaccttgagctcacagagggactgtcatctaaaccaggggaaccactgaactaaagcccaatttgcttgcattttctgatgacttttataagtttcaaatactcagacttgtggaattttataatttcatatcagctgatgaggtatgcttgcttttatatcccagacttctcctcaaagaggggataggcctggtttcctttgtactaatcgggaaggctgtgagattaatccagagcattaattgtatcactgtgtatggtaaggaattcttttcagcttttggtgccagctacagagttgagctggccatgtttcacagtatatcaagcattatagagaaagacagaaattttcttctttgtgtagctctcctaacgcactctttattttactacagaaattattttagagtttttgtatagacttctttggtagtctgtttctaaaatgaaatgtatttcaataagcagtgtaattttttcagtgtagctgaacctatgttgtaaaatagaaaaaaatttttataatcatcaaaatgtgattcttaaagatgcatataacttctataattcaaagctattcttacatccgtacaactcaaaaggtgcttcagagactagatgtatctgagagggtctccagaccaggttactgcaaaaatgaggttttgctttcaggatttggcgtaaatacttggtagttttgacatctctgcttaacactcaagagaggctccctaatgtgctcctgtcctccatgttctgcttggcttcgttagtgcattacatgaaatgatttgcaggggatggggccttttccagggaagtcacctaaagcttgcatgttttgaaaatttgaataaggctgtttgctgacaggaggaggaagtagtggagatcatttcatctcagtcacgtctgtttctcacttcccttaggaattgtgttgatgtttaacttttatgggatgacaaattgaaatcgctcattttgaggttgctttatttttctagaattgttataagaagctaaaatagtaaacttaaaatcacaaacatgacattgctgatagtggctgagaaattcagatgagaagacaaattggttatgaattttgaaatatctattatatgtaaaatgtggatatgttcacaaccttgagctattttaacacagtttaaatatagtgagggaaaactcctaagttttactgccctgtcctctgcaaattatgtaataccagcattcttaggcgataaagagagcagcacctctagtacctttaggcagattactttttcaagtttggggaacttcaaaagaccataatcaaccaggagcttattataggaaaggctgaacagaagggctagtgtattgattacacttaacagatcatatttatccagactcagtatagcttaaaattttgtatttctttatctgagagaactgagttcccaggctaaatcacttacctcccaccccctctccaattttttttttaagagacaaggtcttgctatgttgcccaggctagagtgcagtggctattcacaggtgcagttatagcacactacagcctccaactcttgggttcaagcaaccctgcctcagctaaccaagtagctgggactacaggtgcatgctaccatgcccagtccattttttaatcttgaaatttcttcatttttctttcttcggtttcttaaaatctttgcctgaatcagaacgctggcttttatttatttttttatttttaatattaaatgtgcagatatgcttcgagcacttttctaactaatgagctctgtggtaagaaaaaatgaactctttcaattgagattaagtccatatttttcaaacatcacgttctctattggctttttggtttagtgtttctaaattttctccttctgattttgcctgtcttatataatgagcataggaaaattttggaatgaggcagaaaagtatatcaagacatacttcctggttttggatgtaagttttaaagaatggtatttttaatatttgtacacattctttgagcacccaggtacccaagccaataaggaaagttaattccttgcatatgactgttatatctttagtggttgtctccctctccctccacagtctccttggcattccatgacaagtttgtcaacctacacttttatatagacatatcattatttcatggtcaagcctgtagtattaaaatgatttttttaaaagatgtaaa

SEQ ID NO: 3467 - DNA, 4543 bp, Homo sapiens
gagcgccgcggctgcaggcccccgccgcagggatggaccgccgaggcggcggccggggcggcggaggcggaggcggccggcccggtggtctggagccgaaccggcaatatctctgaggtgtgactgttctctcagcttcatcaaatataaagtggaaagagttttgttcatgaagccactgaatgaaccattgcttgccttaaaggaagataagatgctcccaagtcccttgcagctctcttcagaagaaaaatcactagtgctctgctcttgccataataccaaacctttttgactcatgctttggtgctgcaacactggaagaattgcacacagtttccaggaatatctttttttcatttgagtgattctttgtggatgagaaaagatttgagtcttaataattaccttgttttaaagctatttctttatagtctgaactgtttaataaattgggccacttaccaatgagccacacagccagttcttgtcaggagctggttgaaaactgtgctgtgcatgtagcaggaatggcacaagaagatagccgtcgtggtcaagtgccatcttccttttatcatggtgccaaccaagaacttgacctgtccaccaaagtgtacaaaagggaatcaggaagtccttattctgtgttagtggacaccaagatgagcaaaccgcatctccatgaaacagaagaacagccatatttcagggagacaagagcagtgtctgacgtgcatgctgttaaggaagaccgggagaattctgatgacacagaggaggaagaggaagaagtctcttacaaaagggagcagatcatagtggagtgtgtttcctgtaacaaatcgttcaagaaactctggtcccttcatgaacatatcaagatcgtccatggatatgcagaaaagaaattttcctgtgaaatttgtgagaagaaattctataccatggctcatgtgcggaaacacatggttgcacacacaaaagacatgccatttacatgcgaaacctgtggaaaatcattcaaacgcagtatgtcactcaaggtgcactccttgcagcattctggagagaagccctttagatgcgagaactgtgacgaaaggtttcagtacaagtaccagctacgctcccacatgagcattcatattgggcacaaacagttcatgtgccagtggtgtggcaaggatttcaacatgaagcagtacttcgacgaacacatgaaaacacacactggagagaaaccctttatctgtgaaatctgtggcaaaagcttcaccagccgccccaacatgaagagacaccgcagaactcacacaggcgagaagccctatccatgtgatgtgtgtggccagcggttccgcttctcgaacatgcttaaggcccacaaggagaagtgctttcgggtgaccagccccgtgaatgtgccacctgctgtccagatcccacttacaacttccccagccaccccagttccttctgtggtgaacacagccacaaccccaacccctccaatcaatatgaatcctgtaagcactcttccccctcggcccatcccccaccccttctcacacctgcacatccacccacaccctcaccacccacaccaccttcccatccctccagtccctcacctcccgccacctccagctctctttaagagtgagcctttaaatcatagaggccagagtgaggacaactttctgcggcacctggcagagaagaacagttcagcacagcatcattaacatccgtctccttagtgtgttctccaggagacacgtccccatgtgtgagcgtgcacagagggagtcggtgagcatttccttagttctcagactctcctccgcctctaccaagagcttcgccagtgtcactgaatcaacagatccaagggaatgaacaagaagactaccttgagctcacagagggactgtcatctaaaccaggggaaccactgaactaaagcccaatttgcttgcattttctgatgacttttataagtttcaaatactcagacttgtggaattttataatttcatatcagctgatgagggtcccaggccataaaacaacggagagctgtacttgcttgtcacttggaggaaccacatccttgagacagcctgctgtcttgtatgtcttcagtaggaaacttctgacacacacattcaagggagttcctgcccctgagaagtgttcccatagctttccagtcgcaggttactttcacactacgtcagcttctctggtgagatcagggatgttacatattacttgaaaatgatttcataggaagtgaggatggggcaagaaaggaggtagaagctgaattttgcttaacttcagaaggaaatctgatacttgccttggctagttctgatcaactaaagagcctgtgtctgtactggatgtgccaaagagtcaagttgtttctggaatatccagctcctctgaatgaacacagcttcctccctacctgtcttttatgggtgaaaagggaccgtctgatgagcatgatagacatcctgtacaggactcaagactgtttcattgcatttgaaagttggtgggaagtattttattctgctagagctcctaaccctcctagaaatatcttttcatgctctattaattcaattcattagtttaaaaagaaacagtgtgacataattttggtgtttacttcttaagttgtctccccaagggcatatatgtagcctctgaaaatgggatgatttcttctcaatcttccataaatttgaatatgcattttattcatttcttgacatgggctgtgtgactgttttccatcagcagttctggctttgtccacaagggagcaataaagtacgttagctttattctcaaccttctaaagaaagatcccacttttaaatctcttctggaatagcctcttagctcaaagcttattcatgtattttgattatttaagaaattttcccttattacaaagtccagtcgtcgttcatccctcatgatgccaagcaatgattgatgtgtgggtgtggagtccttgtgggtcaggcatcttaattaattagactttttacatattgatgatccccagattgaaagccaggaccttcccataggggcgcctttgtgtgctaaaggcagagcaggcaggcttctccactcctatctcctccgcaggccaccaccatcacatctataggaggaacaagagcactgggggaactctggagtatgagtaaggaaatgcttctcaccttctctgctccaaagagatatctgttacatcagggaacaagtcctctaggtcaggcacttcctcctgaccagtgcaacgggcactccaggttagaaactgtgtgtgctccctctctgtcagttacttgtctaagggctcctatccgtggtcatcagctctctggccatgagttctgtttgtgcttattgcagcagcatcttcacaacaaacaggtcagtaatcaacctgggaagggaaaagacgacagtaaatattaccccctgtagagccgggaggcatttacacctggaatggccttcttaactgatttctgcctggccacctcacccccagccaagtctgaacctgagcaataccaggcacagagaggtgtctacttgtaactccaacacttgacaaaaaacaaaactgaagctgtgattggtttaggcagcaagtggccaggtgcaacttgtttgtttttatttttgttttccccaacagtactgagatcacttgcacttttcctcatttcttaagaaaatccagtttgcttgccatgacttgtttagcgttaggtttacaaagcttgttgttgaatgttgaatatttgtccaaaggagtttgacaaaatagaagctgcttggtccctgttctgcctgctaggtcataaggatgaaggccatgtggctggggtacttatgtcaagtccagaatggggcagtgtccctctcctacctctctgcggagacgcaattgaaggtcaagtagactcagtgtagggcaggcagctgtcatgctgcaaagaagtttagaggagtctttgggttggggaggtgacaggtaggtaggacaggatctcttaagatgggaaagatactggggagaggagggctgcttggccccagggaactgcagtgaggtggaactgagctccgctcctgaatctccaaaggagcccatgctgcccggcttccctgagtcattttttccagcatcctgtcagatccctcaatgtactgatttcccccttgtgttaactataccgatattatttttttagcaattgaaatgcacttttttatttcaactcaatcatgattttaagtataaaaaatttatagattgttaaaactacttttttgtgtatttttaaccactcaatgtagcattgtatattttattcttgtgagactctggtacaggtgtgccgcctaatgatttttctgagatgctgggcctttggatgtgtacggtaaccaacttaatgctaatgttcaaagtaaaaaaaaaaaaaaaaagcagcca

SEQ ID NO: 3468 - DNA, 2237 bp, Homo sapiens
agtttccattcttggtctccttttggcgccctggggcagcgagagaccgtgagaaatttctcggcggcgccgaagatgcgcgccacttccggtctggctcctaacaacgggggaggctggtaaccagggtgggggggatggcggagcgggcgctagagcccgaggcggaggcggaggctgaggcgggcgcgggcggggaggcagcagccgaggagggcgcagcgggccgaaaggcgcggggccggccgcgactcacggagtcggaccgggcccggcgacggctcgagtcccggaagaagtacgacgtgcggcgcgtgtacctgggcgaggcgcacgggccctgggtggacctgcggcgccgcagcggctggagcgacgccaagctcgccgcctacctcatctctctggagcgcggccagcggagcggccgccacgggaagccttgggagcaggtccccaaaaagccaaagcggaagaaaaggcggcgacgcaacgtgaactgcctgaagaacgtggtgatctggtacgaggaccacaagcaccgctgcccgtacgagccgcacctggcggagctagaccccacttttggcctgtacaccacggccgtgtggcagtgcgaagctggccaccgctacttccaggacctgcattcgcccctgaagcccctcagcgactcagaccctgacagtgacaaagtgggcaatgggctggtggctggcagctctgactcatccagctctggctctgcctctgactctgaggagtctcctgagggccagccggtcaaggctgcggcagcggcagcggcagcgacgcccaccagcccggtgggcagcagcgggctcatcactcaggagggcgtgcacattccctttgacgtccaccacgtggaaagcctggccgagcagggtaccccgctgtgctccaacccagcaggcaatgggcctgaagccctggagacagtggtgtgcgtgccggtgcctgtgcaagtgggtgcgggccccagcgccctctttgagaacgtgccccaggaggccctgggtgaggtggtggccagctgccccatgccaggcatggtgcccggctcacaggtgatcatcattgcgggccctggttacgacgctctcacggccgagggcattcacctcaacatggcagcaggcagcggtgtccccggcagtggactgggcgaggaggtgccctgtgccatgatggagggtgtggcagcctacacccagacagagcccgagggtagccagcctagcaccatggacgccaccgcagtagcaggcatcgagaccaagaaagagaaggaggacctgtgcttgctaaagaaggaggagaaggaggagccagtagccccggagctggcaacaacggtgcctgagagcgcagagcctgaggcagaggcggacggggaggagctggacggcagcgacatgtcagccatcatctatgaaatccccaaggagcctgagaagaggcggcggagcaagcggtcgcgggtgatggatgctgacggcctgctcgagatgttccactgcccatacgagggctgcagccaagtctacgtggccctcagcagcttccagaaccacgtcaatcttgtgcatcggaaaggaaagaccaaagtgtgccctcatcctggctgtggcaagaagttctatttatccaaccacctgcggcggcacatgatcatccattcaggtgtccgtgaattcacctgcgagacctgcggcaagtccttcaagaggaagaaccacctggaggtacatcggcgcacccacaccggcgagacccccctgcagtgcgagatctgtggctaccagtgccggcagcgcgcgtcgctcaactggcacatgaagaagcacactgcggaggtgcagtacaacttcacgtgcgatcgctgcgggaagcgcttcgagaagctggacagcgtcaagttccacacgctcaaaagccacccggatcacaagcccacctgacccacctgaccactgaccgcccctatttattcgtccgctcggacaccacgcccgggcttgccggggcctggacagctgcgagggccgcccggaccgcgggccggaaggaggcgcccccgccccgccccagagctgggccccctgggcaggttccccaccccgccccaccgcatccttctcggagctggtgcctggggctgcattgctggaactgtgtcaagagagcagagtgagattaaagagcgagaaagg

SEQ ID NO: 3469 - DNA, 4966 bp, Homo sapiens
ctggaaaataatgcaggtaatctaaaaaggacggaggaacagcaaggtttggatgaagggtttgactctcttacagatcagagcactggagagactgatcctgatgatgtatctggagtgcagcctaaaggtcatattaatacgaagaaaaatcttacagctctcagtacttccaaagtagatcacaatgtcccaaggcatcgttgtatgttatgtaacaaggaatttttaggtggtcacattgtaaggcatgcccaggctcatcagaaaaaaggcagttttgcatgtgtaatatgtggtaggaaatttagaaacagaggacttatgcagaagcatttgaagaatcatgttaagaagatacagaggcagcaaattgctgcagctcaacaggatgatcaggaagtcactgctttggaagaaataaattgttctagttcttccatttcatttgaaaatgggaattctgatagtaaggatttggaagtggagacacttactgcttctagtgaaggaaacaaagaagtcatccctgagcatgtggctgaattcattgaaattcccataagtgtaccagaagatgttattgaaaatgttattgaaaatggcagtcctaataattctttaaataatgttttcaagcctttaactgaatgtggggatgattatgaggaggaagaggatgaagaaggtgattatgaagaagatgattatgacctgaatcaagaaacttcagtaattcataaaatcaatggaactgtgtgccatccaaaagacatatatgccacagatcaagaaggaaactttaagtgtcctgctcttggttgtgtccggatatttaaaagaattgggtttctaaataaacatgcaatgaccgtacatccaaccgatttaaatgtgcgacaaacagtaatgaagtggagcaaaggaaaatgcaaattttgtcaaaggcaatttgaagattctcaacattttatagaccaccttaatagacatagctatccaaatgtgtatttttgtttgcattttaattgcaacgagtcgtttaagctgccgttccagcttgcccagcacacaaaaagtcacaggatatttcaggctcagtgtagttttccagaatgccatgagctttttgaagatcttcctctgctgtatgaacatgaagctcaacactatttaagtaaaacaccagagtcatctgcacaaccaagtgaaacaattctttgggatgttcagacagactcaaatcctaatcaggaaaaagactcatctagtaatgagaaacaaactattagtctgccagtttctactagcaaatcaaggaaagagtctacagaaccaaagacatgtatagaaagtatggaaaagaaaacagacagtttagttcagaatggaaacgaacgttctgatgacactgtttcaaatataagcttgatagaccaaaagatgcctgacatagagccaaattctgaaaataattgtagtagtagtgatatagtcaatggacacagtgaaatagagcaaacacctttagtttcatcagatcctgctttgaaaattgatacaaacagaatcaggacagaaaatggttccattttgcccagtgttgtaccacaagaacacaacaccttgccagtatctcaggcaccttccaaaccaaatctgacaagtgaacatacttcatatggcttaattttaacaaaaccatacgtcagaccattgcctcccagttaccttgatgaacggtatcttagtatgccaaaacgcagaaaatttctgactgatagagtagatgcctgttctgatcaagataacgtgtataaaaaatcagtgaaaagattaagatgtggcaaatgcctgaccacctactgtaatgcagaagcacttgaggctcatcttgcacaaaagaaatgtcagacactctttggatttgattcagatgatgaaagtgcctgatgaaaacggttcagaaagatctgtcaatcaagcagtagtgtgaaaaaagcactataagaaaatgcatcatcagtttgctatttccctgatggccttaattttagagtggtcttggattactaaagataaagacaaagcacattttctagaatgaactcacagagatgtgctggcttagactccaaaaggattataaaactcccaaagtaccagttttccagaaaaccacattttacagtttatgatgattaatagcagcagcatgttcagtttcgcttatatgagaaacatgtttaggcaactagtcagaaaaccagctatggccttacagaaagggaaaaattaacccattattaaaaagtgtgtgtggggaggggggctggtttacaatattaaaccatttaaagtattttattctacaaatggggtttgttttcttgtcatgcataatcagattatgtcccctcccttctggttaaacatggtttaaggaaccgctgctgtttggtttgtgattgatttagaaacttatacattaacttaccacagtgctatcaattaaagattgtaacaggtttccagatgattaattaggtcaaagttcaatgaatggcacgccagcattgaaaattaaaaaacaaaacaaaaaaaaccacagtgctttgctaataagctcttgatagaacctcccactaaccacttttgtggtacaaattagttaacatttaaagggcagcagtgtcaataaaatagaaaaaaaccgatcagtactctggggagagatgaaaggaatctaagactttacaggctttgtagttgaaggaaaacactgaattgcaaattattcaatgtgaataatggtaaaagcacactgggatacttctgtttgtgtatatgttgggacattgcttgatgattcatagtaaggtcctttagacattaatgtgagttatctaagtacagtcctattaaaataactggctcaaaaaatcagctaagaatcaggttgagaaatcattcattttattctattaggagaggtaattccaaaataagccatactattcctgtttttttaattcattagtgatgactctggtctgaacagtaatttttatatgtaaaaggaagtatttacacaaaacatttgcacaagaacacagtaagagatacattcaagcattgttttccttagtgatgttattttcctaagaagattttaacttaataaagtgttaaaacaataaatatttttaaaaataccctctcagatgttttccatttgtccattattgaaaggaagatgcttaaagacttccttttactaatagtgtgtaaatctaaaacagggattaaaataacaaaaaggcagtgtttcaaaacagatctcctaatgtcccaatgtcaaatattccagttattctaaataataaaatctttgttcaaggcagataatctcatcagaccctattagagcttcttgaatgaggctattacggaagtggggaatttcttccaggtagcatccatattttattaaattaggatttccagatcatgatagatcagatgatttttttttaatttcccggttttattggtttatcatcagcattcactactatgcaatgatggtcataagtccattccaaatttaaatttgtttctgttatgtagcctatattaggctgtggaatttacatttaggtaactaaacacagctcataattaaaatcttttctttaaggtcagctaaaaaaaatgtttcctgtatttcttgatactaaaaatgtaatgatttttattttagttcattctaaaagtatgtcttgtaataaaaagtctgtttggaaactggttcatttggacagtgaagtcttttgaaatatttctgctttgtacattttccagaagtttaatattttatcacattttccacaagttgtaacaattgatataaatccatgcccacaaagtattccattttcattacttttactgttcatgccaagatgtttcaaatatattccatttgtaatctgtctttaacttgaggtttatttctacttttgtgttgctaaaattatttctgcaagactgagatcaaactggtttatatataactaaatcaaggaatgttttataaaattctatttgaccacactgtcttaacctcggtttatatacttctcaaatagctattgaaagaatgtgttcattttattacatctgtcttttaaaacataaacctacatcattttgcttttatagggtgcataaacttccaacagttctaatttgagcgcttcagaagaaaaggaagcttgcttcttattcctcagattcttctttttttctgttttgaggatgtattcatcctacatggaccaagtttcaaatctttgtttttaaataaaaatttccttcaaaaaattaaatgttaaatttctgctgtgtgtcagtaaggtgaagaaaatagcaaatctgaatttttgctgctcagatattatggaggaggtaaaaaggggaatctccgtggacaaggacactggtactttgggctttagccatattcatttttttgaaaccaccaattatataatacttaaataatttatatcattgaacttgtgattcttttcaaatcacactgaaggttcagccgtactcctttcatgtttggtttaatactgttgtatggatgaaaaacctaaaagggatgatagtgtttattttttaatttatttggtactgtaaaacaccttttcagaatgagtaaatgctgcatatgcattttggagttgttaatatgtgaaagatattacagattcagcaagaaaggaaatttgtgcttccttgttgaatgttaaattattttactttgcattttataagagtacaaattaaaactgagccattgaactgcaataaatcaacaatagtgtctcatttcaagaaattttttgtactgtacatagatttgttcaataaaacgtccttgttggtaatcaag

SEQ ID NO: 3470 - DNA, 3478 bp, Homo sapiens
aaagggacacggtgtccgagtctttaggtctgcgcgggagccgaggctgcgcacctgggctgaacctccacagtcctctacactcttccaggagcagcagaaaatgaacatgtctcaggcatcagtgtcattccaggacgtgactgtggaattcacccgggaggagtggcagcacctgggccctgtcgagaggacgctgtacagagatgtgatgctggagaactacagccacctcatctcagtgggatattgcattactaaacctaaggtgatctccaagttggagaaaggagaagagccatggtctttagaagatgaattcctgaaccagaggtacccagggtattttaaagttgatcacatcaaagggatccgggaaaaacaagaaaaacctctgtggcaagaaatattcatcagtgatgctgacaaaacattgagtaaagaaggacagaaagttttagaaaaaccatttaatctggaaatagctccagagctttcagaaaaaatatcctgtaaatgtgactcacacagaatgaatttgccagttgcttctcaattaattataagtgaaagaaaatattcaagaaagaagactgaatacatgaatgtgtgtgagaaactgcagcttgatattaagcatgagaaagctcatgctgaagagaaatcttatgaacatggtgaaaatgctaaagctttcagttataagaaagatcagcattggaaatttcaaactttggaggaatcttttgaatgtgatggatctggacaaggtttatatgataagacaatttgtattacacctcagagttttctaacaggagaaaagtcctgtaaggatgatgaatttagaaaaaactttgataaaatcactttatttaaccacatgagaactgacacaagggggaaatgctctgatcttaatgaatatgggacatcctgtgacaaaaccaccgctgttgaatacaataaagttcacatggctatgacacactatgagtgtaatgaaagggggattaatttcagtaggaagtcacccctcactcaatctcagagaactattacaggatggagtgcttttgaaagcaataaatgtgaagaaaattttagccagagctcagcccatatagtacatcagaaaacacaagctggagataaatttggtgaacataatgaatgtacagatgccctctaccagaaattagactttacagcacatcagagaattcacacagaagataaattctacctttctgatgaacatgggaaatgcagaaaatccttttaccggaaagcacacctcattcagcatcagaggccccactcaggagagaaaacttaccaatatgaggaatgtgcaaaatccttttgttcaagttcacatcctattcagcatcctggaacttatgtgggattcaaactttatgaatgtaatgaatgtgggaaagctttctgtcagaattcaaacctcagtaaacatctgagaattcacacaaaagagaaaccttgtgataacaatggctgtgggagatcttacaagtcacccctcataggacaccagaaaacagatgcagagatggaactctgtggtggcagtgaatatgggaagacatcacatctcaaaggacatcagagaattctcatgggggagaaaccctatgaatgtattgaatgtgggaaaactttctccaagacatcacatctcagagcacatcagagaattcacacaggtgaaaaaccctatgaatgtgttgaatgtgagaaaactttctctcacaagacacacctcagtgtacatcagagagttcacacaggggagaaaccctatgaatgtaatgactgtgggaaatcttttacctataactcagccctgagagcacatcaaagaattcacacaggtgagaagccctatgaatgcagtgactgtgagaaaacttttgcccataattcagccctcagagcacatcatagaattcacacgggggagaaaccttatgaatgtaatgaatgtggaaggtcttttgcccatatttctgttctcaaggcacatcaaagaattcacacaggggagaaaccctatgaatgtaatgaatgtgggagatctttcacctacaattcagccctgagagcacatcagagaattcacacaggtagaaaaccctatgaatgtagtgactgtgagaaaacttttgcccataattcagccctcaaaatacatcagagaattcacacgggggagaaaccctatgaatgtaatgaatgtgagaaaacatttgcccataattcagcccttagagcacatcagaatatccacacaggggagaaactctatgaatgtagtgaatgtggaaaaacttttttccagaagacacgcctcagtacacatcggagaattcacacaggggagaaaccctatgaatgtagcaagtgtgggaaaactttctcccagaaatcatacctcagtggacatgagagaattcacacaggggaaaaaccgtatgaatgtaacgtatgtgggaaaacttttgtctataaggcagccctcatagtgcatcaaagaattcacacaggggagaaaccctatgaatgtaaccaatgtgggaaaactttctcccaaagaacacacctctgtgcacatcagagaattcatactggggaaaaaccctatgagtgtaatgaatgtgggaaaacgtttgctgataattcagccctcagggcacatcacagaattcacacaggggagaaaccctatgaatgtaatgactgtgggaagactttctccaagacatcacatctcagagcacatcttagaactcgctcaggggagaaaccctatgaatgcagtgaatgtgggaaaaccttctctgagaagtcatatgttagtgcacatcagagagttcatacgggggagaaaccctacgaatgtaatgtatgtgggaagccatttgcccataattcaaccctcagagtacatcaaagaattcacacaggggagaaatcctatgaatgtaatgattgtgggaaaacgttctcccagaaatcacaccttagtgcacaccagagaattcacacaggggagaaaccctatgagtgtaatgaatgcggaaaagcttttgcccaaaattcaactctcagagtacaccagagaattcacacaggggagaaaccctatgaatgtgatgaatgtgggaaaacttttgtccgtaaggcagctcttagggtacatcacaccagaatgcataccagagagaaaaccctagcatgtaatggatttgggaagtcctgagggaatgcataccttaccacataacacgtagtgcagaaactcatgtgacataggctgggaacttgtttcccttatccatttcctttttcattaggctcatagtttgtggaaaaatcccaatatgccgtttattcaggtggggctgaccatgggatgtggtgctaatgataaatattacatttacccttggccctt

SEQ ID NO: 3471 - DNA, 2149 bp, Homo sapiens
agccccacctcctgccgtctgccctcccgggcctgaaagggacacggtgtccgagtctttaggtctgcgcgggagccgaggctgcgcacctggggcacatgaataggattacatgctccttgattacagtggggttatgtcgcagtaaaaccattatcaagtcgaaccatctcatgtcagggaccatctctgtaagaactgagaggcagaccaggtctctcatgaccccactgctctttcctcctccccagctgaacctccacagtcctctacactcttccaggagcagcagaaaatgaacatgtctcaggcatcagtgtcattccaggacgtgactgtggaattcacccgggaggagtggcagcacctgggccctgtcgagaggacgctgtacagagatgtgatgctggagaactacagccacctcatctcagtgggatattgcattactaaacctaaggtgatctccaagttggagaaaggagaagagccatggtctttagaagatgaattcctgaaccagaggtacccagggtattttaaagttgatcacatcaaagggatccgggaaaaacaagaaaaacctctgtggcaagaaatattcatcagtgatgctgacaaaacattgagtaaagaaggacagaaagttttagaaaaaccatttaatctggaaatagctccagagctttcagaaaaaatatcctgtaaatgtgactcacacagaatgaatttgccagttgcttctcaattaattataagtgaaagaaaatattcaagaaagaagactgaatacatgaatgtgtgtgagaaactgcagcttgatattaagcatgagaaagctcatgctgaagagaaatcttatgaacatggtgaaaatgctaaagctttcagttataagaaagatcagcattggaaatttcaaactttggaggaatcttttgaatgtgatggatctggacaaggtttatatgataagacaatttgtattacacctcagagttttctaacaggagaaaagtcctgtaaggatgatgaatttagaaaaaactttgataaaatcactttatttaaccacatgagaactgacacaagggggaaatgctctgatcttaatgaatatgggacatcctgtgacaaaaccaccgctgttgaatacaataaagttcacatggctatgacacactatgagtgtaatgaaagggggattaatttcagtaggaagtcacccctcactcaatctcagagaactattacaggatggagtgcttttgaaagcaataaatgtgaagaaaattttagccagagctcagcccatatagtacatcagaaaacacaagctggagataaatttggtgaacataatgaatgtacagatgccctctaccagaaattagactttacagcacatcagagaattcacacagaagataaattctacctttctgatgaacatgggaaatgcagaaaatccttttaccggaaagcacacctcattcagcatcagaggccccactcaggagagaaaacttaccaatatgaggaatgtgcaaaatccttttgttcaagttcacatcctattcagcatcctggaacttatgtgggattcaaactttatgaatgtaatgaatgtgggaaagctttctgtcagaattcaaacctcagtaaacatctgagaattcacacaaaagagaaaccttgtgataacaatggctgtgggagatcttacaagtcacccctcataggacaccagaaaacagatgcagagatggaactctgtggtggcagtgaatatgggaagacatcacatctcaaaggacatcagagaattctcatgggggagaaaccctatgaatgtattgaatgtgggaaaactttctccaagacatcacatctcagagcacatcagagaattcacacaggtgaaaaaccctatgaatgtgttgaatgtgagaaaactttctctcacaagacacacctcagtgtacatcagagagttcacacaggggagaaaccctatgaatgtaatgactgtgggaaatcttttacctataactcagccctgagagcacatcaaagaattcacacagggcttgctgtctgtcatgttggtatcttaatggctaccaagagtctgtttcatcagtcgtaa

SEQ ID NO: 3472 - DNA, 5834 bp, Homo sapiens
agttccttctgcgctttgttcaagatgtgggtctggcgctttcgtgactcaagaccctcttaggaacttcttcactgaactcaaggaggagatcaggcaagatctgtgctgtgcagatcctttggattgaggctgctgtgcacaggaatatggatggtgaaactgggactgaggaggagttaattccaaagcatcattcctgaaaaatcagaatcatacatactttcaagagaattccacagagacattgcccaggaagtcaaaatttagaaggctcctctgaagggaaagagaagactagagaggacactggtatgttccaagcaggagaaaatgaggagaaagacaagaaatttcaaacataagacagttaaagacaataaagtactcacagaagggagtgaccaagaatctgaaaaagacaatagtcagtgctgtgaccctgcaacaaatgagagagttcaggctgaaaagagacagtatgtatgtactgagtgtgggaaagcctttagtcagagtgcaaacctcacagtacatgagcgaatccacacgggagagaaaccctataagtgtaaggagtgtggaaaagctttcagtcatagctctaaccttgttgttcatcggagaatccacactggactgaagccctatacatgcagtgaatgtgggaaatctttcagtggaaagtcacatcttattcggcaccagggaatccacagtggggagaaaacttatgaatgtaaagagtgtgggaaagcctttagtcggagttcgggccttatatcacatcacagagttcacaccggagagaagccctattcttgtattgagtgtgggaaagcctttagccgtagttcaaaccttactcaacatcagcgaatgcacagaggaaaaaaagtttacaaatgtaaggagtgtgggaaaacatgtggttctaatacaaagattatggaccatcagagaattcacactggagagaagccttatgaatgtgatgagtgtggaaaaactttcatcttaaggaaaactcttaatgaacaccagagacttcatcgtagagagaaaccttacaaatgtaatgagtgtgggaaggcttttacttctaatcgaaaccttgttgatcatcagagagttcacactggagagaaaccctataaatgtaatgaatgtgggaaaaccttcaggcagacttctcaagttattctacacttgagaacccacactaaggagaaaccctataaatgtagtgagtgtgggaaagcctatcggtatagttcacagcttattcaacaccagaggaaacataatgaggagaaagaaacctcataaataacaaatattgtgggtagtagggctgactgctgcttttctaaaaagtagttctttagtatcaactttaattctacttctaagaatcatactctacttctaagaaaataattagaagtagacaaagattaatgaaagggatgttcatgacagcatcatatacgactgaaagaagaaaactagattttcaacattacagggttgaaatgaatgatgagctatccatatgatggttctgcagccattgcaaacatttttaaagacaatttaatgccatggggaaatgattggataagacggaagataatgacatacaatccaaaatttaaaaaaatatttttgcataggaaaaattgagaaggaagtaaaccaaaatgttaacagtgatcatctctgggcgataggattataggtgatttctattttcttctgtatacttttctatgctttctagattatctacatgagaatatactaattttatatgcaagaaaaaaagcacagtattttttaaatgcaatgaagacgtgcttattttcactcagcagtgttatgaaaggcacgtagtatatagagcccaaagccctgggattgcaccctgacactggcatttagcagcagtggaaccgcgagcaagtcccttccttttagagcgtgtttcctgttaagtaaaatcataaacaccgatcctttgtcctttttagttttaagacaagctgactttagagttgtcaacaaaatatataataacactgttaggttaaaagaacacagcaaaaattcactgaaccctcctttcccacagttctggaaggatctgcagatgatggagaactacctaggcttcatcttttcaacatatgtctacacaaccagaaaaaaatgaaattgaaacaactgtagactcaaaaacttcagatacagtcaccagttaatataaaactagtgggagactctgccttcacatggtatatagagtttaaaggctaaaagtacaaactttggggttggagatatccatgttctaaccccagttctaccatgaactagcttgtcagttttggacaagtcacttaactgctctgagcctcagacctgtgtgtaaaaaaggaacaattacctaccttacaaggttgttgtgaggattaagtgagtaatgcatgaaatatatgataagccagacacgtggtaaatgataaaatcttaagtataggacattgtagcagtgtttctaaacactttagggagagtgattaaagagaatttttgtgtaaggtagtacttaggatattttcagatgtattgaacagaataccaagtactagcagcctagaccttaagaacattgattgattgcttaaggggaatctagaggtaagcagtgctatgtttggtttggcaactcagcacttcatcacacttctctcttaactccataattttcagcatgttgactttcatttttcataacctcatggtggcaagacagtggccacagctgcatcttgccttcacacaactccttcagattgggaactggaaaaggagctgaggctttctcatctggtttcttccttttgtcactgagaaaaatctttccctgaagaagggacggagaggtgttgagcaatcaatacaacagatgttttctatcttcctctgcctttctttatgaccagtcctccttgaaggtcttagcccatcttccaccaatatttaaaacattttaagtgcttagctcaaagtcactctgaaacacttagaatctccctatttttaactcagccattcctctgtgtatacagtgaatccctaagcccactgttatctgtcttatgcacatagtgaattagtgtttggggaatttttgataatatgttatttagttctccctctattatacaagaaaattgagtgtcattgaggttaggtgactggctagtaagttgtcggagccaggatttgagctcagatctgactttgaaattcatgctttcttcattataccaaagtgcctctgcccaccatggtggttctgtatgtgagtggaagaccagttggcgttttcccaggtagctgcctctatgaaaggtgattgtatctaacaattatttgatatttgaccatggttttatagggaagatgttatcagtgttctgtgaatggggtttatggcctatctctgtacctcataatttagttttaaggtatatatatttctttcttgctgttaccggaaagaaagaagtgaagggtgaaggttgtatatttgtgtgaaaaaaaattactgattttgtcctattttgataggatagtggtttgcacataatttgtgatataatagtcctttgcatggtcattccaagcagggtttggaaggcctggaacagatttgtagcattcatggacaagcctggtctatcattcctgagcagaattgttgatgctttatatattgctgagcagatattctctgaccaaaacattttttcaccaccatgtcatagtgcctaaaactctttatttagataggctttcttttttgtcttagaagactatgatcttcaagagtatatctcaaggaaggatatgatgccatctcataaccagagaactgaatataggagagcttcatatttcttgccccaggcaggcgaggattatagtctcttgaggaggccatcacccatcttctaggctaatacctgccttgagctgtaggaataaacacttgacagtgggttcctgcatcctttcagataaacattcagctataatttgaactgatcacccacctttctccgggagtctcccagggttaccaacttttacctcagtcagagtttaggcatgcagctcttaccatcctttcaagccctttcataataccctctggaaaccaggaactgtctcttttaatgtgctttctttttctttcttttcttttcttttcttttttttttttttttgagatggaatctcgcactgtcgcccatgctggagtgcagtggcgtgatctcagctctcagctcaccgcaacctccagctcccaggttcaagcaattctcctgcctcagcctcctgagtagctgagattacaggcacctgccaccacacccagctaatttttgtatttttaatagagatagggtttcaccatgttggccaggctgatctcgaactcctgacctcacaagatccacctgcctcggcctcccaaagtgctgggattataggcatgagccactgcacctggctttatttatatgtgtatttatttatttatttatttatgagatggagtgttgctcttgtcgcccaggctggagtgcaatggcgtgatatcggctcactgcaacctctgcctcctgggttcaagcgattctcctgtctcagcctcccaagtagctgggattacaggtacctgccaccacacctggctaattttttgtatttttagtagagacgaggttttgccatgttggtcaggctggtcttgaatgaatgtgttttcttcacattcttgttccaatggaaaccgggctgttccccaagggcagtgcttattctgcattcctcaattgctggtttatgtgtctctcaactcatgtacctctctgtactgccatttcttctctcttctccatcagaaacttagctctaatcagtcatggttgcatacacacgtagtcctaggtactcaggaggctgaggggggaggatcacttgagcccaggagttcactgttacagtgagctatgatcacaattctgcactgcagcctaggtcacggagcaagaccctgtctcagaaacaaaacagtacaaaacaaaaaacccacaaaaacccaacccagtgcttttgaaatatatatcactaaactactgtgtattgctcattcttgttatttggtttcttgtctactcacatttattcacttacagttttagtaccctgaatattcctgaggaatataaagaggcaataattttagccacagacatcctggttatatagaattgctcctgtgtagaataaaaatatatatgctctttttagttgagaggaaaatacgaaaatctcattttatatagccttgagtagagggcaatacgtaagacaaagaattctgcttagagaggaaagtgtcgccctggacttagaaatcttttttcatagatggtgcgtcctgtgttaggtattacttggaagaaaattgaagtaaaaaacagctttaagtaactgagtaattaggattaattagtagctgttgaatctaaatcccttaagactaaatttcattgcagctctgtaccctcagcaggacttcctttcttgattgttttttccatttaatataaaatttaaaagatgcccatattgtcagttgtttttagtcgccagactgtctttaatagcctctgatgttataaaactggagtcatgaaattgttttgcaggaagtagtgataattccttcaataaacgtctgctattcttataaa

SEQ ID NO: 3473 - DNA, 474 bp, Homo sapiens
ttgcgtacttcttgtcccacagtgctgtctgcagctcatccttgagggagctaatctcctgtttcagtgactcaagaccctcttaggaacttcttcactgaactcaaggaggagatcaggcaagatctgtgctgtgcagatcctttggattgaggctgctgtgcacaggaatatggatggtgaaactgggactgaggaggagttaattccaaagcatcattcctgaaaaatcagaatcatacatactttcaagagaattccacagagacattgcccaggaagtcaaaatttagaaggctcctctgaagggaaagagaagactagagaggacactggtatgttccaagcaggagaaaatgaggagaaagacaagaaatttcaaacataagacagttaaagacaataaagtactcacagaagggagtgaccaagaatctgaaaaagacaatagtcagtgctgtgaccctgcaacaa

SEQ ID NO: 3474 - DNA, 556 bp, Homo sapiens
agttccttctgcgctttgttcaagatgtgggtctggcgctttcgtgactcaagaccctcttaggaacttcttcactgaactcaaggaggagatcaggcaagatctgtgctgtgcagatcctttggattgaggctgctgtgcacaggaatatgggtatttcctcttattccttactccactgcacctaatcaataaccaagaaccatgtaaccattgcttagagggacttgaacaggcagatgatgctggtgaattaaaggaagacagcctccaaatggtgaaactgggactgaggaggagttaattccaaagcatcattcctgaaaaatcagaatcatacatactttcaagagaattccacagagacattgcccaggaagtcaaaatttagaaggctcctctgaagggaaagagaagactagagaggacactggtatgttccaagcaggagaaaatgaggagaaagacaagaaatttcaaacataagacagttaaagacaataaagtactcacagaagggagtgaccaagaatctgaaaaagacaatagtcagtgc

SEQ ID NO: 3475 - DNA, 3186 bp, Homo sapiens
cgggtgtggagcacggggagtcgggcgtggggcgggcagggagtggagtcggggtcttactccggtggctgcagggcgcagggtagccgtgtcaggcctgcccaggtgcagagcgctcttccgcgaccccaacagcctctggtccggtctggcgcgccctcgctttcccagagggcgacctgggctatggcggccgtggcgctggcgagcgggacacgcctcggccttgtcctcgagctgctcccgggacagcccgcgctgccccgggcgcgccgggagtcagtgaccttcgaggatgtggccgtctacttctctgagaacgaatggatcggcctgggccctgctcagagagccctgtacagggatgtgatgctggagaattatggggctgtggcttccctggcatttccatttcccaaaccggctctgatttcccagctggagcgaggggaaacaccctggtgctcggttcctcggggagctctggatggagaggccccaaggggcatctcctcagagggtgtgttgaagaggaagaaagaagattttattctgaaggaggaaattattgaggaagcacaggacctcatggtcctatcaagtggaccccagtggtgtggatcccaggaattatggtttgggaaaacctgtgaagagaaaagcaggttagggagatggcctggttacctcaatgggggacgtatggaaagttctacaaatgatattatagaagtgattgtcaaggatgagatgatctcagtagaagagagttcagggaatactgatgtcaataacctccttggtatacatcacaaaattctaaatgagcaaatattctatatatgtgaggaatgcggcaagtgttttgatcaaaatgaggactttgatcaacaccagaaaactcataatggagagaaggtctatggatgtaaggaatgtgggaaggctttcagttttcgatcacattgcattgcacatcagagaattcacagtggggtgaaaccctatgaatgtcaagaatgtgctaaggcctttgtttggaagtcaaacctgattcgtcaccagagaatacatactggagagaaaccctttgaatgtaaggaatgtgggaagggctttagtcagaacacaagccttacgcaacatcaacggatccacactggtgagaaaccatacacatgtaaggaatgtgggaaaagctttactcgaaacccagcccttcttcgacatcagagaatgcacactggggagaagccttacgaatgtaaggactgtgggaagggcttcatgtggaactcagatctttctcagcaccagagggtccacactggggacaagcctcatgaatgtactgactgtgggaaaagcttcttttgcaaggcacatcttattcgacatcaaagaatccatactggggaaagaccctataaatgtaatgactgtgggaaggccttcagtcagaattctgtcttaattaagcaccagaggcgccatgctagagacaaaccctataactgtcagatctctcaccttcttgaacattagagagtgcataatggtgatacttgtttataattcttatgctgcaggaaccctagagacaaaatgagatgaccattcacaatttgctgtaacccttaacttaaatagccagtattatcttgcccttttgaacatttaccatgtactctagcaagactggtccctctgttctatgatgttttaacaaggcatcatttagttgggcagctactctgtatcaggtgctaaccactttacatacattaatttgcataacaatcctattaaggtaggtgctcttctccccattttacaaatgagaaatctgagttgaaagaggttataaaactcattcagggttgctcagttagtaagttatagagttgaaattggagccaggcctatctgactgcagagtttactgttctttacttaattgtacatatttatgtctctgcccatttttatttgcttattttcctgtgcttttagtttcccttcatcactcagatctagctccttcaactaagaagatctctcttcctcttctacttgtaatcagtaccacccaagttagtatttaattatgtgccatcttatatttttctaatagtctcatgtcttttaatcttaaccccagctaaatgactctgaggaccaacagtacatttcttttatgtttttcaaatcctgaaacattaatctttgactagatataacatgctcatgataaaaaagaattgaaatagttgaaaagggtgttcagtgaaaagtaaatttccttgtcattcctatctcttgagttctccccagaggcaatcactgctactggttgtgtatctctgtagatactctttgtatacaagtgtttattagtattgcttttcataattctgtctcactgaaaaccttatttgatggaagcaacattgcagttaaattgtgaactctaagaccttttcttcagaagttgctttccttttgaggccaccaaagtaatttagggaaacagcagagggtaatccaggtctttttttttttttttttttttttagacagagtctcactctgttgctctggctggagtgcagtggtgctatctcagctcactgcaagctccacctcctgggttcatgccattcttctgcctcagcctcccaagtagctgggactacaggtgcccgccaccatgcctggctaatattttttatttttagtagagacggggtttcaccatgttagccaggctggtctcgatctcctgaccttgtgatccacctgtctcggcctcccaaagtgctgggattacaggcctcagctaccacgcctggccaatccaggtcttaagagacctcattgcctttgttttatgagatatcattctgggattgggaatatgtaaactcaactggagattttttttcataaaaatttatatagttccagccctctcattgcttcctatcctaaatcctcttccagtctgtccatccctcactaccatgatagtctacattctgataagctgtgaggccactgccaagggagggagaaatggtcactttctggtggtggttaatgctttgttagatagcttcatccagtcaatagttgaaaagttttcacataatccagtattggcatcagagccagaaatgccctccc

SEQ ID NO: 3476 - DNA, 4099 bp, Homo sapiens
tggcagttaaagaaataactccccaggaggtgctagacatcgggcgcatgttagaggcacaaagatgagaatgttaaaagacataaaatacaggtctgctctgggaatgcaaaaactggtaaaaggagagataaaagagcaggtgcagtctagtgaagtacccgctacctcctatcagcaaatatctgtccacctagggtgcagcgagctggagaggaaggggtggcctagagcgcaggggaaggattcctccccagccgcctgcacccctaccccggtagcggtccctgggatcgtccgtgtctccaggagaaccggaccgctctcccctccctccccgagcgagaaaggaggaccacagagatgcggcgccctccgccgtcctagagcaaccggagcggcccgagccccggcctcccggatgctggggcctggcgggagtcagtgaccttcgaggatgtggccgtctacttctctgagaacgaatggatcggcctgggccctgctcagagagccctgtacagggatgtgatgctggagaattatggggctgtggcttccctggcagcatttccatttcccaaaccggctctgatttcccagctggagcgaggggaaacaccctggtgctcggttcctcggggagctctggatggagaggccccaaggggcatctcctcaggatatccatttctaaagcctgctgggatttcccatcctgagcaggtggaagagccattaaacctgaaactgcaaggagagggtccaagcctgatttgtccggagggtgtgttgaagaggaagaaagaagattttattctgaaggaggaaattattgaggaagcacaggacctcatggtcctatcaagtggaccccagtggtgtggatcccaggaattatggtttgggaaaacctgtgaagagaaaagcaggttagggagatggcctggttacctcaatgggggacgtatggaaagttctacaaatgatattatagaagtgattgtcaaggatgagatgatctcagtagaagagagttcagggaatactgatgtcaataacctccttggtatacatcacaaaattctaaatgagcaaatattctatatatgtgaggaatgcggcaagtgttttgatcaaaatgaggactttgatcaacaccagaaaactcataatggagagaaggtctatggatgtaaggaatgtgggaaggctttcagttttcgatcacattgcattgcacatcagagaattcacagtggggtgaaaccctatgaatgtcaagaatgtgctaaggcctttgtttggaagtcaaacctgattcgtcaccagagaatacatactggagagaaaccctttgaatgtaaggaatgtgggaagggctttagtcagaacacaagccttacgcaacatcaacggatccacactggtgagaaaccatacacatgtaaggaatgtgggaaaagctttactcgaaacccagcccttcttcgacatcagagaatgcacactggggagaagccttacgaatgtaaggactgtgggaagggcttcatgtggaactcagatctttctcagcaccagagggtccacactggggacaagcctcatgaatgtactgactgtgggaaaagcttcttttgcaaggcacatcttattcgacatcaaagaatccatactggggaaagaccctataaatgtaatgactgtgggaaggccttcagtcagaattctgtcttaattaagcaccagaggcgccatgctagagacaaaccctataactgtcagatctctcaccttcttgaacattagagagtgcataatggtgatacttgtttataattcttatgctgcaggaaccctagagacaaaatgagatgaccattcacaatttgctgtaacccttaacttaaatagccagtattatcttgcccttttgaacatttaccatgtactctagcaagactggtccctctgttctatgatgttttaacaaggcatcatttagttgggcagctactctgtatcaggtgctaaccactttacatacattaatttgcataacaatcctattaaggtaggtgctcttctccccattttacaaatgagaaatctgagttgaaagaggttataaaactcattcagggttgctcagttagtaagttatagagttgaaattggagccaggcctatctgactgcagagtttactgttctttacttaattgtacatatttatgtctctgcccatttttatttgcttattttcctgtgcttttagtttcccttcatcactcagatctagctccttcaactaagaagatctctcttcctcttctacttgtaatcagtaccacccaagttagtatttaattatgtgccatcttatatttttctaatagtctcatgtcttttaatcttaaccccagctaaatgactctgaggaccaacagtacatttcttttatgtttttcaaatcctgaaacattaatctttgactagatataacatgctcatgataaaaaagaattgaaatagttgaaaagggtgttcagtgaaaagtaaatttccttgtcattcctatctcttgagttctccccagaggcaatcactgctactggttgtgtatctctgtagatactctttgtatacaagtgtttattagtattgcttttcataattctgtctcactgaaaaccttatttgatggaagcaacattgcagttaaattgtgaactctaagaccttttcttcagaagttgctttccttttgaggccaccaaagtaatttagggaaacagcagagggtaatccaggtctttttttttttttttttttttttagacagagtctcactctgttgctctggctggagtgcagtggtgctatctcagctcactgcaagctccacctcctgggttcatgccattcttctgcctcagcctcccaagtagctgggactacaggtgcccgccaccatgcctggctaatattttttatttttagtagagacggggtttcaccatgttagccaggctggtctcgatctcctgaccttgtgatccacctgtctcggcctcccaaagtgctgggattacaggcctcagctaccacgcctggccaatccaggtcttaagagacctcattgcctttgttttatgagatatcattctgggattgggaatatgtaaactcaactggagattttttttcataaaaatttatatagttccagccctctcattgcttcctatcctaaatcctcttccagtctgtccatccctcactaccatgatagtctacattctgataagctgtgaggccactgccaagggagggagaaatggtcactttctggtggtggttaatgctttgttagatagcttcatccagtcaatagttgaaaagttttcacataatccagtattggcatcagagccagaaatgccctccctaggtccaggaccaaagataaaacaaacacgaggaacatgtagcgtctacacaggaaagtaaagaattatagaattaactaattctacttgaaatcaggagttttataaaacaacatttttagacgtggtcatcttttattggtttccatcatctcttccccttctctctgggaacagttacccgggtattctttgggaagctatcctttctcagctatgtggtttggcaccaccaccatcttcatgagtggaccctgtttggcttgtgtcaatcagtttatcccatccccttggccacagagccattgtgatatgaggagatactggctcttctggaaaagagaggcttttcttcatcgagagctaccagaggagatattatctgtcctctgtgtggcacataggaaaatgtgagacctagaattatagcaactttttttttctgttaaaaggggagattctcaagcttccaggtgctaccatatggagcctaaggataaagccaataccaaagaaaacagtgactaaacagagagaaactaggtccttggtgacatcttttgagccactagaccaagctttacctgaagcagagctacctcagaacttttcagctatgtgagccaataaacatctgtcaaacga

SEQ ID NO: 3477 - DNA, 5629 bp, Homo sapiens
cgggtgtggagcacggggagtcgggcgtggggcgggcagggagtggagtcggggtcttactccggtggctgcagggcgcagggtagccgtgtcaggcctgcccaggtgcagagcgctcttccgcgaccccaacagcctctggtccggtctggcgcgccctcgctttcccagagggcgacctgggctatggcggccgtggcgctggcgagcgggacacgcctcggccttgtcctcgagctgctcccgggacagcccgcgctgccccgggcgcgccgggagtcagtgaccttcgaggatgtggccgtctacttctctgagaacgaatggatcggcctgggccctgctcagagagccctgtacagggatgtgatgctggagaattatggggctgtggcttccctggcagcatttccatttcccaaaccggctctgatttcccagctggagcgaggggaaacaccctggtgctcggttcctcggggagctctggatggagaggccccaaggggcatctcctcaggatatccatttctaaagcctgctgggatttcccatcctgagcaggtggaagagccattaaacctgaaactgcaaggagagggtccaagcctgatttgtccggagggtgtgttgaagaggaagaaagaagattttattctgaaggaggaaattattgaggaagcacaggacctcatggtcctatcaagtggaccccagtggtgtggatcccaggaattatggtttgggaaaacctgtgaagagaaaagcaggttagggagatggcctggttacctcaatgggggacgtatggaaagttctacaaatgatattatagaagtgattgtcaaggatgagatgatctcagtagaagagagttcagggaatactgatgtcaataacctccttggtatacatcacaaaattctaaatgagcaaatattctatatatgtgaggaatgcggcaagtgttttgatcaaaatgaggactttgatcaacaccagaaaactcataatggagagaaggtctatggatgtaaggaatgtgggaaggctttcagttttcgatcacattgcattgcacatcagagaattcacagtggggtgaaaccctatgaatgtcaagaatgtgctaaggcctttgtttggaagtcaaacctgattcgtcaccagagaatacatactggagagaaaccctttgaatgtaaggaatgtgggaagggctttagtcagaacacaagccttacgcaacatcaacggatccacactggtgagaaaccatacacatgtaaggaatgtgggaaaagctttactcgaaacccagcccttcttcgacatcagagaatgcacactggggagaagccttacgaatgtaaggactgtgggaagggcttcatgtggaactcagatctttctcagcaccagagggtccacactggggacaagcctcatgaatgtactgactgtgggaaaagcttcttttgcaaggcacatcttattcgacatcaaagaatccatactggggaaagaccctataaatgtaatgactgtgggaaggccttcagtcagaattctgtcttaattaagcaccagaggcgccatgctagagacaaaccctataactgtcagatctctcaccttcttgaacattagagagtgcataatggtgatacttgtttataattcttatgctgcaggaaccctagagacaaaatgagatgaccattcacaatttgctgtaacccttaacttaaatagccagtattatcttgcccttttgaacatttaccatgtactctagcaagactggtccctctgttctatgatgttttaacaaggcatcatttagttgggcagctactctgtatcaggtgctaaccactttacatacattaatttgcataacaatcctattaaggtaggtgctcttctccccattttacaaatgagaaatctgagttgaaagaggttataaaactcattcagggttgctcagttagtaagttatagagttgaaattggagccaggcctatctgactgcagagtttactgttctttacttaattgtacatatttatgtctctgcccatttttatttgcttattttcctgtgcttttagtttcccttcatcactcagatctagctccttcaactaagaagatctctcttcctcttctacttgtaatcagtaccacccaagttagtatttaattatgtgccatcttatatttttctaatagtctcatgtcttttaatcttaaccccagctaaatgactctgaggaccaacagtacatttcttttatgtttttcaaatcctgaaacattaatctttgactagatataacatgctcatgataaaaaagaattgaaatagttgaaaagggtgttcagtgaaaagtaaatttccttgtcattcctatctcttgagttctccccagaggcaatcactgctactggttgtgtatctctgtagatactctttgtatacaagtgtttattagtattgcttttcataattctgtctcactgaaaaccttatttgatggaagcaacattgcagttaaattgtgaactctaagaccttttcttcagaagttgctttccttttgaggccaccaaagtaatttagggaaacagcagagggtaatccaggtctttttttttttttttttttttttagacagagtctcactctgttgctctggctggagtgcagtggtgctatctcagctcactgcaagctccacctcctgggttcatgccattcttctgcctcagcctcccaagtagctgggactacaggtgcccgccaccatgcctggctaatattttttatttttagtagagacggggtttcaccatgttagccaggctggtctcgatctcctgaccttgtgatccacctgtctcggcctcccaaagtgctgggattacaggcctcagctaccacgcctggccaatccaggtcttaagagacctcattgcctttgttttatgagatatcattctgggattgggaatatgtaaactcaactggagattttttttcataaaaatttatatagttccagccctctcattgcttcctatcctaaatcctcttccagtctgtccatccctcactaccatgatagtctacattctgataagctgtgaggccactgccaagggagggagaaatggtcactttctggtggtggttaatgctttgttagatagcttcatccagtcaatagttgaaaagttttcacataatccagtattggcatcagagccagaaatgccctccctaggtccaggaccaaagataaaacaaacacgaggaacatgtagcgtctacacaggaaagtaaagaattatagaattaactaattctacttgaaatcaggagttttataaaacaacatttttagacgtggtcatcttttattggtttccatcatctcttccccttctctctgggaacagttacccgggtattctttgggaagctatcctttctcagctatgtggtttggcaccaccaccatcttcatgagtggaccctgtttggcttgtgtcaatcagtttatcccatccccttggccacagagccattgtgatatgaggagatactggctcttctggaaaagagaggcttttcttcatcgagagctaccagaggagatattatctgtcctctgtgtggcacataggaaaatgtgagacctagaattatagcaactttttttttctgttaaaaggggagattctcaagcttccaggtgctaccatatggagcctaaggataaagccaataccaaagaaaacagtgactaaacagagagaaactaggtccttggtgacatcttttgagccactagaccaagctttacctgaagcagagctacctcagaacttttcagctatgtgagccaataaacatctgtcaaacgagttagagttgagttttctgttatttgcaacttagccacactaatactgttttgtgtttgaaatcactgttttctcatacagctcctcagtgtcaccttttcctcttgctcagtagtctcataagcttctcagttttatctcatctcagttgcttggaagttgagcatctaaataggtggcttttgctgggtgcagtggcttacgcctgtaatcccatcactttgggaggccaaggtgggcagatcacctgagattgggagttcaagaccagcctgaccaacatagagagaccccgtctctactaaaaatacaaaattagccaggtgtggtggcacatgccagtaatctcagctactcaggaggctgaggcaggagaattgcttgaatctgggaggtggaggttgcagtgagccgagattgtgccattgcactccagcctgggcaacaagagtgaaactccatctcaaaaaaatgaaaataataaataggtggctctcatgacctaaggttaatttcatgcatactactaagtgatgctttaagtcataccattagtgcaggaatttttgctccttagttcagctaaaatctgggttcttgtctcatgaccaggaaaaattagtcacagggacacattgaaaagtgaggagggcagaatttattaagtgaaaaggaaaactctcaacaaaaagaggggtcctgcatgcaggttttccatctcactaaactgaataccaggccaccacacatgagctgaagagcctagtcttctccccctgcatgaattcctggtggctacaccccgttctcccagtgtgcaggcaggcccttagtctgagccactccacattatttcccttactgtgtatgtgttaaggaacggaatttttcatcatgggcatgtttaggcaatccccctgtgcacaatgacctgggcagcatttggctgtctcctgattctatcattcccccctctaaagaagtacatctaacttagaataaggataaggataagggtagtgatcgatcttaactggttcctgctgatgggggcactgttttgggaaaatagcagtgagatctccctcagaggcctatctaagggtccctggtaaaaggtggccatcatttgaggttccaattgcatgaacattcagagttcaatggcctgaaggtgagaagagacaaaccaggttattagaagacaatcaaaatgaaacaaagcggggatggtaaggacagctaaaaaaaatcctaaggctgctgacacacccagataactggtagctatagttatgcctgctaagattggggtgtttggggcttggctttcgttagctcccttggtcttattttcccaaaaaagaaacctccaggttatgggcaccttatttagtctaatcatctggcaggatttgcagggtaattgcccagaactagaatattgatccagatttttacattactcatcccttttgctgcttctgagctgcagccagagattgctggttggttcacaggaataagcagtgttagtttaaaatgtgggcaaaaacttaaaaacaacgaatgagtctaaaatctaatgacaaatatataagtcttgaaacataatttctctccagttctcatttttgttaaaaataaatcatgataggactgagttgtttgcaaaataaactttagtcttgt

SEQ ID NO: 3478 - DNA, 4227 bp, Homo sapiens
gagagggaggtgggtgcgcggcgcccgcggcctggggcgctgactcccctcacttggaggcgccctgcgtccggcagaggaggcgagcatcccgctcaggtgatgaggaacccctcgcgcacccagcgcagaaggctgctgccgccggacgcctccattgtttgaccacaacaagggccggattctcacccagcaggatcctaaggcctttgtagtccttcagccactgtgggccctgcctctgcctgttcttctggaatgtcttgggggttttgatcctgtcactgtgacctgcaaatccaagagacacatctttggaagataagagagcttcttcaagaccaaaaaaggagacggcatgatacccatgtagggaattccccaaagcagggcttgccatacctggaccccgaggagcctgcttgctggaaaggctttcctgtctgatgtgcaggaggcagaatgccaaactgactcttcaaggggcaactgcaggggctcgagaccagccagcagtatctcatccttcgatacaggggatatactgtacagtcctttttctagaagtgagacatacaagattactctacaagaggaagattccaggggctcaaaaacgcaaaggtttgcactttgagagccccttggaatgttgacaactcaggatctaaaacaaagttctgtgttaatgagttacagaattcacgtggaagtcaatgtcactttataatcgataataatactgagtgaggaacactatgcaggaagaaaccttccgtagaaagacaggcagggaaaagcttaggctgaccttaaacttacctaatagagcaagcctgagatagactgccaaaatggccaaataagagactctatgaaataacagtcttgtaactgtagtaatcataaggaaattttctccttgaaatcacgataccaaataggaaaaatgatctacaagtgccccatgtgtagggaatttttctctgagagagcagatctttttatgcatcagaaaattcacacagctgagaagccccataaatgtgacaagtgtgataagggtttctttcatatatcagaacttcatattcattggagagaccatacaggagagaaggtctataaatgtgatgattgtggtaaggattttagcactacaacaaaacttaatagacataagaaaatccacacagtggagaagccctataaatgttacgagtgtggcaaagccttcaattggagctcccatcttcaaattcatatgagagttcatacaggtgagaaaccgtatgtctgtagtgagtgtggaaggggctttagtaatagttcaaacctttgcatgcatcagagagtccacaccggagagaagccctttaaatgtgaagagtgtgggaaggccttcaggcacacctccagcctctgcatgcatcaaagagtccacacaggagagaaaccctataaatgttatgagtgtgggaaggcgttcagtcagagttcgagcctctgcatccaccagagagtccacactggagagaaaccctatagatgttgtggatgtgggaaggccttcagtcagagttcgagcctgtgcatccaccagagagtccacacaggagagaaacctttcaaatgtgatgagtgcggaaaggccttcagtcagagtacgagcctctgcatccaccagagagtccacacaaaggagagaaaccatctcaaaatatcagttatataaaacgttttgctaagagtttaaaatcttaaaacccataagtgccactaggaaggaaaccctgtatatacctacattgacccaagaaatatttacgcaatccctagcagaacattgtttctgaggaggcatatgtgagattgatttgttggttcatgccaagtgtgttccacaggttgactttgaatgtggacctctgagcatccacgcaggatggctctcaggtcccagtcacagacgtcgcttcctgggattccagcacgatgcctccatagttgaaagactacacaaaaagccacaatcattgcccggcctcctgagtcaccttctatctatactttgcttaaaagctatcccagatactcccccttgaggagctcatgcccttccttcctctttattcgagcatactggcaatgcattggaaaacagacagctcccactaagatcacgttctggtatttctgaggttaacacttgatttagcccctacatatctttccatatatcctattatttctgaatatatgtcctcaaaatccccataaatatccatcccttcctagatggcattaactttcattttagattttaggtgactcataattcccattcacttagcctatcagaaaagtcattggcagacatatatgtccttgaaccttttttatttgtgtggattctgctcatcactgtctctgttagacttattttgtagtggctgcatcacatatttttcacttgaatttttttggaaatagctgaatgtaaatagcagggaggaagaagcaagcaaagtgagagcttttcttcatccagaattgccctctgggctcctttggtaacagatggagctccttcctagctagggagaccttatgagaagtggatggtaggaggagtcactaatgtttcaatctctatttctgtaatcttgggcaataatgcataggagttcttgataccccttcattgattactgtgtatcagttctttgttaggcatgaacgtctttattaatccatcattcttttcttcattcaacaaatatgtattgaacacctcctatatgccaggcactgtgctaggtgctgggaataccactgatgagacagacaaggtccctactcttgtggagtttacttctggtggaggagacagatgataagtaaacaaataaataatgtagtttgagatagtgattaagtgctatgaagaaaataaactagggtgatgattttagtggtggggtggggtgggggtggggtgacattagctagtggtcagggaggcctttccgcggtgggatgttgagctgaggccggaggagaagtagcagtcgctggcagagcacacaggctgctctgggggatgagctggtgcgtttaaggaacaggccagcactggcattcgcaagcagtggggaaggggagagatgccgaggtggtcagtatcctgactttcagaggcctttttttgtttgttttaatttttgctagattgatattaaaaactcatgtggaggaactcaaggaatgtttagaagaccaaaagtccccaatgacaggaacaaaagcaaccaatttttaactttctcttctcattcctgttttcattgatttcccacatgtagtccttttgctcaggaagtctttggggaaattaaggatctttgaagctctgaaataggtgatcaggttagtggtgtctgtcagctgtctaagaggttggaaaatgaactactcaagatagtcacgaaaatactgaaagtttgatttttctttccatatttgaattaattttttctgtttgactggaaggggtttttgtataactaaaacctcagcgcataaaggagatttaaaaggagcacatgatttagtgggtgggccatgaaactagagatgggatttgggggtgaatttgtcaatatctggattttaatccagacatctctgctaacaagcctttggtaagtcacttcagatacttttcctcctttttacaaagagagggctggcttagttatttgccaaagccccttccaggcctgaattccacaagtacgatttactgtagtgtcttatcactctttcatgtcacaatagcgtggagcattagagaaaagcctagacttttagttgatagccagttgaaatatcattgatagaattttagttttaggaaaaattggtttgatttctagctttattactattaggtatgtgagcttgggcaaatcgcttaatctttgagtctagttttctctcaaaatgagaacattaggctaaatgatttccgagtttccagctagtcctagagttctatatttctacatagttgaattattttatcatgctgttgctggggaatatgactaacccttttgaagctactaattttatgtcgagctttaaagtccataattgttatcttcagaaaatattatttgacctacagtatgtccaaatcaatttaataaaatcgctttataa

SEQ ID NO: 3479 - DNA, 4262 bp, Homo sapiens
cgcgcgctgtcccccggaggcgtctgggtgtgcggagcgcgcgcgcgcgcggctcggaggcgcacctgtgaggtgtccctgaggagagggagggcgccctgcgtccggcagaggaggcgagcatcccgctcaggtgatgaggaacccctcgcgcacccagcgcagaaggctgctgccgccggacgcctccattgtttgaccacaacaagggccggattctcacccaggatcctaaggcctttgtagtccttcagccactgtgggccctgcctctgcctgttcttctggaatgtcttgggggttttgatcctgtcactgtgacctgcaaatccaagagacacatctttggaagataagagagcttcttcaagaccaaaaaaggagacggcatgatacccatgtagggaattccccaaagcagggcttgccatacctggaccccgaggagcctgcttgctggaaaggctttcctgtctgatgtgcaggaggcagaatgccaaactgactcttcaaggggcaactgcaggggctcgagaccagccagcagtatctcatccttcgatacaggggatatactgtacagtcctttttctagaagtgagacatacaagattactctacaagaggaagattccaggggctcaaaaacgcaaaggtttgcactttgagagccccttggaatgttgacaactcaggatctaaaacaaagttctgtgttaatgagttacagaattcacgtggaagtcaatgtcactttataatcgataataatactgagtgaggaacactatgcaggaagaaaccttccgtagaaagacaggcagggaaaagcttaggctgaccttaaacttacctaatagagcaagcctgagatagactgccaaaatggccaaataagagactctatgaaataacagtcttgtaactgtagtaatcataaggaaattttctccttgaaatcacgataccaaataggaaaaatgatctacaagtgccccatgtgtagggaatttttctctgagagagcagatctttttatgcatcagaaaattcacacagctgagaagccccataaatgtgacaagtgtgataagggtttctttcatatatcagaacttcatattcattggagagaccatacaggagagaaggtctataaatgtgatgattgtggtaaggattttagcactacaacaaaacttaatagacataagaaaatccacacagtggagaagccctataaatgttacgagtgtggcaaagccttcaattggagctcccatcttcaaattcatatgagagttcatacaggtgagaaaccgtatgtctgtagtgagtgtggaaggggctttagtaatagttcaaacctttgcatgcatcagagagtccacaccggagagaagccctttaaatgtgaagagtgtgggaaggccttcaggcacacctccagcctctgcatgcatcaaagagtccacacaggagagaaaccctataaatgttatgagtgtgggaaggcgttcagtcagagttcgagcctctgcatccaccagagagtccacactggagagaaaccctatagatgttgtggatgtgggaaggccttcagtcagagttcgagcctgtgcatccaccagagagtccacacaggagagaaacctttcaaatgtgatgagtgcggaaaggccttcagtcagagtacgagcctctgcatccaccagagagtccacacaaaggagagaaaccatctcaaaatatcagttatataaaacgttttgctaagagtttaaaatcttaaaacccataagtgccactaggaaggaaaccctgtatatacctacattgacccaagaaatatttacgcaatccctagcagaacattgtttctgaggaggcatatgtgagattgatttgttggttcatgccaagtgtgttccacaggttgactttgaatgtggacctctgagcatccacgcaggatggctctcaggtcccagtcacagacgtcgcttcctgggattccagcacgatgcctccatagttgaaagactacacaaaaagccacaatcattgcccggcctcctgagtcaccttctatctatactttgcttaaaagctatcccagatactcccccttgaggagctcatgcccttccttcctctttattcgagcatactggcaatgcattggaaaacagacagctcccactaagatcacgttctggtatttctgaggttaacacttgatttagcccctacatatctttccatatatcctattatttctgaatatatgtcctcaaaatccccataaatatccatcccttcctagatggcattaactttcattttagattttaggtgactcataattcccattcacttagcctatcagaaaagtcattggcagacatatatgtccttgaaccttttttatttgtgtggattctgctcatcactgtctctgttagacttattttgtagtggctgcatcacatatttttcacttgaatttttttggaaatagctgaatgtaaatagcagggaggaagaagcaagcaaagtgagagcttttcttcatccagaattgccctctgggctcctttggtaacagatggagctccttcctagctagggagaccttatgagaagtggatggtaggaggagtcactaatgtttcaatctctatttctgtaatcttgggcaataatgcataggagttcttgataccccttcattgattactgtgtatcagttctttgttaggcatgaacgtctttattaatccatcattcttttcttcattcaacaaatatgtattgaacacctcctatatgccaggcactgtgctaggtgctgggaataccactgatgagacagacaaggtccctactcttgtggagtttacttctggtggaggagacagatgataagtaaacaaataaataatgtagtttgagatagtgattaagtgctatgaagaaaataaactagggtgatgattttagtggtggggtggggtgggggtggggtgacattagctagtggtcagggaggcctttccgcggtgggatgttgagctgaggccggaggagaagtagcagtcgctggcagagcacacaggctgctctgggggatgagctggtgcgtttaaggaacaggccagcactggcattcgcaagcagtggggaaggggagagatgccgaggtggtcagtatcctgactttcagaggcctttttttgtttgttttaatttttgctagattgatattaaaaactcatgtggaggaactcaaggaatgtttagaagaccaaaagtccccaatgacaggaacaaaagcaaccaatttttaactttctcttctcattcctgttttcattgatttcccacatgtagtccttttgctcaggaagtctttggggaaattaaggatctttgaagctctgaaataggtgatcaggttagtggtgtctgtcagctgtctaagaggttggaaaatgaactactcaagatagtcacgaaaatactgaaagtttgatttttctttccatatttgaattaattttttctgtttgactggaaggggtttttgtataactaaaacctcagcgcataaaggagatttaaaaggagcacatgatttagtgggtgggccatgaaactagagatgggatttgggggtgaatttgtcaatatctggattttaatccagacatctctgctaacaagcctttggtaagtcacttcagatacttttcctcctttttacaaagagagggctggcttagttatttgccaaagccccttccaggcctgaattccacaagtacgatttactgtagtgtcttatcactctttcatgtcacaatagcgtggagcattagagaaaagcctagacttttagttgatagccagttgaaatatcattgatagaattttagttttaggaaaaattggtttgatttctagctttattactattaggtatgtgagcttgggcaaatcgcttaatctttgagtctagttttctctcaaaatgagaacattaggctaaatgatttccgagtttccagctagtcctagagttctatatttctacatagttgaattattttatcatgctgttgctggggaatatgactaacccttttgaagctactaattttatgtcgagctttaaagtccataattgttatcttcagaaaatattatttgacctacagtatgtccaaatcaatttaataaaatcgctttataacagg

SEQ ID NO: 3480 - DNA, 4207 bp, Homo sapiens
gagagggaggtgggtgcgcggcgcccgcggcctggggcgctgactcccctcacttggaggcgccctgcgtccggcagaggaggcgagcatcccgctcaggtgatgaggaacccctcgcgcacccagcgcagaaggctgctgccgccggacgcctccattgtttgaccacaacaagggccggattctcacccagcaggatcctaaggcctttgtagtccttcagccactgtgggccctgcctctgcctgttcttctggaatgtcttgggggttttgatcctgtcactgtgacctgcaaatccaagagacacatctttggaagataagagagcttcttcaagaccaaaaaaggagacggcatgatacccatgtagggaattccccaaagcagggcttgccatacctggaccccgaggagcctgcttgctggaaaggctttcctgtctgatgtgcaggaggcagaatgccaaactgactcttcaaggggcaactgcaggggctcgagaccagccagcagtatctcatccttcgatacaggggatatactgtacagtcctttttctagaagtgagacatacaagattactctacaagaggaagattccaggggctcaaaaacgcaaaggtttgcactttgagagccccttggaatgttgacaactcaggatctaaaacaaagttctgtgttaatgagttacagaattcacgtggaagtcaatgtcactttataatcgataataatactgagtgaggaacactatgcaggaagaaaccttccgtagaaagacaggcagggaaaagcttaggctgaccttaaacttacctaatagagcaagcctgagatagactgccaaaatggccaaataagagactctatgaaataacagtcttgtaactgtagtaatcataaggaaattttctccttgaaatcacgataccaaataggaaaaatgatctacaagtgccccatgtgtagggaatttttctctgagagagcagatctttttatgcatcagaaaattcacacagctgagaagccccataaatgtgacaagtgtgataagggtttctttcatatatcagaacttcatattcattggagagaccatacaggagagaaggtctataaatgtgatgattgtggtaaggattttagcactacaacaaaacttaatagacataagaaaatccacacagtggagaagccctataaatgttacgagtggcaaagccttcaattggagctcccatcttcaaattcatatgagagttcatacaggtgagaaaccgtatgtctgtagtgagtgtggaaggggctttagtaatagttcaaacctttgcatgcatcagagagtccacaccggagagaagccctttaaatgtgaagagtgtgggaaggccttcaggcacacctccagcctctgcatgcatcaaagagtccacacaggagagaaaccctataaatgttatgagtgtgggaaggcgttcagtcagagttcgagcctctgcatccaccagagagtccacactggagagaaaccctatagatgttgtggatgtgggaaggccttcagtcagagttcgagcctgtgcatccaccagagagtccacacaggagagaaacctttcaaatgtgatgagtgcggaaaggccttcagtcagagtacgagcctctgcatccaccagagagtccacacaaaggagagaaaccatctcaaaatatcagttatataaaacgttttgctaagagtttaaaatcttaaaacccataagtgccactaggaaggaaaccctgtatatacctacattgacccaagaaatatttacgcaatccctagcagaacattgtttctgaggaggcatatgtgagattgatttgttggttcatgccaagtgtgttccacaggttgactttgaatgtggacctctgagcatccacgcaggatggctctcaggtcccagtcacagacgtcgcttcctgggattccagcacgatgcctccatagttgaaagactacacaaaaagccacaatcattgcccggcctcctgagtcaccttctatctatactttgcttaaaagctatcccagatactcccccttgaggagctcatgcccttccttcctctttattcgagcatactggcaatgcattggaaaacagacagctcccactaagatcacgttctggtatttctgaggttaacacttgatttagcccctacatatctttccatatatcctattatttctgaatatatgtcctcaaaatccccataaatatccatcccttcctagatggcattaactttcattttagattttaggtgactcataattcccattcacttagcctatcagaaaagtcattggcagacatatatgtccttgaaccttttttatttgtgtggattctgctcatcactgtctctgttagacttattttgtagtggctgcatcacatatttttcacttgaatttttttggaaatagctgaatgtaaatagcagggaggaagaagcaagcaaagtgagagcttttcttcatccagaattgccctctgggctcctttggtaacagatggagctccttcctagctagggagaccttatgagaagtggatggtaggaggagtcactaatgtttcaatctctatttctgtaatcttgggcaataatgcataggagttcttgataccccttcattgattactgtgtatcagttctttgttaggcatgaacgtctttattaatccatcattcttttcttcattcaacaaatatgtattgaacacctcctatatgccaggcactgtgctaggtgctgggaataccactgatgagacagacaaggtccctactcttgtggagtttacttctggtggaggagacagatgataagtaaacaaataaataatgtagtttgagatagtgattaagtgctatgaagaaaataaactagggtgatgattttagtggtggggtggggtgggggtggggtgacattagctagtggtcagggaggcctttccgcggtgggatgttgagctgaggccggaggagaagtagcagtcgctggcagagcacacaggctgctctgggggatgagctggtgcgtttaaggaacaggccagcactggcattcgcaagcagtggggaaggggagagatgccgaggtggtcagtatcctgactttcagaggcctttttttgtttgttttaatttttgctagattgatattaaaaactcatgtggaggaactcaaggaatgtttagaagaccaaaagtccccaatgacaggaacaaaagcaaccaatttttaactttctcttctcattcctgttttcattgatttcccacatgtagtccttttgctcaggaagtctttggggaaattaaggatctttgaagctctgaaataggtgatcaggttagtggtgtctgtcagctgtctaagaggttggaaaatgaactactcaagatagtcacgaaaatactgaaagtttgatttttctttccatatttgaattaattttttctgtttgactggaaggggtttttgtataactaaaacctcagcgcataaaggagatttaaaaggagcacatgatttagtgggtgggccatgaaactagagatgggatttgggggtgaatttgtcaatatctggattttaatccagacatctctgctaacaagcctttggtaagtcacttcagatacttttcctcctttttacaaagagagggctggcttagttatttgccaaagccccttccaggcctgaattccacaagtacgatttactgtagtgtcttatcactctttcatgtcacaatagcgtggagcattagagaaaagcctagacttttagttgatagccagttgaaatatcattgatagaattttagttttaggaaaaattggtttgatttctagctttattactattaggtatgtgagcttgggcaaatcgcttaatctttgagtctagttttctctcaaaatgagaacattaggctaaatgatttccgagtttccagctagtcctagagttctatatttctacatagttgaattattttatcatgctgttgctggggaatatgactaacccttttgaagctactaattttatgtcgagctttaaagtccataattgttatcttcagaaaatattatttgacctacagtatgtccaaatcaattt

SEQ ID NO: 3481 - DNA, 4309 bp, Homo sapiens
gcgctgtcccccggaggcgtctgggtgtgcggagcgcgcgcgcgcgcggctcggaggcgcacctgtgaggtgtccctgaggagagggaggtgggtgcgcggcgcccgcggcctggggcgctgactcccctcacttggaggcgccctgcgtccggcagaggaggcgagcatcccgctcaggtgatgaggaacccctcgcgcacccagcgcagaaggctgctgccgccggacgcctccattgtttgaccacaacaagggccggattctcacccaggatcctaaggcctttgtagtccttcagccactgtgggccctgcctctgcctgttcttctggaatgtcttgggggttttgatcctgtcactgtgacctgcaaatccaagagacacatctttggaagataagagagcttcttcaagaccaaaaaaggagacggcatgatacccatgtagggaattccccaaagcagggcttgccatacctggaccccgaggagcctgcttgctggaaaggctttcctgtctgatgtgcaggaggcagaatgccaaactgactcttcaaggggcaactgcaggggctcgagaccagccagcagtatctcatccttcgatacaggggatatactgtacagtcctttttctagaagtgagacatacaagattactctacaagaggaagattccaggggctcaaaaacgcaaaggtttgcactttgagagccccttggaatgttgacaactcaggatctaaaacaaagttctgtgttaatgagttacagaattcacgtggaagtcaatgtcactttataatcgataataatactgagtgaggaacactatgcaggaagaaaccttccgtagaaagacaggcagggaaaagcttaggctgaccttaaacttacctaatagagcaagcctgagatagactgccaaaatggccaaataagagactctatgaaataacagtcttgtaactgtagtaatcataaggaaattttctccttgaaatcacgataccaaataggaaaaatgatctacaagtgccccatgtgtagggaatttttctctgagagagcagatctttttatgcatcagaaaattcacacagctgagaagccccataaatgtgacaagtgtgataagggtttctttcatatatcagaacttcatattcattggagagaccatacaggagagaaggtctataaatgtgatgattgtggtaaggattttagcactacaacaaaacttaatagacataagaaaatccacacagtggagaagccctataaatgttacgagtgtggcaaagccttcaattggagctcccatcttcaaattcatatgagagttcatacaggtgagaaaccgtatgtctgtagtgagtgtggaaggggctttagtaatagttcaaacctttgcatgcatcagagagtccacaccggagagaagccctttaaatgtgaagagtgtgggaaggccttcaggcacacctccagcctctgcatgcatcaaagagtccacacaggagagaaaccctataaatgttatgagtgtgggaaggcgttcagtcagagttcgagcctctgcatccaccagagagtccacactggagagaaaccctatagatgttgtggatgtgggaaggccttcagtcagagttcgagcctgtgcatccaccagagagtccacacaggagagaaacctttcaaatgtgatgagtgcggaaaggccttcagtcagagtacgagcctctgcatccaccagagagtccacacaaaggagagaaaccatctcaaaatatcagttatataaaacgttttgctaagagtttaaaatcttaaaacccataagtgccactaggaaggaaaccctgtatatacctacattgacccaagaaatatttacgcaatccctagcagaacattgtttctgaggaggcatatgtgagattgatttgttggttcatgccaagtgtgttccacaggttgactttgaatgtggacctctgagcatccacgcaggatggctctcaggtcccagtcacagacgtcgcttcctgggattccagcacgatgcctccatagttgaaagactacacaaaaagccacaatcattgcccggcctcctgagtcaccttctatctatactttgcttaaaagctatcccagatactcccccttgaggagctcatgcccttccttcctctttattcgagcatactggcaatgcattggaaaacagacagctcccactaagatcacgttctggtatttctgaggttaacacttgatttagcccctacatatctttccatatatcctattatttctgaatatatgtcctcaaaatccccataaatatccatcccttcctagatggcattaactttcattttagattttaggtgactcataattcccattcacttagcctatcagaaaagtcattggcagacatatatgtccttgaaccttttttatttgtgtggattctgctcatcactgtctctgttagacttattttgtagtggctgcatcacatatttttcacttgaatttttttggaaatagctgaatgtaaatagcagggaggaagaagcaagcaaagtgagagcttttcttcatccagaattgccctctgggctcctttggtaacagatggagctccttcctagctagggagaccttatgagaagtggatggtaggaggagtcactaatgtttcaatctctatttctgtaatcttgggcaataatgcataggagttcttgataccccttcattgattactgtgtatcagttctttgttaggcatgaacgtctttattaatccatcattcttttcttcattcaacaaatatgtattgaacacctcctatatgccaggcactgtgctaggtgctgggaataccactgatgagacagacaaggtccctactcttgtggagtttacttctggtggaggagacagatgataagtaaacaaataaataatgtagtttgagatagtgattaagtgctatgaagaaaataaactagggtgatgattttagtggtggggtggggtgggggtggggtgacattagctagtggtcagggaggcctttccgcggtgggatgttgagctgaggccggaggagaagtagcagtcgctggcagagcacacaggctgctctgggggatgagctggtgcgtttaaggaacaggccagcactggcattcgcaagcagtggggaaggggagagatgccgaggtggtcagtatcctgactttcagaggcctttttttgtttgttttaatttttgctagattgatattaaaaactcatgtggaggaactcaaggaatgtttagaagaccaaaagtccccaatgacaggaacaaaagcaaccaatttttaactttctcttctcattcctgttttcattgatttcccacatgtagtccttttgctcaggaagtctttggggaaattaaggatctttgaagctctgaaataggtgatcaggttagtggtgtctgtcagctgtctaagaggttggaaaatgaactactcaagatagtcacgaaaatactgaaagtttgatttttctttccatatttgaattaattttttctgtttgactggaaggggtttttgtataactaaaacctcagcgcataaaggagatttaaaaggagcacatgatttagtgggtgggccatgaaactagagatgggatttgggggtgaatttgtcaatatctggattttaatccagacatctctgctaacaagcctttggtaagtcacttcagatacttttcctcctttttacaaagagagggctggcttagttatttgccaaagccccttccaggcctgaattccacaagtacgatttactgtagtgtcttatcactctttcatgtcacaatagcgtggagcattagagaaaagcctagacttttagttgatagccagttgaaatatcattgatagaattttagttttaggaaaaattggtttgatttctagctttattactattaggtatgtgagcttgggcaaatcgcttaatctttgagtctagttttctctcaaaatgagaacattaggctaaatgatttccgagtttccagctagtcctagagttctatatttctacatagttgaattattttatcatgctgttgctggggaatatgactaacccttttgaagctactaattttatgtcgagctttaaagtccataattgttatcttcagaaaatattatttgacctacagtatgtccaaatcaatttaataaaatcgctttataacaggg

SEQ ID NO: 3482 - DNA, 5108 bp, Homo sapiens
ggaggcgggcggtgggggcgcgggccgggtggccgcgcatgcgtgcggcccccgctcccccggggcttccccggcctcgtgcgtgcgcacgcgcgctgtcccccggaggcgtctgggtgtgcggagcgcgcgcgcgcgcggctcggaggcgcacctgtgaggtgtccctgaggagagggaggtgggtgcgcggcgcccgcggcctggggcgctgactcccctcacttggagtgagttctcggcggccgggctgcagtctttctttctttcccggagggaggcgggggccgggggccagggagcgggctgggggtgggaaggaggtggagtggcttaaagaaaagaaaaacaacccatcccggaggatgggcctcgggatggcggggaaggtcagagcggctccgcgcagcctggcgggtcccgggctgagaagccgcccctcgggcctcgggcggtcggccgcgggcccgcagtgcgggggagcggggccggggggcgcagatggcggccggtgcgagcgagggctgggcagcgggcagggcgaggccgggcgaggcccctcgggagccggactcccgagccaggctccattgttgttggagccgagggaagggggagcgctgccgccctcgtcgcccgtggagccgcgtcttggagcccttccaggcgggtcccgggagaggcggtcatggccgcgccaggggaccggggagccgggcggctgcggaggagccggctgcatggggtgctgtgtgtttttcagggcgccctgcgtccggcagaggaggcgagcatcccgctcaggtgatgaggaacccctcgcgcacccagcgcagaaggctgctgccgccggacgcctccattgtttgaccacaacaagggccggattctcacccagcaggatcctaaggcctttgtagtccttcagccactgtgggccctgcctctgcctgttcttctggaatgtcttgggggttttgatcctgtcactgtgagtcttgctctgtcgcccaggctggagtgcagtggcacgatctcagctcattgcaacctctgtctcccaggttcaagcgattctcctgcctcagcctctggagtagctgggattacagatgggaccacctagttgcaggaaaacaagctcagggctcccactgattctacattatgacctgcaaatccaagagacacatctttggaagataagagagcttcttcaagaccaaaaaaggagacggcatgatacccatgtagggaattccccaaagcagggcttgccatacctggaccccgaggagcctgcttgctggaaaggctttcctgtctgatgtgcaggaggcagaatgccaaactgactcttcaaggggcaactgcaggggctcgagaccagccagcagtatctcatccttcgatacaggggatatactgtacagtcctttttctagaagtgagacatacaagattactctacaagaggaagattccaggggctcaaaaacgcaaaggtttgcactttgagagccccttggaatgttgacaactcaggatctaaaacaaagttctgtgttaatgagttacagaattcacgtggaagtcaatgtcactttataatcgataataatactgagtgaggaacactatgcaggaagaaaccttccgtagaaagacaggcagggaaaagcttaggctgaccttaaacttacctaatagagcaagcctgagatagactgccaaaatggccaaataagagactctatgaaataacagtcttgtaactgtagtaatcataaggaaattttctccttgaaatcacgataccaaataggaaaaatgatctacaagtgccccatgtgtagggaatttttctctgagagagcagatctttttatgcatcagaaaattcacacagctgagaagccccataaatgtgacaagtgtgataagggtttctttcatatatcagaacttcatattcattggagagaccatacaggagagaaggtctataaatgtgatgattgtggtaaggattttagcactacaacaaaacttaatagacataagaaaatccacacagtggagaagccctataaatgttacgagtgtggcaaagccttcaattggagctcccatcttcaaattcatatgagagttcatacaggtgagaaaccgtatgtctgtagtgagtgtggaaggggctttagtaatagttcaaacctttgcatgcatcagagagtccacaccggagagaagccctttaaatgtgaagagtgtgggaaggccttcaggcacacctccagcctctgcatgcatcaaagagtccacacaggagagaaaccctataaatgttatgagtgtgggaaggcgttcagtcagagttcgagcctctgcatccaccagagagtccacactggagagaaaccctatagatgttgtggatgtgggaaggccttcagtcagagttcgagcctgtgcatccaccagagagtccacacaggagagaaacctttcaaatgtgatgagtgcggaaaggccttcagtcagagtacgagcctctgcatccaccagagagtccacacaaaggagagaaaccatctcaaaatatcagttatataaaacgttttgctaagagtttaaaatcttaaaacccataagtgccactaggaaggaaaccctgtatatacctacattgacccaagaaatatttacgcaatccctagcagaacattgtttctgaggaggcatatgtgagattgatttgttggttcatgccaagtgtgttccacaggttgactttgaatgtggacctctgagcatccacgcaggatggctctcaggtcccagtcacagacgtcgcttcctgggattccagcacgatgcctccatagttgaaagactacacaaaaagccacaatcattgcccggcctcctgagtcaccttctatctatactttgcttaaaagctatcccagatactcccccttgaggagctcatgcccttccttcctctttattcgagcatactggcaatgcattggaaaacagacagctcccactaagatcacgttctggtatttctgaggttaacacttgatttagcccctacatatctttccatatatcctattatttctgaatatatgtcctcaaaatccccataaatatccatcccttcctagatggcattaactttcattttagattttaggtgactcataattcccattcacttagcctatcagaaaagtcattggcagacatatatgtccttgaaccttttttatttgtgtggattctgctcatcactgtctctgttagacttattttgtagtggctgcatcacatatttttcacttgaatttttttggaaatagctgaatgtaaatagcagggaggaagaagcaagcaaagtgagagcttttcttcatccagaattgccctctgggctcctttggtaacagatggagctccttcctagctagggagaccttatgagaagtggatggtaggaggagtcactaatgtttcaatctctatttctgtaatcttgggcaataatgcataggagttcttgataccccttcattgattactgtgtatcagttctttgttaggcatgaacgtctttattaatccatcattcttttcttcattcaacaaatatgtattgaacacctcctatatgccaggcactgtgctaggtgctgggaataccactgatgagacagacaaggtccctactcttgtggagtttacttctggtggaggagacagatgataagtaaacaaataaataatgtagtttgagatagtgattaagtgctatgaagaaaataaactagggtgatgattttagtggtggggtggggtgggggtggggtgacattagctagtggtcagggaggcctttccgcggtgggatgttgagctgaggccggaggagaagtagcagtcgctggcagagcacacaggctgctctgggggatgagctggtgcgtttaaggaacaggccagcactggcattcgcaagcagtggggaaggggagagatgccgaggtggtcagtatcctgactttcagaggcctttttttgtttgttttaatttttgctagattgatattaaaaactcatgtggaggaactcaaggaatgtttagaagaccaaaagtccccaatgacaggaacaaaagcaaccaatttttaactttctcttctcattcctgttttcattgatttcccacatgtagtccttttgctcaggaagtctttggggaaattaaggatctttgaagctctgaaataggtgatcaggttagtggtgtctgtcagctgtctaagaggttggaaaatgaactactcaagatagtcacgaaaatactgaaagtttgatttttctttccatatttgaattaattttttctgtttgactggaaggggtttttgtataactaaaacctcagcgcataaaggagatttaaaaggagcacatgatttagtgggtgggccatgaaactagagatgggatttgggggtgaatttgtcaatatctggattttaatccagacatctctgctaacaagcctttggtaagtcacttcagatacttttcctcctttttacaaagagagggctggcttagttatttgccaaagccccttccaggcctgaattccacaagtacgatttactgtagtgtcttatcactctttcatgtcacaatagcgtggagcattagagaaaagcctagacttttagttgatagccagttgaaatatcattgatagaattttagttttaggaaaaattggtttgatttctagctttattactattaggtatgtgagcttgggcaaatcgcttaatctttgagtctagttttctctcaaaatgagaacattaggctaaatgatttccgagtttccagctagtcctagagttctatatttctacatagttgaattattttatcatgctgttgctggggaatatgactaacccttttgaagctactaattttatgtcgagctttaaagtccataattgttatcttcagaaaatattatttgacctacagtatgtccaaatcaatttaataaaatcgctttataa

SEQ ID NO: 3483 - DNA, 3291 bp, Homo sapiens
agtttcttgcaaacccggaagcagatctcttggagtgaaggctgttagtcgccgcgtagaaccctggaagaagaggaagaggaaggcaaaggagtcagggatggctcttcctcagggacagttgacattcaaggatgtggccatagaattctctcaggaggagtggacatgcctggaccctgctcagaagactttgtacagggacgtcatgttggagaattataggaacctggtctccctggatatctcttgtaaatgtgtaaacacggatttgccaccaaaggggaagaacaatatgggagaagcgttctacacggtgaagttggagagacttgaaagctgtgacactgtaggcttgtccttccaggaagttcagaaaaatacatacgactttgagtgtcagtggaaagatgatgaaggaaattataaaacagtacttatgttgcaaaaagaaaatctccctggtagaagagctcaacgtgatagaagggctgcaggaaacaggcatattgaaaatcagcttggagtaagctttcagtcacatctccctgaactgcagcaatttcaacatgaagggaaaatttatgaatacaatcaagttgagaagtctcctaataatcgaggaaaacattataaatgtgatgaatgtggcaaggtcttcagtcaaaactcacggctaacaagtcataagagaattcatactggagagaagccttaccagtgtaataagtgtggcaaagcctttactgttcgttcaaacctaacaatccatcaggtcatccatactggagaaaaaccttacaaatgtaatgaatgtggaaaggtcttcagtcaaccttcaaaccttgcaggtcatcagagaattcatactggagagaaaccttacaagtgtaatgagtgtggcaaagcctttagagcacattcaaaactaactacacatcaggtcatccatactggagaaaaaccttacaaatgtaaggaatgtggcaagtgcttcactcaaaattcacaccttgcaagtcatcgaagaattcatactggggagaagccttacaagtgtaatgagtgtggcaaagcctttagtgttcgctcaagcctgactacccatcagacaatccacactggagaaaaaccttacaaatgtaatgaatgtggcaaggtcttcaggcacaattcataccttgcaaagcatcggcgaattcatactggtgagaaaccttacaagtgtaatgagtgtgggaaagccttcagtatgcattcaaacttaactaagcatcagatcatccataccggagaaaagcctttcaaatgtaatgaatgcgtcaaggttttcactcagtattcacacttagcaaatcatcgaagaattcatactggagagaaaccttacaggtgtgatgagtgtggcaaagcctttagtgtgcgatcaagcctaactacccatcaggcaattcatactggagaaaagccttacaaatgtaatgactgcggtaaggtcttcacacaaaattcacaccttgcaagtcatcggggaattcattctggagagaaaccttacaagtgtgatgaatgtggtaaagccttcagtcaaacatcacaacttgcaaggcattggagagttcatactggagaaaaaccttacaagtgtaatgagtgtggcaaagcctttagtgttcattcaagcctaactatacatcagacaatacatactggacaaaaaccatacaaatgtaatgattgcggcaaggtcttcagacacaattcgtaccttgcaattcatcagagaattcacactggtgagaaaccttataagtgtaatgagtgcggcaaagcatttagtgtacattcaaacctagctacccatcaggtcatccatactggagaaaaaccttacaaatgtaatgaatgtggcaaggtcttcactcaaaattcacatcttgcaaatcatagaagaattcacactggagaaaaaccttataggtgtaatgagtgtgggaaagccttcagtgttcgttcaaccctaactacccatatggcagtccatactggagacaaaccttacaaatgtaaccaatgtggcaaggtctttactcaaaattcaaaccttgcaaaacatcgaagaattcatagtggatagaaaccttacaaaggacgccgggcgtggtggctcacgcctgtaatcccagcactttgggaggccgaggcggggggatcacctgaggtctcgagttcgagaccaggctggccaacacggtgaaacgctgtctctactaaaaatacaaaaattagctgggtgtggtggtgcacgcctgtaatcccagctactcgggaggctgaggcaggagaatcacttgaacctgggaggcggaggttgcagtgagcgagatcatgccattgcactccagcctgggcaacaggagtgaaactccatctccaaaaaaaaaaaaaaaaaaaaagtaaccttacaaaggagtgcggccagtttttcagccacaaattctttcacaacatcagagaattcattcttgagacaattcttacaaatacagtgactgtggcaaactcctgatgagtttaagcattaacagacatcagagttcaaatcctgtgaatatactatgtatgacagaagctttatccaggtctcagagctcaatacgcatcaaaagatacatctttgatgaagtcacacaaacgtaacatgcatgctgagactattactcctggaccacaactgtaggtgaggattcataggaagagtagaactcagtctctagtttcctcataaccctctgatattatatacttcagcataatcagaagtccaaatgtgttaaaactcattacatgatacatatcaaaggttgtaggatgtttggaaatggccaattactttcagcttataaaatgttttgttgaagtatttaagatttattgaaaaggctactatttataacttccaaccagaactttgcaatgtgctgattttatacatgattatacgcctaacatggtgttgttcgggaaagaatcaaaggatggaagggctcactcacttcattaggtgaggattatttctctccaagctcctgaagaaaaaagactctgccttttaaaattaaatatagtctgaattagagagcacttggaaagggcagaggatgatgaactatgatgtcactcatcatccttattgcactgcaggtgcccttcttctgacagaagagcactgtgggtatgggaagaaattctctactggccgggcacagtggctcacgcctgtaatgccag

SEQ ID NO: 3484 - DNA, 2698 bp, Homo sapiens
ctttgcacgctaagctagccacacttccggcaagagcagctagaatcgttccggtgcatattgaataggcgcagaaagggagaaaaagattctacagccctggccacagtactttggtgacacttttcgtggggctctctggaggacttttcccaaggcagatggagaaaacttcgtgaaacccactccttgctattaaaggaaatgttgtggaatataattggacttaggttttgcagagcttgagcatggcctttttgtcctcccaccttctggttcttgaagacattgccggtgacctggccccagactaacacaaggcgggcgtataccgtcagcctgcctggcgtccccttgcctcagcacacacagagacctcttgcaagatgcttctctgccgccataggctggaggttccccgggaactttcccttccttcctagctgaggaagatccctcacttccgctcgccgcgccaccggtcccacctccccgccccccgctgggtcctagcgccggcccctgtttggcagggtccgggctccgtcggtgcgaggagccgacgccgacgccacggagtcagcacaagtctcatcagagaaaccccgttcaccaaggccatggaagtggaggctgcagaggcccggtccccagcccccggctacaagcgctcgggccgccgctacaagtgcgtgtcctgtaccaagacatttccaaacgcgcccagggcagcgcgccacgctgccacacatgggccggcagactgctctgaagaggtggccgaggtgaagccaaagccagagacagaagctaaggcagaggaagccagtggggagaaggtgtcaggctccgcggccaagcctaggccctatgcgtgtccgctatgccccaaggcctacaagacggcacccgagctgcgcagccacgggcgcagccacacgggggagaagccctttccgtgccccgagtgcggccgccgcttcatgcagcccgtgtgcctgcgcgtgcacctggcctcgcacgctggcgaactgcccttccgctgtgcgcactgcccgaaggcctatggcgcgctctccaagctcaagatccaccagcgtggccacacaggcgagcggccttacgcctgcgccgactgcggcaagagctttgctgacccttcagtgttccgcaagcaccggcgtactcacgctggcctgcggccctacagctgtgagcgttgcggcaaagcctatgcggagctcaaggacctccgcaaccatgagcggtcccacaccggcgagcgccccttcctctgctccgagtgcgggaagagcttctcccgctcatcctcgctcacgtgccaccagcgcatccacgcggcacagaagccctaccgctgcccggcctgcggcaagggcttcacgcagctcagttcctaccagagccacgagcgcacgcactcgggggagaagcccttcctgtgcccgcgctgcggccgcatgttctccgacccctcgagcttccgtcgccaccagcgcgcccatgaaggggtgaagccataccactgcgagaagtgcggcaaggacttccggcagccggcggacctggccatgcaccggcgtgtgcacacaggcgaccggccgttcaagtgcctgcaatgtgacaagacgttcgtggcgtcctgggacctcaagcggcacgcgctggtgcactctggccagcggcccttccgctgtgaggagtgcgggcgagccttcgccgagcgtgccagcctcacgaagcatagccgggtgcactcgggggagcgccccttccactgtaacgcatgtgggaaatcctttgtggtgtcgtcgagcctgaggaagcacgagcggacccatcgaagcagtgaggccgcgggtgtgccccctgcacaggagctggtggtggggttggcgctgcctgtgggcgtggcaggtgagagttcagccgccccggcagcaggggcggggctgggggaccctccagcagggctgctagggctgcccccggagtcaggtggtgtgatggccacacagtggcaggtggtgggcatgacggtggagcatgtggaatgccaagatgctggtgtccgggaggctcctggtcccttggaaggggcaggcgaggcggggggtgaggaggctgacgagaagcccccccagtttgtgtgccgagagtgcaaggagaccttctccacaatgacgctgctgcgtcggcacgagcgctcacacccggagctccggcccttcccctgcacccagtgcggcaagagcttctctgaccgggctgggctgcgcaaacacagccgcactcacagctcagtgcgcccctacacctgcccccattgtcccaaggccttcttgagtgccagcgacttgcgcaagcatgaacgcacccaccctgtgcccatggggacccccacacccctggagcccctggtggctttgctaggaatgcctgaagaggggccggcctgaagcccatgaccccccagcaccacactccgggagcccagcccccatcgggggcttcctgtacctccttttgcctggctctgctctttagactccagatccctacccctcagcaactagctcccctgtcggccagctaagagagctgggacagtggaggctggcagaagctgagacgtgactgtctaggagtaacactcattaaagctttcattttggca

SEQ ID NO: 3485 - DNA, 2468 bp, Homo sapiens
ctttgtccctcattcggccttccgtccattcatttgttcatctcctcatccttcgttcagtcctccttgccacgtcctccgaagccacgttttctgaggcttataaccggggtcctgccctccaggggctgcctggctggcgggggcgccgcgtacagacggttgcgaggagcgaggagctccgggtttctgcaactctcggctcctcggcgcgcttcgtaggccccaccgcccttcaaactcccacaaacttaagggaccccattttactgatgaggaaactgaggtccagagcggcgtggggcccttacctctctactgccataaagtattcctgagggcactagggaagggggttcttgaaggatagaaaccccgttcaccaaggccatggaagtggaggctgcagaggcccggtccccagcccccggctacaagcgctcgggccgccgctacaagtgcgtgtcctgtaccaagacatttccaaacgcgcccagggcagcgcgccacgctgccacacatgggccggcagactgctctgaagaggtggccgaggtgaagccaaagccagagacagaagctaaggcagaggaagccagtggggagaaggtgtcaggctccgcggccaagcctaggccctatgcgtgtccgctatgccccaaggcctacaagacggcacccgagctgcgcagccacgggcgcagccacacgggggagaagccctttccgtgccccgagtgcggccgccgcttcatgcagcccgtgtgcctgcgcgtgcacctggcctcgcacgctggcgaactgcccttccgctgtgcgcactgcccgaaggcctatggcgcgctctccaagctcaagatccaccagcgtggccacacaggcgagcggccttacgcctgcgccgactgcggcaagagctttgctgacccttcagtgttccgcaagcaccggcgtactcacgctggcctgcggccctacagctgtgagcgttgcggcaaagcctatgcggagctcaaggacctccgcaaccatgagcggtcccacaccggcgagcgccccttcctctgctccgagtgcgggaagagcttctcccgctcatcctcgctcacgtgccaccagcgcatccacgcggcacagaagccctaccgctgcccggcctgcggcaagggcttcacgcagctcagttcctaccagagccacgagcgcacgcactcgggggagaagcccttcctgtgcccgcgctgcggccgcatgttctccgacccctcgagcttccgtcgccaccagcgcgcccatgaaggggtgaagccataccactgcgagaagtgcggcaaggacttccggcagccggcggacctggccatgcaccggcgtgtgcacacaggcgaccggccgttcaagtgcctgcaatgtgacaagacgttcgtggcgtcctgggacctcaagcggcacgcgctggtgcactctggccagcggcccttccgctgtgaggagtgcgggcgagccttcgccgagcgtgccagcctcacgaagcatagccgggtgcactcgggggagcgccccttccactgtaacgcatgtgggaaatcctttgtggtgtcgtcgagcctgaggaagcacgagcggacccatcgaagcagtgaggccgcgggtgtgccccctgcacaggagctggtggtggggttggcgctgcctgtgggcgtggcaggtgagagttcagccgccccggcagcaggggcggggctgggggaccctccagcagggctgctagggctgcccccggagtcaggtggtgtgatggccacacagtggcaggtggtgggcatgacggtggagcatgtggaatgccaagatgctggtgtccgggaggctcctggtcccttggaaggggcaggcgaggcggggggtgaggaggctgacgagaagcccccccagtttgtgtgccgagagtgcaaggagaccttctccacaatgacgctgctgcgtcggcacgagcgctcacacccggagctccggcccttcccctgcacccagtgcggcaagagcttctctgaccgggctgggctgcgcaaacacagccgcactcacagctcagtgcgcccctacacctgcccccattgtcccaaggccttcttgagtgccagcgacttgcgcaagcatgaacgcacccaccctgtgcccatggggacccccacacccctggagcccctggtggctttgctaggaatgcctgaagaggggccggcctgaagcccatgaccccccagcaccacactccgggagcccagcccccatcgggggcttcctgtacctccttttgcctggctctgctctttagactccagatccctacccctcagcaactagctcccctgtcggccagctaagagagctgggacagtggaggctggcagaagctgagacgtgactgtctaggagtaacactcattaaagctttcattttggca

SEQ ID NO: 3486 - DNA, 400 bp, Homo sapiens
cgtcggtgcgaggagccgacgccgacgccacggagtcagcacaagtctcatcagagaaaccccgttcaccaaggccatggaagtggaggctgcagaggcccggtccccagcccccggctacaagcgctcgggccgccgctacaagtgcgtgtcctgtaccaagacatttccaaacgcgcccagggcagcgcgccacgctgccacacatgggccggcagactgctctgaagaggtggccgaggtcccacaccggcgagcgccccttcctctgctccgagtgcgggaagagcttctcccgctcatcctcgctcacgtgccaccagcgcatccacgcggcacagaagccctaccgctgcccggcctgcggcaagggcttcacgcagctcagttcctaccagag

SEQ ID NO: 3487 - DNA, 386 bp, Homo sapiens
catctagaggtggaggattgagaattgtggctggaggttcggtcgctgccgggaggaggactctgtcgctggagctgaggctggaaaaagaaaccccgttcaccaaggccatggaagtggaggctgcagaggcccggtccccagcccccggctacaagcgctcgggccgccgctacaagtgcgtgtcctgtaccaagacatttccaaacgcgcccagggcagcgcgccacgctgccacacatgggccggcagactgctctgaagaggtggccgaggtgaagccaaagccagagacagaagctaaggcagaggaagccagtggggagaaggtgtcaggctccgcggccaagcctaggccctatgcgtgtccgctatgccccaaggcc

SEQ ID NO: 3488 - DNA, 431 bp, Homo sapiens
ctgtcacttccagacagtgccagctaccagatttagcccattggctcagcccttttctggtcccagtggctctgcggacacttggtccaactcctttcttcaatgagcagatcagggaggaaacgaacgcaggatgtcagagccaggaatgctgggcaggaaggatgtgtgggttccgagagaaaccccgttcaccaaggccatggaagtggaggctgcagaggcccggtccccagcccccggctacaagcgctcgggccgccgctacaagtgcgtgtcctgtaccaagacatttccaaacgcgcccagggcagcgcgccacgctgccacacatgggccggcagactgctctgaagaggtggccgaggtgaagccaaagccagagacagaagctaaggcagaggaagccagtggggagaaggtgtcaggct

SEQ ID NO: 3489 - DNA, 562 bp, Homo sapiens
agttgctgtctctgaggactaaccatccagaggaggaaagaaaacacaaatgctggggacctgtcacttccagacagtgccagctaccagatttagcccattggctcagcccttttctggtcccaggtctgtcttttctgggcgcttggagaccttcaggccaggcccacgtctgggtacactctttatcctggcatagttcttggacactgagctgaagaaggaagatgagaaaccccgttcaccaaggccatggaagtggaggctgcagaggcccggtccccagcccccggctacaagcgctcgggccgccgctacaagtgcgtgtcctgtaccaagacatttccaaacgcgcccagggcagcgcgccacgctgccacacatgggccggcagactgctctgaagaggtggccgaggtgaagccaaagccagagacagaagctaaggcagaggaagccagtggggagaaggtgtcaggctccgcggccaagcctaggccctatgcgtgtccgctatgccccaaggcctacaagacggcacccgagctgcgcagccacgggc

SEQ ID NO: 3490 - DNA, 2396 bp, Homo sapiens
agattccagtctggggcggaggcccgtacagctgtgcaaggccagaattctgtgtgaacagttgctgtctctgaggactaaccatccagaggaggaaagaaaacacaaatgctggggacctgtcacttccagacagtgccagctaccagatttagcccattggctcagcccttttctggtcccaggtctgtcttttctgggcgcttggagaccttcaggccaggcccacgtctgggtacactctttatcctggcatagttcttggacactgagctgaagaaggaagatgagaaaccccgttcaccaaggccatggaagtggaggctgcagaggcccggtccccagcccccggctacaagcgctcgggccgccgctacaagtgcgtgtcctgtaccaagacatttccaaacgcgcccagggcagcgcgccacgctgccacacatgggccggcagactgctctgaagaggtggccgaggtgaagccaaagccagagacagaagctaaggcagaggaagccagtggggagaaggtgtcaggctccgcggccaagcctaggccctatgcgtgtccgctatgccccaaggcctacaagacggcacccgagctgcgcagccacgggcgcagccacacgggggagaagccctttccgtgccccgagtgcggccgccgcttcatgcagcccgtgtgcctgcgcgtgcacctggcctcgcacgctggcgaactgcccttccgctgtgcgcactgcccgaaggcctatggcgcgctctccaagctcaagatccaccagcgtggccacacaggcgagcggccttacgcctgcgccgactgcggcaagagctttgctgacccttcagtgttccgcaagcaccggcgtactcacgctggcctgcggccctacagctgtgagcgttgcggcaaagcctatgcggagctcaaggacctccgcaaccatgagcggtcccacaccggcgagcgccccttcctctgctccgagtgcgggaagagcttctcccgctcatcctcgctcacgtgccaccagcgcatccacgcggcacagaagccctaccgctgcccggcctgcggcaagggcttcacgcagctcagttcctaccagagccacgagcgcacgcactcgggggagaagcccttcctgtgcccgcgctgcggccgcatgttctccgacccctcgagcttccgtcgccaccagcgcgcccatgaaggggtgaagccataccactgcgagaagtgcggcaaggacttccggcagccggcggacctggccatgcaccggcgtgtgcacacaggcgaccggccgttcaagtgcctgcaatgtgacaagacgttcgtggcgtcctgggacctcaagcggcacgcgctggtgcactctggccagcggcccttccgctgtgaggagtgcgggcgagccttcgccgagcgtgccagcctcacgaagcatagccgggtgcactcgggggagcgccccttccactgtaacgcatgtgggaaatcctttgtggtgtcgtcgagcctgaggaagcacgagcggacccatcgaagcagtgaggccgcgggtgtgccccctgcacaggagctggtggtggggttggcgctgcctgtgggcgtggcaggtgagagttcagccgccccggcagcaggggcggggctgggggaccctccagcagggctgctagggctgcccccggagtcaggtggtgtgatggccacacagtggcaggtggtgggcatgacggtggagcatgtggaatgccaagatgctggtgtccgggaggctcctggtcccttggaaggggcaggcgaggcggggggtgaggaggctgacgagaagcccccccagtttgtgtgccgagagtgcaaggagaccttctccacaatgacgctgctgcgtcggcacgagcgctcacacccggagctccggcccttcccctgcacccagtgcggcaagagcttctctgaccgggctgggctgcgcaaacacagccgcactcacagctcagtgcgcccctacacctgcccccattgtcccaaggccttcttgagtgccagcgacttgcgcaagcatgaacgcacccaccctgtgcccatggggacccccacacccctggagcccctggtggctttgctaggaatgcctgaagaggggccggcctgaagcccatgaccccccagcaccacactccgggagcccagcccccatcgggggcttcctgtacctccttttgcctggctctgctctttagactccagatccctacccctcagcaactagctcccctgtcggccagctaagagagctgggacagtggaggctggcagaagctgagacgtgactgtctaggagtaacactcattaaagctttcattttggcaccaggtc

SEQ ID NO: 3491 - DNA, 2865 bp, Homo sapiens
attgcgggcccagcaggtcctagaacccgccggctgtctccgcggttctgggctgcggacacccaggctcggcccgcgcggctgctggcccggcgcggtgtggtcccgggggtcctagagcccgccatgttttgggtttttgtcccggtcgcgtggcccgcgctgcaagatcccaggcgccggcggccccctcccctgctgaggcccggccaccactcccgcggtcctagagaacgccatcttgcaagcctttgtccctcattcggccttccgtccattcatttgttcatctcctcatccttcgttcagtcctccttgccacgtcctccgaagccacgttttctgaggcttataaccggggtcctgccctccaggggctgcctggctggcgggggcgccgcgtacagacggttgcgaggagcgaggagctccgggtttctgcaactctcggctcctcggcgcgcttcgtaggccccaccgcccttcaaactcccacaaacttaagggaccccattttactgatgaggaaactgaggtccagagcggcgtggggcccttacctctctactgccataaagtattcctgagggcactagggaagggggttcttgaaggatgtaaaggggctttcccgttggagaaggcaggcaagggctccccgagcccaggaaactgcatctagaggtggaggattgagaattgtggctggaggttcggtcgctgccgggaggaggactctgtcgctggagctgaggctggaaaaagaaaccccgttcaccaaggccatggaagtggaggctgcagaggcccggtccccagcccccggctacaagcgctcgggccgccgctacaagtgcgtgtcctgtaccaagacatttccaaacgcgcccagggcagcgcgccacgctgccacacatgggccggcagactgctctgaagaggtggccgaggtgaagccaaagccagagacagaagctaaggcagaggaagccagtggggagaaggtgtcaggctccgcggccaagcctaggccctatgcgtgtccgctatgccccaaggcctacaagacggcacccgagctgcgcagccacgggcgcagccacacgggggagaagccctttccgtgccccgagtgcggccgccgcttcatgcagcccgtgtgcctgcgcgtgcacctggcctcgcacgctggcgaactgcccttccgctgtgcgcactgcccgaaggcctatggcgcgctctccaagctcaagatccaccagcgtggccacacaggcgagcggccttacgcctgcgccgactgcggcaagagctttgctgacccttcagtgttccgcaagcaccggcgtactcacgctggcctgcggccctacagctgtgagcgttgcggcaaagcctatgcggagctcaaggacctccgcaaccatgagcggtcccacaccggcgagcgccccttcctctgctccgagtgcgggaagagcttctcccgctcatcctcgctcacgtgccaccagcgcatccacgcggcacagaagccctaccgctgcccggcctgcggcaagggcttcacgcagctcagttcctaccagagccacgagcgcacgcactcgggggagaagcccttcctgtgcccgcgctgcggccgcatgttctccgacccctcgagcttccgtcgccaccagcgcgcccatgaaggggtgaagccataccactgcgagaagtgcggcaaggacttccggcagccggcggacctggccatgcaccggcgtgtgcacacaggcgaccggccgttcaagtgcctgcaatgtgacaagacgttcgtggcgtcctgggacctcaagcggcacgcgctggtgcactctggccagcggcccttccgctgtgaggagtgcgggcgagccttcgccgagcgtgccagcctcacgaagcatagccgggtgcactcgggggagcgccccttccactgtaacgcatgtgggaaatcctttgtggtgtcgtcgagcctgaggaagcacgagcggacccatcgaagcagtgaggccgcgggtgtgccccctgcacaggagctggtggtggggttggcgctgcctgtgggcgtggcaggtgagagttcagccgccccggcagcaggggcggggctgggggaccctccagcagggctgctagggctgcccccggagtcaggtggtgtgatggccacacagtggcaggtggtgggcatgacggtggagcatgtggaatgccaagatgctggtgtccgggaggctcctggtcccttggaaggggcaggcgaggcggggggtgaggaggctgacgagaagcccccccagtttgtgtgccgagagtgcaaggagaccttctccacaatgacgctgctgcgtcggcacgagcgctcacacccggagctccggcccttcccctgcacccagtgcggcaagagcttctctgaccgggctgggctgcgcaaacacagccgcactcacagctcagtgcgcccctacacctgcccccattgtcccaaggccttcttgagtgccagcgacttgcgcaagcatgaacgcacccaccctgtgcccatggggacccccacacccctggagcccctggtggctttgctaggaatgcctgaagaggggccggcctgaagcccatgaccccccagcaccacactccgggagcccagcccccatcgggggcttcctgtacctccttttgcctggctctgctctttagactccagatccctacccctcagcaactagctcccctgtcggccagctaagagagctgggacagtggaggctggcagaagctgagacgtgactgtctaggagtaacactcattaaagctttcattttggcacc

SEQ ID NO: 3492 - DNA, 2510 bp, Homo sapiens
agattccagtctggggcggaggcccgtacagctgtgcaaggccagaattctgtgtgaacagttgctgtctctgaggactaaccatccagaggaggaaagaaaacacaaatgctggggacctgtcacttccagacagtgccagctaccagatttagcccattggctcagcccttttctggtcccaggtctgtcttttctgggcgcttggagaccttcaggccaggcccacgtctgggtacactctttatcctggcatagttcttggacactgagctgaagaaggaagatgtggctctgcggacacttggtccaactcctttcttcaatgagcagatcagggaggaaacgaacgcaggatgtcagagccaggaatgctgggcaggaaggatgtgtgggttccgagagaaaccccgttcaccaaggccatggaagtggaggctgcagaggcccggtccccagcccccggctacaagcgctcgggccgccgctacaagtgcgtgtcctgtaccaagacatttccaaacgcgcccagggcagcgcgccacgctgccacacatgggccggcagactgctctgaagaggtggccgaggtgaagccaaagccagagacagaagctaaggcagaggaagccagtggggagaaggtgtcaggctccgcggccaagcctaggccctatgcgtgtccgctatgccccaaggcctacaagacggcacccgagctgcgcagccacgggcgcagccacacgggggagaagccctttccgtgccccgagtgcggccgccgcttcatgcagcccgtgtgcctgcgcgtgcacctggcctcgcacgctggcgaactgcccttccgctgtgcgcactgcccgaaggcctatggcgcgctctccaagctcaagatccaccagcgtggccacacaggcgagcggccttacgcctgcgccgactgcggcaagagctttgctgacccttcagtgttccgcaagcaccggcgtactcacgctggcctgcggccctacagctgtgagcgttgcggcaaagcctatgcggagctcaaggacctccgcaaccatgagcggtcccacaccggcgagcgccccttcctctgctccgagtgcgggaagagcttctcccgctcatcctcgctcacgtgccaccagcgcatccacgcggcacagaagccctaccgctgcccggcctgcggcaagggcttcacgcagctcagttcctaccagagccacgagcgcacgcactcgggggagaagcccttcctgtgcccgcgctgcggccgcatgttctccgacccctcgagcttccgtcgccaccagcgcgcccatgaaggggtgaagccataccactgcgagaagtgcggcaaggacttccggcagccggcggacctggccatgcaccggcgtgtgcacacaggcgaccggccgttcaagtgcctgcaatgtgacaagacgttcgtggcgtcctgggacctcaagcggcacgcgctggtgcactctggccagcggcccttccgctgtgaggagtgcgggcgagccttcgccgagcgtgccagcctcacgaagcatagccgggtgcactcgggggagcgccccttccactgtaacgcatgtgggaaatcctttgtggtgtcgtcgagcctgaggaagcacgagcggacccatcgaagcagtgaggccgcgggtgtgccccctgcacaggagctggtggtggggttggcgctgcctgtgggcgtggcaggtgagagttcagccgccccggcagcaggggcggggctgggggaccctccagcagggctgctagggctgcccccggagtcaggtggtgtgatggccacacagtggcaggtggtgggcatgacggtggagcatgtggaatgccaagatgctggtgtccgggaggctcctggtcccttggaaggggcaggcgaggcggggggtgaggaggctgacgagaagcccccccagtttgtgtgccgagagtgcaaggagaccttctccacaatgacgctgctgcgtcggcacgagcgctcacacccggagctccggcccttcccctgcacccagtgcggcaagagcttctctgaccgggctgggctgcgcaaacacagccgcactcacagctcagtgcgcccctacacctgcccccattgtcccaaggccttcttgagtgccagcgacttgcgcaagcatgaacgcacccaccctgtgcccatggggacccccacacccctggagcccctggtggctttgctaggaatgcctgaagaggggccggcctgaagcccatgaccccccagcaccacactccgggagcccagcccccatcgggggcttcctgtacctccttttgcctggctctgctctttagactccagatccctacccctcagcaactagctcccctgtcggccagctaagagagctgggacagtggaggctggcagaagctgagacgtgactgtctaggagtaacactcattaaagctttcattttggcaccaggtc

SEQ ID NO: 3493 - DNA, 1951 bp, Homo sapiens
gcctggcggttgctttgtctctccttcgccggagccggctcttcctgttagtctccgctgctagttcttggctctgggaggcccaggtggctctgcagcagcctctgccaccctgtgacctgcgagtattgggacatccctagctgacgccaggacacccgggaagccgaggaatggtgagtggactgcgcctggcttcccgaagtggagaagagggctggttgaaacctgctgtggcgcgactcgggcctccacgccatcggctccggaacctgcggaccgagtcgccgtggcgtagccggggctcagtcctcttctgttcagggccgggccgggcggggcgggcagcggaacccctgcatcctgtctgtacctgcgggcgccacttccgccggccggagccctgtcgggaacccctcgcctcccctatccaggactcggtggcttttgaggatgtggctgtgaactttacccaggaggaatgggctttgctagattcttctcagaagaatctctacagagaagtgatgcaggaaacctgcaggaacctggcttctgtaggaagccaatggaaagaccagaatattgaagatcacttcgaaaaacctgggaaagatataagaaatcatatcgtacagagactgtgtgaaagtaaagaagatggtcagtatggagaagttgtcagccaaattccaaatcttgatctgaacgagaacatttctactggattaaaaccatgtgaatgcagtatttgtggaaaagtctttgtacgtcattccctccttaataggcatatcctagctcactcaggatacaaaccatatggagagaagcaatataaatgtgaacagtgtgggaaattcttcgtttctgttccaggtgttagaagacacatgataatgcacagtggaaatccagcttataaatgtacgatatgtgggaaagctttttattttctcaattcagttgaaagacatcagagaactcacacaggagaaaaaccctataaatgtaaacaatgtggtaaagcattcactgtttccggttcttgtctaatacatgaacgaactcacactggagagaaaccctacgaatgtaaggaatgtgggaaaacattcagattttcttgttcttttaagacgcatgaaaggactcacactggagaaagaccctataaatgtaccaaatgtgataaagccttcagctgttccacttcccttcgttaccatggaagcattcatactggagagagaccctatgagtgtaaacaatgtggcaaagcctttagtcgtttgagttccctttgtaaccatagaagtactcataccggagagaaaccctatgaatgtaaacaatgtgatcaagccttcagtcgcctcagttcccttcacctccacgaaagaattcatactggagaaaaaccctatgaatgtaagaaatgcggtaaagcctacactcgttccagtcaccttactcgccatgaaagaagtcatgatatagaggctgggtgtagtgactcagcctataatcccagcactttgggaggccaaggcgtgtggattgcttgagcccaggagttcataaccagcctggattaaaacaatgtgaaacaacctgggcaacatggtgaaaccctgtctttacaaaaaataaaataatgccgggcacggtggcttacgcctgtaatcccagcactttgggaggccgaggcgggtggatcacgaggtcaggagatcgagaccatcctggccaacacggtgaaaccccgtctctactaaaaatacaaaaaattagctgggcgtggtggcagacgcctgtggtcccagttactcgggaggctgaggcaggagaatggcatgaacccgggaggcggaacttgcagtgagccgagatcgcaccactgcacttcagcctgggtgacagagtgagactctgtctcaaaaaataagat

SEQ ID NO: 3494 - DNA, 1919 bp, Homo sapiens
gcctggcggttgctttgtctctccttcgccggagccggctcttcctgttagtctccgctgctagttcttggctctgggaggcccaggtggctctgcagcagcctctgccaccctgtgacctgcgagtattgggacatccctagctgacgccaggacacccgggaagccgaggaatggtgagtggactgcgcctggcttcccgaagtggagaagagggctggttgaaacctgctgtggcgcgactcgggcctccacgccatcggctccggaacctgcggaccgagtcgccgtggcgtagccggggctcagtcctcttctgttcagggccgggccgggcggggcgggcagcggaacccctgcatcctgtctgtacctgcgggcgccacttccgccggccggagccctgtcgggaacccctcgcctcccctatccaggactcggtggcttttgaggatgtggctgtgaactttacccaggaggaatgggctttgctagattcttctcagaagaatctctacagagaagtgatgcaggaaacctgcaggaacctggcttctgtagaaatcatatcgtacagagactgtgtgaaagtaaagaagatggtcagtatggagaagttgtcagccaaattccaaatcttgatctgaacgagaacatttctactggattaaaaccatgtgaatgcagtatttgtggaaaagtctttgtacgtcattccctccttaataggcatatcctagctcactcaggatacaaaccatatggagagaagcaatataaatgtgaacagtgtgggaaattcttcgtttctgttccaggtgttagaagacacatgataatgcacagtggaaatccagcttataaatgtacgatatgtgggaaagctttttattttctcaattcagttgaaagacatcagagaactcacacaggagaaaaaccctataaatgtaaacaatgtggtaaagcattcactgtttccggttcttgtctaatacatgaacgaactcacactggagagaaaccctacgaatgtaaggaatgtgggaaaacattcagattttcttgttcttttaagacgcatgaaaggactcacactggagaaagaccctataaatgtaccaaatgtgataaagccttcagctgttccacttcccttcgttaccatggaagcattcatactggagagagaccctatgagtgtaaacaatgtggcaaagcctttagtcgtttgagttccctttgtaaccatagaagtactcataccggagagaaaccctatgaatgtaaacaatgtgatcaagccttcagtcgcctcagttcccttcacctccacgaaagaattcatactggagaaaaaccctatgaatgtaagaaatgcggtaaagcctacactcgttccagtcaccttactcgccatgaaagaagtcatgatatagaggctgggtgtagtgactcagcctataatcccagcactttgggaggccaaggcgtgtggattgcttgagcccaggagttcataaccagcctggattaaaacaatgtgaaacaacctgggcaacatggtgaaaccctgtctttacaaaaaataaaataatgccgggcacggtggcttacgcctgtaatcccagcactttgggaggccgaggcgggtggatcacgaggtcaggagatcgagaccatcctggccaacacggtgaaaccccgtctctactaaaaatacaaaaaattagctgggcgtggtggcagacgcctgtggtcccagttactcgggaggctgaggcaggagaatggcatgaacccgggaggcggaacttgcagtgagccgagatcgcaccactgcacttcagcctgggtgacagagtgagactctgtctcaaaaaataagataaaataaaataaaaaaataattagctggg

SEQ ID NO: 3495 - DNA, 489 bp, Homo sapiens
caggtggctctgcagcagcctctgccaccctgtgacctgcgagtattgggacatccctagctgacgccaggacacccgggaagccgaggaatggactcggtggcttttgaggatgtggctgtgaactttacccaggaggaatgggctttgctagattcttctcagaagaatctctacagagaagtgatgcaggaaacctgcaggaacctggcttctgtagaaatcatatcgtacagagactgtgtgaaagtaaagaagatggtcagtatggagaagttgtcagccaaattccaaatcttgatctgaacgagaacatttctactggattaaaaccatgtgaatgcagtatttgtggaaaagtctttgtacgtcattccctccttaataggcatatcctagctcactcaggatacaaaccatatggagagaagcaatataaatgtgaacagtgtgggaaattcttcgtttctgttccaggtgttagaagac

SEQ ID NO: 3496 - DNA, 730 bp, Homo sapiens
gcagcagcctctgccaccctgtgacctgcgagtattgggacatccctagctgacgccaggacacccgggaagccgaggaatggactcggtggcttttgaggatgtggctgtgaactttacccaggaggaatgggctttgctagattcttctcagaagaatctctacagagaagtgatgcaggaaacctgcaggaacctggcttctgaagccaatggaaagaccagaatattgaagatcacttcgaaaaacctgggaaagatataagaaatcatatcgtacagagactgtgtgaaagtaaagaagatggtcagtatggagaagttgtcagccaaattccaaatcttgatctgaacgagaacatttctactggattaaaaccatgtgaatgcagtatttgtggaaaagtctttgtacgtcattccctccttaataggcatatcctagctcactcaggatacaaaccatatggagagaagcaatataaatgtgaacagtgtgggaaattcttcgtttctgttccaggtgttagaagacacatgataatgcacagtggaaatccagcttataaatgtacgatatgtgggaaagctttttattttctcaattcagttgaaagacatcagagaactcacacaggagaaaaaccctataaatgtaaacaatgtggtaaagcattcactgtttccggttcttgtctaatacatgaacgaactcacactggagagaaac

SEQ ID NO: 3497 - DNA, 1718 bp, Homo sapiens
ggcggttgctttgtctctccttcgccggagccggctcttcctgttagtctccgctgctagttcttggctctgggaggcccaggtggctctgcagcagcctctgccaccctgtgacctgcgagtattgggacatccctagctgacgccaggacacccgggaagccgaggaatggactcggtggcttttgaggatgtggctgtgaactttacccaggaggaatgggctttgctagattcttctcagaagaatctctacagagaagtgatgcaggaaacctgcaggaacctggcttctgtaggaagccaatggaaagaccagaatattgaagatcacttcgaaaaacctgggaaagatataagaaatcatatcgtacagagactgtgtgaaagtaaagaagatggtcagtatggagaagttgtcagccaaattccaaatcttgatctgaacgagaacatttctactggattaaaaccatgtgaatgcagtatttgtggaaaagtctttgtacgtcattccctccttaataggcatatcctagctcactcaggatacaaaccatatggagagaagcaatataaatgtgaacagtgtgggaaattcttcgtttctgttccaggtgttagaagacacatgataatgcacagtggaaatccagcttataaatgtacgatatgtgggaaagctttttattttctcaattcagttgaaagacatcagagaactcacacaggagaaaaaccctataaatgtaaacaatgtggtaaagcattcactgtttccggttcttgtctaatacatgaacgaactcacactggagagaaaccctacgaatgtaaggaatgtgggaaaacattcagattttcttgttcttttaagacgcatgaaaggactcacactggagaaagaccctataaatgtaccaaatgtgataaagccttcagctgttccacttcccttcgttaccatggaagcattcatactggagagagaccctatgagtgtaaacaatgtggcaaagcctttagtcgtttgagttccctttgtaaccatagaagtactcataccggagagaaaccctatgaatgtaaacaatgtgatcaagccttcagtcgcctcagttcccttcacctccacgaaagaattcatactggagaaaaaccctatgaatgtaagaaatgcggtaaagcctacactcgttccagtcaccttactcgccatgaaagaagtcatgatatagaggctgggtgtagtgactcagcctataatcccagcactttgggaggccaaggcgtgtggattgcttgagcccaggagttcataaccagcctggattaaaacaatgtgaaacaacctgggcaacatggtgaaaccctgtctttacaaaaaataaaataatgccgggcacggtggcttacgcctgtaatcccagcactttgggaggccgaggcgggtggatcacgaggtcaggagatcgagaccatcctggccaacacggtgaaaccccgtctctactaaaaatacaaaaaattagctgggcgtggtggcagacgcctgtggtcccagttactcgggaggctgaggcaggagaatggcatgaacccgggaggcggaacttgcagtgagccgagatcgcaccactgcacttcagcctgggtgacagagtgagactctgtctcaaaaaataagataaaataaaataaaaaaataattagctggg

SEQ ID NO: 3498 - DNA, 1627 bp, Homo sapiens
gctttgtctctccttcgccggagccggctcttcctgttagtctccgctgctagttcttggctctgggaggcccaggtggctctgcagcagcctctgccaccctgtgacctgcgagtattgggacatccctagctgacgccaggacacccgggaagccgaggaatggactcggtggcttttgaggatgtggctgtgaactttacccaggaggaatgggctttgctagattcttctcagaagaatctctacagagaagtgatgcaggaaacctgcaggaacctggcttctgtaggaagccaatggaaagaccagaatattgaagatcacttcgaaaaacctgggaaagatataagaaatcatatcgtacagagactgtgtgaaagtaaagaagatggtcagtatggagaagttgtcagccaaattccaaatcttgatctgaacgagaacatttctactggattaaaaccatgtgaatgcagtatttgtggaaaagtctttgtacgtcattccctccttaataggcatatcctagctcactcaggatacaaaccatatggagagaagcaatataaatgtgaacagtgtgggaaattcttcgtttctgttccaggtgttagaagacacatgataatgcacagtggaaatccagcttataaatgtacgatatgtgggaaagctttttattttctcaattcagttgaaagacatcagagaactcacacaggagaaaaaccctataaatgtaaacaatgtggtaaagcattcactgtttccggttcttgtctaatacatgaacgaactcacactggagagaaaccctacgaatgtaaggaatgtgggaaaacattcagattttcttgttcttttaagacgcatgaaaggactcacactggagaaagaccctataaatgtaccaaatgtgataaagccttcagctgttccacttcccttcgttaccatggaagcattcatactggagagagaccctatgagtgtaaacaatgtggcaaagcctttagtcgtttgagttccctttgtaaccatagaagtactcataccggagagaaaccctatgaatgtaaacaatgtgatcaagccttcagtcgcctcagttcccttcacctccacgaaagaattcatactggagaaaaaccctatgaatgtaagaaatgcggtaaagcctacactcgttccagtcaccttactcgccatgaaagaagtcatgatatagaggctgggtgtagtgactcagcctataatcccagcactttgggaggccaaggcgtgtggattgcttgagcccaggagttcataaccagcctggattaaaacaatgtgaaacaacctgggcaacatggtgaaaccctgtctttacaaaaaataaaataatgccgggcacggtggcttacgcctgtaatcccaaagtgctgggattacaggcatgagccactgtgcccagcggagtaagtttaatttgtatgtattgttctgtgattaatggaccagtgagtaatgattgctaattgttgcgattttcttactagcctcacttggcaaattttggttatcccttgtccattatacacattccacctttttttattaaaggaaaaactactcttggtgt

SEQ ID NO: 3499 - DNA, 1994 bp, Homo sapiens
gtgttgggcagcgcgaatgtggcgagctcggtgcgtctccgctgctccttccccttatccctgggaggtccaagtggtcccgcggcagcttctgttgctctgggacctgcaggtcccggaaggtccttagggaggaccccagacaccggagactgggaaatggattcagtgtcatttgaagatgtggctgtggcctttactcaggaggagtgggctttgctggatccttctcaaaagaatctctacagagatgtgatgcaagaaatcttcaggaacctggcttctgtaggaaacaaatcagaagaccagaatatccaagatgacttcaaaaatcctgggagaaatctaagcagtcatgtggtagagagactgtttgaaattaaagaaggcagtcaatatggagaaaccttcagccaggattcaaatttgaatctgaataagaaagtttctactggagtaaagccatgtgaatgcagtgtgtgtggaaaagtcttcatatgtcattcagcccttcataggcacatcctgtctcacattggaaacaaactatttgagtgtgaggaatgtccagagaagttatatcattgcaaacaatgtgggaaagcctttatctctctcaccagtgttgacagacacatggtaacacacactagtaatgggccttataagggtccagtgtatgagaagccttttgattttcctagtgtatttcaaatgcctcagagcacttacactggagagaaaacatataaatgtaaacattgtgataaagccttcaattattcaagttatcttcgtgaacatgaaagaactcatactggagagaaaccctatgcatgtaagaaatgtggtaaatcattcactttttccagttctcttcgccaacatgaaagatctcatactggagagaaaccctatgaatgtaaggaatgtggcaaagccttcagtcgttccacttacttgggaatacatgaaagaacgcatactggagaaaaaccctatgaatgtataaaatgtggcaaagcctttagatgttccagagtcctcagagtccatgaaaggactcacagtggagaaaagccctatgaatgtaaacaatgtggtaaagccttcaaatattctagtaacctatgtgagcatgaaagaactcacactggagtgaaaccttatggatgtaaggaatgtggtaagtcgtttacttcttccagtgcccttcgaagccatgaaaggactcatactggagaaaaaccctatgaatgtaagaaatgtggtaaagccttcagttgttccagttcccttcgaaagcatgaaagagcttatatgtggtaaaaaacaacaacaacaaaacacctctgtcaatgtaagaagtgtgttaaagctttcagttattctagtttcattagaacacgtgaaaaaattaaaaactcaaattagagagaaacccaacacatgtaaggaagattagaatgtatgcaattttcctagttcccttctaaaacttagaaggacccgtcctgggaaagaacgtcataaaatacgaaaaatgtgttagaacactttattttcccagccgctttcaaatatatttttatcagtggttcattgttaaagaaggtgtctatactttagattttcagttttttgcagggaatcatggagctgagaatttcacagatactttataagccatagtacatgagcttaataggctgtgttttgtttctcatcagttaacataatttttgtctattcatttaaaaatttgttggatccctagactaagttgaaatgtatttctaatagtaggcaattttaattttcatgtagttgtttaattgttctctaattaatggaccaatgaaaaatgagttcatgtgtgtgtgtgtgtgtgtgtgtgtgtgtgtgtattctacctttttatgggaaaactacttttttgttgtaaagattttcttctgttttctttgctaataaagaattgttattaatttgca

SEQ ID NO: 3500 - DNA, 2751 bp, Homo sapiens
actctcaagcgcgccgcgaaaggagggagcagcttccgggacctggcgcggcttttgtgttgggcagcgcgaatgtggcgagctcggtgcgtctccgctgctccttccccttatccctgggaggtccaagtggtcccgcggcagcttctgttgctctgggacctgcaggtcccggaaggtccttagggaggaccccagacaccggagactgggaaatgggactattggcattcagggatgtggctctagaattctctccagaggagtgggaatgcctggacccagctcagcggagtttgtatagggatgtgatgttagagaactacagaaacctgatctcccttggtcttgctatgtctaagccagaactgatcatctgtctggaggcaaggaaagagccctggaacgtgaacacagagaagacagccagacactcagtagagacgaggtttcgccatgttggccaggctggtctcaaactccttacctcaggtgatccacctgccttggcctcccaaagtgctgggattacaggcacgggccaccactgccagcctatttgtgtattctgaattatatttaaccattcatttggtgagttttgtcttcttatcttactgaagacattttgccagagcagggcctgcaagtttcattccaaaaagtgatgctgagaagatatgaaagatgttgtcttgagaaattacgcttaaggaatgactgggaaattgtggattatccagactcaggtagttctttataacaatgtgagaatgaactaatacagaaaagtggtaccagagagttgggacattgctataaagatacctgaaaatgtggaagtgactttggaactgggtaacaggcagaagttggaagagtttggagggctcagaagaagacaggaagataaggaaaagtttggaacttcctagagacttgttgaatggttgtaaccaaaatgctgatggtgatatggacaatgaagtccaggctgaggagttctcagatggagatgaggaccttattgggagctacagtaaaggtcactcttgctatgctttagcaaagagactagtggcattgtgcccctgctatagggatctgttgaactttgaacttgagagagatgatttagggtatctggcagaaaatatttctaagtagcaaagcattcaagatatggcctggctccttctaacagtgtatgctcatatttctgaggaaagagattatctgaaactggaacttacatttaaaagggaaatggagtattaaagtttggaaatgtgcagcctagccatgtattagaaaagaaaaaaccattttctggggaggaattcaacctagctgcaaaaatttgtgtaagtaaagaggagccgtatgttaacagccaagacaatgggaaaaatgcccccaagacatttcagagactttcgtggcagcccctctcatcacaggcctggaggcctaggagggaaaaacagttttgtgggtcaggcttagggccctgctattctgtgcagccttgggaccctgttccctgtgctttagctgctccagctccagccatggctaaaaggactccagatatgtttcaggttgctgctccagagggtataagacacaagccttggaggcttccagatggtgttaagcctgcaggtgctcagagggcaagagttgaggcttgggagcctccattctttcagatttctgaggatgtatggaaacaactggatatccaggcagaaatttgcttcaggggcggagcccttgtggagaacctctactagggtactgtggaggggaaatatggggttgaagtccccacaaagagtctccactggggcactgccaagtggagctgtgagaagagggccactgtcctccacaccccagaatggtagctccatcaacagtttgcactgtgtgcttggaaaagccacaggcactcaacaccagcctgtgagagcggccatggggcactaagccctgcagagccgccagaagcagagctgtccaagaccttgggagcctaccccttgcatcagtgtggcctggatgttagacatggaatcaaaggatattattttggagctctaagatttaatgactgccctgctgggtttcggacttgcatggggcctgtaacccctttgttttggccaatgtctcccttttggaacaggaacatttacccaatgcctgtacccttattgtatcctagatgtaactaacttgcttttgattttacaggctcataggcagaagggactgccttatctcagatgaaactttggacttggacttttgagttaatgctgaaatgagttaagactttgggagactgtttggaaagcataattgtgttttgaaatgtgaggacatgatatttgggatgggccaggagtggaatgatatggtttggctctgtgtccccacccaaatttcatgtcaaattgtaatcttcaatgttggaggagggtcctggtgggaaggtaattggatcatgggggcagacttctcctttgctgttctcatgatgagtgagttctcatgatacttgattgtttaaaagtgtatagcatttccccctttgctctctctctcctgccagccatgtgaagatgtgcttgcttcccctttgccttctgccatgattctaagtttcctgaggcctccccagaagcagaagcatgtaaagcccacagaaccgtgagttgattaaatctcttttctttataaatt

SEQ ID NO: 3501 - DNA, 2433 bp, Homo sapiens
cttgtagcggacattttgtttctgtcaggctgtccctggccggggttctgtaacgcttgtgtgggccgcaggtggaggtgttgggaaagcgcggaggagatgttgtccccagtgtcccgagacgcgtctgatgctctgcagggacggaagtgcctgcgtccccgatcgagacgcctgccgctcccggcagctgtccgcgcccacggtcctatggcggagctaacggactccgcgcggggctgtgtggtctttgaggatgtgtttgtatacttctctcgggaagaatgggagcttcttgatgatgctcagagacttttgtaccatgatgtgatgctggagaactttgcacttttagcctcactgggaattgcattttccagatcacgtgcagtcatgaaactagagcgaggagaagagccctgggtgtatgaccaggtggatatgacttcagccacagaaagagaggcccagaggggacttagacctggttgttggcatggagtggaggatgaagaggtatcttctgagcagagcatttttgtagcaggagtgtcagaggtcaggactctcatggcagagctggagtctcacccatgtgacatatgtggcccaatattgaaagataccttacacctggctaaataccatgggggaaaagccaggcagaaaccatacttgtgtggggcatgtggaaagcaattctggttcagtacagactttgaccagcaccagaaccagcccaatggagggaaacttttcccaaggaaggagggcagagactctgtgaaaagctgcagagtccatgtgccagagaagaccctcacatgtgggaaaggtaggagagacttttcagccacatctggccttcttcagcatcaggcctctctcagcagcatgaagccccacaagagcactaagcttgtgagtggctttctcatgggacagaggtatcacaggtgtggtgaatgtgggaaagccttcacccgcaaagacacacttgctcggcatcagagaatccacactggagaaaggccttatgagtgtaacgaatgtgggaaattcttcagccaaagctatgacctctttaaacaccagacagttcacactggagaaaggccatacgagtgcagcgaatgtgggaaattctttagacaaatctccggcctgattgagcacaggcgagttcacacgggtgaaagactctatcagtgtggcaaatgtgggaaattttttagcagtaagtctaatctcattcgacaccaggaagttcacacaggagccaggccttatgtatgcagcgaatgtgggaaagagttcagtcggaaacacacacttgttctgcaccaacgaactcacactggagaaaggccttatgagtgcagtgaatgtgggaaggcctttagccaaagctcccaccttaatgtacactggagaattcacagcagtgattatgagtgtagcagatgtggtaaagctttcagctgcatctccaaactcattcagcaccagaaagttcactctggagaaaagccttatgagtgcagcaagtgcgggaaagccttcactcaaagacccaacctcatcaggcactggaaagtccacactggggaaaggccttatgtgtgtagtgagtgcgggagagaattcatccggaaacagacacttgttctgcaccagagggttcatgctggagaaaagctttaagagtgtagcaaatgtgggggaaagtcttaggccaatgcccctgacttactatatggtggggaactagcagtagttaatgagtgcagcagatgcaggaaagccttcccctggaggctgaaccttacccgccattgggaatttcacaccggacacaggccttagcagtctaagcaatgtgctgtctctgttcagcccaacagctcaccctagagtggaactctgggagcagccattgggagggaaccatcagtaagaagtgaaacttcatagatatggacattcccactggggagattccctgtgagtgtcaagtatgtgagatgctttcagcagctgtgttgcactttttaaatggctattggcctttgctggggcaggagccatctgctcctaccatctggcagaatcatactgcgtttaccatttaccccagcatgcttgtgacgggcagacctctcttctctccccagtccctaaaaggtgttgtgagtggtctcacagcccactaggggtcttaatttcctctcttttgatgtaaatggcatggaaataatcagctttgttcaagaggacacagaaggattctgcaaatagcctgcagagacttacctgtgttgattgatttcatatgatgctcgttatggatatatccaatatccaagtcacccagctctggaactgcctgcttcacattgctcatgataataaaggcctgttctttaagccacc

SEQ ID NO: 3502 - DNA, 1932 bp, Homo sapiens
agcggacattttgtttctgtcaggctgtccctggccggggttctgtaacgcttgtgtgggccgcaggtggaggtgttgggaaagcgcggaggagatgttgtccccagtgtcccgagacgcgtctgatgctctgcagggacggaagtgcctgcgtccccgatcgagacgcctgccgctcccggcagctgtccgcgcccacggtcctatggcggagctaacggactccgcgcgggaattgcattttccagatcacgtgcagtcatgaaactagagcgaggagaagagccctgggtgtatgaccaggtggatatgacttcagccacagaaagagaggcccagaggggacttagacctggttgttggcatggagtggaggatgaagaggtatcttctgagcagagcatttttgtagcaggagtgtcagaggtcaggactctcatggcagagctggagtctcacccatgtgacatatgtggcccaatattgaaagataccttacacctggctaaataccatgggggaaaagccaggcagaaaccatacttgtgtggggcatgtggaaagcaattctggttcagtacagactttgaccagcaccagaaccagcccaatggagggaaacttttcccaaggaaggagggcagagactctgtgaaaagctgcagagtccatgtgccagagaagaccctcacatgtgggaaaggtaggagagacttttcagccacatctggccttcttcagcatcaggcctctctcagcagcatgaagccccacaagagcactaagcttgtgagtggctttctcatgggacagaggtatcacaggtgtggtgaatgtgggaaagccttcacccgcaaagacacacttgctcggcatcagagaatccacactggagaaaggccttatgagtgtaacgaatgtgggaaattcttcagccaaagctatgacctctttaaacaccagacagttcacactggagaaaggccatacgagtgcagcgaatgtgggaaattctttagacaaatctccggcctgattgagcacaggcgagttcacacgggtgaaagactctatcagtgtggcaaatgtgggaaattttttagcagtaagtctaatctcattcgacaccaggaagttcacacaggagccaggccttatgtatgcagcgaatgtgggaaagagttcagtcggaaacacacacttgttctgcaccaacgaactcacactggagaaaggccttatgagtgcagtgaatgtgggaaggcctttagccaaagctcccaccttaatgtacactggagaattcacagcagtgattatgagtgtagcagatgtggtaaagctttcagctgcatctccaaactcattcagcaccagaaagttcactctggagaaaagccttatgagtgcagcaagtgcgggaaagccttcactcaaagacccaacctcatcaggcactggaaagtccacactggggaaaggccttatgtgtgtagtgagtgcgggagagaattcatccggaaacagacacttgttctgcaccagagggttcatgctggagaaaagctttaagagtgtagcaaatgtgggggaaagtcttaggccaatgcccctgacttactatatggtggggaactagcagtagttaatgagtgcagcagatgcaggaaagccttcccctggaggctgaaccttacccgccattgggaatttcacaccggacacaggccttagcagtctaagcaatgtgctgtctctgttcagcccaacagctcaccctagagtggaactctgggagcagccattgggagggaaccatcagtaagaagtgaaacttcatagatatggacattcccactggggagattccctgtgagtgtcaagtatgtgagatgctttcagcagctgtgttgcactttttaaatggctatt

SEQ ID NO: 3503 - DNA, 2989 bp, Homo sapiens
ctgctcgctggcctcccagtcttcccagcaaccggtgacactgcccgcgccagactgaccactagccgacgcgggcgagagggacaggagcgtgacctccccatcccgaggggccggacgctcgggcgcctccccgctccccccactcggaggccgcgcgcgccgttagccccttcctcgctcccccgccccagtcccgcagtccgggaggcgggggtcggcagccggctgagtgggaaccgcgcggtgtctgaggaggcagtcggcgaccggtttccacttcaagcgtgacccttttgcctgtgggatgagctccagcatggggtgaggtacagaagagagacttgaagagcgtgccttgggactcaagcgccaaacctgtaccctagcgagtgtcctactccgcatccgtaatggaaggaaatgcacatcttactccagaggcacaagaggaggacatcccatgcggctactcctgcccagcgtggtggggcagcagaagctccagagcccagacttgcaggctcacggtgcagggtgaacctggccacagctcaccctggaacagccacaatgtctgccccttagagaagaaccctgaaatcagaccagtttttgcggcctccccctttcctctctgttacagtgccctttccaggccttaagagaagtaaaacttagctgcagcgtcaggaggtggaccccagagtgtgagtggcacgcttccctgtgaacccgtcctcaccatgtttgccacatctggggcagtggcagcggggaagccttactcgtgcagcgaatgtggcaagagcttctgctacagctcagtgctgctgcgacatgaacgagctcacggcggtgacggccgcttccgttgcctagaatgcggtgagcgctgtgcacgggctgctgacctccgagcgcacaggcgcacgcatgctggccagaccctctacatctgcagtgagtgcggacaaagcttccgccacagcggccgtcttgacctacacttgggcgcacaccggcagcgatgccgcacttgcccctgccgcacatgcggccggcgcttcccgcacctcccggcgctgctgctacaccggcgccgccagcatctgccagagcggccccgccgctgcccgctgtgcgcccgcaccttccggcagagcgcgctgctcttccaccaggcgcgggcgcaccccttggggacaacctctgaccctgctgccccaccccaccgctgcgcgcagtgcccgcgagccttccgaagcggcgccgggctgcggagtcacgcgcgcatccacgtgtcccggagccccacgcgaccccgtgtctcagacgcccaccagtgtggcgtgtgcggcaagtgctttggcaagagctctacgctgacgcgacacctgcagacgcactcgggggagaaacccttcaagtgcccggagtgcggcaagggcttcctggagagcgccacgctggtgcgccaccagcgcacacacacgggcgagaagccgtacgcatgtggcgactgtggacgctgcttcagcgagagttccacgctgctgcgccatcggcgcagccatcagggcgagcggccacatgcgtgcgccacttgcggcaagggtttcgggcagcgctccgacctggtggtgcaccagcgcatccacacgggcgagaagcccttcgcgtgccccgagtgcggccgccgcttcagcgaccgctcggacctcaccaagcaccggcgcacgcacacgggcgagaagccctaccgctgcgaactgtgcggcaagcggttcacgtgcgtgtccaatctcaacgtgcatcggcgcaaccatgccggccacaagccacacaaatgccccgagtgcagcaaggccttcagcgtcgcctccaagcttgcactgcaccgcaagacgcacctgggcgaacggccagcggagtgcgcagagtgcggcaagtgcttcagccacagccgctcgctgtcacagcatcagcgggcccacacgcgcgcccgcaccgctgccgccgttgccatccagtccgcagtgggcactgccctcgtctttgaggggccggctgaacaggaaaagccagggttctctgtgtcctagttgagggaggcttgctgaggcttctctaaaggtggttgggcaagcacctatatagtatcacggggacagttgaggcaactcgtagatggagatttgggaaaagacgatgtggcctcctacctttccagtttctgttggcagcccttcacgtagcctcctgcctcgcctctacacctactaccctgtcggcccttttgccatgctgtcctcgtataactcggattctctcctcaggtgtaggtgcagggagtcagggaacccttagactcccctgtgtgcaagagcccaggtgttggtgtgtccctttaatgctactgtgctctctggtgtttctgattttcctgcctttattctgtcttctcttgtcctatctcattccagcccacatcttctcctttcctgattacttttgttgtcctgcctcttcaggtaatggtcacagatttggctgtaggcacgttaccagccctgtggcttcttgactcttggttccctgttaactctgtttctgagaaatgtgggtatggaggtgggtgggaaagctcacttccatgaaggatgtctccatgctaggagctgcctgcaccctggcagaggtggccagtcacgtgaaggtgggcagggcccttagcatggccacacatgtccccagggcagatcaaggggcctctcagaaccatgttccccagccaggtgaggaccattttcactgggacccaggccaaaaccatgtgggtgcacaaagccaggcactgccaagtggaacatgaggttatttccaaatcatgggagccaccagcagggagagggcaggatggaaaatcccctggagccggtcaactttttgctcatggctagtgaaataaagttgtttgagtactaga

SEQ ID NO: 3504 - DNA, 672 bp, Homo sapiens
atgtttgccacatctggggcagtggcagcggggaagccttactcgtgcagcgaatgtggcaagagcttctgctacagctcagtgctgctgcgacatgaacgagctcacggcggtgacggccgcttccgttgcctagaatgcggtgagcgctgtgcacgggctgctgacctccgagcgcacaggcgcacgcatgctggccagaccctctacatctgcagtgagtgcggacaaagcttccgccacagcggccgtcttgacctacacttgggcgcacaccggcagcgatgccgcacttgcccctgccgcacatgcggccggcgcttcccgcacctcccggcgctgctgctacaccggcgccgccagcatctgccagagcggccccttttgccatgctgtcctcgtataactcggattctctcctcaggtgtaggtgcagggagtcagggaacccttagactcccctgtgtgcaagagcccaggtgttggtgtgtccctttaatgctactgtgctctctggtgtttctgattttcctgcctttattctgtcttctcttgtcctatctcattccagcccacatcttctcctttcctgattacttttgttgtcctgcctcttcaggtaatggtcacagatttggctgtaggcacgttaccagccctgtggcttcttga

SEQ ID NO: 3505 - DNA, 883 bp, Homo sapiens
ttcccttctttcatcttggagcccacagttcgcgcaagtggagctatggaaggcccatgctgtgctgttctaatcatgtgagggattcttaggggttgagggggaaggactgaaaacggctgcagaccgtttaggatgcctggagtggagacaggagttaagccccttactcagagtcgctcttaagaactgcccagggccgggcacagtggctcatgcctgttatcctagcactttgggaggccaaagtgggaggctctcttgagctcgggagttcaagaccagcctgggcaacatggtttccacttcaagcgtgacccttttgcctgtgggatgagctccagcatggggtgaggtacagaagagagacttgaagagcgtgccttgggactcaagcgccaaacctgtaccctagcgagtgtcctactccgcatccgtaatggaaggaaatgcacatcttactccagaggcacaagaggaggacatcccatgcggctactcctgcccagcgtggtggggcagcagaagctccagagcccagacttgcaggctcacggtgcagggtgaacctggccacagctcaccctggaacagccacaatgtctgccccttagagaagaaccctgaaatcagaccagtttttgcggcctccccctttcctctctgttacagtgccctttccaggccttaagagaagtaaaacttagctgcagcgtcaggaggtggaccccagagtgtgagtggcacgcttccctgtgaacccgtcctcaccatgtttgccacatctggggcagtggcagcggggaagccttactcgtgcagcgaatgtggcaagagcttctgctacagctcagtgctgctgcgacatgaacgagctcacggc

SEQ ID NO: 3506 - DNA, 930 bp, Homo sapiens
ctgagccgacttaagggggcaacggccgccaccgggttctggcagcgttaaacgttccccactacgtttttggtgcccggtctcgccctccaagtcggctggcgccacgggcaaggggctagggtaggctcggggttgggaaggggctcgctcaaagaaagtttgcccagcaacttgtgacgcgcgccgactgaggcgccccaggattggctgcgctgctgtgggccacggaaagcgacctgttcaggtttccacttcaagcgtgacccttttgcctgtgggatgagctccagcatggggtgaggtacagaagagagacttgaagagcgtgccttgggactcaagcgccaaacctgtaccctagcgagtgtcctactccgcatccgtaatggaaggaaatgcacatcttactccagaggcacaagaggaggacatcccatgcggctactcctgcccagcgtggtggggcagcagaagctccagagcccagacttgcaggctcacggtgcagggtgaacctggccacagctcaccctggaacagccacaatgtctgccccttagagaagaaccctgaaatcagaccagtttttgcggcctccccctttcctctctgttacagtgccctttccaggccttaagagaagtaaaacttagctgcagcgtcaggaggtggaccccagagtgtgagtggcacgcttccctgtgaacccgtcctcaccatgtttgccacatctggggcagtggcagcggggaagccttactcgtgcagcgaatgtggcaagagcttctgctacagctcagtgctgctgcgacatgaacgagctcacggcggtgacggccgcttccgttgcctagaatgcggtgagcgctgtgcacgggctgctgacctccgagcgcacaggcgcacgcatgctggccagaccctcta

SEQ ID NO: 3507 - DNA, 583 bp, Homo sapiens
agactgaccactagccgacgcgggcgagagggacaggagcgtgacctccccatcccgaggggccggacgctcgggcgcctccccgctccccccactcggaggccgcgcgcgccgttagccccttcctcgctcccccgccccagtcccgcagtccgggaggcgggggtcggcagccggctgagtgggaaccgcgcggtgtctgaggaggcagtcggcgaccggtttccacttcaagcgtgacccttttgcctgtgggatgagctccagcatggggtgaggtacagaagagagacttgaagagcgtgccttgggactcaagcgccaaacctgtaccctagcgagtgtcctactccgcatccgtaatggaaggaaatgcacatcttactccagaggcacaagaggaggacatcccatgcggctactcctgcccagcgtggtggggcagcagaagctccagagcccagacttgcagtgccctttccaggccttaagagaagtaaaacttagctgcagcgtcaggaggtggaccccagagtgtgagtggcacgcttccctgtgaacccgtcctcaccatgtttgccac

SEQ ID NO: 3508 - DNA, 2934 bp, Homo sapiens
attacatatacacagatgttatggatcttataccactttcttttctcagagttagagaatacattagtgaacatttctgtgttgaaaactattttattgaataatttcagtcattcatataagtcagaaccagctctctctactctctccattttaccttgagtcacattaaaagttctgcccatgaccaattggtaaatatatgtgtttgtgtgtgttttccagggagcattgacatttagggatgtggccatagaattctctctggaggagtggcaatgcctggattctacacagcagaatttatataggaatgtgatgttagagaactacagaaacctggtcttcctgggtattgctgcctttaagccagacctgatcatttttctggagcaaggaaaagagccctggaatatgaagagacatgagatggtggaagaacccccagttatatgttctcatttttcccaagagttttggccagagcaaggcatagaagattctttccaaaaaatgatattgagaagatatgacaaatgtggacatgagaatttacacttaaaaattagttgtaccaatgtggatgagtgtaacgtgcacaaagaaggttataataaacttaaccagagtttaacaactacacagagcaaagtatttcaatgtggcaaatatgcaaacgtctttcataaatgttcaaattcaaacagacataagataaggcatactggagagaaaggtttgaaatgtaaagaatatgtcagatcattttgcatgctttcacacctatctcaacatgaaagaatttatactagagagaattcctacaaatgtgaagaaaatggcaaagcttttaactggtcctcaacccttacttattataagagtattcatactggagagaaaccctacaaatgtgaagaatgtggcaaagcctttagtaagttctcaatccttactaaacataaggtaattcatactggagagaaaccctacaaatgtgaagaatgtggcaaagcttttaatcgatcctcaatccttactaaacataagataattcatactggagagaaaccctacaaatgtgaagaatgtggcaaaggatttagtagcgtctcaacccttaatacacataaggcaattcatgctgaagagaagccctacaaatgtgaagaatgtggcaaagcttccaactcgtcctcaaagctcatggaacataagagaattcatactggagagaaaccctacaagtgtgaagaatgtggcaaagccttcagctggtcctcaagccttactgaacacaagagaattcatgctggagagaaaccctacaaatgtgaagaatgcgggaaagcttttaatcgatcctcaatccttactaaacataagattattcatactggagagaaaccctacaaatgtgaaggatgtggcaaagcctttagtaaggtctcaacccttaatacacataaggcaattcatgctgaagagaagccctacaaatgtgaagaatgtggcaaagcttccaactcatcctcaaagctcatggaacataagagaattcatactggagagaaaccctacaagtgtgaagaatgtggcaaagccttcagctggtcctcaagccttactgaacacaagagaattcatgctggagagaaaccctacaaatgtgaagaatgtggcaaagccttcacctggtcctcaagctttactaaacacaagagaattcatgctgcagagaaaccttacaaatgtgaagaatgtggcaaaggctttagtacgttctcaatccttactaaacataagataattcatactggagagaaacgctacaaatgtgaagaatgtggcaaagccttcagctggtcctcgatccttactgaacataagataattcatactggagagaaaccctacaaatgtgaagaatgtggcaaagccttcagcagatcctcaagccttactagacacaagagaattcatactggagagaaaccctacaaatgtgaagaatgtggcaaagcttttaagtcatcctcaactgttagttatcataagaaaattcatactggagagaatccctaaaaatgtgaagaatgtggtaaatccttcagctgattctcagtctagtaaacataagaaaattcatactggagagaaaatctacaaaggtgaagaatgtggcaaagcttttaaacagtcctcaatctttattacacataagaaaattcatgctggagagaaacactacaaacgtgaagaatgtgacaaaggcttcaaccggtcctcaaaccttgtggaacataagagaattcatactggagagaaaccctacaaatgcgaagaatgtgataaagacttcaactgttcctcacaccttactactcataaaagaattcatactggaggaaaagccctacaaatgtgaaaaacgtggcaaagcttttcattagttctcaacccttactgaacataagggaatttatacaggagggaaaccctacaaatgtgaagaatgtggcaagccttttagctgttcctcaatccttactaaacattcatgtaattcatactggagggaattcctataattgtgtggaatgtggcaaagcctttaaccagtccttaaggcttactacatataagacaactcatactggagagaaaccatgcatgtgtgaagaatgtgggaaagcctctaacagatcctcaattcttaagaaacataggctaattcatacatgagagactctacaaacctgaaagatgtgacaatgcttttggcaacacctcagacttttctgaatataaaagaaatcatatgaatgagaaatcctagaaatgtgaagaatgtgacaaagcctttaaatggctgtcacacttgattgtaggtaagataatatactggagaaaactactagaataaacaatgtg

SEQ ID NO: 3509 - DNA, 8731 bp, Homo sapiens
gacccggaagcggatctcgcggggctactggcgctctcggcccacacaatatgacctcggggaggatgcgaggaagatgaactgtgatgatccacttcttcttaatgaatgactgacttacctgagaaagaaactcagaggaagaggaaagaaagaagaggagggaatggctctttctcagggactgtttacattcaaggatgtggccatagaattctctcaagaggagtgggagtgcctggaccctgcccagagggccttgtacagggacgtgatgttggagaactacaggaacctgctttctctcgatgaggataacatccctccagaagatgatatttctgttggatttacaagcaagggattatcaccaaaggaaaataataaagaggaattataccatctggtgatattagaaagaaaggaaagccatggcatcaacaattttgacctcaaggaagtctgggaaaatatgcctaagtttgacagcctgtgggactatgatgtaaaaaattacaaaggaatgcctttgacctgtaacaaaaatctcactcacagaaaagatcaacaacataataaatcctcaatacatttctctttaaagcagagtgtttctataagagatagtgcacaccagtatttcatccatgacaagccatttataaggaatttgttaaaactgaaaaataacataaggtatgccggaaacaaatacgtgaagtgttttgaaaataaaattggattaagcttacaggcacagctggctgaactacagagatttcaaactggggagaaaatgtatgaatgtaatccagttgagaagtctatcaatagttcctcagtttcaccacttcctccttgtgtcaaaaacatttgtaataaatataggaagattttgaaataccctttattacatacacagtatgggagaacacacattagagaaaaatcatacaagtgtaatgactgtggaaaggcttttagcaaaagttcgaacctcactaatcatcagagaattcactctggacagagaccttacaaatgtaacgagtgtggcaaagcctttaaccagtgttcgaacctcactaggcatcagagagtccatacaggagagaaaccatatcaatgtaatatatgtggcaaggtctgtagtcaaaattcaaatcttgcaagtcatcagaggatgcatactggagagaaaccttacaaatgtaatgaatgtggtaaggcatttatccagcgttcacacctttggggtcatgaaagaattcatactggagagaaaccttacaaatgtaatgaatgtgacaaagcctttgctgaacgttcaagccttacccaacataagagaatccatactggagagaagccttacatatgtaatgagtgtggcaaagcttttaagcagtgctcacatctcactaggcatcagaatatacatcctggagagaaaccacacaaatgtaatgtgtgtggcagggcttttatccaaagttcaagtcttgtggaacatcagagaattcacactggagaaaaaccttacaaatgtaataaatgtgataaagcttttatcaaacgttcacacctttggggtcatcagagaactcatactggagagaaaccttacaaatgtactgaatgtggcaaagcctttactgaacgttcaaatcttactcagcataagaaaatccatactggagagaaaccttacaaatgtactgaatgtggcaaagcttttacccaatttgcaaacctcactagacaccagaaaatacacattgaaaagaaacattgtaaacataatatacatggtaatgctttattccaaagttcaaaccttggagatcatcaaaaaagttataatagagaaaaacatatcaaatataatgagacaaaaattaagtattcaagctgtacctagcatcaggggctccattgtgaaaagaaaccatataaaacgaaaatgtggtaaagcctttagctatggcttatgtctcacttgataccagaatatacatctttgagataaaccacacaaagataacatgtatggcaaggcttatccaaagttcaagccttgtggaacatcatagaattcttactgtagagaagccttacaaatataatgaatgtgaacagctttataaaaatatttaccctattatggttataacagaagacattcaggatggaaaccatacaaatgtggcaagtcctttaagcaatgttctgacttcaggatacaccattcatattggagagaagcattacaagtgaaggtggtaaattattttaaatttctcaatggaaattcatccttatatgcaagcattttgtcatacaaaaattcaggctagagggaactaagtcttttttccttcttgaagattaagtgattgatgttaaattcacagacaattttaaaaagtcacaaactcatggtgtgtgtcagaggagcaaggacatctgtggaaagatgtaacttcagtgttaaaaattttttattcagttatttcatatttttaaaagtatgaaatctgttgctgttaaatcttcatggcatgcttttcatttatcatgattgtctcaaggaatggatgtaagatggaagggactacttccttaggtgtggcttctttatattactgaaacctggaaaaagcaagaacactaattttttctttttttggagacagagtcttgctctgtcacccaggctggagtgcagtggcaccatctcagctcactgcaacctctgtctcccgggttcaagcaattctcctgcctcagcctcacgagtagctgggattacaggcatgcgccatcatgcctggctagttttttgtttttttgtttttgtatttttagtagagacagagtttcgccatgttggccaggctgatcttgaactcctgacctcaggtgatccacctgccttggcctcccaaagtgctgggattacaggcatgagccaccgtgcccagccaagaacactaatatacaatatactataagagcatgggggtttgtgccagaagagaggtaaaactattgtctaacatatatgctttatgtggtcaggaccccttagaattgttgatgtgactggggacctttgtcgattataggagagattggttacagtacaagatgaccatgaaacaagaagagtagggtgggacattgagagattttcatggaagtgaaatggtcggttactagagactgcatatgtggtagaaagaaatggagggggaatgatagtcaccctctcttgaaaggtagttactgttgcatatcacagattattgaacatagataggtcttatttttggaaactgaagagagaatggttaccatagaggacagttccatcaaaagaaccagagtagtgttcttataggggattcacatttggcccctgagattgcatttgataccattttatttagaatatattatacttcttatgtcttaattagtaaaatataatcatttttagtaaccctgaatgaatcgtgtgccttccgtcaacccaagcatatcccacctcattgggacacttaatatcaaacactataatacatcattagactctcaaggttgaatgtcatctataacaatttctatccatgttatgttcaaacagtatacaatttaagaagtatatattcataatttgcacttgaaatattttctccacactctgccctagatgacttctatggctataatgaaaatgccatgccatagtgggacaatatcagaccccctgaaacctgtcttcctgttcatgaatatgcactgtgcagttatatttctacatgcctttttttctacataactttatttctgcatgccttttacatgagaggaaaataacaaatgtaagcatatgaaaattattagtaaatgaaatttctgaaataataacacaacttctttttttgtacttggagcactccgtgaaataatttgaaaaaaatcagtgttcatgagtttccccttaataatgaacataagcaatggattttttttttaaagaaactagaaacctcatgtatttacccccaaaacatttttttttactgatttgcacttgtcgccactccactggaacaggagggaaccccgtgcaaagtttggtttagatttcaggattggtggtactctacatcaaagtattataagaatgtttattacaaaaggctttctggagagaacagggtagacttcccaagctggttaaaaaatggctagagaaggcagtgaaagatgattgacttggggtgttatgatgtttatctggtggggctggagtgaatactcatctgtggtttaaattttcagctagccggctgggcagggaggctgacatctgtaatgtcagcactttgagaggcccaggcgaggagattgcctgagcccaggagtttgagactagcataggcaatatgtcaagaccctgtctgcaaatttagaagttagttgggcatggtggcacatttctatagtgcctcagcctctcgagtagctgggactacaggcatgcaccaccatgcccagctaatttttgtatttttaatagacacaaggtttcaccatattggccaggctgatctcgaactcctgacctcaagtgatctgcctgcctaggcctcccaaagtgctgggattacaggtgtgagccaccatacccagcctaatacctcatcactttttgttgctgaataatattctacagtttgtctgtccattcattatttgatggagatttgaactctttctactgtttgaaattaggctattatgggccaggtgcagtggctgatgcctgtaatcccagcactttgggagaccgagatgggcggatcacgaggtcaggagatcaaggccatcctggctaacatggcaaaaccccgtctctactaaaaatacaaaaaattagctggcctggtggcgggcatctgtagtctcagctactcggaaggctgaggcaggagaatggcatgaatccgggaggcggagcgtgcagtgagcccagatcacgccactgcactccagcctgggcgacagagcgagactctgtctcaaaaaaaaaagaaattaggctattatggaaaatgctgctatgaacaactttttacaagatgtttttgcacatacatgttttcacttctcttgggtatgtctgtaaacgtggaatttctgggtcatatagtaattatcagtgattatctttttgtggattcaccaaactgttttcgaaggcagctgcaccattttacttttctaccagcgatgttccagtgttccattttctgcacttcctatcgattattgatgtttgtagttgttgggttcacagtagtagtagtatatagccttctagtcacttacaagtgatatttcattgtggttggatttccttaatgatgaatgttgagcatctgttcctatgcttattagccatgtgcatcttcattggagaaatgtctactcagacatttcttttaatgttttaaaaattagattgtgtatttttggttcagttatgagttattttatattctgaatactacacccttatgagatttgccagtactttttccacttctgtgtactgtttttccactttcttgatagcattctggatttcggcaaagttggcaatgttctatggctcatacctgtagtctcagcactttgagaggctcaggagagaggaccacctgtgtccaggagttcgaggctagcctgggcaacatagtgagaccacatctctacaaaaaataaaaaattagctgggtgtcatggcatgcacctgtagtcccagctactcgggaggttgaggtgaaaggattgcttgagacagggaggttgaggctgcagtgagccatgactgacactgcactcagcctgagtgacagagtgagactcaggaccaatacagtaatacagattgtgatgaataaactttgaaaacatggaattagctttattctgaatgattgtattagtctgtgtttaggaaaacgtatacaattacttcaagaataagaatagttatatgttaagaatttttgctgggcgcggtggctcacacctgtaatcccagcactttgggaggctgaggtgggcggatcacgaggtcaggagatcgagaccatcctggctaacacgatgaaaccccgtctctactaaaaatacaaaaaattatcggggcgtggtagtggggggcctgcagtcccagctactcaggaggccgaggcaggagaatggcgtgaacccaggaggcggagcttgcagtgagctgagatcgtgccactgcactccagcctgggccacagagcgagactccgtctcaaaaaaaaaaaaataaaataaaaagaattttggaggtgcttgagcagtgaaaggtgtggaagactccagcaggaatatcaaagaaaaatagtcactggcagcttcagtgagaaaccagagctcatggagatgtcttagaagttactgcttctggctgcttgattgggattagagatggtgaggtctgtgcagtattcatctgagattaatggcttagtgcttcacttctgcctttcctattccattcaggttttcctttttttttttttttaacagcattttaaatttttttttatttttaatttattatctatttattttgagaccgggttaagagacgggctaatttttgtatttttggtagagacaggttttcgccatgttgcccagtctggttttgaactcctgacctcaagcagtccacccacttcagcctcccatagtgctgggattacagttgtgagccactgcgcctggcccattcaggtttttctcattggcaaagtttagcaagaaccatacaggaaacgccttctggaaaacagttctgagcaccagattgcagtggtggtactgttaagtggacaaaggacattgcagtatagaaaagtagctgagacatattgacctcaaaactggagatggttttagaaactttgagagggaatgcaaatggtgcctaatgtctttgttcagttgttttgggtacctgcagtattattcttttaggaaatggtgactgggtgccatgttcaaatgtattccccaaaagttcatgttggaaattgaatcctcaaatccatatgttgatggtatttagaggtgggagcctttgggaggtaattagggatagatgaagttatgggggtggctccctatgttgggattagtagccttataagaagaggaaaagagagctgagctggcatgcttcctccttctcaccatgtgatgacttctgttatgatgcagcaagaaggccctcaccacatgtagccgctcagccttggacttcccagcctccagagctggaagaaataaattatatatatacacatacataaattatatacatacatataaattacccaggtcaggttttctgttacagcaacaaaaaatggactaagacacaggataggttggggtttgggggctgtattgtgaatatctaaaaaaattggcagtggaaacatgacacagtgattgatagcaatttgatgagcatcactgagaagcaaatgatgtagaaagacagactttattgtcctttccttgcccttcaggcctagatctctaacagtttgtcaagaaagagggtattgctaaagctgtctaggctttgcttttaaaagtcttgtaaggaatggcatgtcctgtggtgcccggagatacaaaaccttttttgttaaatcctggaagcttactgtataaaatgagtcttttctgtcaattgcaccactgggatagttgaccctgtagggcaactgatgcttatgtggtaactcagagatggaggggcttccatattatggtttctctatctcaaaaatgggcctctgattattgcaaaggaaacaagcaagaaggtcacacttagttttaagtggtttggcctgaaagtgatacattacacttacaccctgtttggcaaaaccggtctcatggttttaacttgaggcaaggtggctgagaaattaggggaatgttggctatgtatgtgaagctgttaaaagaatgaggattacaggcatgagccactgttcctggctttctaacttaattgtttctttctcttcctctgtttttgatgtgtgaatatgaaatttgaaaatccccgttcttcattaaaattacagtagccatttaacagaattaatattctttgggaaaaaaatatggaaatattgttttcaggtaaacaagacaaagcctcaaaatgaaaatggttttgccccttatcctatacccttctcagtcatacaccagccatctgcattctcctcaaggagaaggaaggctgagtgctgatggaggtagagtaggcagaatggacttctcaagaggatctgccacatcccaaactgcagcctccggacttgctattatgtgagaaagataaacttcctacttgttttttagtccctgtttttcagattgtcgttacaaaaatttttctacctgacaaataagattgttatttttcactgggaatagaatgcagcatttgagagtgaatcttccattttcatggcttagaaaaacttcatgaaaacctttttccactgctgaggtggatctatttagttcatgttgcctgagatacaaaatgtgggaataaaagtagaattatgacctgctaatc

SEQ ID NO: 3510 - DNA, 896 bp, Homo sapiens
gagtctccgtctttcgggttcaagcctgcgcctcgcgggccacaggttcccacgctccgctgtcgggttttggggtcgccctgtaggttaaaaccccgaacctgctcattcctctcgcggcgtggccctaagacgttcccagtcccgtcgctccgagagggtctagagatctgcgtccatttcggattaaaatcgttctgaagtgggtactggccccgacctttttgctttagcccacacaatatgacctcggggaggatgcgaggaagatgaactgtgatgatccacttcttcttaatgaatgactgacttacctgagaaagaaactcagaggaagaggaaagaaagaagaggagggaatggctctttctcagggactgtttacattcaaggatgtggccatagaattctctcaagaggagtgggagtgcctggaccctgcccagagggccttgtacagggacgtgatgttggagaactacaggaacctgctttctctcgatgaggataacatccctccagaagatgatatttctgttggatttacaagcaagggattatcaccaaaggaaaataataaagaggaattataccatctggtgatattagaaagaaaggaaagccatggcatcaacaattttgacctcaaggaagtctgggaaaatatgcctaagtttgacagcctgtgggactatgatgtaaaaaattacaaaggaatgcctttgacctgtaacaaaaatctcactcacagaaaagatcaacaacataataaatcctcaatacatttctctttaaagaaaaaaaaaaagaaaaaaaaaaaacaaaacaaaacaaaacccaaggcaacgaaagaaaagagaagaaagaacaaaggcaaaaacaaaaccaataccaag

SEQ ID NO: 3511 - DNA, 2525 bp, Homo sapiens
gatctggcggggcctttgtcttgtgctccagctggagctttggtcccgtattctcggctatttatccccagctgcgggaggccctggtgactctgctgctgcagtgtctggtttccctgtgacctgcaggtactgggagttacatagctaagatgccaggacaccccgaaagccggaaaacgggactactggcattcagtgatgtggtcatagaattctctccagaggagtgggcatgcctggaccctgcccagcgaaatttgtatagggatgtgatgttcgagaactacagaaacctggtctccctgggacttccaggactatgttaaaatagaagcattgataatgggcacaatatcactttgcattggtgtctgtgcatttgaaggagcaaacacctctaccagtttttataaactggtttatacagctattttatcttattccattcaagaccttttgccagagcaggatatgaaagatttatgccaaaaagtgacactgacaagacatagaagctggggccttgacaatttgcacttagtgaaagactggagaactgtgaatgaaggtaaggggcagaaagaatattgcaatagacttactcaatgttcatcaactaaaagcaaaatctttcaatgtattgaatgtggcagaaattttagctggaggtcaatccttactgaacataagagaattcatactggagagaagccatacaaatgtgaagaatgtggcaaagttttcaatcgatgttcaaacctaacaaaacataaaagaattcatactggagagaaaccctacaaatgtgacgaatgtggcaaagtttttaattggtggtcacaactaactaaccataagaaaattcatactggagagaaaccctacaaatgtgatgaatgtgacaaagtttttaattggtggtcacaactaactagccataagaaaattcatagtggagagaaaccatacccatgtgaagaatgtggcaaagcctttacccagttctcaaaccttacacaacataagagaattcatactggagagaaaccctacaaatgcaaagaatgttgcaaagcctttaacaagttctcaaaccttactcaacataagagaattcatactggagagaaaccttacaagtgtgaagaatgtggcaacgtttttaatgagtgctcacacctaactagacataggagaattcatactggagagaaaccctacaaatgtgaagaatgtggcaaagcctttacacagtttgcaagccttactcgtcataaaagaattcatactggagaaaaaccctaccaatgtgaagaatgtggcaaaacttttaatcggtgttcacacctaagtagccataagagaattcatactggagagaaaccctacaaatgtgaagaatgtggcagaacctttactcaattctcaaacctcactcagcataaaagaattcatactggagagaaaccctacaaatgcaaagaatgtggcaaagcgtttaacaagttctcaagccttactcaacataggagaattcatactggagtgaaaccctacaaatgtgaagaatgtgggaaagtttttaaacagtgctctcacctaactagccataagagaattcatactggagagaaaccctacaaatgtaaagaatgtggcaaagctttttaccaatcctcaatccttagtaagcataagagaattcatactgaagagaaaccctacaaatgtgaagaatgtggcaaagcctttaaccagttctcaagccttactcgtcataaaagaattcatactggagagaaacgctacaaatgtaaagaatgtggaaaaggtttttaccaatcctcaatccatagtaagtataagagaatttatactggagaggaacctgacaaatgtaaaaaatgtggcagtctttaaaaactgcttcattatacatggcttcactaatttcatactgaataaaagtggtatgagcataatgactgtttaaggatgtttcacaaaatgtaagcttcagagtgcacaacactatactgaatgaaatttataaatataaaagattacaatatctttatttcaaagatcttcctgtaaacagaatctgtactagaggaaaaacccttaaacaattattcagactttattcaactttagaggattttacgggggcaaaaaacctcctacaaatgtggaaaaacattttttcaagatatatgccttagaaaacaccagagtttatagtatagtagaatatattttacagatacagtgaatacaaacaaatgtccaaaattaagtctaaataaaacattacataatttactgtagaaagtactaaggcactaacagtttcagatgttactttaaagcagtgttgattgtcgagaataattcaaagttaaaatagataatttagttgtatgtaaatttaaatgaatcaagagatgatgtctttttgaagcacagttacattcatgttatacttttttgcattaaaagtttttatatttttgattata

SEQ ID NO: 3512 - DNA, 1895 bp, Homo sapiens
gatctggcggggcctttgtcttgtgctccagctggagctttggtcccgtattctcggctatttatccccagctgcgggaggccctggtgactctgctgctgcagtgtctggtttccctgtgacctgcaggtactgggagttacatagctaagatgccaggacaccccgaaagccggaaaacgagacgcattctcactatgttgcccaggctggtcttgaactccttccctcaagtgattcttctgcctaatcctcccaaagttcttagattacagggactactggcattcagtgatgtggtcatagaattctctccagaggagtgggcatgcctggaccctgcccagcgaaatttgtatagggatgtgatgttcgagaactacagaaacctggtctccctggctattttatcttattccattcaagaccttttgccagagcaggatatgaaagatttatgccaaaaagtgacactgacaagacatagaagctggggccttgacaatttgcacttagtgaaagactggagaactgtgaatgaaggtaaggggcagaaagaatattgcaatagacttactcaatgttcatcaactaaaagcaaaatctttcaatgtattgaatgtggcagaaattttagctggaggtcaatccttactgaacataagagaattcatactggagagaagccatacaaatgtgaagaatgtggcaaagttttcaatcgatgttcaaacctaacaaaacataaaagaattcatactggagagaaaccctacaaatgtgacgaatgtggcaaagtttttaattggtggtcacaactaactaaccataagaaaattcatactggagagaaaccctacaaatgtgatgaatgtgacaaagtttttaattggtggtcacaactaactagccataagaaaattcatagtggagagaaaccatacccatgtgaagaatgtggcaaagcctttacccagttctcaaaccttacacaacataagagaattcatactggagagaaaccctacaaatgcaaagaatgttgcaaagcctttaacaagttctcaaaccttactcaacataagagaattcatactggagagaaaccttacaagtgtgaagaatgtggcaacgtttttaatgagtgctcacacctaactagacataggagaattcatactggagagaaaccctacaaatgtgaagaatgtggcaaagcctttacacagtttgcaagccttactcgtcataaaagaattcatactggagaaaaaccctaccaatgtgaagaatgtggcaaaacttttaatcggtgttcacacctaagtagccataagagaattcatactggagagaaaccctacaaatgtgaagaatgtggcagaacctttactcaattctcaaacctcactcagcataaaagaattcatactggagagaaaccctacaaatgcaaagaatgtggcaaagcgtttaacaagttctcaagccttactcaacataggagaattcatactggagtgaaaccctacaaatgtgaagaatgtgggaaagtttttaaacagtgctctcacctaactagccataagagaattcatactggagagaaaccctacaaatgtaaagaatgtggcaaagctttttaccaatcctcaatccttagtaagcataagagaattcatactgaagagaaaccctacaaatgtgaagaatgtggcaaagcctttaaccagttctcaagccttactcgtcataaaagaattcatactggagagaaacgctacaaatgtaaagaatgtggaaaaggtttttaccaatcctcaatccatagtaagtataagagaatttatactggagaggaacctgacaaatgtaaaaaatgtggcagtctttaa

SEQ ID NO: 3513 - DNA, 798 bp, Homo sapiens
ctttggtcccgtattctcggctatttatccccagctgcgggaggccctggtgactctgctgctgcagtgtctggtttccctgtgacctgcaggtactgggagttacatagctaagatgccaggacaccccgaaagccggaaaacgagacgcattctcactatgttgcccaggctggtcttgaactccttccctcaagtgattcttctgcctaatcctcccaaagttcttagattacagggactactggcattcagtgatgtggtcatagaattctctccagaggagtgggcatgcctggaccctgcccagcgaaatttgtatagggatgtgatgttcgagaactacagaaacctggtctccctggctattttatcttattccattcaagaccttttgccagagcaggatatgaaagatttatgccaaaaagtgacactgacaagacatagaagctggggccttgacaatttgcacttagtgaaagactggagaactgtgaatgaaggtaaggggcagaaagaatattgcaatagacttactcaatgttcatcaactaaaagcaaaatctttcaatgtattgaatgtggcagaaattttagctggaggtcaatccttactgaacataagagaattcatactggagagaagccatacaaatgtgaagaatgtggcaaagttttcaatcgatgttcaaacctaacaaaacataaaagaattcatactggagagaaaccctacaaatgtgacgaatgtggcaaagtttttaattggtggtcacaactaactaaccataagaa

SEQ ID NO: 3514 - DNA, 1289 bp, Homo sapiens
atggctaaaagaccgggatcccctggaagccgagaaatgggactgttgacattcagagatgtagtcatagaattctctctggaggagtggcaatgcctggatcacgctcagcagaatttatatagagatgtgatgttagagaactacagaaacctggtctccctgggtattgctgtctctaagccagacttgatcacctgtctggagcaaaataaagagccttggaatataaagagaaatgagatggtaaccaaacacccagttatgtgttctcatttcacccaagaccttccgccagagctaggcataaaagattcactccaaaaagtaataccaagaagatatggaaaaagtggacatgacaatttacaagtaaaaacatgtaaaagcatgggtgagtgtgaggtgcaaaaaggaggttgtaatgaagttaaccaatgtttgtcaactacccaaaacaaaatatttcagactcataaatgtgtcaaagtcttcggcaaattttcaaattccaatagacataagacaagacatactggaaagaaacatttcaaatgtaaaaaatatggcaaatcattttgcatggtttcacaactacatcaacatcagataattcatactagggagaattcctaccaatgtgaagaatgcggcaaacccttcaactgctcttcaaccctttctaaacataaaagaattcatactggagagaaaccctacagatgtgaggaatgtggcaaagcttttacctggtcctcaacccttactaaacataggagaattcatactggagaaaaaccctacacatgtgaagaatgtggccaagcctttagccgctcctcaacacttgctaaccacaagagaattcatactggagagaaaccatacacatgtgaagaatgtggcaaagcctttagcttatcctcatccctcacttaccacaagagaattcatactggagagaaaccctacacatgtgaagaatgtggcaaagcctttaactgctcctcaacccttaagaaacataagataattcatactggagagaaaccctacaaatgtaaagaatgtgggaaagcctttgccttctcctcaactcttaatactcataagaggattcatactggagaggaaccctacaaatgtgaagaatgtgacaaagcttttaagtggtcctcaagtcttgctaatcataagagtatgcatactggagagaaaccctacaaatgtgaataatgtgataaagtccagccttcagaccttataatacataaaataatttatacttg

SEQ ID NO: 3515 - DNA, 1567 bp, Homo sapiens
ggtacttgatccaggtatatgtcacattcccaactgttggctgggcccaagcaaattagtaaaataaattaggtgctgtgtgaaagtatacgccacaatcacacctgcgggaaggaccaggaataaatttcacaattctacgtatttcccagctttaggtctgagagtctacacttctgagctccagttcttctcttcactgctctgcgtcctctgttcctagaggccaagccactgtggccttgtgttctgcaggtatccgcagatttatggctaaaagaccgggatcccctggaagccgagaaatgggactgttgacattcagagatgtagtcatagaattctctctggaggagtggcaatgcctggatcacgctcagcagaatttatatagagatgtgatgttagagaactacagaaacctggtctccctgggtattgctgtctctaagccagacttgatcacctgtctggagcaaaataaagagccttggaatataaagagaaatgagatggtaaccaaacacccagttatgtgttctcatttcacccaagaccttccgccagagctaggcataaaagattcactccaaaaagtaataccaagaagatatggaaaaagtggacatgacaatttacaagtaaaaacatgtaaaagcatgggtgagtgtgaggtgcaaaaaggaggttgtaatgaagttaaccaatgtttgtcaactacccaaaacaaaatatttcagactcataaatgtgtcaaagtcttcggcaaattttcaaattccaatagacataagacaagacatactggaaagaaacatttcaaatgtaaaaaatatggcaaatcattttgcatggtttcacaactacatcaacatcagataattcatactagggagaattcctaccaatgtgaagaatgcggcaaacccttcaactgctcttcaaccctttctaaacataaaagaattcatactggagagaaaccctacagatgtgaggaatgtggcaaagcttttacctggtcctcaacccttactaaacataggagaattcatactggagaaaaaccctacacatgtgaagaatgtggccaagcctttagccgctcctcaacacttgctaaccacaagagaattcatactggagagaaaccatacacatgtgaagaatgtggcaaagcctttagcttatcctcatccctcacttaccacaagagaattcatactggagagaaaccctacacatgtgaagaatgtggcaaagcctttaactgctcctcaacccttaagaaacataagataattcatactggagagaaaccctacaaatgtaaagaatgtgggaaagcctttgccttctcctcaactcttaatactcataagaggattcatactggagaggaaccctacaaatgtgaagaatgtgacaaagcttttaagtggtcctcaagtcttgctaatcataagagtatgcatactggagagaaaccctacaaatgtgaataatgtgataaagtccagccttcagaccttataatacataaaataatttatacttgaaaaaatca

SEQ ID NO: 3516 - DNA, 3022 bp, Homo sapiens
ggacaggacggcttccgggatttggcggggcctttgtctctagctgctgcgggagctccaggtctagtctttactgctctgtgtattctgctcctagaggcccagcctctgtgactccgttatctgcaggtattgggagatgcacagctaagatgccaggaccacctggaagcctagaaatgggaccactgacatttagggatgtggccatagaattctctctggaggagtggcaatgcctggacactgcacaacggaatttatataggaaagtgatgtttgagaactacagaaacctggtcttcctgggtattgctgtctctaagcctcacctgataacctgtttggagcaaggaaaagagccctggaataggaagagacaggagatggtagccaaacccccagttatatattctcatttcactgaagacctttggccagagcatagcataaaagattcttttcaaaaagtgatactgagaggatatggaaaatgtggacatgagaatttacaattaagaataagttgtaaaagtgtggatgagtctaaggtgttcaaagaaggttataatgaacttaaccaatgtttgagaactacccagagcaaaatatttcaatgtgataaatacgtgaaagtctttcataaattttcaaattcaaacagtcataagaaaagaaatactggaaagaaggttttcaaatgtaaagaatgtggcaaatcattttgcatgctttcacatctaacacaacatataagaattcacactagagagaattcttacaaatgtgaggaatgtggcaaagttcttaactggttctcagagcttattaaacataagggaattcatatgggagagaaaccctacaaatgtgaggaatgtggcaaagcctttaaccaatcctcaacccttattaaacataagaaaattcatattgaagagaaacccttcaaatgtgaagaatgtggcaaagcctttagtttattctcaatccttagtaaacataagataattcatactggagacaaaccttacaaatgtgatgaatgtcacaaagcctttaactggtttgcaacccttactaaccataagagaattcatactggagagaaacccttcaaatgtgaagaatgtggcaaagactttaaccagttttcaaaccttactaaacataagaaaattcatactggagagaaaccctacaaatgtgaagaatgtggcaaagcttttaaccagtttgcaaaccttactagacataagaaaattcatactggagagaaatcctacaaatgtgaagaatgcggcaaagcttttatacagtcctcaaaccttactgaacatatgagaattcatactggagagaaaccctacaaatgtgaagaatgtggcaaagcttttaatgggtgctccagccttactcgacataagagaattcacactagagagaatacctacaaatgtgaagaatgtggcaaaggctttactttattttcaacccttactaaccataaagtaattcatactggagagaaatcctacaaatgtgatgaatgtggcaatgtttttaactggcctgcaactcttgctaatcataagagaattcatgctagagagaaaccctacaaatgtgaagaatgtggcaaagcttttaaccggtcctcacaccttactagacataagaaaattcatactggtgagaaactctacaaacctgaaaaatgtgacaataattttgataacacctaaaacttttctaaacataaaagacaccatcctgttgagaaaccctaaaaatgtgaagaatttgacaaagccttccaatgattgttacacttgcttgtaggtaagataatttatattggagaaaactttataagtgtaaagaatgtgacaaaacttaaccaatactcacatcttattgcacaggaaagcatttttacttgagaaagattgtacaagtataaagaatgtgaaaaagtcattgatatcttttcacatcttactcaacaccagagtttatacttattaaaagcattataaatgcaattactgtcaaaagaaatttcagaaaacataacactttaaagtgaagaagcgtgtttattttgaagacaaacataacaaatataaggagcataggagggttgtagtacctttacttgtattacaaatcttattgtacgcattttgtactagagaaaaacactgaagcagttgctcaaactttgttcaacatcagggaatttatattggagaaaaatcctgcaaatgtaatgaatttggaaaaacattttttttcaaaaactacggcgtagaaaacatgaatttatattgaaatgtgtttttgcagatgcagtaagtatgaaaaatatttaatccaaaattgagtctatgtaaatattaaataatttacagtagaaataactaaggcactgacactttagacattacactaaaacagagtgttgagtataaaaaaatctataagttgttagattatttgtaaataactttaaaaggagtagaagattctttggagagttataattacattgaaagtatactttttttcttgaaaaaattatggcttatttgaaaagtaaataatgatgaaattcaactctcaaattactttatttcattcctattgtattcacatgtgaaagcatgtgataaattgttgctgtgtcagatataggagagattcttttttattagatgggcattatttatggttttttctgtggaagagtatgggcattaaaatgtaaggtttatgatgaaaatctaagtggagaggccctgttagtttacttttcatattgagtgatgcatgaggtaggtgtttggagtaatattctgcatcatagagaaaagcatttttaattttactttaaattaaatgtaattaaattactagtgaatcattttactaattgtacttttatgctataaatgcagtacatttgaaaatttttagattatgtataagcttaattttataattaaacatttctttaaca

SEQ ID NO: 3517 - DNA, 2159 bp, Homo sapiens
agtctttactgctctgtgtattctgctcctagaggcccagcctctgtgactccgttatctgcaggtattgggagatgcacagctaagatgccaggaccacctggaagcctagaaatgggaccactgacatttagggatgtggccatagaattctctctggaggagtggcaatgcctggacactgcacaacggaatttatataggaaagtgatgtttgagaactacagaaacctggtcttcctgggtattgctgtctctaagcctcacctgataacctgtttggagcaaggaaaagagccctggaataggaagagacaggagatggtagccaaacccccagagtcttactgtgttgctcaggctgatcttgaactcctggtctcaagttatcttactgccttggcctccctaaagatgtgggattacagaaataatccactttgccaggctactatgtagcccttcatgtagaactgtgctagtcataatgaatcataacactgtcaccttttattttgaaaagtctttatttttatctgtttttaaagtacactaatcttgaatcaagtattcttggttaggaattttattactgcatcaaaatttgggaagttcttagcctttttcatctacaagtaacctctacattactttttccctacattcttcttctaagagttttttaatgaatatattgatgtacttgatggtgtccaataagttttacatttcatgttttaattttcttttggaattttatatttttgttttatatattttaggatatgccacctcacatgagttaattgttttggttttttagtttatattataattgagtatgccagtatttaactctgtaaaatttaagacagtgtggaacaaagtcaaatatgaatcagccatatgtctactaccaatataacgatctctgtgtttacctgtataaatattttccctgttctttttatgacttgtatatttctggtataggtttgttgcaaatggttatttaatcttgactaggtgagaagtcatagaaattctcctaatttcaacatctatttattcatggatctatattatttttgtgtgggagaaaaacttttctatttaaagataatttacaaacgatcataatctcttttaggtatgtctatttttacttgtcaaaaacacataacatttacaatagaatatttttaaatgtttattttagtcctattatattgacattgttatgcaacatattcctaaaatgtttttatcttgcaaagctaaatatcaatacccattaaaaaactatgaattttacccatttcctggcacttttcaaacaccactctgttttctctaagagtgtaactgcttcatatatctcatacaatctctgtctttttgtgactggctcattttattttgcacaatatcatcaagctttatagttgttagaatattttctgctttttaaatactgggtgatatttaagtattttgtattttagattatatctactgagtaatttggtgacaaatttgcactgcttttacctattggctttcagtaacaatgctgcaataattacaggtatgcaaatgacctatatgatcatatatgtgtaagtttatatatgtgccgcattctgttctactagtgtacgtttttacctttgtactcataccaaattgttacaattctgtagctctgtaatgtgtttcaaaatcagaaactgtaatgccttcaaaattgtttattttattgcagatttttgggtactttattatctcttaagactttatatactttgggggttgctgtttctatttcttcaaaaatgcatgagaaatttgaacaacattgcattaaatctgtaaattacattgagcaggatggacatcttcacaagattaattattttaacatttcaacaagcatgctcaagagtgtattgttttaatttctatgtatttgtgaatttttcagttttttcttcttactgttctatactcatttcattttggtcatagaaagtaatccataaaaatttagttttaaataatttgttaagacttcttttttggtttaccaggttttctatcaaggagaatttcgtatgaggtattgagaaggctgtttatcattatgttgttgagtgttc

SEQ ID NO: 3518 - DNA, 2132 bp, Homo sapiens
tcttctagaggcccagcctctatggccctctgacctgcaggtattggcgatccatagctaagacgccaggtcccccggaaacctagaaatgacctgatcacctgtctggaacaagaaaaagagccttggactagaaagagacataggatggtggccgaacccccagttatttgttctcattttgcccaagacttttcaccagagcagaacataaaagattctttccaaaaagtgacaccaagaagatatggaaaatgtgaacatgagaatttacagttaagtaaaagtgtggatgagtgcaaagtgcaaaaaggaggttataatggacttaaccaatgtttgccaactacccagagcaaaatatttcaatgtgataaatatatgaaaatctttcataaattttcaaatttaaatggacataaggtaagacacaccagaaaaaaaccttttaaatataaagaatttggcaaatcattttgcatattttcaaacctaactcaacataaaataatttgtactagagtaaatttctacaaatgtgaagactgtggaaaagcctttaatggatcctcaatctttactaaacataaaagaattcatattggagagaaatcgtacatatgtgaagaatgtggcaaagcctgtaaccagttcacaaaccttactacacataagataatttatactagagacaaactctacaaacgtgaagaatgtagcaaagcctttaacctgtcgtcacacattacaacacatacaataattcatactggagagaatccctacaaacgtgaagaatgtgacaaagcctttaatcagtccttaacccttactacacataagataattcataccagagagaaactcaatgaatataaggaatgtggcaaagctttcaaccagtcctcacaccttaccagacataagataattcatactggagagaaaccctacaaatgtgaagaatgtggcaaagcctttaaccagtcctcacaccttaccagacataagataattcatactggagagaagccctacagatgtgaagaatgtggcaaagcctttaggcagtcctcacaccttactacacataagataattcatactggagagaaaccctacaaatgtgaagaatgtggcaaagcttttaacaagtcctcacaccttactagacataagagcattcatactggagaaaaaccctaccagtgtgaaaaatgtggcaaagcttctaaccaatcctcaaaccttactgaacataagaatattcatactgaagagaaaccatacaaatgtgaagaatgtgggaaagcctttaaccagttctcaaaccttactacacataaaagaattcatactggagagaaaccctacaaatgtgaagaatgtggcaaagcttttaaccagtcctcaatccttactacacataagagaattcatactggagagaaatcctacaaatgtgaagaatgtggcaaagctttctatcgatcctcaaaacttactgaacataagaaaattcatactggagagaaaccctacacatgtgaagaatgtggcaaagcctttaaccattcctcacatcttgctacacataaggtaattcatactggagagaaaccctaccaatgtgaagaatgtggtaaagcctttaaccagtcctcacaccttactagacataagagaattcatactggagagaaaccctaccaatgtgaaaaatgtggcaaagcttttaaccagtcctcaaaccttactggacataagaaaattcatactggtgagaaactctacaaacctaaaagatgtaacagtgattttgaaaacacttcaaagttttctaaacataaaagaaattatgctggtgagaaatcttagaaatgtgaagaatgtaacaaaacctttaaaagttgtcacacttgattgtgcataagataattcatactaaaaaaaaacctacaagtgtgaagaatgtggcaaaacttttaaccaatgctcacaccttattgcacaggaaagcatttgtactagaaaaaaatttcaaatatacagaatgtgaaaaagccattaatatctgttcacatcttactcaacatcagagatttcatacttaataaaagcattatacatgc

SEQ ID NO: 3519 - DNA, 6497 bp, Homo sapiens
gtctctcccttcagcccgagctccgggtctcgtcttcactgctctgtgtcctcttcttctagaggcccagcctctatggccctctgacctgcaggtattggcgatccatagctaagacgccaggtcccccggaaacctagaaatggaaccattgaaatttagggatgtggccatagaattctctctggaggagtggcaatgcctggacactatacagcagaatttatataggaatgtgatgttagagaactacagaaacctggtcttcttgggtattgttgtctctaagccagacctgatcacctgtctggaacaagaaaaagagccttggactagaaagagacataggatggtggccgaacccccagttatttgttctcattttgcccaagacttttcaccagagcagaacataaaagattctttccaaaaagtgacaccaagaagatatggaaaatgtgaacatgagaatttacagttaagtaaaagtgtggatgagtgcaaagtgcaaaaaggaggttataatggacttaaccaatgtttgccaactacccagagcaaaatatttcaatgtgataaatatatgaaaatctttcataaattttcaaatttaaatggacataaggtaagacacaccagaaaaaaaccttttaaatataaagaatttggcaaatcattttgcatattttcaaacctaactcaacataaaataatttgtactagagtaaatttctacaaatgtgaagactgtggaaaagcctttaatggatcctcaatctttactaaacataaaagaattcatattggagagaaatcgtacatatgtgaagaatgtggcaaagcctgtaaccagttcacaaaccttactacacataagataatttatactagagacaaactctacaaacgtgaagaatgtagcaaagcctttaacctgtcgtcacacattacaacacatacaataattcatactggagagaatccctacaaacgtgaagaatgtgacaaagcctttaatcagtccttaacccttactacacataagataattcataccagagagaaactcaatgaatataaggaatgtggcaaagctttcaaccagtcctcacaccttaccagacataagataattcatactggagagaaaccctacaaatgtgaagaatgtggcaaagcctttaaccagtcctcacaccttaccagacataagataattcatactggagagaagccctacagatgtgaagaatgtggcaaagcctttaggcagtcctcacaccttactacacataagataattcatactggagagaaaccctacaaatgtgaagaatgtggcaaagcttttaacaagtcctcacaccttactagacataagagcattcatactggagaaaaaccctaccagtgtgaaaaatgtggcaaagcttctaaccaatcctcaaaccttactgaacataagaatattcatactgaagagaaaccatacaaatgtgaagaatgtgggaaagcctttaaccagttctcaaaccttactacacataaaagaattcatactggagagaaaccctacaaatgtgaagaatgtggcaaagcttttaaccagtcctcaatccttactacacataagagaattcatactggagagaaatcctacaaatgtgaagaatgtggcaaagctttctatcgatcctcaaaacttactgaacataagaaaattcatactggagagaaaccctacacatgtgaagaatgtggcaaagcctttaaccattcctcacatcttgctacacataaggtaattcatactggagagaaaccctaccaatgtgaagaatgtggtaaagcctttaaccagtcctcacaccttactagacataagagaattcatactggagagaaaccctaccaatgtgaaaaatgtggcaaagcttttaaccagtcctcaaaccttactggacataagaaaattcatactggtgagaaactctacaaacctaaaagatgtaacagtgattttgaaaacacttcaaagttttctaaacataaaagaaattatgctggtgagaaatcttagaaatgtgaagaatgtaacaaaacctttaaaagttgtcacacttgattgtgcataagataattcatactaaaaaaaaacctacaagtgtgaagaatgtggcaaaacttttaaccaatgctcacaccttattgcacaggaaagcatttgtactagaaaaaaatttcaaatatacagaatgtgaaaaagccattaatatctgttcacatcttactcaacatcagagatttcatacttaataaaagcattatacatgcaattactgtcaaaaatctttcagaaaatataagcctctaaagtgaagagtattcattttgaagacacacattatgaacataaggagggttgtggtacctttacttgtatcacagatctcattgtacacattttgtgctagaggaaaaccatggagcagttgcttaaactttgtgcaacataaggaaatttatattggagaaaaaccctgcaaatgtaataaatttgggaaaacattttttcaaaaacgacagcttagaaaacactagagggttcatactaaaatctatttttgcagatgcagtaaatatgaaaaaatatttaatccaaaattctatgtaaatatcagataattcacagtagaaatagttaaggcactgacacttcaggcattacactaaatcagattgctgagtatagaaaagaatctaaaactaaagttggtaaatgaattatttgtatataacattataagaagtagaaaatttttgcagagttgtaactacattcaaactatcctttgaaaaaaattaggttttatgaaaagtgaataatgtcatttaactcaagttatgctcttcattcctattgtattcacatgtgaaagcatgtgacttaattgttgctgcatcaaagatgagagattctttgttattaggtgtgcattatttacgaccttttttagtgaaagagttaaggacattaaaatgtaagatgcaagatgaaaatgtaagtggagaggctctttctggttaatttataatattgactgatgcatgaggtaggagttcagataaatatcctgtgttatattgagaaaaaaaattttctggtatatcattttactaattgtactttttttttttttgagacagagttttgctcttgttgcccaggctggagtgcaatggtgtgatcttggctcaccaaaacctccacctcccaggttcaagggattctcctgcctcagcctcccgagtagctgggattacaggcatgtgccaccatgcccggctaattttgtatttttaatagagatggggtttctctatgttggtcaggctggtctcaaactcccgacctcgggtgatccacccacctcggcctcccaaagtgctgggattacaggcgcgagtcaccatgcctggccaattgtacttttatgtaataaaatgtagtacattttaaaatttttagataatgtgtgaacttattaatcaggctttttaaaaaacatgttaagaccatcgtgcattcaatgaagcattattatgccattaaatttaacttatcccatcttactcaagggtataggtaaatgatggtaactatacactatttaataagataatggactaacatttctagtaatctgttttgccagtggctttaaattgcaaataagtcagagaatattattcctgtaggttgaattattactcattttttcttatttaaacttatttttcttaatttttgtgggtacatagtatgtgtaaatatggcatatatggcatattttgatacaggtatataatatgtaataattacatatgggtaaatgaaatattcattacctgcagcatttattgtttgtatttgtttgtattataaactaattctgcacttttcggtttttttttgagacgagtctcactatgtcacccaggctgtgcacgcctgggtgcattggcgtggtctcagctcactgcaacctccgcctactgggttcaagtgattcttccgcctcagcctcctgagtagttgggactacaggcgcatgccaccacactcagctaatttttgtatttttagtagaaacagtttcactacgttggccaggtttgtcttgaactcctgaccccatgattagccccctcggcctcccaaagtgctgggattacaggtgggagccaccacacccagccacttttagttgttttcaaatgtacattaaattgttgttggctacagggtctcttttatggtcataagaaaacaatataaacaaaatgcatacatttctgagacctgaattaacattaaaaaattgttatatatttttcttcaaacatgttgcctctctgcctgcaagcacatacagactattagttttgatttacacagagttaaatatatacatatattactttaaagataaagcttgggtttaaaaaaattatggagtaaataaatgccttctttgcgagtatgagtttctacctagtttcagaagagcaatattgaaacaaatcaaattattttaattagatgatgactgcaaaactaaaaaaacttaaaaatgctgaaaacaaatccatactctctgctttgtattgaattgattactgtaaaattgtatggcttataattcagaatctccctatgcaaatttttgtttttacttgcctgattcttaggctagacccataattttcttgtgtcttacatttttttctcttattttatataagatgctatgtgagctggtcagagattataaaaataatttttataaaattagtgcaaaaaatttagatttaatttcaaaattagtgtattgttatattttatgttgttagaatattttattttgttcttttaattggagaacgctgtataagcctactttttttagtttttgttcctttcagtttttataatgaaaataagtaaatattgattgagcccatttatttaggtgagtactaggggggcttcctaaatcatgaggatgtttttatatataaatatagcaaacaaacatgacagtgctttctgtgtcacagatgctttataataagccataaatattcctgttggagttagtttgtaacttcaagacagagatggaacatatcaattgtgagaaataacattgattttttatgtggagaggacatttattttcaggctgcaaagctcagttttgctgaattaaaaaattgtgcttcttttatttcctaattgtcttagttttgtttgtcttattatgtgtatttcagctgtgtatgcatcacagccctcctttttgctgtgctgtggctacagttttctcactgttctcttcacaccatgtcatttcacatggtatattgtaggttttgatgagaaatcggtatttttaatgcactgcaagattggttttaactggagattttgcatatcaatataattttctgatcagttaaattaaaacaaaaagcatacagtgtccacagatgaaaggattaaatcatttagcgttgtttttctctgtttgttaaagaataatcttattaaattcttacacaaagtgtggcaaatataaaatttgcttgaaaatatatcttagaaattaaacttttaatttaattttctacagtatacttatgccacaatgtacgtttccatgcaaaatcttctatttgtaagtgtgaacattaaacattgcaaaatagtaaaatgacctctgtgattttgaaacctggagtaatatttcttttccatattcatattacaatttgaagaaattttctcagttttatatgtttttttagtgggtgaagttcagtctacagtttttacatttagtcacctaactctagccaacttcttggtcatattctctggaaaacattcgaagatcatggcagcttttagataaaaacattttctattattttgcgtgcaaacttgtttactgtgttcacagagtggccagtcatgagaccataagaaacagctgcccttttagtgtctttcataccgtctgtaatatataaattgtgcatttattctgtgaagcatgacattttgaagtatatacacattgtcaaatgcttcattctaggtaattaatgctttacctaacatagttaacatttttgtggtaagagcacatgacaatgttttagcatttttcagaaatacaaatacattgttatgaactataggcaccatgcagtacaaaagcttttttgaacttatttctcctattcaactgtaattatgtatttgactgacatctttctaaacccctcttttttccaaatatgttggcatctggtggtcaccattttattctccacttcagttagattaatttttctagaatcatgtaagtgaaataatttggttaatctatgtaattgaaaataataaatttttttattttaaagatgaa

SEQ ID NO: 3520 - DNA, 2466 bp, Homo sapiens
atgtggcaaaacctttaagtggttctcataccttactaaacataagagaattcacactggagagaaaccatacaaatgtgaagaatgtggcaaagcttttaactggtgctcgagtcttactaaacataagagaatccatactggtgagaaaccctacaaatgtgaagaatgtggaaaagcctttcactggtgttcaccctttgttagacataagaaaattcatacaggagaaaaaccctatacatgtgaagactgtggcagagcgtttaaccggcactcacatctcaccaaacataagacaattcacactggaaagaaaccctacaaatgtaaagaatgtgggaaagcctttaaccactgctcactacttactatacatgagaacccatacgggagagaaaccctataaatgtgaagaatgtggcaaagcttttaactcatcatcaattcttactgaacataaggtaattcatagcggagagaaaccctacaaatgtgaaaaatgtgacaaagtctttaagaggttctcataccttactaaacacaagagaattcacactggagagaaaccctacaaatgtgaagaatgtggcaaagcttttaactggtcctcaatccttactgaacataagagaattcatactggagagaaaccctacaactgtgaagaatgtggaaaagcctttaatcggtgctcacaccttactagacataagaaaattcatactgccgtcaaacgctataaatgtgaagaatgtggcaaagcttttaaacggtgctcacatcttaatgaacataagagagttcaaagaggagagaaatcctgcaagtataaaaaatgtggggaagcttttaatcactgctcaaaccttactacgtaagaatttttactaaagagaaatcctacaaatgtaaagaatgtggcaaattccataaatcttgctcaaggcattgaaatcacaagataattcatactggagagaaacactacaaatgtgaagaatgtggggaaagtcttcaaccattgctgacagcttattgcacagaagaaaattcatgctgagaaaaattctgattttaaagaatgtggcaaagcatttaataactactatgaacttactcatcagaggttttgtgctagataaaagcaatgtaagtgtaatgatacacattacatttatctgtggaaagatgtcaccaaataaaagccttagagtacacaaggtgtaatgatagtgatacattacatttgtacatggaaagacttcaaaaatataagccttagagtacacaagagtttttatactgaagaaaaacattacaaatataaagattgttgcaatacttttacttatgttacagattttgttgtacataggagaatttatactgaaaggtaaccctctaacagttgctcaaattttattccattttagataatttacattggaaagaaaccctacaactgtaatgaatatgaaaaaaattgtttaaaaagtacaccttagaaaacactagtttaaggccgggcgcggtggctcacacttataatcccagcactttgggaggccgaggcaggcggatcacgaggtcaggagatcgagaccacgatgaaaccctgtctctactaaaaatacaaaaaattagctgggcatgttgtcgggtgcctgtagtcccagctactgggagaggctgaggcaggagaatggcgtgaacccgagaggcggagcttgcagtgagccgagatcgcgccactgaactccaacctgggcgacagagactctgtctcaaaaaaaaagaaagaacgctagtttatatgaaagcatttaacagatgcagtaaatataaaaaattaataaaaaattaagtctaaatgaacatcagaagattcacagtagaaaccactaagacgctaacactttcaatgttattctaaatcagggcattgattataaagagtaattcaaggttaacataatttagttagcctaaacagaaataggagattaatattttgagacttaaacaattatattcaaagtacactttttgcattgaaagaattttagatttttacaaaggcaaattttgatgtaattgaactctcaaattacttgatgctgtgtctttattcctagtgtctgtatgaaagcatgtggtcaatttctgctgctcggggtttgagaagttctatattaggatgtcatttacatacttttcaacagaagattgaggacactgaaatatgaggtgtgtgaagaaagtacacagagaaacttttgtggttgacttataaaacttgtaagtgctgcatgagatagatgttcagagtaatagtcttgtgcattattcaaattttagtaaattgttttaccaattgcacattagatagtatagtggattttgtaatgcttttcttagactgtgtgaacttagtttcaataaaacaattatttttaatgtgtt

SEQ ID NO: 3521 - DNA, 2161 bp, Homo sapiens
ggccgtcgatcacctccgggcacaggatgcgagaatcagtctcagtgtttcctgtttggattgccatgaggacatcaacccagagtgactgtagaccctcttcccagcacctgagagtctttgagacatttgaggttgttgtgtgcagactgggatgggagttgttccagttttcacttgggtgaaaaaaaaggagagctggagactgatcaaccaattactttcatttcatatggcgattagaaaaacagatgaggcaatcataatctctgcaatccaggaactgtgtctgtggcaaatgaataaatggctgaatttcacaccatggagaactgttgacattcagggatgtgaccatagaattctctctggaggagtgggagtttctgaaccctgctcagcagagtttgtataggaaagtgatgctagagaactacagaaacctggtctctctgggtcttactgtttctaagccagaactgattagccgtctggagcaaagacaggagccctggaatgtgaagagacatgagaccatagccaaacccccagctatgtcttctcattacactgaagaccttttgccagaacagtgcatgcaagattcattccaaaaagtgatactgagaagatatggaagctgtggacttgaggatttacacttaaggaaggatggggaaaatgtgggtgagtgtaaggatcaaaaagaaatttataatggacttaaccaatgtttgtcaactctacctagcaaaattttcccatataataaatgtgtgaaagtctttagtaaatcatcaaatctaaatagagaaaacataagacatactacagagaaacttttcaaatgtatgcaatgtggcaaagtctttaaatctcactcaggcctttcttatcataagataattcacactgaagagaaactctgcatatgtgaggaatgtggcaaaacctttaagtggttctcataccttactaaacataagagaattcacactggagagaaaccatacaaatgtgaagaatgtggcaaagcttttaactggtgctcgagtcttactaaacataagagaatccatactggtgagaaaccctacaaatgtgaagaatgtggaaaagcctttcactggtgttcaccctttgttagacataagaaaattcatacaggagaaaaaccctatacatgtgaagactgtggcagagcgtttaaccggcactcacatctcaccaaacataagacaattcacactggaaagaaaccctacaaatgtaaagaatgtgggaaagcctttaaccactgctcactacttactatacatgagagaacccatacgggagagaaaccctataaatgtgaagaatgtggcaaagcttttaactcatcatcaattcttactgaacataaggtaattcatagcggagagaaaccctacaaatgtgaaaaatgtgacaaagtctttaagaggttctcataccttactaaacacaagagaattcacactggagagaaaccctacaaatgtgaagaatgtggcaaagcttttaactggtcctcaatccttactgaacataagagaattcatactggagagaaaccctacaactgtgaagaatgtggaaaagcctttaatcggtgctcacaccttactagacataagaaaattcatactgccgtcaaacgctataaatgtgaagaatgtggcaaagcttttaaacggtgctcacatcttaatgaacataagagagttcaaagaggagagaaatcctgcaagtataaaaaatgtggggaagcttttaatcactgctcaaaccttactacgtaagaatttttactaaagagaaatcctacaaatgtaaagaatgtggcaaattccataaatcttgctcaaggcattgaaatcacaagataattcatactggagagaaacactacaaatgtgaagaatgtggggaaagtcttcaaccattgctgacagcttattgcacagaagaaaattcatgctgagaaaaattctgattttaaagaatgtggcaaagcatttaataactactatgaacttactcatcagaggttttgtgctagataaaagcaatgtaagtgtaatgatacacattacatttatctgtggaaagatgtcaccaaataaaagccttagagtac

SEQ ID NO: 3522 - DNA, 3164 bp, Homo sapiens
agctgtcagctccggagtctgcggactggagtccccggcaggcacagctcggccgtcgatcacctccgggcacaggatgcgaggaactgttgacattcagggatgtgaccatagaattctctctggaggagtgggagtttctgaaccctgctcagcagagtttgtataggaaagtgatgctagagaactacagaaacctggtctctctgggtcttactgtttctaagccagaactgattagccgtctggagcaaagacaggagccctggaatgtgaagagacatgagaccatagccaaacccccagctatgtcttctcattacactgaagaccttttgccagaacagtgcatgcaagattcattccaaaaagtgatactgagaagatatggaagctgtggacttgaggatttacacttaaggaaggatggggaaaatgtgggtgagtgtaaggatcaaaaagaaatttataatggacttaaccaatgtttgtcaactctacctagcaaaattttcccatataataaatgtgtgaaagtctttagtaaatcatcaaatctaaatagagaaaacataagacatactacagagaaacttttcaaatgtatgcaatgtggcaaagtctttaaatctcactcaggcctttcttatcataagataattcacactgaagagaaactctgcatatgtgaggaatgtggcaaaacctttaagtggttctcataccttactaaacataagagaattcacactggagagaaaccatacaaatgtgaagaatgtggcaaagcttttaactggtgctcgagtcttactaaacataagagaatccatactggtgagaaaccctacaaatgtgaagaatgtggaaaagcctttcactggtgttcaccctttgttagacataagaaaattcatacaggagaaaaaccctatacatgtgaagactgtggcagagcgtttaaccggcactcacatctcaccaaacataagacaattcacactggaaagaaaccctacaaatgtaaagaatgtgggaaagcctttaaccactgctcactacttactatacatgagagaacccatacgggagagaaaccctataaatgtgaagaatgtggcaaagcttttaactcatcatcaattcttactgaacataaggtaattcatagcggagagaaaccctacaaatgtgaaaaatgtgacaaagtctttaagaggttctcataccttactaaacacaagagaattcacactggagagaaaccctacaaatgtgaagaatgtggcaaagcttttaactggtcctcaatccttactgaacataagagaattcatactggagagaaaccctacaactgtgaagaatgtggaaaagcctttaatcggtgctcacaccttactagacataagaaaattcatactgccgtcaaacgctataaatgtgaagaatgtggcaaagcttttaaacggtgctcacatcttaatgaacataagagagttcaaagaggagagaaatcctgcaagtataaaaaatgtggggaagcttttaatcactgctcaaaccttactacgtaagaatttttactaaagagaaatcctacaaatgtaaagaatgtggcaaattccataaatcttgctcaaggcattgaaatcacaagataattcatactggagagaaacactacaaatgtgaagaatgtggggaaagtcttcaaccattgctgacagcttattgcacagaagaaaattcatgctgagaaaaattctgattttaaagaatgtggcaaagcatttaataactactatgaacttactcatcagaggttttgtgctagataaaagcaatgtaagtgtaatgatacacattacatttatctgtggaaagatgtcaccaaataaaagccttagagtacacaaggtgtaatgatagtgatacattacatttgtacatggaaagacttcaaaaatataagccttagagtacacaagagtttttatactgaagaaaaacattacaaatataaagattgttgcaatacttttacttatgttacagattttgttgtacataggagaatttatactgaaaggtaaccctctaacagttgctcaaattttattccattttagataatttacattggaaagaaaccctacaactgtaatgaatatgaaaaaaattgtttaaaaagtacaccttagaaaacactagtttaaggccgggcgcggtggctcacacttataatcccagcactttgggaggccgaggcaggcggatcacgaggtcaggagatcgagaccacgatgaaaccctgtctctactaaaaatacaaaaaattagctgggcatgttgtcgggtgcctgtagtcccagctactgggagaggctgaggcaggagaatggcgtgaacccgagaggcggagcttgcagtgagccgagatcgcgccactgaactccaacctgggcgacagagactctgtctcaaaaaaaaagaaagaacgctagtttatatgaaagcatttaacagatgcagtaaatataaaaaattaataaaaaattaagtctaaatgaacatcagaagattcacagtagaaaccactaagacgctaacactttcaatgttattctaaatcagggcattgattataaagagtaattcaaggttaacataatttagttagcctaaacagaaataggagattaatattttgagacttaaacaattatattcaaagtacactttttgcattgaaagaattttagatttttacaaaggcaaattttgatgtaattgaactctcaaattacttgatgctgtgtctttattcctagtgtctgtatgaaagcatgtggtcaatttctgctgctcggggtttgagaagttctatattaggatgtcatttacatacttttcaacagaagattgaggacactgaaatatgaggtgtgtgaagaaagtacacagagaaacttttgtggttgacttataaaacttgtaagtgctgcatgagatagatgttcagagtaatagtcttgtgcattattcaaattttagtaaattgttttaccaattgcacattagatagtatagtggattttgtaatgcttttcttagactgtgtgaacttagtttcaataaaacaattatttttaatgtgttaa

SEQ ID NO: 3523 - DNA, 3207 bp, Homo sapiens
ttcattgcttagtatcctctgctctagtagttcccggtgactgtcgcagcctctgttgccctctgacttgcagatgctgtgagatccagagctaagactccacgacatcccggaagccgaaaaatggaactgttgacattcagggatgtgaccatagaattctctctggaggagtgggagtttctgaaccctgctcagcagagtttgtataggaaagtgatgctagagaactacagaaacctggtctctctgggtcttactgtttctaagccagaactgattagccgtctggagcaaagacaggagccctggaatgtgaagagacatgagaccatagccaaacccccagctatgtcttctcattacactgaagaccttttgccagaacagtgcatgcaagattcattccaaaaagtgatactgagaagatatggaagctgtggacttgaggatttacacttaaggaaggatggggaaaatgtgggtgagtgtaaggatcaaaaagaaatttataatggacttaaccaatgtttgtcaactctacctagcaaaattttcccatataataaatgtgtgaaagtctttagtaaatcatcaaatctaaatagagaaaacataagacatactacagagaaacttttcaaatgtatgcaatgtggcaaagtctttaaatctcactcaggcctttcttatcataagataattcacactgaagagaaactctgcatatgtgaggaatgtggcaaaacctttaagtggttctcataccttactaaacataagagaattcacactggagagaaaccatacaaatgtgaagaatgtggcaaagcttttaactggtgctcgagtcttactaaacataagagaatccatactggtgagaaaccctacaaatgtgaagaatgtggaaaagcctttcactggtgttcaccctttgttagacataagaaaattcatacaggagaaaaaccctatacatgtgaagactgtggcagagcgtttaaccggcactcacatctcaccaaacataagacaattcacactggaaagaaaccctacaaatgtaaagaatgtgggaaagcctttaaccactgctcactacttactatacatgagagaacccatacgggagagaaaccctataaatgtgaagaatgtggcaaagcttttaactcatcatcaattcttactgaacataaggtaattcatagcggagagaaaccctacaaatgtgaaaaatgtgacaaagtctttaagaggttctcataccttactaaacacaagagaattcacactggagagaaaccctacaaatgtgaagaatgtggcaaagcttttaactggtcctcaatccttactgaacataagagaattcatactggagagaaaccctacaactgtgaagaatgtggaaaagcctttaatcggtgctcacaccttactagacataagaaaattcatactgccgtcaaacgctataaatgtgaagaatgtggcaaagcttttaaacggtgctcacatcttaatgaacataagagagttcaaagaggagagaaatcctgcaagtataaaaaatgtggggaagcttttaatcactgctcaaaccttactacgtaagaatttttactaaagagaaatcctacaaatgtaaagaatgtggcaaattccataaatcttgctcaaggcattgaaatcacaagataattcatactggagagaaacactacaaatgtgaagaatgtggggaaagtcttcaaccattgctgacagcttattgcacagaagaaaattcatgctgagaaaaattctgattttaaagaatgtggcaaagcatttaataactactatgaacttactcatcagaggttttgtgctagataaaagcaatgtaagtgtaatgatacacattacatttatctgtggaaagatgtcaccaaataaaagccttagagtacacaaggtgtaatgatagtgatacattacatttgtacatggaaagacttcaaaaatataagccttagagtacacaagagtttttatactgaagaaaaacattacaaatataaagattgttgcaatacttttacttatgttacagattttgttgtacataggagaatttatactgaaaggtaaccctctaacagttgctcaaattttattccattttagataatttacattggaaagaaaccctacaactgtaatgaatatgaaaaaaattgtttaaaaagtacaccttagaaaacactagtttaaggccgggcgcggtggctcacacttataatcccagcactttgggaggccgaggcaggcggatcacgaggtcaggagatcgagaccacgatgaaaccctgtctctactaaaaatacaaaaaattagctgggcatgttgtcgggtgcctgtagtcccagctactgggagaggctgaggcaggagaatggcgtgaacccgagaggcggagcttgcagtgagccgagatcgcgccactgaactccaacctgggcgacagagactctgtctcaaaaaaaaagaaagaacgctagtttatatgaaagcatttaacagatgcagtaaatataaaaaattaataaaaaattaagtctaaatgaacatcagaagattcacagtagaaaccactaagacgctaacactttcaatgttattctaaatcagggcattgattataaagagtaattcaaggttaacataatttagttagcctaaacagaaataggagattaatattttgagacttaaacaattatattcaaagtacactttttgcattgaaagaattttagatttttacaaaggcaaattttgatgtaattgaactctcaaattacttgatgctgtgtctttattcctagtgtctgtatgaaagcatgtggtcaatttctgctgctcggggtttgagaagttctatattaggatgtcatttacatacttttcaacagaagattgaggacactgaaatatgaggtgtgtgaagaaagtacacagagaaacttttgtggttgacttataaaacttgtaagtgctgcatgagatagatgttcagagtaatagtcttgtgcattattcaaattttagtaaattgttttaccaattgcacattagatagtatagtggattttgtaatgcttttcttagactgtgtgaacttagtttcaataaaacaattatttttaatgtgttaa

SEQ ID NO: 3524 - DNA, 1610 bp, Homo sapiens
aggaacctgagcagatgccttgacccagaccagagacccaagccaaggaaagcccatgatcaccagacaggtaatggggatatgaaggaagaatcagctgcacaattaggttgttgtcataggcccatggccctgggaggtacagggggctccctgtcccccagcctggacttccagctcttccgaggtgaccaggtcttctcagcctgcagaccacttccagacatggtggatgctcatggcccatcctgtgccagctggctgtgtcccttgcccctggcaccgggcaggtctgcactgctggcctgcctacaggacctggacctgaacctgtgcaccccacagccggcacccctgggcacagacctgcagggcctccaagaggacgccttgagcatgaagcacgagccaccagggctgcaggccagctccaccgatgacaagaaattcacagtcaagtacccacagaacaaggacaagctgggaaaacagccagaaagagctggcgagggggccccctgcccagccttctcctctcataacagctcttccccaccaccgctgcagaacagaaagagccccagccccttggctttctgcccctgtccccctgtcaactccatctccaaggagctcccatttctcctccacgccttctaccctggatacccacttctcctgcctccaccccacctgttcacctatggggccctaccttctgaccaatgtccccacctcctcatgctgccccaagacccctcctaccccaccatggctatgcctagcctgctgatgatggtcaatgagctggggcaccccagcgctcggtgggagaccctgcttccctacccaggggccttccaagcctctggccaagctctgccttcccaggcccgaaatccaggtgctggagctgccccaaccgactccccaggcctggagcgtggtggcatggcatctccagcaaagcgggtcccattgagttcccagacaggcaccgcagccttgccttacccgctgaaaaagaagaatggcaaaatcctgtacgagtgcaacatatgtggcaagagctttgggcagctctccaatctcaaggtccacctgcgtgtgcacagtggagagcgtccattccagtgtgccttgtgccagaagagcttcactcaacttgcccacctgcagaagcaccacctggtgcacactggggagcggccccacaagtgctcggtgtgccacaagcgcttcagcagctccagtaacctcaagacccacctgcgcctgcactccggggcccggcccttccagtgcagtgtctgccggagtcgcttcacccagcacatccacctgaagctgcaccatcggctgcatgccccacagccctgtggcctggtgcacacccagctgcccctggcctctctggcctgccttgcccaatggcaccagggggcactagatcttatggcggtggcatctgagaaacacatgggctatgacatagatgaggtcaaagtgtcctcgacatcccaggggaaagcaagagcagtgagcctgagcagtgccgggactcccctggtgatggggcaggaccagaacaattaaaaatgtttcttctg

SEQ ID NO: 3525 - DNA, 1447 bp, Homo sapiens
ggggaggtagcacaaagggaggaccatggtcttctaactgaggaacctgagcagatgccttgacccagaccagagacccaagccaaggaaagcccatgatcaccagacaggtaatggggatatgaaggaagaatcagctgcacaattaggttgttgtcataggcccatggccctgggaggtacagggggctccctgtcccccagcctggacttccagctcttccgaggtgaccagagcacgagccaccagggctgcaggccagctccaccgatgacaagaaattcacagtcaagtacccacagaacaaggacaagctgggaaaacagccagaaagagctggcgagggggccccctgcccagccttctcctctcataacagctcttccccaccaccgctgcagaacagaaagagccccagccccttggctttctgcccctgtccccctgtcaactccatctccaaggagctcccatttctcctccacgccttctaccctggatacccacttctcctgcctccaccccacctgttcacctatggggccctaccttctgaccaatgtccccacctcctcatgctgccccaagacccctcctaccccaccatggctatgcctagcctgctgatgatggtcaatgagctggggcaccccagcgctcggtgggagaccctgcttccctacccaggggccttccaagcctctggccaagctctgccttcccaggcccgaaatccaggtgctggagctgccccaaccgactccccaggcctggagcgtggtggcatggcatctccagcaaagcgggtcccattgagttcccagacaggcaccgcagccttgccttacccgctgaaaaagaagaatggcaaaatcctgtacgagtgcaacatatgtggcaagagctttgggcagctctccaatctcaaggtccacctgcgtgtgcacagtggagagcgtccattccagtgtgccttgtgccagaagagcttcactcaacttgcccacctgcagaagcaccacctggtgcacactggggagcggccccacaagtgctcggtgtgccacaagcgcttcagcagctccagtaacctcaagacccacctgcgcctgcactccggggcccggcccttccagtgcagtgtctgccggagtcgcttcacccagcacatccacctgaagctgcaccatcggctgcatgccccacagccctgtggcctggtgcacacccagctgcccctggcctctctggcctgccttgcccaatggcaccagggggcactagatcttatggcggtggcatctgagaaacacatgggctatgacatagatgaggtcaaagtgtcctcgacatcccaggggaaagcaagagcagtgagcctgagcagtgccgggactcccctggtgatggggcaggaccagaacaattaaaaatgtttcttctgtc

SEQ ID NO: 3526 - DNA, 1649 bp, Homo sapiens
ggggaggtagcacaaagggaggaccatggtcttctaactgaggaacctgagcagatgccttgacccagaccagagacccaagccaaggaaagcccatgatcaccagagtaatggggatatgaaggaagaatcagctgcacaattaggttgttgtcataggcccatggccctgggaggtacagggggctccctgtcccccagcctggacttccagctcttccgaggtgaccaggtcttctcagcctgcagaccacttccagacatggtggatgctcatggcccatcctgtgccagctggctgtgtcccttgcccctggcaccgggcaggtctgcactgctggcctgcctacaggacctggacctgaacctgtgcaccccacagccggcacccctgggcacagacctgcagggcctccaagaggacgccttgagcatgaagcacgagccaccagggctgcaggccagctccaccgatgacaagaaattcacagtcaagtacccacagaacaaggacaagctgggaaaacagccagaaagagctggcgagggggccccctgcccagccttctcctctcataacagctcttccccaccaccgctgcagaacagaaagagccccagccccttggctttctgcccctgtccccctgtcaactccatctccaaggagctcccatttctcctccacgccttctaccctggatacccacttctcctgcctccaccccacctgttcacctatggggccctaccttctgaccaatgtccccacctcctcatgctgccccaagacccctcctaccccaccatggctatgcctagcctgctgatgatggtcaatgagctggggcaccccagcgctcggtgggagaccctgcttccctacccaggggccttccaagcctctggccaagctctgccttcccaggcccgaaatccaggtgctggagctgccccaaccgactccccaggcctggagcgtggtggcatggcatctccagcaaagcgggtcccattgagttcccagacaggcaccgcagccttgccttacccgctgaaaaagaagaatggcaaaatcctgtacgagtgcaacatatgtggcaagagctttgggcagctctccaatctcaaggtccacctgcgtgtgcacagtggagagcgtccattccagtgtgccttgtgccagaagagcttcactcaacttgcccacctgcagaagcaccacctggtgcacactggggagcggccccacaagtgctcggtgtgccacaagcgcttcagcagctccagtaacctcaagacccacctgcgcctgcactccggggcccggcccttccagtgcagtgtctgccggagtcgcttcacccagcacatccacctgaagctgcaccatcggctgcatgccccacagccctgtggcctggtgcacacccagctgcccctggcctctctggcctgccttgcccaatggcaccagggggcactagatcttatggcggtggcatctgagaaacacatgggctatgacatagatgaggtcaaagtgtcctcgacatcccaggggaaagcaagagcagtgagcctgagcagtgccgggactcccctggtgatggggcaggaccagaacaattaaaaatgtttcttctgtc

SEQ ID NO: 3527 - DNA, 1670 bp, Homo sapiens
aggaacctgagcagatgccttgacccagaccagagacccaagccaaggaaagcccatgatcaccagagtaatggggatatgaaggaagaatcagctgcacaattaggttgttgtcataggcccatggccctgggaggtacagggggctccctgtcccccagcctggacttccagctcttccgaggtgaccaggtcttctcagcctgcagaccacttccagacatggtggatgctcatggcccatcctgtgccagctggctgtgtcccttgcccctggcaccgggcaggtctgcactgctggcctgcctacaggacctggacctgaacctgtgcaccccacagccggcacccctgggcacagacctgcagggcctccaagaggacgccttgagcatgaagcacgagccaccagggctgcaggccagctccaccgatgacaagaaattcacagtcaagtacccacagaacaaggacaagctgggaaaacagccagaaagagctggcgagggggccccctgcccagccttctcctctcataacagctcttccccaccaccgctgcagaacagaaagagccccagccccttggctttctgcccctgtccccctgtcaactccatctccaaggagctcccatttctcctccacgccttctaccctggatacccacttctcctgcctccaccccacctgttcacctatggggccctaccttctgaccaatgtccccacctcctcatgctgccccaagacccctcctaccccaccatggctatgcctagcctgctgatgatggtcaatgagctggggcaccccagcgctcggtgggagaccctgcttccctacccaggggccttccaagcctctggccaagctctgccttcccaggcccgaaatccaggtgctggagctgccccaaccgactccccaggcctggagcgtggtggcatggcatctccagcaaagcgggtcccattgagttcccagacaggcaccgcagccttgccttacccgctgaaaaagaagaatggcaaaatcctgtacgagtgcaacatatgtggcaagagctttgggcagctctccaatctcaaggtccacctgcgtgtgcacagtggagagcgtccattccagtgtgccttgtgccagaagagcttcactcaacttgcccacctgcagaagcaccacctggtgcacactggggagcggccccacaagtgctcgataccgtgggttccaggaagaaatcactggaaaagcttccaggcctggagggaaagagaggtgtgccacaagcgcttcagcagctccagtaacctcaagacccacctgcgcctgcactccggggcccggcccttccagtgcagtgtctgccggagtcgcttcacccagcacatccacctgaagctgcaccatcggctgcatgccccacagccctgtggcctggtgcacacccagctgcccctggcctctctggcctgccttgcccaatggcaccagggggcactagatcttatggcggtggcatctgagaaacacatgggctatgacatagatgaggtcaaagtgtcctcgacatcccaggggaaagcaagagcagtgagcctgagcagtgccgggactcccctggtgatggggcaggaccagaacaattaaaaatgtttcttctgtca

SEQ ID NO: 3528 - DNA, 853 bp, Homo sapiens
ctcctggggcatttcctagccaagccagggagctttcaggattggagacctggaaatctccaaggccatttccttttttatttttttctaacagagaggttgtgcaaagtgttctgagagctgggagcagagtgtgatgccaggagggagcacagctggcagatggaagccaaagcctggagtgtagcagagccatctcagctcactgcaacctccgcctcccgggttcaagcaattctcctgcctcagtctcccaagtagctggaaatacagcaggtaatggggatatgaaggaagaatcagctgcacaattaggttgttgtcataggcccatggccctgggaggtacagggggctccctgtcccccagcctggacttccagctcttccgaggtgaccaggtcttctcagcctgcagaccacttccagacatggtggatgctcatggcccatcctgtgccagctggctgtgtcccttgcccctggcaccgggcaggtctgcactgctggcctgcctacaggacctggacctgaacctgtgcaccccacagccggcacccctgggcacagacctgcagggcctccaagaggacgccttgagcatgaagcacgagccaccagggctgcaggccagctccaccgatgacaagaaattcacagtcaagtacccacagaacaaggacaagctgggaaaacagccagaaagagctggcgagggggccccctgcccagccttctcctctcataacagctcttccccaccaccgctgcagaacagaaagagccccagccccttggctttctgcccctgtccccctgtcaactccatctccaaggagctcccatttctcct

SEQ ID NO: 3529 - DNA, 1712 bp, Homo sapiens
ggggaggtagcacaaagggaggaccatggtcttctaactgaggaacctgagcagatgccttgacccagaccagagacccaagccaaggaaagcccatgatcaccagacaggtaatggggatatgaaggaagaatcagctgcacaattaggttgttgtcataggcccatggccctgggaggtacagggggctccctgtcccccagcctggacttccagctcttccgaggtgaccaggtcttctcagcctgcagaccacttccagacatggtggatgctcatggcccatcctgtgccagctggctgtgtcccttgcccctggcaccgggcaggtctgcactgctggcctgcctacaggacctggacctgaacctgtgcaccccacagccggcacccctgggcacagacctgcagggcctccaagaggacgccttgagcatgaagcacgagccaccagggctgcaggccagctccaccgatgacaagaaattcacagtcaagtacccacagaacaaggacaagctgggaaaacagccagaaagagctggcgagggggccccctgcccagccttctcctctcataacagctcttccccaccaccgctgcagaacagaaagagccccagccccttggctttctgcccctgtccccctgtcaactccatctccaaggagctcccatttctcctccacgccttctaccctggatacccacttctcctgcctccaccccacctgttcacctatggggccctaccttctgaccaatgtccccacctcctcatgctgccccaagacccctcctaccccaccatggctatgcctagcctgctgatgatggtcaatgagctggggcaccccagcgctcggtgggagaccctgcttccctacccaggggccttccaagcctctggccaagctctgccttcccaggcccgaaatccaggtgctggagctgccccaaccgactccccaggcctggagcgtggtggcatggcatctccagcaaagcgggtcccattgagttcccagacaggcaccgcagccttgccttacccgctgaaaaagaagaatggcaaaatcctgtacgagtgcaacatatgtggcaagagctttgggcagctctccaatctcaaggtccacctgcgtgtgcacagtggagagcgtccattccagtgtgccttgtgccagaagagcttcactcaacttgcccacctgcagaagcaccacctggtgcacactggggagcggccccacaagtgctcgataccgtgggttccaggaagaaatcactggaaaagcttccaggcctggagggaaagagaggtgtgccacaagcgcttcagcagctccagtaacctcaagacccacctgcgcctgcactccggggcccggcccttccagtgcagtgtctgccggagtcgcttcacccagcacatccacctgaagctgcaccatcggctgcatgccccacagccctgtggcctggtgcacacccagctgcccctggcctctctggcctgccttgcccaatggcaccagggggcactagatcttatggcggtggcatctgagaaacacatgggctatgacatagatgaggtcaaagtgtcctcgacatcccaggggaaagcaagagcagtgagcctgagcagtgccgggactcccctggtgatggggcaggaccagaacaattaaaaatgtttcttctgtc

SEQ ID NO: 3530 - DNA, 936 bp, Homo sapiens
ctcagccacaggcagctgtggcctggctgcccacctccttccttcccagccaggagcactgctgcagcaccgagtggagagccccacagccagcagcccttcgggggtccatgcaggtaatggggatatgaaggaagaatcagctgcacaattaggttgttgtcataggcccatggccctgggaggtacagggggctccctgtcccccagcctggacttccagctcttccgaggtgaccaggtcttctcagcctgcagaccacttccagacatggtggatgctcatggcccatcctgtgccagctggctgtgtcccttgcccctggcaccgggcaggtctgcactgctggcctgcctacaggacctggacctgaacctgtgcaccccacagccggcacccctgggcacagacctgcagggcctccaagaggacgccttgagcatgaagcacgagccaccagggctgcaggccagctccaccgatgacaagaaattcacagtcaagtacccacagaacaaggacaagctgggaaaacagccagaaagagctggcgagggggccccctgcccagccttctcctctcataacagctcttccccaccaccgctgcagaacagaaagagccccagccccttggctttctgcccctgtccccctgtcaactccatctccaaggagctcccatttctcctccacgccttctaccctggatacccacttctcctgcctccaccccacctgttcacctatggggccctaccttctgaccaatgtccccacctcctcatgctgccccaagacccctcctaccccaccatggctatgcctagcctgctgatgatggtcaatgagctggggcaccccagcgctcggtgggagaccctgcttccctacccaggggccttccaagcctctggccaagctctgccttccca

SEQ ID NO: 3531 - DNA, 1009 bp, Homo sapiens
attcaatcttcaaatcagcgccgcgggaagtgcgggcgggtgttgctcccctgtctctggacgacgctgtgactgatcccaggcttggagccggagctgcgagcgaggcagtgaaagggtggcagatttctgtgtaagagctgcagaaaatgatcagcttccaggaatcagtgacattccaggatgtggctgtggatttcactgcagaggagtggcagctgcttgattgtgctgagagaaccctgtattgggatgtgatgttggagaactatagaaacctcatctcagtgggatgtccaattaccaaaacaaaagtgatcctcaaggtagagcaaggacaagagccatggatggtggagggagcgaatccacacgagagctctccaggctggagtgcagtggcgcaatctcagctcgggttcaagtgattctcctacctcagcctcccgaagagctggaactacaggcgcccgccaccatgcctggctaatttttgtatttttagtagagacacggtttcaccatgttggccaggatggtcttgatctcttgaccttgtgagccacccgccttggcctcccaaagtgctgggattacaggtgtgagccaccgtgcctggcccaaaaataaagtattttaaaattcaacaaacgagtatgaaacatttcttcaatgcacattaacattgcagttttgttctaattaactgtcaaaatgacagacagcagcagtgactatcttagaaattcatagaaaatggagcttaaagtttaaagtatgcaaaatttggagaagtcttttttttgaggtcatggaacagtggttcctccctaaagagtatctaagttctagataggacgagaggagataagggggggtgcaaatgaaggtggacaacgaacatgagcaaaagattgaatttaggaatctagaatccatggagtagaaggtatttgttgaggactagtgaaatgcatgcttcccatgagtgaattcatatcttgcataa

SEQ ID NO: 3532 - DNA, 1028 bp, Homo sapiens
attcaatcttcaaatcagcgccgcgggaagtgcgggcgggtgttgctcccctgtctctggacgacgctgtgactgatcccaggcttggagccggagctgcgagcgaggcagtgaaagggtggcagatttctgtgtaagagctgcagaaaatgatcagcttccaggaatcagtgacattccaggatgtggctgtggatttcactgcagaggagtggcagctgcttgattgtgctgagagaaccctgtattgggatgtgatgttggagaactatagaaacctcatctcagtgggatgtccaattaccaaaacaaaagtgatcctcaaggtagagcaaggacaagagccatggatggtggagggagcgaatccacacgagagctctccagagtctcgctctgtcgccaggctggagtgcagtggcgcaatctcagctcgggttcaagtgattctcctacctcagcctcccgaagagctggaactacaggcgcccgccaccatgcctggctaatttttgtatttttagtagagacacggtttcaccatgttggccaggatggtcttgatctcttgaccttgtgagccacccgccttggcctcccaaagtgctgggattacaggtgtgagccaccgtgcctggcccaaaaataaagtattttaaaattcaacaaacgagtatgaaacatttcttcaatgcacattaacattgcagttttgttctaattaactgtcaaaatgacagacagcagcagtgactatcttagaaattcatagaaaatggagcttaaagtttaaagtatgcaaaatttggagaagtcttttttttgaggtcatggaacagtggttcctccctaaagagtatctaagttctagataggacgagaggagataagggggggtgcaaatgaaggtggacaacgaacatgagcaaaagattgaatttaggaatctagaatccatggagtagaaggtatttgttgaggactagtgaaatgcatgcttcccatgagtgaattcatatcttgcataa

SEQ ID NO: 3533 - DNA, 2097 bp, Homo sapiens
atgggaaatgtggtctccgacggatggcctacacccgggaggagtccaggaactctaggtggacagttacttccgcacacgcgtagtaggacggtagccggtattcaatcttcaaatcagcgccgcgggaagtgcgggcgggtgttgctcccctgtctctggacgacgctgtgactgatcccaggcttggagccggagctgcgagcgaggcagtgaaagggtggcagatttctgtgtaagagctgcagaaaatgatcagcttccaggaatcagtgacattccaggatgtggctgtggatttcactgcagaggagtggcagctgcttgattgtgctgagagaaccctgtattgggatgtgatgttggagaactatagaaacctcatctcagtgggatgtccaattaccaaaacaaaagtgatcctcaaggtagagcaaggacaagagccatggatggtggagggagcgaatccacacgagagctctccagaatctgactacccacttgttgatgaaccagggaagcatcgggaaagcaaagacaattttttgaagtcagttttgctcacattcaataaaattctgactatggagagaatccaccattataatatgagcacaagtcttaatccaatgagaaaaaaatcatataaatcgtttgagaagtgtttgccacctaatttagacttacttaaatataatagaagttatactgtagaaaacgcttatgaatgcagtgaatgcgggaaagccttcaaaaagaagtttcatttcattagacatgaaaaaaatcatacaaggaaaaaaccttttgaatgcaatgactgtggaaaagcctatagcaggaaggcacaccttgcaactcatcagaaaattcataatggagagagaccctttgtgtgcaatgattgtgggaaggcgtttatgcataaagcccaactcgtggtccaccagagacttcacactggagagaagccttatgagtgcagtcaatgtgggaaaacattcacttggaactcctcatttaatcaacacgtgaaatctcatacacttgagaagtcatttgaatgtaaggaatgtgggaaaaccttcaggtatagttcatccctttataaacattccagatttcatacaggagagaaaccctaccagtgtatcatatgtggcaaagcttttggcaacacatccgtgcttgttacacaccaaagaattcatacaggagagaaaccttacagttgtattgaatgtggcaaagccttcatcaagaagtcccatctcctcagacatcagataactcatacaggagagaagccctatgaatgtaacagatgtgggaaagcattttcccagaagtcaaatcttattgtacatcagaaaattcatacataatattcactttatgaatatgagaaggccttattaaatatttgctaaatcttattaaatactaaagaattcatggtgagaagtctacaatttaaatgaatttggaagagtagattcccataaaaaacaaccaatgccaatcatgttctggaagtgataataaactttttacagaaaatatgacagaaaacaactataaataatagagcataaagcttggaaagtaagcataacttaaaaaatcaaagaaccagtgaaaactacatttgccattcctgacttttaatttttataataaaataattatgcaagtgtgagtttaaaatatatgcttatacattatattaaagtatgcctattaacagtttctgcagtaaataacattttttcttccagtctcaacatacataattaatcaagtgagaaaatgtgttttaatatgtcatatgaatttcagtgatattttcatccatttgctggcacttttaatgggcatgacagtgtttctgaatctgagtctcctttaattatacaagtgaagacttcttattaaaattaatataaagatattttcctatgtatgtaaataccagaacaaaaaacaagacactaattgaggagagaaaggcacttgtattctgtattacagtaagtattcagttgaggaaaagaattatttaaatatgtaaataaataatttgcacttcaaata

SEQ ID NO: 3534 - DNA, 2120 bp, Homo sapiens
gccaagcattgggtgtgcgcctgtggtcccagctactcgggaggctgaggtgagaagatcgcttcagcccgggaggtcgagtctgcagtgagctaggatcgcactgctgggccacagagcaagaccctgtctcaaaacaaacaaaaaataaattcatgtatgttagcaacaattactatttaatttaaaacttccccattccgattccatcctcaccaagcacgttccttcgcctgcagcttcggtctagagcctgagcgagccgagctgcggatgccaggggctgggtggactccgcagctaagctactgtaaaacacgcacctgcttctaccgcgggtgtacacatggtttgccagggtgtgcgcgtcttcccaaggggtctggggaccaaattccagctcccgccatcgggaggcacggtaagagaccgtaggggacacaatcccgagcaccgcagatgccgaggtctccgctgcgctccagtctgtcaacagaggcttcaggaccgcggggtcccttcaaatgccccgccagtcccaggccaatcaccgcgcagcttcttccgggatcgtcgccaatcatcggccgttgcgtattgcgggtacagaggggtaagtgaagcttcgggcccttacatctttcttgaaggcaagaagcctctcctctacttcccagacaccccgcctcccccactagaaaaagcagccgaagcggctttatttaagggcaagtgggacgatgaggccagagaagtcagaaaggctccatatttgatatggtcaaataatggcgcccttaagagcagcctgtgacaattgaagggtggtcgccatattttcagaaggcaccttccgggtcccttaacccgggtgtctatgtccaagcggccatgaagtgaataaacactgaggaattatatttgtccctatcagaatcctcgaatccctagcagccagtccctgctacttcggttgcctcggctgcgttcggacgccacggctgggcggggccgcccttcctgtggacaacgacagctgaggccgggagcggggaggcggcggctccagggacctggcggccgccgatcggggctgcgaggccccatggcgccgcccccagccccgctcctggcgccgaggcccggggagacccggcctggttgcaggaagcccgggactgtgagcttcgcggacgtggccgtgtacttctccccggaggagtggggctgtctgcggcccgcgcagagggctctgtaccgggacgtgatgcaggagacctacggccacctgggcgcgctcggattcccaggccccaaaccagccctcatctcttggatggaacaggagagtgaggcttggagccccgccgcccaggatcctgagaagggggaaagactgggaggagctcggagaggagatgtcccaaacaggaaggaagaggaaccggaggaagtcccaagagccaaagggcctagaaaggctcctgtgaaggagagtcctgaagtgctggtggaacgcaaccctgacccagctattagcgtggccccggcacgggcacagccacccaaaaatgctgcctgggacccgaccacaggagcacagcccccggcacccatacccagcatggatgctcaggccggccagcggcgccacgtgtgcacggactgcggccgccgcttcacctacccctcactgctggtcagccacaggcgcatgcactcgggggagcggcctttcccctgccccgagtgtggcatgcgcttcaagaggaagttcgcagtggaagcgcaccagtggatccaccgctcctgctccggggggcggcggggccggaggcctgggatccgggctgtgcctcgggcccccgtccgaggtgaccgggacccgcctgtgctcttccggcactacccagacatcttcgaggagtgcggctgagcggcaccgcaggctggagttgagcctgaccttggcacgaaggactgacggatccctgaggtgggccactgagtcggggactccggaactgaaattcatgccctgggctttcctcaaggatccctcaagtttccaacttgtaaaaagaaaagtgcctgtaaagattcgaatagattagacttgc

SEQ ID NO: 3535 - DNA, 1130 bp, Homo sapiens
ttctaccgcgggtgtacacatggtttgccagggtgtgcgcgtcttcccaaggggtctggggaccaaattccagctcccgccatcgggaggcacggtaagagaccgtaggggacacaatcccgagcaccgcagatgccgaggtctccgctgcgctccagtctgtcaacagaggcttcaggaccgcggggtcccttcaaatgccccgccagtcccaggccaatcaccgcgcagcttcttccgggatcgtcgccaatcatcggccgttgcgtattgcgggtacagaggggattcccaggccccaaaccagccctcatctcttggatggaacaggagagtgaggcttggagccccgccgcccaggatcctgagaagggggaaagactgggaggagctcggagaggagatgtcccaaacaggaaggaagaggaaccggaggaagtcccaagagccaaagggcctagaaaggctcctgtgaaggagagtcctgaagtgctggtggaacgcaaccctgacccagctattagcgtggccccggcacgggcacagccacccaaaaatgctgcctgggacccgaccacaggagcacagcccccggcacccatacccagcatggatgctcaggccggccagcggcgccacgtgtgcacggactgcggccgccgcttcacctacccctcactgctggtcagccacaggcgcatgcactcgggggagcggcctttcccctgccccgagtgtggcatgcgcttcaagaggaagttcgcagtggaagcgcaccagtggatccaccgctcctgctccggggggcggcggggccggaggcctgggatccgggctgtgcctcgggcccccgtccgaggtgaccgggacccgcctgtgctcttccggcactacccagacatcttcgaggagtgcggctgagcggcaccgcaggctggagttgagcctgaccttggcacgaaggactgacggatccctgaggtgggccactgagtcggggactccggaactgaaattcatgccctgggctttcctcaaggatccctcaagtttccaacttgtaaaaagaaaagtgcctgtaaagattcgaatagattagacttgccacccatctccccagtcttttgttt

SEQ ID NO: 3536 - DNA, 3547 bp, Homo sapiens
ttgagggcaaagaggttaggaagccggcatggcgctccggtcaataaaatcgatagctggaagctgcctgtgttccaggcaaaggcggtgcggtagcagcgccgccattttccccgaaggcatcttccggtgcctttcacccaagttcgggcaggagtttcctgaataacagcaaaaggtttccgttagccccgcgggcgaccaattccgattccctccgggcctccccggccacgctcagccctggtccggcaggggctcctcgatcccaggggccgccagcgcccgagggccgaggcctggacacggaaggccgtggcgccggcttctcgggtcccatggcgccaccttcggctccgctccctgcgcagggaccaggaaaggccagacccagtcggaaaaggggcaggaggccgagggctctgaagttcgtggacgtggccgtgtacttctccccggaggagtggggctgcctgcggcccgcgcagagggccctgtaccgggacgtgatgcgggagacctacggtcacctgggcgcgctcgggtgcgcaggtcccaaaccagccctcatctcctggttggaacgaaacaccgatgactgggaaccggctgctctagatccgcaggagtacccgagagggctaacagtccagagaaaaagcagaaccagaaagaagaatggggagaaggaagtattcccgcctaaggaggcaccccgaaaggggaagcgaggccggaggcccagcaaaccccgactgattcctaggcagacgtccgggggccccatctgccctgactgcggctgtaccttccctgatcatcaggccctggagagccacaagtgcgcccagaatctaaaaaagccttacccttgcccagactgtgggcgccgcttttcctatccatccctgctggtcagtcaccggcgggcacactccggcgagtgcccctatgtttgtgaccagtgtggcaaacgtttctcccagcgcaagaacctctcccagcaccaggtcatccatacaggggagaagccctatcactgccctgactgtggtcgctgcttccggaggagccggtccttggccaatcaccggaccacacacacaggtgaaaaaccccaccagtgccctagctgtggacgtcgcttcgcctacccctccctgctagccatccaccagcgtacacacacgggagagaagccctacacttgcctcgagtgcaaccgccgcttccgccagcgcacggccctcgtcatccaccagcgcatccacacgggcgagaagccctacccgtgcccggactgcgagcggcgcttctcctcctcctctcgcctggtcagtcaccggcgtgtgcactctggggagcgtccctatgcctgcgagcactgtgaggcccgcttctcccagcgcagcacgctgctccagcaccagctcttgcacaccggagagaagccctacccctgcccagactgtgggcgtgccttccggcggagcggctccctggccatccatcgcagcacgcacacagaggagaagctgcacgcctgcgacgactgtggtcgccgctttgcctacccctcactgctggccagccaccggcgcgtgcactcgggcgagcggccctatgcctgcgacctttgctccaagcgttttgctcagtggagccacctggcccagcaccagctgctgcacacgggggagaagcctttcccctgcctcgagtgtggccggtgcttccgccagaggtggtctctggctgtccacaagtgtagccccaaggccccaaactgtagccctagatctgctatcgggggctccagtcagaggggcaacgcccattagaaggggaaggactgcctacgttcatttcattttatggagggtcccagaaaagggaaggaggagccccaggtcatacagggcagagtcagaactaaacccgggtctcctgctgcacagagctgaactttgtatcttgcaatgcgctggctgcctccctgtgcgtgtctggaacagtcccattaggagaggtgacgtcatttgcttaaagttttccaagctaccctatcctaaaatagtttgtgtggatatcagggctaaaagttctccccatctattttaggggctgtctgcttttctagtctgtccacacagggattacctgtcatcttgcatgcaatcaggagaatctcataggggcaggaccttcccctactctgcctcttcctccatactaggttggaaaaatctggtttagcccactttttgcaacactcctgccaagtggtcttctacccattgcttgaaaatctctcttgacagggagctcactacctcacaaggcaggtcatttcattgtgggatctatagaaggttaagtaccacattctcctctaaaccttgcctacgacatgtttaatacttcatctacatagcagcccttcagataatcacaaccactttgcccccaagttttcaggttaagtagcatgaatttggtcattccttaaagacagggtttcaatttccacacatgatctctgcaaacaggcactgggttttcagtgtcctttttgaagggtcatataaaaataaggtaacaccacagtgccactacaccttctggggctggacttgtttcagcagctttggttgcactgaatttgggggagctgcatggtaccaggggtttattgggttgcagatatataaatgccctaaacttaaaaaaaaaaaaaaaagctataaaactaagtcttcatcttgtatttggaaaattggttcaagctgggtatgagacataagtgtagtcagctctgggagaaggttgctcttaaggagaagcagggacctgtggtttagcagcaggaagtgcaaatgggactggcttgtgctctacctggcagacctggattggcttcaggcagccagtgcctggaaaagcctggagaattgggccgtacttgaccctgattctcatcaggcacagatgaatcacaggcacctaagaatcggcacagaacttccatgaggcctcagtcagcattttttcacaaaatgagctgaggccattcaaggaggctagaaagagggaactgaatccagagaggaagagtctatagtcatcaagttgtatccatgccagcctccctccacagaggtggcagcagcgtggctcaatctgatccacctccatggcacccactgggtaggtgcttcataaagctttaccgagttaaatgtgaacaaggcctaccactttgccttgggcagctgcaccaaattagaatttccagatgtgactcatctcatattccaacagctggagtgggtcatcctttacccctgtggctccttcctacagctctcctgatctcagcacaagcaggggagcagctgggggaacacagctttatgtaattacctctgttcaatatttagcaagttgcattgtaacattgtaactgtttgtttctccttggatgatgagctacccccaagaaggggtcatatcagattgggtctcattaaaatgtctgatgaatgaa

SEQ ID NO: 3537 - DNA, 2713 bp, Homo sapiens
ggcaaagaggttaggaagccggcatggcgctccggtcaataaaatcgatagctggaagctgcctgtgttccaggcaaaggcggtgcggtagcagcgccgccattttccccgaaggcatcttccggtgcctttcacccaagttcgggcaggagtttcctgaataacagcaaaaggtttccgttagccccgcgggcgaccaattccgattccctccgggcctccccggccacgctcagccctggtccggcaggggctcctcgatcccaggggccgccagcgcccgagggccgaggcctggacacggaaggccgtggcgccggcttctcgggtcccatggcgccaccttcggctccgctccctgcgcagggaccaggaaaggccagacccagtcggaaaaggggcaggaggccgagggctctgaagttcgtggacgtggccgtgtacttctccccggaggagtggggctgcctgcggcccgcgcagagggccctgtaccgggacgtgatgcgggagacctacggtcacctgggcgcgctcgggtgcgcaggtcccaaaccagccctcatctcctggttggaacgaaacaccgatgactgggaaccggctgctctagatccgcaggagtacccgagagggctaacagtccagagaaaaagcagaaccagaaagaagaatggggagaaggaagtattcccgcctaaggaggcaccccgaaaggggaagcgaggccggaggcccagcaaaccccgactgattcctaggcagacgtccgggggccccatctgccctgactgcggctgtaccttccctgatcatcaggccctggagagccacaagtgcgcccagaatctaaaaaagccttacccttgcccagactgtgggcgccgcttttcctatccatccctgctggtcagtcaccggcgggcacactccggcgagtgcccctatgtttgtgaccagtgtggcaaacgtttctcccagcgcaagaacctctcccagcaccaggtcatccatacaggggagaagccctatcactgccctgactgtggtcgctgcttccggaggagccggtccttggccaatcaccggaccacacacacaggtgaaaaaccccaccagtgccctagctgtggacgtcgcttcgcctacccctccctgctagccatccaccagcgtacacacacgggagagaagccctacacttgcctcgagtgcaaccgccgcttccgccagcgcacggccctcgtcatccaccagcgcatccacacgggcgagaagccctacccgtgcccggactgcgagcggcgcttctcctcctcctctcgcctggtcagtcaccggcgtgtgcactctggggagcgtccctatgcctgcgagcactgtgaggcccgcttctcccagcgcagcacgctgctccagcaccagctcttgcacaccggagagaagccctacccctgcccagactgtgggcgtgccttccggcggagcggctccctggccatccatcgcagcacgcacacagaggagaagctgcacgcctgcgacgactgtggtcgccgctttgcctacccctcactgctggccagccaccggcgcgtgcactcgggcgagcggccctatgcctgcgacctttgctccaagcgttttgctcagtggagccacctggcccagcaccagctgctgcacacgggggagaagcctttcccctgcctcgagccggtgcttccgccagaggtggtctctgctgtccacaagtgtagccccaaggccccaaactgtagccctagatctgctatcgggggctccagtcagaggggcaacgcccattagaaggggaaggactgcctacgttcatttcattttatggagggtcccagaaaagggaaggaggagccccaggtcatacagggcagagtcagaactaaacccgggtctcctgctgcacagagctgaactttgtatcttgcaatgcgctggctgcctccctgtgcgtgtctggaacagtcccattaggagaggtgacgtcatttgcttaaagttttccaagctaccctatcctaaaatagtttgtgtggatatcagggctaaaagttctccccatctattttaggggctgtctgcttttctagtctgtccacacagggattacctgtcatcttgcatgcaatcaggagaatctcataggggcaggaccttcccctactctgcctcttcctccatactaggttggaaaaatctggtttagcccactttttgcaacactcctgccaagtggtcttctacccattgcttgaaaatctctcttgacagggagctcactacctcacaaggcaggtcatttcattgtgggatctatagaaggttaagtaccacattctcctctaaaccttgcctacgacatgtttaatacttcatctacatagcagcccttcagataatcacaaccactttgcccccaagttttcaggttaagtagcatgaatttggtcattccttaaagacagggtttcaatttccacacatgatctctgcaaacaggcactgggttttcagtgtcctttttgaagggtcatataaaaataaggtaacaccacagtgccactacaccttctggggctggacttgtttcagcagctttggttgcactgaatttgggggagctgcatggtaccaggggtttattgggttgcagatatataaatgccctaaactt

SEQ ID NO: 3538 - DNA, 1581 bp, Homo sapiens
atggcacaaatatcatctggtggtggtggacaaagccggtgccttctttttgctctgggttcagagatgggcagtgagaaggagcagagtccagaaccacacctgcctgaggaaggggaagggggtaagccttggagagtggatgactcagagggttcttggatcccacctggggagaaggagcatgggcaagagagcctgtcggatgaactgcaagaaactcatccaaaaaagccatggcagaaagtcactgtccgggctcgagagctaggggaccccattgctcatccaaggcatgaggcagatgagaagccctttatatgtgcccagtgtggcaaaaccttcaataatacctccaacctgagaacacaccagcggatccacactggtgagaagccttacaagtgttctgaatgtggcaagagcttctcgagaagctccaaccgcatccggcacgagcggatccacctggaagagaaacactacaaatgccccaagtgccaggagagctttcggcggcgctcagacctcaccacgcaccagcaagatcacctaggcaagcggccataccgctgtgacatctgtggcaagagcttcagccagagtgccacgctagctgtgcatcaccggacccacctggagccagcaccctacatctgctgtgagtgtgggaagagcttcagcaacagctccagctttggcgtgcatcaccgcacccacacaggtgagagaccttatgagtgcactgagtgtgggcggaccttcagcgatatctccaactttggagcacaccagcggacccacagaggggagaagccctaccggtgcactgtgtgtgggaaacacttctcccggagctcgaatctcatccgccaccagaaaactcacttgggcgaacaggctgggaaagattccagctgaaggagagccccatttagagtgagggagagagagtgagagaccctaacctattggaggaagatcttcagcatcttttgctgctaccttgacctcaagcccttcatcccactttggagaatggttttgtatagcctctgaagtcaggatctcaggaagtcctgaggagggactctggaataaaaacccttgcctctttccaggccaatttctcgtgttggaaagtcagaagacccagtcttggctttactttcttggggtgaaagagaaatagggtaggctcagaacatgctcatgttattaaggcagcagtccccctggcctttgaggaagtacttatgagatgggtgtcactgtctgaaggttctccaaattgtctgtgaactgcttaggtaggagtgcactgcagtttcctgctagttcccacctgttgtgccccaactttgcttctagatctctggggtgggaggagtgaccttctcaatggaaggggcctccttggtctggagaagagatctgaggtcccaccttagaaatgaaagggaaaccctcagggagccatgacccagggaccttcacactcccccatgtttgttacttgttatccctcccccaacctgcctctgttttccccagagtgattagcagtaaaacccttcaatg

SEQ ID NO: 3539 - DNA, 1565 bp, Homo sapiens
ttttttccagaaatacttgcagacttgaaggaattatcagtctttcattttctatcatcagtgtcctatgatagtttgtgcttccctccctcatccctttgttcatgtcactctgttcaccaacccactctgctgaaatgtcgttatttcttcaaggcccggaggaaatgctaccactctcatcagagggttcagagatgggcagtgagaaggagcagagtccagaaccacacctgcctgaggaaggggaagggggtaagccttggagagtggatgactcagagggttcttggatcccacctggggagaaggagcatgggcaagagagcctgtcggatgaactgcaagaaactcatccaaaaaagccatggcagaaagtcactgtccgggctcgagagctaggggaccccattgctcatccaaggcatgaggcagatgagaagccctttatatgtgcccagtgtggcaaaaccttcaataatacctccaacctgagaacacaccagcggatccacactggtgagaagccttacaagtgttctgaatgtggcaagagcttctcgagaagctccaaccgcatccggcacgagcggatccacctggaagagaaacactacaaatgccccaagtgccaggagagctttcggcggcgctcagacctcaccacgcaccagcaagatcacctaggcaagcggccataccgctgtgacatctgtggcaagagcttcagccagagtgccacgctagctgtgcatcaccggacccacctggagccagcaccctacatctgctgtgagtgtgggaagagcttcagcaacagctccagctttggcgtgcatcaccgcacccacacaggtgagagaccttatgagtgcactgagtgtgggcggaccttcagcgatatctccaactttggagcacaccagcggacccacagaggggagaagccctaccggtgcactgtgtgtgggaaacacttctcccggagctcgaacctcaagcccttcatcccactttggagaatggttttgtatagcctctgaagtcaggatctcaggaagtcctgaggagggactctggaataaaaacccttgcctctttccaggccaatttctcgtgttggaaagtcagaagacccagtcttggctttactttcttggggtgaaagagaaatagggtaggctcagaacatgctcatgttattaaggcagcagtccccctggcctttgaggaagtacttatgagatgggtgtcactgtctgaaggttctccaaattgtctgtgaactgcttaggtaggagtgcactgcagtttcctgctagttcccacctgttgtgccccaactttgcttctagatctctggggtgggaggagtgaccttctcaatggaaggggcctccttggtctggagaagagatctgaggtcccaccttagaaatgaaagggaaaccctcagggagccatgacccagggaccttcacactcccccatgtttgttacttgttatccctcccccaacctgcctctgttttccccagagtgattagcagtaaaacccttcaatg

SEQ ID NO: 3540 - DNA, 1935 bp, Homo sapiens
tgatcgagcggcgggagcgagggcctggacgtagtgtcttcaacagttgtaacagcagctgccatttgctgaatgacagcatgtgtcacacactctgctgagtattacaggcatttttttctaatacaaagtcttgtagtgtggaaatacttgcagacttgaaggaattatcagtctttcattttctatcatcagtgtcctatgatagtttgtgcttccctccctcatccctttgttcatgtcactctgttcaccaacccactctgctgaaatgtcgttatttcttcaaggcccggaggaaatgctaccactctcatcagagtggtttcaagaagagtgacattattcaaatggcacaaatatcatctggtggtggtggacaaagccggtgccttctttttgctctgggttcagagatgggcagtgagaaggagcagagtccagaaccacacctgcctgaggaaggggaagggggtaagccttggagagtggatgactcagagggttcttggatcccacctggggagaaggagcatgggcaagagagcctgtcggatgaactgcaagaaactcatccaaaaaagccatggcagaaagtcactgtccgggctcgagagctaggggaccccattgctcatccaaggcatgaggcagatgagaagccctttatatgtgcccagtgtggcaaaaccttcaataatacctccaacctgagaacacaccagcggatccacactggtgagaagccttacaagtgttctgaatgtggcaagagcttctcgagaagctccaaccgcatccggcacgagcggatccacctggaagagaaacactacaaatgccccaagtgccaggagagctttcggcggcgctcagacctcaccacgcaccagcaagatcacctaggcaagcggccataccgctgtgacatctgtggcaagagcttcagccagagtgccacgctagctgtgcatcaccggacccacctggagccagcaccctacatctgctgtgagtgtgggaagagcttcagcaacagctccagctttggcgtgcatcaccgcacccacacaggtgagagaccttatgagtgcactgagtgtgggcggaccttcagcgatatctccaactttggagcacaccagcggacccacagaggggagaagccctaccggtgcactgtgtgtgggaaacacttctcccggagctcgaatctcatccgccaccagaaaactcacttgggcgaacaggctgggaaagattccagctgaaggagagccccatttagagtgagggagagagagtgagagaccctaacctattggaggaagatcttcagcatcttttgctgctaccttgacctcaagcccttcatcccactttggagaatggttttgtatagcctctgaagtcaggatctcaggaagtcctgaggagggactctggaataaaaacccttgcctctttccaggccaatttctcgtgttggaaagtcagaagacccagtcttggctttactttcttggggtgaaagagaaatagggtaggctcagaacatgctcatgttattaaggcagcagtccccctggcctttgaggaagtacttatgagatgggtgtcactgtctgaaggttctccaaattgtctgtgaactgcttaggtaggagtgcactgcagtttcctgctagttcccacctgttgtgccccaactttgcttctagatctctggggtgggaggagtgaccttctcaatggaaggggcctccttggtctggagaagagatctgaggtcccaccttagaaatgaaagggaaaccctcagggagccatgacccagggaccttcacactcccccatgtttgttacttgttatccctcccccaacctgcctctgttttccccagagtgattagcagtaaaacccttcaatgaaaa

SEQ ID NO: 3541 - DNA, 1859 bp, Homo sapiens
cgctgtccctgatcgagcggcgggagcgagggcctggacgtagtgtcttcaacagttgtaacagcagctgccatttgctgaatgacagcatgtgtcacacactctgctgagtattacaggcatttttttctaatacaaagtcttgtagtgtggaaatacttgcagacttgaaggaattatcagtctttcattttctatcatcagtgtcctatgatagtttgtgcttccctccctcatccctttgttcatgtcactctgttcaccaacccactctgctgaaatgtcgttatttcttcaaggcccggaggaaatgctaccactctcatcagagggttcagagatgggcagtgagaaggagcagagtccagaaccacacctgcctgaggaaggggaagggggtaagccttggagagtggatgactcagagggttcttggatcccacctggggagaaggagcatgggcaagagagcctgtcggatgaactgcaagaaactcatccaaaaaagccatggcagaaagtcactgtccgggctcgagagctaggggaccccattgctcatccaaggcatgaggcagatgagaagccctttatatgtgcccagtgtggcaaaaccttcaataatacctccaacctgagaacacaccagcggatccacactggtgagaagccttacaagtgttctgaatgtggcaagagcttctcgagaagctccaaccgcatccggcacgagcggatccacctggaagagaaacactacaaatgccccaagtgccaggagagctttcggcggcgctcagacctcaccacgcaccagcaagatcacctaggcaagcggccataccgctgtgacatctgtggcaagagcttcagccagagtgccacgctagctgtgcatcaccggacccacctggagccagcaccctacatctgctgtgagtgtgggaagagcttcagcaacagctccagctttggcgtgcatcaccgcacccacacaggtgagagaccttatgagtgcactgagtgtgggcggaccttcagcgatatctccaactttggagcacaccagcggacccacagaggggagaagccctaccggtgcactgtgtgtgggaaacacttctcccggagctcgaatctcatccgccaccagaaaactcacttgggcgaacaggctgggaaagattccagctgaaggagagccccatttagagtgagggagagagagtgagagaccctaacctattggaggaagatcttcagcatcttttgctgctaccttgacctcaagcccttcatcccactttggagaatggttttgtatagcctctgaagtcaggatctcaggaagtcctgaggagggactctggaataaaaacccttgcctctttccaggccaatttctcgtgttggaaagtcagaagacccagtcttggctttactttcttggggtgaaagagaaatagggtaggctcagaacatgctcatgttattaaggcagcagtccccctggcctttgaggaagtacttatgagatgggtgtcactgtctgaaggttctccaaattgtctgtgaactgcttaggtaggagtgcactgcagtttcctgctagttcccacctgttgtgccccaactttgcttctagatctctggggtgggaggagtgaccttctcaatggaaggggcctccttggtctggagaagagatctgaggtcccaccttagaaatgaaagggaaaccctcagggagccatgacccagggaccttcacactcccccatgtttgttacttgttatccctcccccaacctgcctctgttttccccagagtgattagcagtaaaacccttcaatgaaaa

SEQ ID NO: 3542 - DNA, 1683 bp, Homo sapiens
ggcgctgtccctgatcgagcggcgggagcgagggcctggacgtagtgtcttcaacagttgtaacagcagctgccatttgctgaatgacagcatgtgtcacacactctgctgagtattacaggcatttttttctaatacaaagtcttgtagtgtggggttcagagatgggcagtgagaaggagcagagtccagaaccacacctgcctgaggaaggggaagggggtaagccttggagagtggatgactcagagggttcttggatcccacctggggagaaggagcatgggcaagagagcctgtcggatgaactgcaagaaactcatccaaaaaagccatggcagaaagtcactgtccgggctcgagagctaggggaccccattgctcatccaaggcatgaggcagatgagaagccctttatatgtgcccagtgtggcaaaaccttcaataatacctccaacctgagaacacaccagcggatccacactggtgagaagccttacaagtgttctgaatgtggcaagagcttctcgagaagctccaaccgcatccggcacgagcggatccacctggaagagaaacactacaaatgccccaagtgccaggagagctttcggcggcgctcagacctcaccacgcaccagcaagatcacctaggcaagcggccataccgctgtgacatctgtggcaagagcttcagccagagtgccacgctagctgtgcatcaccggacccacctggagccagcaccctacatctgctgtgagtgtgggaagagcttcagcaacagctccagctttggcgtgcatcaccgcacccacacaggtgagagaccttatgagtgcactgagtgtgggcggaccttcagcgatatctccaactttggagcacaccagcggacccacagaggggagaagccctaccggtgcactgtgtgtgggaaacacttctcccggagctcgaatctcatccgccaccagaaaactcacttgggcgaacaggctgggaaagattccagctgaaggagagccccatttagagtgagggagagagagtgagagaccctaacctattggaggaagatcttcagcatcttttgctgctaccttgacctcaagcccttcatcccactttggagaatggttttgtatagcctctgaagtcaggatctcaggaagtcctgaggagggactctggaataaaaacccttgcctctttccaggccaatttctcgtgttggaaagtcagaagacccagtcttggctttactttcttggggtgaaagagaaatagggtaggctcagaacatgctcatgttattaaggcagcagtccccctggcctttgaggaagtacttatgagatgggtgtcactgtctgaaggttctccaaattgtctgtgaactgcttaggtaggagtgcactgcagtttcctgctagttcccacctgttgtgccccaactttgcttctagatctctggggtgggaggagtgaccttctcaatggaaggggcctccttggtctggagaagagatctgaggtcccaccttagaaatgaaagggaaaccctcagggagccatgacccagggaccttcacactcccccatgtttgttacttgttatccctcccccaacctgcctctgttttccccagagtgattagcagtaaaacccttcaatgaaaa

SEQ ID NO: 3543 - DNA, 1577 bp, Homo sapiens
ccctcgcctacagaggcggcgctgtccctgatcgagcggcgggagcgagggttcagagatgggcagtgagaaggagcagagtccagaaccacacctgcctgaggaaggggaagggggtaagccttggagagtggatgactcagagggttcttggatcccacctggggagaaggagcatgggcaagagagcctgtcggatgaactgcaagaaactcatccaaaaaagccatggcagaaagtcactgtccgggctcgagagctaggggaccccattgctcatccaaggcatgaggcagatgagaagccctttatatgtgcccagtgtggcaaaaccttcaataatacctccaacctgagaacacaccagcggatccacactggtgagaagccttacaagtgttctgaatgtggcaagagcttctcgagaagctccaaccgcatccggcacgagcggatccacctggaagagaaacactacaaatgccccaagtgccaggagagctttcggcggcgctcagacctcaccacgcaccagcaagatcacctaggcaagcggccataccgctgtgacatctgtggcaagagcttcagccagagtgccacgctagctgtgcatcaccggacccacctggagccagcaccctacatctgctgtgagtgtgggaagagcttcagcaacagctccagctttggcgtgcatcaccgcacccacacaggtgagagaccttatgagtgcactgagtgtgggcggaccttcagcgatatctccaactttggagcacaccagcggacccacagaggggagaagccctaccggtgcactgtgtgtgggaaacacttctcccggagctcgaatctcatccgccaccagaaaactcacttgggcgaacaggctgggaaagattccagctgaaggagagccccatttagagtgagggagagagagtgagagaccctaacctattggaggaagatcttcagcatcttttgctgctaccttgacctcaagcccttcatcccactttggagaatggttttgtatagcctctgaagtcaggatctcaggaagtcctgaggagggactctggaataaaaacccttgcctctttccaggccaatttctcgtgttggaaagtcagaagacccagtcttggctttactttcttggggtgaaagagaaatagggtaggctcagaacatgctcatgttattaaggcagcagtccccctggcctttgaggaagtacttatgagatgggtgtcactgtctgaaggttctccaaattgtctgtgaactgcttaggtaggagtgcactgcagtttcctgctagttcccacctgttgtgccccaactttgcttctagatctctggggtgggaggagtgaccttctcaatggaaggggcctccttggtctggagaagagatctgaggtcccaccttagaaatgaaagggaaaccctcagggagccatgacccagggaccttcacactcccccatgtttgttacttgttatccctcccccaacctgcctctgttttccccagagtgattagcagtaaaacccttcaatgaaaa

SEQ ID NO: 3544 - DNA, 728 bp, Homo sapiens
ggcctggacgtagtgtcttcaacagttgtaacagcagctgccatttgctgaatgacagcatgtgtcacacactctgctgagtattacaggcatttttttctaatacaaagtcttgtagtgtggaaatacttgcagacttgaaggaattatcagtctttcattttctatcatcagtgtcctatgatagtttgtgcttccctccctcatccctttgttcatgtcactctgttcaccaacccactctgctgaaatgtcgttatttcttcaaggcccggaggaaatgctaccactctcatcagagtggtttcaagaagagtgacattattcaaatggcacaaatatcatctggtggtggtggacaaagccggtgccttctttttgctctggtgttggccatttgtgttcattctcagggttcagagatgggcagtgagaaggagcagagtccagaaccacacctgcctgaggaaggggaagggggtaagccttggagagtggatgactcagagggttcttggatcccacctggggagaaggagcatgggcaagagagcctgtcggatgaactgcaagaaactcatccaaaaaagccatggcagaaagtcactgtccgggctcgagagctaggggaccccattgctcatccaaggcatgaggcagatgagaagccctttatatgtgcccagtgtggcaaaaccttcaataatacctccaacctgagaacacac

SEQ ID NO: 3545 - DNA, 1452 bp, Homo sapiens
ctgatcgagcggcgggagcgagggcctggacgtagtgtcttcaacagttgtaacagcagctgccatttgctgaatgacagcatgtgtcacacactctgctgagtattacaggcatttttttctaatacaaagtcttgtagtgtgggtaggtatcacaattttagtgaagagggagtttaggctcagagtggttgaataatttgcagagagcgataaagatagtatgtgtcacagttgtaatccaaccctaaatgtagtcagtacccctttctttattctgtgtttcttttttccagaaatacttgcagacttgaaggaattatcagtctttcattttctatcatcagtgtcctatgatagtttgtgcttccctccctcatccctttgttcatgtcactctgttcaccaacccactctgctgaaatgtcgttatttcttcaaggcccggaggaaatgctaccactctcatcagagggttcagagatgggcagtgagaaggagcagagtccagaaccacacctgcctgaggaaggggaagggggtaagccttggagagtggatgactcagagggttcttggatcccacctggggagaaggagcatgggcaagagagcctgtcggatgaactgcaagaaactcatccaaaaaagccatggcagaaagtcactgtccgggctcgagagctaggggaccccattgctcatccaaggcatgaggcagatgagaagccctttatatgtgcccagtgtggcaaaaccttcaataatacctccaacctgagaacacaccagcggatccacactggtgagaagccttacaagtgttctgaatgtggcaagagcttctcgagaagctccaaccgcatccggcacgagcggatccacctggaagagaaacactacaaatgccccaagtgccaggagagctttcggcggcgctcagacctcaccacgcaccagcaagatcacctaggcaagcggccataccgctgtgacatctgtggcaagagcttcagccagagtgccacgctagctgtgcatcaccggacccacctggagccagcaccctacatctgctgtgagtgtgggaagagcttcagcaacagctccagctttggcgtgcatcaccgcacccacacaggtgagagaccttatgagtgcactgagtgtgggcggaccttcagcgatatctccaactttggagcacaccagcggacccacagaggggagaagccctaccggtgcactgtgtgtgggaaacacttctcccggagctcgaatctcatccgccaccagaaaactcacttgggcgaacaggctgggaaagattccagctgaaggagagccccatttagagtgagggagagagagtgagagaccctaacctattggaggaagatcttcagcatcttttgctgctaccttgacctcaagcccttcatcccactttgg

SEQ ID NO: 3546 - DNA, 1931 bp, Homo sapiens
agcagccgacgccgagaggcaccgtttcttcttaaaagagaaacgctgcgcgcgcgaggtgggcccctgtcttccagcagctccgggcctgctcgctaggcccgggaggcgcaggcgcaggcgcagtgggggtgagggcgcgtgggggcgcacagcctctggtgcacatggcttcctccccggcggtggacgtgtcctgcaggcggcgggagaagcggcggcagctggacgcgcgccgcagcaagtgccgcatccgcctgggcggccacatggagcagtggtgcctcctcaaggagcggctgggcttctccctgcactcgcagctcgccaagttcctgttggaccggtacacttcttcaggctgtgtcctctgtgcaggtcctgagcctttgcctccaaaaggtctgcagtatctggtgctcttgtctcatgcccacagccgagagtgcagcctggtgcccgggcttcgggggcctggcggccaagatggggggcttgtgtgggagtgctcagcaggccataccttctcctggggaccctctttgagccctacaccttcagaggcacccaagccagcctcccttccacatactactcggagaagttggtgttccgaggccacgagtgggcaggagcttgcagatttggaatctgagcatgatgagaggactcaagaggccaggttgcccaggagggtgggacccccaccagagaccttcccacctccaggagaggaagagggtgaggaagaagaggacaatgatgaggatgaagaggagatgctcagtgatgccagcttatggacctacagctcctccccagatgatagtgagcctgatgcccccagactactgccttcccctgtcacctgcacacctaaagagggggagacaccaccagcccctgcagcactctccagtcctcttgctgtgccggccttgtcagcatcctcattgagttccagagctcctccacctgcagaagtcagggtgcagccacagctcagcaggacccctcaagcggcccagcagactgaggccctggccagcactgggagtcaggcccagtctgctccaaccccggcctgggatgaggacactgcacaaattggccccaagagaattaggaaagctgccaaaagagagctgatgccttgtgacttccctggctgtggaaggatcttctccaaccggcagtatttgaatcaccacaaaaagtaccagcacatccaccagaagtctttctcctgcccagagccagcctgtgggaagtctttcaactttaagaaacacctgaaggagcacatgaagctgcacagtgacacccgggactacatctgtgagttctgcgcccggtctttccgcactagcagcaaccttgtcatccacagacgtatccacactggagaaaaacccctgcagtgtgagatatgcgggtttacctgccgccagaaggcttccctgaactggcaccagcgcaagcatgcagagacggtggctgccttgcgcttcccctgtgaattctgcggcaagcgctttgagaagccagacagtgttgcagcccaccgtagcaaaagtcacccagccctgcttctagcccctcaagagtcacccagtggtcccctagagccctgtcccagcatctctgcccctgggcctctgggatccagcgaggggtccaggccctctgcatctcctcaggctccaaccctgcttcctcagcaatgagctctcctccagctttggctttgggaagccagactccagggactgaaaaggagcaacaaggagagggtctgcttgagaaatgccagatgcttggtccccaggaactaaggcgacagagtgcagggtgggggcaagactgggctgtaggggagctggactactttagtcttcctaaaggacaaaataaacagtattttatgcagg

SEQ ID NO: 3547 - DNA, 1415 bp, Homo sapiens
agcagccgacgccgagaggcaccgtttcttcttaaaagagaaacgctgcgcgcgcgaggtgggcccctgtcttccagcagctccgggcctgctcgctaggcccgggaggcgcaggcgcaggcgcagtgggggtgagggcgcgtgggggcgcacagcctctggtgcacatggcttcctccccggcggtggacgtgtcctgcaggcggcgggagaagcggcggcagctggacgcgcgccgcagcaagtgccgcatccgcctgggcggccacatggagcagtggtgcctcctcaaggagcggctgggcttctccctgcactcgcagctcgccaagttcctgttggaccggtacacttcttcaggctgtgtcctctgtgcaggtcctgagcctttgcctccaaaaggtctgcagtatctggtgctcttgtctccatcctcattgagttccagagctcctccacctgcagaagtcagggtgcagccacagctcagcaggacccctcaagcggcccagcagactgaggccctggccagcactgggagtcaggcccagtctgctccaaccccggcctgggatgaggacactgcacaaattggccccaagagaattaggaaagctgccaaaagagagctgatgccttgtgacttccctggctgtggaaggatcttctccaaccggcagtatttgaatcaccacaaaaagtaccagcacatccaccagaagtctttctcctgcccagagccagcctgtgggaagtctttcaactttaagaaacacctgaaggagcacatgaagctgcacagtgacacccgggactacatctgtgagttctgcgcccggtctttccgcactagcagcaaccttgtcatccacagacgtatccacactggagaaaaacccctgcagtgtgagatatgcgggtttacctgccgccagaaggcttccctgaactggcaccagcgcaagcatgcagagacggtggctgccttgcgcttcccctgtgaattctgcggcaagcgctttgagaagccagacagtgttgcagcccaccgtagcaaaagtcacccagccctgcttctagcccctcaagagtcacccagtggtcccctagagccctgtcccagcatctctgcccctgggcctctgggatccagcgaggggtccaggccctctgcatctcctcaggctccaaccctgcttcctcagcaatgagctctcctccagctttggctttgggaagccagactccagggactgaaaaggagcaacaaggagagggtctgcttgagaaatgccagatgcttggtccccaggaactaaggcgacagagtgcagggtgggggcaagactgggctgtaggggagctggactactttagtcttcctaaaggacaaaataaacagtattttatgcagg

SEQ ID NO: 3548 - DNA, 1710 bp, Homo sapiens
agttccgggctacagcagccgacgccgagaggcaccgtttcttcttaaaagagaaacgctgcgcgcgcgagcctctggtgcacatggcttcctccccggcggtggacgtgtcctgcaggcggcgggagaagcggcggcagctggacgcgcgccgcagcaagtgccgcatccgcctgggcggccacatggagcagtggtgcctcctcaaggagcggctgggcttctccctgcactcgcagctcgccaagttcctgttggaccggtacacttcttcaggctgtgtcctctgtgcaggtcctgagcctttgcctccaaaaggtctgcagtatctggtgctcttgtctcatgcccacagccgagagtgcagcctggtgcccgggcttcgggggcctggcggccaagatggggggcttgtgtgggagtgctcagcaggccataccttctcctggggaccctctttgagccctacaccttcagaggcacccaagccagcctcccttccacatactactcggagaagttggtgttccgaggccacgagtgggcaggagcttgcagatttggaatctgagcatgatgagaggactcaagaggccaggttgcccagtagtgagcctgatgcccccagactactgccttcccctgtcacctgcacacctaaagagggggagacaccaccagcccctgcagcactctccagtcctcttgctgtgccggccttgtcagcatcctcattgagttccagagctcctccacctgcagaagtcagggtgcagccacagctcagcaggacccctcaagcggcccagcagactgaggccctggccagcactgggagtcaggcccagtctgctccaaccccggcctgggatgaggacactgcacaaattggccccaagagaattaggaaagctgccaaaagagagctgatgccttgtgacttccctggctgtggaaggatcttctccaaccggcagtatttgaatcaccacaaaaagtaccagcacatccaccagaagtctttctcctgcccagagccagcctgtgggaagtctttcaactttaagaaacacctgaaggagcacatgaagctgcacagtgacacccgggactacatctgtgagttctgcgcccggtctttccgcactagcagcaaccttgtcatccacagacgtatccacactggagaaaaacccctgcagtgtgagatatgcgggtttacctgccgccagaaggcttccctgaactggcaccagcgcaagcatgcagagacggtggctgccttgcgcttcccctgtgaattctgcggcaagcgctttgagaagccagacagtgttgcagcccaccgtagcaaaagtcacccagccctgcttctagcccctcaagagtcacccagtggtcccctagagccctgtcccagcatctctgcccctgggcctctgggatccagcgaggggtccaggccctctgcatctcctcaggctccaaccctgcttcctcagcaatgagctctcctccagctttggctttgggaagccagactccagggactgaaaaggagcaacaaggagagggtctgcttgagaaatgccagatgcttggtccccaggaactaaggcgacagagtgcagggtgggggcaagactgggctgtaggggagctggactactttagtcttcctaaaggacaaaataaacagtattttatgca

SEQ ID NO: 3549 - DNA, 458 bp, Homo sapiens
agcagccgacgccgagaggcaccgtttcttcttaaaagagaaacgctgcgcgcgcgaggtgggcccctgtcttccagcagctccgggcctgctcgctaggcccgggaggcgcaggcgcaggcgcagtgggggtgagggcgcgtgggggcgcacagcctctggtgcacatggcttcctccccggcggtggacgtgtcctgcaggcggcgggagaagcggcggcagctggacgcgcgccgcagcaagtgccgcatccgcctgggcggccacatggagcagtggtgcctcctcaaggagcggctgggcttctccctgcactcgcagctcgccaagttcctgttggaccgggcctgtcctgctgctcttttccaccctcaggtttctcactttaccaggacggcctgtgtgacttgtggcctccgagggtcctgctcccctcctcatggtctcagcgaatag

SEQ ID NO: 3550 - DNA, 1796 bp, Homo sapiens
agcagccgacgccgagaggcaccgtttcttcttaaaagagaaacgctgcgcgcgcgaggtgggcccctgtcttccagcagctccgggcctgctcgctaggcccgggaggcgcaggcgcaggcgcagtgggggtgagggcgcgtgggggcgcacagcctctggtgcacatggcttcctccccggcggtggacgtgtcctgcaggcggcgggagaagcggcggcagctggacgcgcgccgcagcaagtgccgcatccgcctgggcggccacatggagcagtggtgcctcctcaaggagcggctgggcttctccctgcactcgcagctcgccaagttcctgttggaccggtacacttcttcaggctgtgtcctctgtgcaggtcctgagcctttgcctccaaaaggtctgcagtatctggtgctcttgtctcatgcccacagccgagagtgcagcctggtgcccgggcttcgggggcctggcggccaagatggggggcttgtgtgggagtgctcagcaggccataccttctcctggggaccctctttgagccctacaccttcagaggcacccaagccagcctcccttccacatactactcggagaagttggtgttccgaggccacgagtgggcaggagcttgcagatttggaatctgagcatgatgagaggactcaagaggccaggttgcccagtagtgagcctgatgcccccagactactgccttcccctgtcacctgcacacctaaagagggggagacaccaccagcccctgcagcactctccagtcctcttgctgtgccggccttgtcagcatcctcattgagttccagagctcctccacctgcagaagtcagggtgcagccacagctcagcaggacccctcaagcggcccagcagactgaggccctggccagcactgggagtcaggcccagtctgctccaaccccggcctgggatgaggacactgcacaaattggccccaagagaattaggaaagctgccaaaagagagctgatgccttgtgacttccctggctgtggaaggatcttctccaaccggcagtatttgaatcaccacaaaaagtaccagcacatccaccagaagtctttctcctgcccagagccagcctgtgggaagtctttcaactttaagaaacacctgaaggagcacatgaagctgcacagtgacacccgggactacatctgtgagttctgcgcccggtctttccgcactagcagcaaccttgtcatccacagacgtatccacactggagaaaaacccctgcagtgtgagatatgcgggtttacctgccgccagaaggcttccctgaactggcaccagcgcaagcatgcagagacggtggctgccttgcgcttcccctgtgaattctgcggcaagcgctttgagaagccagacagtgttgcagcccaccgtagcaaaagtcacccagccctgcttctagcccctcaagagtcacccagtggtcccctagagccctgtcccagcatctctgcccctgggcctctgggatccagcgaggggtccaggccctctgcatctcctcaggctccaaccctgcttcctcagcaatgagctctcctccagctttggctttgggaagccagactccagggactgaaaaggagcaacaaggagagggtctgcttgagaaatgccagatgcttggtccccaggaactaaggcgacagagtgcagggtgggggcaagactgggctgtaggggagctggactactttagtcttcctaaaggacaaaataaacagtattttatgcagg

SEQ ID NO: 3551 - DNA, 2065 bp, Homo sapiens
attgggattagtccgctccactcactgtcagcattaagtgggggtgcccaagacggggtggatggggggcgccctccagacctctgaccacggcctcaccgccactcgacccaactatgaagagcgcccccagctgcacgccaggacacgacctttccttcccctagaaaccagtaaaggccgctgccctattcaagatgaaatgtgtggaccgcccccagcccagttgaaatttcccgtgaaagtctctcgccccttccccacagctccacttcagtggactggagggcgcaggcctttgttctgactgcttctgtctgcctgcctcccacccgacgacactcacatgcctctggtgcacatggcttcctccccggcggtggacgtgtcctgcaggcggcgggagaagcggcggcagctggacgcgcgccgcagcaagtgccgcatccgcctgggcggccacatggagcagtggtgcctcctcaaggagcggctgggcttctccctgcactcgcagctcgccaagttcctgttggaccggtacacttcttcaggctgtgtcctctgtgcaggtcctgagcctttgcctccaaaaggtctgcagtatctggtgctcttgtctcatgcccacagccgagagtgcagcctggtgcccgggcttcgggggcctggcggccaagatggggggcttgtgtgggagtgctcagcaggccataccttctcctggggaccctctttgagccctacaccttcagaggcacccaagccagcctcccttccacatactactcggagaagttggtgttccgaggccacgagtgggcaggagcttgcagatttggaatctgagcatgatgagaggactcaagaggccaggttgcccaggagggtgggacccccaccagagaccttcccacctccaggagaggaagagggtgaggaagaagaggacaatgatgaggatgaagaggagatgctcagtgatgccagcttatggacctacagctcctccccagatgatagtgagcctgatgcccccagactactgccttcccctgtcacctgcacacctaaagagggggagacaccaccagcccctgcagcactctccagtcctcttgctgtgccggccttgtcagcatcctcattgagttccagagctcctccacctgcagaagtcagggtgcagccacagctcagcaggacccctcaagcggcccagcagactgaggccctggccagcactgggagtcaggcccagtctgctccaaccccggcctgggatgaggacactgcacaaattggccccaagagaattaggaaagctgccaaaagagagctgatgccttgtgacttccctggctgtggaaggatcttctccaaccggcagtatttgaatcaccacaaaaagtaccagcacatccaccagaagtctttctcctgcccagagccagcctgtgggaagtctttcaactttaagaaacacctgaaggagcacatgaagctgcacagtgacacccgggactacatctgtgagttctgcgcccggtctttccgcactagcagcaaccttgtcatccacagacgtatccacactggagaaaaacccctgcagtgtgagatatgcgggtttacctgccgccagaaggcttccctgaactggcaccagcgcaagcatgcagagacggtggctgccttgcgcttcccctgtgaattctgcggcaagcgctttgagaagccagacagtgttgcagcccaccgtagcaaaagtcacccagccctgcttctagcccctcaagagtcacccagtggtcccctagagccctgtcccagcatctctgcccctgggcctctgggatccagcgaggggtccaggccctctgcatctcctcaggctccaaccctgcttcctcagcaatgagctctcctccagctttggctttgggaagccagactccagggactgaaaaggagcaacaaggagagggtctgcttgagaaatgccagatgcttggtccccaggaactaaggcgacagagtgcagggtgggggcaagactgggctg

SEQ ID NO: 3552 - DNA, 656 bp, Homo sapiens
ccgacgccgagaggcaccgtttcttcttaaaagagaaacgctgcgcgcgcgaggtgggcccctgtcttccagcagctccgggcctgctcgctaggcccgggaggcgcaggcgcaggcgcagtgggggtgagggcgcgtgggggcgcacagttcactgatgaggaaactgaggccctaacggcaggtggagccgggtccccgacccccgagatcggcagggcgctgaagacgtcccttccaccctccagcctctggtgcacatggcttcctccccggcggtggacgtgtcctgcaggcggcgggagaagcggcggcagctggacgcgcgccgcagcaagtgccgcatccgcctgggcggccacatggagcagtggtgcctcctcaaggagcggctgggcttctccctgcactcgcagctcgccaagttcctgttggaccggtacacttcttcaggctgtgtcctctgtgcaggtcctgagcctttgcctccaaaaggtctgcagtatctggtgctcttgtctcatgcccacagccgagagtgcagcctggtgcccgggcttcgggggcctggcggccaagatggggggcttgtgtgggagtgctcagcaggccataccttctcctggggaccctctttgagccctacaccttcagag

SEQ ID NO: 3553 - DNA, 3340 bp, Homo sapiens
tttgtctccttgcggccggcggggtgctgggttcccgtctgctgcctctcggagagtcccgggtgactgccgcaggctccatcgccctgtggcctgcaggtattgcgagatttatagggaggacgctgggacccccaaaagctgggaaatgggactattggcattcagggatgtggctctagaattctctccagaggagtgggaatgcctggacccagctcagcggagtttgtatagggatgtgatgttagagaactacagaaacctgatctcccttggtgaggatagcttcaatatgcaattcctatttcacagtcttgctatgtctaagccagaactgatcatctgtctggaggcaaggaaagagccctggaacgtgaacacagagaagacagccagacactcagttttgtcttcttatcttactgaagacattttgccagagcagggcctgcaagtttcattccaaaaagtgatgctgagaagatatgaaagatgttgtcttgagaaattacgcttaaggaatgactgggaaattgtgggtgagtggaaagggcagaaggcaagttataatggacttgacctatgctcagcaactactcatagcaaaaactttcaatgcaataaatgtgtgaaaggttttagtaaatttgcaaatctaaataaatgtaagataagccatactggagaaaaaccattcaaatgcaaagaatgtggcaatgtctcttgcatgtctttaataatgactcaacagcagagaatccatattggagagaacccgtaccaatgtaaaaaatgtggcaaagcctttaatgagtgctcatgctttactgactgtaagagaattcatgttggagagaaacattgcaaatgtgaagaatgtaataacatttttaagtcttgctcaagtcttgctgttgttgagaaaaatcatactgaaaagaaaacctacagatgtgaagaatgtggcaaagcttttaacctgtgctcagttcttactaaacataagaaaattcatactggagagaaaccatacaaatgtgaagaatgtggcaaatcctttaagttgttcccataccttactcaacacaagagaattcatagtagagagaaaccctacaagtgtgaagaatgtggcaaagtctttaaattgttgtcataccttactcaacatagaagaattcatactggagagaaaaccttccgatgtgaagaatgtggaaaagcctttaaccagagctcacatctgactgaacataggagaattcatactggtgagaaaccatacaaatgtgaggaatgtggcaaagcttttacctggttctcataccttattcagcataagagaattcatactgggcagaaaccctacaaatgtgaggaatgtggcaaagcttttacctggttttcataccttactcaacataagagaattcatactggagagaaaccctacaaatgtgatgaatgtggcaaagcttttaactggttttcatatcttactaatcataagagaattcatactggagagaaaccctacaaatgtgaagaatgtggcaaagcctttggccagagctcacacctttctaaacataagacaattcataccagagagaaaccatacaagtgtgaggaatgtggcaaagcctttaaccactctgcacaacttgctgtacatgagaaaactcatacctgagaaaaaccctacaattctaaacaatatggcatagtctttaatacctattcacaacttcacagcagaatatttttactgaataagagtgttacaaatgtaatgactgtcaaaaggccatttacagtctatgagcctttgagtgcactaaaatgtttaggctacgaacaatacaaatagaccggttcaacacctccacttatatcacagctcttactgtacacagaagaatttatactggagggaaaccctccagttgctcaaactgtattcaatttcaaagactttgtattggagagaaaccctacaaatgtaataaatgcagaaacaacatttgttcaaaaaatatacctcagaaaacaccagagtgttcacactaaaaactgttttacagatgcagtaaatgtgaaaaaatgtctaatcaaaaattacatcaaaacacatccaagaattcatagtaaaaagcactaagtcactgacactttcagacattactgtaaatctgagtgttggttatagagaataattcaaagttaagttaaagtaagtaggagattcaccttttggggaagttataattacatttcaagtataccttttggtgccaggcacggtggctctttcctatagttgctgcacttttggatgccgaggtcgggggattgcttgagcccaggagtttgggaccaggctgggcaacatggcaaaacctcatctctacaaaaagtaaaataaaagccaggcttggtggcacatgcctgttgtcccagctacttggaaggctcaggtgggaggattgcttgagcctggaggttgaggatgcagtgagctgctatctggcaacttcactcctgcctgggcaacagagcaagaccctttctcaataataataataacaacataataataaagtatactcggtgcactgaaagagttttagcttttttgaaaatcacatatttatgtaattcaagtcttaaatcacttgataccatgccttcatttctagtgtttatgtgaaggcatgaggcctactgttgctacatgaaagctgtgagagtttcttctatattcgggtgggtgttgttcatatccttttctttggaagattatggacattgcattgtaagcttcctgaagaaatttaactggagaggctctttgtacttgtcttataatagggttgtaagtgattcatgagataggtcttcagagtactattctgcattatatttaagaaagaaacatttgagttttacaagtcagttgtttttcctattgcacattaaggtaataaaattcagtggattttgaaatgctctttttagactgtttgaacttaatttgttttaataagacattgttttaatgtctttggaccgttgtacattaagtgatgcgtatcctaccaccaacgttaacctatctcaccttagttacggttgtaggtaacaaatggtaacaatacaatagtgggtaacatggtggaatagtatctctaatgatcccttctcccagtggcattaaacttcaaataatttgaaaaatattgttcccacacgttacaccttcattctgtttgctctttttgtaatgacagtgtcattattaaggctataataaagcctatataggattataatcaaa

SEQ ID NO: 3554 - DNA, 609 bp, Homo sapiens
gtcccgggtgactgccgcaggctccatcgccctgtggcctgcaggtattgcgagatttatagggaggacgctgggacccccaaaagctgggaaatgggactattggcattcagggatgtggctctagaattctctccagaggagtgggaatgcctggacccagctcagcggagtttgtatagggatgtgatgttagagaactacagaaacctgatctcccttggtgaggatagcttcaatatgcaattcctatttcacagtcttgctatgtctaagccagaactgatcatctgtctggaggcaaggaaagagccctggaacgtgaacacagagaagacagccagacactcagttttgtcttcttatcttactgaagacattttgccagagcagggcctgcaagtttcattccaaaaagtgatgctgagaagatatgaaagatgttgtcttgagaaattacgcttaaggaatgactgggaaattccatgtgaagatgtgcttgcttcccctttgccttctgccatgattctaagtttcctgaggcctccccagaagcagaagcatgtaaagcccacagaaccaattcaaagtaaaaccttgcagtggctc

SEQ ID NO: 3555 - DNA, 826 bp, Homo sapiens
agagaggaaggggcggccttggggatctggcggggcctttgtctccttgcggccggcggggtgctgggttcccgtctgctgcctctcggagagtcccgggtgactgccgcaggctccatcgccctgtggcctgcaggtattgcgagatttatagggaggacgctgggacccccaaaagctgggaaatgggactattggcattcagggatgtggctctagaattctctccagaggagtgggaatgcctggacccagctcagcggagtttgtatagggatgtgatgttagagaactacagaaacctgatctcccttggtgaggatagcttcaatatgcaattcctatttcacagtcttgctatgtctaagccagaactgatcatctgtctggaggcaaggaaagagccctggaacgtgaacacagagaagacagccagacactcagttttgtcttcttatcttactgaagacattttgccagagcagggcctgcaagtttcattccaaaaagtgatgctgagaagatatgaaagatgttgtcttgagaaattacgcttaaggaatgactgggaaattccatgtgaagatgtgcttgcttcccctttgccttctgccatgattctaagtttcctgaggcctccccagaagcagaagcatgtaaagcccacagaaccggtccagtcgtcgaccatcgagctgctttgaagaccctgcggaggttccgtcgctgcttgaacacagtgcctggactccctgctccgtgaggcgaatttacaccgggtccagctgcgtcagcccgagttctgaattaaaacatgcctcccaca

SEQ ID NO: 3556 - DNA, 2795 bp, Homo sapiens
gtttccggcgcgcgacggggcggggaccgtagcgggtgcagtccagctgctctggacgctgaggccccggcttctcttgctggggtgtcgattcgggagggctgagggcgcggccgagagaacggggcggtcaccgccgccgtggcccgcgcgtcccgcgctctccttgcagtgcaggccccagccgctctcgggcgcggcgtgggggaggcggccctgcaggtgcgtacccggggtccgacacgtgcggggcttcctgcgagctgagtccccgctgcgcgtcttcaggcctttgtaagttgtcaaatttcccaccggcccagctcatcgagcttcttcccagctgtgaacaggagggcctgttccctaattcttgccgaaattgttccaactgctggtgttctgcaagatggagccaggaggagagcccacaggtgctaaagagagcagtaccctgatggagtcccttgcagctgtgaaggctgctttcctggcgcaggccccgagtggcagccggtcagccgaggtgcaggcagctcagagcacggagcctgccgcagaggcaggcgctcccgagggagagggccacagaggggggcctccccgggcgttggggtctcttggcctttgtgaaaaccaggaagccagagagaggcccggaggttcccctcgaggcccggtcacttctgagaaaactggaggacagagtggcctcgagtcagacgtccctccgaacgcaggccccggcgcagagggcgggggcagctggaaggggcggcctttcccgtgcggcgcctgtggccgcagcttcaagtgctcctcggacgcggcaaagcaccggagcatccactcgggggagaaaccgtacgagtgcagcgactgcgggaaggccttcatccacagctcgcacgtggtccggcaccagcgggcgcacagcggggagaggccctacgcgtgcgccgagtgcggcaaggccttcggccagagcttcaacctcctccggcaccagcgcgtgcacacgggcgagaagccctacgcgtgcgccgactgcggcaaggccttcggccagaggtcggacgccgccaagcaccgccgcacccacaccggggagaggctgtacgcgtgcggcgagtgcgggaagcgcttcctgcacagctcgaacgtggtccggcaccggcggacccaccacggggagaacccgtacgagtgccgggagtgcggccaggccttcagccagagctccaacctcctccagcaccagcgcgtgcacacgggggagcggcccttcgcctgccaggactgcggccgcgccttcagccgcagctccttcctccgcgagcaccgccgcatccacaccggggagaagccccaccagtgcggccactgcgggcgcgcgttccgggcgctgtcgggcttcttccggcaccagcgactccacacgggcgagaagccgttccgctgcaccgagtgcggccgcgccttccgcctgagcttccacctcatccagcaccggcgggtgcatggcgccgagtgagccggggctgcggcggaagagatgccggcggcctggtgggcgcgaggccgaggccgggggaggctcctgtccgccccgtgcgcggtgaggaagtaacagccggctgcgcgcctggttctcgggttgcgaaagcctcgccaggcctgcatccgccttggcttgggagcaatcaggagagacagggctcggggaaggcgagcgctgcccgcgggaggcgattcccagaggcggggaggtctcaggggtctgtcccgggccggccgcccgcctctgagactccccgcctcccacggtcagctgctgcggggcagtggccggtgattgaatcggtcattcctccgcaaccaggcctccatcaaaaccctgcatgagatgagggcctcgggcttcgggttggtgaaggcggggtgggggggcagttaggaagggggcgcccagacagggcatggaagcctcgcgtcctcccccgtaccttgcgggtcggtggttcatccatgtatttcaacgccttttcacagccggttcatatggtcccgacttctgtgtgcttagaaaattatggaacttggccgggtgcggtggctcccgcctgtaatcctagcactttgggaggccgaggcgggcggatcacacggtcaagagatcaagaccatcctggccaacatggcaaaacccccatctcgactaaaaatacaaaaaattaattgggcgtggtggcgtgcgcctgtaatctcagctacttgggagcctggggcaggagaatcacttgaacctgggaggcggaggttgcagtgagcggagatctgggcactgtactttagcctgggcgacagagagacccatctcaaaaaaaaaattggaacctgagaagggggtcgtggggtccccggggcccaccgtctgcacttggcatctgaagtcggggtggtcttgtgggactgaccccttaccctgtgggttctgcactagctccgggcaattggtgacagaatcgagttaaattgtaggacatcgcgttggtgtctgagagggagttggagagctggttggtgtggagggaaaggcttacacacatgtgatttcagaagcgttctgtgggtagaggaatcgttttctctttgagactgttatgagtatgtacaaatgttatttcctgtaaaatattttcattttttaaaatgttattttctagatagaaaagtagaagtgtctctttggggagcgtttttgggggcgtatagtaaagctctgtcatcatgaa

SEQ ID NO: 3557 - DNA, 545 bp, Homo sapiens
gtagcgggtgcagtccagctgctctggacgctgaggccccggcttctcttgctggggtgtcgattcgggagggctgagggcgcggccgagagaacggggcggtcaccgccgccgtggcccgcgcgtcccgcgctctccttgcagtgcaggccccagccgctctcgggcgcggcgtgggggaggcggccctgcagaaattgttccaactgctggtgttctgcaagatggagccaggaggagagcccacaggtgctaaagagagcagtaccctgatggagtcccttgcagctgtgaaggctgctttcctggcgcaggccccgagtggcagccggtcagccgaggtgcaggcagctcagagcacggagcctgccgcagaggcaggcgctcccgagggagagggccacagaggggggcctccccgggcgttggggtctcttggcctttgtgaaaaccaggaagccagagagaggcccggaggttcccctcgaggcccggtcacttctgagaaaactggaggacagagtggcctcgagtcagacgtccct

SEQ ID NO: 3558 - DNA, 1642 bp, Homo sapiens
agcggagacgcgagggcggcgtcctgcagggaggcggggggcagcgcctggggcgctccaagctctcggccccaaggaagcccacgctcgggacccgcgtgctgccacagccccgggggcctggagggtcccgtgagccgagcgggacccgggacaagcgcgggacgccgcggggaacggacgggaacgcgcgtggccgccccacagcgggccttcgacacctcctgacacgtcctgcgggtgcccggtcctcagttggctcgagccggatcccggcgcgccaacggctcgaccttgccccccacgaggcagggcttcctgcccggcaggaaggactcggccggcgcctgcgggcaaccgatgagctgaaggcgccgcggctgggccgtcccgctctcccgccgccgagcgcgctgtcctcccgctgcccagagcgtcgccggaagtgccgagggggcgggccaggggtggagactggcgtttccggcgcgcgacggggcggggaccgtagcgggtgcagtccagctgctctggacgctgaggccccggcttctcttgctggggtgtcgattcgggagggctgagggcgcggccgagagaacggggcggtcaccgccgccgtggcccgcgcgtcccgcgctctccttgcagtgcaggccccagccgctctcgggcgcggcgtgggggaggcggccctgcaggtgcgtacccggggtccgacacgtgcggggcttcctgcgagctgagtccccgctgcgcgtcttcaggcctttgtaagttgtcaaatttcccaccggcccagctcatcgagcttcttcccagctgtgaacaggagggcctgttccctaattcttgccgagacggggtctcactatgttgcccaggctggtcaggaactcttgtaatcagtcagtcctccatcctgagccttttgaagtgctaggattacaactgtgagccacagcacccagccaaattacatttcttaattgcacttgagaaattgttccaactgctggtgttctgcaagatggagccaggaggagagcccacaggtgctaaagagagcagtaccctgatggagtcccttgcagctgtgaaggctgctttcctggcgcaggccccgagtggcagccggtcagccgaggtgcaggcagctcagagcacggagcctgccgcagaggcaggcgctcccgagggagagggccacagaggggggcctccccgggcgttggggtctcttggcctttgtgaaaaccaggaagccagagagaggcccggaggttcccctcgaggcccggtcacttctgagaaaactggaggacagagtggcctcgagtcagacgtccctccgaacgcaggccccggcgcagagggcgggggcagctggaaggggcggcctttcccgtgcggcgcctgtggccgcagcttcaagtgctcctcggacgcggcaaagcaccggagcatccactcgggggagaaaccgtacgagtgcagcgactgcgggaaggccttcatccacagctcgcacgtggtccggcaccagcgggcgcacagcggggagaggccctacgcgtgcgccgagtgcggcaaggccttcggccagagcttcaacctcctccggcaccagcgcgtgcacacg

SEQ ID NO: 3559 - DNA, 5041 bp, Homo sapiens
accgtcccgccgaccaccgaagggggcatcagagaccctcggagaaaccaagcccagggaggagcttggaaggcaaggagaagggattcctggtcacctcccttgctcttttcttcctggatgaaacaagaagataatcagggtgtctgtgcacaccaggactcagaagacaaagggatgggttctgattttgaggactctgaggacagggaaggggacccagaagaaagagaaatgggctctaatccacatgacacaaacaagagagaaggccatccggagccggagatgggctccaacccacaggactcaaggcacagggaagcagtgcccgacatctgcacagaggggcagctgagtgaggaagaaggcgtttctgtccgtggggaagaggatgaccaatccggtgtagctgacatggcgatgttcccaggactgtctgagtctgacagcatatcccggagcctccgggaggacgacgacgagagtgctggggagaaccggctggaggaggaagaggagcagccggcccctcccgtacttccctggaggcgacatctctccctggggagtcggcaccgaggtgacaagcccgcccaccgccgcttccaccggctccaccaccccatggccgtggacctcggggagctggatagcctggtggccagcatcatggacgcgcccaccatctgccccgactgcggggagagcttcagtcctggcgccgccttcctgcagcaccagcgcattcaccgcctggctgaggccgctgccgccgccagcctggagcccttcggcctggcgggcgagtgcgacgcgatggtgggcatgatgggggtgggtgtggcggggggcttcggggccgggcccccgctggcccggcccccgcgcgaaaagcccttccgctgcggggagtgcggcaagggcttcagccgcaacacctacctgaccaaccacctgcgcctgcacacgggcgagcggcccaacctgtgcgccgactgcggcaagagcttcagctggcgcgccgacctgctcaagcaccggcgcctgcacacgggcgagaagccctacccgtgccccgagtgcggcgaggccttcagcctcagctcgcatctgttgagccaccggcgcgcgcacgcggcggccagcggcgcgggggcggcggcgctgcggcccttcgcctgcggggagtgcggcaagggcttcgtgcgccgttcgcacctggccaaccaccagcgcatccacacgggcgagaagccgcacggctgtggcgagtgcggcaagcgcttcagctggcgctcggacttggtgaagcaccagcgcgtgcacacgggcgagaagccctacatgtgctccgagtgcggcgagaccttcagcgtcagctcgcacctcttcacgcacaagcgcacgcactcgggtgagcggccctacgtgtgccgcgagtgcgggaagggcttcgggcgtaactcgcacctggtgaaccacctgcgcgtgcacaccggcgagaagcccttccgctgtggccagtgcgagaagcgcttcagcgacttctccacgctcacgcagcaccagcgcacgcacacgggcgagaagccctacacgtgcatcgagtgcggcaagagctttatccagagctcccacctgatccgccaccgccgcatccacacgggcaacaagccgcacaagtgtgcgggctgcggcaaaggcttccgctataaaacgcacctcgcgcagcaccagaagctgcacctgtgttaggggctgggtccgcgggaggctgccgtctggggagcctgtggggggtagatatcctgggactgacccaggggaaggaagtggggaaggggcgggagggacaatctgagagtgactggggagcctttggtgtttggggtttcctgaagtgggaggagtgttgagtaagttggtctttcccggtgctatacttgcctcctctccacggaagaattgttcaggagatgcgcttggggtgatgacttccttaaatacacgctgtagggggtgaagagcttggaggaccaggcactttgaggaagggcagttcgtgggctggggtgggaacaggatggcgggcaatagactagggtaggccgcgatggcctgtagaaggttgcggggagagggtttaaatgagggttatggggcgaaataaaaccaagtataagtgattctatcttggtcccaccaagagtttgcccgatctccacacatcacctgttgtctcacaaaaagtaggggaaccttgtcagtcacataggacaggatatttaatgtacttttcctttctctgagccacagttagctgctattttgaggcatccaaggggaagtgggctgaaaaacgccacactcatttcaaggggcaatgtctggggtttagaaattcatttataactggttctctgatgtgggaaatcctgattctgtcccgggttctttgctacttccttgaaaatactctagcttcatgctgggtcaaggtggtttacctggatgacccccctcccccgccctcgcccatcccaggtgtgtgccacacccagtatttctttcaggtctcaactgtggtgttttaagtgcagggaaaaggaacaatcacagctatgtgtgactttccttttcccacctcaccttgatgtaggtgtttcaagtgaactttagaccaacagttgcccagtgacctgctaaaaagtcaactagctcagagttttgctggcctttatgtgagaaatccaagaaagtgttcacttttttgggatgcgagactccttggtctcatttgccttcactttgcatttgttagtgacctccactaacccccacttccatgcatattgacgagggatctagtctaagtaagaatgtcttttgcctgcgcgtggaggcacagtagaaatctcaaggctttacccagaagagcccagtcagggagaggtgtaaatgcaaaattgccaaatagcacaaacaatgaatgttttctggttgttatatagatgccaaaatagcactttgatatttgcaaagtgctttatgctttttaataattgttagctgtttctcacatcattgtgagttagatcagtattatgaccgctgtcttagggaaggcctgggaacaggagtgtgcaggctgtcctgaagagaggctgaggacagtgtgaataattgtagcctgaccttttgcattctccagctcagctgctaggaagacttacttgtcatgatttatataataaaattaaggacactgaaaattcttatgcttgatgaaaaacttaaggctagcctagaagggccaaacatgtccttattgacaaagctggtctttgtcgcctaattagggtatcctagctatgttccatttctagtaaggggctgtagttagatgactcttgtatagatttcagttacttatgctgaagatccctgtgctaggttagcctttagaagttagagttgtggaaagcagtattgttttcttctctagtgattgttaccctacacatttcatggaagcatcttcacaaaatatcagacacagtggaagggggaaaaaaagctacgagattgtttttacacttttagcaaagtttctgtggatgctagtaatttatacttgatcagttgtattctagtaaagaacctctttggggactgtaggaaagcatgtttttgtggttataaaaacacttaaaaatcctgataattctgggcttgtataatgcctgttgatcttgccctcttaatcagtttattgttattcacaaatgcaaataggttttcaaactacagacagttttgaaagacattaattctcattttcttctagtcaggagtaatacaagcaaacaagtgtccgttttgaattctgatttgtaatctgaatactaaacatattagacccacctgaaaataatatagccaatttctaggtaatcttactgctttgtgggtttctttccatgtacatctacctcttccagctgttttaagttttctcaagtctgtgcctatgaaatctcatccaacttttgattattcatggattgattatccgctttttttttgcttttttgctgccattgctatgcctggtctcgtctgcatcaaatatactacatatcagcaactttagagaatgggttcaacagggagtggagagtgaagctaatgtaaaatagtttagtggcagtgggaatctttggacttcatttacctctctcattatttctattaccatggataaaaaagtcagctgctacgttgatatcccttctatgagcacattcttagcagaagaaaacaatccaactaccaacacccgactctattggtgcatttaaaatgtgattccattttttcttacaattcttcagggaacttacctgcattaagtgaggttaaatgcattcaggaggttgtttgtttcttctatctagttttagaataatatttcttcggcaaaccctgctaactgcggttcacccttgaaaacgttaatctgaggactttttccaccaactcattaatgatggtggaagcaagtgtattatttgtttcctggagaatttgatgaagagcagtcttcctctgctgccctttactaagcaaaacctggagcaatttaaataggctaaatggttttgattaaatcttgagctccgagttggaaggagaaaatgagaagttaaccccttgagccatgtggtctctttacaatcaagagactgtacatatgtgaaaaaatacaaattaaggacctgtgttcatagacaatctaaactgtgtttctgaagtttgtgcacatttttcttcactgtaatgttattttacagctgtttgttaaaatagtgaataatttaatgatcctaaaagtaacaggtttcgtgtgagtgtgcttgtatacgtgagatttgccttattttcaggttgttttatttaacgatggttccttggacagcattctggtgttcagcaaccaatatggaatatttgtcattaaatccatatcagtctttta

SEQ ID NO: 3560 - DNA, 3129 bp, Homo sapiens
atggaggaagaaagaaaaactgctgagttacagaaaaatagaatacaggactcagtagtctttgaggatgtggctgtggactttacccaggaggaatgggctttgctggatcttgctcagagaaacctctacagagatgtgatgctggaaaacttccagaacctggcctcactagggtatccgctacacacaccccatctgatctcccagtgggaacaagaggaggacctgcagacagtgaagagagaacttatccagggcatctttatgggagagcaccgggaaggttttgagactcaacttaaaactaatgaatcagttgcttcacaagatatttgtggagaaaaaatatccaatgaacagaaaatagtaagattcaaaaggaatgattcctggttctccagtttacatgaaaaccaggagtcctgtggtattgattatcagaacaaaagccatgagagacatttgagaaatcatatggtagagaacatctatgaatgttatgaagaaaatcaagatggacagactttcagccaagttccaaatcttgattcactcaagagaaatactgaagtaaaatcctgtgaatgccatgagtgtggaaaggccttcgtggatcattcatcccttaagagtcacatcaggtctcatactggaagcaaaccctatcagtgcaaggaatgtgggaaggccttccattttcttgcttgtttcaagaagcatatgaaaacccccactgaagagaagccctatgaatgtaaggaatgtaccaaagccttcagctgttcctcattctttagggcacatatgaagattcacatcggaaagacaaactatgaatgtaaagaatgtgggaaaggttttagttgttcctcatcgctcacagaacacaaaagaattcacagtggagataagccttatgaatgtaaggaatgtgggaaggccttcagttgttcctcctcactctccaaacacaaaagaattcacagtggagataagccatatgaatgtaaggaatgtgggaaggcctttagctcttcctctcaccttataatacatataagaattcacactggagagaagccttatgaatgtaaagagtgtgggaaggccttcagcgagtcctcaaaactcactgtacatgggaggacacatactggagagaaaccctataaatgtaaggaatgtgggaaagcctacaattgtccctcctccttaagtatccatatgagaaaacacactggagaaaaaccgtatgaatgtctggaatgtggaaaggccttctaccttcccacttcccttaatacacatgtgaaaaatcaaagtcgagagaaaccctatgaatgtaaggaatgtgggaaggcctttagttgtccctcgtcctttagagcacatgtgagagatcacactggaaagatacagtatgaatgtaaggagtgtgggaagacctttagtcgttcctcatccctcaccgaacacctaagaactcacagcggagagaagccgtatgaatgtaaagaatgtgggaaagcctttattagttcctcccaccttacagtacatatcagaactcacactggagagaaaccctatgaatgtaagaaatgtgggaaagcctttatttatccctcagcccttaggatccacatgagaacgcacactggggaaaaaccctatgaatgtaaggaatgtgggaaagcatttcgtcattcttcataccttactgtacatgcaagaatgcacactggagagaaaccctttgaatgtctggaatgtggaaaagctttcagttgtccctcatcctttcgaaggcatgtgagaagccacactggagagaaaccctatgaatgtaaggaatgtgggaaagcctttgtttgtcctgcctactttcgaaggcatgtgaaaactcacactagagaaaacatataaatgtaaggaatatgggaatgtctgcaaagcttcagatcctaggcaacatgtgagatctcatactgtggagacaccctatgaatgtaagaaagtaggaaattgttgctcatcgttttgaagatttgaggacactttagagaaaccctgtgtatgtaagtcatgtgctaaagcctttatgaacattgcttattatgtataagaaaatctctactagaaatgaagatcagtgcctcatccttaaagtagaatgctggctcgttgattaccagtgttttctgataggaacattgaaggtgataaatttaccttttcagctctagccacatactttttagtatgaggtgctttaattttggttctgatgtaaatatgatttccattacaaaatcttttggatcatggaggacacgaaatattttttctgtataggcagcagtggtcttttttaaaaaagtggtttctaattaatgttcattgttctttaaatgggtagtcgttataatattgacaaaccaatataatattgacaaaccaaaaaccaaatattgatttttgttgatgttttgtttttagtctacatggcagataatggaacttgcccactcaatatttttcttcctattcttttttgctaagagacgttagagtttctgagatgataaatttttactattaaaagcttttattgtctagtgagtaatttcagcagaaattaatttaatatactatttttatattttattctttgtccttgctcgtggctgggaattggatccagtgttttgagtgtaaaaattgtgttacattaactacatttcccagaatcacttttttctccagttctaggttagacttgtctaaaataagagtttgtacgagatttggaaggcataagggaagaaaaagctgttatgctatgtttagtggggccatcagacagagagacagatgtataaaggcctggtgacctctagttttcagctcatttttctgactgttggactcattgatcaatatttgctcaaaactgaatgttatagctggacgtgatggtgcatacctgtggtcccagctactcagggagctgaggctggaggatcacttgagcccaggagtttgaggctgcagtgaactatgatcatgccactgcactccagcctgagtgatagagtgagaccctttctcaaaaacaaaacaaaa

SEQ ID NO: 3561 - DNA, 2865 bp, Homo sapiens
cggaaatggagggggtcgctttcctcaccttcctcgctgcgcgggcggcggttggtaaccggtcagaccagcccgagagggacctggtgcctgtacccaggcttctgtcgctctgtcgcctgcgctatgccctgctgtagtcacaggagctgtagagaggaccccggtacatctgaaagccgggaaatggacccagtggcctttgaggatgtggctgtgaacttcacccaggaagagtggacattgctggatatttcccagaagaatctcttcagggaagtgatgctggaaactttcaggaacctgacctctataggaaaaaaatggagtgaccagaacattgaatatgagtaccaaaaccccagaagaagcttcaggagtctcatagaagagaaagtcaatgaaattaaagaagacagtcattgtggagaaacttttacccaggttccagatgacagactgaacttccaggagaagaaagcttctcctgaagtaaaatcatgtgacagctttgtgtgtgcagaagttggcataggtaactcatcttttaatatgagcatcagaggtgacactggacacaaggcatatgagtatcaggaatatggaccaaagccatataagtgtcaacaacctaaaaataagaaagccttcaggtatcgcccatccattagaacacaagaaagggatcacactggagagaaaccctatgcttgtaaagtctgtggaaaaacctttattttccattcaagcattcgaagacacatggtaatgcacagtggggatggaacttataaatgtaaattttgtgggaaagccttccattctttcagtttatatcttatccatgaaagaactcacactggagagaaaccatatgaatgtaaacaatgtggtaaatcctttacttattctgctacccttcaaatacatgaaagaactcacactggggagaagccctatgaatgtagcaaatgtgataaagcatttcatagttctagttcctatcatagacatgaaagaagtcacatgggagagaagccttatcaatgcaaagaatgtggaaaagcatttgcatataccagttctcttcgtagacatgaaaggacccactctgggaaaaaaccgtatgaatgtaagcaatatggggaaggcttatcctatcttataagttttcaaacacacataagaatgaactctggagaaagaccttataaatgtaagatatgtgggaaaggcttttattctgccaagtcatttcaaacacatgaaaaaactcacactggagagaaacgctataaatgcaagcaatgtggtaaagccttcaatctttccagttcctttcgatatcatgaaaggattcacactggagagaaaccctatgagtgtaagcagtgtgggaaagccttcagatctgcctcacagcttcgagtgcacggtgggactcacactggagagaaaccctatgaatgtaaggaatgtgggaaagccttcagatctacctcacaccttcgagtgcatggtaggactcatactggagagaaaccctatgaatgtaaggaatgtgggaaagccttcagatatgtgaagcaccttcaaattcatgaaaggacagaaaaacacataagaatgccctctggagaaagaccttataaatgtagtatatgtgagaaaggcttttattctgccaagtcatttcaaacacatgaaaaaactcacactggagagaaaccctatgaatgcaaccaatgtggtaaagccttcagatgttgcaattcccttcgatatcatgaaaggactcacactggagagaaaccctatgagtgtaagcaatgtgggaaagccttcagatctgcctcacaccttcgaatgcatgaaaggactcacactggagagaaaccctatgagtgtaagcaatgtgggaaagccttcagttgtgcctcaaaccttcgaaagcatggtaggactcacactggagagaaaccctatgagtgtaagcaatgtgggaaagccttcagatctgcctcaaaccttcagatgcatgaaaggactcacactggagagaaaccctatgaatgtaaggaatgcgaaaaagcattctgtaaattctcttcttttcaaatacatgaaaggaagcacagaggagagaagccctatgaatgtaagcattgtgggaatggattcacatctgccaagattcttcaaatacatgcaagaacacacattggagagaaacactatgaatgtaaggaatgcggaaaagcattcaattatttttcttccttgcatatacacgcaaggactcatatgggagagaagccatatgaatgtaaggattgtgggaaagcattcagctagcctggttccttttatggacatgaatagactcacactggaaggaagcactatgaatgcaagcaatgtggcaaaactttcacattttccagttcttttcgatatcatgaaaggactcacactggggagaaaccctatcaatgtaagcagtgtgggaaagccttcattccttttacttcttttcaatgtcatgaaaggactcacacgggagagaaaccctatgagtgtattctagttccgtttgatatcatgaaaggacttacactggagtgaaaccctatgaatgtaagcaatgtgggaaagccttcagatgtgcctcgcaccttcaacggcatggaagggttcacacttgggagaaactctatgaatgtaagcagtatgggaaagccttcagatctgccaagattctttgaatacagataattaatgtaaacaattatcataagtatactaacatgttattctttttaaataagaaggtataataaaatatcccattggttttatgtatta

SEQ ID NO: 3562 - DNA, 2610 bp, Homo sapiens
atcccgtggagtgaaggtcgcaccgcggcgtagagatggggtttctccatgttggtcaggatggtctcgaactcccgacatcaggtgatccgcctgcctcggcctcccaaagtgctgggattacaggtgtgagccaccgcactcagcctccctgttttgaaggattgacttctaaagacttggtacgtgaggaaaaaacacggaagaggaagaggaaagcaaaggagtcagggatggctcttcttcagggtctactgacattcagggatgtggccatagaattctctcaggaggagtggaaatgcctggaccctgctcagaggactctatacagagacgtgatgctggagaattataggaacctggtctccctggatacctcttccaaatgcatgatgaagatgttctcatcaacaggacaaggcaatacagaagtggtccacacagggacattgcaaatacatgcaagtcatcacattggagatacttgcttccaggaaattgagaaagatattcatgactttgtgtttcagtggcaagaaaatgaaacaaatggccatgaagcactcatgacaaaaaccaaaaagttgatgagtagtacagagcgacatgatcaaaggcatgctggaaacaaacctattaaaaatgagcttggatcaagctttcattcgcatctgcctgaagtgcacatatttcaccccgaagggaaaattggtaatcaagttgagaaggctatcaacgatgctttctcagtttcagcatcccaacgaatttcctgtaggccaaaaactcgtatttctaataagtataggaataatttcctccagtcttcattactcacacaaaaacgggaagtacacacaagagaaaaatctttccaacgtaatgagagtggcaaagcctttaatggtagctcactcttaaaaaaacatcagataatccatttaggagacaaacagtataaatgtgatgtatgcggcaaggactttcatcagaagcgataccttgcatgccatagatgtcacactggtgagaatccttacacgtgtaatgagtgtggcaagacattcagtcacaattcagccctgttagttcacaaggcaattcatactggagagaaaccttacaagtgtaatgaatgtggcaaggtttttaatcaacaatcaaaccttgcacgtcatcatagagttcatactggagagaaaccttacaaatgtgaagaatgtgacaaagttttcagtcgcaaatcacaccttgaaagacataggagaattcacactggagagaaaccatacaaatgtaaggtttgtgacaaggctttcagacgtgattcacacctggcacaacatactgtaattcacactggagagaaaccttacaagtgtaatgagtgtggcaagacctttgttcaaaattcatctcttgtaatgcataaggtcattcatactggagagaaacgttacaagtgtaatgaatgtggcaaggtttttaatcacaaatcaaaccttgcatgtcatcgtagacttcatactggagagaaaccttacaagtgtaatgaatgtggcaaggtttttaatcgaaaatcaaaccttgaacgtcatcatagacttcatactggaaagaaatcttagaagtgtaaatttgcaaggtttttaggcaacagtcaaaccttgcatgtcatcatagactttatactggagagaaaccttacaaatgtgaagaatgtgacaaaagttttcaatttcaaatcactccttgaaatacataggagagttcatactggagagaaaccatacaaatgtaaggtttgtgacaaggatttcgggtgtgattcacacctggcccaacatactggaattcacactggaaaggaactgtacaagtgtaatgagtgtggcagagcctttggtggtcagtcaacacttactcaccatcaagcaatccatggtatagggaaacttgactaatgtaatgattgtcacaaagtcttcagtaatattacagccattgcaaaacattggagaatccataatgaaggaggtcttacaagtgtaataaatgtggcaagtttttcagacatcattcataacttgcagttcattggcgatcttatacaggagagaaatcttacaaatgtgatgattgtggcaaggtcttcagtcaagcttcatcttttgcaaaacgggagaattcatacaggagagaaacctcacaagtgtgatgattgtgagcaaagcctttacttcacgttcacaccacattagatatcagaggatccatactggacagaaatcttacaaacgtcctatgtgtggcaaggtcttcagtccgaggttactccttgcagaatatcataacgttcatttttgaggtaatagttacaaatgcggtgagcacagcaaaccatcaaggattgacagtagagtcaattcagaattgacttgagtttgagttgacttaaaacattcagttgaagcattaattgacattaaagtgtttatgttaagaggattgggccaggcgtgtggctcacgcctgtaaatccagcactttaggagcccaaggtggatagatcacttgaggtcatgagtttgagatcagcctggccaa

SEQ ID NO: 3563 - DNA, 5244 bp, Homo sapiens
gcacacatccgcgcagaccaggaagcggatcccgtggagtgaaggtcgcaccgcggcggattgacttctaaagacttggtacgtgaggaaaaaacacggaagaggaagaggaaagcaaaggagtcagggatggctcttcttcagggtctactgacattcagggatgtggccatagaattctctcaggaggagtggaaatgcctggaccctgctcagaggactctatacagagacgtgatgctggagaattataggaacctggtctccctggatacctcttccaaatgcatgatgaagatgttctcatcaacaggacaaggcaatacagaagtggtccacacagggacattgcaaatacatgcaagtcatcacattggagatacttgcttccaggaaattgagaaagatattcatgactttgtgtttcagtggcaagaaaatgaaacaaatggccatgaagcactcatgacaaaaaccaaaaagttgatgagtagtacagagcgacatgatcaaaggcatgctggaaacaaacctattaaaaatgagcttggatcaagctttcattcgcatctgcctgaagtgcacatatttcaccccgaagggaaaattggtaatcaagttgagaaggctatcaacgatgctttctcagtttcagcatcccaacgaatttcctgtaggccaaaaactcgtatttctaataagtataggaataatttcctccagtcttcattactcacacaaaaacgggaagtacacacaagagaaaaatctttccaacgtaatgagagtggcaaagcctttaatggtagctcactcttaaaaaaacatcagataatccatttaggagacaaacagtataaatgtgatgtatgcggcaaggactttcatcagaagcgataccttgcatgccatagatgtcacactggtgagaatccttacacgtgtaatgagtgtggcaagacattcagtcacaattcagccctgttagttcacaaggcaattcatactggagagaaaccttacaagtgtaatgaatgtggcaaggtttttaatcaacaatcaaaccttgcacgtcatcatagagttcatactggagagaaaccttacaaatgtgaagaatgtgacaaagttttcagtcgcaaatcacaccttgaaagacataggagaattcacactggagagaaaccatacaaatgtaaggtttgtgacaaggctttcagacgtgattcacacctggcacaacatactgtaattcacactggagagaaaccttacaagtgtaatgagtgtggcaagacctttgttcaaaattcatctcttgtaatgcataaggtcattcatactggagagaaacgttacaagtgtaatgaatgtggcaaggtttttaatcacaaatcaaaccttgcatgtcatcgtagacttcatactggagagaaaccttacaagtgtaatgaatgtggcaaggtttttaatcgaaaatcaaaccttgaacgtcatcatagacttcatactggaaagaaatcttagaagtgtaaatttgcaaggtttttaggcaacagtcaaaccttgcatgtcatcatagactttatactggagagaaaccttacaaatgtgaagaatgtgacaaaagttttcaatttcaaatcactccttgaaatacataggagagttcatactggagagaaaccatacaaatgtaaggtttgtgacaaggatttcgggtgtgattcacacctggcccaacatactggaattcacactggaaaggaactgtacaagtgtaatgagtgtggcagagcctttggtggtcagtcaacacttactcaccatcaagcaatccatggtatagggaaacttgactaatgtaatgattgtcacaaagtcttcagtaatattacagccattgcaaaacattggagaatccataatgaaggaggtcttacaagtgtaataaatgtggcaagtttttcagacatcattcataacttgcagttcattggcgatcttatacaggagagaaatcttacaaatgtgatgattgtggcaaggtcttcagtcaagcttcatcttttgcaaaacgggagaattcatacaggagagaaacctcacaagtgtgatgattgtgagcaaagcctttacttcacgttcacaccacattagatatcagaggatccatactggacagaaatcttacaaacgtcctatgtgtggcaaggtcttcagtccgaggttactccttgcagaatatcataacgttcatttttgaggtaatagttacaaatgcggtgagcacagcaaaccatcaaggattgacagtagagtcaattcagaattgacttgagtttgagttgacttaaaacattcagttgaagcattaattgacattaaagtgtttatgttaagaggattgggccaggcgtgtggctcacgcctgtaaatccagcactttaggagcccaaggtggatagatcacttgaggtcatgagtttgagatcagcctggccaacagacgtgagtcacttttcccagcctgctttttgtttctttaacaaaaaccaataggggtttttataggtattgtgttgaatctgaatcacattggcttatataataacaatattgatttttccaaaccatcaatgtgggttgtatatatatgtttttaatcattttggttaatgtttgtagatttcaaggtgtgaaattctcagtttttttatgtttattcctaagtatttcttactttaagatctctagcaaatggaagtgttttttaattttcgtttaaattttttattgtttatggaaattcaattaatttttggtgctgctattgcattgtgcaaatccactgaatgtgttgattagttccagtagtattttggttgactcaggccccgcccacctcttcgcctcccgtctggcctgacccaggccccgcccacctcctcgggggtctccccgcgggtctggcttctgtactgtgctgattggcacagacccggaagctgatggcatggactgaaggttgccccgttgagtttgcgcttcccagttctctggtactgctataccggggacgtgggtgtctccacagacctggaaattccggcccctctttctcaactcagagcaaattgagacgtccgggtgggagtccgtgagtcttttccttttgagtttaaagtcgccctgaggctggtcccgtcccggtcttttctgcagtagggccgtgcagacacctcctgtagcgaaactttccttctcaaaacccttcccgacccgtcctcccgcctcgcgctgtttcaggtcctcaccagcgagttggactctcgccctgggctcctcatcggcgcctggagggcagcgctgcagccccactcccgggaaggccgcgtcctctgcctggtcctgggatcctgcagaccccacccctgtccgaaggcgccatcgcccaccacctccctcctcgtgccggccctgcttctccccagttccaaccccaggaaaacgtgcttctcctggaggcaaccctctttttccaccctcgccctgttgttcccggaaggcaggcctggaatgtgaagtttccaggtagatggatattaaacatagaattgaagaaaaaaaaaaaaaccccacaaagtaacaaaagaatgaagcggcgaaagcagaaatttactcaaccaagaaagcaccccacagggtgggggtgggcccaagcgagcgtctccagggccccatttacaaagtttttggaggttatttttttttgaggtccctatgggctaccccttatctggatgaagaatttggcccttggccaaggaaataactgaggtaaattggcctgaggccagagcagatgggtgccctatgcagatgaaggggtggccggtgcttggccttggccactcctgggctctttctctttccacctgcgacctggtggaagggggagggtgttagggagagtagcctttgatcctttgttactttgggtgggaagatggggtttttccttttagtctagttttggaaagttcgcgttaattggttttagattccctgcctccctagacccaggacccatgtggttttttttgtttttgtttttgtttttttgatggagatggggtcttactctgctgcgcaggccgaagagcggtgaccggatcacagctcactgcagcttcaacctcctgggctcaagggatcctcccacctcagcctgcagagtagctgggaccacagccgcgcgccaccacaccgcgccaatttttgtgttcttggtagagaccgggttttgccttgttgtctaggttgggctccaactgcagggctaaagcgatccaagagcatcagcctcccaaagtgctgggattacaggcttgagccaccatgcccgccttatttcttaatttaaaaaaaaaaatgtatatgtagactgaacgcggtggctcatgcctgtcatcccagcactttgtgaggccgattctcctctatccaggagacgggtttcaccattttgccaggtttgtctcaaactcctcggcttaactgatccgcttgctttggccttccaaagtgctaggattacaggagtgagccaccacacgtagccagtcctggcattttgtagaaggatggccaacgcagcctgttgacccttcctggccatcacatgaaaatcagcgactcttccttcttacaaaactcggagcttctcaggataacttggtgaaacgtcccccgctgtgaacctcagtgagcccacctgtaatatacaggtgagggagaagaccagaaaagctcagtcagagtgacactgacccctgaaatgatgggcacaatggagtgtgtggcttttcctgtaggacagggaggtatttagttgtagtttgaactttaaaggattccagtcctccgaaaaacaggattagactcaaatcaccttgaaccttatcatctcatggctttgacccacctacatggctccgtgtcccctgcaggcctcgccccggagctctacaatcctgtgtgcagttgtctccgcagctctctgctgggacatcaaacaggcatctccaccttcatgtgtctataagtgacttcctaaacccccaaacacattcccttacagtcctacacatctcagatgagggtgacagtgtacttctgggtgcttagctgaggttgacaccatgtattttaaatatggaaaataaattacattatttgtaa

SEQ ID NO: 3564 - DNA, 5538 bp, Homo sapiens
gtctcaacctttaggcgcctgaagcgcaaacgtcgcgatcccagtctcagggaggccgagttctctgcctggtgctgggatcttgtggaccccaccgaaggcgtcgtcgcaccccacctcccgcctcatgctgggccttgctgcaccccaagtctccccttagcagtcaccactttccttgagccagcgttggggaggtgccaggggccagtcctgtgacacgagatggggtttctccatgttggtcaggatggtctcgaactcccgacatcaggtgatccgcctgcctcggcctcccaaagtgctgggattacaggtgtgagccaccgcactcagcctccctgttttgaaggattgacttctaaagacttggtacgtgaggaaaaaacacggaagaggaagaggaaagcaaaggagtcagggatggctcttcttcagggtctactgacattcagggatgtggccatagaattctctcaggaggagtggaaatgcctggaccctgctcagaggactctatacagagacgtgatgctggagaattataggaacctggtctccctggatacctcttccaaatgcatgatgaagatgttctcatcaacaggacaaggcaatacagaagtggtccacacagggacattgcaaatacatgcaagtcatcacattggagatacttgcttccaggaaattgagaaagatattcatgactttgtgtttcagtggcaagaaaatgaaacaaatggccatgaagcactcatgacaaaaaccaaaaagttgatgagtagtacagagcgacatgatcaaaggcatgctggaaacaaacctattaaaaatgagcttggatcaagctttcattcgcatctgcctgaagtgcacatatttcaccccgaagggaaaattggtaatcaagttgagaaggctatcaacgatgctttctcagtttcagcatcccaacgaatttcctgtaggccaaaaactcgtatttctaataagtataggaataatttcctccagtcttcattactcacacaaaaacgggaagtacacacaagagaaaaatctttccaacgtaatgagagtggcaaagcctttaatggtagctcactcttaaaaaaacatcagataatccatttaggagacaaacagtataaatgtgatgtatgcggcaaggactttcatcagaagcgataccttgcatgccatagatgtcacactggtgagaatccttacacgtgtaatgagtgtggcaagacattcagtcacaattcagccctgttagttcacaaggcaattcatactggagagaaaccttacaagtgtaatgaatgtggcaaggtttttaatcaacaatcaaaccttgcacgtcatcatagagttcatactggagagaaaccttacaaatgtgaagaatgtgacaaagttttcagtcgcaaatcacaccttgaaagacataggagaattcacactggagagaaaccatacaaatgtaaggtttgtgacaaggctttcagacgtgattcacacctggcacaacatactgtaattcacactggagagaaaccttacaagtgtaatgagtgtggcaagacctttgttcaaaattcatctcttgtaatgcataaggtcattcatactggagagaaacgttacaagtgtaatgaatgtggcaaggtttttaatcacaaatcaaaccttgcatgtcatcgtagacttcatactggagagaaaccttacaagtgtaatgaatgtggcaaggtttttaatcgaaaatcaaaccttgaacgtcatcatagacttcatactggaaagaaatcttagaagtgtaaatttgcaaggtttttaggcaacagtcaaaccttgcatgtcatcatagactttatactggagagaaaccttacaaatgtgaagaatgtgacaaaagttttcaatttcaaatcactccttgaaatacataggagagttcatactggagagaaaccatacaaatgtaaggtttgtgacaaggatttcgggtgtgattcacacctggcccaacatactggaattcacactggaaaggaactgtacaagtgtaatgagtgtggcagagcctttggtggtcagtcaacacttactcaccatcaagcaatccatggtatagggaaacttgactaatgtaatgattgtcacaaagtcttcagtaatattacagccattgcaaaacattggagaatccataatgaaggaggtcttacaagtgtaataaatgtggcaagtttttcagacatcattcataacttgcagttcattggcgatcttatacaggagagaaatcttacaaatgtgatgattgtggcaaggtcttcagtcaagcttcatcttttgcaaaacgggagaattcatacaggagagaaacctcacaagtgtgatgattgtgagcaaagcctttacttcacgttcacaccacattagatatcagaggatccatactggacagaaatcttacaaacgtcctatgtgtggcaaggtcttcagtccgaggttactccttgcagaatatcataacgttcatttttgaggtaatagttacaaatgcggtgagcacagcaaaccatcaaggattgacagtagagtcaattcagaattgacttgagtttgagttgacttaaaacattcagttgaagcattaattgacattaaagtgtttatgttaagaggattgggccaggcgtgtggctcacgcctgtaaatccagcactttaggagcccaaggtggatagatcacttgaggtcatgagtttgagatcagcctggccaacagacgtgagtcacttttcccagcctgctttttgtttctttaacaaaaaccaataggggtttttataggtattgtgttgaatctgaatcacattggcttatataataacaatattgatttttccaaaccatcaatgtgggttgtatatatatgtttttaatcattttggttaatgtttgtagatttcaaggtgtgaaattctcagtttttttatgtttattcctaagtatttcttactttaagatctctagcaaatggaagtgttttttaattttcgtttaaattttttattgtttatggaaattcaattaatttttggtgctgctattgcattgtgcaaatccactgaatgtgttgattagttccagtagtattttggttgactcaggccccgcccacctcttcgcctcccgtctggcctgacccaggccccgcccacctcctcgggggtctccccgcgggtctggcttctgtactgtgctgattggcacagacccggaagctgatggcatggactgaaggttgccccgttgagtttgcgcttcccagttctctggtactgctataccggggacgtgggtgtctccacagacctggaaattccggcccctctttctcaactcagagcaaattgagacgtccgggtgggagtccgtgagtcttttccttttgagtttaaagtcgccctgaggctggtcccgtcccggtcttttctgcagtagggccgtgcagacacctcctgtagcgaaactttccttctcaaaacccttcccgacccgtcctcccgcctcgcgctgtttcaggtcctcaccagcgagttggactctcgccctgggctcctcatcggcgcctggagggcagcgctgcagccccactcccgggaaggccgcgtcctctgcctggtcctgggatcctgcagaccccacccctgtccgaaggcgccatcgcccaccacctccctcctcgtgccggccctgcttctccccagttccaaccccaggaaaacgtgcttctcctggaggcaaccctctttttccaccctcgccctgttgttcccggaaggcaggcctggaatgtgaagtttccaggtagatggatattaaacatagaattgaagaaaaaaaaaaaaaccccacaaagtaacaaaagaatgaagcggcgaaagcagaaatttactcaaccaagaaagcaccccacagggtgggggtgggcccaagcgagcgtctccagggccccatttacaaagtttttggaggttatttttttttgaggtccctatgggctaccccttatctggatgaagaatttggcccttggccaaggaaataactgaggtaaattggcctgaggccagagcagatgggtgccctatgcagatgaaggggtggccggtgcttggccttggccactcctgggctctttctctttccacctgcgacctggtggaagggggagggtgttagggagagtagcctttgatcctttgttactttgggtgggaagatggggtttttccttttagtctagttttggaaagttcgcgttaattggttttagattccctgcctccctagacccaggacccatgtggttttttttgtttttgtttttgtttttttgatggagatggggtcttactctgctgcgcaggccgaagagcggtgaccggatcacagctcactgcagcttcaacctcctgggctcaagggatcctcccacctcagcctgcagagtagctgggaccacagccgcgcgccaccacaccgcgccaatttttgtgttcttggtagagaccgggttttgccttgttgtctaggttgggctccaactgcagggctaaagcgatccaagagcatcagcctcccaaagtgctgggattacaggcttgagccaccatgcccgccttatttcttaatttaaaaaaaaaaatgtatatgtagactgaacgcggtggctcatgcctgtcatcccagcactttgtgaggccgattctcctctatccaggagacgggtttcaccattttgccaggtttgtctcaaactcctcggcttaactgatccgcttgctttggccttccaaagtgctaggattacaggagtgagccaccacacgtagccagtcctggcattttgtagaaggatggccaacgcagcctgttgacccttcctggccatcacatgaaaatcagcgactcttccttcttacaaaactcggagcttctcaggataacttggtgaaacgtcccccgctgtgaacctcagtgagcccacctgtaatatacaggtgagggagaagaccagaaaagctcagtcagagtgacactgacccctgaaatgatgggcacaatggagtgtgtggcttttcctgtaggacagggaggtatttagttgtagtttgaactttaaaggattccagtcctccgaaaaacaggattagactcaaatcaccttgaaccttatcatctcatggctttgacccacctacatggctccgtgtcccctgcaggcctcgccccggagctctacaatcctgtgtgcagttgtctccgcagctctctgctgggacatcaaacaggcatctccaccttcatgtgtctataagtgacttcctaaacccccaaacacattcccttacagtcctacacatctcagatgagggtgacagtgtacttctgggtgcttagctgaggttgacaccatgtattttaaatatggaaaataaattacattatttgtaa

SEQ ID NO: 3565 - DNA, 3455 bp, Homo sapiens
ttctttctccaacctcagcttttcttagtgcctaaagtgtctgcacatggaaatccagaggtagacagagagaaactgagttccggacaatgcattcactaaagaaagtgacttttgaagatgtagctattgacttcacccaggaagagtgggccatgatggacacatccaagagaaagctgtacagagatgtgatgctggaaaatatcagtcacctggtgtccctcgggtaccagataagcaaatcctatataattttgcagctggagcaaggaaaagagctgtggcgggaaggaagagaatttcttcaagaccagaatccagacagggaaagtgcccttaagaaaaaacacatgatatccatgcatcctatcaccagaaaagacgcatccaccagtatgacaatggagaactctctcattctggaggatccttttgaatgtaatgattcgggagaagattgcactcacagttccacaataactcagcgtttgttaactcacagtggaaagaaaccctatgtcagcaaacagtgtggaaaatctcttcgtaatcttttctcccctaaaccacataaacaaattcatactaaaggtaaatcatatcaatgtaatctatgtgaaaaggcctatactaattgctttcgccttagacggcacaagatgactcacactggagagaggccatatgcatgtcatctatgtggaaaagccttcactcagtgttctcaccttagaagacatgagaaaactcacacgggagagagaccatataagtgtcatcaatgtgggaaagcctttattcaatcctttaaccttcgaagacatgagagaactcaccttggaaaaaagtgttatgaatgtgataaaagtgggaaagcctttagtcaaagctctggctttagaggaaacaaaataattcacactggagagaaaccacatgcttgtcttctatgtgggaaggccttcagtctgtcttccgaccttagatgacatgagagaacatgcactggagaaaagccatatgaatgccatttatgtgggaaagccttcagtcaatgtactagtcttaaatagcatcagaaaattcacgctggagagaaaattataaacttcttcagaacatattctgactttagatgacactgtgttaggaatgacgaaggtaaggaatgtggaagagacttcagctgtagttgtagcatctaaacatgccaaaggactcatattttgaagaaatactggaatcaacatggaagatacttcagttacctttattcttcagtccacatcaataaattcatatggaagagaaattgtatgacatgtatgtaccaaagacttgttagtgatctgagcataaatgacatgagagagctgaaactgtcaacatagtcaactaaaagtcttcagcaacagctttaacttaaaacatgtgggactttcaggtagagaatctctaactctgcattcagtgtgaaaatatttttatttgcaatttattgtcaaataacatgagaaaactttacttggatgaaccctttatttgtattttctgtgaataaacattcagccaagcaccaggcttgatgttcacaagaaaacagagtgataaaatgctgctaaaatggaaaataagagaggaaagccttcataagctaaataagaagggaaagtctttccaagggcaatgaattctcttggaataccaaatacttcttactggagaagttatgcaatgaaaaatcatgagaaatcctttcttcatagagcaacacttgtggcacatgtgagatttcacactggacaaaacatggttagcatcctgaaaggagaaaattctttagtggtaattcatttcttagttgacattaagtttctcacattgaggagctatcaaacttgaaaatcactgtggagaaacctgatagatttctcatcagaaaagtgagtcaagaaggtggacctctagaaaaaactcttaacacatactttagcaaaataattcagaaatttgagaaaatatctattcataaaaatgtggcatataaatgcataatagtaaagtgaccagggaataaattgaatgcagaattatataagaaatctcattaaacttttccaaaagatcaatacttacaaatattgaaagaatacaatctgttgttgaaaaaacttagtatgttggcgaagcccttgtttcatttatgcagccctaacaaatcgatttgcatctgcactccttgggtgagattcttggtcgagattctaccccaacttctgagtctccccagtctttaacagctctttcctcacagctcacctccctttacttcaacgtccactaaaaccacttgtttccatccaaccctcgagttgacacaccagggatcttcagccccacttgctagatttctcagtgtgtcattgcatagatttagcagggaaatggaggctgtatcaaagacccctagtatatgcatttgggtgtccgcagcccttgcctctgtctctgagcagttacctgggatcagagaataaggcagctcttctcttctatccctcagaaggctcttgaaattttgtccctggagcctctctaactggaagtagcagttcatctcatgacaccccacattttattcaggtgagtcctgagttattacacagagacagacacagctgtgctccttttactgcagtccagaagataaaacaccagcatgataaaacagccgaacctgtcagccaccttgcaagcctttcctatattcgattcaatgtacttttcccgaagcaaaatgaaagttctcacagaggggccctcctctgccttgtcctcagaattggaaaatgtattgtccgtgaaggagcctcagtactgaacctaaaactcaagagaaaatgtttcctgaatatcaagtgggatgacttgaaattttgccaaacaggcacaatcttaatacgatcggccttactaaggctaaatggccttatccgtggttgaagttgacaaatcaatatattaaaaaatctccacaagtgattgattttactctgcagccagggtttatgtcaagtgtgaggataatgagcaagaaattcaagcccttggcaaactggttggagaggcaaggactgtgtccaggcagagctcatatcattatttattgtttaatctatttaattaaatatgtaatttacccacaaactgtggctgacattatatgtactcctgagccacattgagatgtactatttgtgctatgaaattctatgggatttgacaaatgcatggtggcagatctccagccattattaaagcgtaacacagaatgcttctcttattcaagctcatcttccctccacatagagggaatcaatcgacttttgtatactgatttttgaatttgcttctttatttccatcttcttcaattaaagcacaagatatcgt

SEQ ID NO: 3566 - DNA, 751 bp, Homo sapiens
taatggaaaattgcaaggggtttttcctgatctactttgaaatgcaattccgcttaaagcttttcttagtgcctaaagtgtctgcacatggaaatccagaggtagacagagagaaactgagttccggacaatgcattcactaaagaaagtgacttttgaagatgtagctattgacttcacccaggaagagtgggccatgatggacacatccaagagaaagctgtacagagatgtgatgctggaaaatatcagtcacctggtgtccctcgggtaccagataagcaaatcctatataattttgcagctggagcaaggaaaagagctgtggcgggaaggaagagaatttcttcaagaccagaatccagacagggaaagtgcccttaagaaaaaacacatgatatccatgcatcctatcaccagaaaagacgcatccaccagtatgacaatggagaactctctcattctggaggatccttttgaatgtaatgattcgggagaagattgcactcacagttccacaataactcagcgtttgttaactcacagtggaaagaaaccctatgtcagcaaacagtgtggaaaatctcttcgtaatcttttctcccctaaaccacataaacaaattcatactaaaggtaaatcatatcaatgtaatctatgtgaaaaggcctatactaattgctttcgccttagacggcacaagatgactcacactggagagaggccatatgcatgtcatctatgtggaaaa

SEQ ID NO: 3567 - DNA, 499 bp, Homo sapiens
cagattctggcatccacgtgagcccagtgatcccaatgagcgctgcgttgtgctaaattttcgtaaatcacccaaaagatggggctggaatgatgttaattgtcttggtcctcaaagtgactcgtcaaaaatctgcataatggaaaattgcaaggggtttttcctgatctactttgaaatgcaattccgcttaaagcttttcttagtgcctaaagtgtctgcacatggaaatccagaggtagacagagagaaactgagttccggacaatgcattcactaaagaaagtgacttttgaagatgtagctattgacttcacccaggaagagtgggccatgatggacacatccaagagaaagctgtacagagatgtgatgctggaaaatatcagtcacctggtgtccctcgggtaccagataagcaaatcctatataattttgcagctggagcaaggaaaagagctgtggcgggaaggaagagaatttcttcaagaccagaatc

SEQ ID NO: 3568 - DNA, 3377 bp, Homo sapiens
attttctcaagcaatttttaaatttcattcttttaccctattgagcttttcttagtgcctaaagtgtctgcaagtggaaatccagaggaagacagagagaaactgagttcctgacaatgcattcactagagaaagtgacttttgaagatgtagctattgacttcacccaggaagagtgggacatgatggacacatccaagagaaagctgtacagagatgtgatgctggaaaatatcagtcacctggtgtccctcgggtaccagataagcaaatcctatataattttgcagctggagcaaggaaaagagctgtggcgggaaggaagagtatttcttcaagaccagaatccagacagggaaagtgcccttaagaaaaaacacatgatatccatgcatcctatcatcagaaaagacgcatccaccagtatgacaatggagaactctctcattctggaggatccttttgaatataatgattcgggagaagattgcactcacagttccacaataactcagtgtttgttaactcacagtggaaagaaaccctgtgtcagcaaacagtgtggaaaatcccttcgtaatcttttgtcccctaaaccacgtaaacaaattcatactaaaggtaaatcatatcaatgtaatctatgtgaaaaggcctatactaattgcttttaccttagacggcacaagatgactcacactggagagaggccatatgcatgtcatctatgtggaaaagccttcactcagtgttctcaccttagaagacatgagaaaactcacacgggagagagaccatataagtgtcatcaatgtgggaaagcctttattcaatcctttaaccttcgaagacatgagagaactcaccttggacaaaagtgttatgaatgtgataaaagtgggaaagcctttagtcaaagctctggctttagaggaaacaaaataattcacattggagagaaaccacatgcttgtcttctatgtgggaaggccttcagtctgtcctccgaccttagatgacatgagagaacacgcactggagaaaagccatatgaatgccatttatgtgggaaagccttcagtcaatgtactaatcttaaaaagcatcagaaaattcaccctggagagaaaattataaacttcttcagaacatattctgactttagatgacacagtgttaggaatgacgaaggtaaggaatgtggaagagacttcagctgtagttgtagcatctaaacatgccaaaggactcacattttgaagaaatactgtaatcaacatggaagatacttcagttgcctttattcttcagcccacatcaataaattcatatggaagagaaattgtatgacatgtatgtaccaaagacttgttagtgatctgagcataaatgacatgagagagctgaaactgtcagcataatcaactaaaagtcttcagcaacagctttaacttaaaacatgtgggactttcaggtagagaatctctaactctgcattcagtgtgaaaatgtttttatttgcaatttattgtcaaataacatgagaaaactttacttggatgaaccctttatttgtatttttctgtgaatgaacattcagccaagcaccaggcttgatgttcacaagagaagagtgacaaaatgctgctaaaatggaaaataagagaggaaagccttcataagctaaataacaagggaaagtctttccaagggcaatgaattctcttggaataccaaatacttcttactggagaagttatgcaatgaaaaatcatgagaaatcctttcttcatagagcaacacatgtggcacatgtgagatttcacactggacaaaacagggttagcatcttgaaagaagaaaattctttagtggtaattcatttcttagttgacattaagtttctcacgttgaggagctatcaaacttgaaaatcactgtggagaaacctgatagatttctcatcagaaaagtgagtcaagaaggtggacctctagaaaaaactcttaacacatactttagcaaaataattcagaaatttgagaaaatatctattcataaaaatgtggcatgtaaatgcataatagcaaagtgaccaaggaataaattgaatgcagaattatataagaaatctcattaaacttttccaaaagaccaatacttacaaatattgaaagaatacaatctgttgttgaaaaaacttagtatgttggtgaagcccttgtttcatttatgcagccctaacaaactgatttgcatctgaactccttgggtgagattcttggtggagattctaccccaacttctgagtctccccagtcttcaacagctctttcctcacagctcacctccctttacttcaacgtccaccaaaaccacttgtttccatccaaccctcgagttgacacaccagggatcttcagccccacttgctagatttctcagtttgtcattgcatagatttagcagggaaatggaggctgtatcaaagacccctagtatatgcatttgggtgtccccagctcttgcctctgtctctgagcagttacctgggatcagagaataaggcagctcttctcttctatccctcagaaggctcttgaaattttgtccctggagcctctctaactggaagtagcagttcatctcatgacaccccacattttattcaggtgagtcctgagttattacacagagacagacacagctgtgctccttttactgcagtccagaagataaaacaccagcatgataaaacagccgaacctgtcagccaccttgcaagccttttctatatttgattcaatgtacttttcccgaagcaaaatgaaagttctcacagaggggccctcctctgccttgtcctcagaattggaaaatgtattgtccgtgaaggagcctcaccactgaacctaaaactcaagagaaaatgtttcctgaatatcaagtgggatgacttgaaattttgtcaaacaggcagaatcttaatacgatcggccttactaaggctaaatggccttatccatggttgaaattgacacatcatcatattaaaaaatctccacgagtgattgattttactctgcagccagggtttatgtcaagtgtgaggataatgagcaagaaattcaagcccttggcaaactggttggagaggcaaggactgtgtccaggcagagctcatatcattatttattgtttaatctatttaattaaatatgtaatttacccacaaactgtggctgacattatatgtactcctgagccacattaagatgtactatttgtgctgtgaaattctatgggatttgacaaatgcatggtggcagatctccagcgattattaaagcgtaacacagaatgcttctcttattcaa

SEQ ID NO: 3569 - DNA, 2183 bp, Homo sapiens
aaaagtctgggctaccggcgcggcgtagtggatgcagcatcctagtggaggacgcccctgtgttgctgaacctgtttgcatgagttgctcctgacggccctttaggatacttccatgtctgtagggtctagagtgacatctcctcccctcccctgacgagatctgccctccttggcactgtgcttccccagaggggtggcctcgctgttcccatggacatggcccaggagccagtgaccttcagggacgtggccatctacttctcaagggaggagtgggcgtgtctggaacccagccagagggccctctaccgggacgtgatgctggacaacttcagcagtgtggctgctctgggattttgcagccccagaccagacctcgtctctcgcctggaacagtgggaggagccgtgggttgaagaccgggagagacctgagttccaggcagtgcagaggggaccccggccaggggcaaggaagtctgcagaccccaagagaccttgtgatcatccagcttgggctcacaagaaaacccacgtgcggcgagaaagagccagggaaggaagcagctttaggaagggcttcaggctggacacggatgacgggcagcttcccagagctgctccagaaaggacagacgccaagcccacggctttcccgtgtcaggtgctcacgcagcgttgtgggcggcggccgggccgcagagagcgccggaagcagcgcgcagtagagctgtcattcatctgcggcacgtgcgggaaggcgctcagctgccacagccggctgctcgctcaccagacggtgcacacgggaaccaaggccttcgagtgccccgagtgcggccagaccttccggtgggcttcaaacctgcagcgccaccagaagaaccacacgcgcgagaagcccttctgctgcgaggcctgcgggcaggcgttcagcctgaaggaccgcctggctcagcaccgcaaggtccacaccgagcacaggccctactcgtgtggcgactgtgggaaagccttcaagcagaagtccaaccttctcagacaccagctggtgcacaccggggagcggccgttctactgcgcggactgcggcaaagccttccggaccaaggagaacctcagccaccaccagagggtccacagcggggagaagccctacacctgtgccgagtgcggcaagtccttccggtggcccaagggcttcagcatccaccggaggctgcacctgacgaagaggttctacgagtgcggccactgtgggaaaggcttccgtcacctggggttcttcacgcggcatcagaggactcacaggcacggggaggtgtaggggcgcccgaagagtggggtgctgcgcctctgcgggagtactgggtcctgagggagagctgcagtgagaagttgctcttcagcctggaaaatcaacctgaattcagagaagccttcttagtcctcagagctccccagtcccccgagaagtttactgggaaaactgccaggtgggagaagcagagccatgggtacgccggagatggcgggggctctggagatggcgggggctgcgccccggcgccgggcatcctggggatgtgctgagagtgtgcgcgaccccggagccacgtgccaggccgggctcagaggcggagaagcctgcctggtgcccacagccgtctggctcagggactccaccctggccccgagtcgccgtctgctgggcctttccttcctggctctgcaccccatgctggctgcccggtctggcttcccttcttgtctctgtcttgggcgaggcagctgtgagcattgcacagaggcaaagaccctcctgcagcctctgcgctgggccgtagaaacaagagcctttgtaatactgaacctcattcaaggattaggagtggtggttaggtcagggccacccccagtgctgcaggaacggcctccacccagctctgttggtcagagcctgggtcatgcacctggagttgggagatcaagttgggtctcagggcagtgaggtggccatatccaccacatcgcatttcgtgggggaagaggtgacctctttgttttaaacttaaggtgtctgcttatccagccagaaataaaaatctgccagtggtgttcccaagggaagacccccgtgggaatgggtcgggacactgccgtgtttcaggttagccaatta

SEQ ID NO: 3570 - DNA, 2198 bp, Homo sapiens
tgagatggagtctcactctgttgcccaggctggagtacagtggcgtgatctcggctcactgcaagctctgcctcccggttgctgaacctgtttgcatgagttgctcctgacggccctttaggatacttccatgtctgtagggtctagagtgacatctcctcccctcccctgacgagatctgccctccttggcactgtgcttccccagaggggtggcctcgctgttcccatggacatggcccaggagccagtgaccttcagggacgtggccatctacttctcaagggaggagtgggcgtgtctggaacccagccagagggccctctaccgggacgtgatgctggacaacttcagcagtgtggctgctctgggattttgcagccccagaccagacctcgtctctcgcctggaacagtgggaggagccgtgggttgaagaccgggagagacctgagttccaggcagtgcagaggggaccccggccaggggcaaggaagtctgcagaccccaagagaccttgtgatcatccagcttgggctcacaagaaaacccacgtgcggcgagaaagagccagggaaggaagcagctttaggaagggcttcaggctggacacggatgacgggcagcttcccagagctgctccagaaaggacagacgccaagcccacggctttcccgtgtcaggtgctcacgcagcgttgtgggcggcggccgggccgcagagagcgccggaagcagcgcgcagtagagctgtcattcatctgcggcacgtgcgggaaggcgctcagctgccacagccggctgctcgctcaccagacggtgcacacgggaaccaaggccttcgagtgccccgagtgcggccagaccttccggtgggcttcaaacctgcagcgccaccagaagaaccacacgcgcgagaagcccttctgctgcgaggcctgcgggcaggcgttcagcctgaaggaccgcctggctcagcaccgcaaggtccacaccgagcacaggccctactcgtgtggcgactgtgggaaagccttcaagcagaagtccaaccttctcagacaccagctggtgcacaccggggagcggccgttctactgcgcggactgcggcaaagccttccggaccaaggagaacctcagccaccaccagagggtccacagcggggagaagccctacacctgtgccgagtgcggcaagtccttccggtggcccaagggcttcagcatccaccggaggctgcacctgacgaagaggttctacgagtgcggccactgtgggaaaggcttccgtcacctggggttcttcacgcggcatcagaggactcacaggcacggggaggtgtaggggcgcccgaagagtggggtgctgcgcctctgcgggagtactgggtcctgagggagagctgcagtgagaagttgctcttcagcctggaaaatcaacctgaattcagagaagccttcttagtcctcagagctccccagtcccccgagaagtttactgggaaaactgccaggtgggagaagcagagccatgggtacgccggagatggcgggggctctggagatggcgggggctgcgccccggcgccgggcatcctggggatgtgctgagagtgtgcgcgaccccggagccacgtgccaggccgggctcagaggcggagaagcctgcctggtgcccacagccgtctggctcagggactccaccctggccccgagtcgccgtctgctgggcctttccttcctggctctgcaccccatgctggctgcccggtctggcttcccttcttgtctctgtcttgggcgaggcagctgtgagcattgcacagaggcaaagaccctcctgcagcctctgcgctgggccgtagaaacaagagcctttgtaatactgaacctcattcaaggattaggagtggtggttaggtcagggccacccccagtgctgcaggaacggcctccacccagctctgttggtcagagcctgggtcatgcacctggagttgggagatcaagttgggtctcagggcagtgaggtggccatatccaccacatcgcatttcgtgggggaagaggtgacctctttgttttaaacttaaggtgtctgcttatccagccagaaataaaaatctgccagtggtgttcccaagggaagacccccgtgggaatgggtcgggacactgccgtgtttcaggttagccaatt

SEQ ID NO: 3571 - DNA, 2113 bp, Homo sapiens
ggataacaacttccgctcgggaagtttgtaaaagtctgggctaccggcgcggcgtagtggatgcagcatcctagtggaggacgcccctgtgatctgccctccttggcactgtgcttccccagaggggtggcctcgctgttcccatggacatggcccaggagccagtgaccttcagggacgtggccatctacttctcaagggaggagtgggcgtgtctggaacccagccagagggccctctaccgggacgtgatgctggacaacttcagcagtgtggctgctctgggattttgcagccccagaccagacctcgtctctcgcctggaacagtgggaggagccgtgggttgaagaccgggagagacctgagttccaggcagtgcagaggggaccccggccaggggcaaggaagtctgcagaccccaagagaccttgtgatcatccagcttgggctcacaagaaaacccacgtgcggcgagaaagagccagggaaggaagcagctttaggaagggcttcaggctggacacggatgacgggcagcttcccagagctgctccagaaaggacagacgccaagcccacggctttcccgtgtcaggtgctcacgcagcgttgtgggcggcggccgggccgcagagagcgccggaagcagcgcgcagtagagctgtcattcatctgcggcacgtgcgggaaggcgctcagctgccacagccggctgctcgctcaccagacggtgcacacgggaaccaaggccttcgagtgccccgagtgcggccagaccttccggtgggcttcaaacctgcagcgccaccagaagaaccacacgcgcgagaagcccttctgctgcgaggcctgcgggcaggcgttcagcctgaaggaccgcctggctcagcaccgcaaggtccacaccgagcacaggccctactcgtgtggcgactgtgggaaagccttcaagcagaagtccaaccttctcagacaccagctggtgcacaccggggagcggccgttctactgcgcggactgcggcaaagccttccggaccaaggagaacctcagccaccaccagagggtccacagcggggagaagccctacacctgtgccgagtgcggcaagtccttccggtggcccaagggcttcagcatccaccggaggctgcacctgacgaagaggttctacgagtgcggccactgtgggaaaggcttccgtcacctggggttcttcacgcggcatcagaggactcacaggcacggggaggtgtaggggcgcccgaagagtggggtgctgcgcctctgcgggagtactgggtcctgagggagagctgcagtgagaagttgctcttcagcctggaaaatcaacctgaattcagagaagccttcttagtcctcagagctccccagtcccccgagaagtttactgggaaaactgccaggtgggagaagcagagccatgggtacgccggagatggcgggggctctggagatggcgggggctgcgccccggcgccgggcatcctggggatgtgctgagagtgtgcgcgaccccggagccacgtgccaggccgggctcagaggcggagaagcctgcctggtgcccacagccgtctggctcagggactccaccctggccccgagtcgccgtctgctgggcctttccttcctggctctgcaccccatgctggctgcccggtctggcttcccttcttgtctctgtcttgggcgaggcagctgtgagcattgcacagaggcaaagaccctcctgcagcctctgcgctgggccgtagaaacaagagcctttgtaatactgaacctcattcaaggattaggagtggtggttaggtcagggccacccccagtgctgcaggaacggcctccacccagctctgttggtcagagcctgggtcatgcacctggagttgggagatcaagttgggtctcagggcagtgaggtggccatatccaccacatcgcatttcgtgggggaagaggtgacctctttgttttaaacttaaggtgtctgcttatccagccagaaataaaaatctgccagtggtgttcccaagggaagacccccgtgggaatgggtcgggacactgccgtgtttcaggttagccaatt

SEQ ID NO: 3572 - DNA, 562 bp, Homo sapiens
ctgggctaccggcgcggcgtagtggatgcagcatcctagtggaggacgcccctgtggtttgtcaggacccggttgcgtatcctcttgaagctggtttcttcctggccgaccccgtccgcgatcgtgaccttagttatccctcatagacactttccacacctgtgtctccagccctatcgctccgatgagacccgagcgcttagacttgattcataacacccaaagctccccggccccaggctgagctcctgcaacctccacaccccaccctctggtcctcccaggcattccaccgcgaaggggaggaggcagaaacccgagattcgcttcttctcctttcctgcccacgcccagccacacagtcactgatctgccctccttggcactgtgcttccccagaggggtggcctcgctgttcccatggacatggcccaggagccagtgaccttcagggacgtggccatctacttctcaagggaggagtgggcgtgtctggaacccagccagagggccctctaccgggacgtgatgctggacaacttcagcagtgtggctgctctgg

SEQ ID NO: 3573 - DNA, 589 bp, Homo sapiens
aagtttgtaaaagtctgggctaccggcgcggcgtagtggatgcagcatcctagtggaggacgcccctgtgggctgtgagacccagcgtcgcggctgctgggacagaccggggaggctgcccgtgccctcggctattcgggggctgttcttcagcttcttccggctcggcctcctcttctctcctcgctccttacacttgcagttgctgaacctgtttgcatgagttgctcctgacggccctttaggatacttccatgtctgtagggtctagagtgacatctcctcccctcccctgacgagatctgccctccttggcactgtgcttccccagaggggtggcctcgctgttcccatggacatggcccaggagccagtgaccttcagggacgtggccatctacttctcaagggaggagtgggcgtgtctggaacccagccagagggccctctaccgggacgtgatgctggacaacttcagcagtgtggctgctctgggattttgcagccccagaccagacctcgtctctcgcctggaacagtgggaggagccgtgggttgaagaccgggagagacctgagttccaggcagtg

SEQ ID NO: 3574 - DNA, 2218 bp, Homo sapiens
ctaccggcgcggcgtagtggatgcagcatcctagtggaggacgcccctgtgatggagtctcactctgttgcccaggctggagtacagtggcgtgatctcggctcactgcaagctctgcctcccggttgctgaacctgtttgcatgagttgctcctgacggccctttaggatacttccatgtctgtagggtctagagtgacatctcctcccctcccctgacgagatctgccctccttggcactgtgcttccccagaggggtggcctcgctgttcccatggacatggcccaggagccagtgaccttcagggacgtggccatctacttctcaagggaggagtgggcgtgtctggaacccagccagagggccctctaccgggacgtgatgctggacaacttcagcagtgtggctgctctgggattttgcagccccagaccagacctcgtctctcgcctggaacagtgggaggagccgtgggttgaagaccgggagagacctgagttccaggcagtgcagaggggaccccggccaggggcaaggaagtctgcagaccccaagagaccttgtgatcatccagcttgggctcacaagaaaacccacgtgcggcgagaaagagccagggaaggaagcagctttaggaagggcttcaggctggacacggatgacgggcagcttcccagagctgctccagaaaggacagacgccaagcccacggctttcccgtgtcaggtgctcacgcagcgttgtgggcggcggccgggccgcagagagcgccggaagcagcgcgcagtagagctgtcattcatctgcggcacgtgcgggaaggcgctcagctgccacagccggctgctcgctcaccagacggtgcacacgggaaccaaggccttcgagtgccccgagtgcggccagaccttccggtgggcttcaaacctgcagcgccaccagaagaaccacacgcgcgagaagcccttctgctgcgaggcctgcgggcaggcgttcagcctgaaggaccgcctggctcagcaccgcaaggtccacaccgagcacaggccctactcgtgtggcgactgtgggaaagccttcaagcagaagtccaaccttctcagacaccagctggtgcacaccggggagcggccgttctactgcgcggactgcggcaaagccttccggaccaaggagaacctcagccaccaccagagggtccacagcggggagaagccctacacctgtgccgagtgcggcaagtccttccggtggcccaagggcttcagcatccaccggaggctgcacctgacgaagaggttctacgagtgcggccactgtgggaaaggcttccgtcacctggggttcttcacgcggcatcagaggactcacaggcacggggaggtgtaggggcgcccgaagagtggggtgctgcgcctctgcgggagtactgggtcctgagggagagctgcagtgagaagttgctcttcagcctggaaaatcaacctgaattcagagaagccttcttagtcctcagagctccccagtcccccgagaagtttactgggaaaactgccaggtgggagaagcagagccatgggtacgccggagatggcgggggctctggagatggcgggggctgcgccccggcgccgggcatcctggggatgtgctgagagtgtgcgcgaccccggagccacgtgccaggccgggctcagaggcggagaagcctgcctggtgcccacagccgtctggctcagggactccaccctggccccgagtcgccgtctgctgggcctttccttcctggctctgcaccccatgctggctgcccggtctggcttcccttcttgtctctgtcttgggcgaggcagctgtgagcattgcacagaggcaaagaccctcctgcagcctctgcgctgggccgtagaaacaagagcctttgtaatactgaacctcattcaaggattaggagtggtggttaggtcagggccacccccagtgctgcaggaacggcctccacccagctctgttggtcagagcctgggtcatgcacctggagttgggagatcaagttgggtctcagggcagtgaggtggccatatccaccacatcgcatttcgtgggggaagaggtgacctctttgttttaaacttaaggtgtctgcttatccagccagaaataaaaatctgccagtggtgttcccaagggaagacccccgtgggaatgggtcggga

SEQ ID NO: 3575 - DNA, 2865 bp, Homo sapiens
gtggatgcagcatcctagtggaggacgcccctgtggctggagtgcaatggcgcgatatcggctcgccgcaacttctgcctcctgggttcaagtgaatctcctgccccagcctcctgagcagctgggatgacagatggagtctcactctgttgcccaggctggagtacagtggcgtgatctcggctcactgcaagctctgcctcccggacagcgtctcagtctaacatccaggctggagtgcactggcatgatctcagctcactgcaacctccgcctcccatattcaagcagtccccccacctcagcctcctgagtagctgggactgcatatgtgcactgccacgccccgctaattattgtattgtttatagagacaggctgggcaactgctgggctcgaacagtcctcctgcctcagcctcctagggtgttaggattacaggcgtgagccactgtgcttggccccttgtaatatctctgtcaggttttcggtttgggttttgctggcctcattaagacagactggatagcgtctgctcttcctctgttcactaaatagcttctaagatcagtactgtgcttccgtaggctttggtggagtttaccagggaatccagctgggtgtggtattttctgtgtgggaagggttccagttacattttcaattgccttatcagatggaaggcttccctttcttttgtcagtttcatgatactgtgtttttcatcgagtttgtctgtttcatctcagttgctgaacctgtttgcatgagttgctcctgacggccctttaggatacttccatgtctgtagggtctagagtgacatctcctcccctcccctgacgagatctgccctccttggcactgtgcttccccagaggggtggcctcgctgttcccatggacatggcccaggagccagtgaccttcagggacgtggccatctacttctcaagggaggagtgggcgtgtctggaacccagccagagggccctctaccgggacgtgatgctggacaacttcagcagtgtggctgctctgggattttgcagccccagaccagacctcgtctctcgcctggaacagtgggaggagccgtgggttgaagaccgggagagacctgagttccaggcagtgcagaggggaccccggccaggggcaaggaagtctgcagaccccaagagaccttgtgatcatccagcttgggctcacaagaaaacccacgtgcggcgagaaagagccagggaaggaagcagctttaggaagggcttcaggctggacacggatgacgggcagcttcccagagctgctccagaaaggacagacgccaagcccacggctttcccgtgtcaggtgctcacgcagcgttgtgggcggcggccgggccgcagagagcgccggaagcagcgcgcagtagagctgtcattcatctgcggcacgtgcgggaaggcgctcagctgccacagccggctgctcgctcaccagacggtgcacacgggaaccaaggccttcgagtgccccgagtgcggccagaccttccggtgggcttcaaacctgcagcgccaccagaagaaccacacgcgcgagaagcccttctgctgcgaggcctgcgggcaggcgttcagcctgaaggaccgcctggctcagcaccgcaaggtccacaccgagcacaggccctactcgtgtggcgactgtgggaaagccttcaagcagaagtccaaccttctcagacaccagctggtgcacaccggggagcggccgttctactgcgcggactgcggcaaagccttccggaccaaggagaacctcagccaccaccagagggtccacagcggggagaagccctacacctgtgccgagtgcggcaagtccttccggtggcccaagggcttcagcatccaccggaggctgcacctgacgaagaggttctacgagtgcggccactgtgggaaaggcttccgtcacctggggttcttcacgcggcatcagaggactcacaggcacggggaggtgtaggggcgcccgaagagtggggtgctgcgcctctgcgggagtactgggtcctgagggagagctgcagtgagaagttgctcttcagcctggaaaatcaacctgaattcagagaagccttcttagtcctcagagctccccagtcccccgagaagtttactgggaaaactgccaggtgggagaagcagagccatgggtacgccggagatggcgggggctctggagatggcgggggctgcgccccggcgccgggcatcctggggatgtgctgagagtgtgcgcgaccccggagccacgtgccaggccgggctcagaggcggagaagcctgcctggtgcccacagccgtctggctcagggactccaccctggccccgagtcgccgtctgctgggcctttccttcctggctctgcaccccatgctggctgcccggtctggcttcccttcttgtctctgtcttgggcgaggcagctgtgagcattgcacagaggcaaagaccctcctgcagcctctgcgctgggccgtagaaacaagagcctttgtaatactgaacctcattcaaggattaggagtggtggttaggtcagggccacccccagtgctgcaggaacggcctccacccagctctgttggtcagagcctgggtcatgcacctggagttgggagatcaagttgggtctcagggcagtgaggtggccatatccaccacatcgcatttcgtgggggaagaggtgacctctttgttttaaacttaaggtgtctgcttatccagccagaaataaaaatctgccagtggtgttcccaagggaagacccccgtgggaatgggtcgggacactgccgtgtttcaggttagcc

SEQ ID NO: 3576 - DNA, 567 bp, Homo sapiens
gataacaacttccgctcgggaagtttgtaaaagtctgggctaccggcgcggcgtagtggatgcagcatcctagtggaggacgcccctgtgatctgccctccttggcactgtgcttccccagaggggtggcctcgctgttcccatggacatggcccaggagccagtgaccttcagggacgtggccatctacttctcaagggaggagtgggcgtgtctggaacccagccagagggccctctaccgggacgtgatgctggacaacttcagcagtgtggctgctctgggattttgcagccccagaccagacctcgtctctcgcctggaacagtgggaggagccgtgggttgaagaccgggagagacctgagttccaggcagtgcagaggggaccccggccaggggcaaggaagtctgcagaccccaagagaccttgtgatcatccagcttgggctcacaagaaaacccacgtgcggcgagaaagagccagggaaggaagcagctttaggaagggcttcaggctggacacggatgacgggcagcttcccagagctgctccagaaaggacaga

SEQ ID NO: 3577 - DNA, 4003 bp, Homo sapiens
actcagacacgcagctggaccggacagggcggcttccgggtttggcgcggcctttgtctcttgctgcagccggagctccggtctcgtcttcactgctgtttgtcctctgctcctagaggcccagactctgtggctctgtgacctgcaggtattgggagatccacagctaagactccaggaccctctggaagcctagaaatgggaccattgacatttatggatgtggccatagaattctctctggaggagtggcagtgcctggacacagcacagcagaatttatataggaatgtcatgttagagaattatagaaacctggtattcctgggtattgctgtgtctaatttagacctgatcacctgtctggagcaaggaaaagagccctggaatatgaagagacacgagatggcagccaaacccccagctatgtgttctcattttgccaaagaccttaggccagagcaatatataaaaaattctttccaacaagtgatactgagaagatatggaaaatgtggatatcagaaaggctgtaaaagtgtggatgagcataagttgcacaaaggaggtcacaagggacttaaccggtgtgtgacaactacccagagcaaaatagttcagtgtgacaaatacgtgaaagtctttcataaatattcaaatgcaaagagacataagataagacatactggaaaaaatcctttcaaatgtaaagaatgtggcaaatcattttgcatgctttcacaactaactcaacatgagataattcatactggagaaaaaccctacaaatgtgaagaatgtggcaaagcttttaaaaagtcctcaaaccttacgaatcataagataattcatactggagagaaaccctacaaatgtgaagaatgtggaaaagcttttaaccagtcctcaactcttactagacataagataattcatactggagagaaactctacaaatgtgaagaatgtggcaaagcttttaaccggtcctcaaaccttactaaacataagatagttcatactggagagaaaccctacaaatgtgaagaatgtggcaaagcttttaaacagtcctcaaaccttactaatcacaagaaaattcatactggagagaaaccctacaaatgtggagaatgtggcaaagcctttaccctatcttcacaccttactacacataagaggattcatactggtgagaaaccctacaaatgtgaagaatgtggcaaagcttttagtgtattttcaacccttactaaacataagataattcatactgaagagaaaccctacaaatgtgaagaatgtggcaaagcttttaaccggtcctcacaccttactaatcataaggtaattcatactggagagaaaccctacaaatgtgaagaatgtggtaaagcctttaccaagtcctcaactcttacttatcataaggtaattcatactggaaagaaaccctacaaatgtgaagaatgtggtaaagcctttagtatattctcaatccttactaaacataaagtaattcatactgaagacaaaccctacaaatgtgaagaatgtggcaaaacttttaactactcctcaaattttactaatcataaaaaaattcatactggagagaaaccctataagtgtgaagaatgtggcaaaagctttattctgtcctctcatcttactacacataagataattcatactggagagaaaccctacaaatgtaaagaatgtggcaaagcttttaaccagtcctcaacccttatgaaacataagataattcatactggagagaaaccctacaaatgtgaagaatgtggcaaagcctttaaccagtccccaaaccttactaaacataagagaattcataccaaagagaaaccctacaaatgtaaataatgtgtcaaatcctttagtgtattttcaacttttattaaaacacaagataattcatactggagagaaatcctacaaatgtgataaatgtggcaaagcctttaactggctcttaatccttatgaaacaaaagataattcatactagagagaaaccctacaaatgtaaagaatgtggcaaagcatttaactggtccctaaatcttactaaacataaaaaaacttaaactggagagaaactacaaagctggaagacatcacagtaattctgacaacacctcaaacttttctaaacataaaataaatcatactggtgaggaactttaaaaatgcgaaaaatgtgacaaaatctttaaatgattgtcacacttgattgtaggtaagataattcttactagaaaaactcttacaagtgtgaagaatgtggcaaaatttttaatgaatactcacaccttattgccaggaaagcatttatacttgagaaaaattgtaccaatataaagactgtgaaaaagccattaatgtctgctcacatcttactcaacatcagagagtacttaaaaaaagtattataaatttaattactgtcaaaaagtatttcagaaaatataagcttttaaagtatttattttgaagacaaacattacaaataaaagaggattgtaatacctttatttgtatcacagatcttattgtacacattttgtactagagaaaaccctgaagcagttacttaaactttgttcaacatcagggaattcagattggagaaaaaccctgcaaatgtaataaatttgaaaaaaaagttttccaaaactacaacttagacaacaccagagggttcatactgagatatatttttgcagatgcagtatatatttaaaacatttaatccaaaataagtctatgtaaatatcagagaattcacagtggaaatatctaaggtagggccgggcatggtggctcacgcctgtaatgccagcactttgggaggctgaggtgggcagatcatgaggtcaacagattgagaccatcctggtcaacatggtaaaaccctgtctctactaaaaatacaaaaattagctgggcgtggcggcacgtgcctgtagtctcagctacttgggacgctgaggcaggaaaatccgttgaacccaggaggcagaggttgtagtgagccgagattgcaccactgcactccagccgggtgacagagtgagactccatctcaaaaacaaacaaactaaggtatggatgcttcagacattacactatatcaaagtgctgactgttaaaaatgatcccaaactaacggtagataaatttatttgtacataactttaaaaggagtagaagattttttggaagtttgtaattacattcaaagtatactttttttgtttgtttgttttccttgagacagagtctctctctgtcgtccaggctggagtgcagtggcacaatctcagctcgctgcaacctctgcctcctgggttcaagcaattctcctgcctcagcctactgagtagctgagattacaggtgcacaccaccacgtccggctgacttttgtatttttagtagggacggggtttcaccatattggtcagggtagtcttgaactcctgacctcatgctctgcccagcttggcttcccaaagtgctgtgattacaggcttaagccacagcgcccggcccaaagtgttcttttttccttgaaaagaagtacagattttttaaaaagctaatattgctgtgattcaactctctagttacttgatgctatttcttcatttctattgtattcacatgtgaaagcatgtgatcagttgtcacggcatcaaagataggagagtttctttttttttaggtgggcattatttatgaccttttctttggaagagtaaggacattaaaatgtaacatgcatgatgaaaatctaagtggagatggtatttgtggttaattatgatattgagtggtgcatgaggtaggtgtttagagtaatattcttttgcattatagtaagaacatttaagttttgttaaaattaaaaaattagtacgttattttactatttgtacttttatgtaataaaatgcagtacatttttaaattttc

SEQ ID NO: 3578 - DNA, 4910 bp, Homo sapiens
ggaggggcgctgcgcaaacggcgagggcgtggctaccagccgctgcgctccgctctggggtctcctcaccccagaaggccctcaggtggaggaagggcctcaggtggaggtaggacctgtgctggccgcgggagaggtaaacagaacaccaggacatcccagagtctgggaaatggactcagtggtctttgaggatgtggctgtgaacttcacccaggaggagtgggctttgctgggtccctctcagaagaaactctacagagatgtgatgcaagaaacctttgttaacttggcctctataggggaaaactgggaggagaagaacattgaagatcacaaaaatcaggggagaaagctaagaagtcatatggtagagaggctctgtgaaaggaaagaaggtagtcagtttggagaaaccatcagtcagactccaaatcctaaaccaaacaagaaaacttttactagagtaaaaccatatgaatgtagtgtgtgtggaaaggactatatgtgtcattcatctcttaataggcacatgagatctcatactgaacatagatcatatgaatatcacaaatatggagagaaatcatatgaatgtaaggaatgtgggaaaagattcagctttcgaagttcatttcgaatacatgaaagaactcacactggagagaaaccctataaatgtaaacagtgtggtaaggctttcagttggcccagttcctttcaaatacatgaaagaactcatactggagagaaaccttatgaatgtaaggaatgtgggaaggccttcatttatcacacaacctttcgaggacacatgagaatgcacacaggggagaaaccctataaatgtaaagaatgcgggaaaacgttcagtcatcccagttcttttcgaaatcatgaaagaactcactctggagagaaaccctatgaatgtaaacaatgtggaaaagctttcagatattaccaaacttttcaaatacatgaaaggactcacactggggaaaaaccctatcagtgtaagcaatgtggtaaagctcttagttgtcccacatcctttcgaagtcatgaaaggattcacactggagaaaaaccctataaatgtaaaaaatgtgggaaagccttcagttttcctagttcctttagaaaacatgaaagaattcatacaggagagaaaccctatgattgtaaggaatgtgggaaagcattcatttctcttccaagctatcgaagacatatgataatgcacactggaaatggaccttataaatgcaaggaatgtgggaaagcctttgattgtcctagttcttttcaaatccatgaacgaactcacactggagagaaaccctatgaatgtaaacagtgtggtaaagccttcagttgttccagttcctttcgaatgcatgaaagaactcacactggagagaaaccccatgaatgtaaacaatgtggtaaagccttcagttgttccagttctgttcgaatacatgaaaggactcacactggagagaaaccctatgaatgtaaacagtgtggtaaagccttcagttgttccagttcctttcgaatgcatgaaagaattcacactggagagaaaccctatgaatgtaaacagtgtggtaaagcctttagtttttctagttcctttcggatgcatgaaaggactcacactggagagaaaccctatgaatgtaaacaatgtggtaaagccttcagttgttccagttcctttcgaatgcatgaaaggactcacactggggagaaaccctatgaatgtaaacagtgtggtaaggcgtttagttgttccagttccattcgaatacatgaaaggactcacactggagagaaaccttatgagtgtaaacaatgtggtaaggccttcagttgttctagttctgttcgaatgcatgaaaggactcacactggagtgaaaccctatgaatgtaaacaatgtgacaaagccttcagttgctcacgttcctttcgaatccatgaacgaactcacactggagagaaaccctatgcatgtcaacaatgtggtaaagccttcaagtgttcccgttcctttcgaatacatgaaagagttcatagtggagagtaaccctatgtatataagcaatatggcaaagttttcagttgtcctatttcctttttttttttttttttttttgagttgaattctcactctgttgccctggctggagtgcagtagagtgatctcagctcactgcaacctctgtctcctgggttcaagcgattctcctgcctcagcttcctgagtagctgggacaacaggtgtgaacgaccatgcccacttaatttttgtatttttagtagagatggggtttcgccatgttggccaggctggtctcgaactcctgacctcagacgatccacctgccttggcctcccaaagtgttggattacaggtgtgagccaccacacccggcccccatttccttttgaagacatgaaattattcatatttcagagaaaccctataagacatgggaataccttcagttatttacatgtgaatatgaggaagcattcatactggacaggaaaccctgcgaatgtaggcagtgtgggaaaaccttcaatggtcatatgaccttttaaggaccatgagaaggcatatgaagtgtaaagaattttcatatgccctataaatgtaaagaatttataaccttaaaaatgtaaagaatgtggaaaaccctataaatgtaaaaaatgtagaaaaacctttatttgtcttagtttacttggaaaccatgaacaaactcacactggaaagcgacttcttaaatatagacattgtgagaaagccttcagttggcccacatactaatatgtgagaatgcagactggatagaaatcctataaaagtgagatatagcaatgttttccattttaacaaatgctcatgtgatactcccttatgtgtgaaacttcaatctcatgttgaaactcccactagggaggtactgtataaatgtagataatatgggaaagcctgatgcaaattaattcatgtatattgttctagaaaattcacaacatgtcagaaatgtgataaaacatattatcagttactgattcttaaaatggatctctgaattatggatttctattactttcacaaaagaacactgagatgagataattctgtaagctcttatacagttgtacacaagttgaattgatagtattttttcattaaatcagtttctgaaattttgtctttccatattgaagtctgttagattcatgagtgaattgaagtgtatttataataagctagcagttttgatttttatgtattttttagttgtgctgtaatgggccatcaaaaaatgacaatttggtaatttttaggatttcctactggccttatgtggcaggtactagatatcattatatgtatttcatctttctgaccaaaagaggcttttttagaggaagacagagtacccttttttctattttttatgctaaaaaataatcataataaatttttgagtctgcaaagtttatcatacagtatactctctcattggaattattattttcatcttctgtttgctgtttgtaattccttctggctgtgatttgaataatagactttgtattaataagagagatctgagatagaaccatataacctatagctggaaatggctgtcctggattgtgttaacatgggttatgttgtgacctatgttttctataatctaaccttttatggctccacggtataattcaccaatagcctacttgcaggagatatggaaggcagaagtgaagaaagcattagtcaggttttatagccaccatatgtggagacagatggatgcataggagcttcagggacacctgcttccaccacattgtcctgatcctttgctctgccaattgagagtattcttagaaccaccactaactgcttgactgccatattttccttccttccttccttctttctttccctttccctttcttttctttctttactttctttttccgagatggagtcttgctctgtcgcccaggctggagtgcagtggtacgatcttggctcactgcaacctctgccttctgggttcaagcaattgtcctgccccagcctcccaagtagctgggattataggtgcccaccaccaagcccagctaaattttttttgtatttttagtagagacagggtttcatcattgttggccaggctggtctcaaactcctgacctcatgatctgcccaccttggccttccaaagtgctgagattacaggcgtgagccactgtgcatggccccagctgccatattttcaaagatgtagttttccacaaattgtcttcaaaagttctactcaaagatgcactgcagtttggattttcctagaaactctaatgtgtccaccaggcaaccatttagactcttaaggttgggaatattctctgatgctctgactcacctcatctctaggttgaatttatccaaggtattatttatgtaataaacaccatgttttgttaacagtaccagtgactatgtgtttctgattccaccgtgacaactacagtggtgcagtcaaaaagaactacatgggtgtctgcttctccactgcactgtgcagggaatgcacttacccagtcctacagtgtaagaataagcaccttcctaatatcaagcagattgtcggtgtttcctattacagttgaatgtcatctctcagtacattttcaattttgtttcattatatgtgattaaaaaccatgtgtatgtttttgttgaacaaaagcttctgtagatgtttcttagaaatattttattaacttttcaaataacttgtatgctatcacttgtctatttaattttctgcaaggatatattaaaatattccattgcaattata

SEQ ID NO: 3579 - DNA, 4505 bp, Homo sapiens
gtttcgtgtccgctgcgtttgggttccggtctccgcttctccagtggccccggtggctccaccgcagcgtctggcgcgctgggacctgcacaggccggagagagccgtaggcaggaccccgggacaccctggaagccaggaaatggactcagtggtctttgaggatgtggctgtgaacttcacccaggaggagtgggctttgctgggtccctctcagaagaaactctacagagatgtgatgcaagaaacctttgttaacttggcctctataggggaaaactgggaggagaagaacattgaagatcacaaaaatcaggggagaaagctaagaagtcatatggtagagaggctctgtgaaaggaaagaaggtagtcagtttggagaaaccatcagtcagactccaaatcctaaaccaaacaagaaaacttttactagagtaaaaccatatgaatgtagtgtgtgtggaaaggactatatgtgtcattcatctcttaataggcacatgagatctcatactgaacatagatcatatgaatatcacaaatatggagagaaatcatatgaatgtaaggaatgtgggaaaagattcagctttcgaagttcatttcgaatacatgaaagaactcacactggagagaaaccctataaatgtaaacagtgtggtaaggctttcagttggcccagttcctttcaaatacatgaaagaactcatactggagagaaaccttatgaatgtaaggaatgtgggaaggccttcatttatcacacaacctttcgaggacacatgagaatgcacacaggggagaaaccctataaatgtaaagaatgcgggaaaacgttcagtcatcccagttcttttcgaaatcatgaaagaactcactctggagagaaaccctatgaatgtaaacaatgtggaaaagctttcagatattaccaaacttttcaaatacatgaaaggactcacactggggaaaaaccctatcagtgtaagcaatgtggtaaagctcttagttgtcccacatcctttcgaagtcatgaaaggattcacactggagaaaaaccctataaatgtaaaaaatgtgggaaagccttcagttttcctagttcctttagaaaacatgaaagaattcatacaggagagaaaccctatgattgtaaggaatgtgggaaagcattcatttctcttccaagctatcgaagacatatgataatgcacactggaaatggaccttataaatgcaaggaatgtgggaaagcctttgattgtcctagttcttttcaaatccatgaacgaactcacactggagagaaaccctatgaatgtaaacagtgtggtaaagccttcagttgttccagttcctttcgaatgcatgaaagaactcacactggagagaaaccccatgaatgtaaacaatgtggtaaagccttcagttgttccagttctgttcgaatacatgaaaggactcacactggagagaaaccctatgaatgtaaacagtgtggtaaagccttcagttgttccagttcctttcgaatgcatgaaagaattcacactggagagaaaccctatgaatgtaaacagtgtggtaaagcctttagtttttctagttcctttcggatgcatgaaaggactcacactggagagaaaccctatgaatgtaaacaatgtggtaaagccttcagttgttccagttcctttcgaatgcatgaaaggactcacactggggagaaaccctatgaatgtaaacagtgtggtaaggcgtttagttgttccagttccattcgaatacatgaaaggactcacactggagagaaaccttatgagtgtaaacaatgtggtaaggccttcagttgttctagttctgttcgaatgcatgaaaggactcacactggagtgaaaccctatgaatgtaaacaatgtgacaaagccttcagttgctcacgttcctttcgaatccatgaacgaactcacactggagagaaaccctatgcatgtcaacaatgtggtaaagccttcaagtgttcccgttcctttcgaatacatgaaagagttcatagtggagagtaaccctatgtatataagcaatatggcaaagttttcagttgtcctatttcctttttttttttttttttttttgagttgaattctcactctgttgccctggctggagtgcagtagagtgatctcagctcactgcaacctctgtctcctgggttcaagcgattctcctgcctcagcttcctgagtagctgggacaacaggtgtgaacgaccatgcccacttaatttttgtatttttagtagagatggggtttcgccatgttggccaggctggtctcgaactcctgacctcagacgatccacctgccttggcctcccaaagtgttggattacaggtgtgagccaccacacccggcccccatttccttttgaagacatgaaattattcatatttcagagaaaccctataagacatgggaataccttcagttatttacatgtgaatatgaggaagcattcatactggacaggaaaccctgcgaatgtaggcagtgtgggaaaaccttcaatggtcatatgaccttttaaggaccatgagaaggcatatgaagtgtaaagaattttcatatgccctataaatgtaaagaatttataaccttaaaaatgtaaagaatgtggaaaaccctataaatgtaaaaaatgtagaaaaacctttatttgtcttagtttacttggaaaccatgaacaaactcacactggaaagcgacttcttaaatatagacattgtgagaaagccttcagttggcccacatactaatatgtgagaatgcagactggatagaaatcctataaaagtgagatatagcaatgttttccattttaacaaatgctcatgtgatactcccttatgtgtgaaacttcaatctcatgttgaaactcccactagggaggtactgtataaatgtagataatatgggaaagcctgatgcaaattaattcatgtatattgttctagaaaattcacaacatgtcagaaatgtgataaaacatattatcagttactgattcttaaaatggatctctgaattatggatttctattactttcacaaaagaacactgagatgagataattctgtaagctcttatacagttgtacacaagttgaattgatagtattttttcattaaatcagtttctgaaattttgtctttccatattgaagtctgttagattcatgagtgaattgaagtgtatttataataagctagcagttttgatttttatgtattttttagttgtgctgtaatgggccatcaaaaaatgacaatttggtaatttttaggatttcctactggccttatgtggcaggtactagatatcattatatgtatttcatctttctgaccaaaagaggcttttttagaggaagacagagtacccttttttctattttttatgctaaaaaataatcataataaatttttgagtctgcaaagtttatcatacagtatactctctcattggaattattattttcatcttctgtttgctgtttgtaattccttctggctgtgatttgaataatagactttgtattaataagagagatctgagatagaaccatataacctatagctggaaatggctgtcctggattgtgttaacatgggttatgttgtgacctatgttttctataatctaaccttttatggctccacggtataattcaccaatagcctacttgcaggagatatggaaggcagaagtgaagaaagcattagtcaggttttatagccaccatatgtggagacagatggatgcataggagcttcagggacacctgcttccaccacattgtcctgatcctttgctctgccaattgagagtattcttagaaccaccactaactgcttgactgccatattttccttccttccttccttctttctttccctttccctttcttttctttctttactttctttttccgagatggagtcttgctctgtcgcccaggctggagtgcagtggtacgatcttggctcactgcaacctctgccttctgggttcaagcaattgtcctgccccagcctcccaagtagctgggattataggtgcccaccaccaagcccagctaaattttttttgtatttttagtagagacagggtttcatcattgttggccaggctggtctcaaactcctgacctcatgatctgcccaccttggccttccaaagtgctgagattacaggcgtgagccactgtgcatggccccagctgccatattttcaaagatgtagttttccacaaattgtcttcaaaagttctactcaaagatgcactgcagtttggattttcctagaaactctaatgtgtccaccaggcaaccatttagactcttaaggttgggaatattctctgatgctctgactcacctcatctctaggttgaatttatccaaggtattatttatgtaataaacaccatgttttgttaacagt

SEQ ID NO: 3580 - DNA, 4617 bp, Homo sapiens
tccagggagggagagagcgcgagcgagagagcgagcgagaggaggggggagagagagaaagagaggagccggagggagggcggcaggagcaggcggcgggcgcgcgtggaggcgggcggcgggcgcacagcagcagcccgggcggtgggcagccaggagcccccggcccggcccggcccggcccgccgagggccccagcgcaggagccgcgcccggacccaggcgatgccctcctagctagccgtcacgggatggagggcttcatggactcagggacacagacggacgccgtggtggtgctgtccttggctcaggccgccgtgcttggcctggtctccgaaaatgagctctttggagctaccataagcgccgaggccttctacccggacctggggcccgagctttcaggggcagccatgggagagcccgagccaccaggccccgacgtctaccagctggcctgcaacgggagggccttggaggagccggcggaggaggaggtgctggaggtggaggcagcctgtgagaagcacacccggcggaagacgcggccacctgtgcggttggtgcccaaggtcaagttcgagaaggtggaggaggaggaacaggaggtctatgaggtttctgtgccaggtgacgacaaggacgcagggccagcagaagcccccgccgaggcggccagtggcggctgcgacgccctggtgcagagcagcgccgtcaagatgatcgacctcagcgccttcagccgcaagccccggacgctccggcatctgccccgaaccccgaggccggagctgaacgtggccccatatgaccctcacttcccggccccggcccgggatggcttccccgagcccagcatggcgctgcctgggccagaggccttgcccacagagtgtgggttcgagccaccccacctggcccccctgagtgaccccgaggcccccagcatggagtccccggagcctgtcaagccggaacagggcttcgtgtggcaggaggccagtgagttcgaggctgacacggcgggttcgaccgtggaacgccacaagaaggcccagctggatcggctggacatcaacgtgcagattgacgactcctatctggtggaggcgggcgaccgccagaagcgctggcagtgccgcatgtgcgagaagtcctacacgtccaagtacaacctggtgacgcacatcctgggccacaacggcatcaagccacactcgtgcccacactgcagcaagctcttcaagcagcccagccacctgcagacgcacctgctgacgcaccagggcacccggccccacaagtgccaggtatgccacaaggccttcacgcagaccagccacctcaagcgccacatgctgctgcactcggaggtcaagccctacagctgccacttctgcggccgcggcttcgcctaccccagcgagctcaaggcccacgaagtgaagcatgagagtggccgctgccatgtctgcgtcgagtgcggcctggacttctccaccctgacccagctcaagcgccacctggcctcccaccagggccccaccctctaccagtgcctcgagtgtgacaagtccttccactaccgcagccagttgcagaaccacatgctcaagcaccagaacgtgcgacccttcgtgtgcactgaatgcggcatggagttcagccagattcaccacctcaagcagcactccctcacccacaagggcgtgaaggagttcaagtgcgaggtgtgtggccgggagttcaccctacaggcgaacatgaagcggcacatgctgatccacaccagcgtccggccctaccagtgccacatctgcttcaagacctttgtacagaagcagactctcaagacccacatgattgtacactcgcccgtgaagccattcaaatgcaaggtgtgcgggaagtccttcaaccgcatgtacaacctgctgggccacatgcacctgcacgccggcagcaagcccttcaagtgcccctactgctccagcaagtttaatctcaagggcaacctgagccggcacatgaaggtcaagcatggcgtcatggacatcggcctggacagccaagaccccatgatggagctgacaggcactgacccttcagagctcgacggccagcaggagatggaggacttcgaggagaacgcctacagctatgcgagcgtggacagcagcgccgaggccagtgtcctcactgaacaggccatgaaagagatggcctactacaatgtgctatagcgcaagctgggccacccctaacgggggccgggggcgagggcatgggggtgagacccatgggctgcaggctgcacctcctgcagccgagaaacaagctactgccccactgttctgagccctccctccccgagtcatttgcaccactagggacctttagaccaaatggagactgtactactggccccggctgtgagccagcacaggcccaggcatcccagcaagggaaggagaacacgcgaggcccagatctgggtctccctggcctgcttccgtggggagtgggagaagtggggccactggggacaggtcacaagggcaccggccctcggggtctctccaggcccagcagagctcttcaggggtcctgacactggaagaagagaccacttgagccatgtctttttcacggccaactcctgcctctaaggatgtctgagctcccctctggccagtactgcccacctctaccttgtccaggcccccttccccgccctgtcgacggaccgccaggcagggcactctgccttctacctcccggggtctcccatgcgctcctcaagccaggtgtgcacgtggccctggccctggcctgcaggacagctggggggcacccagcccccagaagacccctgtcctacatccctttctggaagtgagtgtccctacagtggattgcaacacatgtcgtccacttcgaccctagctggagtgcctcaccagggggccccactaggaacaaagccaggacaggccccgcgtcaggcacacactaacaaaaccagaagcatggggcagggcagggcggagtgagggcatcacaggggaccaagaagggctgtccttgggggaggcccaggaccacctgtcggggagggggaccgcagtcatttctcattcctcagtgtccaccttgcgacggggatagccacgagtcagcagcttcccggaaagagcaacgtattttaaaaaggaaagtaaagcccacagagggaaatcaagggtttttttgagcaaagggggtcttctgaaggtaacttattatttttttctttccaactgtgtgtcacctatgaccttttctgatggagatgcattttctttttccaagcgtaagcttcctaatgtgctgtgcgtgcttcctacccacccaccccgagcagcctggccgggcaggactggggctccatggggactgtcaccctggccctggaggtgcagccgctggcagcagcctcagcaggctggggtgggaggcaggagaaggcagagctgggaagccctccacccctgcctggctcctgcagtcgctgacttgctctgtcccatgtcccatcctcggctgtcagggctgctgactctgctcagccaacagctagctccctcgctcgcctgctctcttcccctctgttcccacgccagctcctgcccctggaaccagagatgacaggcccagggcagtgaaatagcacattcaggaactctagggcacccggacccccccacccacttgcctcctgaggcctcagtggggaggggcaagcaggggtcttccccaaaggcacagatgaagccactagcttcagcctagaaacccggagaagggaacagcctgcggtgggaggaaccaatctgcagcgcagccacccccaaggctggatccttaagtgaaggaccaagccaggcctcagggtgactgtgatcaggactgaggggtggacaaggtggcccaagtatggcttccagaccccgaagccccacgacctcccaggtgcccgccatgatgaccctcaggtggcagtgaccccgtcactgtataagacattttctcctgctgagcagaaggcatcatcccctgcaactacctcttcccacgtctttctcccctggtaccaaaaagaaccctgtacctctcctcctcctcctccctcctgccagtgcagtggccttggtcttggaaactgaagggagaaggtctggcccccagggtggggctctcctttccctcccccagccccgccgtcagcactggccctctgtgaggttcgatacttgaacgccccctgccctgtgccttggacctgggcaaagctaggaggaggaaacagcacaactcacagtttgagctggggggtggtcttggcaaggctcctgtctgtacccctccctaaccttctcaaaagaggtgcacagcctctcgggtgacttggaaactcctggacaaattccattctaacttattttgacatgtatacaaaccaactgtttagagattccacttgtgcaaagccctactgtgtttttatgttcctgtttaaaagagaagtttacttagcaataattataaataaatgaatattctttagtgaggtga

SEQ ID NO: 3581 - DNA, 332 bp, Homo sapiens
ttttcctaattggatggagctgtggggcgtgagcaccagcgtcagatcggggccctcaggctaccagcgatgccctcctagctagccgtcacgggatggagggcttcatggactcagggacacagacggacgccgtggtggtgctgtccttggctcaggccgccgtgcttggcctggtctccgaaaatgagctctttggagctaccataagcgccgaggccttctacccggacctggggcccgagctttcaggggcagccatgggagagcccgagccaccaggccccgacgtctaccagctggcctgcaacgggagggccttggaggagccg

SEQ ID NO: 3582 - DNA, 3550 bp, Homo sapiens
tgccttctcagaatgctgttttttctcaggaggggaacatggaggaggaagaaatgaatgatggctcacagatggtgagatctcaggaatcactgacgtttcaggatgtggccgtggacttcaccagagaggagtgggaccagctgtaccctgcccaaaagaacctctatcgagacgtgatgctggagaactacaggaatctagttgcactggggtatcagctttgtaagccagaggtaatcgcgcagttggagctagaggaagaatgggtgatagaaagagacagcctgctggatactcatccagatggagaaaacagacccgaaatcaaaaagtcaaccacaagccagaatatttctgatgaaaatcaaacccatgagatgataatggagagactcgcaggagacagcttctggtactccatcctaggaggactctgggattttgattaccatccagagtttaaccaagaaaaccacaagagatatttaggacaagtaactttgacccacaaaaagatcacacaggagagaagccttgagtgtaataaatttgcagaaaactgtaatctgaactcaaaccttatgcagcagagaattccttccattaaaatacccctgaattctgacacacagggaaacagcatcaaacataattcagacttgatttactatcagggaaattatgtaagagagactccctatgaatatagtgagtgtggaaaaatcttcaatcaacatattcttcttactgatcatattcatactgcagagaaacccagtgagtgtgggaaggccttcagccacacctcatctcttagccagcctcagatgttgcttacaggagagaagccctataagtgtgatgaatgtggaaaaagattcagccagaggatacatctcattcaacatcagagaattcacacaggagaaaagccttttatatgcaatggatgtgggaaagccttccgtcagcattcatcctttactcaacatctgaggattcatactggagaaaagccctataaatgtaatcaatgtggtaaagcttttagccgcatcacatcccttactgaacatcatagacttcataccggagagaaaccttacgaatgtggtttctgtggcaaagccttcagtcagaggacacatctgaatcaacatgaaagaactcatacaggagagaaaccctataaatgtaatgaatgcgggaaagcctttagccagagtgcacaccttaatcaacacaggaaaatccatactcgggagaaattatgtgaatataaatgtgagcaaactgttcgccacagtccttcatttagcagcacataacttatggtgggggaaatcagataaatatataaatgtaggagattttttggtcagacctttttatcccattcaatatcaaattattcatagtggagagaaagcttatacataaatttttgttttgttttgtttttgagactgagtctcactctgtcacccaggctgaagtgcagtggtacaatcttggctcactgcaacctctgccacctgggttcaagcgattctcctgcctcagcctcctgagtagctgggaccacaggtatgcaccaccacgcccagctaattttttgtatttttagtagagacggggtttcaccatgttggccaggctggtctcgaactcctaacctcaggtgatccgcccacctcggcctcccaaagtgctgggattacaggcgtgggccactgcgcctggccataaactttcaatgcgtagaaaccaaattaatttagaccttaaactagcagcatattacattcccaggaggggttataaaaagaaaaaataatttattttacaaatgagattatatttggagtcatgttccaaatctgatataaaactttttaaaaaatcagaagtccttatccaggcatggtggtgcacacctgcaatcccagctactctggagactgaggcatgagaatgacttgaacatgggaggtggaggttgctgtgagctgagatcatgccactgtactccagcctgggcaacagagcaagactctgtctcaaaaaaaaaaaagaaagaaagcctataggcaacaacttgtaattactcacctgtaagttttatggtataaaacttttttttttttttttttttgaggcagagtctcgctctgccacccaggctggagtgcaatggcgcgatctcggctcacagcaacctccacctcctgggttccagcgattcttctgcttcagcctcccgagtagctgggactacaggtgcgtaccaccacgcctggctaactttttttttgtattttttagtagagacacggtttcaccatattgactaggctggtctcgaactcctgaccttgtgatctgcccgcctcggcctcccaaagtgctgggattataggcgtgagcaactgcacctggcaggttatggtataaaacttttaaatcagaaattttgattaattaaagacaatgctggctgggggcggtggttcacgcctataatcccagcactttgggaggccgaggtggggtgatcatctgaggccaggagtttgagaccagcctggccaacatggtaaaaccccatctctactaaaaatacaaaaattagctgggtatggtggtgcacgcctgtagtctcagcagcttgggaggctgaggcagaagaattgcttgaacccggtaggtggaggttgcagtgagccaagatcacgccactgtactccagcctgggcaacagagtgagactgtctcaaaaaaaaaaaaaagtaaaatttaaaaataaaggcgatgctgtagtgcagccagtcacattaacttgaaataaacataaaagaggaatatttcacgaacgtcagttatttgtatgctttctttacagtttttaccatatctagtatttacttaatattctttataaagggatgcaagatttttagccttctcctaggaaatactatttagcatataaaataagttatatgctagttttatatgctaattaaatttattctactcttcatcaaaatagatacataaccttgaaattaaaaatattcgttgatgtccccccaaaaatcttgtgtgccgttgtttgagaaacagtgtgatagtttgtggcaatatcctgtgatgattctttttgcaatcttgacattattttcatcaaatgaatcctaggatcactttgagaagagccttgaagaagacttgagggtcctattgatgaactttgaaatattgattcagagaagtctgcttttctattttgttttagctttaaatttccctgtggcaagtctagattttttttcagttaaaattatttctgctgtatttgtagaacagaagttttgggattttgtaaaataatgaccagagactaagaattcccatgccaccccgtatcactgtggaagatggagaagtgaggaactgtacctgcgggtgagccctggtgccatgttgagggtgggaatcaggagagctgcagtggcttatataaacacctgacgaagtagtctaa

SEQ ID NO: 3583 - DNA, 4492 bp, Homo sapiens
ggggccgtcttcccggcgagtccgcgacggtcgccgcccacggcgagctatgtgttctcatttcacccaagactttttgccagtgcaggggatagaagattcattccacaaacttatactgagaagatatgagaaatgtgggcatgataatttacaattaaggaaaggctgtaaaagtatgaacgtgtgtaaagtgcagaagggagtttataatggaattaataaatgcttgtcaaatactcagagcaaaatatttcaatgtaatgcacgtgtcaaagtttttagtaaatttgcaaattcaaacaaagataagacaagacatactggagagaaacactttaaatgtaacgaatgtggcaagtcatttcagaagttctcagacctaactcaacataaaggaattcatgctggagagaaaccctacacttgtgaagaacgtggcaaagactttggatggtacacagacctgaatcaacacaagaaaattcatactggagagaaaccttacaaatgtgaagaatgtggcaaagcctttaataggtcaacaaaccttactgcacataagagaattcacaacagagagaaagcttacacaggtgaagatcgtgacagagcctttggatggtccacaaacctgaatgaatataagaaaattcatactggagataaaccctacaaatgtaaagaatgtgggaaagcctttatgcattcctcacacctgaataaacatgagaaaattcatactggagagaaaccctacaaatgtaaggaatgtggcaaagtcatttcctcatcctcaagctttgctaaacataagaggattcatactggcgagaaaccctttaaatgtttagaatgtggtaaagcctttaatatttccacaacccttactaaacataggagaattcatactggagagaaaccctacacatgtgaagtatgtggcaaagcctttagacagtccgcaaacctttatgtacataggagaattcatactggagagaaaccctacacatgtggagaatgtggcaaaacctttagacagtccgcaaacctttacgtacataggagaattcatactggagagaaaccttacaaatgcgaagactgtggcaaagcctttggacggtacacagccctgaatcaacacaagaaaattcatactggagagaaaccttacaaatgtgaagagtgtggcaaagcctttaatagttcaacaaaccttactgcacataagagaattcacaccagagagaaaccctacacatgtgaagatcgtggcagagcctttggattgtccacaaacctgaatgaatataagaaaattcatactggagataaaccctacaaatgtaaagaatgtgggaaagcctttatacattccttgcacctgaataaacatgagaaaattcatactggaaagaaaccctacaaatgtaagcaatgtggcaaagtcattacctcatcctcaagctttgctaaacataagaggattcatactggcgagaaaccctttgaatgtttagaatgtggtaaagcgtttactagttccacaacccttactaaacataggagaattcatactggagagaaaccctacacatgtgaagtatgtggcaaagcctttagacagtccgcaatcctttatgtacataggagaattcatactggagagaaaccctacacatgtgaagaatgtggcaaaacctttagacagtccgcaaacctttatgtacataggagaattcatactggagagaaaccttacaaatgtgaagagtgtggcaaagcctttggacggtacacagacctgaatcaacacaagaaaattcatactggagagaaactttacaaatgtgaagagtgtggcaaagactttgtatggtacacggacctgaatcaacagaagaaaatttacactggggagaaaccttacaaatgtgaagagtgtggcaaagcctttgccccatcaacagacctgaatcaacacacgaaaattcttactggagagcaaagttacaaatgtgaagagtgtggcaaagcctttggatggtccatagccctgaatcaacacaagaaaattcatactggagaaaaaccttacaaatgtgaagagtgtggcaaagcctttagtaggtcaagaaaccttactacacataggagagttcacactagggagaaaccctacaaatgtgaagatcgtggcagatcctttggatggtccacaaacctgaacgaatataagaaaattcatactggagataaactctacaaatgtaaagaatgtgggaaagtgtttaaacagtcctcacacctgaatagacatgagaaaattcatactggaaagaaaccctacaaatgtaaggaatgtggcaaagtcattacgtcatcctcaagctttgctaaacataagaggattcatacaggtgagaaaccctttaaatgtttagaatgtggtaaagcgtttactagttccacaacccttactaaacataggagaattcatactggagagaaaccctacacatgtgaagaatgtggcaaagcctttagacagtcagcaatcctttatgtacataggagaattcatactggagagaaaccctacacatgtggagaatgtggcaaaacctttagacagtctgcaaatctttatgcgcataagaaaattcatactggagagaaaccctacacgtgtggagactgtggcaaaacctttagacagtctgcaaatctttatgcacataagaaaattcatactggagataaaaccatacaagtgtaaagaatgtggcaaagcctttaagtcatactacagcattcttaaacataagagaactcataccaggggaatgtcttacgaaggtgacgaatgtcgcggtctttaaatgctcctcaatcctttctaatcataagataattcataatgaagagaaactctaaaatgtgaaaaatgtgagaaggcttttaatcacacctcaatctgttgtagacataagagtaattatattgatgagaagccaaattaaaattaaaaatgtggcaaagacttccaattctagtcagttcttaatgtaattcctactgaagaaaacacctggaaatacaaaaaatgtggcaaaacttgtaaccaatgcttagcatttttgcacatgatagtatttatatgtgagactacttgtacaaacataaaaatatacaaaagctattgtctacttgaaatttatagttaataaaagcattataaatgtaatttctgttgaaagaccttttagaaaatataggccattaaagtgaagaatagtcttaagacagagaatacaaagataaagagggctctagtacctgtacttgtatcccagaacttactatatgcattttgtactagaggaaaactctgaagcagttgcttaaactttgttcaacatcagagaatttatattggagagaaatcctacaaatgtaataaatgtggaaaaacctctgttcagaaactgcaggttaagaaaccagaggccaggcgcggtggctcacgcctgtaatcccaacactttgggaggccaaggagggtggatcacctgaggtcgggagttcaaggacagcctgaccaatatggagaaacctcgtctgtactaaaaatacaaaaattagcaggacatggtggtgcatggctgtaatcccagctactcaggaggctgagacaggagaatggcttgaacccaggaggtggaggttgcggtgagctgagatcgtgccattgcactccagcctgggtaacaagagtgaaactctgtctcaaaacaagataaaaagaaaagaaacaccagagaatttttactagaatataatttgtaggtgcagtaaatgtgaagaaatatttaggctaaaattaagactatgtaaacatcagaggatttacagtagaaagaactaaggaactaacacttcagactttaaaataaatcagagtattaagtataacaaaagttgaacctgttagaaaatttccttgtatataagttgaaaagtaggtttttgaagagatatattcgaaatatattttttcacttgaaaaaagtaaaaatttttttcaaaagcaaataattcaactctaaaattatactatttcaacattctcatttatgtgaaagcatgtgataaattgttgctgcgtcagagatatgagaaactcctttgcattaggtgggcattattcatagacttctacatgaaagagaagagaaataaaagatgcaccaggaaaatctgagcagagaggcttttagtggttgacttactgagtgatgcctgaagtaggtgttcagagtaatactttgcgttatactgagagagaatctgaattttagtagtaaattgttttgccaactgtatatttatgtaataagtgcaataaaatgcagtaaattttaaaattctcttaagataatgtgtgaacttaatttttgaaataaaaattgttattgtgttaaaa

SEQ ID NO: 3584 - DNA, 935 bp, Homo sapiens
gttgcttcagcctgagctcggttagggcctcacttccctgcttccacacctcagggaggcctcggtgattttgccagagcctcagcctccatcgctctgtaacctgcgggtattggatgattcgtagctaagacttcgcgacacccttgaagctgagaaatggaacccttaacattcagggatgtggccatagaattctctccagaagagtggaaatgcctggaccctgcccagcagaatttgtatagagatgtgatgttggagaactacagaaacctggtctccctagctatgtgttctcatttcacccaagactttttgccagtgcaggggatagaagattcattccacaaacttatactgagaagatatgagaaattttcctcgctgatctcttcatgccgtgtaatttcacatggactttcaagaggaaggaacagagccacagagaaaaatgacttgctcacaacagaagagccagtagtaaaacacaggtttgacttgcagtatccagaggaaatgtggagaaacacagttgtacagaagggaagaaaataggttgatactcctgttgcaggaccatttgaagtctgagagtttccaggatatgtcgttattgatccagctcaactttatgtatatgagaaacttggacagtctggacaatagaataaatgaagtcaataaaaccattcttttaacaaacttaataccataccttcagagtgttattttcctttttgtcataaggtgtctggaaatgaagtatggaaatgaaatcatgaataaagacccagttttcagaatctctccacgaagtagaggaactcataccaatccagaagagcctgaagaagatgttcaagctgaaagagtccaagcagcaaatgcactcactactccaaacttggaggaggaaccagtcataactgcaa

SEQ ID NO: 3585 - DNA, 2966 bp, Homo sapiens
acagcggggcgtcacctcggacatacgaacagcgggcggtgttcccggctccgtggggccgtcttcccggcgagtccgcgacggtcgccgcccacggcgaggaacccttaacattcagggatgtggccatagaattctctccagaagagtggaaatgcctggaccctgcccagcagaatttgtatagagatgtgatgttggagaactacagaaacctggtctccctagctatgtgttctcatttcacccaagactttttgccagtgcaggggatagaagattcattccacaaacttatactgagaagatatgagaaatgtgggcatgataatttacaattaaggaaaggctgtaaaagtatgaacgtgtgtaaagtgcagaagggagtttataatggaattaataaatgcttgtcaaatactcagagcaaaatatttcaatgtaatgcacgtgtcaaagtttttagtaaatttgcaaattcaaacaaagataagacaagacatactggagagaaacactttaaatgtaacgaatgtggcaagtcatttcagaagttctcagacctaactcaacataaaggaattcatgctggagagaaaccctacacttgtgaagaacgtggcaaagactttggatggtacacagacctgaatcaacacaagaaaattcatactggagagaaaccttacaaatgtgaagaatgtggcaaagcctttaataggtcaacaaaccttactgcacataagagaattcacaacagagagaaagcttacacaggtgaagatcgtgacagagcctttggatggtccacaaacctgaatgaatataagaaaattcatactggagataaaccctacaaatgtaaagaatgtgggaaagcctttatgcattcctcacacctgaataaacatgagaaaattcatactggagagaaaccctacaaatgtaaggaatgtggcaaagtcatttcctcatcctcaagctttgctaaacataagaggattcatactggcgagaaaccctttaaatgtttagaatgtggtaaagcctttaatatttccacaacccttactaaacataggagaattcatactggagagaaaccctacacatgtgaagtatgtggcaaagcctttagacagtccgcaaacctttatgtacataggagaattcatactggagagaaaccctacacatgtggagaatgtggcaaaacctttagacagtccgcaaacctttacgtacataggagaattcatactggagagaaaccttacaaatgcgaagactgtggcaaagcctttggacggtacacagccctgaatcaacacaagaaaattcatactggagagaaaccttacaaatgtgaagagtgtggcaaagcctttaatagttcaacaaaccttactgcacataagagaattcacaccagagagaaaccctacacatgtgaagatcgtggcagagcctttggattgtccacaaacctgaatgaatataagaaaattcatactggagataaaccctacaaatgtaaagaatgtgggaaagcctttatacattccttgcacctgaataaacatgagaaaattcatactggaaagaaaccctacaaatgtaagcaatgtggcaaagtcattacctcatcctcaagctttgctaaacataagaggattcatactggcgagaaaccctttgaatgtttagaatgtggtaaagcgtttactagttccacaacccttactaaacataggagaattcatactggagagaaaccctacacatgtgaagtatgtggcaaagcctttagacagtccgcaatcctttatgtacataggagaattcatactggagagaaaccctacacatgtgaagaatgtggcaaaacctttagacagtccgcaaacctttatgtacataggagaattcatactggagagaaaccttacaaatgtgaagagtgtggcaaagcctttggacggtacacagacctgaatcaacacaagaaaattcatactggagagaaactttacaaatgtgaagagtgtggcaaagactttgtatggtacacggacctgaatcaacagaagaaaatttacactggggagaaaccttacaaatgtgaagagtgtggcaaagcctttgccccatcaacagacctgaatcaacacacgaaaattcttactggagagcaaagttacaaatgtgaagagtgtggcaaagcctttggatggtccatagccctgaatcaacacaagaaaattcatactggagaaaaaccttacaaatgtgaagagtgtggcaaagcctttagtaggtcaagaaaccttactacacataggagagttcacactagggagaaaccctacaaatgtgaagatcgtggcagatcctttggatggtccacaaacctgaacgaatataagaaaattcatactggagataaactctacaaatgtaaagaatgtgggaaagtgtttaaacagtcctcacacctgaatagacatgagaaaattcatactggaaagaaaccctacaaatgtaaggaatgtggcaaagtcattacgtcatcctcaagctttgctaaacataagaggattcatacaggtgagaaaccctttaaatgtttagaatgtggtaaagcgtttactagttccacaacccttactaaacataggagaattcatactggagagaaaccctacacatgtgaagaatgtggcaaagcctttagacagtcagcaatcctttatgtacataggagaattcatactggagagaaaccctacacatgtggagaatgtggcaaaacctttagacagtctgcaaatctttatgcgcataagaaaattcatactggagagaaaccctacacgtgtggagactgtggcaaaacctttagacagtctgcaaatctttatgcacataagaaaattcatactggagataaaaccatacaagtgtaa

SEQ ID NO: 3586 - DNA, 2302 bp, Homo sapiens
aggtctcgtcctcactactctgtgtcttctgcttttaggggcgcagcctctgtggccctgtgacctgccccctggaagcctagaaatgggactgttgacatttagggatgtggccatagaattctctctggaggagtggcagtgcctggacactgcacagaagaatttatataggaatgtgatgttagagaactacagaaacctggccttcctgggtattgctgtctctaagccagacctcatcatctgtctggagaaagaaaaagagccctggaatatgaagcgagatgagatggtggatgaacccccaggtatatgtcctcattttgctcaagacatttggccagagcagggcgtggaagattcttttcaaaaagtaatactaagaagatttgaaaaatgtggacatgagaatttacagttaagaaaaggttgtaaaagtgtggatgagtgtaaggtacacaaagaaggttataatggacttaaccagtgtttcacaactacccagggcaaagcttctcaatgtggtaaatatttgaaagtcttttataaatttataaatttaaacagatataagataagacatactagaaagaaacctttcaaatgtaaaaattgtgtcaaatcattttgcatgttttcacacaaaacccagcataaaagcatatatactacagagaagtcctacaaatgtaaagaatgtggaaaaacctttaattggtcctcaacccttactaatcataagaaaactcatactgaagaaaagccctacaaatgtgaagaatatggcaaagcttttaatcaatcctcaaattatactacacataaggtaactcatactggagagaagccttacaagtgtgaagaatgtggcaaagcatttagccaatcctcaacactaaccatacataagaggatacatactggagagaaaccctgcaaatgtgaagaatgtggcaaagcatttagccaaccctcagcactaaccatacataagaggatgcacattggagagaaaccctacaaatgtgaagaatgtggcaaagcatttgtttggtcctcaaccctaactagacataagaggctgcacagtggagagaaaccctacaaatgtgaagaatgtgccaaagcttttagccaattcggacaccttactacacataggataattcatactggagagaaaccctacaaatgtgaagaatgtggcaaagcatttatatggccctcaaccctaactaaacataagaggattcacactggagagaaaccctacaaatgtgaagaatgtggcaaagcttttcatcgatcctcaaatcttactaaacataagataattcatactggagagaaaccttacaagtgtgaagaatgcggcaaagcgtttatatggtcctcaaaccttactgaacataagaaaattcatactagagagaaaccctacaaatgtgaagaatgtagtaaagcatttagccgatcctcagccctaactacacataagaggatgcacactggagagaaaccctacaaatgtgaagaatgtggcaaagcttttagccagtcctcaacccttactgcacataagataattcatactggagagaaaccctacaaatgtgaagaatgtggcaaagcatttatattgtcctcgaccctatctaaacataagaggattcacactggagagaaaccctacaaatgtgaagaatgtggcaaaacttttaatcaatcctcaaatcttagtacacataagataattcatactggagagaaaccttacaagtgtgaagaatgtggaaaagcgtttaatcgatcctcaaatcttagtacgcataagataattcatactggagagaaaccttacaagtgtgacgaatgtggcaaatcatttatctggtcctcaaccctttttaagcataagataattcacactggagagaaaccttacaagtgtgaagaatgtgggaaagcttttaatcattctcaaatcttactacacataagacataagaggatgcacactggagagaaaccttacaaatgtgaggaatgtgggaaatcttttaacctgtcttcaacttttattaaacataaggtaattcatactggagtaaaactctacaaatgtgaagaatgtggcaaagtgtttttctggtcctcagccctaactagacataagaaaattcatgctggacagcaaccctacaaatgggaaaaaattggcaaagcctttaaccagtcctcacatcttactacagataagataactcatattggagagaaatcttacaagtgtgaataa

SEQ ID NO: 3587 - DNA, 847 bp, Homo sapiens
ggggcctttgtctctatctgcggccggagctccaggtctcgtcctcactactctgtgtcttctgcttttaggggcgcagcctctgtggccctgtgacctgccccctggaagcctagaaatgggactgttgacatttagggatgtggccatagaattctctctggaggagtggcagtgcctggacactgcacagaagaatttatataggaatgtgatgttagagaactacagaaacctggccttcctgggtattgctgtctctaagccagacctcatcatctgtctggagaaagaaaaagagccctggaatatgaagcgagatgagatggtggatgaacccccaggccttgctgtctctaaccctgatctgatctcctgccttgagcaaataaaagagccctggaatgtgaagagacatgagacagtagtcaaatactcagggtgaaactgacctcagagtgacttaggaagaatttcatttttgggaagagtttcaagaggattgttattcaaatacatttggtagaatttggctgtgcatttttctagtcctaagcttttctttgtcaagacatttttaattactgactcaatcatgctactcattattggtttgttcaggtactctatttctttctggctctatcttgggaggttgtatgtttccataaatttatttactctaagttttcaggtttgtgagtgtctagttgtttataatcatttctagtgatcttttgtattactgttgtatccattgtaatgtctattctttcatttctgattttgtttatttagatctctcttctgtttgtgatgaatctagctagcaatttatcaattttgt

SEQ ID NO: 3588 - DNA, 806 bp, Homo sapiens
cggggcctttgtctctatctgcggccggagctccaggtctcgtcctcactactctgtgtcttctgcttttaggggcgcagcctctgtggccctgtgacctgccccctggaagcctagaaatgggactgttgacatttagggatgtggccatagaattctctctggaggagtggcagtgcctggacactgcacagaagaatttatataggaatgtgatgttagagaactacagaaacctggccttcctgggtattgctgtctctaagccagacctcatcatctgtctggagaaagaaaaagagccctggaatatgaagcgagatgagatggtggatgaacccccagatggagtctcgctctgtcacccaggctggagtgcagtggcgtgatcttggctcactgcaacctccgcctcccaggttcaagccattctcctgcctcagcctcctgagtagctgggactataggtgccgacaccgcgcttggctaattttttgtatttttagtagaaacggggtttcaccgtgctctcgatctcctgatctcgtgatctgcccgcctcggcctcccaaagtgctgggattacagatgccagtaatttaaaatgcctgccttccatgaatgcacagttacagtcaaacattgcagttatctagacaaattatttgttaatgtacataaatgttgccaactagttgtaatgagtaaacatttctgttattgtgttgcagttttatattagtgttttttgtagtgtaagtttcctaacatcagtttattgtgcctattggttttttcttatatat

SEQ ID NO: 3589 - DNA, 1798 bp, Homo sapiens
ctttgtctctatctgcggccggagctccaggtctcgtcctcactactctgtgtcttctgcttttaggggcgcagcctctgtggccctgtgacctgccccctggaagcctagaaatgggactgttgacatttagggatgtggccatagaattctctctggaggagtggcagtgcctggacactgcacagaagaatttatataggaatgtgatgttagagaactacagaaacctggccttcctgggtattgctgtctctaagccagacctcatcatctgtctggagaaagaaaaagagccctggaatatgaagcgagatgagatggtggatgaacccccaggtaggtgagagtgaatacaacagatgacctggatgagaggtccaacgtcaagaagaaagccagtctttaaagtgatttggaaagctgcattccaaaggaaaccgtttctggaaagcctgaaatttaaaaaaaaatatactctcagataggggcatcttctgcttatgcttataaaatctctaagaattctactctcccttcaatgatcttccttaacgtttacagtgacagccaaagtactgttcatggcatataaaagagtgtacaatctgactttttttttcttgtttttgtggacagatagatatctgcatagttttgagacactctatgttaaaatttttttttgttttagaaggagtttcgcttttgtggcccatgctggagtgcaatggtgcgatctcggctcactgcaacctctgcctcccaggttgaagtgattgtcctgcctcaggctcctgagtagctggggttacaggtgcacaccaccacaactggctaattttttgtatttctcgtagagacggagtttcatcatgttggccaggctggtctcctgacctcaggtgatccacccacctcagactcccaaagtgctgggattacaggtgtgagccaccgtgcctggcctctctttttgcacaagagtagtggtttctgtttcattaggggtttttttttgtttgtttgtttttctgctcatttcatcctgttttttttcttgctttcttttttttttttgtttatttaatatggccgtttttacttcctgcagaaagggtatactcgccagcagttttgccatgagagtacactgagcaaaggagacagggtcatttataacctgatgtgtccactctactgctgtgtccagtttccactggctggaacgggcatcctgttttcattactatagccttgaaatatagtttgggccatgcgtggtggctcacgcctgtaatcccagcattttgggaggccaaggtgggtgaatcacgaggtcacgaatttgagaccagcctggccaacatggtgaaaccccatctatactaaaaataaaaaaattagctgggctcagtggtgggcacctgtaatcccagctactcaggtggctgaggcaggagaattgcttgaacccaggagccagaggttgcaatgagctgagatcatgccactgtactttagcctgggcggcagagcaagactctctctcgatgtatatatatatagtttgaaattataaagtataatgtccttctgctttgttctttttcctcaagattgctttggctattcaaaatttattgtggtttcgtgtacattttaggattgtaattttcattactgtgaaaaactggaattttgacagggagtttattgagtctagagatcaccttagataatatggcagtttcacaatacttattctttcaatagaaataaaatatttttaaattta

SEQ ID NO: 3590 - DNA, 2473 bp, Homo sapiens
ctatctgcggccggagctccaggtctcgtcctcactactctgtgtcttctgcttttaggggcgcagcctctgtggccctgtgacctgccccctggaagcctagaaatgggactgttgacatttagggatgtggccatagaattctctctggaggagtggcagtgcctggacactgcacagaagaatttatataggaatgtgatgttagagaactacagaaacctggccttcctgggtattgctgtctctaagccagacctcatcatctgtctggagaaagaaaaagagccctggaatatgaagcgagatgagatggtggatgaacccccaggtatatgtcctcattttgctcaagacatttggccagagcagggcgtggaagattcttttcaaaaagtaatactaagaagatttgaaaaatgtggacatgagaatttacagttaagaaaaggttgtaaaagtgtggatgagtgtaaggtacacaaagaaggttataatggacttaaccagtgtttcacaactacccagggcaaagcttctcaatgtggtaaatatttgaaagtcttttataaatttataaatttaaacagatataagataagacatactagaaagaaacctttcaaatgtaaaaattgtgtcaaatcattttgcatgttttcacacaaaacccagcataaaagcatatatactacagagaagtcctacaaatgtaaagaatgtggaaaaacctttaattggtcctcaacccttactaatcataagaaaactcatactgaagaaaagccctacaaatgtgaagaatatggcaaagcttttaatcaatcctcaaattatactacacataaggtaactcatactggagagaagccttacaagtgtgaagaatgtggcaaagcatttagccaatcctcaacactaaccatacataagaggatacatactggagagaaaccctgcaaatgtgaagaatgtggcaaagcatttagccaaccctcagcactaaccatacataagaggatgcacattggagagaaaccctacaaatgtgaagaatgtggcaaagcatttgtttggtcctcaaccctaactagacataagaggctgcacagtggagagaaaccctacaaatgtgaagaatgtgccaaagcttttagccaattcggacaccttactacacataggataattcatactggagagaaaccctacaaatgtgaagaatgtggcaaagcatttatatggccctcaaccctaactaaacataagaggattcacactggagagaaaccctacaaatgtgaagaatgtggcaaagcttttcatcgatcctcaaatcttactaaacataagataattcatactggagagaaaccttacaagtgtgaagaatgcggcaaagcgtttatatggtcctcaaaccttactgaacataagaaaattcatactagagagaaaccctacaaatgtgaagaatgtagtaaagcatttagccgatcctcagccctaactacacataagaggatgcacactggagagaaaccctacaaatgtgaagaatgtggcaaagcttttagccagtcctcaacccttactgcacataagataattcatactggagagaaaccctacaaatgtgaagaatgtggcaaagcatttatattgtcctcgaccctatctaaacataagaggattcacactggagagaaaccctacaaatgtgaagaatgtggcaaaacttttaatcaatcctcaaatcttagtacacataagataattcatactggagagaaaccttacaagtgtgaagaatgtggaaaagcgtttaatcgatcctcaaatcttagtacgcataagataattcatactggagagaaaccttacaagtgtgacgaatgtggcaaatcatttatctggtcctcaaccctttttaagcataagaggattcatacttgagagaaaccttaaaaagggtaaagaatgtggcaaagcatttatatggtcctcaacgctaaacataagaggatgcacactggagagaaaccctacaaatgtgaagaatgtgaaaaagcttttaatcctcaaatcttactaaacattagataattcacactggagagaaaccttacaagtgtgaagaatgtgggaaagcttttaatcattctcaaatcttactacacataagataattcatactggaaataaaccctacaaatgtgaaaaatgtggcaaagcatatggtccacacccctaagtagacataagaggatgcacactggagagaaaccttacaaatgtgaggaatgtggcaaagcctttaaatgttcctcaactgttactgaacataaagtaattcatactgaagagaaaccctacaaatgtgaaaaatgtgtcaaagcctttaagcagtcttcaatcctgagtaaccataagataattcaaactggaaagaaaccctgcaagtctgaagaat

SEQ ID NO: 3591 - DNA, 3877 bp, Homo sapiens
gatgtggcggggccgttgtttctggttgcagccgcagttcccggtctcgccttcactgctgtgtgtcctcagcctctgtggccctgtaacctgcggcattggaagatccacagctaacatgccaggtgcccctggcagcctagaaatgggaccattgacatttagagatgtgaccatagaattctctctggaggagtggcaatgcctggacacggttcagcagaatttatatagggatgtgatgttagagaactacagaaacctggtcttcctgggtatggctgtctttaagccagacttgataacttgtctgaagcaagggaaagagccttggaatatgaagagacatgagatggtaactaaacccccagttatgcgttctcattttacacaagacctttggccagatcagagcacaaaagattctttccaagaagtaatactgagaacatatgcaagatgtggacataagaatttacgattaagaaaagattgtaaaagtgccaatgagggtaagatgcacaaagaaggttataataaacttaaccaatgcaggacagctacccagagaaaaatatttcagtgtaacaaacatatgaaagtctttcataaatattcaaatagaaataaggttagacacactaaaaagaaaactttcaaatgtataaaatgtagcaaatcatttttcatgctttcatgcttaattcgacataagagaattcatattagacagaatatctacaaatgtgaagaacgtggcaaagcctttaaatcgttctcaacccttactaaacataagataattcatactgaagacaaaccttacaaatataagaaatgtggcaatgcctttaaattttcttcaacgttcactaaacataagagaattcatactggagagacacctttcagatgtgaagaatgtggcaaagcttttaaccagtcctcaaatcttactgaccataagagaattcatactggagagaaaacctacaaatgtgaagaatgtggcaaagcttttaaggggtcctcaaattttaatgcacataaggtaattcatactgcagagaaaccctacaaatgtgaagattgtggcaaaacttttaaccatttctcagcccttagaaaacataagataattcatactggaaagaaaccctacaagcgtgaagaatgtggcaaagcttttagccagtcctcaacccttagaaaacatgagataattcatactggagagaaaccctacaaatgtgaagaatgtggtaaagcttttaagtggtcttcaaaacttactgtacataaggtagttcatactggagagaaaccctacaaatgtgaagaatgtggcaaagcttttagccagttctcaacccttaaaaaacataagataattcatactggaaagaaaccctacaaatgtgaagaatgtggcaaagcttttaacagttcctcaacccttatgaaacataagataattcatactggggagaaaccatacaaatgtgaagaatgtggcaaagcttttaggcaatcctcacaccttactagacataaagcaattcatactggagagaaaccctacaaatgtgaagaatgtggcaaagcttttaaccatttctcagaccttagaagacataagataattcatactggaaagaaaccctacaaatgtgaagaatgtgggaaagcttttagccagtcctcaacccttagaaaccatcagataattcatactggagagaaaccctacaaatgtgaagaatgtggtaaagcttttaagtggtcatcaaaacttactgtacataaggtaattcatactggagagaaaccctgcaaatgtgaagaatgtggcaaagcttttaagcatttctcagccctcagaaaacataaggtaattcatactagggagaaattgtacaaatgtgaagaatgtggcaaagcttttaacaattcctcaatccttgctaaacataagataattcatactgggaagaaaccgtacaaatgtgaagaatgtggcaaagcttttaggcaatcctcacaccttactagacataaagcaattcatactggagagaaaccttacaaatgtgaagaatgtggcaaagcttttagccatttctcagcccttagaagacataagataattcatactggaaagaaaccgtacaaatgtgaagaatgtggcaaagcttttagccatttctcagcccttagaagacataagataattcatactggagagaaaccctacaaatgtgaagaatgtggtaaagcttttaagtggtcatcaaaacttactgtacataaggtaattcatactgcagagaaaccctgcaaatgtgaagaatgtggcaaatcttttaagcatttctcagcccttagaaaacataaggtaattcatactagggagaaattgtacaaatgtgaagaatgtgtcaaagcttttaacagtttctcagcccttatgaaacataaggtaattcatactggagagaaaccctacaagtgtgaagaatgtggtaaagcttttaagtggtcctcaaagcttactgtacataaggtaattcatactggagagaaaccctgcaaatgtgaagaatgtggcaaagcttttaagcatttctcagcccttagaaaacataaggtaattcatactggaaagaaaccctacaaatgtgaagaatgtggcaaagcttttagccaatcctcatcccttagaaaacatgagataattcatagtggagagaaaccatacaaatgtgaagaatgtggtaaagcttttaagtggttgtcaaaacttactgtacataaggtaattcatactgcagagaaaccctgtaaatgtgaagaatgtggcaaagcttttaagcatttctcagcccttagaaaacataagataattcatactggaaagaaaccctacaaatgtgaagaatgtggcaaagcttttaatgattcctcaacccttatgaagcataagataattcatactgggaagaaaccatacaaatgtgcagaatgtggcaaagcttttaagcaatcctcacatcttactagacataaagcaattcatactggggagaaaccctacaaatgcgaagaatgtggcaaagattttaacaattcctcaacccttaagaaacataagctaattcatactagggagaaattgtacaaatgtgaagaatgtgtcaaagcttttaacaatttctcagcccttatgaaacataagataattcatactggggagaaaccctacaaatgtgaagaatgtggtaaagcttttaagtggtcctcaaaacttactgaacataaggtaattcatactggagagaaaccctgcaaatgtgaagaatgtgacaaagcttttaagcatttctcagcccttagaaaacataaggtaattcatactggaaagaaaccctaccaatgtgacgaatgtggcaaagcttttaacaattcctcaacccttacgaaacataagataattcatactggggagaaaccctacaaatgtgaagaatgtggcaaagcctttagtcagtcctcaatccttactaaacataagataattcattctgtagagaaaccctacaaatgtgaagaatgtggcaaagcctttaaccagtcctcacaccttactagacacaaaacaattcatactggagagaaaccctacaaatgtgaagaatgtggcaaagcttttattcagtgctcataccttattagacataaaacaattcataccagagagaaacctacaaatgtgaagaaagtaccaaagcttttaagcaatcctcacaccttactagacaaaacaattcatactggagagaaaccctacaaatgtgaagaatgtgccaaagctttttaa

SEQ ID NO: 3592 - DNA, 3203 bp, Homo sapiens
aatcaggcccgcagctggagcagacagggcggcttccgggatttggcgcggcctttgtttctcgctgccgccgaagctccaattttcgtctgtctgctttgtgtcctctgcacgtagaagcccagcctgtgtggccctgcgacctgcgggtattgggagatccacagctaagacgccagggccccctggaagcctagaaatgggagcgttgacatttagagatgtggccatagaattctctctggaggagtggcaatgtctggacaccgaacaacagaatttatatagaaatgtaatgttagataactacagaaacctggtcttcctgggtattgctgtctcaaagccagacctgatcacctgtctggagcaagaaaaagagccttggaatttgaagacacatgatatggtagccaaacccccagttatatgttctcatattgcccaagacctttggccagagcaaggcataaaagattatttccaagaagtcatactgagacaatataaaaaatgtagacatgagaatttactgttaagaaaaggctgtaaaaatgtggatgagtttaagatgcacaaaaaaggttataatagacataaccagtgtttgacaacttcccatagcaaaatatttcagtgtgacaaatatgtgaaagtctttcataaattttcaaattcaaacagacataagataagacatacttcgaagaaacctttcaaatgtaaagaatgtggaaaattattttgcattctttcacacttagctcaacataaaaaaattcatactggagagaaatcctacaaatgtgaagaatatggcaaagcctttaatgagtcctcaaactgtactacacataaaagaattactgagaaaaaaccttacaaatgtaaagaatgtggcaaagcctttaactggttttcacattttactacacataagagaattcatactggagaaaaaccctaccaatgtgagaaatgtggcaaattttttaaccaatccacaaaccttactacacataaaagaattcatactggagagaaaccctataaatgtgaagaatgtggcaaagcctttaaccagtcctcaaaccttactgaacataagaaaattcatactaaagagcaaccatacaaatgcgaaaaatgtggcaaagcttttaagtggtcctcaacccttacaaaacataaaagaattcataatggagaaaaaccctacaaatgtgaagaatgtggcaaagcttttaaccgatcctcaacccttaatagacataagataactcatactggagggaaaccctacaaatataaagaatgtggtaaagcttttaaccaatcctcaactcttactatacataagataattcatactgtagagaaattttacaaatgtgaagaatgtggcaaagcctttagccgtatctcacaccttactacacataagagaattcatactggagagaaaccctacaaatgtgaagaatgtggcagagctttcaaccagtcctcaacccttactacacataaaagaattcatactggagagaaaccctatgaatgtgaagaatgtggcaaagcttttaaccggtcctcaaccctcactacacataagataattcattctggggaaaaaatctacaaatgtaaagaatgtggtaaagcctttaggcggttctcacaccttactaggcataagacaattcatacataaaattgtaaagactgtggcaaagcttttaaacaatctttataccttactacacataagataattcatactgaagagaaaccctacaaatgtgaagaatgtggcaaagcttttaaccagtcctcaaatcttactaaacataaggtaattcatactggagaaaaacctacaaatgtgaagaatgtggcaaagtcttcaaccaatcttcacaccttactacacataagataattcatactggagagaaaccctacaagtgtgaagaatgtgacaaagcctttaacaaatccttaattcttaacagacatgattcataccagagagaaactctacaaacctgaaagttttaacagtgcttttgacaacacctcaaacttttccagatgtcaaagaaatgctggtgagaaattctagaaatatgaagaatgtgacaaagccattaaattgttgtcacatttaattgtaggtaaggtgattcatactggagaaaacttctacaagtgtaaacaaagtggcaaaacttttaaccaatgctcacactttattgcacaggacatttatacttgagaataaatatacaagtgtaaagaaagtgaaaaccctattaatatctgctcacatcaactcaacatcagagttcatacttaataaaatcattaaaagtgctgggattacaggcgtgagccaccgcgcccggctattcatgtattaatttcttactttaatgttctttagagtataatgtaaggtgtttcaaatttttggttaaatttatttcaaagtatagttatagttattgagatggaattgttttttaattcattctgagatagttgtcagtgaatagaaattctgacttttggatgttgcttttgtattctgcaagtttaataaatttgtttattctaataggttttagtaaagtcttaggcttttcttatgattatgcatagagataaaatattatataggaataatttaactttttcttctcaactggatgcttttgattgtattcttcaatatgtctttcttggacatttagtactatgtttagtaagactgaagaaatggcacattgttgacttgttttagatcttagagtaaaatcttacatttccttgtttagtatgtaattagctctgcattttttgttatatgtgacatttattggcttgaggtgcctttttcctatacctaaatttttcagagatttatcatgaggaaatgttgaattttgtcaagcttttattctgcatctatttaatgttaaaaatgtaaaatcacaatgaattctacataaattgaaaagttttcaaagactattatgaacatctctatgtatgcaaactaaaaaatttagagaaaactgataaagttttaactatacacaactttctaagattgaaccagtaagaaccagaagtcttaaccagagcaaaaatgtataaaatatataatgatattgaataagtaataaaaaagtatcaataat

SEQ ID NO: 3593 - DNA, 2193 bp, Homo sapiens
gaagtggggaaatggaactcttaacattcagggatgtggccatagaattctctccagaagagtggaaatgcctggaccctgcccagcagaatttgtatagagatgtgatgttggagaactacaggaacctgatctccctgggtgttgctatctctaacccagacctggtcatctatctggagcaaagaaaggagccctacaaagtgaagatacatgagacagtagccaaacacccagctgtgtgttctcatttcacccaagactttttgccagtgcaggggatagaagattcgttccacaaacttatattaagaagatatgagaaatgtggacatgagaatttagaattaagaaaaagctgtaaaaggaaggtgcagaaaggaggttataatgaatttaatcaatgcttgtcaactatccagagcaaaatatttcagtgtaatgtacatgtcaaagtatttagtacattttcaaattcaaaccaacgtaggataagacatactggagagaaacactttaaagaatgtggcaagtcatttcagaagttctcagacctaactcaacatcaaggaattcatgctggagagaaaccctacacatgtgaagaatgtggcaaagactttaaatggtatttaatctttaatgaatatgagataattcatactggagagaaacccttcacatgtgaagaatgtggcaacatctttaccacatcctcaaactttgctaaacataaagttcatactggagagaaatcttacaaatatgaagaatgtggcaaagcctttaataggtcctcaacccttactaagcataagagaattcatgctgaagagaaacccttcacatgtgaagaatgtggcaaaatcattacctcatcctcaaatgttgccaaacataagaaaattcataccggagagaaactctacaaatgtcaggaatgtggcaaagtctttaataggtccacaacccttactaaacataacagaattcatactggagagaaaccctacacatgtgaagaatgtggcaaagcctttagtaggtcctcagttctgaatgaacataagagaattcatactggagagaagccctacaaatgtgaacaatgtggcaaagcctttagacaatccgcaacccttaataaacataagagtattcatactggagagaaaccctacacatgtgaagaatgtggaaaagcctttagtcggttcacaacccttaatgaacataagagaattcatactggagagaggccccacaaatgtgaagagtgtggcaaagcctttggatggtccacagacctgaataaacataagataattcatactggagagaaaccttacaaatgtgaagagtgtggcaaagcctttggatggtctgcatacctgagtaaacataagaaaattcatactggagagaaaccttatagatgtgaagagtgtggcaaagcctttttatgttccagagccctgaataaacataagacaattcatactggagagaaaccttacgaatgtgaagagtgtggcaaagcctttggatggtccacatacctgagtaaacataagaaaattcatactggagagaaaccttatagatgtgaagagtgtggcaaagcatttagacgttccagagtcctgaataaatataagacaattcatactggagataaaacccccaaatgtaaaggatgtggcaaagcctttaagtggtcctcataccttaatcaacataataaaatttatactggagagaaactctagaaatatgaagaatgtggcaaagcctttggatgatccacaaacctgaatgaacataagaaaatttatactggaaataaactatacaaatgtgaagaatgtggcaaagcttttggatggtccacaaccctgaatgaaagtaagaattcatactggagaaaaaccctacaaatgtaaagaatgtgggaaagccttcaaacagtccgcatacctgaatcaacataagaaaattgatgctggagagcaaccctacaaatgtgaagaatgtggcaaagcttttagatggtccacaaccctgagtgaacataagaaaattcatatgggagatgaatcctacaaatgtaaagaatgtgggaaagcctataaacggtcctcacccataaataaacatgagaaaattcataatggagagaacacctacaaatgt

SEQ ID NO: 3594 - DNA, 2098 bp, Homo sapiens
ggtggccaacttgggtgtcttcctctgccagggtcaaggacaaggattgaaacgggtggggcctggagccctagccaatcagtggcgccagcgtgaaactgtccaatcaagtgcgcagctacagaggaagaggcggcctcttcaatatggcggggcctttgtctcctagcttccgggctctgatcctagttcgcgtctccactgttccatctcctccgttcctggagttcctcggtgactctactatagcttctgttatcctgtgacctgcaggtactgggagatccatagggaggacggcggaacatctggaggctgggaaatgggagtgttgacattcagggatgtggctgtagaattctccccagaagagtgggaatgcctggactctgctcagcagcgtttgtatagggatgtgatgttagagaactatggaaacctggtctccttgggtcttgctatctttaagccagacttgatgacctgtctggagcaaagaaaagagccttggaaagtgaagagacaggaggcagtagccaaacacccagctggttcttttcattttactgcagagatattgccggatcatgacataaaagattcatttcaaaaagtgattctgagaaaatatggaagctgtgaccttaataatttacatttaaagaaagactaccaaagtgtgggtaattgcaaggggcagaaaagcagttataatggccttcatcaatgtttgtcagctacccatagcaaaacctgtcaatgtaataaatgtggcagaggttttcagttgtgctcaatcttcactgaacataaagacatttttagcagagagaaatgccacaaatgtgaagaatgtggcaaagactgtaggttgttctcagattttactagacataagaaaattcatactgtagagagatgctacaaatgtgaagaatgtggcaaagcgtttaaaaagttttcaaaccttactgaacataagagagttcatactggagagaaaccttacaaatgtgaaggatgtggcaaaacttttacctgctcctcaacccttgttaaacacaagagaaatcatactggagacagaccctacaaatgtgaagaatgtggcaaagcctttaagtgcttctcagaccttactaatcataagagaattcatactggagagaaaccctacaaatgtgaagaatgtaacaaagcctataggtggttctcagaccttgctaaacataagataattcatactggagacaaaccctacacatgtaatgaatgtggaaaagcttttaagtggttctcggcccttagtaaacataagagaattcatactggagagaaaccctacatctgtgaagaatgtggcaaagcctttacccgctcctcaaccctttttaaccacaagagaattcatatggaagagagaccttacaaatgtgaagaatgcagcaaaacctttaagtgcttctcagacctgactaatcataagagaattcacactggagagaaaccctacaaatgtgaagaatgtggcaaagcatcgagctggttctcacacctcatcagacataagagaattcatactagagagaagctccacaagtgttaaaaatgtggaaaagcctttaccaagtcctcatactgtgttcaacatctgaaatttaatactgaacaaatgcagtataaatgtaatgacagtggaagaacatttatcatcttagagggtctctaagaacttactttataatctggttgcttatatgttgggtacatatatagccctttgctattatgtaatgccctttttttttaaatctatgttaatttcaagtctgttttgtcagaaactaggattgcaacccctgcttcttttcctgttttctatttgcttggtaggcttttctttttccctttattttgagcttatttgagatgggtgtcttgattaaagcataccattagatcttgattcttttttcagcttgccatctgtgctttaatttgggtatttagcccatttacatttaaggttagtattcatatgtgtggattggattctgttattaggatcttagctggctattttgcacatttgtttctg

SEQ ID NO: 3595 - DNA, 1765 bp, Homo sapiens
actgttccatctcctccgttcctggagttcctcggtgactctactatagcttctgttatcctgtgacctgcaggtactgggagatccatagggaggacggcggaacatctggaggctgggaaatgggagtgttgacattcagggatgtggctgtagaattctccccagaagagtgggaatgcctggactctgctcagcagcgtttgtatagggatgtgatgttagagaactatggaaacctggtctccttgggtcttgctatctttaagccagacttgatgacctgtctggagcaaagaaaagagccttggaaagtgaagagacaggaggcagtagccaaacacccagctggttcttttcattttactgcagagatattgccggatcatgacataaaagattcatttcaaaaagtgattctgagaaaatatggaagctgtgaccttaataatttacatttaaagaaagactaccaaagtgtgggtaattgcaaggggcagaaaagcagttataatggccttcatcaatgtttgtcagctacccatagcaaaacctgtcaatgtaataaatgtggcagaggttttcagttgtgctcaatcttcactgaacataaagacatttttagcagagagaaatgccacaaatgtgaagaatgtggcaaagactgtaggttgttctcagattttactagacataagaaaattcatactgtagagagatgctacaaatgtgaagaatgtggcaaagcgtttaaaaagttttcaaaccttactgaacataagagagttcatactggagagaaaccttacaaatgtgaaggatgtggcaaaacttttacctgctcctcaacccttgttaaacacaagagaaatcatactggagacagaccctacaaatgtgaagaatgtggcaaagcctttaagtgcttctcagaccttactaatcataagagaattcatactggagagaaaccctacaaatgtgaagaatgtaacaaagcctataggtggttctcagaccttgctaaacataagataattcatactggagacaaaccctacacatgtaatgaatgtggaaaagcttttaagtggttctcggcccttagtaaacataagagaattcatactggagagaaaccctacatctgtgaagaatgtggcaaagcctttacccgctcctcaaccctttttaaccacaagagaattcatatggaagagagaccttacaaatgtgaagaatgcagcaaaacctttaagtgcttctcagacctgactaatcataagagaattcacactggagagaaaccctacaaatgtgaagaatgtggcaaagcatcgagctggttctcacacctcatcagacataagagaattcatactagagagaagctccacaagtgttaaaaatgtggaaaagcctttaccaagtcctcatactgtgttcaacatctgaaatttaatactgaacaaatgcagtataaatgtaatgacagtggaagaacatttatcatcttagagggtctctaagaacttactttataatctggttgcttatatgttgggtacatatatagccctttgctattatgtaatgccctttttttttaaatctatgttaatttcaagtctgttttgtcagaaactaggattgcaacccctgcttcttttcctgttttctatttgcttggtaggcttttctttttccctttattttgagcttatttgagatgggtgtcttgattaaagcataccattagatcttg

SEQ ID NO: 3596 - DNA, 2442 bp, Homo sapiens
gtccaatcaggcacgcagcttgagcggagaggacggcttccgggatgtggcgggatttgtccgcttctttgtctttggctgccgctggaactccgggtctcgtcttcactgctctgtgtcctctgctcctagaggcccagcctctggtcctgtgacctgcaggtattgggaatccacagctaagacgccgggacaccctggaagcctagaaatggacgacctgaggtatggagtgtatcctgtcaagggggcaagtggataccctggggctgagaggaatcttctggagtactcttattttgaaaaggggccgttgacatttagggatgtggtcatagaattctctcaggaggagtggcaatgcctggacactgctcagcaagatttgtataggaaagtgatgttagagaacttcagaaacctggtgttcttgggtattgatgtctctaagccagatctgatcacctgtctggagcaaggaaaagatccctggaatatgaagagacacagtatggtagccacacccccagaaagtggggtattgaaatttcctactataattatattgctgtctaggtgtttcttccagtctgtcaatatttgctttatatatttggaaccttagtgtgacatacacacagacacacagacgtgcacacacacacacacacacacaaaatttgtcataggttcccagttaataaatctattattgtttaatgtctttctttgtctctttgcagttttgacttaaagtactttatgtaagatatgacagtttttgacttaagatgtggcttttgtaatactattttgacctcttctgctctcatttggttaatatttgcatgcaatgtctaaatctatcttgccaccttcagtatgtttttaatcattagatgtcagctgacccttgtagaaaggcaaattggatcttggtttttaataattttaaataaatttctttattgaaagtatgtctcttgattggaaagttttctgaaacaaagagacttactaattttttttgttgttctatttgattcttgcatctttgtcccacattttctctctttgtttctctctgtggctgttttatttttactttgatatgcttttacttctttcttatgttgttttctgtgtctatacaggcatattctttgtggtacgtgggggattacataaaacctttaagagatacaatgtatttcagtctagttaaaaatgaacttttgttgcatgcaaaaattttttctcattacatatgttctcagatttgttcttgatgttgctaattatatttttatatgtatatttattaacatgtttataatgatttctatgcctttatctttcaaattttggggaataattaaaaatttcttctgtgccattatgataatgctaagaaatgtatttttgtgtatgtgcgtatctttcccagaaaataatgtgttttaatatgattttgtgttgctttgttaaatcatcttattttcattggaagcaactgttttcagcaccttttatatgtaaggaagtaccaatatactttttaaaatttggttatttttgaagtttgttttctttttatttagcaggacagatttggtgatggtattatactcacttgataactattttcttcagatttcactatatcacacagttttcttctgtcctgaaaaatttttgttgagaatccactggctatctcataagagtattcttgcaaataatatcactttttttttttttttttttgagatggagtttcactgttgttccccaggccggagtgaaatggcgcgatttcacctcgctgtgtcccaggttcaagcagttctcctacctcagcctcccgagtagctgggattacgggcatatgccaccacacccagctaagtttgtatttttagtagagacagggtttctccatgttggtcaggctagtctcgatctcctgacctcaggtgattcacccacctcagcttcccaaagtgccgggattacaagcttgagctaccgcgcccagccaacacatcacttttatcttgcagctcccgagattctcttttctgtgacttttaaaattgtgcttacatatgtgtttgatataaatatctttgtattctagtttgtttgttcagcttcttcatttttacatcactttttaaaagatttctgttattttttatatttttttacctccataatttctgtttttccaatattttaaatatttctgttcttatttccagttttctgattttctgtagttctctgtgttcatattttactcattgagtattcaatttattttgtttttaaaattaatgtatacattttttatttctttctgaaaaatttataataattttgttggtactacattgccctgttttgtatatattctaatcttttattaaaatttgcaca

SEQ ID NO: 3597 - DNA, 1142 bp, Homo sapiens
gcttctttgtctttggctgccgctggaactccgggtctcgtcttcactgctctgtgtcctctgctcctagaggcccagcctctggtcctgtgacctgcaggtattgggaatccacagctaagacgccgggacaccctggaagcctagaaatggacgacctgaggtatggagtgtatcctgtcaagggggcaagtggataccctggggctgagaggaatcttctggagtactcttattttgaaaaggggccgttgacatttagggatgtggtcatagaattctctcaggaggagtggcaatgcctggacactgctcagcaagatttgtataggaaagtgatgttagagaacttcagaaacctggtgttcttgggtattgatgtctctaagccagatctgatcacctgtctggagcaaggaaaagatccctggaatatgaagagacacagtatggtagccacacccccagatggagtttcactgttgttccccaggccggagtgaaatggcgcgatttcacctcgctgtgtcccaggttcaagcagttctcctacctcagcctcccgagtagctgggattacgggcatatgccaccacacccagctaagtttgtatttttagtagagacagggtttctccatgttggtcaggctagtctcgatctcctgacctcaggtgattcacccacctcagcttcccaaagtgccgggattacaagcttgagctaccgcgcccagccaacacatcacttttatcttgcagctcccgagattctcttttctgtgacttttaaaattgtgcttacatatgtgtttgatataaatatctttgtattctagtttgtttgttcagcttcttcatttttacatcactttttaaaagatttctgttattttttatatttttttacctccataatttctgtttttccaatattttaaatatttctgttcttatttccagttttctgattttctgtagttctctgtgttcatattttactcattgagtattcaatttattttgtttttaaaattaatgtatacattttttatttctttctgaaaaatttataataattttgttggtactacattgccctgttttgtatatattctaatcttttattaaaatttgcacatt

SEQ ID NO: 3598 - DNA, 2861 bp, Homo sapiens
aaacgggccggggttggtgtttgtaaacttgcctcggtcccggtgggggcagccgcggcggtggggttggcagggtgtgctggggcctggaggaggcgccgcgcggccagggagccagcgggaggccgcgcctggcaggtttctgaaacagatcgtgagcttcatcaagagaattcaactggaaaaccaagactggtagactctctttttcttcagacaataggcaggagccaggcagagtccagggattcttggaacacctatcttttcttcggaggacactaagttctatttgaagacaaagttcaatatggcaacaggactgatgggacacgaaggagtcgctaccgtgatttggtgacagttcttcaaaacgacagtgtctcaaggaaaggtggacctaggaactcctgaacttttgggttgccttaagtgagaaatcagcatggctcaggcaagtctcctggcttgtgaaggcctagcaggtgtgagtttggttcccactgcagccagcaagaagatgatgctgagccagattgccagcaagcaggccgagaatggcgagcgggcaggtagccctgatgtgctgaggtgctcgagtcagggtcaccgaaaagacagtgataagtcccggagccgcaaagatgatgacagcttgtctgaggcctctcattcaaaaaagactgttaaaaaggtggtggtagtggaacaaaatggttcttttcaagtaaagattcccaaaaattttgtttgtgaacactgctttggagcctttcggagcagttaccacctaaagaggcacatccttattcacactggtgagaagccatttgaatgcgatatatgtgatatgcgtttcatccagaagtaccacctggaacgccacaagcgtgtgcacagtggtgaaaagccttaccagtgtgaacggtgtcatcagtgtttttctcggacagatcgattactcagacacaaacggatgtgccaagggtgccagtccaagacttccgacgggcagttttctctataggcgcaaggggccccgggtggtgggagtgatcagaagaacctgccgaagagcacaccccctctggtctgatggtcccaccaccgccccatgtgaacctgtcccactcctggaggagtggacccaggagaccagaagagtgcatcaggggacagtggccccagaacctcagctctgtaaataatctgagactatgagtatctcggggaagttcttacagcattcctgggtaggggagctagtccctggacccttggctgaggtcataggtggggactcaaggtacaggaccaagactgaagtgtggctcccacaaccttggactccagctggcagctgaaatggaaaagattggggaaggggatttgtttgttctgttcttgtttttgtttatccaaaagcaacttcagcgggtaaactgtggatacaggtaatccagaggcataagagtcctggtccaaagtagggactatagctggtccagctctccccaaaaattgggtttttagttgcagtagctcctcagtgtttcacaatcctgcacttcgcctcctttttgaggaagaataaggtcaggaatggcagctgagcttactttggcttccttatacactgtagggacaaaaggaaaaacggggtggagcagacaagggctggatccaaaaagtggatggcacctcttccttcctcaagggaaaaggaagagttgtgccagtgggtgttgtcatggcccatgtcacattggcacctgatggcatcagctcaaatgcctttaggaggaaacttgggtgagagtggcccatgaagcccttttcttctttttttggggagtcggtcttggagatggtatgtggctacctcgctgccattgactcctaaagtgagacagatgtgttgagcaaggagtcatggaagtcaaagtgggttctctctccttgtgccctcttaggaacaacccaagactggtcccaagttggctaacagctgctcaagaaacaaaggaatctggggtcttctgacatgcctgttgagcagtaggagctgttctccctccccaagtcctatcactgtattcaggtagaggaggtagggaggggtctgtcctttggtcccaaaaaacaagatctcggcttgcttcctgatggccatccctacccaacagagtgtgggggatgggggtgggggtgctgcagagaaaagactaaagaagaaacctaatgtaggttccattcttaaccatattctttgctcctctctgctccaataccaccaccttgtccactcccaaaaaagtaatcgggtgtgtgtgtgtgtgtgagagagagtgtgtgtgagatatgaatgcatgtatttgtatgcttgcaggagatggcatattattgagccaaacccttctctggccctcaccttcagggaggatgagtggaaaatagcctcctcttgcccaaacatgaagggtgcttgaggtctcagcaggagctgaagaacacaatttggggaacagaagggcttttgttttggagggtttttttttttaagatgaattcaacagcctggtggttaggatgtttctaacccaagccagggcttgtgaacatgaattttctaaggtgaaataaaccttttctttctgctaaagaaagaatccttatgggaagttttggggtttggttgacccccactgtaacctgacctgacctgtggcgggtacgggaactgtcttagtaatcatggagactggctgaacctgagtgccaagctgtcagtagggtctgagatgggaaactcctgaaagtatgatttcatttcccagaaaatgtaaagaatggataccagc

SEQ ID NO: 3599 - DNA, 2587 bp, Homo sapiens
ctggcggcgccctcatggttgcgttagcatggctacctagggatctgttcactgatttagagggtcccagagctctgggtcgggactgaggtgaaagagcggaaaaacgcgagaagcggtgttccttctacacagaggctagagtgcggatcggctgagtcggctgcaggcgcccctgcctccgtcagcgtccaggtgaccgccgttcccgccccgctcttccctgggtggactggaggaggccgcgccgatgaacctgaccgaggattgtatggtctttgaggatgtggccatatatttctcccaagaggaatgggggatccttaatgatgctcagagacacctgcacagcaatgtgatgttggagaactttgcgcttttgtcatcagtaggttgttggcatggagccaaggatgaggaggtaccttccaagcagtgtgtttctgtaagagtgttacaggtcacaattccaaagccagctttgtccaccctgaaggcccagccctgcaagatgtgtagctcaattctgaaggacattctgcacctggctgagcacgatggaacacaccctgagcaagggctgtacacatgtgcagcagagcatgacctgcaccaaaaggagcagattagagagaagctcaccagaagtgatgagtggaggccttcatttgtgaaccacagtgctcacgtgggagagaggaacttcacatgcacgcagggtggcaaggattttactgccagctcagaccttctccagcaacaggtcttaaacagtgggtggaagctgtacagggatacccaggatggggaagcctttcaaggtgaacagaatgatttcaactccagccaaggtgggaaagacttttgccaccaacatgggctgtttgagcaccaaaaaacccataatggggagaggccttatgagttcagtgaatgtggggaattgtttaggtacaactccaaccttattaaatatcagcaaaatcatgctggagaaaggccttatgagggcactgaatatggaaagacctttattagaaagtccaacctagttcagcaccagaaaattcacagtgaaggctttctttcaaaaaggtctgaccccattgaacatcaggagattctcagtagaccaacaccttatgaatgcacccagtgtgggaaggcctttcttacacaggctcatctggttggtcaccagaaaacccatactggagaacagccctatgaatgcaacaagtgtgggaagttttttatgtataactccaaactcatcagacatcagaaagttcacactggggagaggcgttacgagtgcagtgaatgtgggaaattgtttatggacagcttcacactcggtagacatcagagagttcatactggagaaaggccttttgaatgcagcatatgtggaaaattctttagtcaccgctccacactcaatatgcaccagagagttcatgctggcaaaaggctttataagtgtagcgaatgtgggaaagcctttagcctcaaacataatgttgttcagcatctgaaaattcatactggagaacggccttatgagtgcactgaatgtgagaaggcctttgttagaaagtcccacctagttcagcaccagaaaatccacactgatgcattttcaaaaaggtctgacctcattcaacacaagaggattgacattaggccaaggccttatacatgcagtgaatgtgggaaggccttccttacacaggctcatctggttggtcaccagaaaatccatactggagaacggccttatgaatgcactcaatgtgcgaaggcctttgttagaaagtcccacctagttcagcatgagaaaatccacactgatgcattttcaaaaaggtctgacctcattcaacacaagaggattgacctcaggccaaggccttatgtgtgtagtgaatgtgggaaggccttccttacacaggctcatctagatggtcaccagaaaatccagactggagaacggcgttatgaatgcaatgaatgtgggaaattctttttggacagctacaaacttgttattcatcagagaattcacactggagaaaagccttataaatgcagcaaatgtgggaaattctttagatatcgctgtacactgagtagacatcagaaagttcacactggagaaagaccttatgagtgtagtgaatgtgggaaattttttagagatagctacaaactcattattcatcagagagttcatactggagaaaagccttatgaatgcagcaactgtgggaagtttcttagataccgctctacattcattaaacatcataaagtttgcactggggagaagcctcatgagtgcagtaaatgtagggaattgtttaggactaaatcgagccttattatacatcagcagtctcacactggagaaagtccttttaagttaagggaatgtgggaaagacttcaacaaatgtaatactggtcagcgccaaaaaactcacactggagaaaggtcttatgagtgtggtgaatccagcaaagtgtttaaatacaactccagcctcattaaacatcagataattcatactggaaaaaggccttag

SEQ ID NO: 3600 - DNA, 1815 bp, Homo sapiens
gtccttgcgcagccggtggttgatatccgctgtatccatccccgagagggacctggtacctctacccaggtttctatcgctctgtctcctgcgctgtgcccttctgtagtcacaggagctgtagagaggaccccaggacatctgaaagccaggaaatgatgtttcaggaccctgtggcctgtgaggatgttgctgtgaacttcacccaggaggagtgggctttgctggatatttcgcagaggaaactctacagggaagtgatgctggaaactttcaggaacctgacctctatagggaaaaagtggaaagaccagaacattgaatatgagtaccaaaaccccaggagaaacttcaggagtctcatagaagggaatgtcaatgaaattaaagaagacagtcattgtggagaaacttttacccaggttccagatgacaggctgaacttccaggagaagaaagcttctcctgaagcaaaatcatgtgataactttgtatgtggagaagttggcataggtaactcatcttttaatatgaacatcagaggtgacattgggcacaaggcatacgagtatcaggactatgcaccaaagccatataagtgtcaacaacctaagaaagccttcagatatcacccctcctttagaacacaagaaaggaatcacaccggagagaaaccctatgcttgtaaagaatgtggaaaaacctttatttcccattcaggcattcgaagacgcatggtaatgcacagtggggatggaccttataaatgtaagttttgtgggaaagctgtccattgtctcagattatatcttatccatgaaagaactcacactggagagaaaccgtatgaatgtaaacaatgtgttaaatcctttagttattctgctacccatcgaatacatgaaagaactcacactggagaaaagccttatgaatgtcagcaatgtgggaaagcattccatagttccagttcttttcaagcacataaaagaacccacactgggggaaagccatatgaatgtaaacaatgtggcaaatccttcagttggtgtcattcctttcaaatacatgaaagaactcacactggggagaagccctgtgaatgtagcaaatgtaataaagcattccgtagttacagatcctatcttagacataaaaggagtcacacgggagagaagccttatcaatgtaaggaatgtagaaaagcattcacgtatcccagttcccttcgtagacatgaaaggacccactctgcgaaaaaaccttatgaatgtaagcagtgtgggaaagcattatcttataagttttcaaacacacctaagaatgcgctctggagaaagaccttataaatgttagatatgtgggaaaggcctttattctgccaagtcatttcgaagacatgaaaaaactcacactggagagaaaccctataaatgcatgccatgtggtaaagccttcaatctttccagttcctttcagtatcatgaaaggactcacactggagagaaaccctatgagtgtaagcaatgtgggaaagccttcagatgtgccccacaccttcgaaggcatggtaggactcactggagagaaaccctatgagtgtaaggaatgtgggaaagccttcagatctgcctcacaccttcaaattcatgaaaggacacaaacacacataagaatacactctggagaaagaccttataaatgtaagacatgtgggaaaggcttttattctcccacgtcatttcaaagacatgaaaaaactcacactgcagagaaaccctatgaatgcaagcaatgtggtaaagccttcagtag

SEQ ID NO: 3601 - DNA, 1518 bp, Homo sapiens
gctgtatccatccccgagagggacctggtacctctacccaggtttctatcgctctgtctcctgcgctgtgcccttctgtagtcacaggagctgtagagaggaccccaggacatctgaaagccaggaaatggaccctgtggcctgtgaggatgttgctgtgaacttcacccaggaggagtgggctttgctggatatttcgcagaggaaactctacagggaagtgatgctggaaactttcaggaacctgacctctatagggaaaaagtggaaagaccagaacattgaatatgagtaccaaaaccccaggagaaacttcaggagtctcatagaagggaatgtcaatgaaattaaagaagacagtcattgtggagaaacttttacccaggttccagatgacaggctgaacttccaggagaagaaagcttctcctgaagcaaaatcatgtgataactttgtatgtggagaagttggcataggtaactcatcttttaatatgaacatcagaggtgacattgggcacaaggcatacgagtatcaggactatgcaccaaagccatataagtgtcaacaacctaagaaagccttcagatatcacccctcctttagaacacaagaaaggaatcacaccggagagaaaccctatgcttgtaaagaatgtggaaaaacctttatttcccattcaggcattcgaagacgcatggtaatgcacagtggggatggaccttataaatgtaagttttgtgggaaagctgtccattgtctcagattatatcttatccatgaaagaactcacactggagagaaaccgtatgaatgtaaacaatgtgttaaatcctttagttattctgctacccatcgaatacatgaaagaactcacactggagaaaagccttatgaatgtcagcaatgtgggaaagcattccatagttccagttcttttcaagcacataaaagaacccacactgggggaaagccatatgaatgtaaacaatgtggcaaatccttcagttggtgtcattcctttcaaatacatgaaagaactcacactggggagaagccctgtgaatgtagcaaatgtaataaagcattccgtagttacagatcctatcttagacataaaaggagtcacacgggagagaagccttatcaatgtaaggaatgtagaaaagcattcacgtatcccagttcccttcgtagacatgaaaggacccactctgcgaaaaaaccttatgaatgtaagcagtgtgggaaagcattatcttataagttttcaaacacacctaagaatgcgctctggagaaagaccttataaatgttagatatgtgggaaaggcctttattctgccaagtcatttcgaagacatgaaaaaactcacactggagagaaaccctataaatgcatgccatgtggtaaagccttcaatctttccagttcctttcagtatcatgaaaggactcacactggagagaaaccctatgagtgtaagcaatgtgggaaagccttcagatgtgccccac

SEQ ID NO: 3602 - DNA, 1562 bp, Homo sapiens
acagttcatccggaaatggagggggtcgctttcctcaccttcctcgctgcgcgggcggcggttggtaaccggtcagaccagcccgagagggacctggtgcctgtacccaggcttctgtcgctctgtcgcctgcgctatgccctgctgtagtcacaggagctgtagagaggaccccggtacatctgaaagccgggaaatggaccctgtggcctgtgaggatgttgctgtgaacttcacccaggaggagtgggctttgctggatatttcgcagaggaaactctacagggaagtgatgctggaaactttcaggaacctgacctctatagggaaaaagtggaaagaccagaacattgaatatgagtaccaaaaccccaggagaaacttcaggagtctcatagaagggaatgtcaatgaaattaaagaagacagtcattgtggagaaacttttacccaggttccagatgacaggctgaacttccaggagaagaaagcttctcctgaagcaaaatcatgtgataactttgtatgtggagaagttggcataggtaactcatcttttaatatgaacatcagaggtgacattgggcacaaggcatacgagtatcaggactatgcaccaaagccatataagtgtcaacaacctaagaaagccttcagatatcacccctcctttagaacacaagaaaggaatcacaccggagagaaaccctatgcttgtaaagaatgtggaaaaacctttatttcccattcaggcattcgaagacgcatggtaatgcacagtggggatggaccttataaatgtaagttttgtgggaaagctgtccattgtctcagattatatcttatccatgaaagaactcacactggagagaaaccgtatgaatgtaaacaatgtgttaaatcctttagttattctgctacccatcgaatacatgaaagaactcacactggagaaaagccttatgaatgtcagcaatgtgggaaagcattccatagttccagttcttttcaagcacataaaagaacccacactgggggaaagccatatgaatgtaaacaatgtggcaaatccttcagttggtgtcattcctttcaaatacatgaaagaactcacactggggagaagccctgtgaatgtagcaaatgtaataaagcattccgtagttacagatcctatcttagacataaaaggagtcacacgggagagaagccttatcaatgtaaggaatgtagaaaagcattcacgtatcccagttcccttcgtagacatgaaaggacccactctgcgaaaaaaccttatgaatgtaagcagtgtgggaaagcattatcttataagttttcaaacacacctaagaatgcgctctggagaaagaccttataaatgttagatatgtgggaaaggcctttattctgccaagtcatttcgaagacatgaaaaaactcacactggagagaaaccctataaatgcatgccatgtggtaaagccttcaatctttccagttcctttcagtatcatgaaaggactcacactggagagaaaccctatgagtgtaagcaatgt

SEQ ID NO: 3603 - DNA, 1523 bp, Homo sapiens
gtccttgcgcagccggtggttgatatccgctgtatccatccccgagagggacctggtacctctacccaggtttctatcgctctgtctcctgcgctgtgcccttctgtagtcacaggagctgtagagaggaccccaggacatctgaaagccaggaaatggagtctcatagaagggaatgtcaatgaaattaaagaagacagtcattgtggagaaacttttacccaggttccagatgacaggctgaacttccaggagaagaaagcttctcctgaagcaaaatcatgtgataactttgtatgtggagaagttggcataggtaactcatcttttaatatgaacatcagaggtgacattgggcacaaggcatacgagtatcaggactatgcaccaaagccatataagtgtcaacaacctaagaaagccttcagatatcacccctcctttagaacacaagaaaggaatcacaccggagagaaaccctatgcttgtaaagaatgtggaaaaacctttatttcccattcaggcattcgaagacgcatggtaatgcacagtggggatggaccttataaatgtaagttttgtgggaaagctgtccattgtctcagattatatcttatccatgaaagaactcacactggagagaaaccgtatgaatgtaaacaatgtgttaaatcctttagttattctgctacccatcgaatacatgaaagaactcacactggagaaaagccttatgaatgtcagcaatgtgggaaagcattccatagttccagttcttttcaagcacataaaagaacccacactgggggaaagccatatgaatgtaaacaatgtggcaaatccttcagttggtgtcattcctttcaaatacatgaaagaactcacactggggagaagccctgtgaatgtagcaaatgtaataaagcattccgtagttacagatcctatcttagacataaaaggagtcacacgggagagaagccttatcaatgtaaggaatgtagaaaagcattcacgtatcccagttcccttcgtagacatgaaaggacccactctgcgaaaaaaccttatgaatgtaagcagtgtgggaaagcattatcttataagttttcaaacacacctaagaatgcgctctggagaaagaccttataaatgttagatatgtgggaaaggcctttattctgccaagtcatttcgaagacatgaaaaaactcacactggagagaaaccctataaatgcatgccatgtggtaaagccttcaatctttccagttcctttcagtatcatgaaaggactcacactggagagaaaccctatgagtgtaagcaatgtgggaaagccttcagatgtgccccacaccttcgaaggcatggtaggactcactggagagaaaccctatgagtgtaaggaatgtgggaaagccttcagatctgcctcacaccttcaaattcatgaaaggacacaaacacacataagaatacactctggagaaagaccttataaatgtaagacatgtgggaaa

SEQ ID NO: 3604 - DNA, 2738 bp, Homo sapiens
ctttctcgggcgcaggaggttccgcaggcccaggccaggccaggggaggcagccgatccgtcgtcggggttgacagttaccatggcgccgcctctggccccgctccctccccgggacccaaacggggccggacccgagtggagggagccgggggctgtgagcttcgcggacgtggccgtgtacttctgccgggaggagtggggctgcttgcggccagcgcagagggccctgtaccgggacgtgatgcgggagacctacggccacctgagcgctctcggaatcggaggcaacaagccagctctcatctcctgggtggaggaggaggccgaactgtggggtccggctgcccaggatccggaggtggcgaaatgtcagacacaaacggacccagcagattccagaaacaagaaaaaggaaagacaaagggaagggacgggagccctggagaagcccgaccctgtggccgccgggtctcctgggctgaagtctccccaagccccctcggccgggcccccttatggttgggagcagctgtccaaggcaccgcaccggggacgcccctccctctgtgcccacccccctgtcccccgagctgaccagcgtcatggctgctacgtgtgcgggaagagctttgcctggcgctccacactggtggagcacgtctacagtcacactggcgagaagcccttccactgcactgactgcggcaagggcttcggccacgcttcctccctgagcaaacaccgggccatccatcgtggggagcggccccaccgctgtctggagtgtggccgggccttcacgcagcgctcggcgctgacttcgcacctgcgcgtccacaccggcgagaaaccctatggctgcgccgactgtggccgccgcttcagccagagctctgccctctaccagcaccggcgcgtgcacagcggcgagacccccttcccctgcccggactgtggccgcgccttcgcctacccctcggacctgcggcgccacgtgcgcacccacaccggcgagaagccctacccgtgcccggactgcgggcgctgcttccgccagagctcggagatggcagcccacaggcgcacccacagcggcgagaagccctacccctgcccgcagtgcggccgccgctttggccagaagtcagccgtggccaaacaccagtgggttcatcggcccggggccgggggccacaggggccgggtcgccgggcgtctgtctgtgaccctgacccctggccacggagacctggacccgcccgtgggcttccagctgtacccggagatattccaggagtgtgggtgacggccttaaaagtgactatctagacattacgggaggcccgagatgggctcaggggcccgaacctctgcggcggcctgcagggaggtcccagaatctagggcaagagctggccctggggtgcggacagtctgatcttgggcccttagcagcctcctctgccagcaccttgctccccactgcccagggctctccaaggccccctctactgaggcagggctgagttgagaacccccagacctacataaggggaaccaaaagctgtttctcagcccagaggtgctaagaggactgaggtagaggagaaccttgttttacccattgtctttttaaattttttatcattatttttattcttgtgaccctcccagaacacaatactcattgtctttttatttatttatttatttatttctgagacagcttcctgctctgtcacccaggctggagtgcagtggtgtgaacagggctaactgcagcctcaacctgcagtgctcaaggaatcctctcccatcagccttccaaatatctgagactacaggcgggcaacactacggccagctaatttttaaattttacatagagatgaggttctcactgttgtccaggctggtctcaaactccttggctgaagtgatcctgtcgtctcggcttccgcaagtgctgggattacaggcgtgagctaccaccatgcctggcttccattgtctttgtgtgtgtgtgtgtgtgatggggttttgctcttgttgcccaggctggagtgcaatagcgcaatctcagctcactgcaacctctgcctccagagttcaagcaattctccttcctcagcctcccaagtagctgggactacaggcacccaccacctccattgtctttttactgcccaagttaaaatcctgtgactgtgtactggatctggcctgcggttgtcatatttattgatctgagtccaggcagtgtttttaagtgatatgagttagtagtgaaaattgaaaaggatattttacaaccaaatacaggttttctggtgtcttttgaaaaatccaaagatttggcaactcgacctaggctccgacaaaaccacagttgttgggagctgagccggagccagaactcacaattcaccgtggcccggccacccatccccaccactcccgtgggctcctgaccaagcaccacgtgccattcatcatggcttgcttttagtgtttttggtgtttatcttaaagtacagcgaagaagaaagggaagtatttcttagacccatgtctctgtccaaataggcctttccatctggcatttcccgctcatttatatgacttgctgagttcctatggtcatttgagtttgcaaacagtggtctgtagcactcaggttttctggagttggagagaaagggtggcaagagagaagtaaaagttggttttatttta

SEQ ID NO: 3605 - DNA, 2825 bp, Homo sapiens
gccatcggcaccgttagtttccacgccctctagtgcgccctcgggggccctagtaacctccctccttcccttgggcccgggccggggaggctttctcgggcgcaggaggttccgcaggcccaggccaggccaggggaggcagccgatccgtcgtcggggttgacagttaccatggcgccgcctctggccccgctccctccccgggacccaaacggggccggacccgagtggagggagccgggggctgtgagcttcgcggacgtggccgtgtacttctgccgggaggagtggggctgcttgcggccagcgcagagggccctgtaccgggacgtgatgcgggagacctacggccacctgagcgctctcggaatcggaggcaacaagccagctctcatctcctgggtggaggaggaggccgaactgtggggtccggctgcccaggatccggaggtggcgaaatgtcagacacaaacggacccagattccagaaacaagaaaaaggaaagacaaagggaagggacgggagccctggagaagcccgaccctgtggccgccgggtctcctgggctgaagtctccccaagccccctcggccgggcccccttatggttgggagcagctgtccaaggcaccgcaccggggacgcccctccctctgtgcccacccccctgtcccccgagctgaccagcgtcatggctgctacgtgtgcgggaagagctttgcctggcgctccacactggtggagcacgtctacagtcacactggcgagaagcccttccactgcactgactgcggcaagggcttcggccacgcttcctccctgagcaaacaccgggccatccatcgtggggagcggccccaccgctgtctggagtgtggccgggccttcacgcagcgctcggcgctgacttcgcacctgcgcgtccacaccggcgagaaaccctatggctgcgccgactgtggccgccgcttcagccagagctctgccctctaccagcaccggcgcgtgcacagcggcgagacccccttcccctgcccggactgtggccgcgccttcgcctacccctcggacctgcggcgccacgtgcgcacccacaccggcgagaagccctacccgtgcccggactgcgggcgctgcttccgccagagctcggagatggcagcccacaggcgcacccacagcggcgagaagccctacccctgcccgcagtgcggccgccgctttggccagaagtcagccgtggccaaacaccagtgggttcatcggcccggggccgggggccacaggggccgggtcgccgggcgtctgtctgtgaccctgacccctggccacggagacctggacccgcccgtgggcttccagctgtacccggagatattccaggagtgtgggtgacggccttaaaagtgactatctagacattacgggaggcccgagatgggctcaggggcccgaacctctgcggcggcctgcagggaggtcccagaatctagggcaagagctggccctggggtgcggacagtctgatcttgggcccttagcagcctcctctgccagcaccttgctccccactgcccagggctctccaaggccccctctactgaggcagggctgagttgagaacccccagacctacataaggggaaccaaaagctgtttctcagcccagaggtgctaagaggactgaggtagaggagaaccttgttttacccattgtctttttaaattttttatcattatttttattcttgtgaccctcccagaacacaatactcattgtctttttatttatttatttatttatttctgagacagcttcctgctctgtcacccaggctggagtgcagtggtgtgaacagggctaactgcagcctcaacctgcagtgctcaaggaatcctctcccatcagccttccaaatatctgagactacaggcgggcaacactacggccagctaatttttaaattttacatagagatgaggttctcactgttgtccaggctggtctcaaactccttggctgaagtgatcctgtcgtctcggcttccgcaagtgctgggattacaggcgtgagctaccaccatgcctggcttccattgtctttgtgtgtgtgtgtgtgtgatggggttttgctcttgttgcccaggctggagtgcaatagcgcaatctcagctcactgcaacctctgcctccagagttcaagcaattctccttcctcagcctcccaagtagctgggactacaggcacccaccacctccattgtctttttactgcccaagttaaaatcctgtgactgtgtactggatctggcctgcggttgtcatatttattgatctgagtccaggcagtgtttttaagtgatatgagttagtagtgaaaattgaaaaggatattttacaaccaaatacaggttttctggtgtcttttgaaaaatccaaagatttggcaactcgacctaggctccgacaaaaccacagttgttgggagctgagccggagccagaactcacaattcaccgtggcccggccacccatccccaccactcccgtgggctcctgaccaagcaccacgtgccattcatcatggcttgcttttagtgtttttggtgtttatcttaaagtacagcgaagaagaaagggaagtatttcttagacccatgtctctgtccaaataggcctttccatctggcatttcccgctcatttatatgacttgctgagttcctatggtcatttgagtttgcaaacagtggtctgtagcactcaggttttctggagttggagagaaagggtggcaagagagaagtaaaagttggttttatttta

SEQ ID NO: 3606 - DNA, 356 bp, Homo sapiens
gcagacccggaagcggacggcgtggagtgactatcccaccgccgcggggtctattgacattcagggatgtggccatagaattctctcaggaggagtggaaatgcctggaccctgctcagaggactctatacagggacgtgatgctggagaattataggaacctggtctccctggacggagtctcggtctgtcacccaggctggagtgcggtggtgcgatcttggctaactgcagcctctgcctcccaggttcaagtgattttcctgcttcagtctcccaagtagctgggactacaggcacatgccaccacacctggctaatatatctcttccaaatgcatgatgaaggagttctcg

SEQ ID NO: 3607 - DNA, 4569 bp, Homo sapiens
gacccggaagcggacggcgtggagtgactatcccaccgccgcgggattgacttctaaagactcttggtatgtgaggaagaaacctggaagaggaagaggaaagcaaaggagtcagggatggctcttcctcagggtctattgacattcagggatgtggccatagaattctctcaggaggagtggaaatgcctggaccctgctcagaggactctatacagggacgtgatgctggagaattataggaacctggtctccctggatatctcttccaaatgcatgatgaaggagttctcgtcaacagcacaaggcaatagagaagtgttccatgcagggacatctcaaagacatgaaagtcatcacaatggagatttttgtttccaggatattgataaagatattcatgacattgagtttcagtggcaagaagatgaaagaaatggccatgaagcactcatgacaaaaatcaaaaagttgacaggtagtacagagcgatatgatcaaaattatgctggaaacaagcctgttaaatatcagcttggattcagctttcattcgcatctgcctgaactgcacatatttcacactgaagagaaaattgataatcaagttgtgaagtctatccacgatgcttccttggtttcaacagcccaaagaatttcttgtaggcctgaaacccatatttctaatgactatgggaataatttcctgaattcttcattattcacacaaaaacaggaagtacatatgagggaaaaatctttccaatgcaatgacagtggcaaagcctataattgtagctcactcttaaggaaacatcagttaatccatttaggagagaaacaatataaatgcgatatatgtggcaaggtctttaattcgaagcgatacgttgcacgccatcgtagatgtcacactggtgagaaaccttacaagtgtaatgagtgtggcaagaccttcagtcagacatattacctaacatgccatcgtagacttcatactggagagaaaccttacaaatgtgaagaatgtgacaaagctttccatttcaaatcaaagcttcaaatacataggagaattcatactggagagaaaccgtacaagtgtaatgagtgtggcaagacctttagtcagaagtcgtaccttacatgccatcgtaggcttcatactggagagaaaccttacaagtgtaatgagtgtggcaagacctttagtcggaagtcacattttacatgccatcatagagttcatactggagagaaaccttacaagtgtaatgagtgtagcaagacctttagtcacaagtcatctcttacataccatcgtagacttcatactgaagagaaaccttacaagtgtaatgagtgtggcaagaccttcaatcagcagttaacccttaacatttgtagacttcatagtggagagaaaccttacaaatgtgaagaatgtgacaaagcctacagtttcaaatcaaaccttgaaatacatcagaaaattcatactgaagagaatccttacaagtgtaatgagtgtggcaagaccttcagccggacgtcatcccttacataccatcatagacttcatactggacagaaaccttacaaatgtgaagattgtgatgaagctttcagtttcaaatcaaaccttgaaagacataggagaatttatactggagagaaactacacgtgtaatgagtgtggtaagaccttcaatcaggagttaacccttacatgccatcgtaggcttcatagtggagagaaaccttacaaatatgaagaacttgacaaagcttacaatttcaaatcaaaccttgaaatacatcagaaaattcgtactgaagagaatcttacaagtgtaatgagtgtggcaagaccttgagtcatacgtcatcttttgtgtaccatcataaacttcatagtggagagaccttacaaatgtgaagaatgtgaagaagctttctgtttcaaatccaaccttgaaagacataggagaattcacactggtgagaaaccttacaggtgtaatgagtgtggcaagaccttcagccagacctcatcccttacatgccattgtagacttcgtactggagagaaaccttacaaatgtgaagaatttgagttttccatttcaaatcaaaccttgaaagacaaaggagaattcatactggagagaaaccatacaagtgtaatgagtgtggcaagacctttagtcagaactcataccttacacgccatcgtagacttcatactggaggataccttacaaatgtaatgagtgtggcaagacctttagtcagaactcataccttacatgccatcatagacttcatactggagagataccttaaaagtgtagtgagtgtggcaagacctttagtctgaagtcataccttacgcaccatcgtagacttcatactggagaggtaccttacaaggataatgagtgtagaaaaacctttcatgggcagtcagcattttacaaatgtaatgattgtcaccaagtcttgagtaatgctacaactattgcaaatcattggagaatccataatgaagagagatcctacaagtgtgataaatgcagaataaatgcagaaaatttttcagacatccttcatacctttgcagttcatgggtgaagtcgtattagaaaccttacaaatgtgaagaatgtgatgaagctttcagattcaaatcaaaccttgatagtcatagaattcatactagagagaaaccttagcagtgtaatgaacgtggcaaggttttaaatcaaaaagcaaagcttgcacatcatcatagaattcatactggagataaacgttacaaatgtgaagcatgtgacaaagtttacagtcgcaaatcaagcctccaaagacaggagaattcatactggagagaaagcttacatatgtgaagaatgtcaccaagttttcagtcacactcaaaccttgaaagacacaggagaattcctactggagagatagcataaaaatgtaagagtttgtgacaaggctttcaggcataattcgcacctggcacaacatcctagaattcacattggagagaaagcttacaagtataatgaatgtgacaggtctttagtgggcagtcaacacttgtttaccatcaggcaatccatggtgtagggaaactttacttatgtaatgattgtcacaaagtcttcagttacactacaaccattgcgaatcattggagaatccataatgaagagagatcatactagtttaataaatttggcaaatttttcagacattgttcataacttgcagttcatcggcgaactcgtactggagagaaaccttacaaatgtcatgattgtgacaaggtctcagtcaagcttcattctatgcaaaacataggagaattcatacaggagagaaacctcacaagtgtgatgattgcggcaaagcctttaattcacattcacacctcactagacatcagagaatgcatactggacagaaatcttataaatgtcatcagtgtgccaaagtcttcagtctgagctcactccttgcaggatatcagaaaattcattttggagatagttgttccaaatacaatgtgtatagcaaaccatcaagcattaattgacactagagtcagttcagcattgacttgagtttgacttaacattgagttgaagccttaattgacattaaagtgtttatgttaagaggactgggccaggcacagtggctcacacctgtaatctgagcgctttgggaggccagcaccggtagatcacttgagttcaggagtttgaggtcagcctggccaacagacgtgagccattttcccagcctgttttttgtttctttaacaaaaactgatagggatttttttttttttttttgagatggagtttcactcttgttgcccaggctggactgcaatggagcgatcccagctcactacaacctccgcctcccaggttcaagcaattctcctgcctcagcctccagagtagctaggattacaggcatgagccaccacgcccagctaattttgtatttttagtagagatggggtttctccatgttggttaggctggtcttgaactcccagcctcagatgatccacccacctcggcctcccaaagtgctgggattacaggcgtgagccactgcgcccagccccagtgataaggatttttatgggtaccgtgttgaatctaaatcacattgggttatataatcatttaacaatattaatttttccaaaccataagtatgggttgtagctctatgtttctaatcattttgatcaatgtttgtagatttcaaggtaaaaacctctgacctttttacgtttatttctaagtatttcttactttaagttctccagccaatggaagtgttttaaaattttcttttaaagttgtttgttgttaaaagtatggaaattcaactaatttttggtgctgatactgtattgtgcaaatccactgaatatgttacttagttccagtagtattttggttgactctttgtgattttctgcacagaagatcatgtcgtctacaaacaaatataattttacttctttctttct

SEQ ID NO: 3608 - DNA, 522 bp, Homo sapiens
ggacggcgtggagtgactatcccaccgccgcgggattgacttctaaagactcttggtatgtgaggaagaaacctggaagaggaagaggaaagcaaaggagtcagggatggctcttcctcagatatctcttccaaatgcatgatgaaggagttctcgtcaacagcacaaggcaatagagaagtgttccatgcagggacatctcaaagacatgaaagtcatcacaatggagatttttgtttccaggatattgataaagatattcatgacattgagtttcagtggcaagaagatgaaagaaatggccatgaagcactcatgacaaaaatcaaaaagttgacaggtagtacagagcgatatgatcaaaattatgctggaaacaagcctgttaaatatcagcttggattcagctttcattcgcatctgcctgaactgcacatatttcacactgaagagaaaattgataatcaagttgtgaagtctatccacgatgcttccttggtttcaacagcccaaagaatttct

SEQ ID NO: 3609 - DNA, 2281 bp, Homo sapiens
aggattgacttctaaagagtcatgttggccgggcgcgggggctcatacctgtaatcccggcactttgggaggccgagacgggcagatcacgaggtcaggagatcaagaccatcctggctaacacggtgaaaccccgtctctactacgaatacaaaaaattacctgggcgtgttggcgggcacctgtagtcccagctactcaggaggctgaggcaggagaatggtgtgaacccgggaggcggagcttgcagtgagctgagatcgggccacggcactccagcctgggtgacagagtgagactccgtctcaaaaaaaaacaaaaaaagtcatgttatgtgaaggagaagcccagaagaggaaagcagaggagtcaggcatgccacttactcagggacacttgacattcagggacgtggccatagaattctctcaggaggagtggaaatgcctggaccctgtgcagaaggctttatacagggatgtgatgttggagaactacaggaacctggtctccctgggaatctgtcttcctgacctgagtattatctccatgatgaagcaaaggacagagccctggactgtggagaatgaaatgaaagtagcaaaaaatccagataggtgggaaggtatcaaagatatcaacacagggaggagctgtgcagtgagaagcaaagcaggaaacaagcctattacaaatcaacttggattaacctttcagttacctctgccagaactggagatatttcaaggtgaagggaagatttatgaatgtaatcaagttcaaaagttcatcagccacagttcttcagtttcgccacttcaaagaatttactctggggtcaaaacccacatatttaataaacataggaatgattttgttgattttccattgctgtcacaagaacagaaagcacacattaggagaaaaccttacgaatgtaatgagcagggcaaagtcttcagagtgtcttcaagccttcctaatcatcaagtaatccacactgcagataaacctaacagatgtcatgaatgtggtaaaaccgtcagggacaagtcaggcctcgcagaacattggagaattcgtacaggagagaaaccttacaaatgtaaagagtgtggcaagctcttcaatcgaattgcataccttgcacgacacgagaaagtgcatactggagagagtccttacaaatgtaatgagtgtggcaaggtcttcagtcgaattacataccttgtacgacatcagaaaattcatactagagagaaacctcataaatgtaacaaatgtggcaaggtttatagtagcagttcatacctagcacaacattggagaattcatacaggagagaaactttacaaatgtaataaatgtggcaaagaatttagtgggcattcaagcctcaccacccatctgttaatccacactggagagaaaccttacaaatgtaaagaatgtgacaaagcttttaggcacaagttctccctgacagttcatcagagaaatcataatggagagaaaccttataaatgtcatgaatgtggcaaagtcttcactcaagtttcacatcttgcacgacatcagaaaattcacactggagagaaaccttacaaatgtaatgagtgtggcaaagtcttcactcagaattcacaccttgcaaatcatcagagaatccacactggagagaaaccttacaaatgccatgtgtgtggcctttcactgtggtctgggaaagaatcagtaagatgacagggctgacttcattagatgaggagcgtttctatccagtttcctggaggaataaggacactgccttttcagattaaagattgtctgatttagagaccatggaggtggacagagaataacaaaaccgtgatggcagtcatcatgcttattgcagttagcacacacttttcctgacaggcacagtgctgctgtgctctacaaatgaccatgaaatagagcacgccatgactttaggacacagggatttttatgggaagagagttcatcagggactgattacgtaggagagacgatgcaggggaaatggtggccaccgtctccattgaatagcaatagctgctgtttagcaaagactgattaaaaagtactctgatttttcaaatggaagagagaacagttaaatcagagtagagagtttaatcaaaactaccagtggaacatgttcttgagtaggattcacatttaactgctggcataatttgcaactgttggattttctcatgtttggaacaataaagttgaaattttccaaagtgtg

SEQ ID NO: 3610 - DNA, 2975 bp, Homo sapiens
gcgcgcagccgcctgcagacccggaagtggatggcgtggagatatggcgcaactgcggcgcggacacttgacattcagggacgtggccatagaattctctcaggaggagtggaaatgcctggaccctgtgcagaaggctttatacagggatgtgatgttggagaactacaggaacctggtctccctgggaatctgtcttcctgacctgagtattatctccatgatgaagcaaaggacagagccctggactgtggagaatgaaatgaaagtagcaaaaaatccagataggtgggaaggtatcaaagatatcaacacagggaggagctgtgcagtgagaagcaaagcaggaaacaagcctattacaaatcaacttggattaacctttcagttacctctgccagaactggagatatttcaaggtgaagggaagatttatgaatgtaatcaagttcaaaagttcatcagccacagttcttcagtttcgccacttcaaagaatttactctggggtcaaaacccacatatttaataaacataggaatgattttgttgattttccattgctgtcacaagaacagaaagcacacattaggagaaaaccttacgaatgtaatgagcagggcaaagtcttcagagtgtcttcaagccttcctaatcatcaagtaatccacactgcagataaacctaacagatgtcatgaatgtggtaaaaccgtcagggacaagtcaggcctcgcagaacattggagaattcgtacaggagagaaaccttacaaatgtaaagagtgtggcaagctcttcaatcgaattgcataccttgcacgacacgagaaagtgcatactggagagagtccttacaaatgtaatgagtgtggcaaggtcttcagtcgaattacataccttgtacgacatcagaaaattcatactagagagaaacctcataaatgtaacaaatgtggcaaggtttatagtagcagttcatacctagcacaacattggagaattcatacaggagagaaactttacaaatgtaataaatgtggcaaagaatttagtgggcattcaagcctcaccacccatctgttaatccacactggagagaaaccttacaaatgtaaagaatgtgacaaagcttttaggcacaagttctccctgacagttcatcagagaaatcataatggagagaaaccttataaatgtcatgaatgtggcaaagtcttcactcaagtttcacatcttgcacgacatcagaaaattcacactggagagaaaccttacaaatgtaatgagtgtggcaaagtcttcactcagaattcacaccttgcaaatcatcagagaatccacactggagagaaaccttacaaatgccatgtgtgtggtaaggtctttaggcacagttcatggtttgtacagcatcagagaagtgttcatgagagagtccttacaaactgagtttggcaaactctatcataagttctagcagtaatcaacatccgagagtctatactagaaagaaatcatttaaatgtactatatgtggcacaggctgtatcgagacctaccaaatcactagacatcgaaacattcatctttggtgaaaccacacaaatggattgtgtgtgccaaggccaacaagtcaaaatatgttgaacctaatgatatgatgtgtataaagggtgcaaggacacgtggaaatgatctgtaatattcgggttattaaaaatgtaattggctgggcgcagtggctcacacctgtaatcctagcactttgggaggttgaggcaggtggatcacaaggtcaggagtttgagaccagcctggccaatatggtgaaacaccatatctactataaatacaaaaaaattagccaggcgtggtggcacatgcctgcaatcccagctactcgggaggctgaggcaggagaattgcttgaatccaggaggcagaggttgttgcagtgagctgagatcgcgccactgcactccaacctgggtgacagagcgagactccgtctcaaaaaaaaaaaaaaattatttgggtttgaaaggccaggggcagtggttcatgcctataatctcagcacaatagaaagccaagacaggagggtcacttgatgcctggagatcaagataagtatgggcaacgtagcaaggcccatccctacaaaataaaaaaaataagccaggcccttggcatgtgtctgtagttccagctactcaagaggccgaggcaagaggattgctcaagcccaggagtttgagagtttgagcagtgagctctgatcttgccatttgtactccagcttgggtgacagagcgagaccctgtctcaaaagaaaaaaaaggctagtttttatgacttcaacctgaactttgaaatttcttcatgtgccttccctacaggcctttcactgtggtctgggaaagaatcagtaagatgacagggctgacttcattagatgaggagcgtttctatccagtttcctggaggaataaggacactgccttttcagattaaagattgtctgatttagagaccatggaggtggacagagaataacaaaaccgtgatggcagtcatcatgcttattgcagttagcacacacttttcctgacaggcacagtgctgctgtgctctacaaatgaccatgaaatagagcacgccatgactttaggacacagggatttttatgggaagagagttcatcagggactgattacgtaggagagacgatgcaggggaaatggtggccaccgtctccattgaatagcaatagctgctgtttagcaaagactgattaaaaagtactctgatttttcaaatggaagagagaacagttaaatcagagtagagagtttaatcaaaactaccagtggaacatgttcttgagtaggattcacatttaactgctggcataatttgcaactgttggattttctcatgtttggaacaataaagttgaaattttccaaagtgt

SEQ ID NO: 3611 - DNA, 2319 bp, Homo sapiens
ggcccggcgcgctggagaggcgcggggtcaagacgtccggcctcgggggcccgggctgggccgccgagtcccctgggcggcgctgagcgggcgggaggcgggggcccgcggctcggggcaaccgaggccgggtcgcgggatcggccgccatcgccgccgccgctgcactgggagcccgcggggatggagcgggaggcgttgccgtggggcctcgagccccaggatgtgcagagttctgacgaaatgaggagccccgaagggtacctcagaggcaacatgagtgagaatgaggaagaggaaatttctcagcaagaaggcagtggggactatgaagtcgaagagataccatttgggcttgaaccccagagccctgggtttgagccacaaagcccagagtttgaaccccaaagccccagatttgagcctgaaagcccggggtttgagtcccgaagccctgggcttgtgcccccaagccctgagtttgcacccagaagccctgaatcagattctcagagccctgagtttgaatcccagagccctaggtatgaaccccaaagccctggctatgaacctcggagccccgggtatgaaccccggagccctggctatgaatctgagagctctagatatgaatcccagaacactgagctcaaaacccaaagcccagaatttgaagctcaaagttccaaattccaggaaggtgcggagatgcttctgaaccccgaggaaaagagtcctttgaatatctccgtaggagttcaccccctggactccttcactcaggggtttggggagcagcccacaggggacctgcccatagggccaccttttgagatgcccacaggggccctgctgtctacaccgcagtttgagatgcttcagaatcccctgggtctcacaggagcccttcgaggtccaggtcggcggggtggccgggccaggggtgggcagggccctcggcctaacatctgtggcatctgcgggaagagcttcgggcggggctccaccctgatccagcaccagcgcatccacaccggtgagaagccctacaaatgtgaggtctgcagcaaggccttctcccagagctctgacctcatcaaacaccagcgcacccacactggcgagcggccctacaaatgtccccgttgcggcaaggccttcgccgacagctcttacctgcttcgccaccagcgcactcactctggccagaagccctacaagtgcccacattgtggcaaggccttcggcgacagctcctacctcctgcgacaccagcgcacccacagccacgagcggccctacagctgcaccgagtgcggcaagtgctatagccagaactcgtccctgcgcagccatcagagggtgcacaccggtcagaggcccttcagctgtggcatctgcggcaagagcttctcccagcggtcggcccttatcccccatgcccgcagccacgcccgggagaagcccttcaagtgccctgagtgcggcaagcgctttggccagagctcggtgctggccatccacgcccgcacccacctgccaggccgcacctacagctgccccgactgcggcaagaccttcaatcgctcctccactctcatccagcaccagcgctcccacacgggcgagcggccctacaggtgcgccgtgtgcggcaagggcttctgccgctcctccacgcttctgcagcatcaccgggtccacagtggcgagcggccttacaagtgcgatgactgcggaaaggccttctcccagagctccgacctcatccgccaccagcggacccacgcggcgggccggcgctgacctggggccccagcaggggtgggaggtgtgggcagaagataaggggccagggagctagaggaacctttagggaggatagtggagaagccgcaggagaatggaggagctgaggatgctggaagaagagaaccagggtggaggaagtgacatgccctggagacttgtgggaagtgggttggagggaggccaggccggcagcgggaggccctgggagaaatggagagaggtcagcggagggctggcctcagccgcggctccttggtgggtgcctggcttggcaactgctagagcagggaggggggagggcaggggattacctaattagagtgggttagcttagattggtagctgctgaaactctcgttgagtcaggagcgggtaaaaggtaggtggggtggggagtggggccccggggtggggcctgggcctctgcgtgcaaaccccagcctccctcttcttcctcaggctttggagcccctgagtttgagttcaataaaaactttatgtggtaaa

SEQ ID NO: 3612 - DNA, 1784 bp, Homo sapiens
agtgcagcccagcccggggccggggtccagaaggcaacatgagtgagaatgaggaagaggaaatttctcagcaagaaggcagtggggactatgaagtcgaagagataccatttgggcttgaaccccagagccctgggtttgagccacaaagcccagagtttgaaccccaaagccccagatttgagcctgaaagcccggggtttgagtcccgaagccctgggcttgtgcccccaagccctgagtttgcacccagaagccctgaatcagattctcagagccctgagtttgaatcccagagccctaggtatgaaccccaaagccctggctatgaacctcggagccccgggtatgaaccccggagccctggctatgaatctgagagctctagatatgaatcccagaacactgagctcaaaacccaaagcccagaatttgaagctcaaagttccaaattccaggaaggtgcggagatgcttctgaaccccgaggaaaagagtcctttgaatatctccgtaggagttcaccccctggactccttcactcaggggtttggggagcagcccacaggggacctgcccatagggccaccttttgagatgcccacaggggccctgctgtctacaccgcagtttgagatgcttcagaatcccctgggtctcacaggagcccttcgaggtccaggtcggcggggtggccgggccaggggtgggcagggccctcggcctaacatctgtggcatctgcgggaagagcttcgggcggggctccaccctgatccagcaccagcgcactcactctggccagaagccctacaagtgcccacattgtggcaaggccttcggcgacagctcctacctcctgcgacaccagcgcacccacagccacgagcggccctacagctgcaccgagtgcggcaagtgctatagccagaactcgtccctgcgcagccatcagagggtgcacaccggtcagaggcccttcagctgtggcatctgcggcaagagcttctcccagcggtcggcccttatcccccatgcccgcagccacgcccgggagaagcccttcaagtgccctgagtgcggcaagcgctttggccagagctcggtgctggccatccacgcccgcacccacctgccaggccgcacctacagctgccccgactgcggcaagaccttcaatcgctcctccactctcatccagcaccagcgctcccacacgggcgagcggccctacaggtgcgccgtgtgcggcaagggcttctgccgctcctccacgcttctgcagcatcaccgggtccacagtggcgagcggccttacaagtgcgatgactgcggaaaggccttctcccagagctccgacctcatccgccaccagcggacccacgcggcgggccggcgctgacctggggccccagcaggggtgggaggtgtgggcagaagataaggggccagggagctagaggaacctttagggaggatagtggagaagccgcaggagaatggaggagctgaggatgctggaagaagagaaccagggtggaggaagtgacatgccctggagacttgtgggaagtgggttggagggaggccaggccggcagcgggaggccctgggagaaatggagagaggtcagcggagggctggcctcagccgcggctccttggtgggtgcctggcttggcaactgctagagcagggaggggggagggcaggggattacctaattagagtgggttagcttagattggtagctgctgaaactctcgttgagtcaggagcgggtaaaa

SEQ ID NO: 3613 - DNA, 5439 bp, Homo sapiens
gttgccgcgccggccctgcggacgtgcgcgcgctgccttcgcggcacctgggcctgaggtgcgtgcctcccgggccctcgccagctccagatgcgtgaggaggacttcagaaacccgactgagaagtggagcgacccccagggagggtcggacctgcctcaataccgccaaggtctttcatttcttgttcgcttactttcgtgaaatcctcacatcgttttaatggtactagtcaagacaagaaaatcaacaggctttcagccttgaggcaacattggatattattgagacatctgtggaatttaagaacagtatggagctcatcagagtatatcattgaagaatatgatggctgaaaacaatttaaaaatgctaaagattcaacagtgtgtggtagccaacaaactacctagaaacaggccatatgtttgcaatatttgttttaagcactttgaaacaccatcaaaattagctaggcactatctcattcatactggtcaaaagccatttgaatgtgatgtgtgtcataaaacctttagacaactagttcatctggagaggcatcaactaactcatagtctgccttttaaatgtagtatttgtcagcgtcactttaaaaatctgaagacatttgtgaagcaccaacaacttcacaatgaaacctatcagaataatgttaaacaggtcagaagattgctggaggccaagcaagaaaagtcaatgtatggagtgtataatacttttaccacagaggaaagatgggcattacacccgtgctctaagtctgatcccatgtatagcatgaaaagaagaaagaatattcatgcatgtacaatctgtggcaagatgtttccatcacagtcaaaacttgataggcatgtacttattcatactggtcagaggccttttaaatgtgtcttgtgtactaaatcttttcgacagtcaactcacttaaaaatccaccaacttacacattcagaagaaagaccttttcaatgttgtttttgtcaaaaaggatttaagattcaaagcaaacttctgaagcataaacaaatccatactaggaataaggcttttcgggctcttttattaaagaagaggcgtacagaatctcgccccctgcctaataagttaaatgcaaatcagggtggttttgaaaatggtgagattggtgaatctgaggagaataatccacttgatgtccactcaatttatattgtcccttttcaatgtccaaagtgtgaaaagtgttttgaatcagagcagattctcaatgaacacagctgttttgctgctagaagtggcaaaattccaagcaggttcaaaagaagctacaactataaaaccattgttaaaaaaatcttggccaagcttaagcgtgctaggagtaaaaaattagataactttcaatctgagaaaaaagtatttaaaaagagtttcttgagaaattgtgatcttatttctggtgagcagagctctgaacaaacccagagaacatttgtgggttctcttggcaaacatggaacatataaaacaattggcaatagaaagaagaaaacattgactttgccattttcttggcaaaatatgggaaaaaatttgaaaggcatccttacgacagaaaacatattaagcattgataattcagtgaataagaaagacttgtcaatctgtggttcatcaggtgaggaattctttaataactgtgaggtacttcagtgtggtttttcagttccaagggaaaacatacgtactagacataagatatgtccttgtgacaaatgtgagaaggtatttccttctatatccaaactaaaaagacactatttaattcatactggacagaggccctttggctgtaatatttgtgggaaatcttttagacagtcagctcacttaaaaagacatgaacagactcataatgaaaagagtccttatgcatctctttgccaagtagaatttggaaacttcaacaatctttctaatcattcaggtaataatgttaactataatgcttcccaacaatgtcaggctcctggtgttcaaaaatacgaggtctcagagtcagatcaaatgtcaggagttaaggcagagtcacaggattttattcctggtagcaccgggcaaccctgtcttcctaatgtacttttggaatcagagcaaagcaatcctttttgcagttattcagagcatcaggagaaaaatgatgtcttcctgtaccgatgcagtgtttgtgctaaaagtttccgatctccatctaaactggaaagacactacctaattcatgcagggcagaaaccatttgaatgctcagtttgtggcaaaacattcagacaggctcctcactggaagagacatcagcttactcactttaaagaacgaccacaagggaaagtggttgccttagattcggttatgtaaattgtcgcaaccactaacaattgtggtctctggtgatcttatttttaaagcctgtattatttaaaatgcatttttattgaaaggcctgcattaaactgaatggtttcacaggcatttgcttgtcctgcatagtaaggaggtagaatacatagaaaattaatacaatgttttagaaacagccaagttaattttagaggcaagaacatgatttgatgctataaagtaggcattttaatattgtaaacatatactttggctgtattgaaaaatataaatccatgatggctgtacaaataatttagcctcattcattttttaaaggaattattccttaagacatgccatctctttttagatatactcaaaagactgagaggcaaaacttggcttttagctgcagcacatagccctgttatatttgatttattttacatttcatatgaaagcataattttgtccacatgtgactcaaattgcattggtaattttttttttttttttgtaagttaaaaaaactacagagacactaaaggtgaaaatggatgagacaattatagtattattttcattggtctttttttttgagatggagtctcactctttcgccaggctagagtgcagtggcgccatctaggctcactgcaacctccgcatcccagattccagcgattctcctgcctcagcctcctgagtagctgggattacaggtgcctgccatcacgcctggctaatttttgtatttttagtagagacgggggttcaccaagttggccaggatggtctcgatctcttgaccttgtgactcacccgcatcggcctcccaaagtgctgggattacaggcatgagccaccgcacccgacggtcttttcaaagctatttatttttaggactatgtggtaatttcaccttcaggtgataaggattttttttttctcccagctagtgctatctttctcaaaataatttaaaagtaggcgagaggctaggatgtacctatatttaccatgtttacttaccaggaatattttctaagtgccatagtctttttcataatacgtatgagttttaccttttcagaggaataatttcaagtcatttatttgctcattaatgatagcagtagtcatagacttaagactattctagagatcttcatctccataagacttttacatttattttagtaaacttttctttctatgcctctttaatggagtggttctgttatttaagcctgttctaagtttgatcaaatggcaatgactaggtctagttttagtttttatttttgcaggagtctattgctaaagaattttattttgatgcttgttaaatttttattttaattaataaggtagtcattcctgtagagggataagatgcttgtagagttgtgggtatcattccaaatagaactgttatgatttgggaaatattctttactacaaaggacttatttcataattacaaattttccttcatatttgcctttgtttataaaatcttcaggaatgacattctctagcaataaaaggaatgaaccgttatgtttctaagctgaaaagaggaacaggtgggtaattatcctgccatacttaaatatagtggaaaatcctctattgagaatgtggataaatgaacaattgtaagttttgcatcataaactgagaactttcttttgacaggggggaggcgggagggatagtaggtgggggtgatctgcttgcttcttttaccacaggtgatttttaagtaacttgggtttaatttacagagatgaaacatgacagtctgagtaaaatacccagtgatgtagaagtgtgcctgtttattatgtagatacagacatccagcaaaaacaggagaatcacatgctttaaagaacactttctcttaggtttccttgagatatgttcctccagtgcaagcaagataatggtttacagaatttgctttacacaaaacttgtcaagaactcatctgttaaaagcaaggaataactagtttatattttccaataatgttcaaggttttctccttaatatgtttgaaattattgattttggcatttttctaagcaatttatgtaattttatttgaagaaaatgttttgtataatgtttttcccagcctaaacagggagagtcctaacagtgttgtgcttgtatgattctgagactttatttgcgtaagtgatactactatactttatttttgacccatgcctttttaagctgtttcatattgaaaggtggaatattgtaaaaattttgtcaaagatgtactgtagtgctatttgaagtacctgtaacaaaacagttggccctctgtatccatgtactctgcatctgtggattaaaccaattgcagatcaaaaatattagaaaaaataaaaataatacaaataaaaatacagtataacagttatttaaatagcatttacattgcattaggtattagtctagggataaagtatacaggcggatgtgcgttggttatatacaaatatgtcattttatgtaagggacttgagtatacttggatttttggtatctgtgggttggggggacggtccaggaaccaataccccatggataccaagggacaactgtacttatttacctttattgtcattgcaagcttcttatggaaactttataggaatgaaaatatacatgttaagaagattaaacattagatagtagatggtttgttgcatgctagaactgttagtattgttgaatcaattactttggtttcatgaaaaaataaacgataaatatctttaaagagaactagaagaattttttgtttgagtgattccaggctgtagtatgatcatttactgaagtagtttgattggctggctaacttagaattattgtttcttgttttgtactgcaataggggttataattgtaagataaaaatgtgtgtgtgtttaagggaagtaggtggtggttaaaattcttggaaaattttcagaatactttaaaaataaagttccaagttacaca

SEQ ID NO: 3614 - DNA, 563 bp, Homo sapiens
gtgcctcccgggccctcgccagctccagatgcgtgaggaggacttcagaaacccgactgagaagtggagcgacccccagggagggtcggacctgcctcaataccgccaagacatctgtggaatttaagaacagtatggagctcatcagagtatatcattgaagaatatgatggctgaaaacaatttaaaaatgctaaagattcaacagtgtgtggtagccaacaaactacctagaaacaggccatatgtttgcaatatttgttttaagcactttgaaacaccatcaaaattagctaggcactatctcattcatactggtcaaaagccatttgaatgtgatgtgtgtcataaaacctttagacaactagttcatctggagaggcatcaactaactcatagtctgccttttaaatgtagtatttgtcagcgtcactttaaaaatctgaagacatttgtgaagcaccaacaacttcacaatgaaacctatcagaataatgttaaacaggtcagaagattgctggaggccaagcaagaaaagtcaatgtatggagtgtataatactt

SEQ ID NO: 3615 - DNA, 1441 bp, Homo sapiens
gctccaggtgcttgggagtcgggggactgcggaggacgccaagtctgagctcgccgccctctccgagccgtttgggccggacgcctgggtccttcgggctccgccccagggggtggggctatatgttcggaccaatgaccggccgtccctgcggtcccgccccctccccgcccccggagccgcggcctcgctgagtgcccagccgcccggcgcccaggcctggggcaccgcgagtgccgaaccttcggctggacaccaagatgcctggcgaacagcaggcagaggaagaggaggaggaagagatgcaggaggagatggtgctgctggtgaagggtgaggaggatgagggtgaggagaagtatgaggtggtgaaactcaagatccccatggacaacaaggaggtcccgggcgaggcgcccgcgccgtccgccgacccggcgcgtccccacgcgtgccccgactgcggccgcgccttcgcgcgccgctccacgctggcgaagcacgcgcgcacgcacacgggcgaacggcccttcgggtgcaccgagtgcgggcggcgcttctcacagaagtcggcgctgaccaaacacggccgcacgcacacgggcgagcggccctacgagtgccccgagtgcgacaaacgcttctcggccgcctcgaacctgcggcagcaccggcggcggcacacgggcgagaagccgtacgcatgcgcgcactgcggccgccgcttcgcgcagagctccaactacgcacagcacctgcgcgtgcacacgggcgagaagccgtacgcgtgcccggactgcggacgcgcctttggcggcagctcgtgcctggcgcgccaccgacgcacgcacacgggcgagcggccctacgcttgcgccgactgcggcacgcgcttcgctcagagctcggcgctggccaagcaccggcgcgtgcacacgggcgagaagccgcaccgctgcgctgtgtgtggccgtcgcttcggccaccgctccaacctggcggagcacgcgcgcacgcacacaggcgagcggccctacccctgcgccgagtgcggccgccgcttccgcctaagctcgcacttcattcgccaccgacgcgcgcacatgcggcgccgcctgtatatttgcgccggctgcggcagggacttcaagctgccccctggcgccacggccgccactgccaccgagcgttgcccggagtgtgagggcagctgagtcccgcagggctgcggaggggcgcgctggggcttcgacctggctgcactaacccaggctcctcctcgccccggcctccgggtctgggaaattgaggggacggcaggcccggctgccctggaactgggagacagggagaatcccctgccggggtccctggaaacagtgcccaccccacatcactacattccctcggcccgtgttagtgaataaagtattatatcctc

SEQ ID NO: 3616 - DNA, 1454 bp, Homo sapiens
gctccaggtgcttgggagtcgggggactgcggaggacgccaagtctgagctcgccgccctctccgagccgtttgggccggacgcctgggtccttcgggctccgccccagggggtggggctatatgttcggaccaatgaccggccgtccctgcggtcccgccccctccccgcccccggagccgcggcctcgctgagtgcccagccgcccggcgcccaggcctggggcaccgcgagtgccgaaccttcggctgctccccgcctcaggacaccaagatgcctggcgaacagcaggcagaggaagaggaggaggaagagatgcaggaggagatggtgctgctggtgaagggtgaggaggatgagggtgaggagaagtatgaggtggtgaaactcaagatccccatggacaacaaggaggtcccgggcgaggcgcccgcgccgtccgccgacccggcgcgtccccacgcgtgccccgactgcggccgcgccttcgcgcgccgctccacgctggcgaagcacgcgcgcacgcacacgggcgaacggcccttcgggtgcaccgagtgcgggcggcgcttctcacagaagtcggcgctgaccaaacacggccgcacgcacacgggcgagcggccctacgagtgccccgagtgcgacaaacgcttctcggccgcctcgaacctgcggcagcaccggcggcggcacacgggcgagaagccgtacgcatgcgcgcactgcggccgccgcttcgcgcagagctccaactacgcacagcacctgcgcgtgcacacgggcgagaagccgtacgcgtgcccggactgcggacgcgcctttggcggcagctcgtgcctggcgcgccaccgacgcacgcacacgggcgagcggccctacgcttgcgccgactgcggcacgcgcttcgctcagagctcggcgctggccaagcaccggcgcgtgcacacgggcgagaagccgcaccgctgcgctgtgtgtggccgtcgcttcggccaccgctccaacctggcggagcacgcgcgcacgcacacaggcgagcggccctacccctgcgccgagtgcggccgccgcttccgcctaagctcgcacttcattcgccaccgacgcgcgcacatgcggcgccgcctgtatatttgcgccggctgcggcagggacttcaagctgccccctggcgccacggccgccactgccaccgagcgttgcccggagtgtgagggcagctgagtcccgcagggctgcggaggggcgcgctggggcttcgacctggctgcactaacccaggctcctcctcgccccggcctccgggtctgggaaattgaggggacggcaggcccggctgccctggaactgggagacagggagaatcccctgccggggtccctggaaacagtgcccaccccacatcactacattccctcggcccgtgttagtgaataaagtattatatcctc

SEQ ID NO: 3617 - DNA, 1545 bp, Homo sapiens
gggcgggacttcctctaccatcctcgggtggacattttgtttgcttttccattaatccactggtttagtttccagaacgcaatgtcagacctgaggtgacagaaaagggaaaacgtgagagagtgtcttcttccctgaagagaggtgggcctgaggcttgacagtggcgctgcctgagtgacctagccgctgggctgggccctggacagctgatcccaggttcctgcacttgtcgccacccttccgtagtccacaggcctgatggcggcggctgagccgatgggcccggcacaggttcccatgaactcagaagtaattgtggaccctatacaggggcaggtgaactttgaggacgtgttcgtgtacttctcccaggaggagtgggtgctccttgatgaggctcagaggctcctgtaccgtgatgtgatgctggagaactttgcacttatggcctctctgggacatacatctttcatgtcccacatagttgcctcactggtgatgggtagtgagccctgggtacctgactgggtggacatgaccctagctgttgccacaggttgttggcatggaatggaggatgaagagataccttttgagcagagcttttctataggaatcttcagtgcaaaccttcaccagcaccagaagcagcacagtggagagaaaccctttagaagtgataagagcaggccctttcttctgaacaactgtgctgtgcaatcaatggagatgtcttttgtgacaggggaggcttgtaaggacttcctagccagctcaagcattttcgagcaccatgcccctcacaatgagtggaagccacacagcaacaccaagtgtgaggaggcctctcactgtggaaaaaggcattacaaatgcagtgaatgtgggaaaaccttcagccgcaaagactcacttgttcaacaccagagagtccacactggagaaaggccttatgagtgcggtgaatgtgggaaaacctttagccgcaaacccatacttgctcagcaccagagaatccacactggagaaatgccttatgagtgtggcatatgtgggaaagtttttaatcatagctctaaccttattgtacatcaaagagtacacactggagcaaggccttacaagtgcagtgaatgtgggaaagcctatagtcacaaatctacacttgttcagcatgagagtatccatactggagaaaggccatatgagtgcagcgaatgtggaaaatactttggtcacaaatacagactcattaaacattggagtgttcatactggagcaaggccttatgagtgcatcgcatgtgggaagttctttagccaaagctctgaccttattgcacatcaaagagttcataatggtgaaaagccttatgtgtgcagtgaatgtggaaaagcctttagccacaaacatgtacttgttcagcatcatagaattcacactggagaaaggccatataagtgcagtgaatgtgggaaggccttcaggcagagggcttccctcatccgccactggaaaattcacactggagaaaggccttag

SEQ ID NO: 3618 - DNA, 996 bp, Homo sapiens
gggcgggacttcctctaccatcctcgggtggacattttgtttgcttttccattaatccactggtttagtttccagaacgcaatgtcagacctgaggtgacagaaaagggaaaacgtgagagagtgtcttcttccctgaagagaggtgggcctgaggcttgacagtggcgctgcctgagtgacctagccgctgggctgggccctggacagctgatcccaggttcctgcacttgtcgccacccttccgtagtccacaggcctgatggcggcggctgagccgatgggcccggcacaggggcaggtgaactttgaggacgtgttcgtgtacttctcccaggaggagtgggtgctccttgatgaggctcagaggctcctgtaccgtgatgtgatgctggagaactttgcacttatggcctctctgggttgttggcatggaatggaggatgaagagataccttttgagcagagcttttctataggaatgtcacagatcaggattcccaagggaggtccttctactcagaaggcttacccctgtgggacatgtggcctggtcttaaaagacattttgcacttggctgagcaccaggaaacacacccagggcagaaaccatacatgtgtgtgctgtgtgggaaacagttctgcttcagtgcaaaccttcaccagcaccagaagcagcacagtggagagaaaccctttagaagtgataagagcaggccctttcttctgaacaactgtgctgtgcaatcaatggagatgtcttttgtgacaggggaggcttgtaaggacttcctagccagctcaagcattttcgagcaccatgcccctcacaatgagtggaagccacacagcaacaccaagtgtgaggaggcctctcactgtggaaaaaggcattacaaatgcagtgaatgtgagaaaactgcagcaaactatagggaatatgacccttctaaaggtacatccacatgtgtttccattactctggctccattatga

SEQ ID NO: 3619 - DNA, 5419 bp, Homo sapiens
gggcgggacttcctctaccatcctcgggtggacattttgtttgcttttccattaatccactggtttagtttccagaacgcaatgtcagacctgaggtgacagaaaagggaaaacgtgagagagtgtcttcttccctgaagagaggtgggcctgaggcttgacagtggcgctgcctgagtgacctagccgctgggctgggccctggacagctgatcccaggttcctgcacttgtcgccacccttccgtagtccacaggcctgatggcggcggctgagccgatgggcccggcacaggttcccatgaactcagaagtaattgtggaccctatacaggggcaggtgaactttgaggacgtgttcgtgtacttctcccaggaggagtgggtgctccttgatgaggctcagaggctcctgtaccgtgatgtgatgctggagaactttgcacttatggcctctctgggacatacatctttcatgtcccacatagttgcctcactggtgatgggtagtgagccctgggtacctgactgggtggacatgaccctagctgttgccacagagactccaggtgggagtgaccctggttgttggcatggaatggaggatgaagagataccttttgagcagagcttttctataggaatgtcacagatcaggattcccaagggaggtccttctactcagaaggcttacccctgtgggacatgtggcctggtcttaaaagacattttgcacttggctgagcaccaggaaacacacccagggcagaaaccatacatgtgtgtgctgtgtgggaaacagttctgcttcagtgcaaaccttcaccagcaccagaagcagcacagtggagagaaaccctttagaagtgataagagcaggccctttcttctgaacaactgtgctgtgcaatcaatggagatgtcttttgtgacaggggaggcttgtaaggacttcctagccagctcaagcattttcgagcaccatgcccctcacaatgagtggaagccacacagcaacaccaagtgtgaggaggcctctcactgtggaaaaaggcattacaaatgcagtgaatgtgggaaaaccttcagccgcaaagactcacttgttcaacaccagagagtccacactggagaaaggccttatgagtgcggtgaatgtgggaaaacctttagccgcaaacccatacttgctcagcaccagagaatccacactggagaaatgccttatgagtgtggcatatgtgggaaagtttttaatcatagctctaaccttattgtacatcaaagagtacacactggagcaaggccttacaagtgcagtgaatgtgggaaagcctatagtcacaaatctacacttgttcagcatgagagtatccatactggagaaaggccatatgagtgcagcgaatgtggaaaatactttggtcacaaatacagactcattaaacattggagtgttcatactggagcaaggccttatgagtgcatcgcatgtgggaagttctttagccaaagctctgaccttattgcacatcaaagagttcataatggtgaaaagccttatgtgtgcagtgaatgtggaaaagcctttagccacaaacatgtacttgttcagcatcatagaattcacactggagaaaggccatataagtgcagtgaatgtgggaaggccttcaggcagagggcttccctcatccgccactggaaaattcacactggagaaaggccttaggatgggagataattccgtttccttgttcaacataataactgacatcagagagaagctccaagcatagcctttatgtgtagccgacagccagaagtagaactttatacactcaaacactcaccctggggaggttcttccgagtgccagctatatgggaagccttctggagctatgctgaattttctagactcttgctggaatttcgtcaaggcagtgcctgttagaagccatctgtctttgtgctggaagagtcctgccttgtgccaaagtaaccccaatgtgtttcaaaagacagacctctgtactattcccttccctggagggaatcatcagtagcctgaggccatcaaggattctcactttttttctgccccactactggtttaagcatgagcatgacccagttttagccagaaaaatgggagctttgttctgctgaccactggcagaggtttcccttcatggatatagttgatctcacatggcacttgggacgaatttttctagccttcaagacacctgacctgaaattggctgcctcatattctggttttgcaacaaatgccttaatttttagactatctgaaatcttgaggattctgttcgctttgtgggttgggttgagaacagaattgagctaagccagtatgaagggaagaacagcttttgtgagagctccaactatctgtatctctgaagtgatagtaggatggcaaagactagctcttatgctagtgtcaagctaacttacttgactgcttcagctctcctaggaaagaatgccagtctttgtaggcctaatcttttggtctatatgttaagattttttgtgtaattgaggtcaccctaagcagtgggcatttgttgtgataatctctaatgtgtctgggagcaacatgaattacgtcccttgttcccagaagatacttcatattcccaaggcttcttgaggagaatttgaactcagtggacatgtcaagatctctgaagtctatttttcagtaggcagttgatattggctgtcctccagaaggcccaggtaggaatcatagttggtgcagaaacccagattaataaaggaatgagaaaactgcagcaaactatagggaatatgacccttctaaaggtacatccacatgtgtttccattactctggctccattatgagggtttacagaaatatttccatacctgtgtctcttatggctaaggttactgtccagaagtcagtctaaacatttttgcaataaactgcacatatttatagtgtaccatttgataagttttgatacatgttggcacttctcaaaccaaaagtttcctgattccttttatattttctccctttccttcacccatccccaggcaactattgatccgttgtcactgtagatttgtttgtatttcctagaattctacagagatagagtaatttaatatgtattctaatgtttttggcttcttaaactctgaaattaaggctcatggtggtgttctgtgtttcatagttcatttcttttcatttgtactttgctaagagtgttccattgtagagaaatagtttcaaagcaagtgatccaggagagaactcacacaagaacaaagccacagtatctgtcattaccttaaactgaaagtgatgagccgtcatttctgctatatttcataagtaaccctagctaatcctggttaaaagtggaagagaactacacaaaggtgaaaatagggatttgtggggcgttttcttggactctggtgaccataatcctatatggtttttttctttttctgttttagttgtttaatatgaattacattgactgatttttttaaatgttaagccaaccttgcatttctgtaataattcccatttggtcatgatgtattagtcatttagtatattgttgaatttgatttgctattttgttttgttttgttttgtttttttgtaacaagttttgcaccaatgttcacgagtgatatttgtccctaactttctttcttgcttgcttgcttttttttctttgtaattttatatcttgcccaggtttggctttggtatcagcataatgccagctttatagagtaagttgggaagtattcctgctcttcagctctctggaagagtttgtgaataattggtattatttcttccttaaatgtttggtagaattcaccaaggaagctgtctgggcctggagtttgttttgtaggaaagtttctaactataagtttgatttctgtggtagatagagggctgtacaagttatatgtacatctgtctgtgtgtgtgttgtctgtctgtcactctggccctgaagtgtgttttgtaggacagcatctaactacaagtttgatttccatggtagatggagggctatactagttatatatacatctgtctgtccgtccatctgtttgtcactccatccatccatctatctctagagtgagctttgatggtttgtgtctttcaaggagtttttctgttttatttaagtactcaaatttttcaaaatattattttcatacttgtagaatttgtagtggtgcaacctcttctattcctgatactggtaatgtctatatttttcttttaaccttgattggtttgggtagagatttatcaattttacaattttattgatcttaaagtacttggtattattgaattttctgttttctgatattttgggatttttcttttccattttgagttttactaatgccttccgcttttattggatttcatttcttttgctactttttaacatggaagctgaggtccttcatttcaaacctttgggtttttttcccctaatatggggaagagatgttaatgttaaaaatctatctgagaactgctttaattacctcccatcaagcttgatgtggtttcatttttttttttgagacagtgtcttgctctgtcatccaggttggagtgcagtggcgcgatctcggctcactgcaagctctgcctcctgggttcacaccattctcctgcctcagcctcccgagtagcttggactacaggcgcctgccaccatgcctggctaattttttgtatttttagtagagacgaggtttcaccgtgttagccaggatggtctcgatctcctgatcttgtgatccgcctgcctcagcctcccaaagtgctgggattacaggcgtgagcccagccgatgtggtttcattttagttgagtttaggatgttttccagttaaaaaaattcttcttgacacatggctctttttaaatgtatgttatttaattcctaaatatttggggattttgcttatctttctggtagtttctgcaataattccattgtggtcagagtacattaagacttgaattatttacatttattgagatttgctttgtggcccagaatatgggctatcttggtatgagttacatgttcacttgaaatgtatactgtactctcgtttgatgaaggggttctacaagtgttgattaggtaaaaatggttgatgttatttaagttttttctatctttattgacattctgtggttttggttccagcaattattttaagaggattgttgacatctctgaatattaaattggatttacttctctgcagttctgtcagattttgcttcacatattttagtatgtttttattaggtgaataataaatatttcctattttatgtcca

SEQ ID NO: 3620 - DNA, 1799 bp, Homo sapiens
gtttgcttttccattaatccactggtttagtttccagaacgcaatgtcagacctgaggtgacagaaaagggaaaacgtgagagagtgtcttcttccctgaagagaggtgggcctgaggcttgacagtggcgctgcctgagtgacctagccgctgggctgggccctggacagctgatcccaggttcctgcacttgtcgccacccttccgtagtccacaggcctgatggcggcggctgagccgatgggcccggcacaggttcccatgaactcagaagtaattgtggaccctatacaggggcaggtgaactttgaggacgtgttcgtgtacttctcccaggaggagtgggtgctccttgatgaggctcagaggctcctgtaccgtgatgtgatgctggagaactttgcacttatggcctctctgggttgttggcatggaatggaggatgaagagataccttttgagcagagcttttctataggaatgtcacagatcaggattcccaagggaggtccttctactcagaaggcttacccctgtgggacatgtggcctggtcttaaaagacattttgcacttggctgagcaccaggaaacacacccagggcagaaaccatacatgtgtgtgctgtgtgggaaacagttctgcttcagtgcaaaccttcaccagcaccagaagcagcacagtggagagaaaccctttagaagtgataagagcaggccctttcttctgaacaactgtgctgtgcaatcaatggagatgtcttttgtgacaggggaggcttgtaaggacttcctagccagctcaagcattttcgagcaccatgcccctcacaatgagtggaagccacacagcaacaccaagtgtgaggaggcctctcactgtggaaaaaggcattacaaatgcagtgaatgtgggaaaaccttcagccgcaaagactcacttgttcaacaccagagagtccacactggagaaaggccttatgagtgcggtgaatgtgggaaaacctttagccgcaaacccatacttgctcagcaccagagaatccacactggagaaatgccttatgagtgtggcatatgtgggaaagtttttaatcatagctctaaccttattgtacatcaaagagtacacactggagcaaggccttacaagtgcagtgaatgtgggaaagcctatagtcacaaatctacacttgttcagcatgagagtatccatactggagaaaggccatatgagtgcagcgaatgtggaaaatactttggtcacaaatacagactcattaaacattggagtgttcatactggagcaaggccttatgagtgcatcgcatgtgggaagttctttagccaaagctctgaccttattgcacatcaaagagttcataatggtgaaaagccttatgtgtgcagtgaatgtggaaaagcctttagccacaaacatgtacttgttcagcatcatagaattcacactggagaaaggccatataagtgcagtgaatgtgggaaggccttcaggcagagggcttccctcatccgccactggaaaattcacactggagaaaggccttaggatgggagataattccgtttccttgttcaacataataactgacatcagagagaagctccaagcatagcctttatgtgtagccgacagccagaagtagaactttatacactcaaacactcaccctggggaggttcttccgagtgccagctatatgggaagccttctggagctatgctgaattttctagactcttgctggaatttcgtcaaggcagtgcctgttagaagcc

SEQ ID NO: 3621 - DNA, 5130 bp, Homo sapiens
gggcgggacttcctctaccatcctcgggtggacattttgtttgcttttccattaatccactggtttagtttccagaacgcaatgtcagacctgaggtgacagaaaagggaaaacgtgagagagtgtcttcttccctgaagagaggtgggcctgaggcttgacagtggcgctgcctgagtgacctagccgctgggctgggccctggacagctgatcccaggttcctgcacttgtcgccacccttccgtagtccacaggcctgatggcggcggctgagccgatgggcccggcacaggttgttggcatggaatggaggatgaagagataccttttgagcagagcttttctataggaatgtcacagatcaggattcccaagggaggtccttctactcagaaggcttacccctgtgggacatgtggcctggtcttaaaagacattttgcacttggctgagcaccaggaaacacacccagggcagaaaccatacatgtgtgtgctgtgtgggaaacagttctgcttcagtgcaaaccttcaccagcaccagaagcagcacagtggagagaaaccctttagaagtgataagagcaggccctttcttctgaacaactgtgctgtgcaatcaatggagatgtcttttgtgacaggggaggcttgtaaggacttcctagccagctcaagcattttcgagcaccatgcccctcacaatgagtggaagccacacagcaacaccaagtgtgaggaggcctctcactgtggaaaaaggcattacaaatgcagtgaatgtgggaaaaccttcagccgcaaagactcacttgttcaacaccagagagtccacactggagaaaggccttatgagtgcggtgaatgtgggaaaacctttagccgcaaacccatacttgctcagcaccagagaatccacactggagaaatgccttatgagtgtggcatatgtgggaaagtttttaatcatagctctaaccttattgtacatcaaagagtacacactggagcaaggccttacaagtgcagtgaatgtgggaaagcctatagtcacaaatctacacttgttcagcatgagagtatccatactggagaaaggccatatgagtgcagcgaatgtggaaaatactttggtcacaaatacagactcattaaacattggagtgttcatactggagcaaggccttatgagtgcatcgcatgtgggaagttctttagccaaagctctgaccttattgcacatcaaagagttcataatggtgaaaagccttatgtgtgcagtgaatgtggaaaagcctttagccacaaacatgtacttgttcagcatcatagaattcacactggagaaaggccatataagtgcagtgaatgtgggaaggccttcaggcagagggcttccctcatccgccactggaaaattcacactggagaaaggccttaggatgggagataattccgtttccttgttcaacataataactgacatcagagagaagctccaagcatagcctttatgtgtagccgacagccagaagtagaactttatacactcaaacactcaccctggggaggttcttccgagtgccagctatatgggaagccttctggagctatgctgaattttctagactcttgctggaatttcgtcaaggcagtgcctgttagaagccatctgtctttgtgctggaagagtcctgccttgtgccaaagtaaccccaatgtgtttcaaaagacagacctctgtactattcccttccctggagggaatcatcagtagcctgaggccatcaaggattctcactttttttctgccccactactggtttaagcatgagcatgacccagttttagccagaaaaatgggagctttgttctgctgaccactggcagaggtttcccttcatggatatagttgatctcacatggcacttgggacgaatttttctagccttcaagacacctgacctgaaattggctgcctcatattctggttttgcaacaaatgccttaatttttagactatctgaaatcttgaggattctgttcgctttgtgggttgggttgagaacagaattgagctaagccagtatgaagggaagaacagcttttgtgagagctccaactatctgtatctctgaagtgatagtaggatggcaaagactagctcttatgctagtgtcaagctaacttacttgactgcttcagctctcctaggaaagaatgccagtctttgtaggcctaatcttttggtctatatgttaagattttttgtgtaattgaggtcaccctaagcagtgggcatttgttgtgataatctctaatgtgtctgggagcaacatgaattacgtcccttgttcccagaagatacttcatattcccaaggcttcttgaggagaatttgaactcagtggacatgtcaagatctctgaagtctatttttcagtaggcagttgatattggctgtcctccagaaggcccaggtaggaatcatagttggtgcagaaacccagattaataaaggaatgagaaaactgcagcaaactatagggaatatgacccttctaaaggtacatccacatgtgtttccattactctggctccattatgagggtttacagaaatatttccatacctgtgtctcttatggctaaggttactgtccagaagtcagtctaaacatttttgcaataaactgcacatatttatagtgtaccatttgataagttttgatacatgttggcacttctcaaaccaaaagtttcctgattccttttatattttctccctttccttcacccatccccaggcaactattgatccgttgtcactgtagatttgtttgtatttcctagaattctacagagatagagtaatttaatatgtattctaatgtttttggcttcttaaactctgaaattaaggctcatggtggtgttctgtgtttcatagttcatttcttttcatttgtactttgctaagagtgttccattgtagagaaatagtttcaaagcaagtgatccaggagagaactcacacaagaacaaagccacagtatctgtcattaccttaaactgaaagtgatgagccgtcatttctgctatatttcataagtaaccctagctaatcctggttaaaagtggaagagaactacacaaaggtgaaaatagggatttgtggggcgttttcttggactctggtgaccataatcctatatggtttttttctttttctgttttagttgtttaatatgaattacattgactgatttttttaaatgttaagccaaccttgcatttctgtaataattcccatttggtcatgatgtattagtcatttagtatattgttgaatttgatttgctattttgttttgttttgttttgtttttttgtaacaagttttgcaccaatgttcacgagtgatatttgtccctaactttctttcttgcttgcttgcttttttttctttgtaattttatatcttgcccaggtttggctttggtatcagcataatgccagctttatagagtaagttgggaagtattcctgctcttcagctctctggaagagtttgtgaataattggtattatttcttccttaaatgtttggtagaattcaccaaggaagctgtctgggcctggagtttgttttgtaggaaagtttctaactataagtttgatttctgtggtagatagagggctgtacaagttatatgtacatctgtctgtgtgtgtgttgtctgtctgtcactctggccctgaagtgtgttttgtaggacagcatctaactacaagtttgatttccatggtagatggagggctatactagttatatatacatctgtctgtccgtccatctgtttgtcactccatccatccatctatctctagagtgagctttgatggtttgtgtctttcaaggagtttttctgttttatttaagtactcaaatttttcaaaatattattttcatacttgtagaatttgtagtggtgcaacctcttctattcctgatactggtaatgtctatatttttcttttaaccttgattggtttgggtagagatttatcaattttacaattttattgatcttaaagtacttggtattattgaattttctgttttctgatattttgggatttttcttttccattttgagttttactaatgccttccgcttttattggatttcatttcttttgctactttttaacatggaagctgaggtccttcatttcaaacctttgggtttttttcccctaatatggggaagagatgttaatgttaaaaatctatctgagaactgctttaattacctcccatcaagcttgatgtggtttcatttttttttttgagacagtgtcttgctctgtcatccaggttggagtgcagtggcgcgatctcggctcactgcaagctctgcctcctgggttcacaccattctcctgcctcagcctcccgagtagcttggactacaggcgcctgccaccatgcctggctaattttttgtatttttagtagagacgaggtttcaccgtgttagccaggatggtctcgatctcctgatcttgtgatccgcctgcctcagcctcccaaagtgctgggattacaggcgtgagcccagccgatgtggtttcattttagttgagtttaggatgttttccagttaaaaaaattcttcttgacacatggctctttttaaatgtatgttatttaattcctaaatatttggggattttgcttatctttctggtagtttctgcaataattccattgtggtcagagtacattaagacttgaattatttacatttattgagatttgctttgtggcccagaatatgggctatcttggtatgagttacatgttcacttgaaatgtatactgtactctcgtttgatgaaggggttctacaagtgttgattaggtaaaaatggttgatgttatttaagttttttctatctttattgacattctgtggttttggttccagcaattattttaagaggattgttgacatctctgaatattaaattggatttacttctctgcagttctgtcagattttgcttcacatattttagtatgtttttattaggtgaataataaatatttcctattttatgtcca

SEQ ID NO: 3622 - DNA, 2185 bp, Homo sapiens
cgctgcggcgaccagctccggaaagcgcggtggggacgcgctgtgttctcgcagctcagaggcgggtctgaggctcggtggcggcgcccagggtggcccgggccctttcctcggtcgttgtctcaccgccacaggctccgatggcggcggccacgctgagggaccccgctcagcagggctatgtgacctttgaggacgtggctgtctacttctcccaggaggaatggagattgcttgatgacgctcagaggctcctctaccgcaatgtgatgctggagaactttacacttctggcctctctgggacttgcatcttccaagacccatgaaataacccagctggagtcatgggaggagcccttcatgcctgcttgggaagttgtgacttcagccatactgagaggtagttggcaaggagccaaggctgaggcagctgctgagcagagtgcttctgtagaagtgcccagttcaaacgttcagcaacaccagaagcagcactgtggagagaaacccttaaaaagacaagagggcagggtcccagttttgaggagttgcagagtccacctatcagagaagtccttgcaaagcagggaagttgggaaggatcttctgaccagctcaggtgttctcaagcaccaggtgactcacacgggagagaagtcacataggagctccaaaagtagggaggcctttcatgctggaaaaaggcattacaaatgcagtgaatgtgggaaagcctttggtcagaaatatttacttgttcagcaccagagactgcacactggggaaaagccttatgaatgcagtgaatgtgggaagttatttagccataagtccaacctttttatacaccaaatagttcacactggagaaaggccttatgggtgtagtgactgtggaaaatcctttagccgtaatgctgacctcattcaacaccagagagttcacactggagaaaagccttttacatgcagtgaatgtggaaaagctttcaggcataattccacacttgttcagcatcacagaatccacactggagtaaggccttatgagtgcagtgaatgtggaaaattgtttagtttcaactccagcctcatgaaacatcagagagttcacactggagaaagaccttataagtgcagtgaatgtggaaaattctatagccacaagtccagccttatcaatcattggcgtgttcacactggagaaaggccttatgagtgcagtgaatgtgggaaattttttagccaaagctcaagcctcatgcaacatcgaaaagttcacactggagaaaaaccttttaagtgcaatgaatgtgggagattctttagtgagaattccagccttgttaaacatcagagggttcacactggagcaaagccttatgagtgcagggaatgtgggaaattttttcgccacagctccagtcttgttaaacatcgaaggattcacactggagaaatacaatgattgtgagaaatcctttagctggtgtttcaacctcattcaacaccagaaagttcacagtgtaaaaaagtcttgaaggttactaatggaaatccattagctatacctccaaactcattcaacactggacagttcacagagtggacaatgtagtgaatatggtaaaaggcctcagccaaaggcctaaccgtattcaacaccagaaagtttagactggagaaaggccttagactgtcgctgaatcaatatgacctgacttaaagcagaaacagccaggcgtggtggctgacacctgttattctcaccactttgggaggctgaagcgggcggatcacaaggtcaggacatcgaaaccatcctggttaacacaatgaaaccacatctctactaaaaatacaaaaatttactgggcatggtggtgggcgcctgtagtcccagctactcaggaggctgaggcagaagaatggcatgaacctaggaggcagagtttgcggtgagctgagatcacgccactgcactccagactgggtgacagagtgagactctgtctaaaaaaaaaaaaaaaaaaaattagcccggcgtggtggcaggcaactgtagtcccagctacttggggggctgaggcaggagatttgcttgaacccgggaggcggaggttgcattgagccgagatcacgccactgcactccagcttgggtgacagagtgagacttcgtctc

SEQ ID NO: 3623 - DNA, 494 bp, Homo sapiens
cgctgcggcgaccagctccggaaagcgcggtggggacgcgctgtgttctcgcagctcagaggcgggtctgaggctcggtggcggcgcccagggtggcccgggccctttcctcggtcgttgtctcaccgccacaggctccgatggcggcggccacgctgagggaccccgctcagcagggctatgtgacctttgaggacgtggctgtctacttctcccaggaggaatggagattgcttgatgacgctcagaggctcctctaccgcaatgtgatgctggagaactttacacttctggcctctctgggacttgcatcttccaagacccatgaaataacccagctggagtcatgggaggagcccttcatgcctgcttgggaagttgtgacttcagccatactgagagtttggctgcgtaacaggtcggcaaatctcctcactcagatattcttcccgaaccgacagccacaagtggcgcccgaacagggacgtgagtga

SEQ ID NO: 3624 - DNA, 3202 bp, Homo sapiens
actttccggccgctggctgtcgaagccggagtcccacctgtgtccccacagccctgtcacgaatcccggtcgggttctgggaggcacagcctcggggttgcgggccgggtgcggctcggcggtggaggactcacttcctgctccatccccggctgggccctggggcggaactgatgacgcttgataatgtggctggggacttcagggaagagtgggttacctggacactgcttagagaatcctctccaggaatgccacccagcacagttagaagaatgggctctcaaaggaatttccaggcctagtgtaatctcccagccggagcagaaagaagagccatgggtcctaccactccaaaactttgaggcgaggaagatcccgagggaaagccacacagactgtgagcatcaggtggcaaagctcaatcaggacaattctgaaacagcagaacaatgtggaacatcctcagaaaggaccaataaagatctttctcatactcttagttggggaggaaactgggagcaaggcctagaattagaagggcaacatggaacccttccaggagagggccagctggagtccttttcacaggagagggatttaaacaagctcctggatggatatgtaggagagaagcctatgtgtgcagaatgcgggaaaagctttaaccagagttcctatctcataagacacctaagaacccacactggcgagaggccctatacgtgcattgagtgtgggaaaggcttcaaacagagctcagaccttgtcacccatcgcagaacacacacaggagagaagccctaccaatgcaaggggtgtgagaagaaattcagcgacagctcaacactcatcaaacatcagagaacccacacaggggagagaccctatgagtgcccagagtgtggaaagacttttgggcggaagccacacctcataatgcaccaaagaacccacacaggcgagaagccctacgcgtgcctggaatgtcacaaaagcttcagtcgaagctcaaatttcatcactcaccagaggacccacacaggggtgaagccttacaggtgtaatgactgtggggagagttttagccagagctcggatttgattaagcaccaacgaacccacacgggagaacggcccttcaaatgcccggagtgcgggaagggcttcagagatagttctcattttgtagctcacatgagcactcattcaggagagaggcctttcagttgtcctgactgccacaaaagcttcagtcagagctcacatttggtcacgcaccaaagaacacacacaggtgagagaccttttaagtgcgaaaactgtgggaaaggattcgccgacagctccgccctcattaagcaccaacgaatccacaccggagaaagaccctacaaatgtggagagtgtgggaagagcttcaatcagagctcccactttattacccatcagcgaatccacttaggagacaggccctatcgatgtcctgagtgtggcaagaccttcaatcagcgttcccatttcctcacacaccagagaacgcatacaggagaaaaacctttccactgtagtaaatgtaacaagagcttccgtcagaaagcgcatcttttatgccatcaaaacacccatttgatttaggaagtagtctttggtgttcagctgctcccttgcacattttcattgctactgtcttcaagcaccccaaatagagaaaacctgggcgtcagtggctcaatttgggccctgatctattctccctctttcttgtctatgttataacagagaggataaacttaaagggtccaaataacggtccgaatacaaaaggcattccttcagtgtgtgactgactcttagggaaatgtgagtttaatagttgatgcccgccaggcgtggtggctcacccctgtaatcccagcacttttgggaggccaaggtgggtggatcacttgaggtcaggagttgagaccagcctggtgagcatggtgaaacctcatctctactaaaaatgcaaaaattagctgggcatggtggcacgtgcctgtagtcccagctactcgggaggccgaggcagaagaatcatttgaactcagaaggtgcaggttgcagtgagttgagatcatgccactgcactccagcctgggcaacagagagagactctgtctccaaaaaaattaaaaagttgatgcctagttactaaatgagaagtgagaaaaatgtggcctagagatcacatgttcaccacctagtacagtgcctggcacaacatagatgctcaataactaaatggtcccatcattattaatgattaatagttgaggtcttatataaaggctttaatgcagtacctggcccttaaaagacactcagtacaagattggtggcttttatcagtcttattactcaattagaaatttattagtgtagtccccccgccccaaactcagaacgtgaaagaaattagattggaactagaaggtttggggttggaatacacaaattgaataaaatggaaatgcactgccagttcagtgctgtgcaggcattagtcaccagaggtctcactgccatgacaaggccaaattatcgtagaggatgtttgcggtcttgtgacttggaggctgaaagaatttcagaagctcttttaaatggcagtgtatggcagtgtatctaccagaggtttgctgtcatctgacacagagaaaatatcctacaatgaacaagccagagggacctggtagaggactataaaattgtggaagcaaaattgctgagaatgtcaaatgatattacagggatcctccctggcatttagctgaaggaagcaactcttgttttctaatttgctgggtcattggccatttagttttaggttaatataattctctgatccttttagggccatccaggttatgcactagtacattcctacattcaattgaaataaattgagggacggcaagtgtgttggaaagaacaccgacttcattgagaaggtaaagtatttgagtcctggccctgacgcttaatttggccagactttcatcttctcccagcctcaagttttacctacctcacaaggttgttgtgaggatctaaaaatacacacacacacacacacacacacacacacacacacactttgttggttaactataaatgtaatatctctatgttataattctgttgctaatgtcttttt

SEQ ID NO: 3625 - DNA, 284 bp, Homo sapiens
ctgatgcacattgaggtctcttgctttaggaactgatgacgcttgataatgtggctggggacttcagggaagagtgggttacctggacactgcttagagaatcctctccaggaatgccacccagcacagttagaagaatgggctctcaaaggaatttccaggcctagtgtaatctcccagccggagcagaaagaagagccatgggtcctaccactccaaaactttgaggcgaggaagatcccgagggaaagccacacagactgtgagcatcaggtggcaaagct

SEQ ID NO: 3626 - DNA, 2257 bp, Homo sapiens
ggtgcccaagtcgccctcggggtggcagttcccgttaaccttagccacaaagtcaaagatggcaggaaagggacacagccggcgctgatgctgggaggcctccagggatggagagtggcctggctggcaacggcacaggagctgggctggtgatgaaggtcaagcaggagaagccggagcggctgctgcagacgctggcgccgcaggccatgcttgtggagaaggacaaggagaacatatttcagcagcaccggggcctcccgccacgccagaccatggggcggcctcgagccctggggggacaggaggagtctgggagtccaaggtgggcccctcccactgagcaggatgcggggctggcaggccgggctcccgggtcagcctccggccccctgagcccctcgctttcctccggcgagggtcactttgtatgcctggactgcgggaagaggttcagctggtggtcgtccctgaagatccaccagcgcacccacaccggggagaagccgtacctctgcggcaagtgcggcaagagcttcagccagaagccgaacctggcgcgccaccagcggcaccacacgggcgagcgacccttctgctgccccgagtgcgcgcggcgcttcagccagaagcagcacctgctcaagcaccagaagacccactcccggcccgccacccactcgtgccccgagtgcgagcgctgcttccgtcaccaggtgggcctccgcatccaccagcgcgcgcacgcccgggaccgccagggctcccgcgccggcctgcacgagctgattcaggacgcggcggcgcgccgggcctgtcgcctgcagccggggccgccgcgggggcgccccgagtgggcctggctggggctctgccagggctggtggggccagcccggggcccgggccgcggtctccggccccgaggggccgggcgagccgcgccagttcatctgcaacgagtgtggcaagagcttcacctggtggtcgtcgctgaacatccaccagcgcatccacactggcgagcgcccctatgcgtgccccgagtgcggccgccgcttcagccagaagcccaacttgacgcggcacctgcgcaaccacacaggcgagcgcccgcacccctgcccgcactgtggccgcggcttccgccagaagcagcacctgctcaagcacctgcgcacgcacctgcccggcgcccaggctgcgccctgccccagctgcggtaagagctgccgcagccgcgccgcgctgcgcgcccaccagcgcgcccacgctgtcgctgagcccgccgttccggccggggaaccgggcgaccagccgcaggccgaggccatcccgggcttggccgcgaggccgcggagctcccaacggtccccgggggcccgggacacgctgtggggccggggacaagcgggcctcgctgggcctggcgagccgcgccagttcatctgcaacgagtgcggcaagagcttctcgtggtggtcggcgctcaccatccaccagcgcatccacacgggtgagcggccctacccgtgccccgagtgcggccgccgcttcagccagaagcccaacctgacgcggcaccggcgcaaccacacaggcgagcggccctacctgtgtcccgcctgcggccgcggcttcagccagaagcagcacctgctcaagcaccagcgcgtgcaccgcgcggcccctgcgtgcagccccaaggaggaggcgcgctagtggactggacctcagcggacccgtggtggtgcgggggatgtttgcggggtgtgtgtggggagtgggggtggccaggattgctggctcttagaaccccttagagcgggaccggtggattccttaaggctctgaagggctgagaacagttctagaagcgtcccaaagggtgctgggaaaggtcccagcgtgggttgagggaggagggaagatccgagttcctcaccgcgggccgggatgtgaccaccctcttcagaggttggaccccaggcttcaagcaccgagtgaggggtctgttggggacgctgggagagtctctggtgtgaagtggcttaggtctggactggtcagctgtggcaccagccggtcctgcccacgcttcaggatggccgggggctgcccctgtgggagagttgccaagactcggcgataccaaggatggaagccagaggctgtggcgagggagagccaagcatattcccagcaccagggccactgctggcacgtcgtagacatccaataaatatttttggaaggag

SEQ ID NO: 3627 - DNA, 635 bp, Homo sapiens
cccggcggggggaggttggggacgggcctggcagttgtgaactcgaacctgccgctgtcgccgcggcggggcggggagcgagagtgggccgcggaggccggccttcgggctccatggacgggcgccgcgtccctgcacagcccgccgcagagatggcaggaaagggacacagccggcgctgatgctgggaggcctccagggatggagagtggcctggctggcaacggcacaggagctgggctggtgatgaaggtcaagcaggagaagccggagcggctgctgcagacgctggcgccgcaggccatgcttgtggagaaggacaaggagaacatatttcagcagcaccggggcctcccgccacgccagaccatggggcggcctcgagccctggggggacaggaggagtctgggagtccaaggtgggcccctcccactgagcaggatgcggggctggcaggccgggctcccgggtcagcctccggccccctgagcccctcgctttcctccggcgagggtcactttgtatgcctggactgcgggaagaggttcagctggtggtcgtccctgaagatccaccagcgcacccacaccggggagaagccgtacctctgcggcaagtgcggcaagagcttcag

SEQ ID NO: 3628 - DNA, 675 bp, Homo sapiens
attgtctctagggctttctgtcttgctgtaacgtctctccagccagctgcagctcctgctgacttatcccaccccagcgcaggtcatccaacggtgacttatggccccggcctcctggctcgatgaggatggcaggaaagggacacagccggcgctgatgctgggaggcctccagggatggagagtggcctggctggcaacggcacaggagctgggctggtgatgaaggtcaagcaggagaagccggagcggctgctgcagacgctggcgccgcaggccatgcttgtggagaaggacaaggagaacatatttcagcagcaccggggcctcccgccacgccagaccatggggcggcctcgagccctggggggacaggaggagtctgggagtccaaggtgggcccctcccactgagcaggatgcggggctggcaggccgggctcccgggtcagcctccggccccctgagcccctcgctttcctccggcgagggtcactttgtatgcctggactgcgggaagaggttcagctggtggtcgtccctgaagatccaccagcgcacccacaccggggagaagccgtacctctgcggcaagtgcggcaagagcttcagccagaagccgaacctggcgcgccaccagcggcaccacacgggcgagcgacccttctgctgcccc

SEQ ID NO: 3629 - DNA, 5292 bp, Homo sapiens
acttccggcgtcctctactagtggccattttgattggtgttgggtgtattttccagtgagagaccgcggagtgttgggtcgtgtagaagtgactgaacccagaaggtggagacgagacgttgtcccgactgcacagaggctgctctgcagctccttaaaggcgctaggcgtgacccgcaccaaggccgggatcgggaccaccgtgcccgggtacctgcactgctcgccccctcctttcgaccccgctttccccacccagtcggatggcggcggccgcgctgaggcccccggctcagggcactgtgacctttgaagatgtggctgtgaacttttcccaggaggaatggagtctccttagtgaggctcagagatgcctttatcatgacgtgatgctggagaacctgacacttatatcttctctaggttgttggtatggagcaaaagacgagacaccttctaagcagaccctttctatacaacaggagtccccactcaggacacattggacaggtgtatgtaccaagaaggtccacctctggggaatgtgtggccctctcctgggagatatcttacaccagggaacacaacacaatcagaaattgaatgggtttggggcatatgaaaaaaaattggatgacgatgcaaaccatcatcaagaccagaagcagcacattggagagaaatcgtacagaagcaatgccaagggaacatcttttgtaaagaactgtaaattccatatgtcacatgagccatttatctttcatgaggttgggaaagactttttgtccagcttgagattactccaacaagaggacattcacacttcagggaagtcaaactttgaaactaagcatgggataccccttcagggtggaaaaactcattacatctgtggagagtccacaataccgtttagcaacaaacactcacttgtccttcaccagagacttctccctagagaaggaccttatgtatgcagtgattctgggaaattcactagcaaaagtaatagttttaataatcatcagggagttcgcactggaaaaagaccttatcagtgtggacaatgtgatgaatcattttggtataaggcccacctcactgaacaccagagagttcacactggagaaagaccttatgagtgtggagaatgtgataaatcttttagtcataagcacagtcttgttgaccatcagcgagttcacactggagaaagaccttatgaatgtgacgaatgtgggaaatcttttagccataagcgcagccttgttcaccaccagcgagttcacactggagaaagaccttatcagtgtggagaatgtgggaaatcgtttaatcacaagtgcaacctcattcagcatcagcgagttcacactggagaaagaccttttgagtgtacggcatgtgggaagttatttaggagcaactcccacctaaaggaacaccagagagttcacactggagaaagaccctatgagtgtaaagaatgtaggaaatcatttaggtacaagtcacacctcactgaacaccagagagttcacactggagaaaggccatatgagtgtagagaatgtgggaaatgttttcatcaaaagggcagtctcattcaacatcagcagatccactctggagaaaggccacatgagtgtggagaatgtgggaaatgttttcatcaaaagggcagtctcattcgacatcagcagattcactctggagaaaggccacatgagtgtggagaatgtggaaagtgttttcgtcaaaagggaaacctcattaaacatcaacgagttcacacgggagaaagacatcatgaatgttgaaaatttggcagatctgttggtaaaaagagcaccctcattcaacattcgtgagatcacactggaaagcacttatgagtatggagaatgtgcaaaatcatctagccaaaaggttggcctcattcaacaatagcaagatcacactggggaaaggctttctgagtgtagagaatgtatgaaatcctgtacatagaagttttgcctcaccaaataccagaagggtcacactggagaaagaccctatagttatggggaatttgggaaattacctaacaagaagtcccacctcactgaacactactgagttcacagttgagaaaggccatatgactgtaaggaatttgtaaaattatttagccagaagagctgcattactattcatcagataatttacaatggagaaaggccacataataatttctcacataataaatgtgagaaatcatttccgtacagctctgcgctccatgttcgtaagagttcacactggacaaagccttatgagagcagcgagtagaaaatcctttgtgggaaaactctggtttcattaaacacaggagagttcatgctagagaaaggcctcaacagtgtagcaaatatggaaagacattcactagaagctctgccctgcaagttcacactagagaaagcccttctcagtgaagtaaatttggaaaattgattagtcaaacctctatgctccttcaaaatcagagttcacactggatcaaggctttatggtgtgacaaatatggcacattctttatctaaatgtctaacatattatgcacagacaagctcctgctgtggaagtgccttttgagtgcagagcatttgcgagggcttcactcttctttcactggataccagaatgttgacaggagaaaaataacatagatgtgtgggaatattacttcttgtccagtgtaactgtgggagagagcccttatgaggacaccatcaacctatattgaatgtcatatgtccagtagctgcataaattccaggtatatgggagctgtattgcatttcttatcctgcgtatgtccttgccagatttatttcattcttaggtctctggcaaaagccatttcatctctaccacttggcaggtacctacagtgcatcactcatgcactccatcatattccagaaaaaaagttcaagttgtctcccattcagcagtggtatttttgagtagcctctgcactcgttcctttctcatttctctatgaagagttaggccatggacctgactcagttctggcctagagcagaagtgtccaatcttttggctttcctggtccacattggaagaagaattgtcttgtgccgcatatgaaatacattaacactaatgatagctgatgaacttttttaaaaaatcacacaaaaaccctcataatgttttaagaaagtttacaaatttgtgttgggctgcattcaaagctgtcctgagatacatgcggcccacaagctgcgggttggaccagcttggcctagagaatttttctgattacttgacaagatgggctgtctttcctaggaatctcatgattgtcatgattcttaaaatggaattttccagcctcttaactcaccaacccaagtacaagctgcctctcattgttctggtttctgctatgatgaagtccttatttaagcttccttcaatcttgggaattgtattgactgtattgtgtgaattgtatactcactgcattgtgtggcttagatacaacatggttctggtaccatgaaggattctggtaccatgaaagtttgttggggttactaaactgtgtgactcttagggaacagtatgaaggcagaatatagctctgcatttgtggcctagtttggatggctgcctaaggcctccaaataaagacttcagggctttgtgatctttatttttagatgaaatagtgcaataatatgtgttttcataaatcaacctgagtaggggacagttttagtgacacactttggtgcttctgagaacagcacaaaattattctcttgtttataatggatattgcattctgctcagtactggtgagggaaatctgttctcaagtcctacagtgcattcatgtgtcctgaagtccagaattctgtaggatagtgtcctacgttataagcctggagaaagaaatcataattctttaatttttatttttttagggaaatgatgtcactctgaaactcaggctggaatacactggcatggtcatacctcactgcggcctcaaactcctgggctcaagtgatcctcctgcctcagcctcccgagtacctgagattagcccaggtaatttaagaattttttatagagatagggttttgctattttaccctgactgatgttcaactcctggcctcaagtaatcctctagcatacgcccttgaaagcactaggattacaggtgtgagccaccatgcccagcccaaaaataatttttgtagaattagcatttctaggtagtgaagcagactgcaacagaatagttgggatatactttttttaaaaaggcatccacaatgattcagtcactatgtctgtgatggacaagcaggtacagaaattttcaggacctccataattatgaatctagtgtagcttaggtcattgtcagactaaatctaaaggttttgtggatttctgtagcctatctgggctgcataccaaaaagccatccctgaattagtaggaggaagaggatagggagaaaggaaatctcttagtccagtgatgtggcctttgcaaccagccagcattccaatttaatcaggtggaaatgatcttcctggctcataagtatttggtatcacacaggctaattgccccccttagggcgtgatgagagttaggagagtcaatgtaaaatcacataacctatttgtcaaaaataatgttaaatccagatagttctttcaaattaaatttttaaagctgtaataagactgggcatggtgactcatgcctgttatcccaacactttgggagtccagggtgggagtattgcttgaggtaagaagtttgagactagcctgggtcccatagtaagaccctgtctcttaaaaaataaatactatctttctctctggcctctccatgctccagacaatcactgaattacaatatttgcttaacagtagattaatgtcaattttctggaattttatatgactgatataacatgtttcctcttttcatacctgagtactctcctgagccctatttatttagatgttcttcttttttctttattattatttttatttcacatagcagggatgcatattttgacattcatcaatcatgatatatgagtagttcattctttttatcttagaatatgacatgctatggaaatcactgtatacgaattcatctgcttatggatatgttattgcttcttatttttgtctgttaggaataaaactgcttgttaagcacatttgaatgcaa

SEQ ID NO: 3630 - DNA, 2386 bp, Homo sapiens
tggccttggcttcaggaaaggagcattcagacgcttccgtcagcctcccaggatggcagcccctgacctggcccacggacgcggtgacctttgacgacgtggctgtggacttcacccaggaggaatggactttactggacccatctcagagagacctctacagagatgtgatgctggaaaactacgagaacctggcctcagtaggacatcacctgttccaacccagtgtgatctattggctggagcaggaagaggagttgagggcagggcggagagcagttctccaagaatggcgacttaaaaccaaagggccagcacttcggcaggatagatcttggttcagagcatcaaatgagacacagacggcaagaagccacaatggagggcagctctgtgaccgcacgcagtgtggagaagctttcagtgaacactcaggcctcagcacacacgtgagaactcaaaatacaggagacagttgtgtgtctaatcattatgaaagggacttttttattccatgccagaaaaccttgttcaaaattggagagcagttttccgtgttgggtcagtgtggaaaagccttcagctctactccaaatgttgtttcccagcaagcatgcactcgggacagatctcttgactacagcagctgtggggaagtgttccttaatcagtcataccttcaggcacgtgcgggaagtcacaacggagaagaaacatggaaatggaagccgtgtgggaaagctctaactcactccatgggctgcgccacacctgttgaaatgcatgccgtcaggaatccccacgtatgtagggaatgtgggaaggcctttaggtacactgcctaccttactggtcgcgtgcaagtccaccctggggaaaagccctgtgaattggaagaatgtggaaaagcctcccctgtttcttccagcctaactcaacatgtaagaattcatgctgcagagaaaccctgtgaatgtaaagaatgcggaaaagccttcactggactctcaggtctttctaaacacgtccaaacagaccctggacagaagccctatgaatgtaaggactgtgggaaagcctgcggtgggttttatctactgaatgagcatggaaaaactcacacgagggagaagccctttgcatgtgtggtttgcggaaaatattttagaaattcctcatgccttaataatcatgttcgaattcacactggaataaaaccctatacatgcagctactgtgggaaggccttcactgtgcgctgtggccttactagacacgtacgaacacacacgggcgagaagccatacacgtgtaaggactgcgggaaagccttctgtacatcctcgggccttactgagcatgtaaggactcacactggagagaaaccatatgaatgtaaagattgtgggaaatccttcactgtttcttcaagcctgactgagcacgcgagaatccataccggagagaaaccctacgaatgtaagcagtgtggcaaagccttcacagggcgctcaggcctcactaaacacatgcggacacacaccggggagaagccctatgaatgtaaggactgtgggaaagcctacaatagggtttatctactgaatgagcatgtgaaaactcacacagaggagaagccctttatatgtacggtatgcaggaaatccttcagaaattcctcgtgcctgaataagcacattcagattcacactggaataaaaccttatgaatgtaaggactgtgggaaaacattcactgtttcttcgagcctaaccgagcacatacgaactcacactggagagaaaccttatgaatgtaaagtatgcggaaaggccttcaccacatcctcacaccttatcgtgcacataagaacccacaccggtgagaaaccctacatatgtaaggagtgtgggaaagcctttgcttcctcctcacaccttatcgaacacagaaggactcacacaggagagaaaccttacatatgtaacgagtgtgggaaagccttccgtgcctcctctcacctgcataaacatggaagaattcacactgggcagaaaccctataaatgtaaggaatgtgggaaagcatacaataggttttatctactaaaagaacatttaaaaacttacactgaagagcaggtttttgtatgtaaggactgtggaaaatcttttaagaattcctcatgccttaaccatcacactcaaattcacactgatgagaaacctttctaatgtaaagaatgtggggaagctgtcagctacactcattcacgttgaagacatgaaagacctctcgttctccagatgtccatgacttgaggaatgtggctaggcaatcagcatctcatcacaacccggcaggcaggaactcaccctggagccct

SEQ ID NO: 3631 - DNA, 2922 bp, Homo sapiens
ctgtcttacagctgatccggttcttgcggcggtgcgtgctggcgccggagagttccgcgcgtgtcctcgggctgtccgcggggaagctggtccgggagtgggcgcccgcccgcctgcctcgcgccttgcgcccccggcaccgcttccagaagggaaagtcgccgccgctcgcggtagacccgggcagcgcttccattccgcggagctggaaatagggatccagccatccgtgggtcaggaggaatggagactgtaccttccacatagattcacaagctgccctgcagtggccttggcttcaggaaaggagcattcagacgcttccgtcagcctcccaggatggcagcccctgacctggcccacggaggtcatgtttctagggactcagtctgccttcatgaagaacagacacaggcagcagggatggtggctggctggctgataaattgttaccaggacgcggtgacctttgacgacgtggctgtggacttcacccaggaggaatggactttactggacccatctcagagagacctctacagagatgtgatgctggaaaactacgagaacctggcctcagtagaatggcgacttaaaaccaaagggccagcacttcggcaggatagatcttggttcagagcatcaaatgagacacagacggcaagaagccacaatggagggcagctctgtgaccgcacgcagtgtggagaagctttcagtgaacactcaggcctcagcacacacgtgagaactcaaaatacaggagacagttgtgtgtctaatcattatgaaagggacttttttattccatgccagaaaaccttgttcaaaattggagagcagttttccgtgttgggtcagtgtggaaaagccttcagctctactccaaatgttgtttcccagcaagcatgcactcgggacagatctcttgactacagcagctgtggggaagtgttccttaatcagtcataccttcaggcacgtgcgggaagtcacaacggagaagaaacatggaaatggaagccgtgtgggaaagctctaactcactccatgggctgcgccacacctgttgaaatgcatgccgtcaggaatccccacgtatgtagggaatgtgggaaggcctttaggtacactgcctaccttactggtcgcgtgcaagtccaccctggggaaaagccctgtgaattggaagaatgtggaaaagcctcccctgtttcttccagcctaactcaacatgtaagaattcatgctgcagagaaaccctgtgaatgtaaagaatgcggaaaagccttcactggactctcaggtctttctaaacacgtccaaacagaccctggacagaagccctatgaatgtaaggactgtgggaaagcctgcggtgggttttatctactgaatgagcatggaaaaactcacacgagggagaagccctttgcatgtgtggtttgcggaaaatattttagaaattcctcatgccttaataatcatgttcgaattcacactggaataaaaccctatacatgcagctactgtgggaaggccttcactgtgcgctgtggccttactagacacgtacgaacacacacgggcgagaagccatacacgtgtaaggactgcgggaaagccttctgtacatcctcgggccttactgagcatgtaaggactcacactggagagaaaccatatgaatgtaaagattgtgggaaatccttcactgtttcttcaagcctgactgagcacgcgagaatccataccggagagaaaccctacgaatgtaagcagtgtggcaaagccttcacagggcgctcaggcctcactaaacacatgcggacacacaccggggagaagccctatgaatgtaaggactgtgggaaagcctacaatagggtttatctactgaatgagcatgtgaaaactcacacagaggagaagccctttatatgtacggtatgcaggaaatccttcagaaattcctcgtgcctgaataagcacattcagattcacactggaataaaaccttatgaatgtaaggactgtgggaaaacattcactgtttcttcgagcctaaccgagcacatacgaactcacactggagagaaaccttatgaatgtaaagtatgcggaaaggccttcaccacatcctcacaccttatcgtgcacataagaacccacaccggtgagaaaccctacatatgtaaggagtgtgggaaagcctttgcttcctcctcacaccttatcgaacacagaaggactcacacaggagagaaaccttacatatgtaacgagtgtgggaaagccttccgtgcctcctctcacctgcataaacatggaagaattcacactgggcagaaaccctataaatgtaaggaatgtgggaaagcatacaataggttttatctactaaaagaacatttaaaaacttacactgaagagcaggtttttgtatgtaaggactgtggaaaatcttttaagaattcctcatgccttaaccatcacactcaaattcacactgatgagaaacctttctaatgtaaagaatgtggggaagctgtcagctacactcattcacgttgaagacatgaaagacctctcgttctccagatgtccatgacttgaggaatgtggctaggcaatcagcatctcatcacaacccggcaggcaggaactcaccctggagccctatgcagcagacacagagaaagccctcagtgttctctaaggtcttgctgaatatggatggtatccagtagagagaactctattgatgtgtgatatgcagcagcattgttgctgttctgctcagtactttgatgatcccttgtgatctcacaatgaagaaaaaccttaggagggtgagaattgttgggaagtcattttttacattacatctttcctcaccctttagtaaacgtggtgattgac

SEQ ID NO: 3632 - DNA, 2229 bp, Homo sapiens
acttccggtctccggggtcgacgacatagcgggtcgtatttttatccaaaagaaggacctggaggaggatgagagcgttactgctgcacacctaaagtcaaggaacaggagcattgggaatatgtgattcattgcgactgctggttgtatattaagaaaatgagtgaggggctcaaatgatctaggacagaaattctttctttttaaatcgacagatataattgtatgtatttatcatgtgcaacatgaagttttatggggagaagcccgaggaagattgaccagttttgtaattctagcaacatggtccatggatcagtgacattcagggatgtggccattgacttctctcaggaggagtgggagtgcctgcagcctgatcagaggaccttgtacagggatgtgatgttggagaactacagccacctgatctcactgggaagttccatttctaaaccagatgtaattacgttactagagcaagagaaagagccctggatggttgtaaggaaagaaacaagcagacggtatccagatttggagttaaaatatggacctgagaaagtatctccagaaaatgatacctctgaagtaaatttacccaaacaggttataaagcaaataagtacaactcttggcattgaggccttttattttagaaatgactcagaatatagacaatttgagggactacagggatatcaagaaggaaatatcaatcaaaagatgatcagctatgaaaaactgcctactcatactcctcatgcttctcttatttgcaatacacataaaccgtatgaatgtaaggaatgtgggaaatactttagtcgtagtgcaaatcttattcagcatcagagtattcatactggagagaaaccctttgaatgtaaggagtgtgggaaagcctttcgacttcacatacaatttactcgacatcagaaatttcatactggtgagaaaccttttgaatgtaacgaatgtggaaaggcctttagtcttcttaccctgcttaatcgccataagaacattcacacaggtgagaaactgtttgaatgtaaggaatgtgggaagtcctttaatcgtagctcaaaccttgttcaacatcagagtattcattctggtgtaaaaccatatgaatgtaaggagtgtgggaaaggctttaatcgtggtgcacaccttattcagcatcagaaaattcattccaatgagaaaccctttgtatgtaaggaatgtgggatggcctttcgatatcattaccaacttattgaacattgccaaattcatactggtgagaaaccctttgaatgtaaagaatgtggaaaggcgtttactcttctgacaaagcttgttcgacatcagaagattcatactggtgagaaaccctttgaatgcagggaatgtgggaaggcctttagtcttctcaaccagcttaatcgccataagaacattcacacaggtgaaaaaccgtttgaatgtaaggaatgtgggaagtcctttaatcgtagctcaaaccttgttcaacatcagagtattcatgctggtataaaaccatatgaatgtaaggagtgtgggaaaggctttaatcgtggtgcacaccttattcagcatcagaaaattcattccaatgagaaaccttttgtatgtagggaatgtgagatggcctttagatatcattgccaacttattgaacattctcgaattcatactggtgacaagccatttgaatgtcaagactgtgggaaggccttcaatcgtggctcaagccttgttcaacatcagagtattcacactggtgagaagccctatgaatgtaaggagtgtgggaaggcttttagactttacctacaactttcccaacatcagaaaactcacacaggtgaaaaaccatttgaatgtaaggaatgtgggaaattctttcgtcgtggttcaaatcttaatcaacatcgaagtattcatactggaaagaaaccctttgaatgtaaggaatgtgggaaagcctttcgacttcatatgcaccttattcgacatcagaaattgcatactggtgagaaaccctttgaatgtaaggagtgtgggaaagcctttcgacttcatatgcaacttattcgacatcagaaattgcatactggtgagaaaccctttgaatgtaaggaatgtggaaaggtttttagtcttcccacccagcttaatcgccataagaacattcacacaggtgagaaggcatcttga

SEQ ID NO: 3633 - DNA, 4249 bp, Homo sapiens
acttccggtctccggggtcgacgacatagcgggtcgtatttttatccaaaagaaggacctggaggaggatgagagcgttactgctgcacacctaaagtcaaggaacaggagcattgggaatatgtgattcattgcgactgctggttgtatattaagaaaatgagtgaggggctcaaatgatctaggacagaaattctttctttttaaatcgacagatataattgtatgtatttatcatgtgcaacatgaagttttatggggagaagcccgaggaagattgaccagttttgtaattctagcaacatggtccatggatcagtgacattcagggatgtggccattgacttctctcaggaggagtgggagtgcctgcagcctgatcagaggaccttgtacagggatgtgatgttggagaactacagccacctgatctcactgggaagttccatttctaaaccagatgtaattacgttactagagcaagagaaagagccctggatggttgtaaggaaagaaacaagcagacggtatccagatttggagttaaaatatggacctgagaaagtatctccagaaaatgatacctctgaagtaaatttacccaaacagatttcttcattggcttccaaaccatcttttacagctattcatattcaaaggagaatccattgcagaatctgcattgcatttggttatctctctttagtgtattgtagcctggaaatcctatgaatgtaggcgctcaaattttgttgcaagatttaatagagtgaaaacagagctcccatacaaagggaggggacccaaagagggtagtcgttgccggctcgaatgcctgggtttatatcctgatcattgtccctcccgctgtgctctcaggcaatagatgattggctatttctttacctcctgtttttgcctaattagcattttagcgggctctctttcttacctgatgggtcgggtgtgagctgagttgcaagccccgtgtttaaaggtggatgtggtcaacttcccatctaggcttagggattcttaatcggcctaggaaatcctgctagtcctgtttctcagtaccccctctcaacaggaaaacccaagtgctgttggggaggttggccaacaactgctctaattgcttcctgctgaattggggtgtagtaggggttgtgcagttgagatttcctctggaggggtgccttcgatgtcattaacattggagcatgggctagcaggccggtccaggggtccgcggtagattttagtcatggactgcatctggggctccatttgaagaatgagttgtggctttacagcttcgattctggaaaagacaaacttaacaaggaggttaaagatacagagattgaaatgtatggcctgcagtgcaggggattatttctttggcacacttcacaggccctgactatctgcttgatagttttgaaaaggcctggtccatctcctcattcttaaaaaatgagattgaattttgattagcccaggaaaattgtctatgtgtttagatttctttctttatagtgtcatttagtgttgttctctttgttgcatattctgtacaagggaatttgagtccagaggctctgttaggtcagattaaacattttggggaagaatactttgtaggctatttgtatggcatatttcactgtcagaaaacatttaagtacaggtccttgcattagtgaaactaagtttgatcatttgggtaagctggtaaccgccataagtccattgtaaagatctaatttgtagtgcataaataatctatggagagactttgacctctgaatatttataatcatgtgtattttagctgtggattgaatacaaaatgaaaattgaaatagactattcaaaaatgaatgccattaaggttgtcaacataagtcaacttgtgtgataaggctgacagtatattcagtacaaaattagcaccctctagtttattcagggagccaagattattttgtctggaaccttgtttttgttcagcatttatcatcagcacctatacatcatggctggtatgtgagctgttgataaactttgaaaaaaattaagcctttaaatcaagctataaaacatgataccattgtggcatcatgaattagagagattaacttttttaaagatcaataataatcctttgtgattttattccagtgcatttaaaaatctataaaatgataatttatattgatagctttcttctttttgtgaatatatccttatcagattattatgcttttgatagactacttaattctatttcttaacatttaattgtatctataatcataggtaaagttataattttctaaacatttttcaggttttgttaatgcagtgatcttataaatcttacaaaacgaggctatttaaaacctggctttctagtctcatgttcctattttttatttccactttcatctttttcatattgattctctttgactttcttttttgaactcaacagattccctgggtattaacccagcacaactcctttatgggtcattgcacattctggtatctcattaagaattgtcataaaaaagagatcccaggaggccttccagtgaaactctatcatcatgcaatcttgggatttctaagttggaagtcacagtccctttgcaaacataataaaacactttaaaatatttgctaaagttacaaaccaattatgtaaaaatttaaaaatcacctactacttttaaaagcagagaaggcatccatagactatttccttgcttacaagctcagtgaacatactgaattcacttataaaaagaattttctcaattttagttgcttttcaaaaaattcttattccttttatttgtaattctttgacattgttgctgcttcacagttttggtaattggacagtttggtctttattatgatattaacatttttacctgtcctgaaacaaggaaatacaatcaaagaaacagaagattggtggaccttgaaccacattatgatatcagatgacccagagtcatggttactaagttgcttaaatttttagtaacaaagatgtattagaaagtgacaggtcaattcaataatggtttttttggatacatttaattatataatccccttaagttgtgcttagtcagcagtatttaatctgttgtctattatatatctaactggtctgttatgtttattatatatttatatattgcttattcatatcttattggagtaactcatttttaaaacaatatatttcatctcctaggagaagaggatcgagtatgtgtttttattctttttcattaggacattggggtattttcttattgtgaaatgtattgaatatttcatttatttggtttgtgagtctgaccttcactccctagcactgatttttatttggccctccttttacctgattcataggagttacgagtagccgttaatatggatacatttttcccatttctagtacactgccccttccaaaagtgtctggcttactcaaacttttctgtatttgttccatcttgcttttacagatcaatacaaataggtaactataccttctaaacaaacatcaagttggtggaaaaaaggcatatgaacagttctttctcacctactatcaacaaacagtaaattaaacattcctaactgcagcctccttttgtaaaatttataaccatttatcttttgagtgtgacatgatactagatgtatgataattacatgttttgtgtatcagtatgaacatgatttttaacagacttgttccaatgaactattatagagatggtccccaacaatgtcaactaacaatttctcagctttatgatggtacaaaagtgatatgttgctatagtttggatatttgtccctccaaatctcatgttgaagtttgatctcagtgttggaggtggggcctaatggaaggtgtttgggtcatggtggaagatccctcatgaataaattaatgccctctctggattgaggggtgagtgagctatcgctctgttaatttttgtgagagctggttgttcaaaagaacctggcacctcctccctcaccctcttgttttctctcttgccatgtgatgtctgcatacactggctctcccttcatcatctgccatgagtggaagcagcctgagacccttagcagaagcagatgctgcaccatgattcttgtacattctgcagaacagtgagccaaataaacctctttattaatc

SEQ ID NO: 3634 - DNA, 648 bp, Homo sapiens
acttccggtctccggggtcgacgacatagcgggtcgtatttttatccaaaagaaggacctggaggaggatgagagcgttactgctgcacacctaaagtcaaggaacaggagcattgggaatatgtgattcattgcgactgctggttgtatattaagaaaatgagtgaggggctcaaatgatctaggacagaaattctttctttttaaatcgacagatataattgtatgtatttatcatgtgcaacatgaagttttatggggagaagcccgaggaagattgaccagttttgtaattctagcaacatggtccatggatcagtgacattcagggatgtggccattgacttctctcaggaggagtgggagtgcctgcagcctgatcagaggaccttgtacagggatgtgatgttggagaactacagccacctgatctcactgggaagttccatttctaaaccagatgtaattacgttactagagcaagagaaagagccctggatggttgtaaggaaagaaacaagcagacggtatccagatttggagttaaaatatggacctgagaaagtatctccagaaaatgatacctctgaagtaaatttacccaaacaggttataaagcaaaaaaaaggtaaaaaaaaaaaaaaaaag

SEQ ID NO: 3635 - DNA, 7500 bp, Homo sapiens
gaggaagagatctgtggctgcgggagatctctgcggattggggctccagcctgactgacccgacagtgcgggtggcctagggggaggcgctcagatcgtatttttatccaaaagaaggacctggaggaggatgagagcgttactgctgcacacctaaagtcaagggggagaagcccgaggaagattgaccagttttgtaattctagcaacatggtccatggatcagtgacattcagggatgtggccattgacttctctcaggaggagtgggagtgcctgcagcctgatcagaggaccttgtacagggatgtgatgttggagaactacagccacctgatctcactgggaagttccatttctaaaccagatgtaattacgttactagagcaagagaaagagccctggatggttgtaaggaaagaaacaagcagacggtatccagatttggagttaaaatatggacctgagaaagtatctccagaaaatgatacctctgaagtaaatttacccaaacaggttataaagcaaataagtacaactcttggcattgaggccttttattttagaaatgactcagaatatagacaatttgagggactacagggatatcaagaaggaaatatcaatcaaaagatgatcagctatgaaaaactgcctactcatactcctcatgcttctcttatttgcaatacacataaaccgtatgaatgtaaggaatgtgggaaatactttagtcgtagtgcaaatcttattcagcatcagagtattcatactggagagaaaccctttgaatgtaaggagtgtgggaaagcctttcgacttcacatacaatttactcgacatcagaaatttcatactggtgagaaaccttttgaatgtaacgaatgtggaaaggcctttagtcttcttaccctgcttaatcgccataagaacattcacacaggtgagaaactgtttgaatgtaaggaatgtgggaagtcctttaatcgtagctcaaaccttgttcaacatcagagtattcattctggtgtaaaaccatatgaatgtaaggagtgtgggaaaggctttaatcgtggtgcacaccttattcagcatcagaaaattcattccaatgagaaaccctttgtatgtaaggaatgtgggatggcctttcgatatcattaccaacttattgaacattgccaaattcatactggtgagaaaccctttgaatgtaaagaatgtggaaaggcgtttactcttctgacaaagcttgttcgacatcagaagattcatactggtgagaaaccctttgaatgcagggaatgtgggaaggcctttagtcttctcaaccagcttaatcgccataagaacattcacacaggtgaaaaaccgtttgaatgtaaggaatgtgggaagtcctttaatcgtagctcaaaccttgttcaacatcagagtattcatgctggtataaaaccatatgaatgtaaggagtgtgggaaaggctttaatcgtggtgcacaccttattcagcatcagaaaattcattccaatgagaaaccttttgtatgtagggaatgtgagatggcctttagatatcattgccaacttattgaacattctcgaattcatactggtgacaagccatttgaatgtcaagactgtgggaaggccttcaatcgtggctcaagccttgttcaacatcagagtattcacactggtgagaagccctatgaatgtaaggagtgtgggaaggcttttagactttacctacaactttcccaacatcagaaaactcacacaggtgaaaaaccatttgaatgtaaggaatgtgggaaattctttcgtcgtggttcaaatcttaatcaacatcgaagtattcatactggaaagaaaccctttgaatgtaaggaatgtgggaaagcctttcgacttcatatgcaccttattcgacatcagaaattgcatactggtgagaaaccctttgaatgtaaggagtgtgggaaagcctttcgacttcatatgcaacttattcgacatcagaaattgcatactggtgagaaaccctttgaatgtaaggaatgtggaaaggtttttagtcttcccacccagcttaatcgccataagaacattcacacaggtgagaaggcatcttgaatgtaaggaatgtggaaagtcctttaatcgtgtctcaaaccatgttcaacatcagagtattcgtgctggtgtaaaaccatgtgaatgtaaggggtgtgggaaaggcttcatttgtggttcaaacgttattcagcatcagaaaattcattccagtgagaaactctttgtatgcaaggagtggaggacgacctttagatatcattaccacttatttaacattaccaaattcacactggtaaaaaaccctttgaatgtaaagaatgtggaaaggccttcagttttctgacacagcttgctggacttcaggtcattcatactggcgagaagccatttgaatttgagaaatgtgggaaggccttcaatagtggctcaaaccttgttcaacatcagagtattcatactggtgagaaactctatgaatgtaaggagtgtgggaaaactttcagatttagtttggtcctgactgcacatcaaagaattcatactggtatgaaaccctgtgaatgtacagaatgtgggaagacctttagttgtagctcaaacattgttcaacatgttaaaattcatactggtgagaaacgctataatgtaaggaatatgggaaagcatttgctgtggatgatcagctgtctcaacatcagaaaattcagaatagttagaaattttgtgacaataaggagtgtggacaagccttcactgtgtacgaaaaatttactcaacaccagagagctcatattgatgagaaatcttgtgaacataaaagaatgtgtgaagaactttcatcatggcctgggatttgctcaacttctgagtattcatacttctgagaaatctttgagtgtaaggaatgtggggcgttttatagccacactaaataccttagagttcggagaagataattcttgtgagaaagtctttgaatgaggaatatagggtagttgtcatgttcacaatgtactccctatgaaataatttaccagatacaggcatacctcgctgaattgtgcattgcagttattgtgttttatacaaactgaaggtttgtggcaaccctgtggtgagcaagacgatcaggtccattttcccaacgtcaggtgtgcatttcatgtctttatgtcacattttggtaattctcagaatatttcaaactatttcattgttatatatctatcatggtgatcaatgaccagtgatttttgatgttgctattgtaattgctttgggataccacaaattctgcccataaaagatggtaaacctagttgatacttgttgtgggttttgaaagaatagtcaaatatacaatcatataccccaacctagattcaaaattgttaacaatttgcacgtttattttttgtatatttgttgtaccattgagaataagttttagacatcatgacactttaccctttatttaatcaacgtgtgtatcaaccaaacatgaagacaatatagacaatatcatatagccattgtaccataattaccgttaaggaaagtattcataattctgtaatatcattccattttcagatttcttcattggcttccaaaccatcttttacagctattcatattcaaaggagaatccattgcagaatctgcattgcatttggttatctctctttagtgtattgtagcctggaaatcctatgaatgtaggcgctcaaattttggtaggtattagaatcaacagtggcacttagtaaagctacagaggcttaagccctagcttataattctgggcctctatgttttttattatttctccaggtgattgtgataccaaccagagttagagagccactgacctagaacatttctcctttctcctcattcttctttttttttttttttttgcagttgcaagatttaatagagtgaaaacagagctcccatacaaagggaggggacccaaagagggtagtcgttgccggctcgaatgcctgggtttatatcctgatcattgtccctcccgctgtgctctcaggcaatagatgattggctatttctttacctcctgtttttgcctaattagcattttagcgggctctctttcttacctgatgggtcgggtgtgagctgagttgcaagccccgtgtttaaaggtggatgtggtcaacttcccatctaggcttagggattcttaatcggcctaggaaatcctgctagtcctgtttctcagtaccccctctcaacaggaaaacccaagtgctgttggggaggttggccaacaactgctctaattgcttcctgctgaattggggtgtagtaggggttgtgcagttgagatttcctctggaggggtgccttcgatgtcattaacattggagcatgggctagcaggccggtccaggggtccgcggtagattttagtcatggactgcatctggggctccatttgaagaatgagttgtggctttacagcttcgattctggaaaagacaaacttaacaaggaggttaaagatacagagattgaaatgtatggcctgcagtgcaggggattatttctttggcacacttcacaggccctgactatctgcttgatagttttgaaaaggcctggtccatctcctcattcttaaaaaatgagattgaattttgattagcccaggaaaattgtctatgtgtttagatttctttctttatagtgtcatttagtgttgttctctttgttgcatattctgtacaagggaatttgagtccagaggctctgttaggtcagattaaacattttggggaagaatactttgtaggctatttgtatggcatatttcactgtcagaaaacatttaagtacaggtccttgcattagtgaaactaagtttgatcatttgggtaagctggtaaccgccataagtccattgtaaagatctaatttgtagtgcataaataatctatggagagactttgacctctgaatatttataatcatgtgtattttagctgtggattgaatacaaaatgaaaattgaaatagactattcaaaaatgaatgccattaaggttgtcaacataagtcaacttgtgtgataaggctgacagtatattcagtacaaaattagcaccctctagtttattcagggagccaagattattttgtctggaaccttgtttttgttcagcatttatcatcagcacctatacatcatggctggtatgtgagctgttgataaactttgaaaaaaattaagcctttaaatcaagctataaaacatgataccattgtggcatcatgaattagagagattaacttttttaaagatcaataataatcctttgtgattttattccagtgcatttaaaaatctataaaatgataatttatattgatagctttcttctttttgtgaatatatccttatcagattattatgcttttgatagactacttaattctatttcttaacatttaattgtatctataatcataggtaaagttataattttctaaacatttttcaggttttgttaatgcagtgatcttataaatcttacaaaacgaggctatttaaaacctggctttctagtctcatgttcctattttttatttccactttcatctttttcatattgattctctttgactttcttttttgaactcaacagattccctgggtattaacccagcacaactcctttatgggtcattgcacattctggtatctcattaagaattgtcataaaaaagagatcccaggaggccttccagtgaaactctatcatcatgcaatcttgggatttctaagttggaagtcacagtccctttgcaaacataataaaacactttaaaatatttgctaaagttacaaaccaattatgtaaaaatttaaaaatcacctactacttttaaaagcagagaaggcatccatagactatttccttgcttacaagctcagtgaacatactgaattcacttataaaaagaattttctcaattttagttgcttttcaaaaaattcttattccttttatttgtaattctttgacattgttgctgcttcacagttttggtaattggacagtttggtctttattatgatattaacatttttacctgtcctgaaacaaggaaatacaatcaaagaaacagaagattggtggaccttgaaccacattatgatatcagatgacccagagtcatggttactaagttgcttaaatttttagtaacaaagatgtattagaaagtgacaggtcaattcaataatggtttttttggatacatttaattatataatccccttaagttgtgcttagtcagcagtatttaatctgttgtctattatatatctaactggtctgttatgtttattatatatttatatattgcttattcatatcttattggagtaactcatttttaaaacaatatatttcatctcctaggagaagaggatcgagtatgtgtttttattctttttcattaggacattggggtattttcttattgtgaaatgtattgaatatttcatttatttggtttgtgagtctgaccttcactccctagcactgatttttatttggccctccttttacctgattcataggagttacgagtagccgttaatatggatacatttttcccatttctagtacactgccccttccaaaagtgtctggcttactcaaacttttctgtatttgttccatcttgcttttacagatcaatacaaataggtaactataccttctaaacaaacatcaagttggtggaaaaaaggcatatgaacagttctttctcacctactatcaacaaacagtaaattaaacattcctaactgcagcctccttttgtaaaatttataaccatttatcttttgagtgtgacatgatactagatgtatgataattacatgttttgtgtatcagtatgaacatgatttttaacagacttgttccaatgaactattatagagatggtccccaacaatgtcaactaacaatttctcagctttatgatggtacaaaagtgatatgttgctatagtttggatatttgtccctccaaatctcatgttgaagtttgatctcagtgttggaggtggggcctaatggaaggtgtttgggtcatggtggaagatccctcatgaataaattaatgccctctctggattgaggggtgagtgagctatcgctctgttaatttttgtgagagctggttgttcaaaagaacctggcacctcctccctcaccctcttgttttctctcttgccatgtgatgtctgcatacactggctctcccttcatcatctgccatgagtggaagcagcctgagacccttagcagaagcagatgctgcaccatgattcttgtacattctgcagaacagtgagccaaataaacctctttattaatca

SEQ ID NO: 3636 - DNA, 3600 bp, Homo sapiens
acttccggtctccggggtcgacgacatagcgggtcgtatttttatccaaaagaaggacctggaggaggatgagagcgttactgctgcacacctaaagtcaagggggagaagcccgaggaagattgaccagttttgtaattctagcaacatggtccatggatcagtgacattcagggatgtggccattgacttctctcaggaggagtgggagtgcctgcagcctgatcagaggaccttgtacagggatgtgatgttggagaactacagccacctgatctcactggcaggaagttccatttctaaaccagatgtaattacgttactagagcaagagaaagagccctggatggttgtaaggaaagaaacaagcagacggtatccagatttggagttaaaatatggacctgagaaagtatctccagaaaatgatacctctgaagtaaatttacccaaacaggttataaagcaaataagtacaactcttggcattgaggccttttattttagaaatgactcagaatatagacaatttgagggactacagggatatcaagaaggaaatatcaatcaaaagatgatcagctatgaaaaactgcctactcatactcctcatgcttctcttatttgcaatacacataaaccgtatgaatgtaaggaatgtgggaaatactttagtcgtagtgcaaatcttattcagcatcagagtattcatactggagagaaaccctttgaatgtaaggagtgtgggaaagcctttcgacttcacatacaatttactcgacatcagaaatttcatactggtgagaaaccttttgaatgtaacgaatgtggaaaggcctttagtcttcttaccctgcttaatcgccataagaacattcacacaggtgagaaactgtttgaatgtaaggaatgtgggaagtcctttaatcgtagctcaaaccttgttcaacatcagagtattcattctggtgtaaaaccatatgaatgtaaggagtgtgggaaaggctttaatcgtggtgcacaccttattcagcatcagaaaattcattccaatgagaaaccctttgtatgtaaggaatgtgggatggcctttcgatatcattaccaacttattgaacattgccaaattcatactggtgagaaaccctttgaatgtaaagaatgtggaaaggcgtttactcttctgacaaagcttgttcgacatcagaagattcatactggtgagaaaccctttgaatgcagggaatgtgggaaggcctttagtcttctcaaccagcttaatcgccataagaacattcacacaggtgaaaaaccgtttgaatgtaaggaatgtgggaagtcctttaatcgtagctcaaaccttgttcaacatcagagtattcatgctggtataaaaccatatgaatgtaaggagtgtgggaaaggctttaatcgtggtgcacaccttattcagcatcagaaaattcattccaatgagaaaccttttgtatgtagggaatgtgagatggcctttagatatcattgccaacttattgaacattctcgaattcatactggtgacaagccatttgaatgtcaagactgtgggaaggccttcaatcgtggctcaagccttgttcaacatcagagtattcacactggtgagaagccctatgaatgtaaggagtgtgggaaggcttttagactttacctacaactttcccaacatcagaaaactcacacaggtgaaaaaccatttgaatgtaaggaatgtgggaaattctttcgtcgtggttcaaatcttaatcaacatcgaagtattcatactggaaagaaaccctttgaatgtaaggaatgtgggaaagcctttcgacttcatatgcaccttattcgacatcagaaattgcatactggtgagaaaccctttgaatgtaaggagtgtgggaaagcctttcgacttcatatgcaacttattcgacatcagaaattgcatactggtgagaaaccctttgaatgtaaggaatgtggaaaggtttttagtcttcccacccagcttaatcgccataagaacattcacacaggtgagaaggcatcttgaatgtaaggaatgtggaaagtcctttaatcgtgtctcaaaccatgttcaacatcagagtattcgtgctggtgtaaaaccatgtgaatgtaaggggtgtgggaaaggcttcatttgtggttcaaacgttattcagcatcagaaaattcattccagtgagaaactctttgtatgcaaggagtggaggacgacctttagatatcattaccacttatttaacattaccaaattcacactggtaaaaaaccctttgaatgtaaagaatgtggaaaggccttcagttttctgacacagcttgctggacttcaggtcattcatactggcgagaagccatttgaatttgagaaatgtgggaaggccttcaatagtggctcaaaccttgttcaacatcagagtattcatactggtgagaaactctatgaatgtaaggagtgtgggaaaactttcagatttagtttggtcctgactgcacatcaaagaattcatactggtatgaaaccctgtgaatgtacagaatgtgggaagacctttagttgtagctcaaacattgttcaacatgttaaaattcatactggtgagaaacgctataatgtaaggaatatgggaaagcatttgctgtggatgatcagctgtctcaacatcagaaaattcagaatagttagaaattttgtgacaataaggagtgtggacaagccttcactgtgtacgaaaaatttactcaacaccagagagctcatattgatgagaaatcttgtgaacataaaagaatgtgtgaagaactttcatcatggcctgggatttgctcaacttctgagtattcatacttctgagaaatctttgagtgtaaggaatgtggggcgttttatagccacactaaataccttagagttcggagaagataattcttgtgagaaagtctttgaatgaggaatatagggtagttgtcatgttcacaatgtactccctatgaaataatttaccagatacaggcatacctcgctgaattgtgcattgcagttattgtgttttatacaaactgaaggtttgtggcaaccctgtggtgagcaagacgatcaggtccattttcccaacgtcaggtgtgcatttcatgtctttatgtcacattttggtaattctcagaatatttcaaactatttcattgttatatatctatcatggtgatcaatgaccagtgatttttgatgttgctattgtaattgctttgggataccacaaattctgcccataaaagatggtaaacctagttgatacttgttgtgggttttgaaagaatagtcaaatatacaatcatataccccaacctagattcaaaattgttaacaatttgcacgtttattttttgtatatttgttgtaccattgagaataagttttagacatcatgacactttaccctttatttaatcaacgtgtgtatcaaccaaacatgaagacaatatagacaatatcatatagccattgtaccataattaccgttaaggaaagtattcataattctgtaatatc

SEQ ID NO: 3637 - DNA, 3674 bp, Homo sapiens
aaggtcttcacgtctgaggaagagatctgtggctgcgggagatctctgcggattggggctccagcctgactgacccgacagtgcgggtggcctagggggaggcgctcagatcgtatttttatccaaaagaaggacctggaggaggatgagagcgttactgctgcacacctaaagtcaagggggagaagcccgaggaagattgaccagttttgtaattctagcaacatggtccatggatcagtgacattcagggatgtggccattgacttctctcaggaggagtgggagtgcctgcagcctgatcagaggaccttgtacagggatgtgatgttggagaactacagccacctgatctcactgggaagttccatttctaaaccagatgtaattacgttactagagcaagagaaagagccctggatggttgtaaggaaagaaacaagcagacggtatccagatttggagttaaaatatggacctgagaaagtatctccagaaaatgatacctctgaagtaaatttacccaaacaggttataaagcaaataagtacaactcttggcattgaggccttttattttagaaatgactcagaatatagacaatttgagggactacagggatatcaagaaggaaatatcaatcaaaagatgatcagctatgaaaaactgcctactcatactcctcatgcttctcttatttgcaatacacataaaccgtatgaatgtaaggaatgtgggaaatactttagtcgtagtgcaaatcttattcagcatcagagtattcatactggagagaaaccctttgaatgtaaggagtgtgggaaagcctttcgacttcacatacaatttactcgacatcagaaatttcatactggtgagaaaccttttgaatgtaacgaatgtggaaaggcctttagtcttcttaccctgcttaatcgccataagaacattcacacaggtgagaaactgtttgaatgtaaggaatgtgggaagtcctttaatcgtagctcaaaccttgttcaacatcagagtattcattctggtgtaaaaccatatgaatgtaaggagtgtgggaaaggctttaatcgtggtgcacaccttattcagcatcagaaaattcattccaatgagaaaccctttgtatgtaaggaatgtgggatggcctttcgatatcattaccaacttattgaacattgccaaattcatactggtgagaaaccctttgaatgtaaagaatgtggaaaggcgtttactcttctgacaaagcttgttcgacatcagaagattcatactggtgagaaaccctttgaatgcagggaatgtgggaaggcctttagtcttctcaaccagcttaatcgccataagaacattcacacaggtgaaaaaccgtttgaatgtaaggaatgtgggaagtcctttaatcgtagctcaaaccttgttcaacatcagagtattcatgctggtataaaaccatatgaatgtaaggagtgtgggaaaggctttaatcgtggtgcacaccttattcagcatcagaaaattcattccaatgagaaaccttttgtatgtagggaatgtgagatggcctttagatatcattgccaacttattgaacattctcgaattcatactggtgacaagccatttgaatgtcaagactgtgggaaggccttcaatcgtggctcaagccttgttcaacatcagagtattcacactggtgagaagccctatgaatgtaaggagtgtgggaaggcttttagactttacctacaactttcccaacatcagaaaactcacacaggtgaaaaaccatttgaatgtaaggaatgtgggaaattctttcgtcgtggttcaaatcttaatcaacatcgaagtattcatactggaaagaaaccctttgaatgtaaggaatgtgggaaagcctttcgacttcatatgcaccttattcgacatcagaaattgcatactggtgagaaaccctttgaatgtaaggagtgtgggaaagcctttcgacttcatatgcaacttattcgacatcagaaattgcatactggtgagaaaccctttgaatgtaaggaatgtggaaaggtttttagtcttcccacccagcttaatcgccataagaacattcacacaggtgagaaggcatcttgaatgtaaggaatgtggaaagtcctttaatcgtgtctcaaaccatgttcaacatcagagtattcgtgctggtgtaaaaccatgtgaatgtaaggggtgtgggaaaggcttcatttgtggttcaaacgttattcagcatcagaaaattcattccagtgagaaactctttgtatgcaaggagtggaggacgacctttagatatcattaccacttatttaacattaccaaattcacactggtaaaaaaccctttgaatgtaaagaatgtggaaaggccttcagttttctgacacagcttgctggacttcaggtcattcatactggcgagaagccatttgaatttgagaaatgtgggaaggccttcaatagtggctcaaaccttgttcaacatcagagtattcatactggtgagaaactctatgaatgtaaggagtgtgggaaaactttcagatttagtttggtcctgactgcacatcaaagaattcatactggtatgaaaccctgtgaatgtacagaatgtgggaagacctttagttgtagctcaaacattgttcaacatgttaaaattcatactggtgagaaacgctataatgtaaggaatatgggaaagcatttgctgtggatgatcagctgtctcaacatcagaaaattcagaatagttagaaattttgtgacaataaggagtgtggacaagccttcactgtgtacgaaaaatttactcaacaccagagagctcatattgatgagaaatcttgtgaacataaaagaatgtgtgaagaactttcatcatggcctgggatttgctcaacttctgagtattcatacttctgagaaatctttgagtgtaaggaatgtggggcgttttatagccacactaaataccttagagttcggagaagataattcttgtgagaaagtctttgaatgaggaatatagggtagttgtcatgttcacaatgtactccctatgaaataatttaccagatacaggcatacctcgctgaattgtgcattgcagttattgtgttttatacaaactgaaggtttgtggcaaccctgtggtgagcaagacgatcaggtccattttcccaacgtcaggtgtgcatttcatgtctttatgtcacattttggtaattctcagaatatttcaaactatttcattgttatatatctatcatggtgatcaatgaccagtgatttttgatgttgctattgtaattgctttgggataccacaaattctgcccataaaagatggtaaacctagttgatacttgttgtgggttttgaaagaatagtcaaatatacaatcatataccccaacctagattcaaaattgttaacaatttgcacgtttattttttgtatatttgttgtaccattgagaataagttttagacatcatgacactttaccctttatttaatcaacgtgtgtatcaaccaaacatgaagacaatatagacaatatcatatagccattgtaccataattaccgttaaggaaagtattcataattctgtaatatc

SEQ ID NO: 3638 - DNA, 3538 bp, Homo sapiens
gttgacgacctagctgggtaaggtcttcacgtcctaggaagaaatcggtggctgcgggaggtcttcgtggactgggactcgaacctgaccgacccggcagtgcgggggagaagcccgaggaagattgaccaattttgtaattctagaaacatggtccatggagtgcatctcgttatgttgcccaggctgtttgccaactcctgggctcaagcagtccttccaccttggtctcccaaagtgctggtataacaggcatgagccaccacaccaggccagcagcaggattcttgaagaatgtggatcagtgacattcagggatgtggccattgacttctctcaggaggagtgggagtgcctgcagcctgatcagaggaccttgtacagggatgtgatgttggagaactacagccacctgatatcactgggaagttccatttctaagccagatgtgattacattactagagcaagagaaagagccctggattgttatttggagtcaaaatatggacctgagaaaatatctccagaaaatgatatttttgaaataaatttacccaaacatgttataaagcaaataagtaaaacacttggcctcgaggccttttattttagaaatgactcagaatatagaagtagatttgagggacgacagggacatcaagaaggatatatcaaccagaagatcatcagctatgaagaaatgcctgcttatactcatgcttctcctattcataatacacataaaccatatgaatgtaaggaatgtgggaaatactttagttgtggttcaaatcttattcagcatcagagtattcatactggagagaaaccctataaatgcaaagaatgtgggaaagcctttcaacttcacatacaacttactcgacatcagaaatttcatactggtgagaaaacttttgaatgtaaggaatgtggaaaagcctttaatcttcccacccagcttaatcgccataagaacattcacacagttaagaaactgtttgaatgtaaggaatgtgggaagtcttttaatcgtagctcaaaccttactcagcatcaaagtattcatgctggtgtaaaaccatatcaatgtaaggagtgtgggaaagcctttaatcgtggttcaaatcttattcagcatcaaaaaattcattccaatgagaaaccctttgtatgtagggaatgtgagatggcctttcgatatcattaccaactcattgaacattgccgaattcatactggcgagaaaccctttgaatgtaaagaatgcagaaaggcctttactcttctgacaaagcttgttcgacatcagaagattcatatgggtgagaagccctttgaatgcagggaatgcgggaaggcctttagtctcctcaatcagcttaatcgccataagaatattcacacaggtgaaaaaccatttgaatgtaaagaatgtgggaagtcctttaatcgtagttcaaaccttattcaacaccagagtattcatgctgatgtaaaaccatatgaatgtaaggagtgtgggaaaggctttaatcgtggtgcaaatcttattcagcatcaaaaaattcattccaatgagaaaccctttgtatgtagggaatgtgagatggcctttcgatatcattaccaacttattcaacattgccaaattcatactggtgggaaaccctttgaatgtaaagaatgtggaaaggcctttagtcttctgacacagcttgctcgacataagaacattcatactggtgagaaaccatttgaatgtaaagactgtgggaaggccttcaatcgtggctcgaaccttgttcaacatcagagtattcacactggtgagaagccctatgaatgtaaggagtgtgggaaggcttttagacttcacctacaactttctcaacatgagaaaactcatacaggtgagaaaccctttgaatgtaaggaatgtgggaaattctttcgtcgtggttcaaatcttaatcaacatcgaagtattcataccggaaagaaaccctttgaatgtaaggaatgtgggaaagcctttcgacttcatatgcaccttattcgacatcagaaatttcatactggtgagaagccctttgaatgtaaggaatgtggcaaggccttcagtcttcacacccagcttaatcaccataagaacattcacacaggtgagaagccatttaaatgtaaagaatgtgggaagtcctttaatcgtgtctcaaaccttgttcaacatcagagtattcatgctggtgtaaaaccatatgaatgtaaggagtgtgggaaaggctttagtcgtgtttcaaaccttattcagcatcagaaaactcattccagtgcgaaaccctttgtatgtaaggagtgtaggaagacctttagatatcattaccagcttactgaacattaccgaattcatactggtgagaaaccctttgaatgtaaagaatgcggaaaggcctttggtcttctgacacagcttgctcaacatcagatcattcatactggtgagaagccatttaaatgtaaggagtgtgggaaggcctttaatcgtggctcaaaccttgttcaacctcagagtattcatactggtgagaaaccctatgaatgtaaggagtgtgggaaggcttttagacttcacctacaactttctctgcatcaaaaacttgtacaggtgagaaaccctttgaatgtaagaaatgtgggacagccttcagacatcagtagcaacttactgaacatcagaaaattcatacttgggtgaaaacctttgaatgtaaggaatgtgggaaggcctttcaatatcattaccaatttcatggacattatagatttcatattcgtgagaacccttatgaatgtcaaggatgtgggaaatgctttaccagtggtagaaaccttagagtacatcagagaattcatactggtgagaaaccatatcaatgtgaagaatgtgggaaagcctttagtcatagttcaaacctgttaaacatgttaaaattcatactgatgagaaaccctatgaatgtaaggaatgtgaaaaggcctttagcagtaattatgatcttactgtacatctgagaatccgtactgctgagaaaccctgtgagtgtaaagaatgtggaaaacttttggatttagcttagtctttactgcacatcaaagaattcatactggtatgaaccgtatgaatgtaaagaatgtggaaagacctttacttgtagctcgagccttgttcaacatgttaaaattcatactggtgagcaaccctgtgaatgtaaaggatgtgggaagacctttagacttagttcagtcctttctgcacatcacagaattcatactggcatgaaaccctatgaatgtaaagaatgtgagcaaacccttactgtgaatgatctgcttacgcaacatcagaaaattcattatagttagaagttttatgaatataaggagtgtagacaagccttcactgtgtatgaaaaatttactcaacaccagagaattcatattgatgagaaatcctgtgaacataaaagaatgtg

SEQ ID NO: 3639 - DNA, 8665 bp, Homo sapiens
tggggttgacgacctagctgggggagaagcccgaggaagattgaccaattttgtaattctagaaacatggtccatggatcagtgacattcagggatgtggccattgacttctctcaggaggagtgggagtgcctgcagcctgatcagaggaccttgtacagggatgtgatgttggagaactacagccacctgatatcactgggaagttccatttctaagccagatgtgattacattactagagcaagagaaagagccctggattgttgtaagtaaagaaacaagcagatggtatccagatttggagtcaaaatatggacctgagaaaatatctccagaaaatgatatttttgaaataaatttacccaaacatgttataaagcaaataagtaaaacacttggcctcgaggccttttattttagaaatgactcagaatatagaagtagatttgagggacgacagggacatcaagaaggatatatcaaccagaagatcatcagctatgaagaaatgcctgcttatactcatgcttctcctattcataatacacataaaccatatgaatgtaaggaatgtgggaaatactttagttgtggttcaaatcttattcagcatcagagtattcatactggagagaaaccctataaatgcaaagaatgtgggaaagcctttcaacttcacatacaacttactcgacatcagaaatttcatactggtgagaaaacttttgaatgtaaggaatgtggaaaagcctttaatcttcccacccagcttaatcgccataagaacattcacacagttaagaaactgtttgaatgtaaggaatgtgggaagtcttttaatcgtagctcaaaccttactcagcatcaaagtattcatgctggtgtaaaaccatatcaatgtaaggagtgtgggaaagcctttaatcgtggttcaaatcttattcagcatcaaaaaattcattccaatgagaaaccctttgtatgtagggaatgtgagatggcctttcgatatcattaccaactcattgaacattgccgaattcatactggcgagaaaccctttgaatgtaaagaatgcagaaaggcctttactcttctgacaaagcttgttcgacatcagaagattcatatgggtgagaagccctttgaatgcagggaatgcgggaaggcctttagtctcctcaatcagcttaatcgccataagaatattcacacaggtgaaaaaccatttgaatgtaaagaatgtgggaagtcctttaatcgtagttcaaaccttattcaacaccagagtattcatgctgatgtaaaaccatatgaatgtaaggagtgtgggaaaggctttaatcgtggtgcaaatcttattcagcatcaaaaaattcattccaatgagaaaccctttgtatgtagggaatgtgagatggcctttcgatatcattaccaacttattcaacattgccaaattcatactggtgggaaaccctttgaatgtaaagaatgtggaaaggcctttagtcttctgacacagcttgctcgacataagaacattcatactggtgagaaaccatttgaatgtaaagactgtgggaaggccttcaatcgtggctcgaaccttgttcaacatcagagtattcacactggtgagaagccctatgaatgtaaggagtgtgggaaggcttttagacttcacctacaactttctcaacatgagaaaactcatacaggtgagaaaccctttgaatgtaaggaatgtgggaaattctttcgtcgtggttcaaatcttaatcaacatcgaagtattcataccggaaagaaaccctttgaatgtaaggaatgtgggaaagcctttcgacttcatatgcaccttattcgacatcagaaatttcatactggtgagaagccctttgaatgtaaggaatgtggcaaggccttcagtcttcacacccagcttaatcaccataagaacattcacacaggtgagaagccatttaaatgtaaagaatgtgggaagtcctttaatcgtgtctcaaaccttgttcaacatcagagtattcatgctggtgtaaaaccatatgaatgtaaggagtgtgggaaaggctttagtcgtgtttcaaaccttattcagcatcagaaaactcattccagtgcgaaaccctttgtatgtaaggagtgtaggaagacctttagatatcattaccagcttactgaacattaccgaattcatactggtgagaaaccctttgaatgtaaagaatgcggaaaggcctttggtcttctgacacagcttgctcaacatcagatcattcatactggtgagaagccatttaaatgtaaggagtgtgggaaggcctttaatcgtggctcaaaccttgttcaacctcagagtattcatactggtgagaaaccctatgaatgtaaggagtgtgggaaggcttttagacttcacctacaactttctctgcatcaaaaacttgtacaggtgagaaaccctttgaatgtaagaaatgtgggacagccttcagacatcagtagcaacttactgaacatcagaaaattcatacttgggtgaaaacctttgaatgtaaggaatgtgggaaggcctttcaatatcattaccaatttcatggacattatagatttcatattcgtgagaacccttatgaatgtcaaggatgtgggaaatgctttaccagtggtagaaaccttagagtacatcagagaattcatactggtgagaaaccatatcaatgtgaagaatgtgggaaagcctttagtcatagttcaaacctgttaaacatgttaaaattcatactgatgagaaaccctatgaatgtaaggaatgtgaaaaggcctttagcagtaattatgatcttactgtacatctgagaatccgtactgctgagaaaccctgtgagtgtaaagaatgtggaaaacttttggatttagcttagtctttactgcacatcaaagaattcatactggtatgaaccgtatgaatgtaaagaatgtggaaagacctttacttgtagctcgagccttgttcaacatgttaaaattcatactggtgagcaaccctgtgaatgtaaaggatgtgggaagacctttagacttagttcagtcctttctgcacatcacagaattcatactggcatgaaaccctatgaatgtaaagaatgtgagcaaacccttactgtgaatgatctgcttacgcaacatcagaaaattcattatagttagaagttttatgaatataaggagtgtagacaagccttcactgtgtatgaaaaatttactcaacaccagagaattcatattgatgagaaatcctgtgaacataaaagaatgtgtgaagaactttcatcgtggcctgggatttgctcaacatcagagtattcatactgctgagaactcctttgagtgtaaagaatgtgggatattttatagccacactaaatgccttagagttcagagaagataattttggtgagaaagttactgatgtgaggaatgtagagtagctgccatgttcacagtttactgcccgtgaaatattttactggatacaggcgtaccttgcttaattgtgcattgcagttactgcattttatacacactgaaggtttgcagcaaccttgcagtgaataagtctatcagcaccattttccaaacagcatatgcacatttcatgtctttgtgtcacactttgctagttttcataatatttcaaactttttcattgttaaatctgttatggtgatctgtgaccagtgttttttgattactagtgtaattgttactagtgtaattgtttggggataccacaaatcctgcccataaaagatggtgaacctagttgataattgttgtgggttttgaaagaatagtaaaatatatacacatatcccccccacctagattcaaaattgttaacaatttgccacatttattttttgtatatttgttgtaccattgagaataagttttagaccattgagaataagttttagatatcatgacactttactccttgttacatcagcatgtgtgttacccaaacataaagacaatatcatataaccatagtaccataattacccttaaggaaaatattcataattctgtaatatcattccatcttcagatttcttccttggcctgcaaaccatcttttacagctattcattttctctttttttttttttttttttgagatggagtctcgctctgtcgcccagactggagtgcagtggtgcgatctgggctcactgcaagctctgcctcctgggttcacgccattctcccgcctcagcctcctgagtagctgggactagaggcacccgccaccatgcccagctaattttttgtatttttagtagagacagggtttcactctgttagccaggatggtctcgatctcctgacctcgtgatccacccgccttggcctcccaaagtgctgggattacaggcatgagccagcatgcctggcctacagctattcattttctaaggagagtccattgcagattctgcattgcatttggttatctctctttagtgtattgtagcatggaaaccccatgaaagtatgctctcaaattatggtgggtatcagaatcccctgtggaacttagtaaacctacagaagtgtagccctagtttataagcctgggcctctgttttttattatttctccaggttttgtgtctgtgataccaaccagagttagagagccactggtctagaacatttctcattttaaaaaaatgacattgaattttgagtagcccagaaatgttgttggctatgtgtttagatttctttctttatagtgtcatttagccttgttcttggttgtattttctttacaagggaaagtaagtccagaggctttcttaggtctagattaaacgttttggggaagaatactttgtaggttatttctatgtcatattgtactgtcagaaaacatttaagtacaggtccttgcattagtgaaactaaggatgatcatttgggtaagctggtaaccgccgtaagtccattgtaaagatttagtttgtagtgggtaagtaatctatggagagacgttgtcatctctgaaaagttatagtcacgtgtacttaagccctggattgaatacaaaatgaaaattgaaatagactattgagaaatgaatgccattaaagcgtcaacataattcaacttgtgtgatatggctgacactgtactcagtacaaaactggcaccctttggattgtatagggagccaagattgtccggaacctcttttttgttcagcatttatcaccagcacctataccatggctggtacatgagctgttgataaaaatttgaaaaaatattaaccctttaaatcaagctgtaaaacatgataccattaagccgggagcagtggcctcatgcctgtaatcccagcactttgggaggccaaggtgggcagatcacctgaggtcaggagtttgagaccaacttggccaacatggcaaaactccatctctcctaaaaataaaaaaattagctggacatggtggtgcattcctgtaatcccagctacttgggaggctgaggcaggagaatcactcgaaattggaaggtggaggtggcagtgagccaagatcgtgccactgcactccagcctgggcgacaaagtgagacttcatctcaaaaaaaccccaaaacaaaacatgataccgatgtggcatcatgaattagattaaattttttttaagattaagaataatcctttgtgattttattccattgtgttgaaaaatctataaagtgataatttatattgatagctttcttctttttatgaatataccctggtcagatgattattctttcaatagactacttaattctatcttttaccatttaattgcatctataatcataagtaaagttataattttccaagtatttttcaggtattgatattgcaatgatgttatacaacttataaaacaagattatataaaacttggctttcaaatcttatgttcctattttttatttccagtttcatcttttttctatccattctcttgaactttcttctttgaaatcagcagagtccctgggtattaacctagcacaactcctttctgggtcattgcacatcccggtagtatcattaagagttgtcagaaagatccctggcagcctttcggtgaaactctatcatcatgcaatcatggcagtactatgttggaagtcagagtccctttgcaaacataataaaacactttaatatatttgttaaagttacaaaccaagtatgtacaaatttaaaaatcacggccaggcacggtggctcacgcctgtaatccccaacttaaaatggtttgacttataattttcagctttataatagtacaaaagtgatatgctgctatagtttggatatttatcccctccaaatctcatattgaagtttgatcccaatgttggaggtggggcctaatgggaggtgtgtgggtcatgggagaagatccctcatgaataaattaatgtcctctctggattggggggtgaattatcactctgttagttcctatgagagctggttgtacaaaagagcctggcacctccttcctcaccctcttgcttcctctcttgccatgtgatgtctgcatacactgccccctttcatctgccatgagtggaagcagcctgaggcccttaccagaagcagatgttgcaccatgattcttgtaaatcctacagaacactgagccaaataaacctctttctttattaataacccaacctcagacattcctttatagcaacacaaaactaagacatactcagtcagagtatgctccttgacttaaaatggggctatatctagataaacccattgttaaattgaaaatattgtagaccataaatgcacatatggtgtatgatgttttcaatttatgatgggtttatttggacataactccccgtaagttgagaagcacctgtagtaattattattatttatgctcaaattgacataatgtggccagtaggaatccatttacattttttttttactacttatttttttcttttgatgttttaaaggaatattgttttcaggccgtaagaggatgtttaagactgaccctgtttgttggttcatgtcccccatgcctcttgtcctgagtcatggaatcaactcatgatttaataccctcttatcttagggagtcctggttccttttagaggaaaaaagaattagagaccaaaaaatctggctgctgtgagtgcacatggcagttacaggtatggaaaaaaagatgctgcttttgttagaattcttttaatagtttcagagttgaaaatgtcatcctaaggtcagaagttccctctgaattttctcaacttacatttctatgatctgctcttgtttgcatttggtattttattgaattatgttttatgtatggtgatagctgagaagtttatctccttttaaggcctggctgaaatgatacattaatctgcctcccatttttggagatattgctctgatttaaatttgtcatggtgtttctgagcagcgttgtaaagaaacttgttttagaatattcagtcatggatgttatcttgaatgttcatagactccccagaaaagaagaaaaagtagacacaagatttctgtcatccttttacagggtattgtgatcatccagcttggggtatgagggataacggacctgtgtgtcttaatttccagaataccattccatttcaatgagtcttctgcacaagttgtggtctcagggattcactgtcttcatttgtaattgatcaaaatgaaaccatctccaggattcctcagtgggtcaggatctgttatttattaggcccgcatatccattctaccctgctttcatgattatagaaccagtaatttttattgatagttggctgtgactatctagaataaggactgcagttatttctccaaggtgttgtcatgtgacataacttatggcaagtaggatgtaagtgaatattttggcaattctggaaacctcttaaaacaaactagcttaatatattaatatttgagaaatctgggtgaagggtaaccagaattatttactattcttccaagttctgtataagtctgagtgctcattccattctgatgccagaatggtaaaattcatgattggtttagagcaaggccacagtatcaggcttacatccatattatatgacagagaaattaacttttattatattttatccactttaatttggggcagttttactattttactcacaaccaaatttaatcttaaacgctacaactagattgtcacatgtaaaaagtaataaccatcattatatcttttatgttctgtaattccaaagcacggatctgtagagaacagagtgtctatcccatgcatgttgtcatgtacttatcccacaccctattgaaatcacagtacccataagggagacattttttttcttcaagaatatgtatttctgccacatctatgattctccagaatgagatgacagaaaatgctaaactattgttaaatgactatatgtagttccacttctggatggtagatgggggggctctgcaaactcattttctaataaaactggcaaaaaaaaatgta

SEQ ID NO: 3640 - DNA, 932 bp, Homo sapiens
ccgccccctgtgtcagtggatgcgaccgggcgggccctcggccttcccggccgctggagagggacttcggccgctggctcccggggcggctgaggctgagcgttggtccggagcaggtgccgggtgcgggccgcggtgtgcgggaccggagcccggcgcgagcggcggcgggggtggggaaagcgcatttgtaacgcgggcgacaacgtgcccgaaatccccggacggtgggtctgcatcgagaccccgagctctggagctggaaaaacccggctgaggctttacagttctctatactctcccaagagccacagaaaatgaacacatttcaggcatcagtgtcattccaggacgtgactgtggaattcagccaggaggagtggcagcacatgggccctgttgagaggaccctgtacagagatgtgatgctggagaactacagccacctcgtctcagtgggctactgctttacaaaaccagaactgatcttcacattggaacaaggagaagatccatggttattagagaaagagaaaggatttctaagcaggaactccccagaagactcccaacctgatgaaatctcagagaagagcccagaaaatcaaggcaaacatttgttgcaagttttattcaccaataaattattgactacagagcaagaaatttcaggaaaaccacataatcgagacataaacatttttcgtgcaagaatgatgccttgtaaatgtgacattgcggggtctgcttgccaggggctcagcctgatggccccacactgtcagtattcaaaagaaaaggctcatgagcgtaatgtttgtgacaaatggctcatcagtattaaggatggcagaactaacactcaagagaaatctttcgcttatagtaaaattgtgaaaaccctccatcataaggaggaagttattcaacat

SEQ ID NO: 3641 - DNA, 4213 bp, Homo sapiens
tcgagactcccgggaagcggtttgggaagctcgggggtcggctcggaaagtagagggggcgcagctggggcgggaggacagcgtttgtgcccggaagcgggagaggaagcgggaagtttgtgggatccccgccccctgtgtcagtggatgcgaccgggcgggccctcggccttcccggccgctggagagggacttcggccgctggctcccggggcggctgaggctgagcgttggtccggagcaggtgccgggtgcgggccgcggtgtgcgggaccggagcccggcgcgagcggcggcgggggtggggaaagcgcatttgtaacgcgggcgacaacgtgcccgaaatccccggacggtgggtctgcatcgagaccccgagctctggagctggaaaaacccggatgccatactgctgttaacatatgtgacactggagactttgtccctacctcatagaatcccatgcatgatgatacatgaagggttttccgtggctatctacttctgattcttttgaaagctttaaagacattgggcatgaaaggttcagtgagtttccggggatccctcgtttgtggtagagccaggaggaaaacagttccgttcattctttcacagctgaggctttacagttctctatactctcccaagagccacagaaaatgaacacatttcaggcatcagtgtcattccaggacgtgactgtggaattcagccaggaggagtggcagcacatgggccctgttgagaggaccctgtacagagatgtgatgctggagaactacagccacctcgtctcagtgggctactgctttacaaaaccagaactgatcttcacattggaacaaggagaagatccatggttattagagaaagagaaaggatttctaagcaggaactccccagaagactcccaacctgatgaaatctcagagaagagcccagaaaatcaaggcaaacatttgttgcaagttttattcaccaataaattattgactacagagcaagaaatttcaggaaaaccacataatcgagacataaacatttttcgtgcaagaatgatgccttgtaaatgtgacattgcggggtctgcttgccaggggctcagcctgatggccccacactgtcagtattcaaaagaaaaggctcatgagcgtaatgtttgtgacaaatggctcatcagtattaaggatggcagaactaacactcaagagaaatctttcgcttatagtaaaattgtgaaaaccctccatcataaggaggaagttattcaacatcagacaattcagactctggggcaagattttgaatataatgaaagtagaaaagcttttcttgaaaaggctgcccttgttacatctaacagtacccacccaaaaggaaaatcttacaatttcaataaatttggggaaaacaaatatgataaatcaacctttattattcctcagaacatgaatccagagaagagtcactatgagtttaatgatactggaaattgtttctgtagaatcactcacaaaactctcacaggagggaaatccttcagccaaaagtcacacattagagaacatcatagagttcatataggggtgaaaccctttgaatatggaaaaagtttcaaccgtaattcaaccctcccagtgcatcagagaactcatgcaacagataaatactctgattatcacccatgtacagagacattcagctaccagtcaactttcagtgtacatcagaaggttcacataagggcaaaaccctatgagtataatgaatgtgggaaatcctgctctatgaattcacacttgatttggcctcagaaaagtcacacaggggagaaaccctatgaatgtcctgagtgcgggaaagccttcagtgagaagtcacgcctaagaaaacatcagagaactcacacgggagagaaaccatacaaatgtgatggatgtgataaagctttcagtgcaaagtcaggcctaagaatacaccagagaacccacacaggggagaaaccattcgaatgtcatgaatgtgggaaatcttttaactataagtcaatcctcatagtgcatcagagaactcacacaggggagaaaccttttgaatgtaatgaatgcgggaaatctttcagccatatgtcaggcctaaggaatcaccgaagaactcacacaggggaaagaccatataaatgtgatgaatgtgggaaagctttcaaactgaagtcaggcctgaggaaacatcatagaacacacacaggggagaagccctacaaatgtaatcagtgtggaaaagctttcggtcagaaatcacaactcagaggacatcatagaattcacacaggggaaaaaccctataaatgtaatcattgtggggaagctttcagtcagaaatcaaacctcagagtacatcacagaactcatactggggagaaaccctatcaatgtgaggagtgtggaaaaacattcaggcagaaatcaaatctcagagggcatcagagaactcacactggggagaagccctatgaatgtaatgaatgtggaaaagctttcagtgagaagtcagtcctaagaaaacatcagcgaactcacaccggggagaaaccatataattgtaatcagtgtggggaagctttcagtcagaaatccaatctcagagtacatcagagaactcacacaggggagaaaccctataaatgtgataaatgtgggagaactttcagtcaaaaatcaagccttagagaacatcagaaagcccacccaggggattaaatgtatgcatataaagaatacgaaaaaactctgagctggaaatcaaacctcacaatacataaatgaacacacaggagagaactgttaacatagtgagcactggaatttcctctacaatttcagcctccaccaaatatcaaagaatagaagataaattgttgaaatctattttatatgggcattctttcagccagagcccagtcttctatggatatacagaactcacacagcaaagaaaccctataaacataatgaatatggaaaatactcttgcgaactcactcctcagaaaactcacgctgcagaaaagctctgagaaagtaataaaaatgtgaaaactttgtgccaacaatcaaaactcattcaccatcagagaaatcacacaatgacaaaagctagaatataataagtgtgtgataaactttaatgaaaagtcagtacagcagaaaatacattcaagatagagacctcatagtatattaaaacaaacaagaaatgaagttaatggatgtgggaaattcttctgccatgtcaaccctcattttaacctacacagaggtaatccctatatgtcgtataataactattgaaatgttcactagtaatcattttcacttctccctcatgccacacctggcctaaatttctcaaccactctctcatctaaacggggtcatattgttaccctctagctagtggaatatggggtcagtgacaggtcttaaatacatcagtcaaattctcaatattttcttctatccctcattagaatggaatggaggaaaaccttgggactcaggctctgatgatggaaagtacaagatggtaggaacccgggtcagagaaggatcctgtggcatggagttttctcctccctgtacacagttggacttcttgcagtgaggaaataaatgtgttccctgctgaacttctaaaggtttgggtatacttgatactgacagaaactcaacaaccctcacataataaaacttaggagtatgatttttcaggacatctgaactcagtgtatgtcagaaaagtcacataggacaaatctcggacagcatcctgaatgaccatggcttttatccccaaagtcttcctcatcagacaggtaatatcataagaaatctgacattttaacaaatataggaaattcttcacacacacagacacacactcacacatacacacccaaagtctcattaaatatatgataatttagttttgaatgtgtaaaagttttcaacaaattatcatattttatatcagagcttgttacaaggagaaaatctatcaatttgagaaaggtaagtaatagcctttatctagatattgctttatcagaactgttgtttcacatataatatcaaaacttttaatgaaatataagacattcactataataaaaagcttaaaaagaacaaaaaataaactgcataaactgaaaa

SEQ ID NO: 3642 - DNA, 2355 bp, Homo sapiens
gtttataaacgttgaccaaagtgccagaactcgtgggcgctgtgtctgtggcaagaccccgagctgtggagaccgaaagagctgcataaattccagctttattacctgctactgctttacaaaaccagaactgatcttcacattggaacaaggagaagatccatggttattagagaaagagaaaggatttctaagcaggaactccccagaagactcccaacctgatgaaatctcagagaagagcccagaaaatcaaggcaaacatttgttgcaagttttattcaccaataaattattgactacagagcaagaaatttcaggaaaaccacataatcgagacataaacatttttcgtgcaagaatgatgccttgtaaatgtgacattgcggggtctgcttgccaggggctcagcctgatggccccacactgtcagtattcaaaagaaaaggctcatgagcgtaatgtttgtgacaaatggctcatcagtattaaggatggcagaactaacactcaagagaaatctttcgcttatagtaaaattgtgaaaaccctccatcataaggaggaagttattcaacatcagacaattcagactctggggcaagattttgaatataatgaaagtagaaaagcttttcttgaaaaggctgcccttgttacatctaacagtacccacccaaaaggaaaatcttacaatttcaataaatttggggaaaacaaatatgataaatcaacctttattattcctcagaacatgaatccagagaagagtcactatgagtttaatgatactggaaattgtttctgtagaatcactcacaaaactctcacaggagggaaatccttcagccaaaagtcacacattagagaacatcatagagttcatataggggtgaaaccctttgaatatggaaaaagtttcaaccgtaattcaaccctcccagtgcatcagagaactcatgcaacagataaatactctgattatcacccatgtacagagacattcagctaccagtcaactttcagtgtacatcagaaggttcacataagggcaaaaccctatgagtataatgaatgtgggaaatcctgctctatgaattcacacttgatttggcctcagaaaagtcacacaggggagaaaccctatgaatgtcctgagtgcgggaaagccttcagtgagaagtcacgcctaagaaaacatcagagaactcacacgggagagaaaccatacaaatgtgatggatgtgataaagctttcagtgcaaagtcaggcctaagaatacaccagagaacccacacaggggagaaaccattcgaatgtcatgaatgtgggaaatcttttaactataagtcaatcctcatagtgcatcagagaactcacacaggggagaaaccttttgaatgtaatgaatgcgggaaatctttcagccatatgtcaggcctaaggaatcaccgaagaactcacacaggggaaagaccatataaatgtgatgaatgtgggaaagctttcaaactgaagtcaggcctgaggaaacatcatagaacacacacaggggagaagccctacaaatgtaatcagtgtggaaaagctttcggtcagaaatcacaactcagaggacatcatagaattcacacaggggaaaaaccctataaatgtaatcattgtggggaagctttcagtcagaaatcaaacctcagagtacatcacagaactcatactggggagaaaccctatcaatgtgaggagtgtggaaaaacattcaggcagaaatcaaatctcagagggcatcagagaactcacactggggagaagccctatgaatgtaatgaatgtggaaaagctttcagtgagaagtcagtcctaagaaaacatcagcgaactcacaccggggagaaaccatataattgtaatcagtgtggggaagctttcagtcagaaatccaatctcagagtacatcagagaactcacacaggggagaaaccctataaatgtgataaatgtgggagaactttcagtcaaaaatcaagccttagagaacatcagaaagcccacccaggggattaaatgtatgcatataaagaatacgaaaaaactctgagctggaaatcaaacctcacaatacataaatgaacacacaggagagaactgttaacatagtgagcactggaatttcctctacaatttcagcctccaccaaatatcaaagaatagaagataaattgttgaaatctattttatatgggcattctttcagccagagcccagtcttctatggatatacagaactcacacagcaaagaaaccctataaacataatgaatatggaaaatactcttgcgaactcactcctcaga

SEQ ID NO: 3643 - DNA, 1996 bp, Homo sapiens
ggcttgggcacaagatggccgctgcgcgcccagaggcccagagtcggagctcaccgactccggagtcgcgatcccaggagccactggacctggtcctggtgcctgatgactgccggcctggcacacccccgagtgacctcatcgagatccaggtggtgaaggtgacggacaccacgctggtccctgagcccccggagccaggttctttccactgtgccttgtgccctgctgccttccggctggtttccgagctgctgttccacgaacatggccacttggctggggccgagggaggcgggcagggtggggacccgagccggtgccacgtgtgcggccacagctgcccgggccccgccagcctgcgcgcgcactacagcttgcacacgggggagcggccctaccgctgcgcgctctgcccccgcgccttcaaggccttggcgcccctgctccggcaccagcaccggcacggggtggagccgggcacctctcggaggcctccggacacagcggccgttgcagaacagaggcccggggtggccccggagagggcggaggtggtgatggcggcggcggcggcgggcgcagcggtggggaagccttttgcctgcaggttctgcgccaagcccttccgccgctcctcagacatgcgagaccacgagcgcgtgcacactggcgagcggccataccattgcggcatctgcggcaagggcttcacccagtcctcggtgcttagcggccacgcccgcatccacactggcgagcgcccgttccgctgcacgctctgcgaccgcaccttcaacaactcctccaacttccgcaagcaccagcgcacccacttccacgggccggggccggggctgggagactctggaggccagctgggctcgtcggcggctgaggggtcggggagcgggtgtggggtaggggaccctgcggaggaggggcggggggagaccgcgaaggtgaaggtggaggccgaccagtaggctgcagaccagggacatgggttagttaaggcggaggtacgaggccgacccggggagggggacggggtggggaaacggaggcaggggacagaagaggggagattgggggagagatgacagctgcagggatggttgtgagccgctagtgatggagagcagagggagagggccaggctccagactcccacacgcccacacagcacctctgccaggcctaggagaggacaggtgcagctcttgcagctctgcgggtgtgcggccaaaggcaaggcccacgggctggatgtcacttccccgactgtctcttggttggcttgtccttgtgcaagacccagcctgtcacgacagagcctgggcacttcagaggaggagccaggatcgaatggaaggggggaattggggtccaccatagtcttctgctctggtcctccacgggtggaccaggatggagtctcctgcctacctcactgcattgcactggacctgggatgcctatccaccctctggcagaagacactcaccaggttatctgtgaagagactctgggatcccatcacctcaaagccagagggtccccaagtcaccgctgagagcacttgagcctcaaggatgtaagcctgaccataggatcttgactccaacagcggcaacccccacccccattgtggtccgtccttaacccatccactcttcttcggaggcaactgagaacacataaagcaagcagctacctagcatccccctcctaaagctttagactcagagcccagggtcccccacaagcctcaaggtagcctcaggtttctctaatttcctccactcccagttcgaagcaaacagcttactgcctagtccccgccaatcccaagggcgggctggctgatggcagcatggtgggctggcctgggtgtggagtgaaagagtcactgtggtgggggcgagaggaggacttgggagctggaggtgtgacaccttcagttctgttcctattaaaggaccttctgaagggc

SEQ ID NO: 3644 - DNA, 3282 bp, Homo sapiens
gtaaaggcagagaggaaaggcgaggggtgttgacgccaggaaggttccatcttggttaagggcaggagtcccttacggacttgtctgaggaaagacaggaaagcgccagcatctccaccttccccggaagcctccctttgccaggcagaaagggtttcccatggggccgcccctggcgccgcgcccggcccacgtacccggggaggccgggccccggaggacgagggaaagcaggccgggcgccgtgagcttcgcggacgtggccgtgtacttctctcccgaggagtgggaatgcctgcggccagcgcagagggccctgtaccgggacgtgatgcgggagaccttcggccacctgggcgcgctgggattttcagttcccaaacccgcttttatctcgtgggtggaaggagaagtggaggcgtggagcccggaggcccaggatcccgacggtgagagctctgcagctttcagcaggggccaaggacaggaagcaggatccagggatgggaatgaggagaaggaaaggctgaagaagtgtccaaaacaaaaagaggtggcgcatgaagtggctgtcaaggagtggtggcccagcgtcgcctgcccagagttctgcaaccctaggcagagccccatgaatccctggctcaaggacactctgacccgaagactgccccactcttgcccagactgtggccgcaacttcagctacccttccctcctggccagccaccagcgggtccactccggggagcggcccttctcctgcggccagtgtcaggcgcgtttctcccagcgcaggtacctgctccagcatcagttcatccacaccggcgagaagccctacccctgccccgactgcgggcgccgcttccgccagaggggttccctggctatccacaggcgggctcacaccggggagaagccttacgcgtgctcagactgcaagagtcgcttcacttacccctacctgctggccatccaccagcgcaagcacacgggcgagaagccctacagctgccccgattgcagcctccgtttcgcctacacctccctgctggccatccacaggcgcatacacaccggcgagaagccctacccctgtcctgactgcggccgccgcttcacctattcttccctcctcctcagtcaccggcgcattcactccgacagccggcccttcccctgcgtggagtgtgggaaaggcttcaagcgcaagaccgccctggaagcccatcggtggatccaccgctcctgcagcgagaggcgcgcgtggcagcaggccgtggtggggcgttcagagcccatccctgttttgggaggcaaggatcccccagttcacttccggcactttccagatatatttcaagagtgtgggtgatggcgttcacacaaactggtcagcgtttccctggagaggaagaggcaaggtttgtgtatttgggggataaggaaaggaagtgggcgtttgaggaaaacaaagttctgccttaggtaaaaagcagaggtaggggcacagagggctgtggggaggaggcaggaatctgaaaaggtgcctgggggttgaccccattttctgaagctccagcacacagggccccgtgttcacgtcccatccttcactgaaaaccattcacctaactggcttttccttcatgattgttctctcccttgtagctctctgctttttggcctgtatctctcctactcctctgagatggggtcccctacattccagtgcctattaaaggagcctgcacccactctggaccccccagaatagaggggatacctcaggcctgtccctcggctggtggggggggcggagctcatcccaggattcttttcttttttttgagatggagtcatgctctgtcgcccaggctggagtgcagtggcgtgatctcggctcactgcaacctctgcctcctgggttcaagccattctctgcctcagccttcccattagctgggattacaggcatgcgccaccaggcccagctaatttttgtgctgttagtagagacggggttccaccatcttggccaggctggtcttgaattcctgacctcgtgatccacccgcctcggcgtctcaaagtgctgggattacaagcgtgagccaccgacccctgccgaggattctgccttttaccaatgcaggtgaaacatctggcaaggagacacctggagtgtaggtgttccttggtcttgaagacctagaggtggccatagagaggacagtggcctcaggtggggaactccccccccactctcattctgcaagtgcacaaactatcaaacatagcggactctggaactgggccaactcttcactgtatgcattagtgattgcagtgtttttttcttcttcagatatttgcatgttccctggattttgtattttttgataaagatatattcttgggccacagtagctggagatataatgccggaggattcttttttttttttttttttttgagacagagtctgtctctattgcctgggctggagtgcagtggcccaagctacgctcactgcaagctccacctcctgggttcacaccattctcctgcttcagtctcccgagtagctggaattacaagcacccgccaccacgcccaactaatattttgtatttttagtagagacgggggtttcaccgtgttagccaggatggtctcgatctcctgacttcgtgatcctcccgcctcggcctcccaaagtgctgggattacaggcgtgagccactgcacccagcctctttttttttttgagatggagtttcgctcttgttgcccaggctagagtgcaatggcatgatcttggctcactgcaacctccgcctcctaggttcaagcgattctcctgccccagcctcttgagtagctgggattacaggcacccacgaccatgcctggctaattgcatttttactagagacaggtttcaccatgttggccaggctggtctccaattcctgacctcaggtgatccacccgacttggcctcccaaagttctgggattacattttttttttaaagaaagaataaattaattgtgattaaagttgaaatcaaggcatagtctttccagtctaatttttactgtaatgcttgtatgtcaacagttatgaaggccaggcgcggtggctcacgcctgtaatcctagcagtttgggaggctgaggagggtggatcacttaaggtcaagagttcaagaccagcctggccaatatggtgaaaccccatctctactaaaaataccaaaaaaaaaaaaaaaaa

SEQ ID NO: 3645 - DNA, 1734 bp, Homo sapiens
catcttggttaagggcaggagtcccttacggacttgtctgaggaaagacaggaaagcgccagcatctccaccttccccggaagcctccctttgccaggcagaaagggtttcccatggggccgcccctggcgccgcgcccggcccacgtacccggggaggccgggccccggaggacgagggaaagcaggccgggcgccgtgagcttcgcggacgtggccgtgtacttctctcccgaggagtgggaatgcctgcggccagcgcagagggccctgtaccgggacgtgatgcgggagaccttcggccacctgggcgcgctggccgagcccattgtttctccttcgcaggattttcagttcccaaacccgcttttatctcgtgggtggaaggagaagtggaggcgtggagcccggaggcccaggatcccgacggtgagagctctgcagctttcagcaggggccaaggacaggaagcaggatccagggatgggaatgaggagaaggaaaggctgaagaagtgtccaaaacaaaaagaggtggcgcatgaagtggctgtcaaggagtggtggcccagcgtcgcctgcccagagttctgcaaccctaggcagagccccatgaatccctggctcaaggacactctgacccgaagactgccccactcttgcccagactgtggccgcaacttcagctacccttccctcctggccagccaccagcgggtccactccggggagcggcccttctcctgcggccagtgtcaggcgcgtttctcccagcgcaggtacctgctccagcatcagttcatccacaccggcgagaagccctacccctgccccgactgcgggcgccgcttccgccagaggggttccctggctatccacaggcgggctcacaccggggagaagccttacgcgtgctcagactgcaagagtcgcttcacttacccctacctgctggccatccaccagcgcaagcacacgggcgagaagccctacagctgccccgattgcagcctccgtttcgcctacacctccctgctggccatccacaggcgcatacacaccggcgagaagccctacccctgtcctgactgcggccgccgcttcacctattcttccctcctcctcagtcaccggcgcattcactccgacagccggcccttcccctgcgtggagtgtgggaaaggcttcaagcgcaagaccgccctggaagcccatcggtggatccaccgctcctgcagcgagaggcgcgcgtggcagcaggccgtggtggggcgttcagagcccatccctgttttgggaggcaaggatcccccagttcacttccggcactttccagatatatttcaagagtgtgggtgatggcgttcacacaaactggtcagcgtttccctggagaggaagaggcaaggtttgtgtatttgggggataaggaaaggaagtgggcgtttgaggaaaacaaagttctgccttaggtaaaaagcagaggtaggggcacagagggctgtggggaggaggcaggaatctgaaaaggtgcctgggggttgaccccattttctgaagctccagcctgggctacaaagcaggactctgtctcaaaacaaaaacagatacaaaaactgggaacggggtgttatctttacttcaccacatagcctctcctgaattggtggacctggattcctagcttggctcagtccccactggctgtgtggcctttagcatcacctagattctac

SEQ ID NO: 3646 - DNA, 2255 bp, Homo sapiens
aaaggcagagaggaaaggcgaggggtgttgacgccaggaaggttccatcttggttaagggcaggagtcccttacggacttgtctgaggaaagacaggaaagcgccagcatctccaccttccccggaagcctccctttgccaggcagaaagggtttcccatggggccgcccctggcgccgcgcccggcccacgtacccggggaggccgggccccggaggacgagggaaagcaggccgggcgccgtgagcttcgcggacgtggccgtgtacttctctcccgaggagtgggaatgcctgcggccagcgcagagggccctgtaccgggacgtgatgcgggagaccttcggccacctgggcgcgctgggattttcagttcccaaacccgcttttatctcgtgggtggaaggagaagtggaggcgtggagcccggaggcccaggatcccgacggatccagggatgggaatgaggagaaggaaaggctgaagaagtgtccaaaacaaaaagaggtggcgcatgaagtggctgtcaaggagtggtggcccagcgtcgcctgcccagagttctgcaaccctaggcagagccccatgaatccctggctcaaggacactctgacccgaagactgccccactcttgcccagactgtggccgcaacttcagctacccttccctcctggccagccaccagcgggtccactccggggagcggcccttctcctgcggccagtgtcaggcgcgtttctcccagcgcaggtacctgctccagcatcagttcatccacaccggcgagaagccctacccctgccccgactgcgggcgccgcttccgccagaggggttccctggctatccacaggcgggctcacaccggggagaagccttacgcgtgctcagactgcaagagtcgcttcacttacccctacctgctggccatccaccagcgcaagcacacgggcgagaagccctacagctgccccgattgcagcctccgtttcgcctacacctccctgctggccatccacaggcgcatacacaccggcgagaagccctacccctgtcctgactgcggccgccgcttcacctattcttccctcctcctcagtcaccggcgcattcactccgacagccggcccttcccctgcgtggagtgtgggaaaggcttcaagcgcaagaccgccctggaagcccatcggtggatccaccgctcctgcagcgagaggcgcgcgtggcagcaggccgtggtggggcgttcagagcccatccctgttttgggaggcaaggatcccccagttcacttccggcactttccagatatatttcaagagtgtgggtgatggcgttcacacaaactggtcagcgtttccctggagaggaagaggcaagatctgctagccctacttttgaagaggaaacttttgaaggaatgaacaaaagaggtaggtgggactaagcatttctgcattccaggactggtggtcagtgactcaaatatctctttgaaaagactgcttctttgaatccttgggttccaagataattaatgggaactggtgccgggcacggtggctcacacctgtgatcccagcactgtgggaggctgaggctggttaatcacttgaggtcaggagtttgagaccagctgggcaatatagtgaaaccccatctctaccaaaaaattagccaggcgtggtggcacatgcctgtagtcccagctactcaggaggctaaggcaagaggatcacttgagcctgggagacagaggttgcagtaagctgagatggctccattgcactccagcctgggctacaaagcaggactctgtctcaaaacaaaaacagatacaaaaactgggaacggggtgttatctttacttcaccacatagcctctcctgaattggtggacctggattcctagcttggctcagtccccactggctgtgtggcctttagcatcacctagattctacaaataacatttttctctatttgttttacacatgtcaatctgcctatccatccctctatccattcatttatccattttattaatgtatttcaaagtaagttgcagacatcattacatttcacttctaaacacttcagcatacagctgagttttatgcaagaaacttaagctctcagctgggtacagtggctcacacctgtaatcccagcactttgggaggctgaggcaggaggattgcatgagattgggagtttgagacgagcctggaaaacagcaagacctcatttctact

SEQ ID NO: 3647 - DNA, 3078 bp, Homo sapiens
agtgcgcagcagggcaggttcctgcggagccgccggagacggtcgggtttgccagggccgggcgggaccgcggggaccatggcggagccgcctcggcactattcacaatagcaaagatgtggaatcaacctaaatgcccatcaatggcagactggataaagaaaatgtacatatgcactatggaatactatgcagccataaagaaaatcatatcctttgcagaaagatggatggagctggaggccattgtcttaagtgagataacacaggagtagaaaacaaagtgccgttctcacttataagggcgagctaaacactgagtatatatggatacgaagcagggaatgaataacagacattggggcctacttgaaggtggaggctgggaggagaatgaggactgaaaaattccttatcggctacctctgacttttgaggatgttgctatttatttctccgagcaagaatggcaggatctagaggcatggcagaaggaactttacaagcatgtgatgagaagcaattatgagactctcgtctctctagatgatggacttccaaaaccagaactaatatcctggattgaacacgggggagagcccttcaggaaatggagagaatcacagaaatcaggaaacataatttgctcctctgttgatatgcattttgatccaggttttgaggaacagctgttttggggaagccagcaggctatgaattcaggaaaaactaaaagccatttccaattagatcctgaaagccagtgttcctttggatcctttgtttccttcaggcctgaccaaggcatcaccctcgggagcccacagagacacgacgccagggctcctccaccactagcctgcggccccagtgaatctaccctaaaagaaggaatcccaggtcccagaaatctggatcttcctggtttgtgggacgtccccgcctgggagagcacccagcacccttggcctgtctgcggggaaagctgttgggagaacaaccatttagtaatgcaccagagaggccactcaaaggaccggacacgtagggcctgggagaaattcaacaagagggcggagacgcagatgccgtggagcagccctcgggtacagaggcacttccggtgtggcgtgtgcggtaagagcttccgccggaagctgtgtctgctgcgccatctggcggcccacacggggaggggccccttccggaacgctgacggtgaaatgtgcttccgacacgagctgacccatcccagccaccgcctcccgcagcagggggagaagcctgcccagtgcaccccatgcggcaagcgctccctcccagtggacagcacgcaggctcgccggtgccagcacagccgggaggggccggcctcttggagagaaggccgcggggcctccagcagtgtgcactcgggacagaaaccaggctcgcgcctgccccaggaggggaacagccaccaggaaggggacacggaggcgctgcagcatggcgcagaggggccctgctcctgctcggagtgtggcgagcgctcccctatgagcgccaggctcgccagcccctgcagggcgcatactggagaaaagcccttccagtgtgcgcattgcaccaagcgcttccgcctgcgccgcctgctgcaggtccaccagcacgcgcacggtggggagagaccgttctcctgcaggaagtgtggcaagggcttcgccaagcagtgtaaactcacggagcacattcgagtccacagcggagagaagcctttccggtgtgccaagtgtggcaggaacttccgtcagaggggacagctgctgcggcaccagcggctgcacacggacgagaagccctttcagtgcccagagtgtgggctgagcttccgcctggagagcatgctgagagcccaccggctccggcacggtggggagaggccgttctcctgtagcgagtgtggcagaggcttcacccaccagtgcaagctccgtgagcacctgagagtgcacagcggggagaggcccttccagtgcctgaagtgcgacaagcgcttccgcctgaagggcatcctgaaggcccaccagcacacgcacagcaaggagaggccgttctcgtgcggggagtgtggcaagggcttcaccagacaatccaagctcacggagcacttgcgcgtgcacagcggggagagacccttccagtgcccagagtgcaacaggagcttccgcctgaaggggcagctgctcagccatcagcgcctgcacacgggagagaggcccttccagtgtccggagtgcgacaagcgctatcgcgtgaaggccgacatgaaggcccaccagctgctgcacagcggggagatgcctttctcctgtgagtgcggcaagggctttgtgaaacactcaaagctcatcgagcacatcagaacgcacacgggagagaagccttttcagtgtcccaagtgtgacaagagtttccgcctgaaggcgcagctgctcagccatcagggcctgcacacaggggagaggccttttcactgccctgagtgtgacaagaacttccgggaaaggggacacatgctgaggcaccagcgcatccacaggcccgagaggccctttgcctgtggcgattgtgggaagggcttcatttacaagtctaagcttgcggagcacatcagagtacacacaaaatcctgtcctgctccaaatgaactggacattaagaaaaggctcagccaactgtttgcaatgatagaggccgattggagttgaggcagagtgggacatccaaagcgttgagcaggattggtattgcccaggaatccacagcaacagtagccagacccgctggtagacgggttttaggagcaggtatccttctttgagcaagagtgtcatgcaagttaggaatatgaagaaccacaaaggattttctcttcagaagcatcaccaattatatttctttcttttttttttttttttccaagatggagttttgctctgtcacccaggctggagtgcagtggcgtgatcccagctatattggaaaagacagcattataaaacaaggacataattttatgaaaaaggaggcatctgc

SEQ ID NO: 3648 - DNA, 2874 bp, Homo sapiens
gcaggttcctgcggagccgccggagacggtcgggtttgccagggccgggcgggaccgcggggaccatggcggagccgcctcggctacctctgacttttgaggatgttgctatttatttctccgagcaagaatggcaggatctagaggcatggcagaaggaactttacaagcatgtgatgagaagcaattatgagactctcgtctctctagatgatggacttccaaaaccagaactaatatcctggattgaacacgggggagagcccttcaggaaatggagagaatcacagaaatcaggaaacataatttgctcctctgttgatatgcattttgatccaggttttgaggaacagctgttttggggaagccagcaggctatgaattcaggaaaaactaaaagccatttccaattagatcctgaaagccagtgttcctttggatcctttgtttccttcaggcctgaccaaggcatcaccctcgggagcccacagagacacgacgccagggctcctccaccactagcctgcggccccagtgaatctaccctaaaagaaggaatcccaggtcccagaaatctggatcttcctggtttgtgggacgtccccgcctgggagagcacccagcacccttggcctgtctgcggggaaagctgttgggagaacaaccatttagtaatgcaccagagaggccactcaaaggaccggacacgtagggcctgggagaaattcaacaagagggcggagacgcagatgccgtggagcagccctcgggtacagaggcacttccggtgtggcgtgtgcggtaagagcttccgccggaagctgtgtctgctgcgccatctggcggcccacacggggaggggccccttccggaacgctgacggtgaaatgtgcttccgacacgagctgacccatcccagccaccgcctcccgcagcagggggagaagcctgcccagtgcaccccatgcggcaagcgctccctcccagtggacagcacgcaggctcgccggtgccagcacagccgggaggggccggcctcttggagagaaggccgcggggcctccagcagtgtgcactcgggacagaaaccaggctcgcgcctgccccaggaggggaacagccaccaggaaggggacacggaggcgctgcagcatggcgcagaggggccctgctcctgctcggagtgtggcgagcgctcccctatgagcgccaggctcgccagcccctgcagggcgcatactggagaaaagcccttccagtgtgcgcattgcaccaagcgcttccgcctgcgccgcctgctgcaggtccaccagcacgcgcacggtggggagagaccgttctcctgcaggaagtgtggcaagggcttcgccaagcagtgtaaactcacggagcacattcgagtccacagcggagagaagcctttccggtgtgccaagtgtggcaggaacttccgtcagaggggacagctgctgcggcaccagcggctgcacacggacgagaagccctttcagtgcccagagtgtgggctgagcttccgcctggagagcatgctgagagcccaccggctccggcacggtggggagaggccgttctcctgtagcgagtgtggcagaggcttcacccaccagtgcaagctccgtgagcacctgagagtgcacagcggggagaggcccttccagtgcctgaagtgcgacaagcgcttccgcctgaagggcatcctgaaggcccaccagcacacgcacagcaaggagaggccgttctcgtgcggggagtgtggcaagggcttcaccagacaatccaagctcacggagcacttgcgcgtgcacagcggggagagacccttccagtgcccagagtgcaacaggagcttccgcctgaaggggcagctgctcagccatcagcgcctgcacacgggagagaggcccttccagtgtccggagtgcgacaagcgctatcgcgtgaaggccgacatgaaggcccaccagctgctgcacagcggggagatgcctttctcctgtgagtgcggcaagggctttgtgaaacactcaaagctcatcgagcacatcagaacgcacacgggagagaagccttttcagtgtcccaagtgtgacaagagtttccgcctgaaggcgcagctgctcagccatcagggcctgcacacaggggagaggccttttcactgccctgagtgtgacaagaacttccgggaaaggggacacatgctgaggcaccagcgcatccacaggcccgagaggccctttgcctgtggcgattgtgggaagggcttcatttacaagtctaagcttgcggagcacatcagagtacacacaaaatcctgtcctgctccaaatgaactggacattaagaaaaggctcagccaactgtttgcaatgatagaggccgattggagttgaggcagagtgggacatccaaagcgttgagcaggattggtattgcccaggaatccacagcaacagtagccagacccgctggtagacgggttttaggagcaggtatccttctttgagcaagagtgtcatgcaagttaggaatatgaagaaccacaaaggattttctcttcagaagcatcaccaattatatttctttcttttttttttttttttccaagatggagttttgctctgtcacccaggctggagtgcagtggcgtgatcccagctatattggaaaagacagcattataaaacaaggacataattttatgaaaaaggaggcatctgcaaacgaaaacaatttctacgaggttatatgtgattgttaacatttttaagaaaaggtgcacacagaaatccagataagatgtgattacctttgtgcatttgtataaaaatatatgtgtgtaattataaggaa

SEQ ID NO: 3649 - DNA, 2792 bp, Homo sapiens
ggggcggagcggaggggagtcagtgcgcagcagggcaggttcctgcggagccgccggagacggtcgggtttgccagggccgggcgggaccgcggggaccatggcggagccgcctcggatgatggacttccaaaaccagaactaatatcctggattgaacacgggggagagcccttcaggaaatggagagaatcacagaaatcaggaaacataatttgctcctctgttgatatgcattttgatccaggttttgaggaacagctgttttggggaagccagcaggctatgaattcaggaaaaactaaaagccatttccaattagatcctgaaagccagtgttcctttggatcctttgtttccttcaggcctgaccaaggcatcaccctcgggagcccacagagacacgacgccagggctcctccaccactagcctgcggccccagtgaatctaccctaaaagaaggaatcccaggtcccagaaatctggatcttcctggtttgtgggacgtccccgcctgggagagcacccagcacccttggcctgtctgcggggaaagctgttgggagaacaaccatttagtaatgcaccagagaggccactcaaaggaccggacacgtagggcctgggagaaattcaacaagagggcggagacgcagatgccgtggagcagccctcgggtacagaggcacttccggtgtggcgtgtgcggtaagagcttccgccggaagctgtgtctgctgcgccatctggcggcccacacggggaggggccccttccggaacgctgacggtgaaatgtgcttccgacacgagctgacccatcccagccaccgcctcccgcagcagggggagaagcctgcccagtgcaccccatgcggcaagcgctccctcccagtggacagcacgcaggctcgccggtgccagcacagccgggaggggccggcctcttggagagaaggccgcggggcctccagcagtgtgcactcgggacagaaaccaggctcgcgcctgccccaggaggggaacagccaccaggaaggggacacggaggcgctgcagcatggcgcagaggggccctgctcctgctcggagtgtggcgagcgctcccctatgagcgccaggctcgccagcccctgcagggcgcatactggagaaaagcccttccagtgtgcgcattgcaccaagcgcttccgcctgcgccgcctgctgcaggtccaccagcacgcgcacggtggggagaccgttctcctgcaggaagtgtggcaagggcttcgccaagcagtgtaaactcacggagcacattcgagtccacagcggagagaagcctttccggtgtgccaagtgtggcaggaacttccgtcagaggggacagctgctgcggcaccagcggctgcacacggacgagaagccctttcagtgcccagagtgtgggctgagcttccgcctggagagcatgctgagagcccaccggctccggcacggtggggagaggccgttctcctgtagcgagtgtggcagaggcttcacccaccagtgcaagctccgtgagcacctgagagtgcacagcggggagaggcccttccagtgcctgaagtgcgacaagcgcttccgcctgaagggcatcctgaaggcccaccagcacacgcacagcaaggagaggccgttctcgtgcggggagtgtggcaagggcttcaccagacaatccaagctcacggagcacttgcgcgtgcacagcggggagagacccttccagtgcccagagtgcaacaggagcttccgcctgaaggggcagctgctcagccatcagcgcctgcacacgggagagaggcccttccagtgtccggagtgcgacaagcgctatcgcgtgaaggccgacatgaaggcccaccagctgctgcacagcggggagatgcctttctcctgtgagtgcggcaagggctttgtgaaacactcaaagctcatcgagcacatcagaacgcacacgggagagaagccttttcagtgtcccaagtgtgacaagagtttccgcctgaaggcgcagctgctcagccatcagggcctgcacacaggggagaggccttttcactgccctgagtgtgacaagaacttccgggaaaggggacacatgctgaggcaccagcgcatccacaggcccgagaggccctttgcctgtggcgattgtgggaagggcttcatttacaagtctaagcttgcggagcacatcagagtacacacaaaatcctgtcctgctccaaatgaactggacattaagaaaaggctcagccaactgtttgcaatgatagaggccgattggagttgaggcagagtgggacatccaaagcgttgagcaggattggtattgcccaggaatccacagcaacagtagccagacccgctggtagacgggttttaggagcaggtatccttctttgagcaagagtgtcatgcaagttaggaatatgaagaaccacaaaggattttctcttcagaagcatcaccaattatatttctttcttttttttttttttttccaagatggagttttgctctgtcacccaggctggagtgcagtggcgtgatcccagctatattggaaaagacagcattataaaacaaggacataattttatgaaaaaggaggcatctgcaaacgaaaacaatttctacgaggttatatgtgattgttaacatttttaagaaaaggtgcacacagaaatccagataagatgtgattacctttgtgcatttgtataaaaatatatgtgtgtaattataaggaagttctgacatttt

SEQ ID NO: 3650 - DNA, 1928 bp, Homo sapiens
gcccgtccccctgaccccagggtctgagtcgccgctgccgccgctgccaccatccgcgaggcaggagagaggaggaggagtgcggcgcggcggccccgggaccaaggagggacccagacatggagctgcgggaagaagcctggtctccggggccgctggattctgaggaccagcagatggccagtcacgagaacccagtggacatcctcatcatggatgatgacgacgtccccagctggcctcccaccaagctgtccccgccccagtctgcgcccccagccggcccgcctccccggccgcggccgcccgccccctacatctgcaacgagtgtggcaagagctttagccactggtccaagctgacgcggcaccagcgcacgcacaccggcgagcggcccaacgcctgcgccgactgcggcaagaccttctcgcagagctcgcacctggtgcagcaccggcgcatccacacgggcgagaagccctacgcctgcttggagtgcggcaagcgcttcagctggagctccaacctcatgcagcaccagcgcatccacacgggcgagaagccctacacctgccccgactgcggccgcagcttcactcagagcaagagcctggccaagcaccggcgctcgcacagcggcctcaagcccttcgtgtgcccgcgctgcggccgcggcttcagccagcccaagagcctcgcgcgtcacctgcggctgcacccggagctgtcggggcctggcgtggcggccaaggtgctggcggctagcgtccggcgggccaaggggcccgaagaggcggtggcggcggacggcgagatcgccatccccgtgggcgatggcgagggcatcatcgtggtgggcgcgccgggcgagggggccgcggccgcggcagccatggcgggcgcgggggcaaaggccgcggggccccggtcgcggcgcgccccggcccccaagccgtacgtgtgtctggagtgcgggaagggcttcgggcacggggccgggctcctggcgcaccagcgggcccagcacggggacgggctcggggcggcggggggcgaggagccggcccacatctgcgtggagtgcggggagggcttcgtgcagggcgccgcgctccggagacacaagaagatccacgcggtgggcgcgccctcggtctgcagcagctgcggacagagctactaccgcgcgggcggggaggaggaggacgacgacgacgacgaggccgcgggcgggcggtgccccgagtgccgcggtggggagggccggtaggggaggggcccgggggggggggcgggcagggcccctcgggcttggcgggagcgacgacgtgcaagaccaagagacccagggagaagcggacggggtgcgatggaccccgcggcatccccggctccccgccctcctctgtccctgcgccgtccgtgggggggcactggggcgtattagggcccgttcacttctccgcctcgagactctgccccctcagcctggcccgcccttcctaagttatcggcctgcgagccggagagacaatggagagaactgcagaggccgagtggcgaccaggccccaagcggaaggccattttccctgctcttcctcagttgtccggggcgggggtggggggtgctgcgaggaatggagaaaccaggccctttagaggatcccagagagggaagagaaccaggggcccttttctcttttagaattttcttttaatcagcccaccttttgactccccgcccgccccaatccattatttttttctgccttccgggtcccatccttagagctcgagtcgttccttcccctcctggattccgggtagcagaggcagcgccgcaggaggcgggtgcccgtttgtcccaggcctgggcgtggtggaggaaggggtgctggaacaataaacggcactatccaaatgtc

SEQ ID NO: 3651 - DNA, 3766 bp, Homo sapiens
aacttttttcggggaaggagacggctgcaagcccgcggtctcttgttgctgtgctaacgaccgttggaaccctctttctggctcttggaacgctcggctctgagaggctccaggtttctccgccagagctcctgtcgctctgtcagttgcgctgtgttcctctctagtcacaagagccttggggaagacagttggaagctcagacatggactcagtggcctttgaggatgtggctgtgaacttcaccccagacgagtgggctttgctggatccttcccaaaagaatctctaccgagaagtgatgcaagaaaccttgaggaacttggcctctatagaggtcttatggaagagagactctttgaaagtgaaggtcatcagcatggagaaattttgacccaggttctggatgacatgctgaagaagaaaactggagtagaatcatgtgaaaggaatgtgtgtgaggtcagcatgggtcatttatcccttaataagcacaccagagctgacactggacacaagccatatgagtatcaggaatatggacagacgccatataaatgtacatactgtaagaaagccttcagctgtctcccctacttttgcagacatgtaattgcacacactggagaaaaaccctatgaatgtaaggattctgcgaagacatttagtttttccatttattttcatagtcataaaagagctcactctggagggaacccctatgaatgtaaacaatctggaaaaccctttggatgcgcctcagaacttcaaatgcatgcaaggactcagtgtggagaaaccttacaaatgtaagaaatgtgaaaaagcatttaataacttatcttcctttcaaatacatgaaagaatgcacagaggagggaagtatcatgcctgtaagggttctgggaatacataccgtttttctggtttctatcatagacataaaatgcctcatgctggcgggaagttttatggatgtaagaaatgtgggaaagcctttattagtttctgtgcctttcgataccatcaaaggactcacactaaagagaaaccctatgcgtgtaaacaatgtgggaaagcctatatttcttacacttcttttcaatatcatcagttgaatcacactggagcgaaatgctatgagtgtaagcagtgtggcaaaggcttcgatttgcccaattccattcgatatcatgaaatgactcacactggggagaaaccccatgaatgtaagcaatgtgggaaaactttcagatgtgcctcaagcctccgaatacatggaaggactcacactggggagaaaccctatgaatgtaaacagtgtggtaaagtctctcgttattggagcggccttcaggtacatgaagtaactcatattggaaaaaagctttatgaatgtaaggaatgtgggaaatcatactatagttctggttcctttctaaatcataaaaggatccacaccagggagaagtcttatgaatgcaaggaatgtgggaaagcatttggtaatcccatatcctttcaaaaacatgaagggagtcacagaaaatggaagccttatgaatgtaaggaatgtgggaaggtattcagtttttccagttcccttcggagacatgaaaggacacacactgaaaaactctgtgaatgtaaacagcatgggaaaggattttttcatagaagctgtcctagacacatgaagatagacactggagagatacttcataaacgtaagatacgtggaaaagtctttcattctcctagttcatttcaaacatgtgaaagatctcacactagagaaaaacgctataaatgcaagcaatgtggaaaacccttcatttatttcaatgcctttcaacgtcatcaaaggagccacactggagagaacccctatgagtgtaagcaatgtgggaaagcctgtatttcttccactgcttttcagtgtcgtgaattgagtcacactggagcaaaacgctataagtgtaagcagtgtggcaaaggcttcaatttgcccagttccattcgatatcatgaaatgactcacactggagagaaaccctatgaatgtaagcaatgtgggagagctttcagatctgcctcacacctacgaacacatgaaaggactcacattggggagaaaccctatgaatgtaaacagtgtggtaaagtctatcgttactggagtggccttcgaatacatggactaactcatattggaaaaaagccttatgaatttaatgaccgtgggaaatcattctatagttccaatttctttctaaatcataaaagggtccacactagagtgaagacatatgaatgcaaggaatgtgggaaagcatttgataatcctacatcctttcaaaaacatgaagggagtcacagaaaagggaagtcttatgaatgtaaggaatgtgggaaggtattcagtttttcccgttcctttcgtagatatgaaagggcacacactggcgaaaagccctgtgaataaacaatgtgggaaaggatttttcatatcttctgtggagctttgaatgcatgaaaagacagactacagagaaatgctaaatgtaaggcgtgtataaaagcatttagtaatttctcttccttgcttatacatggaaggatgcacactggagagaagccatatgaatgtaagaattgtgggaaagccttcacatctgccaagagccttcaaaatcatggaaggacacacaccggagagaaaccatgtgaatgcaagcaatgtggcaaagctttcatttgttccagttcctgtcagagacatgaagagacacattctgttaatatgcattcagttatcctaattcctttgaaacacagaaaaagagtagggaaaggacctctgagataactgttttctgagttgagaagagctacttgtgaatggacaattaaatctagatgtatttagatctgatacaattcatctgtagccaacctttttttaaatttttttattttttagatggagtcttgctctgtcgcccagactggagtgcagtggcacgatcttggctcactgcaacctccgcctcctgggtttaagcaattctcctgcctcagcctcccaagtagctgggattacaggtaaccgccatcacgcctggctaattttagagatggagtttcaccatgttggccaggctggtctcaaactcctgacctcaagtgatccacccacctcggcctcccaaagtgctgggattacaggcgtgagccactgcgccctgccacctatagccaatcttaatgagatttcataggcacagacaaggaaggttatcagtcacatattagaggcaccacacagggagagcagtgtgtggccacatgcttcagcccattttttctgattctcttgcttgcaaattaagagtattctccaaatcacttgactttccttttctcagagttatagttctccagagatgtcaccagatgattcacattaaaggtacatttccagttgacttttttatttcagatattagtaaatgattaccagagaactaattcaaactgtcatggttggaaatactctgatgctcaactccctaatctatagagtgagttaaggtctatactcttttgcaagcattgttctagtggcagtgaccctgttcatgattcagcctgacatttactatgctgccctgaaaaccaactagatgggagcttgtttctctctgcattgtgtagtgagtggtgtcacccaggactttcatgtgagaaaaagcaccttgctttt

SEQ ID NO: 3652 - DNA, 777 bp, Homo sapiens
agatctcacactagagaaaaacgctataaatgcaagcaatgtggaaaacccttcatttatttcaatgcctttcaacgtcatcaaaggagccacactggagagaacccctatgagtgtaagcaatgtgggaaagcctgtatttcttccactgcttttcagtgtcgtgaattgagtcacactggagcaaaacgctataagtgtaagcagtgtggcaaaggcttcaatttgcccagttccattcgatatcatgaaatgactcacactggagagaaaccctatgaatgtaagcaatgtgggagagctttcagatctgcctcacacctacgaacacatgaaaggactcacattggggagaaaccctatgaatgtaaacagtgtggtaaagtctatcgttactggagtggccttcgaatacatggactaactcatattggaaaaaagccttatgaatgcaaggaatgtgggaaagcatttgataatcctacatcctttcaaaaacatgaagggagtcacagaaaagggaagtcttatgaatgtaaggaatgtgggaaggtattcagtttttcccgttcctttcgtagacatggaaggatgcacactggagagaagccatatgaatgtaagaattgtgggaaagccttcacatctgccaagagccttcaaaatcatggaaggacacacaccggagagaaaccatgtgaatgcaagcaatgtggcaaagctttcatttgttccagttcctgtcagagacatgaagagacacattctgttaatatg

SEQ ID NO: 3653 - DNA, 1654 bp, Homo sapiens
agaggggccgctggctgggacgcttcgctcggcgcgcgcaggtggagccagcgagaggctctgaggctgccagagtggttgtgtctgttcctccggtaaggggtgattcgccgaggggcgcggaccagacagacctcgggtcaggcccgggaaccccgagaggagagcccagcccctggtggaggcggcttggcggagattcggagccgtcagcagctcagccagacgtccaggatcccaccccttgcaaaagaccaggccgtggaagccatgttcccaccagccagggggaaggagctgctctcgtttgaggatgtggcgatgtacttcaccagagaggagtggggccacctcaactggggtcagaaggacctctaccgagatgtgatgttggagaactacaggaacatggtcttgctgggatttcagtttcccaaacctgagatgatctgtcagctggagaactgggacgagcagtggatcctggatctaccgagaactgggaataggaaggcttccggtagtgcttgcccaggttctgaagccagacacaagatgaaaaagctaactccaaaacagaaattttctgaagatttagagtcatataagatatcagtggtaatgcaggaatcagctgagaaactttcagaaaagttacataagtgtaaagaatttgtggacagttgcaggcttactttccctactagtggtgatgaatacagcaggggcttccttcaaaaccttaaccttattcaagatcagaatgcgcaaacaaggtggaagcagggcagatatgatgaggatggcaaacccttcaatcaaagatctttgcttttggggcatgagcgaattctcacaagagcaaagtcttatgaatgcagtgaatgtggaaaagtcattaggcgtaaggcatggtttgatcaacatcaaagaattcactttttagagaatccttttgagtgtaaggtctgtgggcaagccttcagacagcggtcagctcttacggtccataaacagtgtcacctgcaaaacaagccatacagatgtcatgactgtggaaagtgttttcggcagctcgcgtatcttgttgaacataagaggattcacaccaaagaaaaaccttataaatgtagcaaatgtgaaaaaacgtttagtcagaattcaacccttattcgacatcaggtgatccatagtggagaaaaacgccataaatgccttgagtgtggaaaagcctttggccggcattcaacccttctatgtcatcaacagattcacagtaaaccgaacacccataaatgcagtgaatgtggacagtcctttggtaggaatgtggatctcattcagcatcaaagaatccatacaaaggaggaattctttcaatgtggagaatgtgggaaaacgtttagttttaagaggaatctttttcgacatcaggtcattcacactggaagccaaccctaccaatgtgtcatatgtggaaaatctttcaagtggcacacaagctttattaagcaccagggcactcacaaaggacagatatccacatgatgttaattggaaagcagtcattggagaactagaacttataaacctctacttcaagtgtgtatcacgtaattgtttccatgaaaagcaataaatgtaacaaagggtt

SEQ ID NO: 3654 - DNA, 510 bp, Homo sapiens
agagtggttgtgtctgttcctccggtaaggggtgattcgccgaggggcgcggaccagacagacctcgggtcaggcccgggaaccccgagaggagagcccagcccctggtggaggcggcttggcggagattcggagccgtcagcagctcagccagacgtccaggatcccaccccttgcaaaagaccaggccgtggaagccatgttcccaccagccagggggaaggagctgctctcgtttgaggatgtggcgatgtacttcaccagagaggagtggggccacctcaactggggtcagaaggacctctaccgagatgtgatgttggagaactacaggaacatggtcttgctggtttatttccagtttgatgctgcaataccactgtgctgaacgtctctggcacattcatcttggttgcaattgtactttaggctatatttctaagagcgaaatgaccacagccaaaggtatgaacattgttcaggctttcaataaagactgccagatattta

SEQ ID NO: 3655 - DNA, 2143 bp, Homo sapiens
aatagaaagatcgcggaaccttccaccatcaagggaccgcagggccggctctgctttcccagcacgctgcctcaccaagaaagaatccagagaaggactggtggacttggaatgttaagtcatggcccatttgatgatgttcagggatgtggctgtagatttctctcaggaggagtgggagtgcctggacctggaacagagggatttatatagagatgtgatgttggagaactacagcaacatggtctcactgggtttttgcatttatcagccagaagcgttctctttattggagaaagggaaagagccctggaagattttgagggatgagacaagaggaccttgcccagacatgcagtcgaggtgtcagaccaagaagttattaccaaaaaatggcatttttgagagagaaatagcccaattggaaataatgagaatttgtaaaaaccacagccttgactgtttatgttttagaggtgactgggaaggcaacactcagtttcaaacacttcaagataatcaagaggaatgcttcaagcaggtgatacgcacctgtgaaaaaaggcccacttttaaccagcatacagtgtttaatctacaccagagacttaatacaggagacaaactgaatgaatttaaagaactggggaaagcctttatttctggttcagatcatactcaacatcagttaattcacacaagtgagaaattctgtggagataaagaatgtgggaatacctttcttcctgattcagaagttattcaatatcagacagttcacactgttaagaaaacatatgaatgtaaagaatgtgggaagtcttttagtttacgttcgagtcttactggtcataagagaattcataccggtgagaaaccttttaaatgtaaggattgtgggaaagcctttagatttcattcacaacttagtgtccataagcgaattcatactggtgagaaatcttatgaatgtaaggaatgtgggaaggcctttagttgtggctcagatcttactcgacatcagagaattcatactggtgaaaaaccctatgaatgtaatgaatgtagaaaggcctttagtcagcgatcacatcttattaaacatcagagaattcacactggtgaaaaaccttatgaatgtaaggagtgtgggaaagcttttactcgtggatcacacctaactcagcatcagagaattcatactggtgagaaatctcatgagtgtaaggaatgtggaaaagcctttattcgtggttcaaatcttgctcaacatcagaatgttcatgttggtaggaaaccttataaatgtgagaaatgtgggaaagcctatatttggagctcacaccttgctcgacatcagcgaattcatactggcaggaaaccttatgaatgtaagcaatgcgggaagacttttacttgggcttcgtatcttgctcaacatgagaaaattcacaatgagaggaaatcctatgaatgtaaggaatgtggaaagacctttcttcatggctcagagtttaatcgacatcagaaaattcatactggtgagagaaactatgaatgtaaggaatgtggaaagaccttttttcgtggttcagaacttaatcgacaccagaaaattcatactggaaagaggccatatgaatgtgaagaatgtggaaaagcctttctctggggttcacaacttactcgacatcagagaatgcatactggtgaggaaccttacgtatgtaaagaatgtgggaaatcttttatctggggttcacagcttacacgacataagaaaattcatactgatgcagaaccttatggatgcaagaaaagtagccacatctttagtcaccattcatattttactgaacaaaaaattcataatagtgcaaatctctgtgaatggacagactatgggaacacctttagtcatgagtcaaactttgctcaacaccagaatatttacacttttgagaaatcctatgaatttaaagattttgagaaagcattttcttcaagctctcacttcatttcactcttgtgaaatattatataaaagtgtaggaagggctttattcatgactcattaattgatgtcatttatttttttctcttgaggaacaccacaaatgtaagtaatattggaaggcatttt

SEQ ID NO: 3656 - DNA, 538 bp, Homo sapiens
acacgacgttgacaggcgctgtgtgtgaccctaatggactatttaaatgtgactgtatctctgctttcccagcacgctgcctcaccaagaaagaatccagagaaggactggtggacttggaatgttaagtcatggcccatttgatgatgttcagggatgtggctgtagatttctctcaggaggagtgggagtgcctggacctggaacagagggatttatatagagatgtgatgttggagaactacagcaacatggtctcactgggtttttgcatttatcagccagaagcgttctctttattggagaaagggaaagagccctggaagattttgagggatgagacaagaggaccttgcccagacatgcagtcgaggtgtcagaccaagaagttattaccaaaaaatggcatttttgagagagaaatagcccaattggaaataatgagaatttgtaaaaaccacagccttgactgtttatgttttagaggtgactgggaaggcaacactcagtttcaaacacttcaagataatcaagagga

SEQ ID NO: 3657 - DNA, 578 bp, Homo sapiens
atgactgcgtcgcgttgtgcgtgaccacgttcgtaaaggtggtgatagcagccgctatggggccaaaaacaaagaattgagctttgcgttgagtgacaggcatagtccttcgtgaatgtgtggggagcagtttttgtgctggcccgtagctggattggagtgggggcaacctagaaggaggggagaagaatgggacacagtgtagacaacatagttcaagagtttctccgtaaattagagcagagaaatggagcagcaggttggggtagagggctggggaagacggctggggaacaaccacccatcaacatgttgttggaaatgagccacgagaggggggaaaagtccaggcaaggctctgctttcccagcacgctgcctcaccaagaaagaatccagagaaggactggtggacttggaatgttaagtcatggcccatttgatgatgttcagggatgtggctgtagatttctctcaggaggagtgggagtgcctggacctggaacagagggatttatatagagatgtgatgttggagaactacagcaacatggtctcactgggtttttgcatttatca

SEQ ID NO: 3658 - DNA, 922 bp, Homo sapiens
gacatactggaccgcagggtctcctgggaaacgtagtccaagcctcgccggggatagatgggcccaactaaagtgtgctgcgttctctgggtcctgaggcggcagtctggccgcagtgaccagactaactgtgccccggaggctgcttggaattccacttaacgctggaagcacgcagacgctcttgaggcgggcagctgcgtagcgtgtggaggagccgggagagcgcaccccaatgtggcacctgagcgtctgggaccgaaccagcatggggagtcggaaggggacaaatccgcgatcccagtcatgcatctctgctttcccagcacgctgcctcaccaagaaagaatccagagaaggactggtggacttggaatgttaagtcatggcccatttgatgatgttcagggatgtggctgtagatttctctcaggaggagtgggagtgcctggacctggaacagagggatttatatagagatgtgatgttggagaactacagcaacatggtctcactgggtttttgcatttatcagccagaagcgttctctttattggagaaagggaaagagccctggaagattttgagggatgagacaagaggaccttgcccagacatgcagtcgaggtgtcagaccaagaagttattaccaaaaaatggcatttttgagagagaaatagcccaattggaaataatgagaatttgtaaaaaccacagccttgactgtttatgttttagaggtgactgggaaggcaacactcagtttcaaacacttcaagataatcaagaggaatgcttcaagcaggtgatacgcacctgtgaaaaaaggcccacttttaaccagcatacagtgtttaatctacaccagagacttaatacaggagacaaactgaatgaatttaaagaactggggaaagccttt

SEQ ID NO: 3659 - DNA, 4554 bp, Homo sapiens
gcaaatgcgtgctacgtcactgtgcgatcgggttgtgcttagcttggggtctcctggccccttgacgcgtcaggttgctgtacccctgcatcggatgcgctgtaccctgcgctggctccgtgaaccttagggacaacaccgggacacccgcgaggccggaaaatggactcagtggcttttgaggatgtgtctgtgagcttcagccaggaggagtgggctctgctggctccttcacagaagaaactctacagagatgtgatgcaggaaacattcaagaacctggcatctataggggaaaaatgggaagacccgaatgttgaagatcaacacaaaaaccaaggacgaaatctaagaagccatacgggagagagactctgtgaaggtaaagaaggtagtcaatgtgcagaaaacttcagtcccaatctcagtgtgacgaagaagactgccggagtaaaaccatatgagtgtactatctgtggaaaagccttcatgcgtctctcatcccttactagacacatgaggtctcacactggatacgagctatttgagaagccatataaatgtaaggagtgtgagaaagcctttagttatctcaaatcctttcaaagacatgaaaggagtcacactggagaaaaaccctataaatgtaaacaatgtggaaaaaccttcatatatcaccagccctttcaaagacatgagcggactcacattggagaaaaaccctatgaatgtaagcaatgtggaaaagctcttagttgttccagttcgcttcgagttcatgaaaggattcacactggagaaaagccctatgaatgtaaacaatgtgggaaagccttcagttgttccagttctattcgagtacacgaaagaactcacactggagagaaaccctatgcatgtaaggaatgtgggaaagccttcatttcccacacaagtgttctaacacacatgataacacacaacggagatagaccttataaatgcaaagaatgtggaaaggcattcatttttcccagttttttacgagtacatgaaagaattcacactggagagaaaccctataaatgtaaacaatgtggtaaagccttcagatgttccacctccattcaaattcatgaaagaattcatactggagagaagccctataaatgtaaagaatgtgggaaatctttcagtgcacgcccagcctttcgagtacacgtgagagtgcatactggagagaaaccctataagtgtaaagaatgtgggaaagcctttagtagaatcagttactttcgaatacatgaaaggactcacactggagagaaaccctacgaatgtaaaaaatgtgggaaaactttcaattatcctctagatttgaaaatccacaagagaaatcacactggagaaaaaccctatgagtgtaaggaatgtgcaaaaaccttcatttctcttgagaactttcgaagacacatgatcacccacactggagacggaccttataaatgtagggactgtgggaaggtgttcatttttcctagtgcgttacgaacacatgaaagaactcacactggagagaaaccctatgaatgtaaacaatgtggaaaagcctttagttgttctagttacattcggatacataaaagaactcacactggggagaaaccttatgaatgtaaggaatgcgggaaggcctttatttatcccacaagctttcaaggacacatgagaatgcatactggagagaaaccctataaatgtaaagaatgtgggaaggcctttagtcttcacagttcctttcaaagacatacaagaattcacaattatgagaaacctcttgaatgtaagcaatgtggaaaagccttcagtgtgtccacatccttaaaaaaacatatgagaatgcacaatcgatagaaactctataaatgtgagaaataggagaaagttttcaattctaacagatgctttcaaagttgtgaaaattcccactgaagagagaaatcctgtcaatgtaagtaatatagaaagcgagatacaagatgattcatgtatagtcaggtaccacataatcatgtttcagtcagcaatggaccatataggttggtagccccataagattatataacacctaaaacatttctatcaaccgcaatttagtagcagtagtaacaccatagtgcagcacattatttaagtgtttatggtgctggtgtaaacgtgctgcactttcagttgtataaaagtacaagacagcggccggggacggtggctcacgcctgtaatcccagcactttgggaggccaaggcgggcggatcacgaggccaggagatcaagaccatcctggctaacacggtaaaaccccatctctactaaaaatacaaacaattagccgggcgtggtggtgggcgcctgtagtcccagctacttgggaggctgaggcaggagaatggcataaacccaggaggccgagctgacagtgagctgagatccggccaacagagcgagactctgtctcaaaaaaaaaaaaaaaaaaaaagtacaacacagctgggcatggtcacacctgtgatcccaacactgggagactaaggcagtaggattgcttgatgccaggactactctggtcaacctagtgagaccctgtctctacaaaaaataaaaacattttctaagtgtggtagcacaccctgtagtcccatctacatgggaggctgaggcaggaggattgcctgagcccaggagttcaaggctacagtgaaccaagatcacgtgatggcagtccagcatgggtgacagtgagactgtatcaaaaaaaaaaaaaaaaaattggctgggcacagtggctcatacctgtaatcccagcactttgggaggctgaggtgggagaatcagttgaggtcaggagttcaagaccagcctggtcaacatgatgaaaccctgtctccattagaaatacgaaaattagctgggcgttctggtgtgcctgtagtcccagctacttgggaggccaaagcaggagaatcgcttgaacccgggaggtggagattgcagtgagctgagatctaccactacactccagcctgggtgacagagcgagactccgtctcgaaaaaaaaaaaattacagcacagatgtgcaatatatacttgataataaatggctaagttactggtttatatatttacaatcctgttttagaatgtattcctgtgtttttttaacagtaagacagtctcaggcaggtccttaaggagatattcccggaaaaactttgttatgataggcgatgacggctccatgtgcaggactgcccctgaacgtattctggcgggacaaaacatggaggcagaagacaatgatattgatgatcctcaccccgtgtagtcctacactaatgtgtgtttgtgtcttagttagtctttaacaaaaatagtttaaaaaaatttaatagaaaaagcttatagaatatggacataaaatatttttgtacagctgtacaatgtgttttaagctaaattattacaaagtttttaaaaataagtttataaagaaaataatgtacagtaagttaaggtttattcattattgaggaaaaaatgtttttatgaatgtagtgtagtccaagtgtacagtgtttataaattctccattagtgtacagtaacatcctgggccttcgcattcactcaccactcaactgactcacccagagcaacttctagtcctgcaagctatgttcatggagtgtcctatgcaggtgcatccttttttatcttttatactgcatgtttactctgtgtattttctgtgtttagactcataaatacttaacattttgttacaatttcctacagtgttcagtacaacaacatgttgtatggtttatagcctagtagcaatagactgtaccatatagtctagatgtgttgtagctataccatctagatttgtgtaagttcactttgtgatgtttgtaccatgaggaaatcacctacaacacgtttctcagaacatatacccatgattaagcaatctctgcctgtaaaatgctccagaaaattcacaccatgatataaattcatcacacacgatataaaagttaaggcaaggcatggtggctcatgcctgtaatcccagcactttgggaggccaaggcaggcagatcacctgaggtcaggagttcgagaccagcctggccaagacggtgaaaccccatctctactaaaaatacaaaaattacctgagcgtggtggcatgcacctgtaattccagctacttgggaggctgaagcaggagaatcatttgaacctgggaggtggaggctgcagtgagctgagattgtgccactacactccagcctgggcaacagagcaagactccatcccacacaccaaaaaaaagttaaaaattttttatcactggctcattcttcaagtacatctctggactatgaattgtaacttaactacttttccaagaagtcttggaagtgagataattctgtaagtactctttaagcagtggtcaaaagtttaaaaggttgtgttttctcattaaatcagttagtaaaacttt

SEQ ID NO: 3660 - DNA, 1593 bp, Homo sapiens
gcaaatgcgtgctacgtcactgtgcgatcgggttgtgcttagcttggggtctcctggccccttgacgcgtcaggttgctgtacccctgcatcggatgcgctgtaccctgcgctggctccgtgaaccttagggacaacaccgggacacccgcgaggccggaaaatggactcagtggcttttgaggatgtgtctgtgagcttcagccaggaggagtgggctctgctggctccttcacagaagaaactctacagagatgtgatgcaggaaacattcaagaacctggcatctataggggaaaaatgggaagacccgaatgttgaagatcaacacaaaaaccaaggacgaaatctaagaagccatacgggagagagactctgtgaaggtaaagaaggtagtcaatgtgcagaaaacttcagtcccaatctcagtgtgacgaagaagactgccggagtaaaaccatatgagtgtactatctgtggaaaagccttcatgcgtctctcatcccttactagacacatgaggtctcacactggatacgagctatttgagaagccatataaatgtaaggagtctggagaaaaaccctataaatgtaaacaatgtggaaaaaccttcatatatcaccagccctttcaaagacatgagcggactcacattggagaaaaaccctatgaatgtaagcaatgtggaaaagctcttagttgttccagttcgcttcgagttcatgaaaggattcacactggagaaaagccctatgaatgtaaacaatgtgggaaagccttcagttgttccagttctattcgagtacacgaaagaactcacactggagagaaaccctatgcatgtaaggaatgtgggaaagccttcatttcccacacaagtgttctaacacacatgataacacacaacggagatagaccttataaatgcaaagaatgtggaaaggcattcatttttcccagttttttacgagtacatgaaagaattcacactggagagaaaccctataaatgtaaacaatgtggtaaagccttcagatgttccacctccattcaaattcatgaaagaattcatactggagagaagccctataaatgtaaagaatgtgggaaatctttcagtgcacgcccagcctttcgagtacacgtgagagtgcatactggagagaaaccctataagtgtaaagaatgtgggaaagcctttagtagaatcagttactttcgaatacatgaaaggactcacactggagagaaaccctacgaatgtaaaaaatgtgggaaaactttcaattatcctctagatttgaaaatccacaagagaaatcacactggagaaaaaccctatgagtgtaaggactgtgggaaggtgttcatttttcctagtgcgttacgaacacatgaaagaactcacactggagagaaaccctatgaatgtaaacaatgtggaaaagcctttagttgttctagttacattcggatacataaaagaactcacactggggagaaaccttatgaatgtaaggaatgcgggaaggcctttatttatcccacaagctttcaaggacacatgagaatgcatactggagagaaaccc

SEQ ID NO: 3661 - DNA, 2286 bp, Homo sapiens
aaatgcgtgctacgtcactgtgcgatcgggttgtgcttagcttggggtctcctggccccttgacgcgtcaggttgctgtacccctgcatcggatgcgctgtaccctgcgctggctccgtgaaccttagggacaacaccgggacacccgcgaggccggaaaatgatggggtctggctgtgttgctcaggctgatcttgaactcctgggctcaagcgatcctccaccctcagcatcccaaagtgctaggattccaggcatgagctactattaccggcccaacattctcattttctgaaagcaatagactcagtggcttttgaggatgtgtctgtgagcttcagccaggaggagtgggctctgctggctccttcacagaagaaactctacagagatgtgatgcaggaaacattcaagaacctggcatctataggggaaaaatgggaagacccgaatgttgaagatcaacacaaaaaccaaggacgaaatctaagaagccatacgggagagagactctgtgaaggtaaagaaggtagtcaatgtgcagaaaacttcagtcccaatctcagtgtgacgaagaagactgccggagtaaaaccatatgagtgtactatctgtggaaaagccttcatgcgtctctcatcccttactagacacatgaggtctcacactggatacgagctatttgagaagccatataaatgtaaggagtgtgagaaagcctttagttatctcaaatcctttcaaagacatgaaaggagtcacactggagaaaaaccctataaatgtaaacaatgtggaaaaaccttcatatatcaccagccctttcaaagacatgagcggactcacattggagaaaaaccctatgaatgtaagcaatgtggaaaagctcttagttgttccagttcgcttcgagttcatgaaaggattcacactggagaaaagccctatgaatgtaaacaatgtgggaaagccttcagttgttccagttctattcgagtacacgaaagaactcacactggagagaaaccctatgcatgtaaggaatgtgggaaagccttcatttcccacacaagtgttctaacacacatgataacacacaacggagatagaccttataaatgcaaagaatgtggaaaggcattcatttttcccagttttttacgagtacatgaaagaattcacactggagagaaaccctataaatgtaaacaatgtggtaaagccttcagatgttccacctccattcaaattcatgaaagaattcatactggagagaagccctataaatgtaaagaatgtgggaaatctttcagtgcacgcccagcctttcgagtacacgtgagagtgcatactggagagaaaccctataagtgtaaagaatgtgggaaagcctttagtagaatcagttactttcgaatacatgaaaggactcacactggagagaaaccctacgaatgtaaaaaatgtgggaaaactttcaattatcctctagatttgaaaatccacaagagaaatcacactggagaaaaaccctatgagtgtaaggaatgtgcaaaaaccttcatttctcttgagaactttcgaagacacatgatcacccacactggagacggaccttataaatgtagggactgtgggaaggtgttcatttttcctagtgcgttacgaacacatgaaagaactcacactggagagaaaccctatgaatgtaaacaatgtggaaaagcctttagttgttctagttacattcggatacataaaagaactcacactggggagaaaccttatgaatgtaaggaatgcgggaaggcctttatttatcccacaagctttcaaggacacatgagaatgcatactggagagaaaccctataaatgtaaagaatgtgggaaggcctttagtcttcacagttcctttcaaagacatacaagaattcacaattatgagaaacctcttgaatgtaagcaatgtggaaaagccttcagtgtgtccacatccttaaaaaaacatatgagaatgcacaatcgatagaaactctataaatgtgagaaataggagaaagttttcaattctaacagatgctttcaaagttgtgaaaattcccactgaagagagaaatcctgtcaatgtaagtaatatagaaagcgagatacaagatgattcatgtatagtcaggtaccacataatcatgtttcagtcagcaatggaccatataggttggtagccccataagattatataacacctaaaacatttctatcaaccgcaatttagtagcagtagtaa

SEQ ID NO: 3662 - DNA, 1915 bp, Homo sapiens
gcttagcttggggtctcctggccccttgacgcgtcaggttgctgtacccctgcatcggatgcgctgtaccctgcgctggctccgtgaaccttagggacaacaccgggacacccgcgaggccggaaaatggggaaaaatgggaagacccgaatgttgaagatcaacacaaaaaccaaggacgaaatctaagaagccatacgggagagagactctgtgaaggtaaagaaggtagtcaatgtgcagaaaacttcagtcccaatctcagtgtgacgaagaagactgccggagtaaaaccatatgagtgtactatctgtggaaaagccttcatgcgtctctcatcccttactagacacatgaggtctcacactggatacgagctatttgagaagccatataaatgtaaggagtgtgagaaagcctttagttatctcaaatcctttcaaagacatgaaaggagtcacactggagaaaaaccctataaatgtaaacaatgtggaaaaaccttcatatatcaccagccctttcaaagacatgagcggactcacattggagaaaaaccctatgaatgtaagcaatgtggaaaagctcttagttgttccagttcgcttcgagttcatgaaaggattcacactggagaaaagccctatgaatgtaaacaatgtgggaaagccttcagttgttccagttctattcgagtacacgaaagaactcacactggagagaaaccctatgcatgtaaggaatgtgggaaagccttcatttcccacacaagtgttctaacacacatgataacacacaacggagatagaccttataaatgcaaagaatgtggaaaggcattcatttttcccagttttttacgagtacatgaaagaattcacactggagagaaaccctataaatgtaaacaatgtggtaaagccttcagatgttccacctccattcaaattcatgaaagaattcatactggagagaagccctataaatgtaaagaatgtgggaaatctttcagtgcacgcccagcctttcgagtacacgtgagagtgcatactggagagaaaccctataagtgtaaagaatgtgggaaagcctttagtagaatcagttactttcgaatacatgaaaggactcacactggagagaaaccctacgaatgtaaaaaatgtgggaaaactttcaattatcctctagatttgaaaatccacaagagaaatcacactggagaaaaaccctatgagtgtaaggaatgtgcaaaaaccttcatttctcttgagaactttcgaagacacatgatcacccacactggagacggaccttataaatgtagggactgtgggaaggtgttcatttttcctagtgcgttacgaacacatgaaagaactcacactggagagaaaccctatgaatgtaaacaatgtggaaaagcctttagttgttctagttacattcggatacataaaagaactcacactggggagaaaccttatgaatgtaaggaatgcgggaaggcctttatttatcccacaagctttcaaggacacatgagaatgcatactggagagaaaccctataaatgtaaagaatgtgggaaggcctttagtcttcacagttcctttcaaagacatacaagaattcacaattatgagaaacctcttgaatgtaagcaatgtggaaaagccttcagtgtgtccacatccttaaaaaaacatatgagaatgcacaatcgatagaaactctataaatgtgagaaataggagaaagttttcaattctaacagatgctttcaaagttgtgaaaattcccactgaagagagaaatcctgtcaatgtaagtaatatagaaagcgagatacaagatgattcatgtatagtcaggtaccacataatcatgtttcagtcagcaatggaccatatag

SEQ ID NO: 3663 - DNA, 1032 bp, Homo sapiens
ttggctgaacaccagacaacacatcccaggcagaaaccatttgtgtgtgaggaatctggggatgccttcaataacaaatccactcttgttcagcaccagagaatccacagcagagaaaggccttatgaatgcagcaaatgtggaatcttcttcacttacgccgctgacctcactcaacaccagaaagttcacaatagaggaaaaccgtatgagtgctgtgaatgtggaaaattcttcagccagcactccagccttgttaaacatcgcagggttcacaccggtgaaagccctcacgtgtgtggtgactgtgggaaattcttcagccgaagctccaacctcattcagcataagagggttcacactggtgaaaagccatatgagtgcagcgactgtgggaagttcttcagccagcgttccaacctcattcatcataagagggttcatacgggcagaagtgcccatgagtgcagtgaatgtgggaaatctttcaactgcaactccagcctaattaaacattggagagttcacactggagaaagaccttacaagtgtaacgaatgtgggaaattcttcagccacattgccagcctcattcaacatcagatagttcacactggcgagcggcctcacgggtgtggtgagtgtgggaaagccttcagccgaagctctgacctcatgaaacatcagcgagttcacactggtgagcggccttatgaatgcaatgaatgtgggaagttatttagccagagctccagcctcaatagccatcggagacttcacactggtgaacggccttaccagtgcagtgaatgtgggaaattctttaaccaaagctccagcctcaataaccaccggagacttcacaccggcgagcggccttatgagtgcagcgaatgtgggaaaaccttcaggcagaggtccaatctgaggcagcacctgaaagttcacaaaccagacaggccttacgaatgcagcgaatgtgggaaagccttcaaccaaaggcctaccctcattcggcatcagaagattcac

SEQ ID NO: 3664 - DNA, 3888 bp, Homo sapiens
cggggaggctgagtccccaggagctggggaccccgagttgggggcggggcggctggggctacgcccgtgaagctgccccgccggctttcccggaccgcgagggggacagtgaggccgggaccccctccgcgcctttgcaccagccgtgaccccttgcaacgggggtacccagcggagctgcgcgctctcggcgcccccggagcctgcgccccgggccccttgcgcattttgcacgggggagactgaggctaggagtgcgaccctcagcccggggtcacacctcgtctggggcacggccaggtgggtggtagcctcagcctgcgagaccccctacccccgccccgtggtttcccgcaccgtggggccctgctctgaccacagactccgatggcagcggcggcgctgcgggaccccgcgcagggctgcgtgacctttgaggacgtgaccatttacttctcccaggaggagtgggtgctcctcgatgaggctcagagactcctgtactgcgatgtgatgctggaaaactttgcacttatagcctcgctgggacttatatctttcaggtcccacatcgtttcccagttggagatggggaaagagccctgggtgcctgacagtgtggatatgacatcagccatggccagaggggcttatggcaggcctggctctgatttttgccatggaacagagggcaaggacttaccttctgagcataacgtttctgtagaaggagtggcacaggacaggagtcccgaggcaactctgtgcccccagaagacctgcccctgtgacatatgtggcctacgtttgaaagacattttgcatttggctgaacaccagacaacacatcccaggcagaaaccatttgtgtgtgaggcatatgtgaaaggctctgagttcagtgcaaaccttccccggaaacaggtgcagcagaacgtacacaaccctatcagaacggaggagggccaggcttcccctgtaaagacctgcagagaccacacatcagatcagctttccacctgcagggagggtgggaaggactttgtggccacagcagggtttctgcagtgtgaggtcactcccagcgatggggagccgcacgaggccaccgaaggtgtggtggattttcacattgcactaaggcataacaagtgctgtgaatctggggatgccttcaataacaaatccactcttgttcagcaccagagaatccacagcagagaaaggccttatgaatgcagcaaatgtggaatcttcttcacttacgccgctgacctcactcaacaccagaaagttcacaatagaggaaaaccgtatgagtgctgtgaatgtggaaaattcttcagccagcactccagccttgttaaacatcgcagggttcacaccggtgaaagccctcacgtgtgtggtgactgtgggaaattcttcagccgaagctccaacctcattcagcataagagggttcacactggtgaaaagccatatgagtgcagcgactgtgggaagttcttcagccagcgttccaacctcattcatcataagagggttcatacgggcagaagtgcccatgagtgcagtgaatgtgggaaatctttcaactgcaactccagcctaattaaacattggagagttcacactggagaaagaccttacaagtgtaacgaatgtgggaaattcttcagccacattgccagcctcattcaacatcagatagttcacactggcgagcggcctcacgggtgtggtgagtgtgggaaagccttcagccgaagctctgacctcatgaaacatcagcgagttcacactggtgagcggccttatgaatgcaatgaatgtgggaagttatttagccagagctccagcctcaatagccatcggagacttcacactggtgaacggccttaccagtgcagtgaatgtgggaaattctttaaccaaagctccagcctcaataaccaccggagacttcacaccggcgagcggccttatgagtgcagcgaatgtgggaaaaccttcaggcagaggtccaatctgaggcagcacctgaaagttcacaaaccagacaggccttacgaatgcagcgaatgtgggaaagccttcaaccaaaggcctaccctcattcggcatcagaagattcacatcagagaaaggagcatggagaatgtgctccttccctgttcacagcacacaccagagataagctctgagaacagaccttatcagggcgctgtcaactacaagttgaaacttgttcatccaagtacccaccctggggaggttccctaggaatgctagctgtgttggaagctttctggagacaagttacattctcttactgtagagtttatcagcgttttttcactgctggggttgtgatagaagccatgtcagcaccacacactgcagctctccaaagagtgtgtccaccactccactgtgctcagggaaggcagacctctcctctctctttccaatccctaaagggaattaggagtagtctgaagccttgggaagatgtcattcccgccctgtatggctggtttagccatggacatgaccagcttttggctgtgaagacctgagcagggttttgccaacagcttgttctagagaaggtttccctttttctgggacattgttggtctcatgttatgcctgtgaaggatttgtccagccttcatgttactctacacaacaacttatctcctgtgtattgccctggttcatgtgatgataatggccttatgataaagccgcctttagtcttccatgttctgatcactgtgtggggtggttcaagagcagagttaagatctaccaaactgaaggggtctccagattatcttggaggggacaggaggatggcagagaaacaactgtcaatccagatttgacctcatttgcattgccaccaaggcctcctaggaaaaattgtaggaatttatgggtataatattgtggtctgaatggcgtgaatttttatcccgaggagggggcagttgtgacaacctccagtgcatgtgggaacagcatgaattgggtcccttattcccagggggtgccccatattccccaatactgtaaagcagatgctgtttagcacctgccaaggagccatatgccctgaagttcagcattaggcaggtatctcttaactgtaagacataccaggcccagctgggaccataatttgtacagaaacactggatgtgattaatagggagtaggcgagattatagcaaaccagcagaaatggaactctgctaaatgtgcatccgtgaatgctcccttgaatgtggctgtgcaggattcagggtttgcagaaattctcaggacctcagacctctgtcctatgactaatgttactggcagagcaaataatctaaaggttttggttttgtggattaccatctccgtgctgtgcatctgaaggccagtgctgtgctggcaggaaaatagggactgagaaaaagcagatcctatactatagggactgtagtatctatgacgtagccagccattctttgctcccaaggcaagaagaaagagatgacagagtcaatatagggttgccaaatcggattttctaaaatgagtaggaagttggatttttatgtgcaacagtttcttttaatgctttgttgatatgtgattgtcatgcaataattattcatatttggtaagttttgtacatatattatgtacactcagggaaccaataccataatcatgataatgaacgtatccatcacctgcaaagctacctcatgcccctttacattccctccttgccttccctaggaaaccgttgatttacattttttactttagatttgtttgccttttctagaattaacacaattggaatcataaagtatttatactctc

SEQ ID NO: 3665 - DNA, 3036 bp, Homo sapiens
aagggctactccgggatctacggacccgggttcccctggcgtaggtcggccctcggccgcagggtggggctgggcatgcagccgggaccccgggcgtcctgtcccgttcctgcgcggcgactgcggccccggcgccctctctgggcagctccgcgcccgcagcctcgcgtctcccgagattgtgcggctgtaagcaacacaggttcgcggcccgactcactgcaccgagacgctgagggctgcagcagaaacagtttaatagccagagaggggaggacaccccagatccgcctccctgagggatttggggtctggacgggggcggctgggtgtagggtcgttggttggtggggaagtgaggggtgaatcctgggacaggaggtgaagaaaccgcattctgctgaatgggctccctcgttgggacttcaacctgattggcgccagcctttgctgggattcaggatctgagaactccggcgactcttgagcagttctcagagatcttatccccaggcacaatggggaagccggcggtcagcgtctgctgtgacctgactctcagggaggcggccccttgaggcagcggggctgagggcacctggttaatatctaactgcaatctcgcctccagcctggctcgcagttcctgtgaacccggcctcagtggctttagaggatgtggctgtgaacttcacccgagaagagtgggctttgctgggtccttgtcagaagaatctctacaaagatgtgatgcaggaaaccatcaggaacctggattgtgtaggaatgaaatggaaagaccagaacattgaagatcaatatagatatcccaggaaaaatctaagatgtcgtatgttagagagatttgttgaaagtaaagatggaactcaatgtggagaaacatctagccagattcaagatagtattgtgaccaagaacactcttcctggagtaggtccatatgaaagccgtatgagtggagaagtcatcatgggtcattcatcccttaattgttacatcagagttggtgctgggcacaaaccatatgagtatcatgaatgtggagagaagccagatacgcataaacaacgtgggaaagccttcagttaccacaactcacttcaaacacatgagaggcttcacactggaaagaaaccatataattgtaaagaatgtgggaagtccttcagttctttgggaaaccttcaaagacacatggcagtgcagcgtggagatggaccttataaatgtaagttgtgtgggaaagcgtttttttggcccagtttattacatatgcatgagagaacgcacactggagagaaaccatatgaatgtaagcagtgttctaaagccttttctttttacagttcctatctaagacatgaaagaacacatactggggagaaactgtatgaatgtaaacagtgttctaaagccttccctgattacagttcttgtctaagacatgaaagaactcacactggaaagaaaccctatacatgtaaacaatgtgggaaagccttcagtgcttccacttcccttcgaagacacgaaacaactcacactgatgagaaaccctatgcatgtcagcaatgtgggaaagcgtttcatcatctgggaagctttcaaagacacatggtaatgcacacgagagatggacctcataagtgtaagatatgtggaaaaggctttgattgtcctagttcactgaaaagtcatgaaagaactcacactggagagaaactctatgaatgcaagcagtgtgggaaagcgttatctcatagctcaagctttcgaagacacatgacaatgcacactggagatggacctcacaaatgcaagatatgtgggaaagcctttgtttatcccagtgtatttcaaaggcatgaaaagactcacactgcagagaaaccctataaatgtaaacaatgtggcaaagcctaccgtatttccagttctcttcgaaggcatgaaacaactcatactggagagaaaccctataaatgcaaatgtgggaaagcctttattgatttctattcctttcaaaatcacaaaacaactcatgctggagagaagccatatgagtgtaaggaatgtgggaaagcattcagttgtttccaatacctttctcaacatagaaggactcacacaggagagaaaccttatgagtgtaacacatgtaagaaagccttcagtcattttggtaacttaaaagtacatgaaagaattcactctggagagaagccgtatgaatgtaaggaatgtgggaaagcattctcttggctcacttgctttctacgacatgaaagaattcacatgagagagaaaccctatgagtgtcaacaatgtggtaaagccttcactcattcccgttttcttcaaggacatgaaaaaactcatactggagagaacccgtatgaatgtaaggaatgtgggaaagcatttgcttctctcagttccttgcatagacataaaaagactcactggaaaaaaactcacactggagagaacccgtatggatgtaaggaatgtgggaaagcatttgcttctctcagttccttgcatagacataaaaagactcactagcattctctctaaatgtatggaatgtgggaaagcatttattaattttatttcatttcagatacttgtacgaaacacattggagatagaccctgtgaatgtaagcacttggtaaaaccttaagtaatttcagtttctttccagtacagtcatcccttgatacctgctgggtattggttccagcactccgtgagccatgtccagtcccttttataaaatgacatatttgtatgtaacttacccacatcctcttgtatactctcaattatgtctagattacttaaaatacctcatgcattgtaaaagctatgcaaatagttgttctattgtattgtttagggactcatgataaggaaaagagtctatgtattttcagtatagatgcagtaattgtcagcctatcaacatagtatagtcagccagaacattaaagtttctttgtttcaactctca

SEQ ID NO: 3666 - DNA, 2133 bp, Homo sapiens
gtcaatcaggcgcgcttcccagaggagtgtgtggttgaaaaagcccgcggcgtcttctccacccacctgcgctgggcgctcggtgctcggctctgtagctaagagacgacctggaagttccgtggcagcctgtgtcccgcgggaacccgcattggcagcgggagccgtccggaggacctgggacaccgcggaagtcgggaaatggcctcagtggctttagaggatgtggctgtgaacttcacccgagaagagtgggctttgctgggtccttgtcagaagaatctctacaaagatgtgatgcaggaaaccatcaggaacctggattgtgtaggaatgaaatggaaagaccagaacattgaagatcaatatagatatcccaggaaaaatctaagatgtcgtatgttagagagatttgttgaaagtaaagatggaactcaatgtggagaaacatctagccagattcaagatagtattgtgaccaagaacactcttcctggagtaggtccatatgaaagccgtatgagtggagaagtcatcatgggtcattcatcccttaattgttacatcagagttggtgctgggcacaaaccatatgagtatcatgaatgtggagagaagccagatacgcataaacaacgtgggaaagccttcagttaccacaactcacttcaaacacatgagaggcttcacactggaaagaaaccatataattgtaaagaatgtgggaagtccttcagttctttgggaaaccttcaaagacacatggcagtgcagcgtggagatggaccttataaatgtaagttgtgtgggaaagcgtttttttggcccagtttattacatatgcatgagagaacgcacactggagagaaaccatatgaatgtaagcagtgttctaaagccttttctttttacagttcctatctaagacatgaaagaacacatactggggagaaactgtatgaatgtaaacagtgttctaaagccttccctgattacagttcttgtctaagacatgaaagaactcacactggaaagaaaccctatacatgtaaacaatgtgggaaagccttcagtgcttccacttcccttcgaagacacgaaacaactcacactgatgagaaaccctatgcatgtcagcaatgtgggaaagcgtttcatcatctgggaagctttcaaagacacatggtaatgcacacgagagatggacctcataagtgtaagatatgtggaaaaggctttgattgtcctagttcactgaaaagtcatgaaagaactcacactggagagaaactctatgaatgcaagcagtgtgggaaagcgttatctcatagctcaagctttcgaagacacatgacaatgcacactggagatggacctcacaaatgcaagatatgtgggaaagcctttgtttatcccagtgtatttcaaaggcatgaaaagactcacactgcagagaaaccctataaatgtaaacaatgtggcaaagcctaccgtatttccagttctcttcgaaggcatgaaacaactcatactggagagaaaccctataaatgcaaatgtgggaaagcctttattgatttctattcctttcaaaatcacaaaacaactcatgctggagagaagccatatgagtgtaaggaatgtgggaaagcattcagttgtttccaatacctttctcaacatagaaggactcacacaggagagaaaccttatgagtgtaacacatgtaagaaagccttcagtcattttggtaacttaaaagtacatgaaagaattcactctggagagaagccgtatgaatgtaaggaatgtgggaaagcattctcttggctcacttgctttctacgacatgaaagaattcacatgagagagaaaccctatgagtgtcaacaatgtggtaaagccttcactcattcccgttttcttcaaggacatgaaaaaactcatactggagagaacccgtatgaatgtaaggaatgtgggaaagcatttgcttctctcagttccttgcatagacataaaaagactcactggaaaaaaactcacactggagagaacccgtatggatgtaaggaatgtgggaaagcatttgcttctctcagttccttgcatagacataaaaagactcactag

SEQ ID NO: 3667 - DNA, 4203 bp, Homo sapiens
tgtcgctgccggagagtctctgcttcccccttcctacgcgctccgcggcggtagctcgggctctccggaggagggggcgacagagtaaaagagaggctgacttaataaagtttcctgaaacaacaactaccaccgaaaaggcccaaggttgggggagacccccatttttctccgcccctctcctaaagcctgagggaccgttgcaggtggagcggcgctggtgggacccgggttgcggcggcagccgttgccccggcgagggaagcctcaggtcctgcccgctccggttccggctccttcggtggtggcggcggcagctgctgccgggcggttcctcctgtcaactgcctccgcccgcgcgcctcccgcctagccacacagcgcggaggacgccgtgagccgccgccgcagtcgtctcggcccgcggagggacgtggtgagctgtggcgcttccgcgtcagcgccggcggggactctttgggagcgcgtcgggcccgagtccgggttcccccgcgtggtcagcggaggctgcgccaggtggggcccgcagccgcctcccacgccaggctgtccccgcggccgcccggcctgccttccttccttccgcccgcccgccggcccgccctaagagttgaccacgccgcaatgaagagcttcttacagtgaaagcaaagtaggtcgagtccactgaaaatgcctttaagggacaaatactgtcagactgaccaccatcatcacggatgctgtgaaccagtttatatcctggaacctggagatcctcctttgttacagcaaccactacagacatccaaatctggtattcaacaaataattgagtgctttcgatcaggaactaaacaacttaagcatattttattaaaagatgtggacactatttttgaatgtaagttatgccgcagtctcttcagaggattaccaaatttaattacccataaaaaattctactgcccaccaagtctccagatggatgacaaccttcctgatgtaaatgataaacaaagccaagccataaatgatctcctagaagccatatatccaagtgtggacaaacgagaatatattattaagctagaacccatagaaactaatcaaaatgcagtatttcaatatatttcgaggactgataatcctattgaagtcacagagtcaagcagtactcctgaacaaaccgaagttcagatacaggaaactagcactgaacagtcaaaaacagtaccggttacagatacagaggtggaaactgtagagccccctcctgttgagattgttacagatgaagttgcacctacatctgatgaacaacctcaggagtcgcaggctgacttggaaacttctgacaattctgattttggtcaccagttgatatgttgtctttgtagaaaagaattcaattctagacgaggtgttcgccgtcacattcgaaaagtacacaagaaaaagatggaagaactaaaaaagtacattgaaacacgaaagaatccaaaccaatcctctaaaggacgcagtaagaatgttctagttccattaagtaggagttgtccagtatgttgtaaatcatttgctacaaaagcgaatgtaaggaggcattttgatgaagttcatagaggactaaggagggattcaattactcctgatatagcaacaaagcctgggcaacctttgttcctggattctatttctcctaaaaaatcttttaagactcgaaaacaaaagtcttcttcaaaggctgaatacaatttaactgcatgcaaatgcctcctttgcaagaggaaatatagttcacaaataatgcttaaaagacatatgcaaattgtccacaagataactctttctggaacaaactctaaaagagaaaaaggccctaataatactgccaacagttcagaaataaaagttaaagttgaaccagcagattctgtagaatcttcacccccttccattacccattctccacagaatgaattaaagggaacaaatcattcaaatgaaaaaaagaacacaccggcagcacagaaaaataaagttaaacaagactctgaaagccctaaatcaactagtccgtcggctgcaggtggccagcaaaaaaccagaaaaccaaaactttcagctggctttgactttaagcaactttactgtaaactttgtaaacgtcagtttacttccaaacagaacttgactaaacacatcgagttgcacacagatggaaataacatttatgttaaattctacaagtgtcctctttgcacttatgaaactcgtcggaaacgtgatgtgatacgacatataactgtggttcataaaaagtcatctcgttatcttgggaaaataacagccagtttagagatcagagctataaaaaagcctattgattttgttctaaataaagtggcaaaaagaggcccttcgagggatgaagcaaaacatagtgattcaaaacatgatggcacttctaactctcctagtaaaaagtatgaagtagctgacgtcggtattgaagtaaaagtcacaaaaaacttttctcttcacagatgcaataaatgtggaaaggcatttgccaaaaagacttaccttgaacatcataagaaaactcataaggcaaatgcttccaattcacctgaaggaaacaaaaccaaaggccgaagtacaagatctaaggctcttgtctgataacttcaagtgatgtacgaaaaggtttggagttcatttttgtggaaagactttaaattggtgttagaaccactaaacatcttcaaatggtactatgaggaaaaaaagaaaaacatttttctaaatattcaactataactgctgttttctgactaaaataaccatctaaccacttgtttctaaggcactgcctattccagcactttcaagtagctgtgatattacatgttgtcatcacagtccatcagctatccacccttgaccttgtgcatttggtcgacagtttctacaaaaatgttacaaattttgttttctaaacaatttgttgattaagtgatcaacaacctgaagaaaatatcaatttttaattgacaaagactttatatcttagtgattttagttttgtttctctttatttggcaacattttcatctgaattgtatagatatatgattttctagtgagtgtatgttaggaacaaaagacaaaatagtatcaacacattataaatatttagcttactaaatatttgtaattatttttacatccatttatttctagcttgttctccagcacttcagtgtttgaaagtttcatcctaaaatatatactacaggaaagctgcagttcattttcatgcatggatcattacatttttcacttgtaaatgtaggtttttatgaaaattaaacattcccctatttttctttaaattttatacaaagcactttaatgatagatgcaaccttatttttcagttcctatttttttaaagaccacacatttactaatgttaatatgaaggtaataaatagcttactgatattttatggatgcagacaatccatgcacaaccacttcttatgatactagtttatttccttaaatattgctacaaaaggaagatgcgggtgtaagccctgatttttttttctcccaagaaaaatcttaaaggaccactttagataatatttgattcctactgtaaaatttagaaaatgatgaattcttgtccatttttgtaatcaagattttaggaaaaacagaagtacatctatctttatgaaattttgggcaggtttttgtgtatcaatattttgtacttttagggaatattttattttttagttatttgtgtcaaattataattataaaaggtacagcagaaaatataccatgtttttatataggttcacacctgtacttaggagggaccctgtccatctatatactttttgtataaaattttaaaatgttaaagatccacaaggtcttaataaaatgattctatagctagaaaaacatttaccttcccagtgctttgcactaaaatatactgtgaaaggaaactagaaagactgtaactattgctggaaatgttctatattgaatgtacatgctcttgttggaaaaatgtactatatgtgatggaaataaaccagaatcgaagttatttcagctaaatgtgcttcagcaaaggtgcattggttgaaacttaaatgttttattatcaaa

SEQ ID NO: 3668 - DNA, 2375 bp, Homo sapiens
cggttcctcctgtcaactgcctccgcccgcgcgcctcccgcctagccacacagcgcggaggacgccgtgagccgccgccgcagtcgtctcggcccgcggagggacgtgccacgccgcaatgaagagcttcttacagtgaaagcaaagtaggtcgagtccactgaaaatgcctttaagggacaaatactgtcagactgaccaccatcatcacggatgctgtgaaccagtttatatcctggaacctggagatcctcctttgttacagcaaccactacagacatccaaatctggtattcaacaaataattgagtgctttcgatcaggaactaaacaacttaagcatattttattaaaagatgtggacactatttttgaatgtaagttatgccgcagtctcttcagaggattaccaaatttaattacccataaaaaattctactgcccaccaagtctccagatggatgacaaccttcctgatgtaaatgataaacaaagccaagccataaatgatctcctagaagccatatatccaagtgtggacaaacgagaatatattattaagctagaacccatagaaactaatcaaaatgcagtatttcaatatatttcgaggactgataatcctattgaagtcacagagtcaagcagtactcctgaacaaaccgaagttcagatacaggaaactagcactgaacagtcaaaaacagtaccggttacagatacagaggtggaaactgtagagccccctcctgttgagattgttacagatgaagttgcacctacatctgatgaacaacctcaggagtcgcaggctgacttggaaacttctgacaattctgattttggtcaccagttgatatgttgtctttgtagaaaagaattcaattctagacgaggtgttcgccgtcacattcgaaaagtacacaagaaaaagatggaagaactaaaaaagtacattgaaacacgaaagaatccaaaccaatcctctaaaggacgcagtaagaatgttctagttccattaagtaggagttgtccagtatgttgtaaatcatttgctacaaaagcgaatgtaaggaggcattttgatgaagttcatagaggactaaggagggattcaattactcctgatatagcaacaaagcctgggcaacctttgttcctggattctatttctcctaaaaaatcttttaagactcgaaaacaaaagtcttcttcaaaggctgaatacaatttaactgcatgcaaatgcctcctttgcaagaggaaatatagttcacaaataatgcttaaaagacatatgcaaattgtccacaagataactctttctggaacaaactctaaaagagaaaaaggccctaataatactgccaacagttcagaaataaaagttaaagttgaaccagcagattctgtagaatcttcacccccttccattacccattctccacagaatgaattaaagggaacaaatcattcaaatgaaaaaaagaacacaccggcagcacagaaaaataaagttaaacaagactctgaaagccctaaatcaactagtccgtcggctgcaggtggccagcaaaaaaccagaaaaccaaaactttcagctggctttgactttaagcaactttactgtaaactttgtaaacgtcagtttacttccaaacagaacttgactaaacacatcgagttgcacacagatggaaataacatttatgttaaattctacaagtgtcctctttgcacttatgaaactcgtcggaaacgtgatgtgatacgacatataactgtggttcataaaaagtcatctcgttatcttgggaaaataacagccagtttagagatcagagctataaaaaagcctattgattttgttctaaataaagtggcaaaaagaggcccttcgagggatgaagcaaaacatagtgattcaaaacatgatggcacttctaactctcctagtaaaaagtatgaagtagctgacgtcggtattgaagtaaaagtcacaaaaaacttttctcttcacagatgcaataaatgtggaaaggcatttgccaaaaagacttaccttgaacatcataagaaaactcataaggcaaatgcttccaattcacctgaaggaaacaaaaccaaaggccgaagtacaagatctaaggctcttgtctgataacttcaagtgatgtacgaaaaggtttggagttcatttttgtggaaagactttaaattggtgttagaaccactaaacatcttcaaatggtactatgaggaaaaaaagaaaaacatttttctaaatattcaactataactgctgttttctgactaaaataaccatctaaccacttgtttctaaggcactgcctattccagcactttcaagtagc

SEQ ID NO: 3669 - DNA, 4358 bp, Homo sapiens
cgctgccggagagtctctgcttcccccttcctacgcgctccgcggcggtagctcgggctctccggaggagggggcgacagagtaaaagagaggctgacttaataaagtttcctgaaacaacaactaccaccgaaaaggcccaaggttgggggagacccccatttttctccgcccctctcctaaagcctgagggaccgttgcaggtggagcggcgctggtgggacccgggttgcggcggcagccgttgccccggcgagggaagcctcaggtcctgcccgctccggttccggctccttcggtggtggcggcggcagctgctgccgggcggttcctcctgtcaactgcctccgcccgcgcgcctcccgcctagccacacagcgcggaggacgccgtgagccgccgccgcagtcgtctcggcccgcggagggacgtggtgagctgtggcgcttccgcgtcagcgccggcggggactctttgggagcgcgtcgggcccgagtccgggttcccccgcgtggtcagcggaggctgcgccagccacgccgcaatgaagagcttcttacagtgaaagcaaagtaggtcgagtccactgaaaatgcctttaagggacaaatactgtcagactgaccaccatcatcacggatgctgtgaaccagtttatatcctggaacctggagatcctcctttgttacagcaaccactacagacatccaaatctggtattcaacaaataattgagtgctttcgatcaggaactaaacaacttaagcatattttattaaaagatgtggacactatttttgaatgtaagttatgccgcagtctcttcagaggattaccaaatttaattacccataaaaaattctactgcccaccaagtctccagatggatgacaaccttcctgatgtaaatgataaacaaagccaagccataaatgatctcctagaagccatatatccaagtgtggacaaacgagaatatattattaagctagaacccatagaaactaatcaaaatgcagtatttcaatatatttcgaggactgataatcctattgaagtcacagagtcaagcagtactcctgaacaaaccgaagttcagatacaggaaactagcactgaacagtcaaaaacagtaccggttacagatacagaggtggaaactgtagagccccctcctgttgagattgttacagatgaagttgcacctacatctgatgaacaacctcaggagtcgcaggctgacttggaaacttctgacaattctgattttggtcaccagttgatatgttgtctttgtagaaaagaattcaattctagacgaggtgttcgccgtcacattcgaaaagtacacaagaaaaagatggaagaactaaaaaagtacattgaaacacgaaagaatccaaaccaatcctctaaaggacgcagtaagaatgttctagttccattaagtaggagttgtccagtatgttgtaaatcatttgctacaaaagcgaatgtaaggaggcattttgatgaagttcatagaggactaaggagggattcaattactcctgatatagcaacaaagcctgggcaacctttgttcctggattctatttctcctaaaaaatcttttaagactcgaaaacaaaagtcttcttcaaaggctgaatacaatttaactgcatgcaaatgcctcctttgcaagaggaaatatagttcacaaataatgcttaaaagacatatgcaaattgtccacaagataactctttctggaacaaactctaaaagagaaaaaggccctaataatactgccaacagttcagaaataaaagttaaagttgaaccagcagattctgtagaatcttcacccccttccattacccattctccacagaatgaattaaagggaacaaatcattcaaatgaaaaaaagaacacaccggcagcacagaaaaataaagttaaacaagactctgaaagccctaaatcaactagtccgtcggctgcaggtggccagcaaaaaaccagaaaaccaaaactttcagctggctttgactttaagcaactttactgtaaactttgtaaacgtcagtttacttccaaacagaacttgactaaacacatcgagttgcacacagatggaaataacatttatgttaaattctacaagtgtcctctttgcacttatgaaactcgtcggaaacgtgatgtgatacgacatataactgtggttcataaaaagtcatctcgttatcttgggaaaataacagccagtttagagatcagagctataaaaaagcctattgattttgttctaaataaagtggcaaaaagaggcccttcgagggatgaagcaaaacatagtgattcaaaacatgatggcacttctaactctcctagtaaaaagtatgaagtagctgacgtcggtattgaagtaaaagtcacaaaaaacttttctcttcacagatgcaataaatgtggaaaggcatttgccaaaaagacttaccttgaacatcataagaaaactcataaggcaaatgcttccaattcacctgaaggaaacaaaaccaaaggccgaagtacaagatctaaggctcttgtctgataacttcaagtgatgtacgaaaaggtttggagttcatttttgtggaaagactttaaattggtgttagaaccactaaacatcttcaaatggtactatgaggaaaaaaagaaaaacatttttctaaatattcaactataactgctgttttctgactaaaataaccatctaaccacttgtttctaaggcactgcctattccagcactttcaagtagctgtgatattacatgttgtcatcacagtccatcagctatccacccttgaccttgtgcatttggtcgacagtttctacaaaaatgttacaaattttgttttctaaacaatttgttgattaagtgatcaacaacctgaagaaaatatcaatttttaattgacaaagactttatatcttagtgattttagttttgtttctctttatttggcaacattttcatctgaattgtatagatatatgattttctagtgagtgtatgttaggaacaaaagacaaaatagtatcaacacattataaatatttagcttactaaatatttgtaattatttttacatccatttatttctagcttgttctccagcacttcagtgtttgaaagtttcatcctaaaatatatactacaggaaagctgcagttcattttcatgcatggatcattacatttttcacttgtaaatgtaggtttttatgaaaattaaacattcccctatttttctttaaattttatacaaagcactttaatgatagatgcaaccttatttttcagttcctatttttttaaagaccacacatttactaatgttaatatgaaggtaataaatagcttactgatattttatggatgcagacaatccatgcacaaccacttcttatgatactagtttatttccttaaatattgctacaaaaggaagatgcgggtgtaagccctgatttttttttctcccaagaaaaatcttaaaggaccactttagataatatttgattcctactgtaaaatttagaaaatgatgaattcttgtccatttttgtaatcaagattttaggaaaaacagaagtacatctatctttatgaaattttgggcaggtttttgtgtatcaatattttgtacttttagggaatattttattttttagttatttgtgtcaaattataattataaaaggtacagcagaaaatataccatgtttttatataggttcacacctgtacttaggagggaccctgtccatctatatactttttgtataaaattttaaaatgttaaagatccacaaggtcttaataaaatgattctatagctagaaaaacatttaccttcccagtgctttgcactaaaatatactgtgaaaggaaactagaaagactgtaactattgctggaaatgttctatattgaatgtacatgctcttgttggaaaaatgtactatatgtgatggaaataaaccagaatcgaagttatttcagctaaatgtgcttcagcaaaggtgcattggttgaaacttaaatgttttattatcaaatttaaacttattcagtgactatgagcagctacacttgaattatattctgatagttttatttctaagaaatagagtaataatttctctttaatttaaaaacagatttactttcccacatattgaaaatttgtacttatagatctaactttaataactaatagtataatatatttagggaactaaatgtgtaggtggtatttcatttataagccatcttcattagttgcacattattaaacctatatgtttgactttt

SEQ ID NO: 3670 - DNA, 955 bp, Homo sapiens
gtccggggtcagtcagtcgctccctgtcgctgccggagagtctctgcttcccccttcctacgcgctccgcggcggtagctcgggctctccggaggagggggcgacagagtaaaagagaggctgacttaataaagtttcctgaaacaacaactaccaccgaaaaggcccaagccacgccgcaatgaagagcttcttacagtgaaagcaaagtaggtcgagtccactgaaaatgcctttaagggacaaatactgtcagactgaccaccatcatcacggatgctgtgaaccagtttatatcctggaacctggagatcctcctttgttacagcaaccactacagacatccaaatctggtattcaacaaataattgagtgctttcgatcaggaactaaacaacttaagcatattttattaaaagatgtggacactatttttgaatgtaagttatgccgcagtctcttcagaggattaccaaatttaattacccataaaaaattctactgcccaccaagtctccagatggatgacaaccttcctgatgtaaatgataaacaaagccaagccataaatgatctcctagaagccatatatccaagtgtggacaaacgagaatatattattaagctagaacccatagaaactaatcaaaatgcagtatttcaatatatttcgaggactgataatcctattgaagtcacagagtcaagcagtactcctgaacaaaccgaagttcagatacaggaaactagcactgaacagtcaaaaacagtaccggttacagatacagaggtggaaactgtagagccccctcctgttgagattgttacagatgaagttgcacctacatctgatgaacaacctcaggagtcgcaggctgacttggaaacttctgacaattctgattttggtcaccagttgatatgttgtctttgtagaaaagaattcaattctaga

SEQ ID NO: 3671 - DNA, 502 bp, Homo sapiens
cggccgcccggcctgccttccttccttccgcccgcccgccggcccgccctaagaccacgccgcaatgaagagcttcttacagtgaaagcaaagtaggtcgagtccactgaaaatgcctttaagggacaaatactgtcagactgaccaccatcatcacggatgctgtgaaccagtttatatcctggaacctggagatcctcctttgttacagcaaccactacagacatccaaatctggtattcaacaaataattgagtgctttcgatcaggaactaaacaacttaagcatattttattaaaagatgtggacactatttttgaatgtaagttatgccgcagtctcttcagaggattaccaaatttaattacccataaaaaattctactgcccaccaagtctccagatggatgacaaccttcctgatgtaaatgataaacaaagccaagccataaatgatctcctagaagccatatatccaagtgtggacaaacgagaatatatt

SEQ ID NO: 3672 - DNA, 410 bp, Homo sapiens
tcaagcaagccacctgaaaaagatcacaagctgaaaaaagataaggtgtatgtaaaccacgccgcaatgaagagcttcttacagtgaaagcaaagtaggtcgagtccactgaaaatgcctttaagggacaaatactgtcagactgaccaccatcatcacggatgctgtgaaccagtttatatcctggaacctggagatcctcctttgttacagcaaccactacagacatccaaatctggtattcaacaaataattgagtgctttcgatcaggaactaaacaacttaagcatattttattaaaagatgtggacactatttttgaatgtaagttatgccgcagtctcttcagaggattaccaaatttaattacccataaaaaattctactgcccaccaagtctccagatgga

SEQ ID NO: 3673 - DNA, 9999 bp, Homo sapiens
tggcggcgctggggaaatgagcaggtaggaggccgacagcgacctccgcgtctcggagcgaaccgtgagcctccccgtaacgagagagtttgactgtcagccaaggtcaccgggcccggcgcagggaaggggtggggctcggctgagcccgcgagacccgccctgctcgccgcagcccccgccccgctagggccacagggtcccggtatggcgatggctttgacggacccggcgcagggtgtcctgttcccagacctgagctgatctaccacctagagcatgggcaggagccatggaccaggaaggaagacctctcccaaggcacctgtccaggtgacaaaggaaaacccaagagcacagaacctaccacctgtgagctagccttgtctgaaggaatctctttttggggacaactaacacaaggagcttcaggggactcccagttggggcaacccaaggatcaggatgggttttcagaaatgcagggagaacgcttgagaccagggttagattcccaaaaggagaagcttcctggaaaaatgagccccaaacatgatggtttagggacagctgatagtgtgtgttcaaggattatacaggatcgagtctccttaggagatgatgtccatgactgtgactcacatggatcaggtaaaaatccagttattcaggaagaggaaaatatctttaaatgcaatgaatgtgaaaaagtgtttaacaagaaacgcctgcttgctcggcatgagaggattcactctggagtgaagccctatgaatgcacagagtgtggaaaaacctttagcaagagtacatacctcctgcagcaccacatggtccacactggggagaagccctataagtgcatggagtgtgggaaggcttttaatcggaagtcacaccttacccagcaccagcggattcacagtggagagaagccttataagtgcagtgaatgtggaaaggccttcacccaccgctccacttttgtcttgcataacaggagccacactggagaaaaaccctttgtgtgcaaagagtgtggcaaagcctttcgagataggccaggtttcattcgacactacatcatccacagtggtgagaatccctacgagtgcttcgaatgtggcaaggtcttcaaacacagatcatacctcatgtggcaccagcagactcataccggggagaagccctatgagtgcagtgaatgtgggaaggccttctgtgagagcgcagcgctgattcaccactatgtcatccacactggagagaagccctttgagtgcctcgagtgtgggaaggctttcaaccaccgatcctacctcaaaaggcaccagcggattcacactggggagaagccatatgtgtgtagtgaatgcggaaaggccttcacccactgctctactttcatcttgcataaaagggcccacactggagaaaaacctttcgagtgcaaagagtgtgggaaagcctttagcaatagggcagacctcattcgccacttcagcatccacactggagagaagccctatgagtgcatggagtgtggaaaggccttcaaccgcaggtcaggcctcacaaggcaccagcggattcatagtggagagaagccctatgaatgcatcgagtgtgggaaaacattttgctggagcacaaacctcattcgacactctatcatccacactggagagaagccgtatgagtgcagtgaatgtggaaaggccttcagtcgcagctcgtccctcactcagcatcaaaggatgcatactgggagaaatcctatcagtgtaacagatgtgggaagaccttttacaagtgggcagacctcagtcaacatccaagaacttttattggggaaaaactttttgaatgtcaccactgaggaaaatcttttgcaagaggaagcatcttacatggcatctgatcgtacataccaaagagaaaccccacaagtgtcttcactgtgagaaaaccttctgttgccaaatgtcatttgtcacctaaggagtcatattagaaaatcacgcagcttagagccttattctccatccgaattcatcctggaaaaacacccagtggttattacgcacttgggaaaacctttagctccatctttctcattagtttacagtgcaatgttatctcaggaatttttataaacagaaagaggtgacatagaaaagaaaatgaaatgcagacactgcttttatactgttgtcttgtatgtacatttctgtcctgtgtcaggaaagttagtaagggaaggtctggaaacttactcaatgtctttgttctacaacattgtctcttcttaagaagcattgtttttatgagaaataatgaagccttgagttatgaaatacttttatatttaaggattaaaagaaacatgaatgcgcacattttattgtaccacttaatactgtttaggtctttgattttttaaaaaaattcttttttaatgggttttaaacactaacactgagaatttttcttgattcccatctgttggtttacttgattgctatagctgtatggtaaatctcaaaattaggtaatgtgatttcttttttcttactatttttatttaaaattcatttagcattcctagtttgactttccatatacactttaggattggtttttctgtttttcaaatattcttgcttggattttgatagaaattgagttaaatctatagatcaatgtgttggaaattggcatcttagtcttccaattcatgaacatagcctatcttttcattatttaaattttctttgatatatttcattactgttttatagtttacacagtataactcctgcacatttaaaataagaattatagctgcatagttttttgagtgattgtaaatggcattgatatttaaagtttcaatattcacatgatgttggctagtatacagaaacattattttttcaatcttattttgctgtcttgcaaccttcctaaactcattatttcttgccatttcttttgggagaatccttaggattttaaatatagaaatgtcatttgcaatttgggacagttttatttcttgcttcccatctgtataccttttatttgcttttctcatgttattgtactaggtaggatttccagtgtgatgttgaatacgaatagtgacaagttatccatgccttgttcctgatattagggggaaatgttcagtttctcattattatgatgttgaaagttgcttccaaagagtttctctatcgagtttagaaagtttccctctattcctaatttgctgggatttttttggttattattaataagtgttgaattttgtcatatgctttttctccaccaattgatttaattatgtgatgttacttctatagtcagttgatatgatgtgttaccttgattgagtttcaagtattgaaccagcctcacatctttgtgataagccctacttgatcatggagtataattttgtttgtgtactatgctacagtatttcatttgctagtattttgttgaggaagctttcctctgatttcatgagtgataatctgtagttttctttcttcaactgttactgtttggttttgatgtctagatgataactaacctcctaacatgaattggaaggaattctcttctgtttttttggaagatcatgtgtagaattggtgttatttgttcctttaatgtttggtagctttctccagtgaagaagtgggacctggagattttccttttgaatgctttttaattatgtatttattttatttaataggtatagaactattcagagtatttcatattggatgaatttttatagattttcttaaggaagtgttcattttatgtaaatgttctaatttgtagcattctttgaaatatttccttttatcctcttgatggcagcaggatctgtacttatgttccttgttgtattcttgatattggaaatgtatcacttattattgtcagtctttgtagacatatgtcaatttcattgatcatttcaaagaaatagcactttatatcactgatttttctccagtctctgttcttaatttcactgatatctgctctgatgtgtattgtatcctttctcctacttgctctggttgtatttgactcagtggtttcctgacgtggatgtttaggttattgatttgaggctttttttcttttttaatataagctttaagttctatacatttttcttacactgctgttagtttcatcccacaagtcttaatatgcttttgattatcttactcagttctaagattgcctgattccttttgagacatcttctctaacccaggaattatttagaagtatattgtttaatagtgtttggagtattccctgctatttgttattgatttctaatttgttttgcatttgatgttactgttgaaatttgttgactttttttccttatgacccaggatataggctgtcttgttttacatagctgcttgaaaagaatgtgtgttctcggtcatttggtggagtttctgtaaaagtttgtatgatcctgttagttggtggtgttatttaggtctcctgtatccttgctgattttctgtctagtatttctatcaattgccaagagaaggatgttgaagtcctgagctataattgtggaattacctattcctcctttaagttctatcagtttttgctccacataatttaaagctctgttgtttggtatatacacatgtaggtttgcttagtattcttggtgtattgacccttttataattaagtaatgtccctttttgttcctgttaatactcttatcaatttttatctgatatttgtgtggtcagtcttacgttttggttaatgcttgcatgatttacacttcatcatttttttaaaccttatctatatcactatattgggagtaagtttcttgtgaatggcgtatatttgggctgtggttttatatccagtttgcgtatctttttttttttttttttttttttttgagacggagttttgttcttgttgcccaggctggagtggagtggtgcgatctccgctcactgcaacctccgcctcctgggttcaagtgattctcctgcctcaggctcttgagtagctgggattacaggcatccgccaccatgcctgactgattttttgtatttttagtagagatggagtttcaccatgttggccaggctggtctcgaactcctgacctcaggtgatccacctgcctcagcctcccaaagtgctaggattactggtatgagcaaccacgcacagcattttttttttttttttttttttgagacggagtcttgctctgtcgccctggctggagtgcagtggcgcagtctgcaacctctgcctcccgggttcaagccattctcttgcctcagcctcccaagtagctgggattacaggtgcctgccaccacacctagctaatttttatatttttagtagagacggggtttcatcatgttggtcaggctggtctcaaactcctgacctcaggtgatctgcccacctcagcctcccaaagtgctgggattacaggtatgtgtcactgtgtctggccccagtttgcatatttctgtcttttattggtgtatttagaccatttaaagtttacaataattatgttagtgctatgtctgctattttatgattagttttttgtgtttcctgttgcttctttcttggtttgtttgggtttttttttttttgtctttaacattttttagaattccatttgatatatttgtagtgttttttaaatatatttctttgtatttttgtattaattttttagtggttgctttaagtagtataatgtacatatgtaacataattacagttaatggtatgaaaaatttagcactttgatgtatagaaaccttacttggtcccttcaccttgcctgttaatataattgtctaaagtaattcctcttcaaaattgagcaccatgttggaaaatgtaatttttgcttccactgtcaaatatattttacaaaagtcacaggaagtattgcttgttgatctctttacccattccactattctttcttgaaattctaagccaccttctattaacattttctttctgtttggcgaacttgtgtaaccttttttctagggtcagtctgctggtgtctctaaaagtgtctttatgttcccttcattcctgagggatatttttgtgggataataggatttagggtctgcagttcttttagtacttgagaaacatgtttgttccttctgtccgctatggtttcagatgagaaatctgttgccatttgaaccattgttccctagttcataatgtgccatttttatcaacctgcgttcaaagtgttttgttttttttgtagtgttcagaagtttggttatgaggtgtgtgacatggaatttttttgagtgtatcatgtttggtttttgtttagctttttgatttgtcggtttatgccctttgccaaatttgggaatttttaaccattatttcttgaaatattttttcatccctactctttctcctctctgtgatatgaatggtagagcttttgttactgtctcagaggtctcttgtgctttcatgtttaccccctttttctggtctatttttccctttttttcatattggttaatttctgttgactttttttcagctcactgattctttttttctgccatatgcagtctactgttgagcttgtccaatgagttttcgttttggtttttgtatttttcagttgtttaatttccatttgttttgttttgttttgttttgtttttttgagacagactctttgctctgttgcccaggctggagtgcagtggcgcgatctctgctcactgcaagctctgcctcccgggttcatgccattctcctgcctcagcctcccgagtagctgggactacaggtgcccgccaccatgcccggctaattttttgtatttttagtagagacggggtttcactgtgttagccaggatggtctcgatttcctgatctggtgatccacctgcctcggcctcccgaagtgctgggattacaggtgtgagccactgtgcctggcctccatttggttcttttgtacatctttgatttctttgcttagtttataatactaaagggctcagaaaacagaaaaaactaaattccagagtcatggttttctggtggtttgtctcaatatttgaatagaaatcctaaattatctggaggagtagaagtcctgtaatcttttatattgggcttcttaaatatttctgtcaacagatcttatatcagggtgatctgcatatcattcagagttacgtactccacgggaaggttgtatgtaaaatcctccagctctgtaagccttgttatatcctcaatggagaaggggtcattccttttctaagatcactcttacacttttttattagacacacacacacccttccccaaccaaacttgtctaagtcctctgtctttcatactcttgtttagtctttaacttctccttattaaccagcttctttcccataatgtatagctttagtcggatctcaagcctcgtttccaacctatttcacccttccttgcctatcaagctctggttattctttcttccacacacatgccctgagtaactattctgtgcactgtcgccacccctttacatttccttttactccccagatactactaaatggcttccaccaccgttgcctgacttaagcacgtctcagaaaggtcccttttgaccccctcactctctttttggacctccatactgctaaatctctgacttgaaggtcctttcctggcttctgtgaattcctggcttttttcctttttagggtctgtgtctttcttccatctgtaaaacagctttacttcccagcatccatcatgatcattgctgttttctaacttgtccttcaccccatgactgagttaatttgcgctgaagacactttactctcaattatctacagtgtttccctaaatctgtgtctccaggttggatgtttctcatgtcgttaaccactggtcatccttccacaccttttctgtatttgcactcactgagcctatatgcatgtatcatgtggccatgaccttggccgtggggatgcacccataatcatcataagagaacacaaattattactgtgtatcagacattgtttcgaatgttttacatgcgtcagctcttttaacctttatgacaactccataatgttatttcccccctttaactgattagaaaactgaggtacagaaagattaaggaatttgtcaaagatttcacaattatgaaatttgggtttggggactggaagccactgcactggcttcagaatccatgtccttaaccactttattgcttctcataaggtgggtctttgtttcctggtcatcacttgtttttactaaaatgggtcaaactgtgctcatttatttataatctactattcttatttgacagtacatcttggccattccttcaagcaaatgagataaaccagactcactctttaatgcctgcataagctattgtgactgtagaaaagacggagaatgtctgggtttgaggatatgtgggaggggtggggagaaggagtagagaagggctaaggcatgcatgttgttttaggtgtgtttgagatgcctgaagaacatcagtgtatccccctaatttctgtcatgttactcaaaccagacacattgtggccatttctttttcctttatcattcccacgtccggccactgccccattcctttttgttccgtagtagaccctcaatatatatgtgtgtgttggtaaatggccatacacagcagggtattttttattattattttcagttccctcagcgcgtttaccacaaagctgtgcatataggtggcaccatatatggcgtaccttgacctcgaagagaatctacatggacttttatggacctacgtacacaattttagaaatcataataaatgaatgctggagtcctcaagaccccttccagatttgatttgctaggaagactcacaggactcagcattttgtcatactcaatggctatgatttaccacaccgaaagaatccagagcaaactcagcaaaaggctcaaacccaagtccagaggaaaccaggcacaatctttgagaatcttaatgaaatcacacaggatgtgcttcattgaagctccatctgggacttaaaacaacacacgtgagatgtgttccaggaagtcgtcttgagcacccattgctcagagtttatattggacttgctttctagcacataccacaattgtagacctccagaagaacaggaggtgttcagcgtaagacaatttaggcacacggagctacttctcattactgggaacaatgggaaacttcccaaaacctaaagtacagactccagccaaggatgaaccttgcaagatcaaagaatagcagtctctggcctgctctgttctctttttcacagtaacttaaatggaaaaatgctgagttagcttaagtttctgtaacaaacattaagcaaataaaattttctataacagaaataagccatagctttgagatgaaggcttatatacgtgtaaaccattgtaaccaagaaaaaaaaaaaaagtcagagtcacagtgaaaatacttaacaaactagccaggatttaattcagtgatgacagggaacagaggaagtcttgtgagaaaggatcttgcctctgcctagtatctttcacagataggcttcaagtggtttgatttgcagatacaccctttcttggcctttatttcggcaaagatgtgatgggtaggtaaatgccgtgttctttccctagcacgtatgtcagtttctcatccactctttgttcttgctattgaaagttgtagcttctggctacaacagagatagttgaagaatatggagttcgccataatttatcattaaatgtggataatttgagattaaagaatatgttgttgcaggcttagtcactttga

SEQ ID NO: 3674 - DNA, 10126 bp, Homo sapiens
tggcggcgctggggaaatgagcaggtaggaggccgacagcgacctccgcgtctcggagcgaaccgtgagcctccccgtaacgagagagtttgactgtcagccaaggtcaccgggcccggcgcagggaaggggtggggctcggctgagcccgcgagacccgccctgctcgccgcagcccccgccccgctagggccacagggtcccggtatggcgatggctttgacggacccggcgcaggtgtctgtgacctttgatgatgtggctgtgactttcacccaggaggagtggggccagctggacctagctcagcggaccctgtaccaggaggtgatgctggaaaactgtgggctcctggtatctctggggtgtcctgttcccagacctgagctgatctaccacctagagcatgggcaggagccatggaccaggaaggaagacctctcccaaggcacctgtccaggtgacaaaggaaaacccaagagcacagaacctaccacctgtgagctagccttgtctgaaggaatctctttttggggacaactaacacaaggagcttcaggggactcccagttggggcaacccaaggatcaggatgggttttcagaaatgcagggagaacgcttgagaccagggttagattcccaaaaggagaagcttcctggaaaaatgagccccaaacatgatggtttagggacagctgatagtgtgtgttcaaggattatacaggatcgagtctccttaggagatgatgtccatgactgtgactcacatggatcaggtaaaaatccagttattcaggaagaggaaaatatctttaaatgcaatgaatgtgaaaaagtgtttaacaagaaacgcctgcttgctcggcatgagaggattcactctggagtgaagccctatgaatgcacagagtgtggaaaaacctttagcaagagtacatacctcctgcagcaccacatggtccacactggggagaagccctataagtgcatggagtgtgggaaggcttttaatcggaagtcacaccttacccagcaccagcggattcacagtggagagaagccttataagtgcagtgaatgtggaaaggccttcacccaccgctccacttttgtcttgcataacaggagccacactggagaaaaaccctttgtgtgcaaagagtgtggcaaagcctttcgagataggccaggtttcattcgacactacatcatccacagtggtgagaatccctacgagtgcttcgaatgtggcaaggtcttcaaacacagatcatacctcatgtggcaccagcagactcataccggggagaagccctatgagtgcagtgaatgtgggaaggccttctgtgagagcgcagcgctgattcaccactatgtcatccacactggagagaagccctttgagtgcctcgagtgtgggaaggctttcaaccaccgatcctacctcaaaaggcaccagcggattcacactggggagaagccatatgtgtgtagtgaatgcggaaaggccttcacccactgctctactttcatcttgcataaaagggcccacactggagaaaaacctttcgagtgcaaagagtgtgggaaagcctttagcaatagggcagacctcattcgccacttcagcatccacactggagagaagccctatgagtgcatggagtgtggaaaggccttcaaccgcaggtcaggcctcacaaggcaccagcggattcatagtggagagaagccctatgaatgcatcgagtgtgggaaaacattttgctggagcacaaacctcattcgacactctatcatccacactggagagaagccgtatgagtgcagtgaatgtggaaaggccttcagtcgcagctcgtccctcactcagcatcaaaggatgcatactgggagaaatcctatcagtgtaacagatgtgggaagaccttttacaagtgggcagacctcagtcaacatccaagaacttttattggggaaaaactttttgaatgtcaccactgaggaaaatcttttgcaagaggaagcatcttacatggcatctgatcgtacataccaaagagaaaccccacaagtgtcttcactgtgagaaaaccttctgttgccaaatgtcatttgtcacctaaggagtcatattagaaaatcacgcagcttagagccttattctccatccgaattcatcctggaaaaacacccagtggttattacgcacttgggaaaacctttagctccatctttctcattagtttacagtgcaatgttatctcaggaatttttataaacagaaagaggtgacatagaaaagaaaatgaaatgcagacactgcttttatactgttgtcttgtatgtacatttctgtcctgtgtcaggaaagttagtaagggaaggtctggaaacttactcaatgtctttgttctacaacattgtctcttcttaagaagcattgtttttatgagaaataatgaagccttgagttatgaaatacttttatatttaaggattaaaagaaacatgaatgcgcacattttattgtaccacttaatactgtttaggtctttgattttttaaaaaaattcttttttaatgggttttaaacactaacactgagaatttttcttgattcccatctgttggtttacttgattgctatagctgtatggtaaatctcaaaattaggtaatgtgatttcttttttcttactatttttatttaaaattcatttagcattcctagtttgactttccatatacactttaggattggtttttctgtttttcaaatattcttgcttggattttgatagaaattgagttaaatctatagatcaatgtgttggaaattggcatcttagtcttccaattcatgaacatagcctatcttttcattatttaaattttctttgatatatttcattactgttttatagtttacacagtataactcctgcacatttaaaataagaattatagctgcatagttttttgagtgattgtaaatggcattgatatttaaagtttcaatattcacatgatgttggctagtatacagaaacattattttttcaatcttattttgctgtcttgcaaccttcctaaactcattatttcttgccatttcttttgggagaatccttaggattttaaatatagaaatgtcatttgcaatttgggacagttttatttcttgcttcccatctgtataccttttatttgcttttctcatgttattgtactaggtaggatttccagtgtgatgttgaatacgaatagtgacaagttatccatgccttgttcctgatattagggggaaatgttcagtttctcattattatgatgttgaaagttgcttccaaagagtttctctatcgagtttagaaagtttccctctattcctaatttgctgggatttttttggttattattaataagtgttgaattttgtcatatgctttttctccaccaattgatttaattatgtgatgttacttctatagtcagttgatatgatgtgttaccttgattgagtttcaagtattgaaccagcctcacatctttgtgataagccctacttgatcatggagtataattttgtttgtgtactatgctacagtatttcatttgctagtattttgttgaggaagctttcctctgatttcatgagtgataatctgtagttttctttcttcaactgttactgtttggttttgatgtctagatgataactaacctcctaacatgaattggaaggaattctcttctgtttttttggaagatcatgtgtagaattggtgttatttgttcctttaatgtttggtagctttctccagtgaagaagtgggacctggagattttccttttgaatgctttttaattatgtatttattttatttaataggtatagaactattcagagtatttcatattggatgaatttttatagattttcttaaggaagtgttcattttatgtaaatgttctaatttgtagcattctttgaaatatttccttttatcctcttgatggcagcaggatctgtacttatgttccttgttgtattcttgatattggaaatgtatcacttattattgtcagtctttgtagacatatgtcaatttcattgatcatttcaaagaaatagcactttatatcactgatttttctccagtctctgttcttaatttcactgatatctgctctgatgtgtattgtatcctttctcctacttgctctggttgtatttgactcagtggtttcctgacgtggatgtttaggttattgatttgaggctttttttcttttttaatataagctttaagttctatacatttttcttacactgctgttagtttcatcccacaagtcttaatatgcttttgattatcttactcagttctaagattgcctgattccttttgagacatcttctctaacccaggaattatttagaagtatattgtttaatagtgtttggagtattccctgctatttgttattgatttctaatttgttttgcatttgatgttactgttgaaatttgttgactttttttccttatgacccaggatataggctgtcttgttttacatagctgcttgaaaagaatgtgtgttctcggtcatttggtggagtttctgtaaaagtttgtatgatcctgttagttggtggtgttatttaggtctcctgtatccttgctgattttctgtctagtatttctatcaattgccaagagaaggatgttgaagtcctgagctataattgtggaattacctattcctcctttaagttctatcagtttttgctccacataatttaaagctctgttgtttggtatatacacatgtaggtttgcttagtattcttggtgtattgacccttttataattaagtaatgtccctttttgttcctgttaatactcttatcaatttttatctgatatttgtgtggtcagtcttacgttttggttaatgcttgcatgatttacacttcatcatttttttaaaccttatctatatcactatattgggagtaagtttcttgtgaatggcgtatatttgggctgtggttttatatccagtttgcgtatctttttttttttttttttttttttttgagacggagttttgttcttgttgcccaggctggagtggagtggtgcgatctccgctcactgcaacctccgcctcctgggttcaagtgattctcctgcctcaggctcttgagtagctgggattacaggcatccgccaccatgcctgactgattttttgtatttttagtagagatggagtttcaccatgttggccaggctggtctcgaactcctgacctcaggtgatccacctgcctcagcctcccaaagtgctaggattactggtatgagcaaccacgcacagcattttttttttttttttttttttgagacggagtcttgctctgtcgccctggctggagtgcagtggcgcagtctgcaacctctgcctcccgggttcaagccattctcttgcctcagcctcccaagtagctgggattacaggtgcctgccaccacacctagctaatttttatatttttagtagagacggggtttcatcatgttggtcaggctggtctcaaactcctgacctcaggtgatctgcccacctcagcctcccaaagtgctgggattacaggtatgtgtcactgtgtctggccccagtttgcatatttctgtcttttattggtgtatttagaccatttaaagtttacaataattatgttagtgctatgtctgctattttatgattagttttttgtgtttcctgttgcttctttcttggtttgtttgggtttttttttttttgtctttaacattttttagaattccatttgatatatttgtagtgttttttaaatatatttctttgtatttttgtattaattttttagtggttgctttaagtagtataatgtacatatgtaacataattacagttaatggtatgaaaaatttagcactttgatgtatagaaaccttacttggtcccttcaccttgcctgttaatataattgtctaaagtaattcctcttcaaaattgagcaccatgttggaaaatgtaatttttgcttccactgtcaaatatattttacaaaagtcacaggaagtattgcttgttgatctctttacccattccactattctttcttgaaattctaagccaccttctattaacattttctttctgtttggcgaacttgtgtaaccttttttctagggtcagtctgctggtgtctctaaaagtgtctttatgttcccttcattcctgagggatatttttgtgggataataggatttagggtctgcagttcttttagtacttgagaaacatgtttgttccttctgtccgctatggtttcagatgagaaatctgttgccatttgaaccattgttccctagttcataatgtgccatttttatcaacctgcgttcaaagtgttttgttttttttgtagtgttcagaagtttggttatgaggtgtgtgacatggaatttttttgagtgtatcatgtttggtttttgtttagctttttgatttgtcggtttatgccctttgccaaatttgggaatttttaaccattatttcttgaaatattttttcatccctactctttctcctctctgtgatatgaatggtagagcttttgttactgtctcagaggtctcttgtgctttcatgtttaccccctttttctggtctatttttccctttttttcatattggttaatttctgttgactttttttcagctcactgattctttttttctgccatatgcagtctactgttgagcttgtccaatgagttttcgttttggtttttgtatttttcagttgtttaatttccatttgttttgttttgttttgttttgtttttttgagacagactctttgctctgttgcccaggctggagtgcagtggcgcgatctctgctcactgcaagctctgcctcccgggttcatgccattctcctgcctcagcctcccgagtagctgggactacaggtgcccgccaccatgcccggctaattttttgtatttttagtagagacggggtttcactgtgttagccaggatggtctcgatttcctgatctggtgatccacctgcctcggcctcccgaagtgctgggattacaggtgtgagccactgtgcctggcctccatttggttcttttgtacatctttgatttctttgcttagtttataatactaaagggctcagaaaacagaaaaaactaaattccagagtcatggttttctggtggtttgtctcaatatttgaatagaaatcctaaattatctggaggagtagaagtcctgtaatcttttatattgggcttcttaaatatttctgtcaacagatcttatatcagggtgatctgcatatcattcagagttacgtactccacgggaaggttgtatgtaaaatcctccagctctgtaagccttgttatatcctcaatggagaaggggtcattccttttctaagatcactcttacacttttttattagacacacacacacccttccccaaccaaacttgtctaagtcctctgtctttcatactcttgtttagtctttaacttctccttattaaccagcttctttcccataatgtatagctttagtcggatctcaagcctcgtttccaacctatttcacccttccttgcctatcaagctctggttattctttcttccacacacatgccctgagtaactattctgtgcactgtcgccacccctttacatttccttttactccccagatactactaaatggcttccaccaccgttgcctgacttaagcacgtctcagaaaggtcccttttgaccccctcactctctttttggacctccatactgctaaatctctgacttgaaggtcctttcctggcttctgtgaattcctggcttttttcctttttagggtctgtgtctttcttccatctgtaaaacagctttacttcccagcatccatcatgatcattgctgttttctaacttgtccttcaccccatgactgagttaatttgcgctgaagacactttactctcaattatctacagtgtttccctaaatctgtgtctccaggttggatgtttctcatgtcgttaaccactggtcatccttccacaccttttctgtatttgcactcactgagcctatatgcatgtatcatgtggccatgaccttggccgtggggatgcacccataatcatcataagagaacacaaattattactgtgtatcagacattgtttcgaatgttttacatgcgtcagctcttttaacctttatgacaactccataatgttatttcccccctttaactgattagaaaactgaggtacagaaagattaaggaatttgtcaaagatttcacaattatgaaatttgggtttggggactggaagccactgcactggcttcagaatccatgtccttaaccactttattgcttctcataaggtgggtctttgtttcctggtcatcacttgtttttactaaaatgggtcaaactgtgctcatttatttataatctactattcttatttgacagtacatcttggccattccttcaagcaaatgagataaaccagactcactctttaatgcctgcataagctattgtgactgtagaaaagacggagaatgtctgggtttgaggatatgtgggaggggtggggagaaggagtagagaagggctaaggcatgcatgttgttttaggtgtgtttgagatgcctgaagaacatcagtgtatccccctaatttctgtcatgttactcaaaccagacacattgtggccatttctttttcctttatcattcccacgtccggccactgccccattcctttttgttccgtagtagaccctcaatatatatgtgtgtgttggtaaatggccatacacagcagggtattttttattattattttcagttccctcagcgcgtttaccacaaagctgtgcatataggtggcaccatatatggcgtaccttgacctcgaagagaatctacatggacttttatggacctacgtacacaattttagaaatcataataaatgaatgctggagtcctcaagaccccttccagatttgatttgctaggaagactcacaggactcagcattttgtcatactcaatggctatgatttaccacaccgaaagaatccagagcaaactcagcaaaaggctcaaacccaagtccagaggaaaccaggcacaatctttgagaatcttaatgaaatcacacaggatgtgcttcattgaagctccatctgggacttaaaacaacacacgtgagatgtgttccaggaagtcgtcttgagcacccattgctcagagtttatattggacttgctttctagcacataccacaattgtagacctccagaagaacaggaggtgttcagcgtaagacaatttaggcacacggagctacttctcattactgggaacaatgggaaacttcccaaaacctaaagtacagactccagccaaggatgaaccttgcaagatcaaagaatagcagtctctggcctgctctgttctctttttcacagtaacttaaatggaaaaatgctgagttagcttaagtttctgtaacaaacattaagcaaataaaattttctataacagaaataagccatagctttgagatgaaggcttatatacgtgtaaaccattgtaaccaagaaaaaaaaaaaaagtcagagtcacagtgaaaatacttaacaaactagccaggatttaattcagtgatgacagggaacagaggaagtcttgtgagaaaggatcttgcctctgcctagtatctttcacagataggcttcaagtggtttgatttgcagatacaccctttcttggcctttatttcggcaaagatgtgatgggtaggtaaatgccgtgttctttccctagcacgtatgtcagtttctcatccactctttgttcttgctattgaaagttgtagcttctggctacaacagagatagttgaagaatatggagttcgccataatttatcattaaatgtggataatttgagattaaagaatatgttgttgcaggcttagtcactttga

SEQ ID NO: 3675 - DNA, 2413 bp, Homo sapiens
ttggatgggacgtaatttggcggcgctggggaaatgagcaggtaggaggccgacagcgacctccgcgtctcggagcgaaccgtgagcctccccgtaacgagagagtttgactgtcagccaaggtcaccgggcccggcgcagggaaggggtggggctcggctgagcccgcgagacccgccctgctcgccgcagcccccgccccgctagggccacagggtcccggtatggcgatggctttgacggacccggcgcagggtgtcctgttcccagacctgagctgatctaccacctagagcatgggcaggagccatggaccaggaaggaagacctctcccaaggcacctgtccaggtgacaaaggaaaacccaagagcacagaacctaccacctgtgagctagccttgtctgaaggaatctctttttggggacaactaacacaaggagcttcaggggactcccagttggggcaacccaaggatcaggatgggttttcagaaatgcagggagaacgcttgagaccagggttagattcccaaaaggagaagcttcctggaaaaatgagccccaaacatgatggtttagggacagctgatagtgtgtgttcaaggattatacaggatcgagtctccttaggagatgatgtccatgactgtgactcacatggatcaggtaaaaatccagttattcaggaagaggaaaatatctttaaatgcaatgaatgtgaaaaagtgtttaacaagaaacgcctgcttgctcggcatgagaggattcactctggagtgaagccctatgaatgcacagagtgtggaaaaacctttagcaagagtacatacctcctgcagcaccacatggtccacactggggagaagccctataagtgcatggagtgtgggaaggcttttaatcggaagtcacaccttacccagcaccagcggattcacagtggagagaagccttataagtgcagtgaatgtggaaaggccttcacccaccgctccacttttgtcttgcataacaggagccacactggagaaaaaccctttgtgtgcaaagagtgtggcaaagcctttcgagataggccaggtttcattcgacactacatcatccacagtggtgagaatccctacgagtgcttcgaatgtggcaaggtcttcaaacacagatcatacctcatgtggcaccagcagactcataccggggagaagccctatgagtgcagtgaatgtgggaaggccttctgtgagagcgcagcgctgattcaccactatgtcatccacactggagagaagccctttgagtgcctcgagtgtgggaaggctttcaaccaccgatcctacctcaaaaggcaccagcggattcacactggggagaagccatatgtgtgtagtgaatgcggaaaggccttcacccactgctctactttcatcttgcataaaagggcccacactggagaaaaacctttcgagtgcaaagagtgtgggaaagcctttagcaatagggcagacctcattcgccacttcagcatccacactggagagaagccctatgagtgcatggagtgtggaaaggccttcaaccgcaggtcaggcctcacaaggcaccagcggattcatagtggagagaagccctatgaatgcatcgagtgtgggaaaacattttgctggagcacaaacctcattcgacactctatcatccacactggagagaagccgtatgagtgcagtgaatgtggaaaggccttcagtcgcagctcgtccctcactcagcatcaaaggatgcatactgggagaaatcctatcagtgtaacagatgtgggaagaccttttacaagtgggcagacctcagtcaacatccaagaacttttattggggaaaaactttttgaatgtcaccactgaggaaaatcttttgcaagaggaagcatcttacatggcatctgatcgtacataccaaagagaaaccccacaagtgtcttcactgtgagaaaaccttctgttgccaaatgtcatttgtcacctaaggagtcatattagaaaatcacgcagcttagagccttattctccatccgaattcatcctggaaaaacacccagtggttattacgcacttgggaaaacctttagctccatctttctcattagtttacagtgcaatgttatctcaggaatttttataaacagaaagaggtgacatagaaaagaaaatgaaatgcagacactgcttttatactgttgtcttgtatgtacatttctgtcctgtgtcaggaaagttagtaagggaaggtctggaaacttactcaatgtctttgttctacaacattgtctcttcttaagaagcattgtttttatgagaaataatgaagccttgagttatgaaatacttttatatttaaggattaaaagaaacatgaatgcgc

SEQ ID NO: 3676 - DNA, 150 bp, Homo sapiens
gctccacttttgtcttgcataacaggagccacactggagaccctttgtgtgcaaagagtgaaagcctttcgagataggccaggtttcattcgacactacatcatccacagtggtgagaatccctacgagtgcttcgaatgtggcaaggtc

SEQ ID NO: 3677 - DNA, 3600 bp, Homo sapiens
cgcggagattaacgcaaacccggaagcggatcgggtggagtgaaggtcacgtcgccatgatatctcttccaaatgcttgatgaaaaaggtggaagggtcacttgacccagggagttgaaggctgcagtgagccctgtttttgccaccacactccagcctgggattgatttctaaagactcatgttacgtgaggaagcagctcagaagaggaaaggaaaggagtcaggcatggctcttcctcagggacgcttgactttcagggatgtggctatagaattctcattggcagagtggaaattcctgaaccctgcacagagggctttgtacagggaagtgatgttggagaactacaggaacctggaggctgtggatatctcttccaaacacatgatgaaggaggtcttgtcaacagggcaaggcaatagagaagtgatccacacagggacattgcaaagacatcaaagttatcacattggagacttttgcttccaggaaattgagaaagaaattcataacattgagtttcagtgtcaagaagatgaaagaaatggccatgaagcacccacgacaaaaataaaaaagttgactggtagcacagaccaacatgatcacaggcatgctggaaacaagcctattaaagatcagcttggatcaagcttttattcacatctgcctgaactccacatatttcagatcaaaggtgaaattgctaatcaacttgagaagtctaccagtgatgcttcctcagtttcaacatcccaaagaatttcctgtaggccccaaatccatatttctaataactatgggaataatcccctgaattcttcattactcccacaaaaacaggaagtacacatgagagaaaaatctttcccatgtaatgagagtggcaaagcctttaattgtagctcactcttaaggaaacaccagataccccatttaggagacaaacaatataaatgtgatgtatgtggcaagctctttaatcacaagcaataccttgcatgccatcgtagatgtcacactggagagaaaccttacaagtgtaaagagtgtggaaagtccttcagttacaagtcatcccttacatgccatcatagacttcatactggagtaaaaccttacaagtgtaatgagtgtggcaaggtctttcgtcaaaattcagcccttgtaattcataaggcaattcatactggagagaaaccttacaagtgtaatgaatgtggcaaggcttttaatcaacaatcacacctttcacgccatcaaagacttcatactggagtgaaaccttacaaatgtaagatttgtgagaaggcttttgcgtgtcattcctatctggcaaaccatactagaattcatagtggagagaaaacatacaagtgtaatgagtgtggtaaggcttttaatcatcaatcaagccttgcacgtcatcatatacttcatactggagagaaaccttacaaatgtgaagaatgtgacaaagttttcagtcagaaatcaacccttgagagacataagagaattcatactggagagaaaccatacaaatgtaaggtttgtgatacagctttcacgtgtaattcacagctggcacgacatagaagaattcacactggagagaaaacttacaagtgtaatgagtgtcgcaagaccttcagccgcaggtcatcccttctatgccatcgtagacttcatagtggtgaaaaaccttacaagtgtaatcagtgtggcaataccttccgtcaccgggcatcccttgtataccatcgtagacttcacactctagagaaatcttacaaatgtacggtttgtaacaaggttttcatgcgtaattcagtcctggctgtacatactagaattcacactgcaaagaaaccttacaagtgtaatgaatgtgggaaagcttttaatcaacaatcacatctttcacgtcatcgtagacttcatactggagagaaaccttacaaatgtgaagcatgtgacaaagtttttggtcagaaatcagctcttgagtcacataagagaattcatactggagagaaaccatacagatgtcaggtttgtgacacagctttcacgtggaattcacagctggcacgacatacaagaattcacactggagaaaaaacttacaagtgtaatgagtgtgggaagaccttcagttacaagtcatcacttgtatggcatcgtagacttcatggtggagagaaatcttacaaatgtaaggtttgtgacaaggctttcgtgtgtcgttcctatgtggcaaaacatactagaattcacagtggaatgaaaccttacaagtgtaatgagtgcagcaagaccttcagtaacaggtcatcccttgtatgccatcgtagaattcatagtggtgagaaaccttacaagtgtagtgagtgcagcaagacgttcagtcagaaggcaacccttctatgccatcgtagacttcatagtggtgagaaaccttacaagtgtaacgactgtggcaataccttccgtcactggtcatcccttgtataccatcgtagacttcatactggagagaaatcttacaaatgtacggtttgtgacaaggctttcgtgcgtaattcatacctggcaagacatattagaattcacactgcagagaaaccttacaagtgtaatgaatgtggaaaggcttttaatgaacaatcacacctttcacgtcatcatagaattcatactggagagaaaccttacaaatgtgaagcatgtgacaaagttttcagtcgcaaatcacaccttaaaagacataggataattcatactggagagaaaccttacaagtgtaatgagtgtggcaaagcctttagtgaccggtcaacacttattcaccatcaggcaattcatggtatagggaaatttgattaatataatgattgtcacaaagtcttcagtaacactacaacaattgcaaatcattggagaatccatgatgaagagaaatcttctgagtgtaataaatgtggcatgtttttcagacattgttcatacattgcagttcattggcaacctcatactggagagaaaccttacaaatgtcatgattgaggcaaggtcttcagtcaagcttcatcctatgcaaaacaggagaattcatacaggagagaaacctcacaagtgtgatgattgtggcaaagcctttacttcacattcacacctcgttggacatcagagaatccatactggacagaaatcttgcaaatgtcatcagtgtggcaaggtcttcagtccgaggtcactccttgcagaacatgagaaaattcatttttgagataactgttcccaatgcagtgagtatagcaaaccatcaagcattaattgacattggagtcaattcagcattgacttgagtttgtgttgacttaacattgagttcaagccttaattgacattcaagtgtttatgttaagaggatggggccaggtgtggtggctcaggcctgtaatcccagcacgttggaagaccaaggcacataggtcacttgaggtcagaagtttgaaaccaccatggccaacagatgtcggccactttcgccatcctgttttttgtttcttattttcttatttatttatttat

SEQ ID NO: 3678 - DNA, 6151 bp, Homo sapiens
agattcgcgaaaacccggaagcggatcgcgtggagtgacggtcccacggcagcgcgattgacttctaaagactcttggtatgtgaggaagaaacctggaagaggaagaggaaagcaaaggagtcagggatggctcttcctcagggtctattgacattcagggatgtggccatagaattctctcaggaggagtggaaatgcctggaccctgctcagaggactctatacagggacgtgatgctggagaattataggaacctggtctccctggatatctcttccaaatgcatgatgaaggagttctcatcaacagcacaaggcaatagagaagtgatccacacagggacattgcaaagacatgaaagtcatcacactggagactttcgctttcaggaaattgataaagatattcataacttagagtttcagtggcaagaagatgaaagaaatagccatgaagcacccatgacagaaatcaaaaagttgactggtagtgcagaccgatatgatcaaaggcatgctggaaacaagcctattaaagatcagcttggatcaagctttcattcgcatctgcctgaactccacatgtttcagacccaagggaaaattggtaatcaagtggagaagtctatcaacgatgcttcctcaatttcaacatcccaaagaatttcttgtaggcccaaaacccatatttctaataactatgggaataatttccggaattcttcgttactcacacaaaaacaggaggtacacatgagagaaaagtctttccaatgtaatgagagtggcaaagcctttaattatagctcactcttaaggaaacatcaaataatccatttaggagagaaacaatataaatgtgatgtatgtggcaaggtctttaatcggaagcgaaacctagtgtgccatcgtagatgtcacactggggagaaaccttacaggtgtaatgagtgtggcaagactttcagtcagacgtattcccttacatgccatcgtagacttcatactggagagaaaccttacaaatgtgaagaatgtgacaaagctttcagtttcaaatcaaaccttaaaagacataggagaattcatgctggagaaaaaccatacaagtgtaatgaatgtggcaagacctttagtcagacgtcatcccttacatgccatcgtagacttcatactggagagaaacctttcaagtgtaatgagtgtggcaagacctttagtcggaagtcatcccttacatgccatcatagacttcatacgggagagaaaccttataagtgtaatgaatgtggcaagaccttcagtcaggagttaacccttaaatgccatcgtagacttcataccggagagaagccttacaagtgtaatgaatgtggcaaggtttttaataaaaaggcaaaccttgcacgtcatcatagacttcatagtggagagaaaccctacaagtgtactgagtgtgtcaagacgttcagtcgaaattcagcccttgtaattcataaggctattcatattggagagaaacgttacaagtgtaatgagtgtggcaagacgttcagtcgaatttcagccctcgtaattcatacggcaattcatactggagagaaaccttacaagtgtaatgaatgtggcaagggttttaatcggaaaacacaccttgcatgtcatcatagacttcatactggagagaaaccttacaagtgtaatgaatgtggcaaggtttttaatcgaaaaacacaccttgcacatcatcatagacttcatactggagataaaccttacaagtgtaatgaatgtggcaaggtttttaatcaaaaagcacaccttgcacgtcaccatagacttcatactggagagaaaccttacaagtgtaatgaatgtggcaaggtttttaatcaaaaagcaaaccttgcacgtcatcatagacttcatactggagagaaaccttacaagtttaatgagtgtggcaaagcttttaattgaaaagcaaagcttgcacatcatcatacaattcatactggaaagaaacaagtgcaatgagtgtggcaagaccttctgtcacaattcagtccttgtaattcataagaattcatactggagagaaacaagtgtaatgaacgttgcaaaatttttaatcaacaagcacaccttccacgtcatcatagacttcatagtggagagaaaccttagaaatgtgaagcatgtgacaaagtttacagtggcaaatcgagcctcaaaagacaggagaattcatactggagagaaagcttacaaaggtgaagaatatcacagagttttcagtcacaagtcaaaccttgaaagacataaaataaatcatactgcagagaaaccataaaattgtaagagttcgtgacaaggctttcgggcatgactcacacctggcacaacatcctagaatttatactggagagaaaccttacaagtgtaatgagtctggcaaagccttaatgagcagtcaacacttactcaccatcaggcaatccatggtgaaggaaacttgactaatgtaatgattgtcaccaagtcttcagtaacgctacaaccattgcaaatcattggagaacccataaggaagagagatcatacaagtgtaataatcggcaaatttttcagacatcgtccataccttgcagttcattggcgaactcatactggagacaaaccttataaatgtcatgattgaggcaaggtcttcagtcaagcttcatcctatgcaaaacataggagaattcatacaggagagaaacctcacgtgtgatgattgtggcaaagcctttacttcacgttcacacctccttagacatcagagaatgcacactggacggaaatcttacaaatgtcatcagtgtggcaaggttttcagtctgacttcactccttgcagaatatcagaaaattcattttgagataattgttccaaatgcaatgagtagagcaaaccatcaagcagtaattgacattaaagtgtttatgttaagaggattgggccaggtacagtgtctcacacctgtaatcccagcactttgggaggccaaggcgggtagatcacttgaggtcaggagtttcagatcagtctggccaacaaacatgagccacttttcccagtttgctttttgttctttaacaaaaactgatagggatttttatgggtaccgtgttgaatctaaatcacattgggttatataatcatttaacaatattaatttttccaatccatcaatatgggttatatgtctgtatatgtttttaatcatattgatgtatatttgtagatttcaaggtacaaacttctcacctttttacttttatttctatttctttaagttctctagcaaatggaagtgtttttaaattttcttttaaaattgtttattgttacaaacttctcatctttttgcttttattcctaagtatttcttactttaagttctctagcaaatggaagtgtttttaaattttcttttaaaattgtttattgttaatgtatggaaattcagctaatttttggtgctgatattgtactgtgcagatacactgaatctgtttattacttccagtagtattttggttgagtctttgtgattttctacacagaagatcatgtcatctacaaacacatataattttacttctttctttctgatttggatgggtttgatttcttttgctatttcattgctctggctaggacagccagtatttattgaatagaaggggtgagagcattcttccatcatgtgagatcctacaggaaaatcattccatgttccctgcttcgttatctactcgttggtcatttcatggatggcctttctattgttgaggtaaatttccttttctgtctattttgttcagaatttctatgatgagtggattttgaattttgtgaaatactttttctccatctattgagatgatgtggttttcatctttcattctgttcaagtggcatatcacattgatttgcttgactatgttgaaccatccttgcatcccagaaataagtggcacttgagtatctacagtcctttttacatcctcttgaatacagctttttagtacaaggggtcttcaagaagttcatggaaaaatacatattttgcatattatgagaaaattgtgtatgaatttcccagtttttgcaccaaaataaactggtacgaatctgttatgtctgaacaggtcctagtttgaggcacccagaaggataagacatgagttttaaaagagactttctctgccgggcgcagtggctcatgcctgtaatcccaacactttgggaggccaaggtgggtggatcacctgagatccagagttcgagaccagcctcaccaacatggagaaacagcatctctactaaaaatacaaaattagccaggcatggtggcaaatgcctgtaatcccagatactctggaggctgaggcaggagaatggcttgaacccgggaggcagagattgctgtgagccgagattgcaccattgcactccagcctggtcaacaagagcgaaactctgtctcaaaaaaaaaaaaaagaaaagaaaagaaaagagactctatcaaagcaatataaatcctgctaaaattgaaacaaaaaggagcatcaaatttacagtgagaccagatgcagtggctcaggcctgtaatcccagcactttcagaggccaagacaggtgggtcatgtaagcccaggtattcaagacaagcctgggcaacatggtgaaacccccttgtctacaaaaaatacaaaaattagctgggcacggtagcacatgcatgcagggccagctgctgtggagtctgtggtaggaggatagctcgagcctgggaggttgaggctgcagtgagctatgatcatgccactgcattccagcatgggtgatggagcgagatactggctcaaaaaaaaaaatacttcttgtaaagtttgggtagaggaataatgaaatcattgatgctttatgaaaagattatggagatgatgcccagaagaaataaacagtttgtaaatggataacttagtttgagttgggacaagacaatgttgaaggtgatgcatggagtggcaggcacaccatccacatcagtttttttgtttgtttttgttgttgttgtttttttgagatggtgtctcgctctgtctcccaggctggaatgcagtggtgcaatctcggctcactgcaacctctgcctcccgggttcaagtgattctcctgtctctgcctccttagtagctgggactacaggcgcgtgccaccacatcagctaatttttgtatttttagtaagacggggtttcaccatgttggcaaggctggtcttgaactcctgacctcacgatctgcccacctcagcctcccaaagtgtggagattacaggcatgagccaccatgccccttgcacatcagttttacaaaaaaatttatcttgtttgtgccacaatgaagaggactgacaggtaacagcagaaacaatagtcaggagtttgagaacaggctgattaacatggtgaaaccccgtctctactaaaaatacaaaaattagctgggtgtggtggcgggtgcttgtaatcccagttactcaggaggctgaggctgcattatcgctttaacctggggggcggaggttgcagtgagccaagatgggggcaataagagcaaaactttgtctcaaaaaaaaataaataaataaaaaataaaatatgtcaagccccttctcttcctgtctcctctcgtggtgtgtacttgactccccttctcgccagatctcacaggactttcagatttaagcaatacctggccaagaaacaaaagcaaaatcattccattcccccagtggattcagatcaaaactggtaataaaatcaggtacgactccaaaaggagacattggagaagaacgaagcggggtctataaggaattgcacgtgagatggcacacatatttatgctgtgtgagcattacaatcgcgttaccatatcaagctgaaaatgtcaccactatctggagtgttggaaatgttttattgggaatatgttttttctctgaatctgctatgaacacgtcagttgggtgggttcagtaataaatatgtgagacttttcatttcaaaataaaaaaggcaaatgatgtaa

SEQ ID NO: 3679 - DNA, 300 bp, Homo sapiens
aacccggaagcggatcgcgtggagtgacggtcccacggcagcgcgattgacttctaaagactcttggtatgtgaggaagaaacctggaagaggaagaggaaagcaaaggagtcagggatggctcttcctcagggtctattgacattcagggatgtggccatagaattctctcaggaggagtggaaatgcctggaccctgctcagaggactctatacagggacgtgatgctggagaattataggaacctggtctccctggagttgtcaggggagtgtccattggcagcacctgcctcctga

SEQ ID NO: 3680 - DNA, 2697 bp, Homo sapiens
cgtggactgaaagttgcacggcggcgtgtgcgtttcctagttgtctggtgctgctatataggggacgtggggtccccacagacctgcaggttccggcccctcttttctcaacccagagcaaattgaaacgtccgggtaacacaccgctgtgccacggttttggcgagggctgacaattgtgagctgtagaagtaccagcctaacaactgttcaagtgactcctgacctagatgggtggtttcatgcacctccagtacaactgtggctcctagcagctgtggcacaggatttccaaagactcatgttacgtgaggaagccaccaagaagagcaaagaaaaggagccagggatggctcttcctcagggacgcttgactttcagggatgtggctatagagttctctttggaggagtggaaatgcctgaaccctgcacagagggctttatacagggctgtgatgttggagaactacaggaacctggagtttgtggatagctctttaaaatccatgatggagttctcatcaaccaggcacagtattacaggagaagtgatccacacagggacgttgcaaagacataaaagtcatcacattggagatttttgcttcccagaaatgaagaaagatattcatcactttgagtttcagtggcaagaagttgaaagaaatggccatgaagcacccatgacaaaaatcaaaaagttgactggtagtacagaccgaagtgatcacaggcatgctggaaacaagcctattaaagatcagcttggattaagctttcattcgcatctgcctgaactccacatgtttcagactaaagggaaaattagtaaccaattggacaagtctatcggtgcttcctcagcttcagaatcccaaagaatttcttgtaggctcaaaactcatatttctaataagtatgggaagaatttcctccattcttcattcacacaaatacaggaaatatgcatgagagaaaaaccttgccaaagtaatgagtgtggcaaagcctttaattatagctcactcttaaggagacaccacataacccattcaagagagagagaatataaatgtgatgtatgtggcaagatctttaatcagaagcaatacattgtatatcatcatagatgtcacactggtgagaaaacttacaagtgtaatgagtgtgggaagaccttcactcagatgtcatcccttgtatgccatcgtagacttcatactggagagaaaccttacaagtgtaatgagtgtggcaagaccttcagtgagaagtcatcccttagatgccatcgtagacttcatactggagagaaaccttacaagtgtaatgagtgtggcaagacttttggtcgaaattcagcccttgtaattcataaggcaattcatactggagagaaaccttacaagtgtaatgagtgtggcaagaccttcagtcagaaatcatcccttcaatgccatcatatacttcacactggagagaaaccttacaaatgtgaagaatgtgacaatgtttacattcgcagatcacaccttgaaagacataggaagattcatactggagagggatcatacaaatgtaaggtttgtgacaaggttttccggagtgattcataccttgcagaacatcagagagttcatactggagagaaaccatacaagtgtaataaatgtggcaggagtttcagtcggaagtcatcccttcaataccatcatacacttcacactggagagaaaccttacacatgtaatgaatgtggcaaggtttttagtcgaagagaaaaccttgcacgtcatcatagacttcatgctggagagaaaccttacaaatgtgaagaatgtgacaaagttttcagtcgcagatcacaccttgaaagacataggagaattcatactggggaaaaaccatacaaatgtaaggtttgtgacaaggctttccggagtgattcatgccttgcaaaccatacgagagttcatactggagagaaaccttacaagtgtaataaatgtgcgaaggtttttaatcaaaaaggaatccttgcacaacatcagagagttcatactggagagaaaccttacaagtgtaatgaatgtggcaaggtttttaatcaaaaagcaagccttgcaaaacatcagagagttcatactgcagagaaaccttacaagtgtaatgagtgtggcaaagcctttactggacagtcaacacttattcaccatcaagcaatccatgggtgtagggaaactttacaaatgtaatgattgtcacaaagtcttcagtaatgctacaaccattgcaaatcattacagaatccatattgaagagagatctacaagtgtaataaatgtggcaaatttttcagacgtcattcataacttgtagttcatcagtgaactcatactggagagaaaccttacaaatatcatgactgtgacaaggtcttcagtcaagcttcatcctatgcaaaacatagaattcatacaggagagaaacctcacaagtgtgatgattgtggcaaagcctttacttcatgttcacacctcattagacatcagagaattcatactggacagatgccttacaaatgtaagggtggcaaggtcttcactctgtggtcattccatgcagaacatcagaaaattcatttttgagataattgttccaaataaaatgaatataaaaaatcataaaactttaa

SEQ ID NO: 3681 - DNA, 1003 bp, Homo sapiens
cgtggactgaaagttgcacggcggcgtgtgcgtttcctagttgtctggtgctgctatataggggacgtggggtccccacagacctgcaggttccggcccctcttttctcaacccagagcaaattgaaacgtccgggtaacacaccgctgtgccacggttttggcgagggctgacaattgtgagctgtagaagtaccagcctaacaactgttcaagtgactcctgacctagatgggtggtttcatgcacctccagtacaactgtggctcctagcagctgtggcacaggatttccaaagactcatgttacgtgaggaagccaccaagaagagcaaagaaaaggagccagggatggctcttcctcagggacgcttgactttcagggatgtggctatagagttctctttggaggagtggaaatgcctgaaccctgcacagagggctttatacagggctgtgatgttggagaactacaggaacctggagtttgtggatatctcttccaaatgcatgatgaaggagttctcatccacagcgcaaggcaatacagaagtgatccacacagggacattgcaaagacatgaaagtcatcacattagagatttttgcttccaggaaattgagaaagatattcataactttgagtttcagtggcaagaagaggaaaggaatggtcacgaagcacccatgacagaaatcaaagagttgactggtagtacagaccgacatgatcaaaggcatgctggaaacaagcctattaaagatcagcttggatccagctttcattcgcatctgcctgaactccacatatttcagcctgaatggaaaattggtaatcaagttgagaagtctatcatcaatgcctccttaattttgacatcccaaagaatttcttgtagtcccaaaacccgtatttctaataactatgggaataattccctccattcttcattacccatacaaaaattgggaagtacacatgagagaaaaatctttccaatgtaa

SEQ ID NO: 3682 - DNA, 2504 bp, Homo sapiens
cacagacccggaagcggatggcgtggactgaaagttgcacggcggcgtgtgcgtttcctagttgtctggtgctgctatataggggacgtggggtccccacagacctgcaggttccggcccctcttttctcaacccagagcaaattgaaacgtccgggatttccaaagactcatgttacgtgaggaagccaccaagaagagcaaagaaaaggagccagggatggctcttcctcagggacgcttgactttcagggatgtggctatagagttctctttggaggagtggaaatgcctgaaccctgcacagagggctttatacagggctgtgatgttggagaactacaggaacctggagtttgtggatagctctttaaaatccatgatggagttctcatcaaccaggcacagtattacaggagaagtgatccacacagggacgttgcaaagacataaaagtcatcacattggagatttttgcttcccagaaatgaagaaagatattcatcactttgagtttcagtggcaagaagttgaaagaaatggccatgaagcacccatgacaaaaatcaaaaagttgactggtagtacagaccgaagtgatcacaggcatgctggaaacaagcctattaaagatcagcttggattaagctttcattcgcatctgcctgaactccacatgtttcagactaaagggaaaattagtaaccaattggacaagtctatcggtgcttcctcagcttcagaatcccaaagaatttcttgtaggctcaaaactcatatttctaataagtatgggaagaatttcctccattcttcattcacacaaatacaggaaatatgcatgagagaaaaaccttgccaaagtaatgagtgtggcaaagcctttaattatagctcactcttaaggagacaccacataacccattcaagagagagagaatataaatgtgatgtatgtggcaagatctttaatcagaagcaatacattgtatatcatcatagatgtcacactggtgagaaaacttacaagtgtaatgagtgtgggaagaccttcactcagatgtcatcccttgtatgccatcgtagacttcatactggagagaaaccttacaagtgtaatgagtgtggcaagaccttcagtgagaagtcatcccttagatgccatcgtagacttcatactggagagaaaccttacaagtgtaatgagtgtggcaagacttttggtcgaaattcagcccttgtaattcataaggcaattcatactggagagaaaccttacaagtgtaatgagtgtggcaagaccttcagtcagaaatcatcccttcaatgccatcatatacttcacactggagagaaaccttacaaatgtgaagaatgtgacaatgtttacattcgcagatcacaccttgaaagacataggaagattcatactggagagggatcatacaaatgtaaggtttgtgacaaggttttccggagtgattcataccttgcagaacatcagagagttcatactggagagaaaccatacaagtgtaataaatgtggcaggagtttcagtcggaagtcatcccttcaataccatcatacacttcacactggagagaaaccttacacatgtaatgaatgtggcaaggtttttagtcgaagagaaaaccttgcacgtcatcatagacttcatgctggagagaaaccttacaaatgtgaagaatgtgacaaagttttcagtcgcagatcacaccttgaaagacataggagaattcatactggggaaaaaccatacaaatgtaaggtttgtgacaaggctttccggagtgattcatgccttgcaaaccatacgagagttcatactggagagaaaccttacaagtgtaataaatgtgcgaaggtttttaatcaaaaaggaatccttgcacaacatcagagagttcatactggagagaaaccttacaagtgtaatgaatgtggcaaggtttttaatcaaaaagcaagccttgcaaaacatcagagagttcatactgcagagaaaccttacaagtgtaatgagtgtggcaaagcctttactggacagtcaacacttattcaccatcaagcaatccatgggtgtagggaaactttacaaatgtaatgattgtcacaaagtcttcagtaatgctacaaccattgcaaatcattacagaatccatattgaagagagatctacaagtgtaataaatgtggcaaatttttcagacgtcattcataacttgtagttcatcagtgaactcatactggagagaaaccttacaaatatcatgactgtgacaaggtcttcagtcaagcttcatcctatgcaaaacatagaattcatacaggagagaaacctcacaagtgtgatgattgtggcaaagcctttacttcatgttcacacctcattagacatcagagaattcatactggacagatgccttacaaatgtaagggtggcaaggtcttcactctgtggtcattccatgcagaacatca

SEQ ID NO: 3683 - DNA, 553 bp, Homo sapiens
aggtcccgcttctgtcctgcgccgattggcacagacccggaagcggatggcgtggactgaaagttgcacggcggcgtgtgcgtttcctagttgtctggtgctgctatataggggacgtggggtccccacagacctgcaggttccggcccctcttttctcaacccagagcaaattgaaacgtccgggtgagagtccgatttccaaagactcatgttacgtgaggaagccaccaagaagagcaaagaaaaggagccagggatggctcttcctcagggacgcttgactttcagggatgtggctatagagttctctttggaggagtggaaatgcctgaaccctgcacagagggctttatacagggctgtgatgttggagaactacaggaacctggagtttgtggatagctctttaaaatccatgatggagttctcatcaaccaggcacagtattacaggagaagtgatccacacagggacgttgcaaagacataaaagtcatcacattggagatttttgcttcccagaaatgaagaaagatattcatcactttgagt

SEQ ID NO: 3684 - DNA, 2334 bp, Homo sapiens
agattcgcacaaacccggaagcgggtcgcgtggagtgacggtcccaccgcggggatatctcttccaaatgcatgatgaaggagttctcatccacagcgcaaggcaatacagaagtgatccacacagggacattgcaaagacatgaaagtcatcacattagagatttttgcttccaggaaattgagaaagatattcataactttgagtttcagtggcaagaagaggaaaggaatggtcacgaagcacccatgacagaaatcaaagagttgactggtagtacagaccgacatgatcaaaggcatgctggaaacaagcctattaaagatcagcttggatccagctttcattcgcatctgcctgaactccacatatttcagcctgaatggaaaattggtaatcaagttgagaagtctatcatcaatgcctccttaattttgacatcccaaagaatttcttgtagtcccaaaacccgtatttctaataactatgggaataattccctccattcttcattacccatacaaaaattgggaagtacacatgagagaaaaatctttccaatgtaatgagagtggcaaatcctttaattatagctaactcttaaggaaatatcagataatccatttaggatagaaacaatataaatgtgaggtatgtgacaaggtctttaatcagaattgattccttgtatgccataatagatgtcacactggtaagaaaccttacagttgttatgagtgtggcaagaccttcagtcagacgtcatcctttacatgctatcgtagacttcatactggagggaaaccttacaagtgtagtgagcataacaagacctttggttgaaattcagcccttgtaattcataaggcaattcatactggagagaatccttgcaagtgtaatgaatgtggcaaggtttttaatcagaaagcacaccttgcacgtcatcatagacttcatactagagagaagccttacaaatgtgaagaatgtgaaaaagttttcagtcgcaaatcacatcttgaaagacaaaacttaaaagaggtggcgttgcccttgtttttgagaatgccctactgtgtaagtggtagtgttctttcttttttttttttttttaagacggagtctcacctgagcgagcctctgcactggccttatttattattgttattaattttttgtttttgagacggagtttcactcttattgcccaggctggagtgcaatggtgcaatcttggctcactgcaccctctgtctgttgggctcaagcgtttctcttgcctcagcctcccaagtagctgggactacaggtgcatgccaccacgcctggttaatttttgtatttatagtggagatggggtttctccatattggtcaggctggtcttgaacccttgacctcaggtcatccacccgcctcggccttccaaaacgctggatttacaggcttgagccacgcgtccggcctgaagtggtattttttagaaagtaactaaaccttttttcagtttaatgacccagggatgtatttctgaaggacttgggagcgatccttttaaggcaaacaagggagatagtacctgtatcttagtaggaaattaaataattcaaacatcaaatgtttcaaattaaaagctaccgacctttaaataattctgagccttgagaggaacgtggtcatgcaacaagagtccagtggcatgcaggcacaaggttttttcttttttgttttttgtttttttttgagacagtctcgctctgtcgcccaagctgaagtgcagtggtgcgatctcagctcactgcaagctccgcctcctgggttcacgtcattttcctgtctcagcctccccagtagctgggactccaggcacccaccaccactcccggctaattttttgtatttttagtacagacagggtttcactgtgttagccaggatggtcttgatctcctgaccttgtgatccacccacctcagcctcccaaagtgctgggattacaggcatgaatgaccgcgcccagccgcaggcgcaacttttttgagttttcctggccaggcgcagtggctcaagcctgtaatcccagcattttgggaggccgaggtgggcggatcacttgaggtcaggagttagaaaccagcctggccaacgtggtgaaaccccgtctccagtaaacatacaaagccattacagggcatggtggggcacgcctgtattcccagctacttgggaggctgaggcaggagaactgcttgatccggggaggtggaagttgcagtgggccaagatcatgccactgcaccccagcctgggcaacagagcaagactccgtacc

SEQ ID NO: 3685 - DNA, 2623 bp, Homo sapiens
gcgcagcccgttaggccccggggattgtggcgtgacccggcagcggcttcctccgttcgggcatcgctgtgcctcgggttcgcgccccgagtgagcagtcctggcccggagcgtcggtcctggtaatctgtaggaaaagcgctgcggcccagggggtaaagagagatcagcctctgtggactcggtgcttctcctggcaagtaaaccccaaggaggactgaccagttcttgaatttctataccatggcccttcgatcagtgatgttcagtgatgtatccatagacttctctccagaagagtgggaatacctggacttggaacaaaaggacttgtacagagatgtcatgttggagaactacagcaacttggtctcactgggatgcttcatttctaaaccagatgtgatttcctcattggagcaaggaaaagagccttggaaagttgtgaggaaaggaagaagacaatatccagatttggagaccaagtatgagaccaagaagttatctttagaaaatgacatttatgaaataaatttatcccagtggaagataatggaaagaattgaaaaccatggccttaagggtctcattttaaaaaatgattgggaatccacaggaaaaattgaaggacaggagagacctcaagaaggatacttcagtagtgtgaaaatgccatctgaaaaggtgtcctcttaccagaaacgcacatctgttactccacatcagagacttcattttgttgataaaccctatgaatgtaaggaatgtgggaaggcgttcagagtgcgccaacagcttacttttcatcacagaattcatactggtgaaaaaccgtatgaatgtaaggaatgtgggatggccttcagacagactgcacaccttactcgacatcagagacttcattctggtgaaaaactctatgaatgtaaggaatgtggggaagctttcatatgtggtgcagatcttagagtacatcagaaaatgcatattggtgagaagccctatgaatgtaaagaatgtgggaaggcttttagggtacgaggacaacttactctgcatcagaggattcatactggtgagaaaccctatgtgtgtaaagagtgtggaaaagcctttagacagtacgcacacctgactcggcatcagaagcttaatagtgctgacaggctctatgaatgcaaagaatgtgggaaggcctttttgtgtggctctggtcttagagtacatcacaaacttcatactggtgagaaaccctatgaatgtaaggaatgcgggaaggcctttagagtgcgacaacaactaacactccatcagagaattcatactggtgagaaaccctatgaatgtaaggaatgtggaaagacctttagccgtggttatcatcttattctccatcacagaattcatactggtgaaaaaccttacgaatgtaaggaatgctggaaagcctttagtcgctactcacaacttatttcacatcagagtattcatattggtgttaagccctatgactgtaaggaatgcgggaaggccttcagactactttcacaactcacacagcatcagagtattcatattggtgagaaaccttataaatgtaaggaatgtggcaaggcctttagattgcgccaaaaacttactctacatcagagcattcatactggcgaaaaaccctttgagtgtaaggaatgtaggaaggcctttagacttaattcatcccttattcaacatctgagaattcattctggtgagaaaccctatgaatgtaaggaatgtaagaaggcctttaggcaacattcacaccttactcatcatctgaaaattcataatgtaaaaatctaagaaagtcttttcaacttctgtgttatagaacattctatgaatgtagtaattaatctattttgctccatacatgcaactgcgttggcattagaggttttataccattaaaagagtgtgacaatgtattgtagtccatcatcactcaaacctgaaacttcagcatatttgttctaaaaactaatcctgttataagaatgaaaaagacatttaccgtcatccctatcccatcactttgtgtcatactggacaagacgcttaactgctctgtgctataattttttaatttatgacatggtcatataagagtgcagcagtttgacacactttcaatcaagaggtggaatctacatccctctgttgtatacaggaatctacatccctctgtgactgcttcgcccagtagaatatggtagacgtactgctgtgctggtttcttgactcagactttactggtagggttacttcatctcatgaaatgacagaactgtcttgttacaaagtctggctactttgctgaagagaccacatgaagaggccctgaaactacgtagagagggagaggcacctgctgaaccctgtcttcttgacatccaccaagataccagacatttgagtgaaattttggatccaccagaccagccaccagctaaatgccagtgagcgacttggtaacctgaactgatgccatgtagaatggaagaattgaccagctgagcccctggcccaaatttctgacccacaaaaacatgagatataataaaatggttgttgttttaagcca

SEQ ID NO: 3686 - DNA, 1842 bp, Homo sapiens
gcgcagcccgttaggccccggggattgtggcgtgacccggcagcggcttcctccgttcgggcatcgctgtgcctcgggttcgcgccccgagtgagcagtcctggcccggagcgtcggtcctggtaatctgtaggaaaagcgctgcggcccagggggtaaagagagatcagcctctgtggactcggtgcttctcctggcaagtaaaccccaaggaggactgaccagttcttgaatttctataccatggcccttcgatcagtgatgttcagtgatgtatccatagacttctctccagaagagtgggaatacctggacttggaacaaaaggacttgtacagagatgtcatgttggagaactacagcaacttggtctcactgggattacttttgttgtcttttatttctacattagaaatgttgcttcttttagtaaaagaaaacagcatgtgtttgctttcttgttttattttagatttggagaccaagtatgagaccaagaagttatctttagaaaatgacatttatgaaataaatttatcccagtggaagataatggaaagaattgaaaaccatggccttaagggtctcattttaaaaaatgattgggaatccacaggaaaaattgaaggacaggagagacctcaagaaggatacttcagtagtgtgaaaatgccatctgaaaaggtgtcctcttaccagaaacgcacatctgttactccacatcagagacttcattttgttgataaaccctatgaatgtaaggaatgtgggaaggcgttcagagtgcgccaacagcttacttttcatcacagaattcatactggtgaaaaaccgtatgaatgtaaggaatgtgggatggccttcagacagactgcacaccttactcgacatcagagacttcattctggtgaaaaactctatgaatgtaaggaatgtggggaagctttcatatgtggtgcagatcttagagtacatcagaaaatgcatattggtgagaagccctatgaatgtaaagaatgtgggaaggcttttagggtacgaggacaacttactctgcatcagaggattcatactggtgagaaaccctatgtgtgtaaagagtgtggaaaagcctttagacagtacgcacacctgactcggcatcagaagcttaatagtgctgacaggctctatgaatgcaaagaatgtgggaaggcctttttgtgtggctctggtcttagagtacatcacaaacttcatactggtgagaaaccctatgaatgtaaggaatgcgggaaggcctttagagtgcgacaacaactaacactccatcagagaattcatactggtgagaaaccctatgaatgtaaggaatgtggaaagacctttagccgtggttatcatcttattctccatcacagaattcatactggtgaaaaaccttacgaatgtaaggaatgctggaaagcctttagtcgctactcacaacttatttcacatcagagtattcatattggtgttaagccctatgactgtaaggaatgcgggaaggccttcagactactttcacaactcacacagcatcagagtattcatattggtgagaaaccttataaatgtaaggaatgtggcaaggcctttagattgcgccaaaaacttactctacatcagagcattcatactggcgaaaaaccctttgagtgtaaggaatgtaggaaggcctttagacttaattcatcccttattcaacatctgagaattcattctggtgagaaaccctatgaatgtaaggaatgtaagaaggcctttaggcaacattcacaccttactcatcatctgaaaattcataatgtaaaaatctaa

SEQ ID NO: 3687 - DNA, 2368 bp, Homo sapiens
aaagagcccgcggagtcttctccacgcccctgcgctctgagtcctggctctggcgctgagagagagacgccctggaaggtctgtatcagcgtctgtcgcgctgggacccacactggcttttaaggaggacacccggacacctggaagctgggaaatggactcagtggcctttgaagatgtggctgtgaacttcacacaagaggagtgggctttgctgggtccatcacagaagagtctctacagaaatgtcatgcaggaaaccattaggaacctggactgtatagaaatgaaatgggaggaccagaacattggagatcagtgccaaaatgccaagagaaatctaagaagtcatacatgtgaaattaaagatgacagtcaatgtggagaaacttttggccagattccagatagtattgtgaacaagaacactcctcgagtaaatccatgtgacagtggtgagtgtggagaagtcgtcttgggtcattcgtctcttaattgcaacatcagagttgacactggacacaaatcatgtgagcatcaggaatatggagagaagccatatacacataaacaacgtgggaaagccatcagtcatcagcactccttccagacacatgaaaggccccccaccggaaagaaacccttcgattgtaaagaatgtgcaaaaacctttagttctcttggaaacctccgaagacacatggcggcacaccatggagatggaccttataaatgtaagttgtgtgggaaagcctttgtttggcccagtttatttcatttgcacgaaagaacacacactggagagaaaccgtatgaatgtaagcagtgttctaaagcctttcctttttacagttcctatctaagacatgaaagaatccacacgggagagaaagcgtatgaatgtaagcagtgttccaaagcctttcctgattacagtacctatctaagacatgagagaactcacaccggagagaaaccctataaatgtacacaatgtgggaaagccttcagctgttactattacactcgactacatgaaaggactcacacgggagaacaaccctatgcatgtaagcaatgtgggaaaacgttttatcatcacacaagctttcgaagacacatgataaggcacactggagacggaccacataaatgtaagatatgtgggaaaggctttgattgtcctagttcagttcgaaatcatgaaactactcacactggagagaaaccctatgaatgtaagcagtgtgggaaagtgttatctcatagctcgagctttcgaagtcacatgataacacacacaggagatggaccccagaaatgcaagatatgtgggaaagcctttggttgtcccagtttatttcaaagacatgaaaggactcacactggagagaaaccctatcaatgtaaacaatgtggtaaagccttcagtcttgccggttcccttcgaagacatgaagcaactcacactggagtgaaaccctataaatgtcagtgtgggaaagcctttagtgatctctcttcctttcaaaatcatgagacaactcacactggagagaagccatatgagtgtaaggaatgtgggaaagcattcagttgtttcaaatacctttctcaacataaaaggacccacacagtagaaaaaccttatgagtgtaaaacatgtagaaaagccttcagtcatttcagtaacttaaaagtccatgaaaggattcactctggagagaagccatatgaatgtaaggaatgtggaaaagcattctcttggctcacttgccttctacgacatgaaagaattcacactggagagaaaccctatgaatgtctacaatgtggtaaagccttcactcgttcccgtttccttcgaggacatgaaaaaactcacactggagagaagctgtatgaatgtaaggaatgtgggaaagcattgagttctctccgttccttgcatagacataaaaggactcactggaaagatactctctaaatgtatggaatgtgggaaaacattcagtactttaatttcagaaacttgaaagaactcactttggagatagaccctatgaatgtaaacatgggataaagccttaagtagtttcaatttttttaaatacagttatcccccaatatattgcaggggattggttccagcaccctctaaatccacagatgccaagtcctttgttatatggcatatttgcatgtaacctatgcatatcttccagtatactgtgtaaatcatctctagatgacttttaatacctcatgcattgtaaaagctatgtaaatagttgtttgattgtattgtttagagaatcatgacaagaaaaatagtctctacatgttcgatgcagacacaaccattgca

SEQ ID NO: 3688 - DNA, 1540 bp, Homo sapiens
cctgcgctctgagtcctggctctggcgctgagagagagacgccctggaaggtctgtatcagcgtctgtcgcgctgggacccacactggcttttaaggaggacacccggacacctggaagctgggaaatgaaatgaaatgggaggaccagaacattggagatcagtgccaaaatgccaagagaaatctaagaagtcatacatgtgaaattaaagatgacagtcaatgtggagaaacttttggccagattccagatagtattgtgaacaagaacactcctcgagtaaatccatgtgacagtggtgagtgtggagaagtcgtcttgggtcattcgtctcttaattgcaacatcagagttgacactggacacaaatcatgtgagcatcaggaatatggagagaagccatatacacataaacaacgtgggaaagccatcagtcatcagcactccttccagacacatgaaaggccccccaccggaaagaaacccttcgattgtaaagaatgtgcaaaaacctttagttctcttggaaacctccgaagacacatggcggcacaccatggagatggaccttataaatgtaagttgtgtgggaaagcctttgtttggcccagtttatttcatttgcacgaaagaacacacactggagagaaaccgtatgaatgtaagcagtgttctaaagcctttcctttttacagttcctatctaagacatgaaagaatccacacgggagagaaagcgtatgaatgtaagcagtgttccaaagcctttcctgattacagtacctatctaagacatgagagaactcacaccggagagaaaccctataaatgtacacaatgtgggaaagccttcagctgttactattacactcgactacatgaaaggactcacacgggagaacaaccctatgcatgtaagcaatgtgggaaaacgttttatcatcacacaagctttcgaagacacatgataaggcacactggagacggaccacataaatgtaagatatgtgggaaaggctttgattgtcctagttcagttcgaaatcatgaaactactcacactggagagaaaccctatgaatgtaagcagtgtgggaaagtgttatctcatagctcgagctttcgaagtcacatgataacacacacaggagatggaccccagaaatgcaagatatgtgggaaagcctttggttgtcccagtttatttcaaagacatgaaaggactcacactggagagaaaccctatcaatgtaaacaatgtggtaaagccttcagtcttgccggttcccttcgaagacatgaagcaactcacactggagtgaaaccctataaatgtcagtgtgggaaagcctttagtgatctctcttcctttcaaaatcatgagacaactcacactggagagaagccatatgagtgtaaggaatgtgggaaagcattcagttgtttcaaatacctttctcaacataaaaggacccacacagtagaaaaaccttatgagtgtaaaacatgtagaaaagccttcagtcatttcagtaactt

SEQ ID NO: 3689 - DNA, 2361 bp, Homo sapiens
aaagagcccgcggagtcttctccacgcccctgcgctctgagtcctggctctggcgctgagagagagacgccctggaaggtctgtatcagcgtctgtcgcgctgggacccacactggcttttaaggaggacacccggacacctggaagctgggaaatggactcagtggcctttgaagatgtggctgtgaacttcacacaagaggagtgggctttgctgggtccatcacagaagagtctctacagaaatgtcatgcaggaaaccattaggaacctggactgtatagaagtcatacatgtgaaattaaagatgacagtcaatgtggagaaacttttggccagattccagatagtattgtgaacaagaacactcctcgagtaaatccatgtgacagtggtgagtgtggagaagtcgtcttgggtcattcgtctcttaattgcaacatcagagttgacactggacacaaatcatgtgagcatcaggaatatggagagaagccatatacacataaacaacgtgggaaagccatcagtcatcagcactccttccagacacatgaaaggccccccaccggaaagaaacccttcgattgtaaagaatgtgcaaaaacctttagttctcttggaaacctccgaagacacatggcggcacaccatggagatggaccttataaatgtaagttgtgtgggaaagcctttgtttggcccagtttatttcatttgcacgaaagaacacacactggagagaaaccgtatgaatgtaagcagtgttctaaagcctttcctttttacagttcctatctaagacatgaaagaatccacacgggagagaaagcgtatgaatgtaagcagtgttccaaagcctttcctgattacagtacctatctaagacatgagagaactcacaccggagagaaaccctataaatgtacacaatgtgggaaagccttcagctgttactattacactcgactacatgaaaggactcacacgggagaacaaccctatgcatgtaagcaatgtgggaaaacgttttatcatcacacaagctttcgaagacacatgataaggcacactggagacggaccacataaatgtaagatatgtgggaaaggctttgattgtcctagttcagttcgaaatcatgaaactactcacactggagagaaaccctatgaatgtaagcagtgtgggaaagtgttatctcatagctcgagctttcgaagtcacatgataacacacacaggagatggaccccagaaatgcaagatatgtgggaaagcctttggttgtcccagtttatttcaaagacatgaaaggactcacactggagagaaaccctatcaatgtaaacaatgtggtaaagccttcagtcttgccggttcccttcgaagacatgaagcaactcacactggagtgaaaccctataaatgtcagtgtgggaaagcctttagtgatctctcttcctttcaaaatcatgagacaactcacactggagagaagccatatgagtgtaaggaatgtgggaaagcattcagttgtttcaaatacctttctcaacataaaaggacccacacagtagaaaaaccttatgagtgtaaaacatgtagaaaagccttcagtcatttcagtaacttaaaagtccatgaaaggattcactctggagagaagccatatgaatgtaaggaatgtggaaaagcattctcttggctcacttgccttctacgacatgaaagaattcacactggagagaaaccctatgaatgtctacaatgtggtaaagccttcactcgttcccgtttccttcgaggacatgaaaaaactcacactggagagaagctgtatgaatgtaaggaatgtgggaaagcattgagttctctccgttccttgcatagacataaaaggactcactggaaagatactctctaaatgtatggaatgtgggaaaacattcagtactttaatttcagaaacttgaaagaactcactttggagatagaccctatgaatgtaaacatgggataaagccttaagtagtttcaatttttttaaatacagttatcccccaatatattgcaggggattggttccagcaccctctaaatccacagatgccaagtcctttgttatatggcatatttgcatgtaacctatgcatatcttccagtatactgtgtaaatcatctctagatgacttttaatacctcatgcattgtaaaagctatgtaaatagttgtttgattgtattgtttagagaatcatgacaagaaaaatagtctctacatgttcgatgcagacacaaccattgcaggcccacctacgtggtatatgtcacccagaacattaaaatttgttttaacattc

SEQ ID NO: 3690 - DNA, 4119 bp, Homo sapiens
cccagcaggcaaaaaaagaagaaaaaaaaattaacctcagatgttagtaggcaggaagaggcggagggagagctcagtgaaggagaacactggtatggaaactcttcagagactccgtcagaagcatcctatggggaagtccaggagaactataagttgtctctggaggaccggatccaggagcagtccacgtccccggacacctccttgggaagcacgactcccagcagccacacgttggagctggtggcactggacagtgaggtcctgcgagactcactgcagtgtcaagatcacctttccccgggagtgtcttctttgtgtgacgatgacccaggctccaacaagcccctgagcagcaatttgaggcggctgctggaggctggttccctcaaactcgatgctgcagccacggctaatggcagagtggagtcccccgtaaacgttggctcgaacctctccttttccccgccttcccaccacgcccagcagctcagtgttctggccaggaagttggccgagaagcaggaacagaatgaccaatacactccaagtaaccgttttatatggaatcaaggtaagtggttgccaaactcaaccaccacctgcagcttgtctccggattcagccatcctaaaactgaaagctgcagccaatgccgttctgcaggacaaatctctcaccaggactgaggagaccatgcgatttgagtccttttcctccccttttagctcccagtctgccagttctaccttggccgctttgtccaagaaggtcagtgaaagaagtttgactcctggtcaggagcaccctccaccggccagctccttcctttccctggcttctatgacctcctcagcggcccttctgaaggaggtggccgcaagggctgcgggcagtcttctggctgagaaatcatcgctgctgcctgaggaccctctaccgcccccgccttcagagaagaaaccagaaaaagtcactccgccacctccaccgccacctccaccacctccaccaccaccaccacaatccctggaattattattactcccagttcctaagggaagagtttctaaaccctccaattcagcctcagaagaggaaagtggaaagcctttccagtgtccaatatgtggtttggttattaaaaggaagagttactggaagcggcacatggtgattcacacaggtttaaaaagtcatcagtgtccgctctgtccattccggtgtgctcgcaaggacaatctcaaatcccacatgaaggttcatcagcaccaggatcggggagagacctttcagtgccagctgtgcccttttacttcctcacgccacttcagcctgaaactccacatgcgttgccatcagcacttcctgaggacagaagccaaggtgaaggaggagatcccagacccagatgtcaagggatctccccacctcagtgacagtgcctgcctggggcagcaaagggaaggaggagggacagagctagtggggaccatgatgacgtctaacactccagagaggactagccagggaggggctggcgtctcgcctttgctggtgaaggaggaacccaaggaagataacggcctgcccacctcctttactttgaatgctgccgacaggcccgccaaccacacaaagctgaaagacccctccgagtatgtggccaacagtgcgtcagcattgttcagccaggacatctctgttaagatggcgtctgattttctcatgaagctgtcagctgcaaatcagaaggagcccatgaatcttaattttaaagtgaaagaggagcctaaggaaggggagtccctaagcacgactttgcctcggtccagctatgtgttcagcccggaatctgaagtgtcagccccaggcgtctctgaggacgcactaaagccccaggaagggaagggaagtgtgctaaggcgggatgtgtcagtcaaagcagcctctgaacttctcatgaaactctcagcggaaagctacaaggaaacacagatggtgaagattaaagaggaacccatggaggttgacatccaggactcccatgtctcgatatcacccagccggaatgttggctacagcactttaatcgggcgagagaaaaccgaacccttacagaagatgccagagggcagagtacccccagagagaaacctcttcagtcaggatatctctgtgaaaatggcttccgagctcctctttcaactgtcagaaaaagtgagcaaagagcacaatcatacaaaagaaaacaccatccggaccacgaccagccctttcttttcagaagacacatttagacaatcaccattcacctccaattcaaaagaactgctgcccagtgactccgtgctgcacggaagaatatcagctccagaaacagaaaagatagtcctagaggcaggaaatggattaccatcctggaaattcaatgaccagctttttccctgtgacgtgtgtgggaaagtgtttggccgacagcagacattgtcccgacacctctcgctgcacacagaggaaagaaaatacaaatgccacttgtgcccctatgctgctaagtgccgtgcaaatctgaaccagcacttgaccgtccattccgtgaagctggtgagtacagacaccgaggacattgtcagcgccgtcacctctgaaggcagtgatgggaagaaacatccttattattacagttgtcacgtgtgtggatttgagaccgagctcaatgtccagtttgtcagccacatgtcactccacgtggacaaggagcagtggatgttttcgatctgctgcactgcctgcgacttcgtcaccatggaggaagcagagataaagactcacattggcaccaagcacacaggggaagacaggaagacccccagcgaatcaaatagcccctcttcatcctccctctcagctctgagtgattcagccaacagcaaagatgattcagatggctcccagaaaaacaagggcgggaacaatctgctggtcatctctgtcatgcctgggagccagccctcactgaacagtgaggaaaagccagagaaagggttcgaatgtgttttttgcaactttgtctgcaagacgaagaacatgtttgagcgtcatctgcagatacacctcatcacccggatgtttgagtgtgatgtgtgccacaagttcatgaagacccccgaacagctgctggagcataagaaatgccacactgtccccaccggtgggctcaactcaggacagtggtgagtttcagactcctctaggtgcccattctgcatttattccaccaaccgccccgctgccatggagtgccacctcaagacccactacaagatggagtacaagtgccggatctgccagacggtgaaggccaaccagctggagctggagacgcacacccgggagcaccgcctgggcaaccactacaagtgcgaccagtgcggctacctgtccaagaccgccaacaagctcatcgagcacgtgcgcgtccacaccggggagcggcccttccactgtgaccagtgcagctacagctgcaagcgcaaggacaatctcaacctgcacaagaagctgaagcacgccccacgccagaccttcagctgcgaagagtgcctgttcaagaccacacaccctttcgtcttcagccgccacgtcaagaagcaccagagtggggactgccccgaggaggacaagaagggcctgtgtccagcccccaaggaaccggccggcccgggggccccgctcctggtggtcgggagctcccggaatctcctgtctcccctgtcagttatgtctgcctcccaggctctgcagaccgtggccctgtcggcagcccacggcagcagctcagagcccaacctggcactcaaggctttggccttcaacggctcccctttgcgctttgacaagtaccggaactcagattttgcccatctcattcccttgacaatgttataccccaagaaccacttggatctcacattccaccctccccgacctcagactgcgcctcccagcatcccctcacccaaacactccttcctggcctatctcggactgagagaaagagcagagactgtctgagggcagccatgttctgtaccaaaaacagagagacaaaag

SEQ ID NO: 3691 - DNA, 2421 bp, Homo sapiens
aaaaaaaaaaaaaggaaaaaagaaaggaaagaaaagaagaaaacccctcttctggctccaggaaacaagcttcaacccattgcacacaccggagaaggggtttccccctgcccgcccgcccgccccccaactacctccccgctcctgccagtgtctgcctctctgcccccacgggggtttatttgatctcacattaaccaaggaggagaatgtgagaaaagggggaaaatgcccaggaggaagcaggagcagcccaagcgccttccctcaccctcagaagaggaaagtggaaagcctttccagtgtccaatatgtggtttggttattaaaaggaagagttactggaagcggcacatggtgattcacacaggtttaaaaagtcatcagtgtccgctctgtccattccggtgtgctcgcaaggacaatctcaaatcccacatgaaggttcatcagcaccaggatcggggagagacctttcagtgccagctgtgcccttttacttcctcacgccacttcagcctgaaactccacatgcgttgccatcagcacttcctgaggacagaagccaaggtgaaggaggagatcccagacccagatgtcaagggatctccccacctcagtgacagtgcctgcctggggcagcaaagggaaggaggagggacagagctagtggggaccatgatgacgtctaacactccagagaggactagccagggaggggctggcgtctcgcctttgctggtgaaggaggaacccaaggaagataacggcctgcccacctcctttactttgaatgctgccgacaggcccgccaaccacacaaagctgaaagacccctccgagtatgtggccaacagtgcgtcagcattgttcagccaggacatctctgttaagatggcgtctgattttctcatgaagctgtcagctgcaaatcagaaggagcccatgaatcttaattttaaagtgaaagaggagcctaaggaaggggagtccctaagcacgactttgcctcggtccagctatgtgttcagcccggaatctgaagtgtcagccccaggcgtctctgaggacgcactaaagccccaggaagggaagggaagtgtgctaaggcgggatgtgtcagtcaaagcagcctctgaacttctcatgaaactctcagcggaaagctacaaggaaacacagatggtgaagattaaagaggaacccatggaggttgacatccaggactcccatgtctcgatatcacccagccggaatgttggctacagcactttaatcgggcgagagaaaaccgaacccttacagaagatgccagagggcagagtacccccagagagaaacctcttcagtcaggatatctctgtgaaaatggcttccgagctcctctttcaactgtcagaaaaagtgagcaaagagcacaatcatacaaaagaaaacaccatccggaccacgaccagccctttcttttcagaagacacatttagacaatcaccattcacctccaattcaaaagaactgctgcccagtgactccgtgctgcacggaagaatatcagctccagaaacagaaaagatagtcctagaggcaggaaatggattaccatcctggaaattcaatgaccagctttttccctgtgacgtgtgtgggaaagtgtttggccgacagcagacattgtcccgacacctctcgctgcacacagaggaaagaaaatacaaatgccacttgtgcccctatgctgctaagtgccgtgcaaatctgaaccagcacttgaccgtccattccgtgaagctggtgagtacagacaccgaggacattgtcagcgccgtcacctctgaaggcagtgatgggaagaaacatccttattattacagttgtcacgtgtgtggatttgagaccgagctcaatgtccagtttgtcagccacatgtcactccacgtggacaaggagcagtggatgttttcgatctgctgcactgcctgcgacttcgtcaccatggaggaagcagagataaagactcacattggcaccaagcacacaggggaagacaggaagacccccagcgaatcaaatagcccctcttcatcctccctctcagctctgagtgattcagccaacagcaaagatgattcagatggctcccagaaaaacaagggcgggaacaatctgctggtcatctctgtcatgcctgggagccagccctcactgaacagtgaggaaaagccagagaaagggttcgaatgtgttttttgcaactttgtctgcaagacgaagaacatgtttgagcgtcatctgcagatacacctcatcacccggatgtttgagtgtgatgtgtgccacaagttcatgaagacccccgaacagctgctggagcataagaaatgccacactgtccccaccggtgggctcaaaaggggagcttgg

SEQ ID NO: 3692 - DNA, 7463 bp, Homo sapiens
aaaaaaaaaaaaaggaaaaaagaaaggaaagaaaagaagaaaacccctcttctggctccaggaaacaagcttcaacccattgcacacaccggagaaggggtttccccctgcccgcccgcccgccccccaactacctccccgctcctgccagtgtctgcctctctgcccccacgggggtttatttgatctcacattaaccaaggaggagaatgtgagaaaagggggaaaatgcccaggaggaagcaggagcagcccaagcgccttccctcacatgttagtaggcaggaagaggcggagggagagctcagtgaaggagaacactggtatggaaactcttcagagactccgtcagaagcatcctatggggaagtccaggagaactataagttgtctctggaggaccggatccaggagcagtccacgtccccggacacctccttgggaagcacgactcccagcagccacacgttggagctggtggcactggacagtgaggtcctgcgagactcactgcagtgtcaagatcacctttccccgggagtgtcttctttgtgtgacgatgacccaggctccaacaagcccctgagcagcaatttgaggcggctgctggaggctggttccctcaaactcgatgctgcagccacggctaatggcagagtggagtcccccgtaaacgttggctcgaacctctccttttccccgccttcccaccacgcccagcagctcagtgttctggccaggaagttggccgagaagcaggaacagaatgaccaatacactccaagtaaccgttttatatggaatcaaggtaagtggttgccaaactcaaccaccacctgcagcttgtctccggattcagccatcctaaaactgaaagctgcagccaatgccgttctgcaggacaaatctctcaccaggactgaggagaccatgcgatttgagtccttttcctccccttttagctcccagtctgccagttctaccttggccgctttgtccaagaaggtcagtgaaagaagtttgactcctggtcaggagcaccctccaccggccagctccttcctttccctggcttctatgacctcctcagcggcccttctgaaggaggtggccgcaagggctgcgggcagtcttctggctgagaaatcatcgctgctgcctgaggaccctctaccgcccccgccttcagagaagaaaccagaaaaagtcactccgccacctccaccgccacctccaccacctccaccaccaccaccacaatccctggaattattattactcccagttcctaagggaagagtttctaaaccctccaattcagcctcagaagaggaaagtggaaagcctttccagtgtccaatatgtggtttggttattaaaaggaagagttactggaagcggcacatggtgattcacacaggtttaaaaagtcatcagtgtccgctctgtccattccggtgtgctcgcaaggacaatctcaaatcccacatgaaggttcatcagcaccaggatcggggagagacctttcagtgccagctgtgcccttttacttcctcacgccacttcagcctgaaactccacatgcgttgccatcagcacttcctgaggacagaagccaaggtgaaggaggagatcccagacccagatgtcaagggatctccccacctcagtgacagtgcctgcctggggcagcaaagggaaggaggagggacagagctagtggggaccatgatgacgtctaacactccagagaggactagccagggaggggctggcgtctcgcctttgctggtgaaggaggaacccaaggaagataacggcctgcccacctcctttactttgaatgctgccgacaggcccgccaaccacacaaagctgaaagacccctccgagtatgtggccaacagtgcgtcagcattgttcagccaggacatctctgttaagatggcgtctgattttctcatgaagctgtcagctgcaaatcagaaggagcccatgaatcttaattttaaagtgaaagaggagcctaaggaaggggagtccctaagcacgactttgcctcggtccagctatgtgttcagcccggaatctgaagtgtcagccccaggcgtctctgaggacgcactaaagccccaggaagggaagggaagtgtgctaaggcgggatgtgtcagtcaaagcagcctctgaacttctcatgaaactctcagcggaaagctacaaggaaacacagatggtgaagattaaagaggaacccatggaggttgacatccaggactcccatgtctcgatatcacccagccggaatgttggctacagcactttaatcgggcgagagaaaaccgaacccttacagaagatgccagagggcagagtacccccagagagaaacctcttcagtcaggatatctctgtgaaaatggcttccgagctcctctttcaactgtcagaaaaagtgagcaaagagcacaatcatacaaaagaaaacaccatccggaccacgaccagccctttcttttcagaagacacatttagacaatcaccattcacctccaattcaaaagaactgctgcccagtgactccgtgctgcacggaagaatatcagctccagaaacagaaaagatagtcctagaggcaggaaatggattaccatcctggaaattcaatgaccagctttttccctgtgacgtgtgtgggaaagtgtttggccgacagcagacattgtcccgacacctctcgctgcacacagaggaaagaaaatacaaatgccacttgtgcccctatgctgctaagtgccgtgcaaatctgaaccagcacttgaccgtccattccgtgaagctggtgagtacagacaccgaggacattgtcagcgccgtcacctctgaaggcagtgatgggaagaaacatccttattattacagttgtcacgtgtgtggatttgagaccgagctcaatgtccagtttgtcagccacatgtcactccacgtggacaaggagcagtggatgttttcgatctgctgcactgcctgcgacttcgtcaccatggaggaagcagagataaagactcacattggcaccaagcacacaggggaagacaggaagacccccagcgaatcaaatagcccctcttcatcctccctctcagctctgagtgattcagccaacagcaaagatgattcagatggctcccagaaaaacaagggcgggaacaatctgctggtcatctctgtcatgcctgggagccagccctcactgaacagtgaggaaaagccagagaaagggttcgaatgtgttttttgcaactttgtctgcaagacgaagaacatgtttgagcgtcatctgcagatacacctcatcacccggatgtttgagtgtgatgtgtgccacaagttcatgaagacccccgaacagctgctggagcataagaaatgccacactgtccccaccggtgggctcaactcaggacagtggtgagtttcagactcctctaggtgcccattctgcatttattccaccaaccgccccgctgccatggagtgccacctcaagacccactacaagatggagtacaagtgccggatctgccagacggtgaaggccaaccagctggagctggagacgcacacccgggagcaccgcctgggcaaccactacaagtgcgaccagtgcggctacctgtccaagaccgccaacaagctcatcgagcacgtgcgcgtccacaccggggagcggcccttccactgtgaccagtgcagctacagctgcaagcgcaaggacaatctcaacctgcacaagaagctgaagcacgccccacgccagaccttcagctgcgaagagtgcctgttcaagaccacacaccctttcgtcttcagccgccacgtcaagaagcaccagagtggggactgccccgaggaggacaagaagggcctgtgtccagcccccaaggaaccggccggcccgggggccccgctcctggtggtcgggagctcccggaatctcctgtctcccctgtcagttatgtctgcctcccaggctctgcagaccgtggccctgtcggcagcccacggcagcagctcagagcccaacctggcactcaaggctttggccttcaacggctcccctttgcgctttgacaagtaccggaactcagattttgcccatctcattcccttgacaatgttataccccaagaaccacttggatctcacattccaccctccccgacctcagactgcgcctcccagcatcccctcacccaaacactccttcctggcctatctcggactgagagaaagagcagagactgtctgagggcagccatgttctgtaccaaaaacagagagacaaaagacaaaaaaaaaaaaaaaaaccacaaaacttaaacacaaccccagcaggtgtatgttgctgcaaaacctacagaccccgatgggtctggaacatgtgtactgtatatctttagtaaggaatagaaaattggctctgtgtgtatacctattgcattgacctgaaagctgctttatccaatcttcagagaggtgacctactgcatacttctaccttcagaggcatgcctccccagccacccactcccactctcagcccttctccgtacttttctctgaaaggaatcttgtcttgttaaaccctaaagagagtgtccttaatagcaatcagcacttgtaagcttatatactggtgcatttggttttctgttgggtgaatgcggtgtgtgggcgtttgtggattctgaaagagaaagccgtgtgtcgtgtgccatgacatttctattgcacattctttgtactggcttctttaacagcgatgaacgttcttttccctcctgggttgttcatccacgacagtctctccctgtgctccttcatcacctttccctctctctttgatggctacagagtggtagggcctggtgcttagtcgatgaaggaatggtagccatctacagtgctgctggagatttccgccagagcgctggagaccttgcgctcagatcttctctggtgatgaagaggcgaggaatcaagtgactgatctggaagaaatatctcgcagcactgcagctaacatcacagaacttaagtgtgttttgtgtgtgtgcccacacgtagacaaatgtgtacggtgcacacacacagtgcatcattttttaagggcagattatatatatatatgagatgtattaattcagtggttaccatttgtttgcaggaaaaagaaatgtatgggtgaaaaaatttatggttgataaatccagccaaggagattaaaaggggtttggataaattctgggtataaatgctcagactaaaaaaaagaaatggcagttttgcacagtgctatggtcttgcactagtttttgtttctcatctgaaaaaaaaaaagtaaaataaaaggaagaaaatgtaccttttttatggaatgagtagactgtatgtttgaagatttagccacaacctctttgacatataatgacgcaacaaaaaggtgctgtttagtcctatggttcagtttatgcccctgacaagtttccattgtgttttgccgatcttctggctaatcgtggtatcctccatgttattagtaattctgtattccattttgttaacgcctggtagatgtaacctgctaggaggctaactttatacttatttaaaagctcttattttgtggtcattaaaatggcaatttatgtgcagcactttattgcagcaggaagcaggtgtgggttggttgtaaagctctttgctaatcttaaaaagtaatgggtgatttaaaaagaaaaaaggaaaaaaatctttggctgaatatgttcattgcttgtatttttaaaacaacagaatttccagtatgaaacaggctgaaagagcaggaagaaatgttctttgtataataatgggaagtttggaatataaaagtttatatattatttatctattggagaactggtgtacaggaggaacattttcttactgtgttgctgttttccatcatgtgttatcctaagagttggggttttttaaaatctgtttcaccaggggaaaataaaagcatccctaatgttcttcctctagtcagtttgctttgctgaaagctccctggaaattagtacagttctacaggaagccagaagactgtactgtctgtccacaccatggtctcctcagtcccctccacgccagcccctcttccccacacctagtaggtgtgctacacctccctttgccagtcatcccgccatggatggggagcctacttggtgccctggcaaacctgtttacactaaggagatgcccacagggagcgggaagctcccaaaccctcagtcattctccagcagagacctttgctcttggccaggtttgaaacgatgttcaacctcgccacgtcaatgtctcagtaaaagacactatagatagttatggacaatacactccaagaatactgggcttatgggtgggttggttttttgttttgttttgttttgttttcaagtcatgtctttatccccatataatggagaatgtgccacttggctaataatgtgttttcaaaactacaagttcagtgatgacaggaaagagggctaaagtagtcccacagaggctggtagaaaaggcgaatcacacttaagcaccagcaggttaaaaacctgaaagggtggccctgacaattcagactataggttttacagcatgccacttgtgcaataggaggtctagggttgaaactttcaagaacgagaggaggtgaaggaaggagacgtttactgctcaaatgccatgcatttcactgcttgccactgaacttgtatttgaatgacttagtaatgcttaatataattgggcaacttttttagcactttggaaagagtcatcaatctttctggtaaattataaaagttttctgagtgagaaaaggtgtgtttggagtttgtttgactttttatattattattgttattaataaagaaaaaaatctacagcatttttcagactccaccctagaaaatatgtacccctgaatttggtttgcagtttgatactcagggaaggatgtattccatagatatcctttccgtataaaacactaacatctttgagaaattcacctaccaactaacttcaattgttgtcactatgcattcttcaatgaaaactagcttatttttccatatagtaatgcagttagggttctcagcactttctttcttctatcctttttttaactcttcatattatgttcagatgatcatactgtcaaggtttgtgtacattactgaaaatttgtattgtataaagctttttgcattacgaggctgtacagggtcattttgacagtaactggtatattcctttgcatcttatgttgcattgccaatttctagtgtatccagtttgaaagtataatatactctaattaaaaaaaaaaaaaggttggctata

SEQ ID NO: 3693 - DNA, 3165 bp, Homo sapiens
gccagtgtctgcctctctgcccccacgggggtttatttgatctcacattaaccaaggaggagaatgtgagaaaagggggaaaatgcccaggaggaagcaggagcagcccaagcgccttccctcaccctcagaagaggaaagtggaaagcctttccagtgtccaatatgtggtttggttattaaaaggaagagttactggaagcggcacatggtgattcacacaggtttaaaaagtcatcagtgtccgctctgtccattccggtgtgctcgcaaggacaatctcaaatcccacatgaaggttcatcagcaccaggatcggggagagacctttcagtgccagctgtgcccttttacttcctcacgccacttcagcctgaaactccacatgcgttgccatcagcacttcctgaggacagaagccaaggtgaaggaggagatcccagacccagatgtcaagggatctccccacctcagtgacagtgcctgcctggggcagcaaagggaaggaggagggacagagctagtggggaccatgatgacgtctaacactccagagaggactagccagggaggggctggcgtctcgcctttgctggtgaaggaggaacccaaggaagataacggcctgcccacctcctttactttgaatgctgccgacaggcccgccaaccacacaaagctgaaagacccctccgagtatgtggccaacagtgcgtcagcattgttcagccaggacatctctgttaagatggcgtctgattttctcatgaagctgtcagctgcaaatcagaaggagcccatgaatcttaattttaaagtgaaagaggagcctaaggaaggggagtccctaagcacgactttgcctcggtccagctatgtgttcagcccggaatctgaagtgtcagccccaggcgtctctgaggacgcactaaagccccaggaagggaagggaagtgtgctaaggcgggatgtgtcagtcaaagcagcctctgaacttctcatgaaactctcagcggaaagctacaaggaaacacagatggtgaagattaaagaggaacccatggaggttgacatccaggactcccatgtctcgatatcacccagccggaatgttggctacagcactttaatcgggcgagagaaaaccgaacccttacagaagatgccagagggcagagtacccccagagagaaacctcttcagtcaggatatctctgtgaaaatggcttccgagctcctctttcaactgtcagaaaaagtgagcaaagagcacaatcatacaaaagaaaacaccatccggaccacgaccagccctttcttttcagaagacacatttagacaatcaccattcacctccaattcaaaagaactgctgcccagtgactccgtgctgcacggaagaatatcagctccagaaacagaaaagatagtcctagaggcaggaaatggattaccatcctggaaattcaatgaccagctttttccctgtgacgtgtgtgggaaagtgtttggccgacagcagacattgtcccgacacctctcgctgcacacagaggaaagaaaatacaaatgccacttgtgcccctatgctgctaagtgccgtgcaaatctgaaccagcacttgaccgtccattccgtgaagctggtgagtacagacaccgaggacattgtcagcgccgtcacctctgaaggcagtgatgggaagaaacatccttattattacagttgtcacgtgtgtggatttgagaccgagctcaatgtccagtttgtcagccacatgtcactccacgtggacaaggagcagtggatgttttcgatctgctgcactgcctgcgacttcgtcaccatggaggaagcagagataaagactcacattggcaccaagcacacaggggaagacaggaagacccccagcgaatcaaatagcccctcttcatcctccctctcagctctgagtgattcagccaacagcaaagatgattcagatggctcccagaaaaacaagggcgggaacaatctgctggtcatctctgtcatgcctgggagccagccctcactgaacagtgaggaaaagccagagaaagggttcgaatgtgttttttgcaactttgtctgcaagacgaagaacatgtttgagcgtcatctgcagatacacctcatcacccggatgtttgagtgtgatgtgtgccacaagttcatgaagacccccgaacagctgctggagcataagaaatgccacactgtccccaccggtgggctcaactcaggacagtggtgagtttcagactcctctaggtgcccattctgcatttattccaccaaccgccccgctgccatggagtgccacctcaagacccactacaagatggagtacaagtgccggatctgccagacggtgaaggccaaccagctggagctggagacgcacacccgggagcaccgcctgggcaaccactacaagtgcgaccagtgcggctacctgtccaagaccgccaacaagctcatcgagcacgtgcgcgtccacaccggggagcggcccttccactgtgaccagtgcagctacagctgcaagcgcaaggacaatctcaacctgcacaagaagctgaagcacgccccacgccagaccttcagctgcgaagagtgcctgttcaagaccacacaccctttcgtcttcagccgccacgtcaagaagcaccagagtggggactgccccgaggaggacaagaagggcctgtgtccagcccccaaggaaccggccggcccgggggccccgctcctggtggtcgggagctcccggaatctcctgtctcccctgtcagttatgtctgcctcccaggctctgcagaccgtggccctgtcggcagcccacggcagcagctcagagcccaacctggcactcaaggctttggccttcaacggctcccctttgcgctttgacaagtaccggaactcagattttgcccatctcattcccttgacaatgttataccccaagaaccacttggatctcacattccaccctccccgacctcagactgcgcctcccagcatcccctcacccaaacactccttcctggcctatctcggactgagagaaagagcagagactgtctgagggcagccatgttctgtaccaaaaacagagagacaaaagacaaaaaaaaa

SEQ ID NO: 3694 - DNA, 4197 bp, Homo sapiens
gcccccacgggggtttatttgatctcacattaaccaaggaggagaatgtgagaaaagggggaaaatgcccaggaggaagcaggagcagcccaagcgccttccctcacatgttagtaggcaggaagaggcggagggagagctcagtgaaggagaacactggtatggaaactcttcagagactccgtcagaagcatcctatggggaagtccaggagaactataagttgtctctggaggaccggatccaggagcagtccacgtccccggacacctccttgggaagcacgactcccagcagccacacgttggagctggtggcactggacagtgaggtcctgcgagactcactgcagtgtcaagatcacctttccccgggagtgtcttctttgtgtgacgatgacccaggctccaacaagcccctgagcagcaatttgaggcggctgctggaggctggttccctcaaactcgatgctgcagccacggctaatggcagagtggagtcccccgtaaacgttggctcgaacctctccttttccccgccttcccaccacgcccagcagctcagtgttctggccaggaagttggccgagaagcaggaacagaatgaccaatacactccaagtaaccgttttatatggaatcaaggtaagtggttgccaaactcaaccaccacctgcagcttgtctccggattcagccatcctaaaactgaaagctgcagccaatgccgttctgcaggacaaatctctcaccaggactgaggagaccatgcgatttgagtccttttcctccccttttagctcccagtctgccagttctaccttggccgctttgtccaagaaggtcagtgaaagaagtttgactcctggtcaggagcaccctccaccggccagctccttcctttccctggcttctatgacctcctcagcggcccttctgaaggaggtggccgcaagggctgcgggcagtcttctggctgagaaatcatcgctgctgcctgaggaccctctaccgcccccgccttcagagaagaaaccagaaaaagtcactccgccacctccaccgccacctccaccacctccaccaccaccaccacaatccctggaattattattactcccagttcctaagggaagagtttctaaaccctccaattcagcctcagaagaggaaagtggaaagcctttccagtgtccaatatgtggtttggttattaaaaggaagagttactggaagcggcacatggtgattcacacaggtttaaaaagtcatcagtgtccgctctgtccattccggtgtgctcgcaaggacaatctcaaatcccacatgaaggttcatcagcaccaggatcggggagagacctttcagtgccagctgtgcccttttacttcctcacgccacttcagcctgaaactccacatgcgttgccatcagcacttcctgaggacagaagccaaggtgaaggaggagatcccagacccagatgtcaagggatctccccacctcagtgacagtgcctgcctggggcagcaaagggaaggaggagggacagagctagtggggaccatgatgacgtctaacactccagagaggactagccagggaggggctggcgtctcgcctttgctggtgaaggaggaacccaaggaagataacggcctgcccacctcctttactttgaatgctgccgacaggcccgccaaccacacaaagctgaaagacccctccgagtatgtggccaacagtgcgtcagcattgttcagccaggacatctctgttaagatggcgtctgattttctcatgaagctgtcagctgcaaatcagaaggagcccatgaatcttaattttaaagtgaaagaggagcctaaggaaggggagtccctaagcacgactttgcctcggtccagctatgtgttcagcccggaatctgaagtgtcagccccaggcgtctctgaggacgcactaaagccccaggaagggaagggaagtgtgctaaggcgggatgtgtcagtcaaagcagcctctgaacttctcatgaaactctcagcggaaagctacaaggaaacacagatggtgaagattaaagaggaacccatggaggttgacatccaggactcccatgtctcgatatcacccagccggaatgttggctacagcactttaatcgggcgagagaaaaccgaacccttacagaagatgccagagggcagagtacccccagagagaaacctcttcagtcaggatatctctgtgaaaatggcttccgagctcctctttcaactgtcagaaaaagtgagcaaagagcacaatcatacaaaagaaaacaccatccggaccacgaccagccctttcttttcagaagacacatttagacaatcaccattcacctccaattcaaaagaactgctgcccagtgactccgtgctgcacggaagaatatcagctccagaaacagaaaagatagtcctagaggcaggaaatggattaccatcctggaaattcaatgaccagctttttccctgtgacgtgtgtgggaaagtgtttggccgacagcagacattgtcccgacacctctcgctgcacacagaggaaagaaaatacaaatgccacttgtgcccctatgctgctaagtgccgtgcaaatctgaaccagcacttgaccgtccattccgtgaagctggtgagtacagacaccgaggacattgtcagcgccgtcacctctgaaggcagtgatgggaagaaacatccttattattacagttgtcacgtgtgtggatttgagaccgagctcaatgtccagtttgtcagccacatgtcactccacgtggacaaggagcagtggatgttttcgatctgctgcactgcctgcgacttcgtcaccatggaggaagcagagataaagactcacattggcaccaagcacacaggggaagacaggaagacccccagcgaatcaaatagcccctcttcatcctccctctcagctctgagtgattcagccaacagcaaagatgattcagatggctcccagaaaaacaagggcgggaacaatctgctggtcatctctgtcatgcctgggagccagccctcactgaacagtgaggaaaagccagagaaagggttcgaatgtgttttttgcaactttgtctgcaagacgaagaacatgtttgagcgtcatctgcagatacacctcatcacccggatgtttgagtgtgatgtgtgccacaagttcatgaagacccccgaacagctgctggagcataagaaatgccacactgtccccaccggtgggctcaagtaaggaaactcaggacagtggtgagtttcagactcctctaggtgcccattctgcatttattccaccaaccgccccgctgccatggagtgccacctcaagacccactacaagatggagtacaagtgccggatctgccagacggtgaaggccaaccagctggagctggagacgcacacccgggagcaccgcctgggcaaccactacaagtgcgaccagtgcggctacctgtccaagaccgccaacaagctcatcgagcacgtgcgcgtccacaccggggagcggcccttccactgtgaccagtgcagctacagctgcaagcgcaaggacaatctcaacctgcacaagaagctgaagcacgccccacgccagaccttcagctgcgaagagtgcctgttcaagaccacacaccctttcgtcttcagccgccacgtcaagaagcaccagagtggggactgccccgaggaggacaagaagggcctgtgtccagcccccaaggaaccggccggcccgggggccccgctcctggtggtcgggagctcccggaatctcctgtctcccctgtcagttatgtctgcctcccaggctctgcagaccgtggccctgtcggcagcccacggcagcagctcagagcccaacctggcactcaaggctttggccttcaacggctcccctttgcgctttgacaagtaccggaactcagattttgcccatctcattcccttgacaatgttataccccaagaaccacttggatctcacattccaccctccccgacctcagactgcgcctcccagcatcccctcacccaaacactccttcctggcctatctcggactgagagaaagagcagagactgtctgagggcagccatgttctgtaccaaaaacagagagacaaaagac

SEQ ID NO: 3695 - DNA, 1805 bp, Homo sapiens
agaacacatctgctttcctgtgtgagggtgaggcttgggccgggttccccgggaggctcatctccattgcgcagcgctacggcgacccgcaactccgaggctcggctggatgttgagagttgagggagcagccgtttcgggtgggcccaggcgaggagctgacaggaatcggcgtgggtcccgctctggactacatttcccagagggcctggtggcctgccacttttctcgcaggaattcgaacgtttcgtcactcctggcgggacccttagatctgggaggaaacctctctgaggtctggtcagattccaaccctggacagcagtgaacacaacctttcccctgagccactggaattggacagaatgccccattctcctctgatctccattcctcatgtgtggtgtcacccagaagaggaggaaagaatgcatgatgaacttctacaagcagtatccaaggggccggtgatgttcagggatgtttccatagacttctctcaagaggaatgggaatgcctggacgctgatcagatgaatttatacaaagaagtgatgttggagaatttcagcaacctggtttcagtgggactttccaattctaagccagctgtgatctccttattggaacaaggaaaagagccctggatggttgatagagagctgactagaggcctgtgttcagatctggaatcaatgtgtgagaccaaaatattatctctaaagaagagacatttcagtcaagtaataattacccgtgaagacatgtctacttttattcagcccacatttcttattccacctcaaaaaactatgagtgaagagaaaccatgggaatgtaagatatgtggaaagacctttaatcaaaactcacaatttatccaacatcagagaattcattttggtgaaaaacactatgaatctaaggagtatgggaagtcctttagtcgtggctcactcgttactcgacatcagaggattcacactggtaaaaaaccctatgaatgtaaggaatgtggcaaggcttttagttgtagttcatatttttctcaacatcagaggattcacactggtgagaaaccctatgaatgtaaggaatgtggaaaagcctttaagtattgctcaaaccttaatgatcatcagagaattcacactggtgagaaaccctatgaatgtaaagtatgtggaaaagcctttactaaaagttcacaactttttctacatctgagaattcatactggtgagaaaccttatgaatgtaaagaatgtgggaaagcctttactcaacactcaaggcttattcagcatcagagaatgcatactggtgagaaaccttatgaatgtaagcagtgtgggaaggcctttaatagtgcctcaacacttactaaccatcacagaattcatgctggtgagaagctctatgaatgtgaagaatgtagaaaggcctttattcagagctcagaacttattcaacatcagagaatccatacagatgaaaaaccatatgaatgtaatgaatgtgggaaggcctttaataaaggctcaaatcttactcgacatcagagaattcacactggtgagaaaccctatgactgtaaggaatgtggaaaggcttttggtagtcgctctgacctcattcgccatgagggaattcatactggttgaatgacagtaaagtaagaccattttgttaacctttataataatttttttaaaacaggtaaggagaacaaattaggatacatattatcaaaggttctcctatgtattcgtttttaaacgatacgataacaaagtaccaagtac

SEQ ID NO: 3696 - DNA, 4977 bp, Homo sapiens
agatctgggaggtgagatattttggtccccaggagaactggctcaggtctgcaagttcccatccgggatgactggaaagggcttaggtgaggataccgaagaccgatggggagctggcgccttgggcccctgcgggcggagcggcctgaaaggtggaggttgtgtttgggaggccgaggcaggaggatcacgaggtcaagagatcgagaccatcctggccaacatggaaacctctctgaggtctggtcagattccaaccctggacagcagtgaacacaacctttcccctgagccactggaattggacagaatgccccattctcctctgatctccattcctcatgtgtggtgtcacccagaagaggaggaaagaatgcatgatgaacttctacaagcagtatccaaggggccggtgatgttcagggatgtttccatagacttctctcaagaggaatgggaatgcctggacgctgatcagatgaatttatacaaagaagtgatgttggagaatttcagcaacctggtttcagtgggactttccaattctaagccagctgtgatctccttattggaacaaggaaaagagccctggatggttgatagagagctgactagaggcctgtgttcagatctggaatcaatgtgtgagaccaaaatattatctctaaagaagagacatttcagtcaagtaataattacccgtgaagacatgtctacttttattcagcccacatttcttattccacctcaaaaaactatgagtgaagagaaaccatgggaatgtaagatatgtggaaagacctttaatcaaaactcacaatttatccaacatcagagaattcattttggtgaaaaacactatgaatctaaggagtatgggaagtcctttagtcgtggctcactcgttactcgacatcagaggattcacactggtaaaaaaccctatgaatgtaaggaatgtggcaaggcttttagttgtagttcatatttttctcaacatcagaggattcacactggtgagaaaccctatgaatgtaaggaatgtggaaaagcctttaagtattgctcaaaccttaatgatcatcagagaattcacactggtgagaaaccctatgaatgtaaagtatgtggaaaagcctttactaaaagttcacaactttttctacatctgagaattcatactggtgagaaaccttatgaatgtaaagaatgtgggaaagcctttactcaacactcaaggcttattcagcatcagagaatgcatactggtgagaaaccttatgaatgtaagcagtgtgggaaggcctttaatagtgcctcaacacttactaaccatcacagaattcatgctggtgagaagctctatgaatgtgaagaatgtagaaaggcctttattcagagctcagaacttattcaacatcagagaatccatacagatgaaaaaccatatgaatgtaatgaatgtgggaaggcctttaataaaggctcaaatcttactcgacatcagagaattcacactggtgagaaaccctatgactgtaaggaatgtggaaaggcttttggtagtcgctctgacctcattcgccatgagggaattcatactggttgaatgacagtaaagtaagaccattttgttaacctttataataatttttttaaaacaggtaaggagaacaaattaggatacatattatcaaaggttctcctatgtattcgtttttaaacgatacgataacaaagtaccaagtaccaaaaccttggtggcttaaaacaagagaaatttattctctcatagtttagagcctggaaatctaaactcaagggtgctgatcgttttggttccttctgaggactctgaggatctgttctatgcctttttcctaacctctgttaacagctggcagtccttggcattccatggcttttacatacaccattccaatctctgcctccatcttcacattgcattctcgctgtgtatctctgtgtatgtcttttatttggacaccagtcaggttagattggggttacctggtgacctcatcttaacttgattatatctgccaagaccctgtttccaagtaaggtcacatttaccggtaccaggggttaggacttcagcatatctttttaggggatacagttcaacccataataccctgttagaatgattttgtctaatatatttgtaatttccttttatacataagttgttagtcaaatttattttattttattttattttgagacagagtctcgctctgttgcccaggctggagtgcagtggtgtgatctcagctcactgcaacctccagctcctgagttcaagcgattcttgtgcctcagcctctcaagtagttgggattacaggcatgcgccaccatgcccggctaattttttttttttttttttttgtatttttagtagcgacggggtttcaccatgttggccaggctggtcttgaactcctgacttcaagtgatctgcccgcctcagcctcccaaagtgctgggattacagacgtgagccaccgtgatggccaaaacagactttataccaacaaaaattaaaaaggacaaagaaggtcatttataatgataaaggataaattcaacaagaagataaaacaatcctaaatatgtatgcacccaacactgcaacacccagatccataacacagatactactagacctaagaaaagagatagacagcaatacaacaatagcaggggacttcaccactccattgacagcactagacagatcactgggacagaaatcaacaaagaaactctggacttaaattggactctacaccaaatggacccaacagacatctgaagaacattctacccaacaaccacagaatatatactcttctcttctgtgcatggaacattctcaaaaataggtcatatactggaccacaaagcaagtatcaataaattttaaaaaaacaaaatcatatctaacatcttctctgaccatagtggaataaaactagatatcaataccaagaggaactctcaaaacagatacatggaatttaaacagcttgctcctgaatgatttttggatcaatgatgaaactaaggtggaaatttaaaattttttgaaataaatgaaaatagagacaaaacacatgaaaacatctgagatacagcaaaagcagtgctaagagaggattttatagcattaaatgcctacaccaaaaagatagaaaaatctcaaatgaatagcctaacgtcacatctcaaggaactaggaaaaaacaaaacaaactcaacccaaagctggcagaagaaaagcaataacaaatatcagagcaggcaaaaatgagactgagaacaaaggaatgcaaaagatcaataaaagaaaaagttggttctttgcaaagataaaactgacagaccactagctagattaaccaagaaaaaaagaagattcaaataaatacaatcagaaatgataaggtgatattataactgataacacagacatataaaatatcagcagaaactatatgcacatattagaaaacctagaggaagtggataaattcctagaaacacataaccttccaagattgaaccagggagaaataggaatcctcaacagactactgagtattgaaattgaatcagtaatagaaaaaaatcttgcaaaaacaaaaagcccaggaccagacagattcacagctgaattctactagacatgcaaggaagaactagtaacagcactattgaaactattccaaaaattataggagggaatcctccctaactcattctacaaagccagtatcatcctgatactgaagccaggcaaggataaaacacacaaaaaaactacaagccaatatccctgatgaaaatagacacaaaaatcttcagcaaaatactagcaaaccaaatcaaacagtacataaaaaagatagtaacagcacagtcaagtggattttattcctggggtgtaaggatggctcaacatatgcaactcaatacatgattcatcacatacacagaattaaaaataagccaggcactcacacctgtaatcccagcactttgcaaggccaaggcgggcagatcacatgatgtcaagagtttgagaccagtctggctgacatggcgaaaccctgtctctactaaaaatagaaaaattggctgggcatggtggcaggcactgtagtcccagctacttgggaggctgaggcaggagaattacttgaacctgagaagcggaggttgcagtgagctgagatagtgccattgcactccagcctgggcaacagagcaaattgcttgaatgtgggaggtggaggttgcagtgagccgagattatgccattgcactccagccgggggagcaacaaagccagactccatctcaaaaaaaaaccaaaaaaaatcctatttagtacaaggtacattatttaggtaatgagtccattaaaagccaacactttccccactacactatatgtgtatgtaacacaactgcccttgtaacttcctaaacctataattaagaaacaataaaaggcaaattaagaatgcttttttaaaaggtgggggcattatgctaataagttactgtggatttcagagtgcagagtagaaagatcacaagaatttagtgtggtaggtgggaacagaaaatgggtgtataaattttattgacgtgggagtactggatattgtagagacagatatcatcagggcaaggagattaaagatttttgcattgacggtttgacactatattgtggtaataacactgtatgtgttgggagatagaacaggaaacatcttccctggaatatgtatactattaaatgttttatcaaacttttgatcaaacaagacagcacaatttataatttcatttctatttctatgttatgagaaactgatcatttattcaaatgtttaacaggcatgttcatgttactataaactcttctgtttcaccatca

SEQ ID NO: 3697 - DNA, 3333 bp, Homo sapiens
agggttcccaaatctggccagtctttctgccctttcccttgcgggtcgcaccccgcccaggcccctctcccgccccaggtctctcagtcttttttctcagggcgtgtagcttcctgcacacccggaagcagatcgcgcggggaaaagatcacagcgctgcgcgtcagtttccgtctacctggactaaacatttgcttcgccccgtctgcctgaatcgaacgtgcacttggcagtcttcccttgtccatacccgtttcctggggatcgctacggaccttaaaataccagcaacagccccttcgccccaaggtcttgctctgtcagactagagtacagtgccatgatctccgctcactgcagcctcaacctcctgggctcaagcagtctttctgcctcagagtgctgggattacagacgggagccaccacgccaggcctacgagatttgacttgtaaagaattaattatattgactgagagagaagcccagaagaggaagaagaggaaagaaaaggagtcagggatggctcttacacagggacctttgacattcagggatgtagccatagaattctctcaggaggagtggaaatccctggaccctgtgcagaaagctttgtactgggatgtgatgttggagaactacaggaacctggtcttcctgggtatccttcctaaatgtatgaccaaggaattaccaccaatagggaacagtaatacaggagaaaaatgccaaacagtgacgctggaaagacatgaatgttatgatgttgaaaatttttacttaagggaaatccagaaaaatctacaggaccttgagtttcaatggaaagatggtgaaataaattataaagaagtgccaatgacctataaaaacaatcttaatggtaaaagaggtcaacatagtcaagaggatgtagaaaacaaatgtattgaaaatcagcttacattaagctttcagtcacgtctgactgaactgcagaaatttcaaactgaagggaaaatttatgagtgtaaccaatctgagaagacagttaataacagttccctagtttcaccacttcaaagaattcttcctagtgtccaaaccaacatttctaaaaaatatgagaatgagtttttgcagctgtcattacccacccaacttgagaaaacacacattagggaaaaaccttatatgtgtaaagggtgtggcaaagcctttagagtgtcttcaagtcttattaaccatcagatggtacatactacagagaaaccttacaaatgcaatgaatgtggcaaagcctttcatcggggctcactactaactatacatcagatagtccatacaagggggaagccatatcaatgtggtgtatgtggcaagatcttcagacaaaattcagatcttgtaaatcaccggagaagtcacactggagagaaaccgtacaaatgtaatgaatgtggcaagtcctttagtcaaagttataaccttgcaatacatcagagaattcacactggagagaaaccttacaaatgtaatgagtgtgggaaaaccttcaaacaaggctcatgcctcactacacatcagataatccatacaggagagaaaccatatcaatgtgatatatgtggcaaggtcttcaggcagaattctaatcttgtaaatcaccagagaatccacactggagagaaaccatacaaatgcaacatatgtggaaagtcctttagtcaaagttccaacctggcaactcatcagacagttcatagtggaaacaaaccttacaaatgtgatgagtgtggcaaaacctttaaacggagctccagcctcactacacatcagataatccatacaggagagaaaccatatacatgtgatgtatgcgacaaggtcttcagtcaacgttcacaacttgcaaggcaccagagaagtcatactggagagaaaccttacaaatgcaatgaatgtggcaaggtcttcagtcagacttcacatcttgtggggcatcggagaattcatactggagagaaaccttacaaatgtgataaatgtggtaaagcctttaaacagggctcattactcactcgacataagataattcataccagagagaaacgttaccaatgcggtgaatgtggaaaggtctttagtgaaaattcatgccttgtaagacatttaagaattcatactggggagcaaccttacaaatgtaatgtgtgtggcaaggtcttcaattacagtggaaacctttcaattcataagagaatacatacgggagagaaacctttccaatgtaatgaatgtggcacagtcttcaggaactactcatgcctagcacgtcatctaagaattcatactgggcagaaaccttacaaatgtaatgtgtgtggcaaggtcttcaatgacagtggaaacctttcaaatcataagagaattcatactggagagaagccgtttcaatgtaacgaatgcggcaaggttttcagttactactcatgcctagcacgtcatcggaaaattcataccggagagaaaccttacaaatgtaatgattgtggcaaagcctatactcagcgttcaagcctcactaaacatctgataattcatactggagagaaaccttacaattgtaatgagtttggaggggcatttatccaaagttcaaaacttgcaagatatcacagaaatcctactggggagaaaccacacaaatgtagccattgtggtagaacttttagtcatataacaggcctgacgtaccatcagagaaggcatactggagagatgccatacaaatgtattgaatgtggccaggtctttaattccacttcgaaccttgcaaggcatcggagaattcacactggagagaaaccttacaaatgtaatgaatgtggcaaggtctttcgtcatcaatcaacactagcacgtcatcggagtattcatactggagagaaaccttacgtgtgtaatgagtgtggcaaagcctttagagtgcgttcaattctggttaatcatcagaaaatgcatactggggacaaaccttacaaatgtaatgaatgtggtaaagcttttattgaaaggtcaaagctggtgtaccatcaaagaaatcacactggagagaagccatacaaatgtattgaatgtggcaaggcctttgggcggttttcttgcctcaacaaacaccaaatgattcattctggagaaaaaccttataaatgtaatgagtgtggcaaatctttcattagtcgctcaggcctcactaaacatcagacaaaacatactgcagagagtcttaaaacaaaattcaatgtggaaaagcctttagatgttctcctaacttctgggttcaaataa

SEQ ID NO: 3698 - DNA, 531 bp, Homo sapiens
tcattacccacccaacttgagaaaacacacattagggaaaaaccttatatgtgtaaagggtgtggcaaagcctttagagtgtcttcaagtcttattaaccatcagatggtacatactacagagaaaccttacaaatgcaatgaatgtggcaaagcctttcatcggggctcactactaactatacatcagatagtccatacaagggggaagccatatcaatgtggtgtatgtggcaagatcttcagacaaaattcagatcttgtaaatcaccggagaagtcacactggagagaaaccgtacaaatgtaatgaatgtggcaagtcctttagtcaaagttataaccttgcaatacatcagagaattcacactggggagcaaccttacaaatgtaatgtgtgtggcaaggtcttcaattacagtggaaacctttcaattcataagagaatacatacgggagagaaacctttccaatgtaatgaatgtggcacagtcttcaggaactactcatgcctagcacgtcatctaagaatt

SEQ ID NO: 3699 - DNA, 2030 bp, Homo sapiens
ggcggcccggaggtggcgggaggacggctccgcgctgcatgcggggcggggaccagggacccgtgcgggccgcctccagagaatgaggctgccagccttgagagcaccaccgttacctggttgaagaggggaggggaagtccagcattggcctctgcagcgtggatctcccggccaggctctcagctgtcaggtgagtctcacctcacacctctcagaagacatggacaatggcagtgaatggagccaggaggacccggagtgtcggcttgccactgagaaacggagggcaggaatcctacaaccagaactctgcgccccaggatggaggctccagcccagaaggctgggcagggaggactccccaaggccgatgcccagggtgcctccggggcccgggagaagaggcccgaggagccgaggcccctcgaagaggaccgagctgggagccgccccactcaaaagggggacctgcgtggagcggcgggcggtaggacgactcccccaggcgggggctcccggggctgcagcctcggggtgagccccggcccggggacccggcacagcgccgggaccagacccctcgtgcgggagccgtgcggccccacctcttctcagaaccctgagctggttatccccgaggggctgcaagcccgggagggcccctgtaggagcccagcgcgtggcggggactgcagcaggaactcctgcctggcgtggcatcgcggggcgcccgctggggagacgccacccgtgtgtgacccctgtccggagcggatccagaaccacccccggactcaactgtgtgaggtccacacggactgttggccgtgccaaccagggactggcgctccgacctgcccgaggaccccaaagccgacctcccgcgggaggaaccccttggtggagcagccccgggcttgcgcgtgcggcgaggcctttgcgtggagggccctgcggatcccccaggagaggctgcaggcgacggaggagccccgtccgtgtgcccggtgcgggaagcgcttccgccccaaccagcagcagcaggcgggcaagagtcccccagtgtgtcctgagtgcggccaaacctcgcgacctcgccctattgtccccgaccccccggcccagcgactgtacgcttgcgacgagtgcggcaaggccttcacgcgcacctccagcctgctgcagcaccagcgcatccacacgggcgagcggccctacgagtgcgccgagtgcggcaaggccttcgtgcgctgctccggcctgtaccgccaccagaagacgcactcggccgagcgccaccggcgtggccccgtcctggcgcggcgcgccttccggctggggtgcccgccctgcggggactacagcgagcggagtccccgacgggggtcgggagccggggagaagccgtacgagtgcgccgactgcgccaaggccttcgggctgttctcgcacctcgtggagcaccggcgcgtgcacaccggcgagaagccctacgcgtgccccgagtgcggcaaggccttcaaccagcgctcgaacctgagccggcaccagcgcactcacagcagcgccaagccctacgcgtgcccactgtgcgaaaaggccttcaagggccgctcgggcctggtgcaacaccagcgcgcgcacaccggcgagcggccctatggctgctccgagtgcggaaagaccttccgcggctgctccgagctgcgccagcacgagcgcctgcactcgggcgagaagccctacatctgccgcgactgcggcaaggccttcgtgcgcaactgcagcctggtgcgccacctgcgcacgcacacgggcgagcggccctacgcgtgcggagattgcggccgcgccttcagccaacgctccaacctcaacgagcaccggaagcggcacgggggccgcgccgcgccttgactgcagggagccgagagtcgacgcgtcgcccaagcgaaccctgcgtcgaggaggggcctttgtcccggaaaacccaccaacgtttgtaactttgattaaacttcactttgt

SEQ ID NO: 3700 - DNA, 1969 bp, Homo sapiens
cgcctgcgcttgctgtggcccgggtccctcagtgccgcggcggcccggaggtggcgggaggacggctccgcgctgcatgcggggcggggaccagggacccgtgcgggccgcctccagagaatgaggctgccagccttgagagcaccaccgttacctggttgaagaggggaggggaagtccagcattggcctctgcagcgtggatctcccggccaggctctcagctgtcagatcctacaaccagaactctgcgccccaggatggaggctccagcccagaaggctgggcagggaggactccccaaggccgatgcccagggtgcctccggggcccgggagaagaggcccgaggagccgaggcccctcgaagaggaccgagctgggagccgccccactcaaaagggggacctgcgtggagcggcgggcggtaggacgactcccccaggcgggggctcccggggctgcagcctcggggtgagccccggcccggggacccggcacagcgccgggaccagacccctcgtgcgggagccgtgcggccccacctcttctcagaaccctgagctggttatccccgaggggctgcaagcccgggagggcccctgtaggagcccagcgcgtggcggggactgcagcaggaactcctgcctggcgtggcatcgcggggcgcccgctggggagacgccacccgtgtgtgacccctgtccggagcggatccagaaccacccccggactcaactgtgtgaggtccacacggactgttggccgtgccaaccagggactggcgctccgacctgcccgaggaccccaaagccgacctcccgcgggaggaaccccttggtggagcagccccgggcttgcgcgtgcggcgaggcctttgcgtggagggccctgcggatcccccaggagaggctgcaggcgacggaggagccccgtccgtgtgcccggtgcgggaagcgcttccgccccaaccagcagcagcaggcgggcaagagtcccccagtgtgtcctgagtgcggccaaacctcgcgacctcgccctattgtccccgaccccccggcccagcgactgtacgcttgcgacgagtgcggcaaggccttcacgcgcacctccagcctgctgcagcaccagcgcatccacacgggcgagcggccctacgagtgcgccgagtgcggcaaggccttcgtgcgctgctccggcctgtaccgccaccagaagacgcactcggccgagcgccaccggcgtggccccgtcctggcgcggcgcgccttccggctggggtgcccgccctgcggggactacagcgagcggagtccccgacgggggtcgggagccggggagaagccgtacgagtgcgccgactgcgccaaggccttcgggctgttctcgcacctcgtggagcaccggcgcgtgcacaccggcgagaagccctacgcgtgccccgagtgcggcaaggccttcaaccagcgctcgaacctgagccggcaccagcgcactcacagcagcgccaagccctacgcgtgcccactgtgcgaaaaggccttcaagggccgctcgggcctggtgcaacaccagcgcgcgcacaccggcgagcggccctatggctgctccgagtgcggaaagaccttccgcggctgctccgagctgcgccagcacgagcgcctgcactcgggcgagaagccctacatctgccgcgactgcggcaaggccttcgtgcgcaactgcagcctggtgcgccacctgcgcacgcacacgggcgagcggccctacgcgtgcggagattgcggccgcgccttcagccaacgctccaacctcaacgagcaccggaagcggcacgggggccgcgccgcgccttgactgcagggagccgagagtcgacgcgtcgcccaagcgaaccctgcgtcgaggaggggcctttgtcccggaaaacccaccaacgtttgtaactttgattaaacttcactttgtaca

SEQ ID NO: 3701 - DNA, 7162 bp, Homo sapiens
gggggctccgggaatggcgggggaggcgcgcgggagtggccgcggggagcttcggcttcaaggccctgggcgtccgcgcgcggatgcgggtctggggcgggttggggctgggccgggtcgtgaagatgccgtgggccgcggagctgcgcggattctgggctgtggggcgggcacggcctttccggaggcgccgctcctgggcgtcctttcaggcgggcgtggaggcgccagcctcgggcgcgtttagcctcgggcgcgtttagcctcgacctcgggccagcccgcttgccgcgccgtggccctaaggagcggctgccctgctggaccgcatccaccagcagcctggctctgccgctatcgaaggaggcttttaaagcgctggggttacagtccacagatcctggtccctacaaataagcctgctcatgtgagataagaaaggagttcctggaaccaggaattcattctcagtgtagaagacctagctgagacctcactccacagttttggggcagaagcagaagagacgcacagtagaaccgatctcagccttgctgatcatctcgtacagcagcagaaaatgaccatgttacaggagtcattctcatttgacgatttatctgtggacttcacccaaaaggagtggcagctactggatccctctcagaagaatttatacaaggatgtgatgttggagaactatagcagcctagtgtcactggggtatgaagttatgaaaccagatgtcatcttcaaattggagcaaggagaagagccgtgggtaggagatggagaaattccaagttcagattctccagaagtctggaaagtagatggtaacatgatgtggcaccaggataaccaagacaagcttaaaattataaaaagaggtcatgaatgtgatgcatttggaaaaaatttcaatctgaacatgaactttgttcctttaaggaaatcaaacagtgaaggtgacttagatggattgattttaaaacatcatttagatttgcttattccaaaaggagattatggaaaagcagaatcagatgactttaatgtgtttgataatttttttctccattccaagcctgaggatactgatacctggttaaaatactatgactgtgataaatataaagagagctataaaaagtcacagattatcatatatcatagaaatcgtttaggggagaaactctatgaatgcagtgaatgtaggaagcgcttcagtaagaaaccaagtctcattaaacatcagagcagacatataagagacatagcctttggctgtggtaattgtggcaaaacctttccccagaagtctcagtttattacacatcacagaactcatacaggagaaaaaccttataattgtagccagtgtgggaaagccttctcccaaaagtcacagctcacatcccatcagcggacacatacaggagagaaaccttatgagtgtggtgaatgtgggaaagccttctcccggaagtcacatctcatatcgcattggagaacacacacaggagagaaaccctatggatgcaatgaatgtgggagggcctttagtgaaaagtccaatctcattaaccatcagagaattcataccggtgagaagccttttgaatgcagggaatgtgggaaagccttcagcaggaagtcacaactcgttacacatcacagaactcacacaggaacaaaaccctttggatgtagtgattgtagaaaagcattctttgagaagtcagagcttattagacatcagacaattcatactggagagaaaccctatgaatgcagcgagtgtaggaaagcatttagagagaggtcgagtctcattaatcatcagagaacacatacaggagagaaacctcatggatgcattcagtgtgggaaggccttctcccagaagtcacatctcatatcacatcagatgacacacacaggagaaaaaccctttatatgcagtaaatgtgggaaagccttcagcaggaaatcacagctcgttagacatcagagaactcatacgggagaaaaaccgtatgaatgcagtgagtgtgggaaagctttcagtgaaaaattaagtctcactaatcatcaaagaattcatacaggagaaaaaccatatgtatgcagtgaatgtgggaaagccttttgtcagaagtcacatctcatatcacatcagaggacacatacaggggagaaaccctatgaatgcagtgaatgtgggaaggcctttggtgagaagtcaagtcttgcaactcatcagagaactcatactggagaaaaaccgtatgaatgcagggactgtgaaaaagctttctcccagaaatcacagctaaatacccatcagagaattcacactggagagaaaccctatgaatgcagtctttgtaggaaagctttttttgagaagtcggagctaattagacatctgagaactcatacaggagaaaaaccttatgaatgcaatgaatgtagaaaagccttcagggagaagtcaagtctcatcaatcatcagagaatacatacaggagagaagccttttgaatgcagtgagtgtggcaaagctttctctcggaagtcacaccttataccacatcaaaggacacatacgggtgagaaaccctatggatgcagtgaatgtaggaaggccttctctcagaagtcacagctggttaatcatcagagaattcatacaggagagaagccttatcgatgcattgaatgtgggaaagctttctcacagaagtcacagctcatcaatcatcagagaactcatacagtaaaaaaatcctaggaatacagttaatagtagtctttgacagatcatcttggacttcaggaaatgcaattatgataacgtttgtagacagtcacgtcatgttaggtgtttgtactccatgaggatgagaactctaaatgaggtggtgtatggaaagccgatcataattcatagagtagagtgaacctatgactgcagtggatctcaaaaacttttaaaaccatagacaagccttatagagtagaacattcacagcaaagaagaatcctgtgaatgtccaaaagccttccagaagtcaagtctcttaagctattagaaatattcccactggggatgagggaaaaccccatgaatgcgggaaatgaggcaatatttttaagaaatgacagttcattgtacataagaaaatgctcttaggaatgaagttctatgaaagtactaaatatgggacagtgcaacaagtaacgagactattttgtattttggagaattcatattatggagaacctaacaatttaaagacactgggaacacttgcccctcagtatagtactgtcaagggaagccatacactttttgtagacatgggtaccaaaaatacccaattctaagtggttgacagatgttcactttgaagtgtgaagttttaaaaatacgtgaataaattggttattgaaacatctaagacatttcttagtggtatttgtggcttatcttctagtgtcacgtatgttttgtgttttggacttacctataatttaatgtaattgggagtatgaaatgcatatgccttttagtgcctctgatgtctgtgaagacaacactacacaccactggtttttattttttaacaataatataaaaaatggaaactcatgtaacatgactacatgaataagtaccttaagtgataacccgtttcttttaacttatagacatacataaggggtcttttgtttttatggacctttctattcagtaactgaagccaacattgtgtaagtcttctgcatcctcagagtctgagtaacagtttatataaaataaatatgcaaaggcaggaaccacagaataaccatagtaatatataactgaatgagcaaaataaaggtgtgtgaactacattacaacacccaaactaaatgaaataaagtagtgctgtattaaatctttttctcatttagtgaggtgcctccatatagtatatatatatgtatcttaagtgatatgtaacccaaatgtcactattttaatttactgtgataaagtatcatggatattttgtgctgctgttatgctttttgtgttgcataaaatatcttgtaaaaattagatggataaatgaattattaaaaaatcacatttctgaagatgtaaagtattagggaattttgtgctggaaaaacatttttgacattcaaggatgcctattttatcttctagcaaatttctgtggtccctggaaaagtacagatgatcctggacttacagtggggttacctcccaataaacccattgtaagttgaaaacattgtaagtcaaaaatgcatttaatacacccaacttaccaaacatcatagcttagcgtagcctaccttaaacattctcagaacacattctaatgcatcatctattttataaaaaggtgttgaatatctgatgtaattattgaatactgaaggtgaaaaatagtagtgtatggataccattgtaatgttgagaaactgtaagtcacatcctcttaagtcaggaactatctgtataaggaaacaagatttccattttatcatttgaaatgtatttgactttgtttcactagttgcattatccccatggaaaacttcacattgagaacttaccattatatatttccataaaaatgcatgaaccatcccttagctaagtaaggattttgtaatgttctctcaataatgttgcttggcaaagttaatattttttgtatgctgatgaaatttagaaaagtccaatattgagcttgattgcaaacttagaaaaactcaagacttctccttttatgttcaaattgttgtatcagtatggtattttgcacctttaccttaaacaatattttctcctttaattattgattttgcaacattttgggaaagttggaattttaaataaatgaataattttctaaaccagaataccagttcaacagccaaataattctgtctttccatgctgtaattttaaagcatttaattttccaactttttgttcatactcaagtgtatgaacttcctggctgggcacagtggctcatgcctgtaatcccagcactttgggaggctgaggacctcaagtggagacctcaagtggatcacttgaggtcaggagttgaagaccagcatgttcatggccaacatggcaaaaccctgtcttaaattagccgggcatggttgtgcgtgcctgtaatcccagttactcaggaggctgaggcaggagaatcacttgaacctgagaggcagaggttgcagtgagccaagattgtgcagcctgggcgacagagcgagcctctgtcaaaaaaagaaaagaaaaagaacttcctactttttaatatctcaaattcattttactagacgtgggagaccaactaatgcaaatgaacagttacagggtgatgttgtactttgtgatttttgccctattttttctttccatctatcaccattctctttccaatcccagagattgatttattaggtcttggaaattctagattattccattaactattaagcagttaaacctgatacttcctacactagataatggaacttcaacattagcctattgattgcccaagaacaaacatttttttctaaatgtcaggtgttatggggaggattgatgctgacagcagaggtctagttaaaaactgatgcagaggttcaaatacgttgtgcagtaatcactagaactcaccttctaaagtgtcatgagagctctgattctgcaattagagattttttaatgtgtttttgaaattaccttgtaaaccacaaatctgtgtctctgcattgccccttattgtttcctaccacaaattctacatcaagaagaaagttttaaagttagactggatttatttgtgattttatggagcacaataaggtacattgagatagcatactaaaggaggccaaatacaggaagcatcatcttttcttattctcttactgcctggattttcccactgacctggaattgtgcacagttctacaaaggacaattgacattgttttccttttactaagtagtgggttttccttaaggtccagactgaattttgagacctgtatcaggattgccttctgtgtgactttttcttgcaggatctgacatcattacctatgggtccatatatttgtgatactttggtttcgggaacatcacttttagaatgttgacataaaatgcacccacagaatgccgtatttatcaaaagtaactttctagcaaaatctacagcagtaggcatttggaatctgcatttgagacctctgcagtcatttggtcattccagcaatctatgtccaggttgtcaatttcagaggtcttattagtctatacaggtaccaatgagctttcagatgttcaacacctacccctggcctaactgctgataaccaaccataacccttgcagatgcatgcatgttttctgcaccttgctatcatttttcagtccatttttcacatgtatacatagtgattatttttaaatgcaaccctgatttcacatgcctcatgttgaaatatcgtgtggcttattgtggacttaaagtgtaacattctccttatggtatgtaaggacttttgtataaaccaatgcctatctatctatcatttctgaaaactttttcctcctatgcaatattttctggcctctgtgaacaacttgtagttccttgagatttctattatcacttatgtttttgcaaatctgcaattgaaatgcccttgttccttgttaatgcctattgaatctatatgaacctgtacgtgtgtttctcactgtgataatataatcattgcatgttttatctttcccactagaaagcttctagaaagctagtactatcttttttgtctgtgtaatttttgcatcacaagctatatttaaatgtgggtgcagtgagtggctgttttctgccacatggagaaacatggtctgcagtgagagagaagaatgaagccatgatgaaagcaaaatcaagaaagagtcccgattgtgttccagtacctggttcttctggtcttcatgttcaggtccacctctgcccttttcatgtcttgattgttgaattcttctgtgagatactccaaatatcctaataaattctcatgtttgctt

SEQ ID NO: 3702 - DNA, 7020 bp, Homo sapiens
actcttggtaatgcttgcaggtggcccgttcttcctctttgtccttcgctgccacgtgagaggggagtgtacgcgtgtgcgcgcgtgcgagtgtgcgcgtgtgcagtccccgactcgtcccggcccgttcggagccgcccgggagcgcacaaaggccgacggtttgggcgcgtgcgcgggacacgggggacgggcggtgtcacgtgatcgcgaggccgcgggcgcgcgggcgcgactcggcggcggcgtcttttatcctggtccctacaaataagcctgctcatgtgagataagaaaggagttcctggaaccaggaattcattctcagtgtagaagacctagctgagacctcactccacagttttggggcagaagcagaagagacgcacagtagaaccgatctcagccttgctgatcatctcgtacagcagcagaaaatgaccatgttacaggagtcattctcatttgacgatttatctgtggacttcacccaaaaggagtggcagctactggatccctctcagaagaatttatacaaggatgtgatgttggagaactatagcagcctagtgtcactggggtatgaagttatgaaaccagatgtcatcttcaaattggagcaaggagaagagccgtgggtaggagatggagaaattccaagttcagattctccagaagtctggaaagtagatggtaacatgatgtggcaccaggataaccaagacaagcttaaaattataaaaagaggtcatgaatgtgatgcatttggaaaaaatttcaatctgaacatgaactttgttcctttaaggaaatcaaacagtgaaggtgacttagatggattgattttaaaacatcatttagatttgcttattccaaaaggagattatggaaaagcagaatcagatgactttaatgtgtttgataatttttttctccattccaagcctgaggatactgatacctggttaaaatactatgactgtgataaatataaagagagctataaaaagtcacagattatcatatatcatagaaatcgtttaggggagaaactctatgaatgcagtgaatgtaggaagcgcttcagtaagaaaccaagtctcattaaacatcagagcagacatataagagacatagcctttggctgtggtaattgtggcaaaacctttccccagaagtctcagtttattacacatcacagaactcatacaggagaaaaaccttataattgtagccagtgtgggaaagccttctcccaaaagtcacagctcacatcccatcagcggacacatacaggagagaaaccttatgagtgtggtgaatgtgggaaagccttctcccggaagtcacatctcatatcgcattggagaacacacacaggagagaaaccctatggatgcaatgaatgtgggagggcctttagtgaaaagtccaatctcattaaccatcagagaattcataccggtgagaagccttttgaatgcagggaatgtgggaaagccttcagcaggaagtcacaactcgttacacatcacagaactcacacaggaacaaaaccctttggatgtagtgattgtagaaaagcattctttgagaagtcagagcttattagacatcagacaattcatactggagagaaaccctatgaatgcagcgagtgtaggaaagcatttagagagaggtcgagtctcattaatcatcagagaacacatacaggagagaaacctcatggatgcattcagtgtgggaaggccttctcccagaagtcacatctcatatcacatcagatgacacacacaggagaaaaaccctttatatgcagtaaatgtgggaaagccttcagcaggaaatcacagctcgttagacatcagagaactcatacgggagaaaaaccgtatgaatgcagtgagtgtgggaaagctttcagtgaaaaattaagtctcactaatcatcaaagaattcatacaggagaaaaaccatatgtatgcagtgaatgtgggaaagccttttgtcagaagtcacatctcatatcacatcagaggacacatacaggggagaaaccctatgaatgcagtgaatgtgggaaggcctttggtgagaagtcaagtcttgcaactcatcagagaactcatactggagaaaaaccgtatgaatgcagggactgtgaaaaagctttctcccagaaatcacagctaaatacccatcagagaattcacactggagagaaaccctatgaatgcagtctttgtaggaaagctttttttgagaagtcggagctaattagacatctgagaactcatacaggagaaaaaccttatgaatgcaatgaatgtagaaaagccttcagggagaagtcaagtctcatcaatcatcagagaatacatacaggagagaagccttttgaatgcagtgagtgtggcaaagctttctctcggaagtcacaccttataccacatcaaaggacacatacgggtgagaaaccctatggatgcagtgaatgtaggaaggccttctctcagaagtcacagctggttaatcatcagagaattcatacaggagagaagccttatcgatgcattgaatgtgggaaagctttctcacagaagtcacagctcatcaatcatcagagaactcatacagtaaaaaaatcctaggaatacagttaatagtagtctttgacagatcatcttggacttcaggaaatgcaattatgataacgtttgtagacagtcacgtcatgttaggtgtttgtactccatgaggatgagaactctaaatgaggtggtgtatggaaagccgatcataattcatagagtagagtgaacctatgactgcagtggatctcaaaaacttttaaaaccatagacaagccttatagagtagaacattcacagcaaagaagaatcctgtgaatgtccaaaagccttccagaagtcaagtctcttaagctattagaaatattcccactggggatgagggaaaaccccatgaatgcgggaaatgaggcaatatttttaagaaatgacagttcattgtacataagaaaatgctcttaggaatgaagttctatgaaagtactaaatatgggacagtgcaacaagtaacgagactattttgtattttggagaattcatattatggagaacctaacaatttaaagacactgggaacacttgcccctcagtatagtactgtcaagggaagccatacactttttgtagacatgggtaccaaaaatacccaattctaagtggttgacagatgttcactttgaagtgtgaagttttaaaaatacgtgaataaattggttattgaaacatctaagacatttcttagtggtatttgtggcttatcttctagtgtcacgtatgttttgtgttttggacttacctataatttaatgtaattgggagtatgaaatgcatatgccttttagtgcctctgatgtctgtgaagacaacactacacaccactggtttttattttttaacaataatataaaaaatggaaactcatgtaacatgactacatgaataagtaccttaagtgataacccgtttcttttaacttatagacatacataaggggtcttttgtttttatggacctttctattcagtaactgaagccaacattgtgtaagtcttctgcatcctcagagtctgagtaacagtttatataaaataaatatgcaaaggcaggaaccacagaataaccatagtaatatataactgaatgagcaaaataaaggtgtgtgaactacattacaacacccaaactaaatgaaataaagtagtgctgtattaaatctttttctcatttagtgaggtgcctccatatagtatatatatatgtatcttaagtgatatgtaacccaaatgtcactattttaatttactgtgataaagtatcatggatattttgtgctgctgttatgctttttgtgttgcataaaatatcttgtaaaaattagatggataaatgaattattaaaaaatcacatttctgaagatgtaaagtattagggaattttgtgctggaaaaacatttttgacattcaaggatgcctattttatcttctagcaaatttctgtggtccctggaaaagtacagatgatcctggacttacagtggggttacctcccaataaacccattgtaagttgaaaacattgtaagtcaaaaatgcatttaatacacccaacttaccaaacatcatagcttagcgtagcctaccttaaacattctcagaacacattctaatgcatcatctattttataaaaaggtgttgaatatctgatgtaattattgaatactgaaggtgaaaaatagtagtgtatggataccattgtaatgttgagaaactgtaagtcacatcctcttaagtcaggaactatctgtataaggaaacaagatttccattttatcatttgaaatgtatttgactttgtttcactagttgcattatccccatggaaaacttcacattgagaacttaccattatatatttccataaaaatgcatgaaccatcccttagctaagtaaggattttgtaatgttctctcaataatgttgcttggcaaagttaatattttttgtatgctgatgaaatttagaaaagtccaatattgagcttgattgcaaacttagaaaaactcaagacttctccttttatgttcaaattgttgtatcagtatggtattttgcacctttaccttaaacaatattttctcctttaattattgattttgcaacattttgggaaagttggaattttaaataaatgaataattttctaaaccagaataccagttcaacagccaaataattctgtctttccatgctgtaattttaaagcatttaattttccaactttttgttcatactcaagtgtatgaacttcctggctgggcacagtggctcatgcctgtaatcccagcactttgggaggctgaggacctcaagtggagacctcaagtggatcacttgaggtcaggagttgaagaccagcatgttcatggccaacatggcaaaaccctgtcttaaattagccgggcatggttgtgcgtgcctgtaatcccagttactcaggaggctgaggcaggagaatcacttgaacctgagaggcagaggttgcagtgagccaagattgtgcagcctgggcgacagagcgagcctctgtcaaaaaaagaaaagaaaaagaacttcctactttttaatatctcaaattcattttactagacgtgggagaccaactaatgcaaatgaacagttacagggtgatgttgtactttgtgatttttgccctattttttctttccatctatcaccattctctttccaatcccagagattgatttattaggtcttggaaattctagattattccattaactattaagcagttaaacctgatacttcctacactagataatggaacttcaacattagcctattgattgcccaagaacaaacatttttttctaaatgtcaggtgttatggggaggattgatgctgacagcagaggtctagttaaaaactgatgcagaggttcaaatacgttgtgcagtaatcactagaactcaccttctaaagtgtcatgagagctctgattctgcaattagagattttttaatgtgtttttgaaattaccttgtaaaccacaaatctgtgtctctgcattgccccttattgtttcctaccacaaattctacatcaagaagaaagttttaaagttagactggatttatttgtgattttatggagcacaataaggtacattgagatagcatactaaaggaggccaaatacaggaagcatcatcttttcttattctcttactgcctggattttcccactgacctggaattgtgcacagttctacaaaggacaattgacattgttttccttttactaagtagtgggttttccttaaggtccagactgaattttgagacctgtatcaggattgccttctgtgtgactttttcttgcaggatctgacatcattacctatgggtccatatatttgtgatactttggtttcgggaacatcacttttagaatgttgacataaaatgcacccacagaatgccgtatttatcaaaagtaactttctagcaaaatctacagcagtaggcatttggaatctgcatttgagacctctgcagtcatttggtcattccagcaatctatgtccaggttgtcaatttcagaggtcttattagtctatacaggtaccaatgagctttcagatgttcaacacctacccctggcctaactgctgataaccaaccataacccttgcagatgcatgcatgttttctgcaccttgctatcatttttcagtccatttttcacatgtatacatagtgattatttttaaatgcaaccctgatttcacatgcctcatgttgaaatatcgtgtggcttattgtggacttaaagtgtaacattctccttatggtatgtaaggacttttgtataaaccaatgcctatctatctatcatttctgaaaactttttcctcctatgcaatattttctggcctctgtgaacaacttgtagttccttgagatttctattatcacttatgtttttgcaaatctgcaattgaaatgcccttgttccttgttaatgcctattgaatctatatgaacctgtacgtgtgtttctcactgtgataatataatcattgcatgttttatctttcccactagaaagcttctagaaagctagtactatcttttttgtctgtgtaatttttgcatcacaagctatatttaaatgtgggtgcagtgagtggctgttttctgccacatggagaaacatggtctgcagtgagagagaagaatgaagccatgatgaaagcaaaatcaagaaagagtcccgattgtgttccagtacctggttcttctggtcttcatgttcaggtccacctctgcccttttcatgtcttgattgttgaattcttctgtgagatactccaaatatcctaataaattctcatgtttgcttc

SEQ ID NO: 3703 - DNA, 559 bp, Homo sapiens
gcagtccccgactcgtcccggcccgttcggagccgcccgggagcgcacaaaggccgacggtttgggcgcgtgcgcgggacacgggggacgggcggtgtcacgtgatcgcgaggccgcgggcgcgcgggcgcgactcggcggcggcgtcttttgtgagttcatccacagatcctggtccctacaaataagcctgctcatgtgagataagaaaggagttcctggaaccaggaattcattctcagtgtagaagacctagctgagacctcactccacagttttggggcagaagcagaagagacgcacagtagaaccgatctcagccttgctgatcatctcgtacagcagcagaaaatgaccatgttacaggagtcattctcatttgacgatttatctgtggacttcacccaaaaggagtggcagctactggatccctctcagaagaatttatacaaggatgtgatgttggagaactatagcagcctagtgtcactggggtatgaagttatgaaaccagatgtcatcttcaaattggagcaaggagaagagccgtgggtaggag

SEQ ID NO: 3704 - DNA, 7020 bp, Homo sapiens; identical to SEQ ID NO: 3702

SEQ ID NO: 3705 - DNA, 558 bp, Homo sapiens
ggcggcggcgtcttttgtgagttcaagacctaggcttccactgttccattttactatattctgtttccctgagagtgctgtttcagttatatagcaagcgtacctctggccttagatgatcgtgaattccaagttcctagcaagagagaaagagatttcatgtgcaatgtgaatataccagttgaagtacatttctcccgaagtccacagatcctggtccctacaaataagcctgctcatgtgagataagaaaggagttcctggaaccaggaattcattctcagtgtagaagacctagctgagacctcactccacagttttggggcagaagcagaagagacgcacagtagaaccgatctcagccttgctgatcatctcgtacagcagcagaaaatgaccatgttacaggagtcattctcatttgacgatttatctgtggacttcacccaaaaggagtggcagctactggatccctctcagaagaatttatacaaggatgtgatgttggagaactatagcagcctagtgtcactggggtatgaagttatgaaaccagat

SEQ ID NO: 3706 - DNA, 3237 bp, Homo sapiens
gtgtgcagtccccgactcgtcccggcccgttcggagccgcccgggagcgcacaaaggccgacggtttgggcgcgtgcgcgggacacgggggacgggcggtgtcacgtgatcgcgaggccgcgggcgcgcgggcgcgactcggcggcggcgtctttttccacagatcctggtccctacaaataagcctgctcatgtgagataagaaaggagttcctggaaccaggaattcattctcagtgtagaagacctagctgagacctcactccacagttttggggcagaagcagaagagacgcacagtagaaccgatctcagccttgctgatcatctcgtacagcagcagaaaatgaccatgttacaggagtcattctcatttgacgatttatctgtggacttcacccaaaaggagtggcagctactggatccctctcagaagaatttatacaaggatgtgatgttggagaactatagcagcctagtgtcactggggtatgaagttatgaaaccagatgtcatcttcaaattggagcaaggagaagagccgtgggtaggagatggagaaattccaagttcagattctccagaagtctggaaagtagatggtaacatgatgtggcaccaggataaccaagacaagcttaaaattataaaaagaggtcatgaatgtgatgcatttggaaaaaatttcaatctgaacatgaactttgttcctttaaggaaatcaaacagtgaaggtgacttagatggattgattttaaaacatcatttagatttgcttattccaaaaggagattatggaaaagcagaatcagatgactttaatgtgtttgataatttttttctccattccaagcctgaggatactgatacctggttaaaatactatgactgtgataaatataaagagagctataaaaagtcacagattatcatatatcatagaaatcgtttaggggagaaactctatgaatgcagtgaatgtaggaagcgcttcagtaagaaaccaagtctcattaaacatcagagcagacatataagagacatagcctttggctgtggtaattgtggcaaaacctttccccagaagtctcagtttattacacatcacagaactcatacaggagaaaaaccttataattgtagccagtgtgggaaagccttctcccaaaagtcacagctcacatcccatcagcggacacatacaggagagaaaccttatgagtgtggtgaatgtgggaaagccttctcccggaagtcacatctcatatcgcattggagaacacacacaggagagaaaccctatggatgcaatgaatgtgggagggcctttagtgaaaagtccaatctcattaaccatcagagaattcataccggtgagaagccttttgaatgcagggaatgtgggaaagccttcagcaggaagtcacaactcgttacacatcacagaactcacacaggaacaaaaccctttggatgtagtgattgtagaaaagcattctttgagaagtcagagcttattagacatcagacaattcatactggagagaaaccctatgaatgcagcgagtgtaggaaagcatttagagagaggtcgagtctcattaatcatcagagaacacatacaggagagaaacctcatggatgcattcagtgtgggaaggccttctcccagaagtcacatctcatatcacatcagatgacacacacaggagaaaaaccctttatatgcagtaaatgtgggaaagccttcagcaggaaatcacagctcgttagacatcagagaactcatacgggagaaaaaccgtatgaatgcagtgagtgtgggaaagctttcagtgaaaaattaagtctcactaatcatcaaagaattcatacaggagaaaaaccatatgtatgcagtgaatgtgggaaagccttttgtcagaagtcacatctcatatcacatcagaggacacatacaggggagaaaccctatgaatgcagtgaatgtgggaaggcctttggtgagaagtcaagtcttgcaactcatcagagaactcatactggagaaaaaccgtatgaatgcagggactgtgaaaaagctttctcccagaaatcacagctaaatacccatcagagaattcacactggagagaaaccctatgaatgcagtctttgtaggaaagctttttttgagaagtcggagctaattagacatctgagaactcatacaggagaaaaaccttatgaatgcaatgaatgtagaaaagccttcagggagaagtcaagtctcatcaatcatcagagaatacatacaggagagaagccttttgaatgcagtgagtgtggcaaagctttctctcggaagtcacaccttataccacatcaaaggacacatacgggtgagaaaccctatggatgcagtgaatgtaggaaggccttctctcagaagtcacagctggttaatcatcagagaattcatacaggagagaagccttatcgatgcattgaatgtgggaaagctttctcacagaagtcacagctcatcaatcatcagagaactcatacagtaaaaaaatcctaggaatacagttaatagtagtctttgacagatcatcttggacttcaggaaatgcaattatgataacgtttgtagacagtcacgtcatgttaggtgtttgtactccatgaggatgagaactctaaatgaggtggtgtatggaaagccgatcataattcatagagtagagtgaacctatgactgcagtggatctcaaaaacttttaaaaccatagacaagccttatagagtagaacattcacagcaaagaagaatcctgtgaatgtccaaaagccttccagaagtcaagtctcttaagctattagaaatattcccactggggatgagggaaaaccccatgaatgcgggaaatgaggcaatatttttaagaaatgacagttcattgtacataagaaaatgctcttaggaatgaagttctatgaaagtactaaatatgggacagtgcaacaagtaacgagactattttgtattttggagaattcatattatggagaacctaacaatttaaagacactgggaacacttgcccctcagtatagtactgtcaagggaagccatacactttttgtagacatgggtaccaaaaatacccaattctaagtggttgacagatgttcactttgaagtgtgaagttttaaaaatacgtgaataaattggttattgaaacatctaagaca

SEQ ID NO: 3707 - DNA, 960 bp, Homo sapiens
ggacgggcggtgtcacgtgatcgcgaggccgcgggcgcgcgggcgcgactcggcggcggcgtcttttatcctggtccctacaaataagcctgctcatgtgagataagaaaggagttcctggaaccaggaattcattctcagtgtagaagacctagctgagacctcactccacagttttggggcagaagcagaagagacgcacagtagaaccgatctcagccttgctgatcatctcgtacagcagcagaaaatgaccatgttacaggagtcattctcatttgacgatttatctgtggacttcacccaaaaggagtggcagctactggatccctctcagaagaatttatacaaggatgtgatgttggagaactatagcagcctagtgtcactggggtatgaagttatgaaaccagatgtcatcttcaaattggagcaaggagaagagccgtgggtaggagatggagaaattccaagttcagattctccagaagtctggaaagtagatggtaacatgatgtggcaccaggataaccaagacaagcttaaaattataaaaagaggtcatgaatgtgatgcatttggaaaaaatttcaatctgaacatgaactttgttcctttaaggaaatcaaacagtgaaggtgacttagatggattgattttaaaacatcatttagatttgcttattccaaaaggagattatggaaaagcagaatcagatgactttaatgtgtttgataatttttttctccattccaagcctgaggatactgatacctggttaaaatactatgactgtgataaatataaagagagctataaaaagtcacagattatcatatatcatagaaatcgtttaggggagaaactctatgaatgcagtgaatgtaggaagcgcttcagtaagaaaccaagtctcattaaacatcagagcagacatataagagacatagcctttggctg

SEQ ID NO: 3708 - DNA, 539 bp, Homo sapiens
gtgcagtccccgactcgtcccggcccgttcggagccgcccgggagcgcacaaaggccgacggtttgggcgcgtgcgcgggacacgggggacgggcggtgtcacgtgatcgcgaggccgcgggcgcgcgggcgcgactcggcggcggcgtcttttatcctggtccctacaaataagcctgctcatgtgagataagaaaggagttcctggaaccaggaattcattctcagtgtagaagacctagctgagacctcactccacagttttggggcagaagcagaagagacgcacagtagaaccgatctcagccttgctgatcatctcgtacagcagcagaaaatgaccatgttacaggagtcattctcatttgacgatttatctgtggacttcacccaaaaggagtggcagctactggatccctctcagaagaatttatacaaggatgtgatgttggagaactatagcagcctagtgtcactggggtatgaagttatgaaaccagatgtcatcttcaaattggagcaaggagaagagccgtggg

SEQ ID NO: 3709 - DNA, 562 bp, Homo sapiens
aaataaggttattgacctggaaagatgttcttcacataatgggaaaaaaacaaaaacagcttttaaatatgaccatatgcttccattgtatgaaaaatatcacaatagtttccatcatcctaagaatggttacctgtgtccacagatcctggtccctacaaataagcctgctcatgtgagataagaaaggagttcctggaaccaggaattcattctcagtgtagaagacctagctgagacctcactccacagttttggggcagaagcagaagagacgcacagtagaaccgatctcagccttgctgatcatctcgtacagcagcagaaaatgaccatgttacaggagtcattctcatttgacgatttatctgtggacttcacccaaaaggagtggcagctactggatccctctcagaagaatttatacaaggatgtgatgttggagaactatagcagcctagtgtcactggggtatgaagttatgaaaccagatgtcatcttcaaattggagcaaggagaagagccgtgggtaggagatggagaaattccaagttcagattct

SEQ ID NO: 3710 - DNA, 3501 bp, Homo sapiens
aatgcttgcaggtggcccgttcttcctctttgtccttcgctgccacgtgagaggggagtgtacgcgtgtgcgcgcgtgcgagtgtgcgcgtgtgcagtccccgactcgtcccggcccgttcggagccgcccgggagcgcacaaaggccgacggtttgggcgcgtgcgcgggacacgggggacgggcggtgtcacgtgatcgcgaggccgcgggcgcgcgggcgcgactcggcggcggcgtcttttagacctaggcttccactgttccattttactatattctgtttccctgagagtgctgtttcagttatatagcaagcgtacctctggccttagatgatcgtgaattccaagttcctagcaagagagaaagagatttcatgtgcaatgtgaatataccagttgaagtacatttctcccgaagtccacagatcctggtccctacaaataagcctgctcatgtgagataagaaaggagttcctggaaccaggaattcattctcagtgtagaagacctagctgagacctcactccacagttttggggcagaagcagaagagacgcacagtagaaccgatctcagccttgctgatcatctcgtacagcagcagaaaatgaccatgttacaggagtcattctcatttgacgatttatctgtggacttcacccaaaaggagtggcagctactggatccctctcagaagaatttatacaaggatgtgatgttggagaactatagcagcctagtgtcactggggtatgaagttatgaaaccagatgtcatcttcaaattggagcaaggagaagagccgtgggtaggagatggagaaattccaagttcagattctccagtctggaaagtagatggtaacatgatgtggcaccaggataaccaagacaagcttaaaattataaaaagaggtcatgaatgtgatgcatttggaaaaaatttcaatctgaacatgaactttgttcctttaaggaaatcaaacagtgaaggtgacttagatggattgattttaaaacatcatttagatttgcttattccaaaaggagattatggaaaagcagaatcagatgactttaatgtgtttgataatttttttctccattccaagcctgaggatactgatacctggttaaaatactatgactgtgataaatataaagagagctataaaaagtcacagattatcatatatcatagaaatcgtttaggggagaaactctatgaatgcagtgaatgtaggaagcgcttcagtaagaaaccaagtctcattaaacatcagagcagacatataagagacatagcctttggctgtggtaattgtggcaaaacctttccccagaagtctcagtttattacacatcacagaactcatacaggagaaaaaccttataattgtagccagtgtgggaaagccttctcccaaaagtcacagctcacatcccatcagcggacacatacaggagagaaaccttatgagtgtggtgaatgtgggaaagccttctcccggaagtcacatctcatatcgcattggagaacacacacaggagagaaaccctatggatgcaatgaatgtgggagggcctttagtgaaaagtccaatctcattaaccatcagagaattcataccggtgagaagccttttgaatgcagggaatgtgggaaagccttcagcaggaagtcacaactcgttacacatcacagaactcacacaggaacaaaaccctttggatgtagtgattgtagaaaagcattctttgagaagtcagagcttattagacatcagacaattcatactggagagaaaccctatgaatgcagcgagtgtaggaaagcatttagagagaggtcgagtctcattaatcatcagagaacacatacaggagagaaacctcatggatgcattcagtgtgggaaggccttctcccagaagtcacatctcatatcacatcagatgacacacacaggagaaaaaccctttatatgcagtaaatgtgggaaagccttcagcaggaaatcacagctcgttagacatcagagaactcatacgggagaaaaaccgtatgaatgcagtgagtgtgggaaagctttcagtgaaaaattaagtctcactaatcatcaaagaattcatacaggagaaaaaccatatgtatgcagtgaatgtgggaaagccttttgtcagaagtcacatctcatatcacatcagaggacacatacaggggagaaaccctatgaatgcagtgaatgtgggaaggcctttggtgagaagtcaagtcttgcaactcatcagagaactcatactggagaaaaaccgtatgaatgcagggactgtgaaaaagctttctcccagaaatcacagctaaatacccatcagagaattcacactggagagaaaccctatgaatgcagtctttgtaggaaagctttttttgagaagtcggagctaattagacatctgagaactcatacaggagaaaaaccttatgaatgcaatgaatgtagaaaagccttcagggagaagtcaagtctcatcaatcatcagagaatacatacaggagagaagccttttgaatgcagtgagtgtggcaaagctttctctcggaagtcacaccttataccacatcaaaggacacatacgggtgagaaaccctatggatgcagtgaatgtaggaaggccttctctcagaagtcacagctggttaatcatcagagaattcatacaggagagaagccttatcgatgcattgaatgtgggaaagctttctcacagaagtcacagctcatcaatcatcagagaactcatacagtaaaaaaatcctaggaatacagttaatagtagtctttgacagatcatcttggacttcaggaaatgcaattatgataacgtttgtagacagtcacgtcatgttaggtgtttgtactccatgaggatgagaactctaaatgaggtggtgtatggaaagccgatcataattcatagagtagagtgaacctatgactgcagtggatctcaaaaacttttaaaaccatagacaagccttatagagtagaacattcacagcaaagaagaatcctgtgaatgtccaaaagccttccagaagtcaagtctcttaagctattagaaatattcccactggggatgagggaaaaccccatgaatgcgggaaatgaggcaatatttttaagaaatgacagttcattgtacataagaaaatgctcttaggaatgaagttctatgaaagtactaaatatgggacagtgcaacaagtaacgagactattttgtattttggagaattcatattatggagaacctaacaatttaaagacactgggaacacttgcccctcagtatagtactgtcaagggaagccatacactttttgtagacatgggtaccaaaaatacccaattctaagtggttgacagatgttcactttgaagtgtgaagttttaaaaatacgtgaataaattggttattgaaacatctaagaca

SEQ ID NO: 3711 - DNA, 546 bp, Homo sapiens
gacctggaaagatgttcttcacataatgggaaaaaaacaaaaacagcttttaaatatgaccatatgcttccattgtatgaaaaatatcacaatagtttccatcatcctaagaatggttacctgtggtgagatcatagataatagttcttatttagcttgtagacctaggcttccactgttccattttactatattctgtttccctgagagtgctgtttcagttatatagcaagcgtacctctggccttagatgatcgtgaattccaagttcctagcaagagagaaagagatttcatgtgcaatgtgaatataccagttgaagtacatttctcccgaagtccacagatcctggtccctacaaataagcctgctcatgtgagataagaaaggagttcctggaaccaggaattcattctcagtgtagaagacctagctgagacctcactccacagttttggggcagaagcagaagagacgcacagtagaaccgatctcagccttgctgatcatctcgtacagcagcagaaaatgaccatgttacaggtg

SEQ ID NO: 3712 - DNA, 1503 bp, Homo sapiens
atgttggaaggacatgaaagctatgacactgaaaatttttacttcagggaaatccggaaaaatctacaggaagttgactttcaatggaaagatggtgaaataaattataaagaagggccgatgacccataaaaacaatcttactggtcaaagagttcgacatagtcaaggggacgtagaaaacaagcatatggaaaatcagcttatattaaggtttcagtccggtctgggtgaattgcagaaatttcaaactgcagagaaaatttatggatgtaatcaaattgagaggacagttaataattgttttttagcttcaccacttcaaagaatttttcctggtgtccaaaccaacatttctaggaaatatgggaatgattttttgcaactttcgttacctacacaagacgagaaaacacatattagggaaaaaccttacataggtaatgagtgtggcaaagccttcagagtgtcttcaagtcttattaatcatcagatgatacatactacagagaaaccttacagatgcaatgagtctggtaaagcctttcatcggggctcactactaacagtacatcagatagtccatacaagagggaaaccataccaatgtgatgtatgtggcaggatcttcagacaaaattcagatcttgtaaatcaccggagaagtcacactggagacaaaccctacatatgtaatgaatgtggcaagtcctttagtaaaagttcccaccttgcagttcatcagagaattcatactggagagaaaccttacaaatgtaatcgatgtgggaagtgctttagtcaaagttcctctcttgcaactcatcagacagttcatactggagacaaaccctacaaatgtaatgaatgtggcaaaacctttaaacggaactcaagcctcactgcacatcatataatccatgcaggaaagaaaccatatacatgtgatgtatgtggcaaggtcttttatcagaattcacaacttgtaaggcaccagataattcatactggagagacaccttacaaatgtaatgaatgtggcaaggtcttccgttatcgctcaggcctcgcacgtcattggagtattcatactggagagaaaccttacaaatgtaatgagtgtggcaaagcctttagagtacgttcaattctgcttaatcatcagatgatgcatactggagagaaaccttataaatgtaatgaatgtggtaaagcttttatcgaaaggtcaaacttggtttaccatcagagaaaccatactggagagaagccatacaaatgtatggaatgtggcaaggcgtttgggcggcggtcttgcctcactaaacaccaacgaattcattctagtgaaaaaccttataaatgtaatgagtgtggcaaatcttacattagtcgctcaggcctcactaaacatcagataaaacatgctggagagaaccttacaactaaactcaatgtggaaaggccgttagatgttgtcctaacctctgggatccccaaataa

SEQ ID NO: 3713 - DNA, 3876 bp, Homo sapiens
acacccggaagcagatcgcgctggggaaaggccacgtcgctatgagtgtgtttcagtctacctggattaaacgtttgcttctcttcgtctaccttgattaaacgtgcacttcgcagtcctcggttctccatacccgtgacctggggatcgctacggaccttaaaatacccgcaacagccccttcgtcccaagctggagagcagtggcatgatctcggctcactgcagcttctacttcctggcctcaagcagtctttccacctcagcctctcaacgcactggaattacagatgtgagccaccacactaggcctacaagtggtccttacaccagattaatttatcttgaaatggcgggcaactgaatcgcacacctcaatctatgatttgacttttaaagaattaattatattgactgagagagaggcccaggagagaaagaagaaagaaaaggagccagggatggctcttcctcagggatctttgacattcagggatgtggctgtagaattctctcaggaggagtggaaatgcctggaccctgttcagaaagctttgtacagggacgtgatgttggagaactacaggaacctcggcttcctgggactctgtcttcctgacctgaatattatctccatgttggagcaagggaaagagccctggactgtggtgagccaagtgaaaatagcgaggaacccaaactgtggggaatgcatgaaaggcgtgatcaccggtatctctcctaaatgtgtgatcaaggaattaccaccaatacagaacagtaacacaggagaaaaattccaagcagtgatgttggaaggacatgaaagctatgacactgaaaatttttacttcagggaaatccggaaaaatctacaggaagttgactttcaatggaaagatggtgaaataaattataaagaagggccgatgacccataaaaacaatcttactggtcaaagagttcgacatagtcaaggggacgtagaaaacaagcatatggaaaatcagcttatattaaggtttcagtccggtctgggtgaattgcagaaatttcaaactgcagagaaaatttatggatgtaatcaaattgagaggacagttaataattgttttttagcttcaccacttcaaagaatttttcctggtgtccaaaccaacatttctaggaaatatgggaatgattttttgcaactttcgttacctacacaagacgagaaaacacatattagggaaaaaccttacataggtaatgagtgtggcaaagccttcagagtgtcttcaagtcttattaatcatcagatgatacatactacagagaaaccttacagatgcaatgagtctggtaaagcctttcatcggggctcactactaacagtacatcagatagtccatacaagagggaaaccataccaatgtgatgtatgtggcaggatcttcagacaaaattcagatcttgtaaatcaccggagaagtcacactggagacaaaccctacatatgtaatgaatgtggcaagtcctttagtaaaagttcccaccttgcagttcatcagagaattcatactggagagaaaccttacaaatgtaatcgatgtgggaagtgctttagtcaaagttcctctcttgcaactcatcagacagttcatactggagacaaaccctacaaatgtaatgaatgtggcaaaacctttaaacggaactcaagcctcactgcacatcatataatccatgcaggaaagaaaccatatacatgtgatgtatgtggcaaggtcttttatcagaattcacaacttgtaaggcaccagataattcatactggagagacaccttacaaatgtaatgaatgtggcaaggtcttctttcaacgttcacgtcttgcagggcaccggagaattcatactggagagaaaccctacaaatgtaatgaatgtggcaaggtcttcagtcaacattcacatcttgcagtgcatcagagagttcatactggagagaaaccttacaaatgtaatgaatgtggcaaagcctttaattggggctcattactaactgtacatcagagaattcataccggagagaaaccttacaaatgtaatgtgtgtggcaaggtctttaattacggtggatacctttcggttcatatgagatgtcatactggagagaaacctctccattgtaataaatgtggcatggtcttcacttactattcatgcctagcacgtcatcaaagaatgcataccggagagaaaccttacaaatgtaatgtgtgtggcaaggtcttcattgacagtggaaacctttcaattcataggcgaagtcataccggagagaaacctttccagtgtaacgaatgcggcaaggtcttcagttactactcatgcctagcacgtcatcggaaaattcataccggagagaaaccttataaatgtaatgattgtggcaaagcctatactcagcgttcaagcctcactaaacatctggtaattcatactggagagaacccttaccactgtaatgaatttggtgaggcttttatccaaagttcaaaacttgcaagatatcacagaaatcctactggggagaaaccacacaaatgtagtgaatgtggtagaacttttagtcataaaacaagtctggtgtaccatcagagaagacatactggagagatgccatacaaatgtattgaatgtgggaaagtctttaactccactacaaccctggcaaggcatcggagaattcatactggagagaaaccttacaaatgtaatgaatgtggcaaggtcttccgttatcgctcaggcctcgcacgtcattggagtattcatactggagagaaaccttacaaatgtaatgagtgtggcaaagcctttagagtacgttcaattctgcttaatcatcagatgatgcatactggagagaaaccttataaatgtaatgaatgtggtaaagcttttatcgaaaggtcaaacttggtttaccatcagagaaaccatactggagagaagccatacaaatgtatggaatgtggcaaggcgtttgggcggcggtcttgcctcactaaacaccaacgaattcattctagtgaaaaaccttataaatgtaatgagtgtggcaaatcttacattagtcgctcaggcctcactaaacatcagataaaacatgctggagagaaccttacaactaaactcaatgtggaaaggccgttagatgttgtcctaacctctgggatccccaaataatttatacttactcatatagcttgtatatttgtcctttccctttgaagtctcatgtggaattgtagtaatctccagtattggaggtggagcctagtgggaggtgattggatgatgggggtggctttctcaagaaagttttagtaccatccccttgttgctgtccttgtgatagttctcatgaggtctggctcatgcctgtaatcccagcactttgggaggctgaggtgggcggatcacttgaggtcaggagttcaagagcagcctggccaacatggtgaaaccctgtttctgccaaaaatacaaaaattagctgggcttcgtggcgggtactggtagtaccagctactcgagaggctgagtcaggagaattgcttgaaccctggaggcggaggttgcagtgagccgagatcgcgccactgcactctagcctgggtgacagagtgagactccatcacgcacacgcacgcacgaaagtgaatggcacctccctcttgtttgttcttctggccatgtgacatgcccttcacctcccaccatcattttaaccttcctcaggtttcccgagagggtgaacagacgtcagcgccatgtttcctataaagcctgcaaaattgtgagtcaattaaacctctttatacatt

SEQ ID NO: 3714 - DNA, 3620 bp, Homo sapiens
acacccggaagcagatcgcgctggggaaaggccacgtcgctatgagtgtgtttcagtctacctggattaaacgtttgcttctcttcgtctaccttgattaaacgtgcacttcgcagtcctcggttctccatacccgtgacctggggatcgctacggaccttaaaatacccgcaacagccccttcgtcccaagctggagagcagtggcatgatctcggctcactgcagcttctacttcctggcctcaagcagtctttccacctcagcctctcaacgcactggaattacagatgtgagccaccacactaggcctacaagtggtccttacaccagattaatttatcttgaaatggcgggcaactgaatcgcacacctcaatctatgatttgacttttaaagaattaattatattgactgagagagaggcccaggagagaaagaagaaagaaaaggagccagggatggctcttcctcaggtatctctcctaaatgtgtgatcaaggaattaccaccaatacagaacagtaacacaggagaaaaattccaagcagtgatgttggaaggacatgaaagctatgacactgaaaatttttacttcagggaaatccggaaaaatctacaggaagttgactttcaatggaaagatggtgaaataaattataaagaagggccgatgacccataaaaacaatcttactggtcaaagagttcgacatagtcaaggggacgtagaaaacaagcatatggaaaatcagcttatattaaggtttcagtccggtctgggtgaattgcagaaatttcaaactgcagagaaaatttatggatgtaatcaaattgagaggacagttaataattgttttttagcttcaccacttcaaagaatttttcctggtgtccaaaccaacatttctaggaaatatgggaatgattttttgcaactttcgttacctacacaagacgagaaaacacatattagggaaaaaccttacataggtaatgagtgtggcaaagccttcagagtgtcttcaagtcttattaatcatcagatgatacatactacagagaaaccttacagatgcaatgagtctggtaaagcctttcatcggggctcactactaacagtacatcagatagtccatacaagagggaaaccataccaatgtgatgtatgtggcaggatcttcagacaaaattcagatcttgtaaatcaccggagaagtcacactggagacaaaccctacatatgtaatgaatgtggcaagtcctttagtaaaagttcccaccttgcagttcatcagagaattcatactggagagaaaccttacaaatgtaatcgatgtgggaagtgctttagtcaaagttcctctcttgcaactcatcagacagttcatactggagacaaaccctacaaatgtaatgaatgtggcaaaacctttaaacggaactcaagcctcactgcacatcatataatccatgcaggaaagaaaccatatacatgtgatgtatgtggcaaggtcttttatcagaattcacaacttgtaaggcaccagataattcatactggagagacaccttacaaatgtaatgaatgtggcaaggtcttctttcaacgttcacgtcttgcagggcaccggagaattcatactggagagaaaccctacaaatgtaatgaatgtggcaaggtcttcagtcaacattcacatcttgcagtgcatcagagagttcatactggagagaaaccttacaaatgtaatgaatgtggcaaagcctttaattggggctcattactaactgtacatcagagaattcataccggagagaaaccttacaaatgtaatgtgtgtggcaaggtctttaattacggtggatacctttcggttcatatgagatgtcatactggagagaaacctctccattgtaataaatgtggcatggtcttcacttactattcatgcctagcacgtcatcaaagaatgcataccggagagaaaccttacaaatgtaatgtgtgtggcaaggtcttcattgacagtggaaacctttcaattcataggcgaagtcataccggagagaaacctttccagtgtaacgaatgcggcaaggtcttcagttactactcatgcctagcacgtcatcggaaaattcataccggagagaaaccttataaatgtaatgattgtggcaaagcctatactcagcgttcaagcctcactaaacatctggtaattcatactggagagaacccttaccactgtaatgaatttggtgaggcttttatccaaagttcaaaacttgcaagatatcacagaaatcctactggggagaaaccacacaaatgtagtgaatgtggtagaacttttagtcataaaacaagtctggtgtaccatcagagaagacatactggagagatgccatacaaatgtattgaatgtgggaaagtctttaactccactacaaccctggcaaggcatcggagaattcatactggagagaaaccttacaaatgtaatgaatgtggcaaggtcttccgttatcgctcaggcctcgcacgtcattggagtattcatactggagagaaaccttacaaatgtaatgagtgtggcaaagcctttagagtacgttcaattctgcttaatcatcagatgatgcatactggagagaaaccttataaatgtaatgaatgtggtaaagcttttatcgaaaggtcaaacttggtttaccatcagagaaaccatactggagagaagccatacaaatgtatggaatgtggcaaggcgtttgggcggcggtcttgcctcactaaacaccaacgaattcattctagtgaaaaaccttataaatgtaatgagtgtggcaaatcttacattagtcgctcaggcctcactaaacatcagataaaacatgctggagagaaccttacaactaaactcaatgtggaaaggccgttagatgttgtcctaacctctgggatccccaaataatttatacttactcatatagcttgtatatttgtcctttccctttgaagtctcatgtggaattgtagtaatctccagtattggaggtggagcctagtgggaggtgattggatgatgggggtggctttctcaagaaagttttagtaccatccccttgttgctgtccttgtgatagttctcatgaggtctggctcatgcctgtaatcccagcactttgggaggctgaggtgggcggatcacttgaggtcaggagttcaagagcagcctggccaacatggtgaaaccctgtttctgccaaaaatacaaaaattagctgggcttcgtggcgggtactggtagtaccagctactcgagaggctgagtcaggagaattgcttgaaccctggaggcggaggttgcagtgagccgagatcgcgccactgcactctagcctgggtgacagagtgagactccatcacgcacacgcacgcacgaaagtgaatggcacctccctcttgtttgttcttctggccatgtgacatgcccttcacctcccaccatcattttaaccttcctcaggtttcccgagagggtgaacagacgtcagcgccatgtttcctataaagcctgcaaaattgtgagtcaattaaacctctttatacatt

SEQ ID NO: 3715 - DNA, 6620 bp, Homo sapiens
gtttatccgcgggtcacattgccgttcgcctcagtctttggcccctcccgccgggtgaggttggcaccccgtttttcctgctctgagagggaccggttgccaccgccatacttctgtcgccctgtcgtctgtgttgtgactgctttggacgtgggagtcacctgaaagccaggaaatggacttggtggctttcgaggatgtggctgtgaacttcacccaggaggagtggtctttgctggatccttcccagaagaatctctacagagaagtgatgcaggaaaccttgaggaatctggcctccataggagaaaaatggaaagaccagaacattgaagatcagtacaaaaatcccaggaataatctaagaagtcttctgggagagagagttgatgaaaatacagaagaaaatcattgtggagaaacttctagccagattccagatgacacactgaacaaaaaaacttctcctggagtaaaatcatgtgaaagcagtgtgtgtggagaagtcttcgtgggtcattcttcccttaataggcacattagagctgacactgcacacaagccgtctgagtatcaggaatatggacaggagccatataagtgtcaacaacgtaagaaagccttcagatgtcacccctcctttcaaatgcaagaaaaggctcacactggagaaaaactctatgattgtaaagaatgtggaaaaaccttcatatcccattcaagcattcaaagacacatgataatgcacaatggagatggaacttataaatgtaagttttgtgggaaagcctgcccttgtctcagcatatatcttatacatgaacgagttcacactggagagaaaccatataaatgtaaacaatgtggtaaagcctttagttattcaacttcccttcaaatacatgaaagaactcacactggagagaagccttatgaatgtaaggaatgtgggaaagcattcggtagtcccaattccctttatgaacatagaagaactcacactggagagaagccatatgaatgcaaacaatgtggaaaagccttcagatggttccattcctttcaaatacatgaaagaactcacagtgaggagaaggcttatgaatgtaccaaatgtgggaaagcattcaagtgtcccagttatctttgtagacatgaagtgacccactctgggaaaaagccctgtgaatgtaaacaatgtgggaaagcattatcttatcttaactttcaaagacacatgaaaatgcacactagaatgagaccttataaatgtaagactgtggaaaagcctttgattctcccagttcgttttgaagacatgaaagaactcacactggagagaaaccttatgaatgcaagcactgtggtaaagccttcaatcgttccagttcctttcactatcatgaaaggactcacactggagagaaaccctatgaatgtaagcagtgtagtaaagccttcatttcttccacttcctttcgatatcatgaaaggactcacactggagagaaaccgtatgagtgtaagcaatgtgggaaagccttcagatctgcctcacaccttcaaatgcatggaaggactcacactcaagagaaaccctatgaatgtaagcagtgtggtaaagccttcattttttccacttcctttcgatatcatgaaaggactcacactggagagaaaccctatgagtgtaagcaatgtgggaaagccttcacatctgcctcacaccttcaaatgcatgaaaggactcacactggaaagcaactgtatgaatctaaacaatgtgaaaaaacctttggatctgtcagaaaccttcaaattcatgaaaagacacaccctggagagaaaccctataaggaatatggaaaagcattcaacaatttctcttcctttcaaatacatgcaacaatgcacagaggacagaatgcctatgaatgtaaagagtgtgacaaagcattcatatctgccaagatccttcgagtacatgcaagaacacaccctggagagaaaccctatgaatgtaaggaatgcggaaaagcgttcaattatttttcttctttgcgtatacacaaaaggatgcacactggagagaaaccatattaatgtaaggattgtgggaaagcattcagtttgcctggttcctttcgtagacataaaagggctcacactggagtgaaaccgtatgaatgcaaggaatgtggcaaagccttcacttcttctggttcctttcagtgtcataaaaggattcacactggagagaaaccctatgagtgtaagcagtgtggtaaagccttcatttcttccactgccattcgtagacatgaaaggactcacactggagagaaaccctatgagtgtaagcaatgtggaaaagcctttatttctttcagttccattcagtaccatgaaaggactcacactggagagaaacagtatgagtgtaagcagtgtggtaaagccttcatgtcttctactgcatttcagtatcatgaaaagacccacaccagagagaaacactatgaatgtaagcagtgtgggaaagccttcatttcttccggtagccttcgatatcatgaaaggactcacactggagagaaaccctatgaatgtaagcagtgtggtaaagccttcagatctgccactcaacttcagatgcatagaaagattcacactggcgagaaaccctatgaatgtaagcaatgtgggaaagcctacagatctgtctcacaacttctggtgcatgaaaggactcacactgtagagcaaccctatgaatataagcaatatgggaaagccttcagatttgctaagaaccttcaaatacagacaatgaatgtaaacaattaaatgtttatagcagctgcatactaacatgttattctgtattttttttttctttttgagacagagtctcgctctgtcacccaggctggagtgcagtggcgtgatctcagctcactgcaagctccacctcctgggttcacgccattctcctgcctcagtctcctgagtagctgggactacaggtgcctgccaccacacccggctgattttttgtattttttagtagagacggagtttcatcgtgttagccaggatggtctcaatctcctgacctcgtgatctgcccgcctcagtctcccaaagtgctgggattacaggtatgagccaccgtgcccggccgttattctctattttttgttgttgtttgagatgagtcttgttctgttgcccaggctggagtgcagtggcatgatctcgcctccgggttcaagcaattctcctgcctcaggctcctgaggaaaaagattcctaggattacaggtgtgcaccaccacacttggctaatttttatatttttagtagagatgaggtctcaccctattggccacactggtcttgaactcctgacctgaagtgatccacctgccttagcctcccaaagtgctgggatgacaggcatgagccactgcacccagctgttattctctatttaattaattgagaagccataataaaatatctcagtgccatcatgcattagatcaagtttatgttaccacattattttttggacattgtgagtcaatattaccaagtggacaaaatcccaggcatctttttcctcatgtaaattttaattttcatgcttatatacttagaacatttatcttggtcctaattttttgttcattcataataccaaaagttatctcatgttcttcagagtgactttgtgccatatcccacagtggcatacctgtcttcaaagagggtataattcacaaaaggacttacactagaggaaaaccctatgaatgtaagctgcgtgggaaagcattttctgatctgagtggcattgaaacccacatggtattgcacatgacagataggcctctctccccgttcatttctttttttttgagacggagtcttgctctgtcgctgaggctgagaacagtggttccatctctgttcactgccacctccacctcctgggttcaagtgattctcctgccccagcctcccaagtagctgggattacaggtgaccgccaccacgcccagctaatttttgtatttttagtagagacggggcttcactatgttggccaggttcgtctcgaactcctgacctcaggtgatccacctgcctcagcctcccaaagtgctgtgcatacaggcatgagccactgcacccggccttctccccattcattttcaaagacataaaaggatgcacaataaagagagaccctctgaatgcaagcaatatggaaaagcattccattgtatcagatccttttgtagccatgaaagaactcgctgaagagaaaccctgtaaatgaagggaatgtgaaaagccttcattcctgaaatgaagcaattcatactattaatatatgagagaaatcctattataagaaattgattgctgtgcacggtagcttacctgtaattccagcacttccagaggctaaggcaggtggatcacttgaggtcaggagttcaataccagcctgggcaacatagtgaaaccctgtctctaccaaaaatacaaaaattagccaggcatggtggcgcgtgcctgtagtcccagctactcaggaggctgaggcaggagaatcacttgaacccaggagctggatgttgcagtgacccgagattacgccactgtaccccagcagagtgagactccatctgaaaaaaaaagcaaggggccggcacggtggttcacgcctgtaatcccagcactttgggagaccaaggcaggcagatcacctgaggtcaggagttcgagaccagcctggctaacatggcaaaaccccatcgctactaaaaatacaaaaaattagatgggcatggtggcacatgcctgtaatcccagctacatgggagactgaggcaggagaattgcttgaacctgggaggcggaggttgcagtgagccaagatcacagcattgcacttcagcctgggcaacaagagtgaaactccatctcaaaaaaaaaaaaaaaaaaaattgaggaagcattcagttgtcccacttcctttcaaacaggaagagacactagagagaaaccctctgagataactgactgttgaattaagaagagaggcctggccggacacagtggctcacgcctgtaatcccagcactttgggaggctgaggtgggcggatcacgaggtcaggagatcaagaccatcctggctgacacggtgaaaccccgtctctactaaaaaatacaaaaaaactagctgggcgtggtggtgggcgcctgtagtcccagctactcgggaggctgaagcaggagaatggcgtgaatccaggaggcagagcttgcagtgaaccgagatcgcgccactgcactccagcggcgacagagcaagactccgtctcaaaaaaaaaaaaaaaaaaaagagaagtctgacaggacaataaaatttagaaatggagttggaggatgtcataatacaattcaccagtgtcctatcttacatgcaatttcaaaggcagacaagaggaagtcatcagtcacattttagaggcaccaaacaggtgccacatccatacaggctgactccctgctcccagcccattttttcctgaatctttggcttgccaatcaagaatgtcctcaaaatttgctcagaggtgtgggcctttgggtaaaggtgtcttcagaagctccacattaaagatccatcagtggttaagggcaaattgaagagaaataaagactaagatatttttttaaaagactgaaagaatagaacaatgaaaaagccccatctgtaatacagtttttctttttctttttttttgagacaaggtctctctctgtcacccaggctggagtagagtggcattatcctggctcattgcaatctgggcctcctggtttcaagtgattctggtgtctcagccacctgagtagtcaggattacaggtgcacaccaccacgcatggctaaatttttgtatttttagtagagatggggtttcaccatgttgagcaagctggtcttaaactcctgacctcaagtgatccgtctgtcttggcctttcaaaatgctgggattataggcgtgatccactgtgcctggcctggtgtttctttaggtataatgtctttaccagagagctaatgcagactgtcatgggtgagattgttctctgatgttcaattcccctactttgtatattgagtcagtatgagatgcgatttgtttggcaagcacctttgttcctgctgttactgacccttatcttgtagcctcacagctactatgcttttgtccagtccaactagataggagcttcttcctctgctgcagtgactggtctcacccagggctttcaggaaggtgagaataagcaccttcctcctcccaggaagttttgagtttcctgtgtttcatttctgaatgtaatgtctccatttattttcaattatgtttgattatatttgattaaaaacaataatttttttggcaaccaagatttctgtacatgtgtcatagaaatagttgaacttttccacaactgtatactgacaaacattattctttcttaattaattcagtagctatattaaaatatgtattagatcaagttca

SEQ ID NO: 3716 - DNA, 1193 bp, Homo sapiens
cacattgccgttcgcctcagtctttggcccctcccgccgggtgaggttggcaccccgtttttcctgctctgagagggaccggttgccaccgccatacttctgtcgccctgtcgtctgtgttgtgactgctttggacgtgggagtcacctgaaagccaggaaatggacttggtggctttcgaggatgtggctgtgaacttcacccaggaggagtggtctttgctggatccttcccagaagaatctctacagagaagtgatgcaggaaaccttgaggaatctggcctccataggagaaaaatggaaagaccagaacattgaagatcagtacaaaaatcccaggaataatctaagaagtcttctgggagagagagttgatgaaaatacagaagaaaatcattgtggagaaacttctagccagattccagatgacacactgaacaaaaaaacttctcctggagtaaaatcatgtgaaagcagtgtgtgtggagaagtcttcgtgggtcattcttcccttaataggcacattagagctgacacatgtcacccctcctttcaaatgcaagaaaaggctcacactggagaaaaactctatgattgtaaagaatgtggaaaaaccttcatatcccattcaagcattcaaagacacatgataatgcacaatggagatggaacttataaatgtaagttttgtgggaaagcctgcccttgtctcagcatatatcttatacatgaacgagttcacactggagagaaaccatataaatgtaaacaatgtggtaaagcctttagttattcaacttcccttcaaatacatgaaagaactcacactggagagaagccttatgaatgtaaggaatgtgggaaagcattcggtagtcccaattccctttatgaacatagaagaactcacactggagagaagccatatgaatgcaaacaatgtggaaaagccttcagatggttccattcctttcaaatacatgaaagaactcacagtgaggagaaggcttatgaatgtaccaaatgtgggaaagcattcaagtgtcccagttatctttgtagacatgaagtgacccactctgggaaaaagccctgtgaatgtaaacaatgtgggaaagcattatcttatcttaactttcaaagacatgaaagaactcacactggagagaaaccttatgaatgcaagcactgt

SEQ ID NO: 3717 - DNA, 1935 bp, Homo sapiens
gtttatccgcgggtcacattgccgttcgcctcagtctttggcccctcccgccgggtgaggttggcaccccgtttttcctgctctgagagggaccggttgccaccgccatacttctgtcgccctgtcgtctgtgttgtgactgctttggacgtgggagtcacctgaaagccaggaaatggacttggtggctttcgaggatgtggctgtgaacttcacccaggaggagtggtctttgctggatccttcccagaagaatctctacagagaagtgatgcaggaaaccttgaggaatctggcctccataggagaaaaatggaaagaccagaacattgaagatcagtacaaaaatcccaggaataatctaagaagtcttctgggagagagagttgatgaaaatacagaagaaaatcattgtggagaaacttctagccagattccagatgacacactgaacaaaaaaacttctcctggagtaaaatcatgtgaaagcagtgtgtgtggagaagtcttcgtgggtcattcttcccttaataggcacattagagctgacactgcacacaagccgtctgagtatcaggaatatggacaggagccatataagtgtcaacaacgtaagaaagccttcagatgtcacccctcctttcaaatgcaagaaaaggctcacactggagaaaaactctatgattgtaaagaatgtggaaaaaccttcatatcccattcaagcattcaaagacacatgataatgcacaatggagatggaacttataaatgtaagttttgtgggaaagcctgcccttgtctcagcatatatcttatacatgaacgagttcacactggagagaaaccatataaatgtaaacaatgtggtaaagcctttagttattcaacttcccttcaaatacatgaaagaactcacactggagagaagccttatgaatgtaaggaatgtgggaaagcattcggtagtcccaattccctttatgaacatagaagaactcacactggagagaagccatatgaatgcaaacaatgtggaaaagccttcagatggttccattcctttcaaatacatgaaagaactcacagtgaggagaaggcttatgaatgtaccaaatgtgggaaagcattcaagtgtcccagttatctttgtagacatgaagtgacccactctgggaaaaagccctgtgaatgtaaacaatgtgggaaagcattatcttatcttaactttcaaagacacatgaaaatgcacactagaatgagaccttataaatgtaagactgtggaaaagcctttgattctcccagttcgttttgaagacatgaaagaactcacactggagagaaaccttatgaatgcaagcactgtggtaaagccttcaatcgttccagttcctttcactatcatgaaaggactcacactggagagaaaccctatgaatgtaagcagtgtagtaaagccttcatttcttccacttcctttcgatatcatgaaaggactcacactggagagaaaccgtatgagtgtaagcaatgtgggaaagccttcagatctgcctcacaccttcaaatgcatggaaggactcacactcaagagaaaccctatgaatgtaagcagtgtggtaaagccttcattttttccacttcctttcgatatcatgaaaggactcacactggagagaaaccctatgagtgtaagcaatgtgggaaagccttcacatctgcctcacaccttcaaatgcatgaaaggacaataaaatttagaaatggagttggaggatgtcataatacaattcaccagtgtcctatcttacatgcaatttcaaaggcagacaagaggaagtcatcagtcacattttagaggcaccaaacaggtgccacatccatacaggctgactccctgctcccagcccattttttcctgaatctttggcttgcc

SEQ ID NO: 3718 - DNA, 180 bp, Homo sapiens
ctgtctctgccccagggtctattgacattcagggatgtggccatagaattctctcaggaagagtggaagtgcctggaccctgctcagaggactctatacagggacgtgatgctggagaattataggaacctggtctccctgggcagcagtgccgtatgtgatcttggctcaccgcagccg

SEQ ID NO: 3719 - DNA, 3706 bp, Homo sapiens
ttcaggattgacttctaaagactcttggtacgtgaggaagaaacccggaagaggaagaggaaagcaaaggagtcagggatggctctttctcagggtctattgacattcagggatgtggccatagaattctctcaggaagagtggaagtgcctggaccctgctcagaggactctatacagggacgtgatgctggagaattataggaacctggtctccctggatatctcttccaaatgcatgatgaaggagttctcatcaacagcacaaggcaatacagaagtgatccacacagggacattgcaaagacatgaacgtcatcacattggagatttttgcttccaggaaatggagaaagatattcatgattttgagtttcagtggaaagaagatgaaagaaatagccatgaagcacccatgacagaaatcaaacagttgacgggtagtacaaaccgacatgatcaaaggcatgctggaaacaagcctattaaagatcagcttggatcaagctttcattcgcatctgcctgaactccacatgtttcagaccgaagggaaaattggtaatcaagttgagaagtctatcaacagtgcttcgttggtttcaacatcccaaagaatttcttgtaggcctaaaacccacatttctaagaactatgggaataatttcctgaattcttcattactcacacaaaagcaggaagtacacatgagagaaaaatctttccaatgtaatgagagtggcaaagcctttaattatagctcagtcttaaggaaacatcagataatccatttaggagcgaaacaatataaatgtgatgtgtgtggcaaggtctttaatcaaaagcgatatcttgcatgtcatcgtagatgtcacactggcaagaaaccttacaagtgtaatgattgtggcaagaccttcagtcaggagttaacccttacatgccatcatagacttcatactggagagaaacattacaagtgcagtgagtgtggcaagaccttcagtcgaaattcagcccttgtaattcataaggcaattcatactggagagaaatcttacaagtgtaatgaatgtggcaagaccttcagtcaaacgtcataccttgtgtaccatcgtagacttcatactggagagaaaccttacaaatgtgaagaatgtgacaaagctttcagtttcaaatcaaaccttgaaagacataggaaaattcatactggagagaaaccttacaagtgtaatgaatgcagcaggacctttagtcggaagtcatcccttacacgccatcgtagacttcatactggagagaaaccttataagtgtaatgattgtggcaagaccttcagtcagatgtcatcccttgtataccatcgtagacttcatactggagagaaaccttacaaatgtgaagaatgtgatgaagctttcagtttcaaatcgaaccttgaaagacataggagaattcatactggagagaaaccttacaagtgtaatgattgtggcaagaccttcagtcagacatcatcccttgtataccatcgtagacttcatactggagagaaaccttacaaatgtgaagaatgtgatgaagctttcagtttcaaatcaaaccttgaaagacataggataattcatactggagagaaactttacaagtgtaatgaatgtggcaagacctttagtcggaagtcatcccttacacgccattgtagacttcatactggagagaaaccttaccagtgtaatgagtgtggcaaagcctttcgtgggcagtcagcacttatttaccatcaagcaatccatggtatagggaaactttacaaatgtaatgattgtcaccaagtctttagtaatgctacaaccattgcaaatcattggagaatccataatgaagagagatcgtacaagtgtaatagatgtggcaaatttttcagacatcgttcataccttgcagttcattggcgaactcatagtggagagaaaccttacaaatgtgaagaatgtgatgaagctttcagtttcaaatcaaaccttcaaagacataggagaattcatactggagagaaaccttacaaatgtgaagaatgtgacaaagttttcagtcgcaaatcaagccttgaaaaacacaggagaattcatactggagagaaaccatacaaatgtaaggtttgtgacaaagcttttgggcgtgattcacacctggcacaacatactagaattcacactggagagaaaccttacaagtgtaatgaatgtggcaagaacttccgtcacaattcagcccttgtaattcataaggcaattcatagtggagagaaaccttacaagtgtaatgagtgtggcaagaccttccgtcacaattcagcccttgaaattcataaggcaattcatactggagaaaaaccttacaagtgtagtgaatgtggcaaggtttttaatagaaaagcaaacctttcacgtcatcatagacttcatactggagagaaaccttacaagtgtaataaatgtggtaaggtttttaatcaacaagcacaccttgcatgtcatcatagaattcatactggagagaaaccttacaagtgtaatgagtgtggcaaaaccttccgtcacaattcagtccttgtaattcataagacaattcatactggagagaaaccttacaagtgtaatgaatgtggcaaggtttttaatcgaaaagcaaaacttgcacgtcatcatagaattcatactggaaagaaacattagaaatatgaagaatgtgacaaagtttacagttgtaaatcaagtcttgaaagacaggagaattcatactggagagaaagcttacaaatgtaagagtttgtgacaagaatcttgggcgtgattcacacctggcccaacaaactagaagtcacactggagagaaaccttacaagtgtactgagtgtggcaaagcctttagtgggcagtcaacacttattcaccatcaggcaatccatggtatagggaaactttactaatgtaatgattatcacaaagtcttcagtaacactacaaccgtttcaaatcattggagaatccataatgagagattttgaaagtgtaataaatgtggcaaatttttcagacattgttcataccttgcagttcatcggtgaactcatgctggagagaaaccttacaaatgtcatgattgtggcaaggtcttcagtctagcttcatcttatgcaaaacaggagacttcatacaggagacaaacttcacaagtatgatgattgcagcaaagcctttacttcacgttcacacctaattagacatcagagaatccatactggacagaaatcttacaaatgtcatcagtgtggcaaggtcttcagtctgagatcaccccttaaggaacatcagaaaattcatttttgagatgattgttccaaatgcaatgagtatagcaaaccatcaagcattaattggcattagagtcaattcagcattgacttgagtttgaattgacttaacattgagttcaagcattaattgacattaaagtgtttatgttaagaagattgggccaggcggggtggctcacgcctgtaatcccagcactttgggaggccaagaccaatagatcacttgaggtcaggagtttgagaccagactggccaacagacatgagtcacttttcccaccctgtattttgtttctttaataaaaactgttacgggtttttatgggt

SEQ ID NO: 3720 - DNA, 4311 bp, Homo sapiens
aaacccggaagcggatcgcatggagtgatggtcccaccgcagcggattgacttctaaagactcttggtacgtgaggaagaaacccggaagaggaagaggaaagcaaaggagtcagggatggctctttctcagggtctattgacattcagggatgtggccatagaattctctcaggaagagtggaagtgcctggaccctgctcagaggactctatacagggacgtgatgctggagaattataggaacctggtctccctggatatctcttccaaatgcatgatgaaggagttctcatcaacagcacaaggcaatacagaagtgatccacacagggacattgcaaagacatgaacgtcatcacattggagatttttgcttccaggaaatggagaaagatattcatgattttgagtttcagtggaaagaagatgaaagaaatagccatgaagcacccatgacagaaatcaaacagttgacgggtagtacaaaccgacatgatcaaaggcatgctggaaacaagcctattaaagatcagcttggatcaagctttcattcgcatctgcctgaactccacatgtttcagaccgaagggaaaattggtaatcaagttgagaagtctatcaacagtgcttcgttggtttcaacatcccaaagaatttcttgtaggcctaaaacccacatttctaagaactatgggaataatttcctgaattcttcattactcacacaaaagcaggaagtacacatgagagaaaaatctttccaatgtaatgagagtggcaaagcctttaattatagctcagtcttaaggaaacatcagataatccatttaggagcgaaacaatataaatgtgatgtgtgtggcaaggtctttaatcaaaagcgatatcttgcatgtcatcgtagatgtcacactggcaagaaaccttacaagtgtaatgattgtggcaagaccttcagtcaggagttaacccttacatgccatcatagacttcatactggagagaaacattacaagtgcagtgagtgtggcaagaccttcagtcgaaattcagcccttgtaattcataaggcaattcatactggagagaaatcttacaagtgtaatgaatgtggcaagaccttcagtcaaacgtcataccttgtgtaccatcgtagacttcatactggagagaaaccttacaaatgtgaagaatgtgacaaagctttcagtttcaaatcaaaccttgaaagacataggaaaattcatactggagagaaaccttacaagtgtaatgaatgcagcaggacctttagtcggaagtcatcccttacacgccatcgtagacttcatactggagagaaaccttataagtgtaatgattgtggcaagaccttcagtcagatgtcatcccttgtataccatcgtagacttcatactggagagaaaccttacaaatgtgaagaatgtgatgaagctttcagtttcaaatcgaaccttgaaagacataggagaattcatactggagagaaaccttacaagtgtaatgattgtggcaagaccttcagtcagacatcatcccttgtataccatcgtagacttcatactggagagaaaccttacaaatgtgaagaatgtgatgaagctttcagtttcaaatcaaaccttgaaagacataggataattcatactggagagaaactttacaagtgtaatgaatgtggcaagacctttagtcggaagtcatcccttacacgccattgtagacttcatactggagagaaaccttaccagtgtaatgagtgtggcaaagcctttcgtgggcagtcagcacttatttaccatcaagcaatccatggtatagggaaactttacaaatgtaatgattgtcaccaagtctttagtaatgctacaaccattgcaaatcattggagaatccataatgaagagagatcgtacaagtgtaatagatgtggcaaatttttcagacatcgttcataccttgcagttcattggcgaactcatagtggagagaaaccttacaaatgtgaagaatgtgatgaagctttcagtttcaaatcaaaccttcaaagacataggagaattcatactggagagaaaccttacaggtgtaatgaatgtggcaagacctttagtcggaagtcataccttacatgccatcgtagacttcatactggagagaaaccttacaagtgtaatgagtgtggcaagaccttcggtcgaaattcagcccttataattcacaaggcaattcatactggagagaaaccttacaagtgtaatgagtgtggcaaggccttcagtcagaagtcatcccttacatgccatcttagacttcatactggagagaaaccttacaaatgtgaagaatgtgacaaagttttcagtcgcaaatcaagccttgaaaaacacaggagaattcatactggagagaaaccatacaaatgtaaggtttgtgacaaagcttttgggcgtgattcacacctggcacaacatactagaattcacactggagagaaaccttacaagtgtaatgaatgtggcaagaacttccgtcacaattcagcccttgtaattcataaggcaattcatagtggagagaaaccttacaagtgtaatgagtgtggcaagaccttccgtcacaattcagcccttgaaattcataaggcaattcatactggagaaaaaccttacaagtgtagtgaatgtggcaaggtttttaatagaaaagcaaacctttcacgtcatcatagacttcatactggagagaaaccttacaagtgtaataaatgtggtaaggtttttaatcaacaagcacaccttgcatgtcatcatagaattcatactggagagaaaccttacaagtgtaatgagtgtggcaaaaccttccgtcacaattcagtccttgtaattcataagacaattcatactggagagaaaccttacaagtgtaatgaatgtggcaaggtttttaatcgaaaagcaaaacttgcacgtcatcatagaattcatactggaaagaaacattagaaatatgaagaatgtgacaaagtttacagttgtaaatcaagtcttgaaagacaggagaattcatactggagagaaagcttacaaatgtaagagtttgtgacaagaatcttgggcgtgattcacacctggcccaacaaactagaagtcacactggagagaaaccttacaagtgtactgagtgtggcaaagcctttagtgggcagtcaacacttattcaccatcaggcaatccatggtatagggaaactttactaatgtaatgattatcacaaagtcttcagtaacactacaaccgtttcaaatcattggagaatccataatgagagattttgaaagtgtaataaatgtggcaaatttttcagacattgttcataccttgcagttcatcggtgaactcatgctggagagaaaccttacaaatgtcatgattgtggcaaggtcttcagtctagcttcatcttatgcaaaacaggagacttcatacaggagacaaacttcacaagtatgatgattgcagcaaagcctttacttcacgttcacacctaattagacatcagagaatccatactggacagaaatcttacaaatgtcatcagtgtggcaaggtcttcagtctgagatcaccccttaaggaacatcagaaaattcatttttgagatgattgttccaaatgcaatgagtatagcaaaccatcaagcattaattggcattagagtcaattcagcattgacttgagtttgaattgacttaacattgagttcaagcattaattgacattaaagtgtttatgttaagaagattgggccaggcggggtggctcacgcctgtaatcccagcactttgggaggccaagaccaatagatcacttgaggtcaggagtttgagaccagactggccaacagacatgagtcacttttcccaccctgtattttgtttctttaataaaaactgttacgggtttttatgggtatctgttgaatctaaatcacatttgtttgtataatcattcaacaatattaagacttccaatccatcaatatgggttgtatgtctatttagtttttttgatcaatgtagatttcaaggtacaagcttctcacctccttaattcagtttatttgtaagtattaagtttcatagcaaattgaagtgtgttcataagtttctttaaacattatttattgttaatgtaaggaaattcaactaattttgggtgctgattttgtattctgcaaatacattgagtgggtttattagtatcagtaaaatcttggttgattctt

SEQ ID NO: 3721 - DNA, 2133 bp, Homo sapiens
gtattccccgctctccagcagcttcctagctgggttttcacctcagccagcgctcatgctcaacctaggcagggcggggcaggagggcctagcgggaggcggagcgagggtcggagggtgacgctccggacttctgctaggtctgagacgcgccggcctcccgctgctgctccggagaagcggcgcctcctccccgccaggaccccgaggcggggggttcccgccttctcttctgagcgcctcttcccgctgcgcccgcatcagtctgggcctggcccagggtccccggtggagacgtgtttttttctccaaccaccgtgcccctctgtttaaaagcagccagtcaacctttgtgtcctttctccagaaggaaaagcatctcagctgttgtggaaaagggccccagcgtcctcttgtcaccgacagggcgattgcagtgcgttccggtcattttttccaggacactttctgtcttcatgacaggaacatcgagaagccaaggctagtggctgggttactgatggattactgatggattcttctcagcacttagtgacctttgaggatgtggctgtggactttacccaggaggagtggactttgttggatcaagcccagagagatctctacagagatgtgatgttggagaactacaagaatctcattatactagcagggtctgaattattcaaacgtagtctcatgtctggattggaacaaatggaagagctgaggacaggagtgacaggagttctgcaggaattggatttgcaactcaaaaccaaaggctccccactgctgcaagatatttctgcagaaagatcaccaaatggagtacaattggagagaagcaatactgcagagaaactgtatgactctaaccattctggaaaagtcttcaatgaacacccatttcttatgactcacatgataactcacattggagagaaaacttctgaggataatcagagtggaaaagccttaagaaagaactttcctcatagtttttacaagaaaagtcatgctgaggggaaaatgcctaagtgtgttaaacatgaaaaagccttcaaccagtttccaaatcttactaggcagaataaaactcacacacaagagaaattgtgtgaatgcaaagactgttggagaacttttcttaatcagtcatcccttaagttacatataagatctcacaatggagacaaacactatgtatgtaaggaatgtgggaaagccttcagtaattcctcacaccttataggacatggaagaattcacagtggagagaagccctatgtctgtaaagaatgtggtaaagctttcactcaatccacaggacttaaattacacatcagaactcacagtggagaaaaaccatataaatgtaaagagtgtgggaaagccttcacccattcttcataccttactgatcatacaagaatccacagtggaaagaagccctatgtatgtatggaatgtggaaaagccttcactagatccacaggacttattttacacatgcgaattcacactggagaaaagccatatgaatgtaaggagtgtggaaaagcttttattcattcctcataccttacaaaacatgtaaggattcacagtggagagaagctgtatttatgtaaggcatgtgggaaagcttttactcgttcctcaggacttgttttacacatgagaacacatactggagaaaagccctatgaatgtaaagaatgtgggaaagcctttaataattcctcaatgcttagtcaacatgtaaggattcacactggagagaagccatatgaatgcaaagaatgtgggaaagctttcactcaatcctcgggccttagtacccatttaagaactcacactggagaaaaggcctgtgaatgtaaggaatgcggtaaagcatttgctcgttccacaaatcttaatatgcacatgcgaacgcacacaggagaaaagccttatgcatgtaaagaatgtgggaaagccttcaggtattccacataccttaacgttcacacacgaactcacactggagcaaaaccatatgaatgtaagaaatgtgggaaaaacttcactcaatcttcagcacttgctaaacatctaagaactaaggcatgtgaaaaaacctga

SEQ ID NO: 3722 - DNA, 3098 bp, Homo sapiens
gcacacgatgctgcgccagacgctcctacacagtaacctggaaattatcaccggcggagcaaagtcacagctcagggaggccctccgcgttgtctggcggaggaggggagtggcaggtgatcctcacagtcactctaggaaagccagctgccatgacataaggatactcaggccaccaatggatagcccaggcaggaggcatgaaggtgtgccagccactgtgtcagtcaccttataagcagattttctgagacctgctaacagccatgtgagtgaccttggaagtaggttgtcaccagtcaagccttgagatgactgcagccatgacccacagcttgactacaacccagagagacactgagccaggaacacccagctgaagtgcctccaaaccccgacccacagcgactgtgagataatcagtgtttgttgccttaagccacgaagtttgtgataatttgtttctcggaaacagataactaatacagagcaggaagcagatcgcctcagtgaaggtcacactgcagcactattgatttctaaagactcatgttacgtgaggaagcagctcagaagaggaaagaaaaggagccaggcatggctcttcctcagggacacttgacttttagggatgtggctatagaattctctttggaggagtggaaatgcctggaccctacgcagagggctttatacagggccatgatgttggagaactacaggaacctgcattctgtggatatctcttccaaatgcatgatgaagaagttctcatcaacagcgcaaggcaatacagaagtggacacagggacattagaaagacatgaaagtcatcacattggagatttttgcttccagaaaattgggaaagatattcatgactttgagtttcaatggcaagaagacaaaagaaatagccatgaagcaactatgacacaaatcaaaaagttgactggtagcaccgacagatatgatcgaaggcatcctggaaacaagcctatcaaagatcagcttggattaagctttcattcgcatcttcctgaactccacatatttcagaccaaagggaaagttggtaatcaagttgagaagtctatcaacgatgcttcctcagttctaacgtcccaaagaatttcttctaggcccaaaatccatatttctaataactatgaaaataatttcttccattcatcattactcacactaaaacaggaagtacacataagagaaaaatctttccaatgtaatgagagtggcaaagcctttaattgtagctcactcttaaggaaacatcagataatctatttaggagggaaacaatataaatgtgatgtatgtggcaaggtctttaatcagaagcgataccttgcatgccatcatagatgtcacactggtgagaaaccttacaagtgtaatgaatgtggcaaggtttttaatcaacaatcaaaccttgcaagtcatcatagacttcatactggagagaaaccttacaaatgtgaagaatgtgacaaagtttttagtcgcaaatcaaatcttgaaagacataggagaattcatactggagagaaaccatacaaatgtaaggtttgtgaaaaggctttcaggcgtgattcacacctcacacaacacactagaattcacactggagagaaaccttacaagtgtaatgagtgtggcaaagcctttagtgggcagtcaacacttattcaccatcaagcaatccatggtatagggaaactttataaatgtaatgattgtcacaaagtcttcagtaatgctacaaccattgcaaatcattggagaatccataatgaagagagatcttacaagtgtaataaatgtggcaaattttttagacgtcgttcatatctcgtagttcattggcgaactcatactggagagaaaccttacaagtgtaatgagtgtggcaagaccttccatcacaattcagcccttgtaattcataaggcaattcatactggagagaaaccttacaagtgtaatgagtgtggcaagaccttccgtcacaattcagcccttgtaattcataaggcaattcatactggagagaaaccttacaagtgtaatgaatgtggcaaggtttttaatcaacaagcaacccttgcacgtcatcatagacttcatactggagagaaaccttacaaatgtgaagaatgtgacacagttttcagtcgcaaatcacaccatgaaacacataagagaattcatactggagagaaaccttacaaatgtgatgattttgacgaggccttcagtcaagcttcatcttatgcaaaacaaaggagaattcatatgggagagaaacatcacaagtgtgatgattgtggcaaagcctttacttcacattcacatcgcattagacatcagagaatccataccggacagaaatcttacaaatgtcataagcgtggcaaggtcttcagttagaggtcactccttgcaaaacatcagaaaattcattcctgagataattgttccaaatgcaatgagtatagcaaaccatcaagcattaattgacattagagtcaattcagcattgacttgagtttcagttgacttgacattgagttcaagcattaattgacattaaagtgtttacgttaagaggattgggctgggcagggtggcttatacctgtaatcccagcactgtgggaggtcaagacggatagatcacttgaggtcaggagtttgagaccatcctggccaaaagacgtgagccacttttcctagcctgttttttgtttctgatagggatttttatgggtattgtgttgaatctaaatcacattgggttatataatcatttaacaatattaatctttccaatccatcaatatgggtcatatctctatttatataagtttttaatcattttgatcaatgtttgtagatttcaaggtacaaacttctcacctttttacgtttattcctaaatatttcttactgtaagttctctagcaaatggaagtgttttcttaattttcttttaacattgtttattgttaatgtatggaaatttaactaatttttggtactgatattgtattctgcaaatacactgtgtttattagcttc

SEQ ID NO: 3723 - DNA, 6950 bp, Homo sapiens
ggctgggcagtgaccgtaaagctgttcgctcggtgcgacgcaagtctcagctcagcgcgcttatcctgggtccaccggcgctaccgccccccgacgtgagagagcgaagttcttgggccgcgctccctccctacctgggtgccctccccctccgggagcctgggtccccggggcggtcgcggcggctgcatcctcaggccaggccgcggggggagggggcggcacgggcctccgaaagcggggccatggagcccagagagtcggggaaggctcctgtgacgtttgatgacatcactgtgtacttactccaggaggaatgggtgctgctgagccagcaacagaaggagctctgtggttccaacaagctggtggcaccactgggaccaactgttgccaatcctgagctgttccgcaagttcggacgagggccagagccatggcttggcagcgtccagggccagaggagccttctggagcatcacccaggaaaaaaacagatgggctacatgggagaaatggaggtgcaaggtcccaccagggagagtggacagtccctcccgcctcagaagaaagcctacctttcccacctcagtacaggcagtggacacatcgagggagactgggccggaagaaacaggaaacttctgaagccccggtccatccagaagtcgtggtttgtgcagtttccgtggctgatcatgaatgaggagcagacggctctgttctgctctgcttgccgagaatacccctccatcagggacaaacggtcaagactaatagaaggttatacaggaccattcaaggtggagactctcaaataccacgcgaagagcaaggcccacatgttctgtgtcaatgccttggcagcgagggaccccatctgggcagcccggttccggagcatcagagacccacctggagatgttctggccagcccggagccgctcttcactgcagattgccccatattctaccccccagggcctctgggaggatttgatagcatggctgagctcctgccaagttcaagagctgaactagaggaccctgggggggatggagcaattcctgcaatgtatctagactgcatttcagatttgaggcaaaaagaaatcactgatggcatccacagctcctcagacattaatattttatataatgatgcagtagaatcctgcattcaggacccttctgcagaggggctgtcggaggaggttcctgtggtgtttgaggagctgccggtggtgttcgaggatgtggcagtgtatttcacccgggaggagtggggcatgctagacaagcggcagaaggagctgtacagagacgtgatgcggatgaactacgagctgttggcatccttgggacctgccgctgccaagccagacttgatctccaaactggagcggagggctgcaccctggatcaaggacccaaatgggccaaagtgggggaaaggtcgtcctccagggaacaagaagatggtggcagtgagagaggcagacacacaggcctcggctgcagactccgcgttgcttccaggctctcccgtggaggcccgtgcctcctgctgcagttccagcatttgtgaggaaggagatggacctaggagaatcaagaggacatacaggccccgttccattcagaggtcatggtttgggcagttcccatggttagtaattgaccccaaagagaccaaactcttctgctcagcctgcatagaaagacctaatctccatgataaatcatctcggttagtcagaggttacacggggccttttaaagtggagactttaaaataccatgaagtcagcaaagcgcacaggctctgtgtcaacacggttgaaatcaaggaagacacccctcacactgccctcgttccagagatctccagcgacctcatggccaacatggagcactttttcaatgccgcctactccattgcataccactcaaggcccctgaatgactttgagaagatcctgcagctcctccaaagcacggggaccgtgatattaggcaagtaccgcaatcgcacggcgtgcactcagttcatcaagtacatctcagagaccctgaagagggagatcctggaggacgtgcggaactcgccctgtgtgagcgtgctgctggacagctccaccgacgcctccgagcaggcctgcgtggggatttacatccgctacttcaagcagatggaggtgaaagagtcctacatcactctggcccctctctacagtgagacagcagatgggtacttcgagaccatcgtttctgccctggatgagctggacatccccttccggaagcctggctgggtggtggggctggggacggatggctcagccatgttgagctgcagaggaggccttgtggaaaagttccaggaggtcatcccgcagctgctgcctgtccactgcgtggcccaccggctgcacctggctgtggtggacgcctgcgggagcatcgatctggtgaagaagtgtgaccggcacatccgcaccgtcttcaagttttatcagtcctcaaacaagaggctgaacgagctgcaggaaggtgcggcgcctctggagcaggagatcatccgcctgaaggatctgaatgcggtccgctgggtggccagcaggaggcgcacgctgcacgcgctgctcgtgagctggcccgccctggccaggcacctccagagggtggcagaggctgggggccagattgggcaccgggccaaagggatgctgaagctcatgcgcggcttccactttgtcaagttctgccacttcctgttggacttcctgagcatctacaggcctctgtccgaggtgtgccagaaggagatcgtgctgattacagaggtgaacgccacgctgggccgcgcctacgtggcactggagagcctccgtcaccaggcagggcccaaagaggaagaattcaacgccagcttcaaggatgggcggctccacggcatctgcttggacaaactggaggtagcggaacagcggttccaggcggatagggagaggacagtcctgacggggattgagtacctccagcagaggtttgacgcagaccgacccccacagctgaagaacatggaggtgtttgacaccatggcctggccaagtgggattgaacttgccagttttgggaatgatgacattctcaacctggccaggtatttcgagtgctccctcccaacaggatacagtgaggaagctctgctggaggagtggctgggcctgaaaaccattgcccagcacctcccgttctccatgctctgcaaaaacgccctggcccagcactgccgcttccccctgctaagcaagctcatggccgtggtggtctgtgtgcccatctccacctcttgctgtgagcgggggttcaaggccatgaaccgaatcaggaccgatgagaggaccaagctctccaacgaggtgctcaacatgctcatgatgacagctgtgaacggcgtggccgtcacggagtacgacccccagcccgccatccagcactggtacctgacctcctcaggccggcgtttcagccatgtctacacctgtgcccaggtgccagcccgctcccctgcaagcgccaggctcaggaaggaggagatgggagccctctatgtggaggagcccaggacccagaagccacccatcctgccctccagggaagcagcggaggttctgaaggactgcatcatggagcctcccgagagactcctgtatccccacaccagccaggaggcccccgggatgtcctgagggacagggagtccttgggactgccttggagacgcctctgtgatcactgggacaggctctgcagattctaggctgccctaggatcttctgctggtggcgatggtctctaagcaccaggaagtgggcagtggcatcccagagcagcaggggtatcaggaggtgcatgacctgtttcctgaggccccactcagcacagccatgcctcacagcacacaaatgtgccagaaggttctatatctcaagttcatttttaaggtgctgcagaaaataaccccatcatgaaaggtttcagcccctgagttttggtggcaagaggagtgtcctggtaggggagactgttggacatccctggggaatgttccagggaggctgcccacagtctaagtgggaatgggaaagaccaccttgttagagggggaggttgcccctgctctagggacagctggcctggctgcaagagcccccagaggcattgttctgggacttcctaccctggctcccacagcagaagcagtgaggccgtggtctcgtgcggaactctacctcttcccagggcttcctttagggcgaaacaatcacaagccctttgcacagagcacccaagaaagttctcttcctgcagctccagatggtggagctgggctcttctggcagggggtctggtgcttcccggagagccgagccgcgtttaacccgtggcatgcccggcccggtttacccaggagaggatgggacgaagttggagttgggaggcttgggatgcagccccagctctgctgcaggcagtggtctgattaatcccttcctctttgtgcctcagtttccctctccatgaagtggcagcagagatccaagtgcctgctgactccccatctgccctaggattagtgaatgagagcctcgagctccctcaaagacctctggctgcagtgtggacttagctgccatctgccccatcctcgtccttagtgggacaggtaggaatttgtctccaaagtccttgttgtaggagttgctctctgaatgcaccatctgcacgacaggctagtccactcttctctgagctgccctggggactctgcaccaggatctccagggcccactgagacatccccgaatgggcgctcagtgacaagggctttgaacaacctcctccagggactttgggcctgctctagcttcagaaccacagaaccaccgccctagaggcacagaggggcttctggcactgctaggttcacaccctcctcgccccgatcttccttccacctaaagtgaagcacttttccttccaagggcagctccgtcttggcaggctcaggaggccgcttatcaggaggaggatgattttgtctaggttctgccttccttaaccatgggcaggaaatgaggcaagtcagcaggcagggtttctctgccctgcctgatacttgttttaaacaggcaggaagtgggcgccatccatcccagcttgcttgctgcctggctcaggcaggtcctgtgctgtgctgcaggcccctgtgggtgggccctttctccatagtctgccgcttcccattcccagggtagatgctggcatctgagcacctgagtacccttcctattcccagggtagaagctgctgtctgagtacccttcccattcccagggtagatgctggcatctgagcacctgagtacccttcctattcccagggtagaagctgctgtctgagtacccttcccattcccagggtagatgctggcgtccgagcccctccctggtaccgcaggtaccctggtaccccacctgccctttcatccccaccccagtacttagccttagcactgttgctttcgtgtcattttcagttctagtcaggaattcctttcttgctttctgcctttgacctgtggaaatgtctcccagccctgtgggtctggcggtcagagggaccccacaggcctgtggtgcgggagctctgggaggtgttactatctgcgtggctaaggcacacacaggcctccttctccccatcaccgtctccatgggcgttcaggaacttgcccaggtcaggcactgtggatgtgaactcgtggaaagggagggagaaaggcttttttaggtggggctatagcctctgccctacccacagggattccacatcaaggtgctgttccagcacacatgcttcctgcggcctcttcatccttgaagaatccctcagagcaggaggccatcctgtgagcagccgtgagtgggtctctgtgggagtagttctggagctgaggtggaagctaggggaagcaactcgccctctccacgtcagcatcagcgtgctccgaggacaccggccagtgccttccttaggtggtgggaaaggggggtccctgtgcagcggggccactgagaatgctgtttgtcataaaatttgcactacccgatttctcaaggggcacaggcctgctccgttcccctttgtcagccaatggccaagaaggaagaagatgactgccatcttattcctgaacttcctcattcaggacccccgtggaaacacagtgagcatccttatcagaggccctggcccaggctggcccctttgctttgtttggagaggctggctgagtttcagcccctagtgctggagacccccttgttggagaggcttcctgtttatgcctcacaagaagaaaaaccacagggctctgggaggggaagaagcatgcactcccgctttggctggagtcccagcgcttgtcgccaccctcctccttgcctgtagtcttgacagcatccgtatgtacgtgtcctggcatttcccctccctctccctgatgactgatacccaccgggtctgacattccaagtaaccagtatgtaactggtagtttgatcccaatagccatagcgactccaggtgggagtgagggagcccagccccctgtcctggaagataccttagagtatgtgaccgcgctccagacccttgcttctctctcctgcagaggatgagtttctagggtgctaagtacctatcagaacagtgtggaggggcgggtccctcatacaggtgtgtgcttagccaaatacagtaactgtgactggcccagggatgttctctcctctattttcaaagatgaaaggaggttttaaaaaccatgtttgattcctaaccttttgctacctgaataaagcagagtctatttcaacaca

SEQ ID NO: 3724 - DNA, 3304 bp, Homo sapiens
acaaacgctgcggttcagccagggaaacccgtcggctctccggcgcgcaggcgcagttgcgcccggcagcgacgggaaacgtctctgaattaggtgttccgctcgcctcttgtgcggtgtggagctgcgcgccccccgccgaggcgggcccaggtgccttctccaagagaggcagcagggagggagaaatggcaaggaggttgctgccagcccatgtacaggagtccgtgacgttcagggatgtggccgtgttcttcagccaggacgagtggttgcacctggactctgcccagagagccttgtaccgggaggtgatgctggagaactacagcatcctggtctcactggggattctcttttccaagccaaaggtcatctcccagttagagcaaggagaagacccctggatggtggagagtggagttccccaaggcgcacatctcggatgggaaagcttgtttggaaccatagtttctaaagaagaaaatcaggaagtcatgaaaaaactcataattgatggcacatttgacttcaagttggagaagacctacataaatgaagataagttagagaagcaacaaggcaaaaagaacagacttttcagtaaagtgttagttaccatcaaaaaagtctacatgaaggagaggagctttaaaggtgttgaatttgggaaaaatcttggtctaaaatcatcgcttattagaaaaccgagaatagtttccagaggaaggagaccccgttcacagcagtattcagttctctttaaacaactgggggtcaacacagtgcgtaaatgttataaatgtaatatctgtgggaaaatcttcctccacagttcctccctgagtaaacaccagagaatccacactggagagaagctctataaatgtaaggaatgtaggaaagccttcagccaaagctcatccctaactcagcacttgagggttcatacaggagagaaaccttatatatgtagtgaatgtggaaaagccttcagtttcaccacatctcttattggacaccagagaatgcatactggagagagaccttataaatgcaaggaatgtggaaaaacatttaaaggtagttcatctcttaataatcaccagcgaattcacacaggagagaagccctataagtgtaatgaatgtgggagggccttcagtcagtgctcatctctcattcagcaccacagaattcatactggggagaaaccgtatgaatgtactcagtgtgggaaagccttcacttcaatatcgcggctaagtaggcaccatcgaattcatactggagagaaaccctttcattgtaacgagtgtggaaaagtattcagctatcactcagcccttatcatacatcagagaattcacactggtgagaaaccatatgcatgcaaagaatgtgggaaagccttcagccaaagctcagctctcatacaacatcaaagaattcacactggagaaaaaccctacaaatgtaatgaatgtgggaaagccttctcttggatttcacggcttaatatacatcacagaattcacactggagagaaaccatataattgtaaggaatgtggaaaagccttcagttcccactcaggcgttaatactcatcgaaaaattcatactggagaaaaaccttataaatgtaatgactgtgagaaagccttcaaccaaagctcagctctaattcagcaccagagaattcatactggagagaaaccatataattgtaaagtgtgtgggaaagccttcagacagagttcatcccttatgacacacatgagaattcatacaggggaaaaaccttataaatgtaaagaatgtgggaaggcttttagtcagagctcatctcttactaatcatcaaaggactcataattgagaaaaactgtataaatgcatgtaggaactgaagttatattccatactgagtatcaaaaaattcattgtggggagaaagtgatgaagagtagttaatcataggtaaaacttcagcattagacctcatcacacatcagagacttcatgatgcagggtaaccttgggaatgctagaaaagcttctataaaatgtttattcatatgttcttaagttattaccatgaaatggagaatttttaagattgcagggttagtatttgattgtctagtgatgtacgataacagccaccagctttcctgagcatcactgggaagcctgctgtttatgtacaagtacagccataaaatccagacacagataaatctaggaatctattttttgaaactattatgcaagccagtggtactagaaagaatgttttagaaaagaaatatgtacaggtgacccatagctacctcactgtcactaaaatgttttttaataatcttaaagcagattctgcacttcatggtaaagactttgaattgtttctctgctttctaagccattcacctgagaagaaaatcactccataaactatgcagacgtactgtctttgcgttttcttcctgactacttgttccaaactctgagtcagatctaaagtcactttaagtcacagaacgcatggtatttcacttgtttttctcattaaaagtgattacctttgctgtattaaattgataagtaaaggtcattcagacaaccactgcttttgcaatttactgaaaaatgttataaattatctcagaatgtagccaatagcaagcacagctcagctcccagggtctgcctgcttctgtgagctttctggttaccagccaccagaaggcccaggaacaatgtagaactcaggtcatcatccttggaggtaaaatgaaccagatgattttcacccttacttccactttttcgccttcatcagacaaggttcactttctccccacactctaaaggtcactgggcaaatatttaggctctgagttcagatactctttcttccagcaaatggacttacactcttcaacaagtgatttagctcatttcagcatttctaaaatgtgaatcataagattagcaagctaaaaacagttatctcacaagtcaaaattgttgggctttacagaggctaacatctagtttagccaagtttatcaggagggggcaagcacttaagggctgaaacgacccatttcataaagtgctaagtttttctgccaaggaactttaaaaaatagaaaactggctgggtgcagtggctcacgcctgtaatcccggcactttgggaggccaagacgggcagatcatgaggtcaggagatcgagaccatcctggctaacatggtgaaaccacgtctccactaaaaatacaaaaaaaaaaaaaaaa

SEQ ID NO: 3725 - DNA, 690 bp, Homo sapiens
ttttcttgcgcccttgtttttttggggccagggagaatgggtaacgctacctttaagcagctttgataactgtttttgataaaggaagtaaatcttacaagaggaagaaaagaggactaatttttggttggctgttcctaaaaaagagcatcagttcttcaactgctgtttttcgtattgaacaacatccaagtgcagatgtgtggaatattgtgtcatttcctattactttatctgaatgagccttgcctgattctgcccttgaccctgttaaggcacggcagatggtcttcatcccttcgctcctttcgtctttatcgtaaagcactggcagaaaggtagcaggcccggtgactctgaacctgcttcccacactggtttaagtggccggacttagggcccctctggcctgggcagttccaggctccttctctgcaggtgctcagcttatggcttctaacctggtctggcctaatgagggtgggcatgcaggctggatgaaaagacctcacagcttttttctccattccaggtgccttctccaagagaggcagcagggagggagaaatggcaaggaggttgctgccagcccatgtacaggagtccgtgacgttcagggatgtggccgtgttcttcagccaggacgagtggttgcacctggactctgcccagagagccttgtaccgggag

SEQ ID NO: 3726 - DNA, 553 bp, Homo sapiens
gcagttgcgcccggcagcgacgggaaacgtctctgaattaggtgttccgctcgcctcttgtgcggtgtggagctgcgcgccccccgccgaggcgggcccaggtacaggctgccggtgccttctccaagagaggcagcagggagggagaaatggcaaggaggttgctgccagcccatgtacaggagtccgtgacgttcagggatgtggccgtgttcttcagccaggacgagtggttgcacctggactctgcccagagagccttgtaccgggaggtgatgctggagaactacagcatcctggtctcactggggattctcttttccaagccaaaggtcatctcccagttagagcaaggagaagacccctggatggtggagagtggagttccccaaggcgcacatctcggatgggaaagcttgtttggaaccatagtttctaaagaagaaaatcaggaagtcatgaaaaaactcataattgatggcacatttgacttcaagttggagaagacctacataaatgaagataagttagagaagcaacaaggcaaaaagaa

SEQ ID NO: 3727 - DNA, 5220 bp, Homo sapiens
ggggtggggggggcgccctcggagccgggcggaggggaggggggaaagaggagcgcagggtgagagtgagccgcaggcttcgggaggcgagggggcggggggagcagcgccgaggccgccgcctccgcctccgccgcctaggactagggggtgggggacggacaagccccgatgccgggggagacggaagagccgagacccccggagcagcaggaccaggaagggggagaggcggccaaggcggctccggaggagccccaacaacggccccctgaggcggtcgcggcggcgcctgcagggaccactagcagccgcgtgctgaggggaggtcgggaccgaggccgggccgctgcggccgccgccgccgcagctgtgtcccgccggaggaaggccgagtatccccgccggcggaggagcagccccagcgccaggcctcccgacgtccccgggcagcagccccaggccgcgaagtccccgtctccagttcagggcaagaagagtccgcgactcctatgcatagaaaaagtaacaactgataaagatcccaaggaagaaaaagaggaagaagacgattctgccctccctcaggaagtttccattgctgcatctagacctagccggggctggcgtagtagtaggacatctgtttctcgccatcgtgatacagagaacacccgaagctctcggtccaagaccggttcattgcagctcatttgcaagtcagaaccaaatacagaccaacttgattatgatgttggagaagagcatcagtctccaggtggcattagtagtgaagaggaagaggaggaggaagaagagatgttaatcagtgaagaggagataccattcaaagatgatccaagagatgagacctacaaaccccacttagaaagggaaaccccaaagccacggagaaaatcagggaaggtaaaagaagagaaggagaagaaggaaattaaagtggaagtagaggtggaggtgaaagaagaggagaatgaaattagagaggatgaggaacctccaaggaagagaggaagaagacgaaaagatgacaaaagtccacgtttacccaaaaggagaaaaaagcctccaatccagtatgtccgttgtgagatggaaggatgtggaactgtccttgcccatcctcgctatttgcagcaccacattaaataccagcatttgctgaagaagaaatatgtatgtccccatccctcctgtggacgactcttcaggcttcagaagcaacttctgcgacatgccaaacatcatacagatcaaagggattatatctgtgaatattgtgctcgggccttcaagagttcccacaatctggcagtgcaccggatgattcacactggcgagaagccattacaatgtgagatctgtggatttacttgtcgacaaaaggcatctcttaattggcacatgaagaaacatgatgcagactccttctaccagttttcttgcaatatctgtggcaaaaaatttgagaagaaggacagcgtagtggcacacaaggcaaaaagccaccctgaggtgctgattgcagaagctctggctgccaatgcaggcgccctcatcaccagcacagatatcttgggcactaacccagagtccctgacgcagccttcagatggtcagggtcttcctcttcttcctgagcccttgggaaactcaacctctggagagtgcctactgttagaagctgaagggatgtcaaagtcatactgcagtgggacggaacgggtgagcctgatggctgatgggaagatctttgtgggaagcggcagcagtggaggcactgaagggctggttatgaactcagatatactcggtgctaccacagaggttctgattgaagattcagactctgccggaccttagtggacaggaagacttggggcatgggacagctcagactttgtatttaaaagttaaaaaggacaaaaaaaaaatctaaagcatttaaaatctagtgaaataactgaagggcctgctctttccattgtggatcacagcacacacatacatacaccctccacctccccatcccctgttctccctctgttgctccccttataaaattgatgttgtctttaccagaaaggtagacaaaaaagaagcagcagcagctcttaaagtgagggttattctcatactcggttccagccatcagcagacttcctgctcatcggcagatccccctttccaacctgtaactctgatgtgctctggatcagcttttaacttttaatcatatattactgtcttctaaatcccttctcctcctctactgctgccctatggttctggctcctaccccctgcggcacacttatcttcaaataccatagaattctaatctctggaggctggcagcttgacttggcactttagggccccttagcagggtgagctgttaaaacagcacacatctctcatcccctcttcctttattcccccctgggtttcagaaaggaaggatatatggggaccacctcccccttctttgatcccagcatctcagtccccctcccaaccctccatatggctctcaatggtgctcacttgcttggaagcaggctcccaatagggagggggctgccctctacagtctctttgactgtaagacagggctctgtatcagtgagacgatgagaaaagtcccaggctaatggcagaaatttgcactttgaacatgtgtgtttttgtgttgtggaacctgagattccttatttattaacaggaagtctgattttttttttttggagtctttgttgctatattttgtggggctgggagagagagattagattattttgacatgggatcccttccataacaggtactttgaaggcaagacatagggttgaagaagcacagccagcctctgaaatcatagctctccagtggcttttaaagaaagctggtcctcagcactaacaaaatcactacaatagcctagtgcttttttggaagcctttttagggaagaatgttaggttcatggtaactagtatgctctttgagatttttacagtgttgaaacttaagaattttgagagggtgaggagggttgttcagaatctaaattacagatagatgattgtttcttgtgaatttgtttcttttcctttttttttgtccctaccatttccttacatttcccttggggcccatctctggctccttgctttttgtttcttgctttgctttatcagttcattccagctccctgttagtgaaggacactgctgttagtgaaggaacaaagtctatgagtcctaaaattttaagtcaaagaaaactgctctgtttcccctttagtaacacttctgaagaggaaaaacttcaatagccaaagttaataatcctatataataattgctttggctttcacctaaaattctgggcatcacaatttccttgggatagaggttgtgttggggaatagattgcttattgctgttcactggagagaaaaggtagtgtttttgtacaaggtcataccgccagaagccccaaatcctattttggctcatcttcaggtaaagagtaattcctatcctgtgtgcctcagaagctagaatcgaaggcttaccctattcattgtttattgtcagaaatgcatgatggctcttggaaagaatgacgttttgctggaaaaaaaaaaaagaacagtttgtgtttcacaaacatggcttatcaattttttcaaagaattcttttttcccaaaaagaggagtaacaaaatgtcatttctgaaagaggcttactttataccaactagtgtcagcatttgggatgccagggaacagagagtgagacacctacaatcaccagtctcaaatgcgctattgtttcttttcagagtgttgcagatttgccatttctccataatatggggatagaaaatggaataaagatagaagggatgtagaatatgctttcctgccaacatggtttggagtcgactttggtatattgactagatttgaaaatacaagattgattagatgaatctacaaaaaagttgtcctcctctcaggtcccttttacactttttgactaactagcatctatattccacacttagcttttttgtcacacttatcctttgtctccgtaaatttcatttgcagtggttagtcatcagatattttagccacctacacaaaagcaaactgcatttttaaaaatctttctgagatgggagaaaatgtattctcctttcctataccgctctcccaacaaaaaaacaactagttagttctactaattagaaacttgctgtactttttcttttcttttaggggtcaaggaccctctttatagctaccatttgcctacaataaattattgcagcagtttgcaatactaaaatattttttatagactttatatttttccttttgataaagggatgctgcatagtagagttggtgtaattaaactatctcagccgtttccctgctttcccttctgctccatatgcctcattgtccttccagggagctcttttaatcttaaagttctacatttcatgctcttagtcaaattctgttacctttttaataactcttcccactgcatatttccatcttgaattggtggttctaaattctgaaactgtagttgagatacagctatttaatatttctgggagatgtgcatccctcttctttgtggttgcccaaggttgttttgcgtaactgagactccttgatatgcttcagagaatttaggcaaacactggccatggccgtgggagtactgggagtaaaataaaaatatcgaggtatagactagcatccacatagagcacttgaacctcctttgtacctgtttggggaaaaagtataatgagtgtactaccaatctaactaagattattatagtctggttgtttgaaataccatttttttctccttttgtgtttttcccactttccaatgtactcaagaaaattgaacaaatgtaatggatcaatttaaaatattttatttcttaaaagccttttttgcctgttgtaatgtgcaggacccttctcctttcatgggagagacaggtagttacctgaatataggttgaaaaggttatgtaaaaagaaattataataaaagggatactttgcttttcaaatctttgttttctcttattctaggtaaggcatattaaaaataaatatgtaaagaagaaaaataaaagttgtcttcatggaa

SEQ ID NO: 3728 - DNA, 1755 bp, Homo sapiens
gtggggggggcgccctcggagccgggcggaggggaggggggaaagaggagcgcagggtgagagtgagccgcaggcttcgggaggcgagggggcggggggagcagcgccgaggccgccgcctccgcctccgccgcctaggactagggggtgggggacggacaagccccgatgccgggggagacggaagagccgagacccccggagcagcaggaccaggaagggggagaggcggccaaggcggctccggaggagccccaacaacggccccctgaggcggtcgcggcggcgcctgcagggaccactagcagccgcgtgctgaggggaggtcgggaccgaggccgggccgctgcggccgccgccgccgcagctgtgtcccgccggaggaaggccgagtatccccgccggcggaggagcagccccagcgccaggcctcccgacgtccccgggcagcagccccaggccgcgaagtccccgtctccagttcagggcaagaagagtccgcgactcctatgcatagaaaaagtaacaactgataaagatcccaaggaagaaaaagaggaagaagacgattctgccctccctcaggaagtttccattgctgcatctagacctagccggggctggcgtagtagtaggacatctgtttctcgccatcgtgatacagagaacacccgaagctctcggtccaagaccggttcattgcagctcatttgcaagtcagaaccaaatacagaccaacttgattatgatgttggagaagagcatcagtctccaggtggcattagtagtgaagaggaagaggaggaggaagaagagatgttaatcagtgaagaggagataccattcaaagatgatccaagagatgagacctacaaaccccacttagaaagggaaaccccaaagccacggagaaaatcagggaaggtaaaagaagagaaggagaagaaggaaattaaagtggaagtagaggtggaggtgaaagaagaggagaatgaaattagagaggatgaggaacctccaaggaagagaggaagaagacgaaaagatgacaaaagtccacgtttacccaaaaggagaaaaaagcctccaatccagtatgtccgttgtgagatggaaggatgtggaactgtccttgcccatcctcgctatttgcagcaccacattaaataccagcatttgctgaagaagaaatatgtatgtccccatccctcctgtggacgactcttcaggcttcagaagcaacttctgcgacatgccaaacatcatacagatcaaagggattatatctgtgaatattgtgctcgggccttcaagagttcccacaatctggcagtgcaccggatgattcacactggcgagaagccattacaatgtgagatctgtggatttacttgtcgacaaaaggcatctcttaattggcacatgaagaaacatgatgcagactccttctaccagttttcttgcaatatctgtggcaaaaaatttgagaagaaggacagcgtagtggcacacaaggcaaaaagccaccctgaggtgctgattgcagaagctctggctgccaatgcaggcgccctcatcaccagcacagatatcttgggcactaacccagagtccctgacgcagccttcagatggtcagggtcttcctcttcttcctgagcccttgggaaactcaacctctggagagtgcctactgttagaagctgaagggatgtcaaagtcatactgcagtgggacggaacgggcaagacatagg

SEQ ID NO: 3729 - DNA, 2676 bp, Homo sapiens
gggttctaagggtcggcggcggcggggttgacggctttgcctaggtccctccgcccgtagctgtcgggtcccggccccgctctgcccacagactccgatggctgcggccgcgctgagggccccgactcaggttactgtgtctccagaaacacatatggacctcacaaagggctgtgtgacctttgaggacatcgccatttacttctcacaggacgagtggggacttcttgatgaggctcagagactcctgtaccttgaagtgatgctggagaactttgcccttgtagcctcactgggttgtggccatggaacagaggatgaagagacaccttctgaccagaatgtttctgtaggagtgtcacagtcaaaggcaggttcatccacacagaagactcaatcctgtgagatgtgtgtcccagtcctgaaagatattttgcatctagctgatctccctgggcagaaaccatacttggttggagaatgtacaaaccatcaccagcaccagaagcatcacagtgcaaagaaatccttgaagagggacatggacagagcctcatatgtgaagtgctgcctattctgtatgtcattgaagccctttcgcaaatgggaggttggaaaggaccttccagccatgttgcggcttctgaggtccctggtctttcctggaggcaagaaacccggcacaattactgaatgtggggaggacattcgcagtcaaaaaagtcattacaagtcaggtgaatgtgggaaggcttccaggcacaaacacactcctgtttaccatccaagagtctacactggaaaaaagctttatgagtgtagcaaatgtgggaaagccttccgtggcaagtactcacttgttcagcaccagagagtccatactggagaaaggccttgggagtgcaatgaatgtggaaaattctttagccaaacctcccacctgaatgatcatcggagaatccacaccggagaaaggccttatgagtgcagcgaatgtggaaaattatttagacaaaactccagccttgttgaccaccagaaaatacacactggagcaaggccttatgagtgtagccagtgtgggaaatcctttagccaaaaagccacccttgttaaacaccaaagagttcacactggagaaaggccttataagtgtggtgaatgtgggaattcctttagtcaaagtgccattcttaatcaacaccgaagaattcacactggagcaaagccttatgagtgtggccagtgtgggaaatcctttagtcaaaaagctaccctcattaaacaccagagagttcacactggagaaaggccttataagtgtggtgactgtgggaaatcctttagtcaaagctccatccttattcaacaccggagaattcatactggagcaaggccttatgagtgtggccagtgtggaaagtcctttagccaaaagtctggtctcattcaacaccaagtggttcacactggagaaaggccttatgagtgcaacaaatgtgggaattcctttagccaatgctccagcctcatacatcaccaaaaatgtcataacacatagaggcctcatgaatgcagcaaatgtggaagcgccttcaactcaagatctatcatcatttagctcctgaaagtccacacttaagtagagccttagacctacagggaaagtgctgtctctgtagtattgtagcagtagagagcctttgtgagggagccatctgcctgaagttgaacctcattcttccttgtttctctggtagaaaccatctaccctctaccaccttgcacagtgggcactggtcactcctatgtgctaagacaaggcagacatctgtgtgttctcttaagtctttggaggaaatcttgagcagtctaagcctttagagaaaattcattcttttttctgactgatcacagcatacgtgtgacccagtttgggtcaggagggcccagccttggttctgctggacacttatgtgcaaggattcccttcatgtaaattcttggtctcacatgacacttggtcattcttccagcctccatgtcaccacgtggtgaatggctgcctcacattgctccagtttgtgcactaataaaagccttatatttgaatctacctgtagtcttggggttctgtttactgtgtggggtggctgggagacagacttcaactctatatgaaggaatggatggcttttgtgggcctctgcaggaaagtaagatgacagagtaattctaattctggttttggtcatacttgctttgctacctaaaatctcctaggaaaaaatgcaaggttttggttattctaatttgtggcctggatccctattctttctgtgagactagaggtcatcctgaggagaggccagctgttatgacaagcatgtgtgcttcagggaataggacaattttattccattgtttccagaggatgtcatatgatgcccagtgctgctgagaagcttttcatggggttctataaggaggcatgccctgatatcaaacattccataggccgatgtcacgcagaagacaacgcgagtcacatgtgaactgtaattggtacagaaatacctgggtatttctgtactgtgtgtactgtagcaaactagttggaatgtgcctcttataaaagtacatttacaaatcttcccgtgactgtggctttgagca

SEQ ID NO: 3730 - DNA, 1586 bp, Homo sapiens
ttcagtggcggtcatttttgcagcgcttgggtgcatccagaccgtcagagctttgggagcgctttgtttggcgacagtcggaaggcgcgaggggaggggtcctcccgctgaacagtgggggttctaagggtcggcggcggcggggttgacggctttgcctaggtccctccgcccgtagctgtcgggtcccggccccgctctgcccacagactccgatggctgcggccgcgctgagggccccgactcaggttactgtgtctccagaaacacatatggacctcacaaagggctgtgtgacctttgaggacatcgccatttacttctcacaggacgagtggggacttcttgatgaggctcagagactcctgtaccttgaagtgatgctggagaactttgcccttgtagcctcactgggttgtggccatggaacagaggatgaagagacaccttctgaccagaatgtttctgtaggagtgtcacagtcaaaggcaggttcatccacacagaagactcaatcctgtgagatgtgtgtcccagtcctgaaagatattttgcatctagctgatctccctgggcagaaaccatacttggttggagaatgtacaaaccatcaccagcaccagaagcatcacagtgcaaagaaatccttgaagagggacatggacagagcctcatatgtgaagtgctgcctattctgtatgtcattgaagccctttcgcaaatgggaggttggaaaggaccttccagccatgttgcggcttctgaggtccctggtctttcctggaggcaagaaacccggcacaattactgaatgtggggaggacattcgcagtcaaaaaagtcattacaagtcaggtgaatgtgggaaggcttccaggcacaaacacactcctgtttaccatccaagagtctacactggaaaaaagctttatgagtgtagcaaatgtgggaaagccttccgtggcaagtactcacttgttcagcaccagagagtccatactggagaaaggccttgggagtgcaatgaatgtggaaaattctttagccaaacctcccacctgaatgatcatcggagaatccacaccggagaaaggccttatgagtgcagccagtgtgggaaatcctttagccaaaaagccacccttgttaaacaccaaagagttcacactggagaaaggccttataagtgtggtgaatgtgggaattcctttagtcaaagtgccattcttaatcaacaccgaagaattcacactggagcaaagccttatgagtgtggccagtgtgggaaatcctttagtcaaaaagctaccctcattaaacaccagagagttcacactggagaaaggccttataagtgtggtgactgtgggaaatcctttagtcaaagctccatccttattcaacaccggagaattcatactggagcaaggccttatgagtgtggccagtgtggaaagtcctttagccaaaagtctggtctcattcaacaccaagtggttcacactggagaaaggccttatgagtgcaacaaatgtgggaattcctttagccaatgctccagcctcatacatcaccaaaaatgtcat

SEQ ID NO: 3731 - DNA, 4252 bp, Homo sapiens
acttcagtggcggtcatttttgcagcgcttgggtgcatccagaccgtcagagctttgggagcgctttgtttggcgacagtcggaaggcgcgaggggaggggtcctcccgctgaacagtgggggttctaagggtcggcggcggcggggttgacggctttgcctaggtccctccgcccgtagctgtcgggtcccggccccgctctgcccacagactccgatggctgcggccgcgctgagggccccgactcagggctgtgtgacctttgaggacatcgccatttacttctcacaggacgagtggggacttcttgatgaggctcagagactcctgtaccttgaagtgatgctggagaactttgcccttgtagcctcactgggttgtggccatggaacagaggatgaagagacaccttctgaccagaatgtttctgtaggagtgtcacagtcaaaggcaggttcatccacacagaagactcaatcctgtgagatgtgtgtcccagtcctgaaagatattttgcatctagctgatctccctgggcagaaaccatacttggttggagaatgtacaaaccatcaccagcaccagaagcatcacagtgcaaagaaatccttgaagagggacatggacagagcctcatatgtgaagtgctgcctattctgtatgtcattgaagccctttcgcaaatgggaggttggaaaggaccttccagccatgttgcggcttctgaggtccctggtctttcctggaggcaagaaacccggcacaattactgaatgtggggaggacattcgcagtcaaaaaagtcattacaagtcaggtgaatgtgggaaggcttccaggcacaaacacactcctgtttaccatccaagagtctacactggaaaaaagctttatgagtgtagcaaatgtgggaaagccttccgtggcaagtactcacttgttcagcaccagagagtccatactggagaaaggccttgggagtgcaatgaatgtggaaaattctttagccaaacctcccacctgaatgatcatcggagaatccacaccggagaaaggccttatgagtgcagcgaatgtggaaaattatttagacaaaactccagccttgttgaccaccagaaaatacacactggagcaaggccttatgagtgtagccagtgtgggaaatcctttagccaaaaagccacccttgttaaacaccaaagagttcacactggagaaaggccttataagtgtggtgaatgtgggaattcctttagtcaaagtgccattcttaatcaacaccgaagaattcacactggagcaaagccttatgagtgtggccagtgtgggaaatcctttagtcaaaaagctaccctcattaaacaccagagagttcacactggagaaaggccttataagtgtggtgactgtgggaaatcctttagtcaaagctccatccttattcaacaccggagaattcatactggagcaaggccttatgagtgtggccagtgtggaaagtcctttagccaaaagtctggtctcattcaacaccaagtggttcacactggagaaaggccttatgagtgcaacaaatgtgggaattcctttagccaatgctccagcctcatacatcaccaaaaatgtcataacacatagaggcctcatgaatgcagcaaatgtggaagcgccttcaactcaagatctatcatcatttagctcctgaaagtccacacttaagtagagccttagacctacagggaaagtgctgtctctgtagtattgtagcagtagagagcctttgtgagggagccatctgcctgaagttgaacctcattcttccttgtttctctggtagaaaccatctaccctctaccaccttgcacagtgggcactggtcactcctatgtgctaagacaaggcagacatctgtgtgttctcttaagtctttggaggaaatcttgagcagtctaagcctttagagaaaattcattcttttttctgactgatcacagcatacgtgtgacccagtttgggtcaggagggcccagccttggttctgctggacacttatgtgcaaggattcccttcatgtaaattcttggtctcacatgacacttggtcattcttccagcctccatgtcaccacgtggtgaatggctgcctcacattgctccagtttgtgcactaataaaagccttatatttgaatctacctgtagtcttggggttctgtttactgtgtggggtggctgggagacagacttcaactctatatgaaggaatggatggcttttgtgggcctctgcaggaaagtaagatgacagagtaattctaattctggttttggtcatacttgctttgctacctaaaatctcctaggaaaaaatgcaaggttttggttattctaatttgtggcctggatccctattctttctgtgagactagaggtcatcctgaggagaggccagctgttatgacaagcatgtgtgcttcagggaataggacaattttattccattgtttccagaggatgtcatatgatgcccagtgctgctgagaagcttttcatggggttctataaggaggcatgccctgatatcaaacattccataggccgatgtcacgcagaagacaacgcgagtcacatgtgaactgtaattggtacagaaatacctgggtatttctgtactgtgtgtactgtagcaaactagttggaatgtgcctcttataaaagtacatttacaaatcttcccgtgactgtggctttgagcagtcataggacctagaaatctgtgtatgtccaatagctgaggttattttcagcaaaaataattaaagggttttattttttaattcttgttggttttctaggttgttcacctcaagtgcattgctgtagaggcagaaaaaggaggataaagataacagaagtcctataggccagggatgtattgatagctcttgtgatttccaccagtgttgctgttgtctcaaattgccacagccttcattgcttgccaacatttcctgcatggagggactcatggttgcccttccccaggcctgaagagagagtgcagtcaacatgagattgctaggcattctggtttctgaaagttgggtgatcagatactttattgtgaaacatgttttacaaactttcttgatgtgtaagtgacatgccatagtttacatccatttatggtgtataatttgaagagtttgtcatacaagcctgtgaaaccataatcatgatcatgaacatattcatgattcacctcttgctgttttacaatctctgcgtgtactttccaggccttcaggagtcctgtcatttactttccctacaggagaatagtttgtgttttctaggattttatgtgaattgaaacgtaaaatacttactccatttttcctgatgatgcacaattttttttttttttttgagatggagtctcagtctgtcaccaggctggagtgcagtggcatgatcttggctcactccaacctcctcctgggttccagcgattctcctgcctcagcctcctgagaagctaggactacaggcatgcactaccacgcccaactaatttttgtatttttagtagagatgtggttttaccatgtttgccaggatggtcttgatctcttgacctcgtgatccgcccgcctcagcctcccgaagtgctgggattacaggcgtaagccaccacaccagctgatgcacaattacttttaagatttatcaatattgcttatgtgaatagttcatttgtattgctgagaaatagtctgtggatatgtcacaatttggataaacagttggatgctttccagttttgggctgttgcaaataatgctactatgaacataggcatataactcttaatatgcagaaatgctttatttctcctgtgtcagtagtacagtgtacgtgaatgcgtcacttttaaagacaaggccagactataacctaactgtaccatttgcattctcatcaacagtatgtgaaccttcttatttctctacattcttgccatacttggtatggttagtctttttaattttagttgttttaatagctgtataatagcatctgtctgtgattttattgcatttttctggtattttatggtattgaacatttgaacatcttgtatctagttgccacctgtatatcctctttggaagaatgtttattaatgtcttttgcttatttttaaatggatgttggtgatactttttcattaataaatagacgtataac

SEQ ID NO: 3732 - DNA, 4181 bp, Homo sapiens
ttcagtggcggtcatttttgcagcgcttgggtgcatccagaccgtcagagctttgggagcgctttgtttggcgacagtcggaaggcgcgaggggaggggtcctcccgctgaacagtgggggttctaagggtcggcggcggcggggttgacggctttgcctaggtccctccgcccgtagctgtcgggtcccggccccgctctgcccacagactccgatggctgcggccgcgctgagggccccgactcaggttactgtgtctccagaaacacatatggacctcacaaagggctgtgtgacctttgaggacatcgccatttacttctcacaggacgagtggggacttcttgatgaggctcagagactcctgtaccttgaagtgatgctggagaactttgcccttgtagcctcactgggttgtggccatggaacagaggatgaagagacaccttctgaccagaatgtttctgtaggagtgtcacagtcaaaggcaggttcatccacacagaagactcaatcctgtgagatgtgtgtcccagtcctgaaagatattttgcatctagctgatctccctgggcagaaaccatacttggttggagaatgtacaaaccatcaccagcaccagaagcatcacagtgcaaagaaatccttgaagagggacatggacagagcctcatatgtgaagtgctgcctattctgtatgtcattgaagccctttcgcaaatgggaggttggaaaggaccttccagccatgttgcggcttctgaggtccctggtctttcctggaggcaagaaacccggcacaattactgaatgtggggaggacattcgcagtcaaaaaagtcattacaagtcaggtgaatgtgggaaggcttccaggcacaaacacactcctgtttaccatccaagagtctacactggaaaaaagctttatgagtgtagcaaatgtgggaaagccttccgtggcaagtactcacttgttcagcaccagagagtccatactggagaaaggccttgggagtgcaatgaatgtggaaaattctttagccaaacctcccacctgaatgatcatcggagaatccacaccggagaaaggccttatgagtgcagcgaatgtggaaaattatttagacaaaactccagccttgttgaccaccagaaaatacacactggagcaaggccttatgagtgtagccagtgtgggaaatcctttagccaaaaagccacccttgttaaacaccaaagagttcacactggagaaaggccttataagtgtggtgaatgtgggaattcctttagtcaaagtgccattcttaatcaacaccgaagaattcacactggagcaaagccttatgagtgtggccagtgtgggaaatcctttagtcaaaaagctaccctcattaaacaccagagagttcacactggagaaaggccttataagtgtggtgactgtgggaaatcctttagtcaaagctccatccttattcaacaccggagaattcatactggagcaaggccttatgagtgtggccagtgtggaaagtcctttagccaaaagtctggtctcattcaacaccaagtggttcacactggagaaaggccttatgagtgcaacaaatgtgggaattcctttagccaatgctccagcctcatacatcaccaaaaatgtcataacacatagaggcctcatgaatgcagcaaatgtggaagcgccttcaactcaagatctatcatcatttagctcctgaaagtccacacttaagtagagccttagacctacagggaaagtgctgtctctgtagtattgtagcagtagagagcctttgtgagggagccatctgcctgaagttgaacctcattcttccttgtttctctggtagaaaccatctaccctctaccaccttgcacagtgggcactggtcactcctatgtgctaagacaaggcagacatctgtgtgttctcttaagtctttggaggaaatcttgagcagtctaagcctttagagaaaattcattcttttttctgactgatcacagcatacgtgtgacccagtttgggtcaggagggcccagccttggttctgctggacacttatgtgcaaggattcccttcatgtaaattcttggtctcacatgacacttggtcattcttccagcctccatgtcaccacgtggtgaatggctgcctcacattgctccagtttgtgcactaataaaagccttatatttgaatctacctgtagtcttggggttctgtttactgtgtggggtggctgggagacagacttcaactctatatgaaggaatggatggcttttgtgggcctctgcaggaaagtaagatgacagagtaattctaattctggttttggtcatacttgctttgctacctaaaatctcctaggaaaaaatgcaaggttttggttattctaatttgtggcctggatccctattctttctgtgagactagaggtcatcctgaggagaggccagctgttatgacaagcatgtgtgcttcagggaataggacaattttattccattgtttccagaggatgtcatatgatgcccagtgctgctgagaagcttttcatggggttctataaggaggcatgccctgatatcaaacattccataggccgatgtcacgcagaagacaacgcgagtcacatgtgaactgtaattggtacagaaatacctgggtatttctgtactgtgtgtactgtagcaaactagttggaatgtgcctcttataaaagtacatttacaaatcttcccgtgactgtggctttgagcagtcataggacctagaaatctgtgtatgtccaatagctgaggttattttcagcaaaaataattaaagggttttattttttaattcttgttggttttctaggttgttcacctcaagtgcattgctgtagaggcagaaaaaggaggataaagataacagaagtcctataggccagggatgtattgatagctcttgtgatttccaccagtgttgctgttgtctcaaattgccacagccttcattgcttgccaacatttcctgcatggagggactcatggttgcccttccccaggcctgaagagagagtgcagtcaacatgagattgctaggcattctggtttctgaaagttgggtgatcagatactttattgtgaaacatgttttacaaactttcttgatgtgtaagtgacatgccatagtttacatccatttatggtgtataatttgaagagtttgtcatacaagcctgtgaaaccataatcatgatcatgaacatattcatgattcacctcttgctgttttacaatctctgcgtgtactttccaggccttcaggagtcctgtcatttactttccctacaggagaatagtttgtgttttctaggattttatgtgaattgaaacgtaaaatacttactccatttttcctgatgatgcacaattttttttttttttttgagatggagtctcagtctgtcaccaggctggagtgcagtggcatgatcttggctcactccaacctcctcctgggttccagcgattctcctgcctcagcctcctgagaagctaggactacaggcatgcactaccacgcccaactaatttttgtatttttagtagagatgtggttttaccatgtttgccaggatggtcttgatctcttgacctcgtgatccgcccgcctcagcctcccgaagtgctgggattacaggcgtaagccaccacaccagctgatgcacaattacttttaagatttatcaatattgcttatgtgaatagttcatttgtattgctgagaaatagtctgtggatatgtcacaatttggataaacagttggatgctttccagttttgggctgttgcaaataatgctactatgaacataggcatataactcttaatatgcagaaatgctttatttctcctgtgtcagtagtacagtgtacgtgaatgcgtcacttttaaagacaaggccagactataacctaactgtaccatttgcattctcatcaacagtatgtgaaccttcttatttctctacattcttgccatacttggtatggttagtctttttaattttagttgttttaatagctgtataatagcatctgtctgtgattttattgcatttttctggtattttatggtattgaacatttgaacatcttgta

SEQ ID NO: 3733 - DNA, 6737 bp, Homo sapiens
acgcttccggcctttgtgactcattgtgtctgtgtcgaggcgtcgggagggcctaagtccgtgtgcggtgcccttcggccggcctgagccccagagtcagctcccctttctcgcccagcgcccccaggccgctcccggggctcacggaatagtaaagaaacacatcataaaacctcccaggacataaaggtgagcacagaccctgtttggatcaagtcagttcctggagcctgaatgatgactgctgaatcacgggaagccacgggtctgtccccacaggctgcacaggagaaggatggtatcgtaatagtgaaggtggaagaggaagatgaggaagaccacatgtgggggcaggattccaccctacaggacacgcctcctccagacccagagatattccgccaacgcttcaggcgcttctgttaccagaacacttttgggccccgagaggctctcagtcggctgaaggaactttgtcatcagtggctgcggccagaaataaacaccaaggaacagatcctggagcttctggtgctagagcagtttctttccatcctgcccaaggagctccaggtctggctgcaggaataccgccccgatagtggagaggaggccgtgacccttctagaagacttggagcttgatttatcaggacaacaggtcccaggtcaagttcatggacctgagatgctcgcaagggggatggtgcctctggatccagttcaggagtcctcgagctttgaccttcatcacgaggccacccagtcccacttcaaacattcgtctcggaaaccccgcctcttacagtcacgagctcttcctgctgcccacattcctgcaccccctcatgagggtagtcccagagaccaggcgatggcatctgcactattcacagcggattcccaggcaatggtgaagatcgaggacatggctgtgtccctcattctggaggaatggggatgtcagaatctggctcggaggaatctcagtagggacaacaggcaggagaattatgggagcgcatttccccagggtggtgaaaacaggaatgagaacgaggagtcaacctcaaaggctgaaacctcggaagattcagcatcacgcggggagacaacaggaagatcccagaaagagtttggagagaaacgtgaccaggagggcaaaacaggagaaagacagcagaaaaaccctgaggagaaaaccaggaaagagaaaagagattcagggccagctataggaaaggacaaaaaaaccatcacaggagagagaggtccaagggagaaggggaaaggattgggaagaagcttcagtctgagctccaacttcaccacccctgaagaagttcccacgggaacaaagtctcacagatgtgatgaatgtggtaaatgcttcacgagaagttcaagccttatccgccataaaataatccacactggagaaaagccctatgaatgtagtgagtgtgggaaagccttcagtcttaactccaaccttgtcctgcatcagaggatccacacaggagagaaacctcatgaatgtaacgagtgtggcaaggccttcagccacagttccaatctcatcctccatcagcgcatccactctggagagaaaccttatgaatgtaatgagtgcgggaaggccttcagccagagctcggacctcaccaagcatcagagaattcacacgggggagaaaccctatgaatgtagtgaatgtggaaaagctttcaaccgaaactcatacctgattttgcatcggagaattcacactcgagaaaagccctacaagtgcactaagtgtggcaaggccttcacccgcagctccaccctcactctgcatcacagaatccatgccagagagagagcctctgagtacagcccagcctcccttgatgcatttggcgcgttcctgaaaagttgtgtgtaaaggaagaatttgccatcaagccatttcccccttttgtttctaaaattatttcagagatgtgtgctcctggagggaaaaagaaatacagcctcaacagattaaaaaacaaaagtcacacttaaggatccttctagtcacatcagcagtgttctgcctttatgtagtagttgggcatataatccttccacacagcccctgcagggaaaggctaatcttacggataatccacgtgagatttccacacaagagaaaagcacacgcatagtgaaatgtcagtcttttcagtaatgaggatacctttaaggcactcttggactctcggcaaccacaacataatagttgaaagatcaagattggctccacgaaagtgatacggaggttaggatgctacttgctgcaaacaagccctactttggccaacatcctgcttatttctcaaaaaagagggacagtgaaaacaaaaacgacattgggacatgctgctcaaggtagttatatatacgataagttgtatatatgatcactggtagcctaccaaagctgtagaaatctaggactgtgctaatcagtatcaaaccaaagatttctatctcttcccgaaagagagggtatgtgcaccagtctacagttccaaaggactgcaacaaatgtagatggttctgtcctcatccctgagatcagttctactgaaatggcaacaacaactccaaatacatctctcccttcttgaaatccctaaagcactatcgcactcctaaatgcatttctccacaagttagcacttgattgtatactgtcttttaatccttcattgtttcatgtatgaagtttttaatcaccccctaacccccaaaaaagattcggttgtcaagggatatatttctatccctgccagcacagtgctggacatagtgagtactgaacacctaagaggcactcattcagactgacttctacaggacttctacgtgtgtgataaaagcctgtgaatcgtgagtccctgaaatatggtagcctggcccagcttctaaagaggaccttcgtagccacaaggcatgctaaacctctagggtctgatgctgtttttgttccaaatataaacgaaaggcactagtcagccgcctgcatagactttctaaacagtgagtaaataccatggaatgtcagaaatgactttatcatcgtcatcttgaagaaaaatatgaacactgatgaaggtcattttttttttttgacatctttctgtggcaaagctcttagaattctttgcagttagctgctgaacagtatgatgatttggggattttctgaatcatttgtacttagatactggagttcagaagatgtgatttttgttgcttttcagaaaaaggaacgtggtagggagtgttttttcccacgcttttccagtaactttgcaaaagcattaattgttcactggcaattactaaatgtattttgttgctctgagaaactcagcagtgtactgagatgtggctggctgtgccatcgtcatagtgcacagtgacttttctgtttcttatcactaaagactgaggtgaggttatgaaactttcattggtcccatcgttgtgcgcagggtgcaactggctacctagaagctgatggcaggagactgtttcacacacaggagattgtgagctgtgtaagtagtcatcgccactcaagtaggacaagggtcctacccaaggctaggaccgccctgcggaaacagaaacatagactgagaacaaacctcaagactatcagtgtgacctccccataacaagagaaccccatatatagtttgagactttcccttgagaaacttatactaaaactattactcatcagtcattcactgatcagcagctaaagtccatgagaccaaatggttttatatggaaccaacgaagtgggagctaaaactgcacagtggtcattctttggcctctccttggctttatgacttaaaccaactacaacttccctatagcttctaagcagtttcatcagcattacttgggaaaacgtgttgcaagtcaaccagtcactaggatatttctacccatgcaacggaagaaaaacccattactccagaagagtatatctaagtaactaaaatggaggcagaaaatgttttaaggattttcttcaaagaataagccacagcaatggttttgtagaaaactcctgtgcttttgagcaaggacttttgccctctagaaagcaactgaggccaggtgcggtggctcacgcctgtaatcccagcactttgggaggccgaggtgagcggatcacctgaggtcaggagttttgagaccagcctggccaacatggtaaaatcccgtctctactaaaattataaaaattagccgggcatgatggtgggcacctgtaatcccagctacttgggaggctgaggcaggagaatcacttgaacccaggaggcagaggttgcagtgagccaagattgcacactgcactccagcctgggtgactagcaaaactccatctcaaaaaaaaaaaaaagaaagaaagaaactgaaaagtgaggtgtggaactccaggcaacgacccaagcacttattttttaagagggaaaggactttggtcatgtttacattggcctttggtttttttttttctttcagccacaactatatgctgatataactcagccatcacttttgagttttgtttttaaatgaaggttaaatgtgacctgtgccctcacatttaattccgtttcatggagacatcttcctgactttgttggatagctgccactagggttgcttcgatcttcagccacatgctgtccttgaagcagctatttgaagatgtgttttctgaggaaaacaggctacaactgtttattaaaaccacttgcagtgcattcgtttatcagatgctcagtgcaaagtgtaattgggtcatggtcaaaaacgcttgcaacatctaattggcgttcaagatagtcattcaaaagttcttggcccgctgaagtctgttaacagttgaaacattctacagttaaccattagcatgctagttgtcctaatggaaatttttgaagagtttttcaatatataccctacccttgccaggaagagaagtaaaatcctcaggttgtggggtatttgtttctactccagcctggcaggcaaggctaaaacctgagattatcgatctatgagacatcttgatatgtaaagcacttaatattaaaggcataaaagtgaaactgctaaatatgtatagagaggttgacgtgtgatacgtgggacagttcacatagacatcagagaatttattccagaaaggagcctcctgaatgtgatgaatacggcaaagcctttaatcacatctcagcccttagcatcggaaagcttatactgtaaataaacttgatgaatattatatgtgaggaaaactttcatgtatagcactcattgcttcagacagaaaatgaattccgtcggtatgttccaatcgtgatgaatttgagaaacattgcaagagggagctcaatcttggccgggcgccgtggctcacgcctgtaatcgcagcactttgggaggccgaggcaggcggatcacgaggtcagtagttcgagaccagcctggccaacatggtgaaaccttgtctctactaaaaatacaaaaaaaaattagctgggcacagtggcgcacgcctgtagtcccagctactcgggaggctgaggcaggagaatggcttgaacctgcgaggcggaggttgcagtgagctaagatcatgccactggcactccagccttgagtgacagagcgaggctctgtatcaaaaaaaaaagttgcgggggggtgctcaatcttaactgcagaggatctacagatgaaaaaaaatgtggggaaatgctttaaaaaaatagcaaaatgtgcaacttcttacaaaaattgttaacgttaggtacttctatatattttatatgaccataatgtccgtgtgtgttttgtaccttcagtcccttgttattgttccgtatattacctgtaagcagatactgtattttattttagcctatttgacagaacacatcactcagaaaaagtgaagtttcagagcaaacagtgaagaaatcagtgtgattgtagacaaaaagtcggttcacagaacggagcagcggggagaggaagggaaaagcttcatagtttggtgcttatcacatcaagagattggtaaatttctgaggaaagacaggctaatggggcactgaaatggaacaactcctttaaacgtgcagccttttgaatttttcctcaaaaccaagaagttgacctctgagctgtcaggtgaccactgtgtgcaaaggggatggattctcttgtcagtagacggtcttctccatgaagcgagagtaggaagtgtactggaatggccaagtgggactgcttcagctgaccaggttcttttaaaccgtagtcatgctttcccactaactcttaaatccttatgcttagaaaattgaggataaggctgggcacagtggctcaggcctgtaatcccagcactttgggagaccaaggcgggtggatcacaaggtcaggagatcgagaccatcctggctaacatggcgaaaccccgtctctactaaaaatacaaaaaaatagctgggcgtggtggcgggcgcctgtagtcccagctactcaggaggctgaggcaggaggatcacttgaacatgggaggcggaggttgcagtgagccaagatggcgccactgcactccagcctgggtgatggcgtgagactccatgtcaaaaaaaaaaaaaa

SEQ ID NO: 3734 - DNA, 2011 bp, Homo sapiens
actcattgtgtctgtgtcgaggcgtcgggagggcctaagtccgtgtgcggtgcccttcggccggcctgagccccagagtcagctcccctttctcgcccagcgcccccaggccgctcccggggctcacggagtctctctctgtcacccaggctggagtgcagtggcgcgttctcagctcactgcaccctccacctcccaggttcaagtgattctcctgcctcagcctcccgagtagctgagattacaggaatagtaaagaaacacatcataaaacctcccaggacataaaggctgcacaggagaaggatggtatcgtaatagtgaaggtggaagaggaagatgaggaagaccacatgtgggggcaggattccaccctacaggacacgcctcctccagacccagagatattccgccaacgcttcaggcgcttctgttaccagaacacttttgggccccgagaggctctcagtcggctgaaggaactttgtcatcagtggctgcggccagaaataaacaccaaggaacagatcctggagcttctggtgctagagcagtttctttccatcctgcccaaggagctccaggtctggctgcaggaataccgccccgatagtggagaggaggccgtgacccttctagaagacttggagcttgatttatcaggacaacaggtcccaggtcaagttcatggacctgagatgctcgcaagggggatggtgcctctggatccagttcaggagtcctcgagctttgaccttcatcacgaggccacccagtcccacttcaaacattcgtctcggaaaccccgcctcttacagtcacgagctcttcctgctgcccacattcctgcaccccctcatgagggtagtcccagagaccaggcgatggcatctgcactattcacagcggattcccaggcaatggtgaagatcgaggacatggctgtgtccctcattctggaggaatggggatgtcagaatctggctcggaggaatctcagtagggacaacaggcaggagaattatgggagcgcatttccccagggtggtgaaaacaggaatgagaacgaggagtcaacctcaaaggctgaaacctcggaagattcagcatcacgcggggagacaacaggaagatcccagaaagagtttggagagaaacgtgaccaggagggcaaaacaggagaaagacagcagaaaaaccctgaggagaaaaccaggaaagagaaaagagattcagggccagctataggaaaggacaaaaaaaccatcacaggagagagaggtccaagggagaaggggaaaggattgggaagaagcttcagtctgagctccaacttcaccacccctgaagaagttcccacgggaacaaagtctcacagatgtgatgaatgtggtaaatgcttcacgagaagttcaagccttatccgccataaaataatccacactggagaaaagccctatgaatgtagtgagtgtgggaaagccttcagtcttaactccaaccttgtcctgcatcagaggatccacacaggagagaaacctcatgaatgtaacgagtgtggcaaggccttcagccacagttccaatctcatcctccatcagcgcatccactctggagagaaaccttatgaatgtaatgagtgcgggaaggccttcagccagagctcggacctcaccaagcatcagagaattcacacgggggagaaaccctatgaatgtagtgaatgtggaaaagctttcaaccgaaactcatacctgattttgcatcggagaattcacactcgagaaaagccctacaagtgcactaagtgtggcaaggccttcacccgcagctccaccctcactctgcatcacagaatccatgccagagagagagcctctgagtacagcccagcctcccttgatgcatttggcgcgttcctgaaaagttgtgtgtaaaggaagaatttgccatcaagccatttcccccttttgtttctaaaattatttcagagatgtgtgctcctggaggg

SEQ ID NO: 3735 - DNA, 573 bp, Homo sapiens
attgtaaccacatcagcaaagcactgttagtatatatgctgaacaaatgtggagaaatcgctgttttacataggaaaccatggtgatttgccccagaatgtgtatccaggaatagtaaagaaacacatcataaaacctcccaggacataaaggtgagcacagaccctgtttggatcaagtcagttcctggagcctgaatgatgactgctgaatcacgggaagccacgggtctgtccccacaggctgcacaggagaaggatggtatcgtaatagtgaaggtggaagaggaagatgaggaagaccacatgtgggggcaggattccaccctacaggacacgcctcctccagacccagagatattccgccaacgcttcaggcgcttctgttaccagaacacttttgggccccgagaggctctcagtcggctgaaggaactttgtcatcagtggctgcggccagaaataaacaccaaggaacagatcctggagcttctggtgctagagcagtttctttccatcctgcccaaggagctccaggtctggctgcaggaataccgccccgatagtggagagg

SEQ ID NO: 3736 - DNA, 3754 bp, Homo sapiens
attgtgtctgtgtcgaggcgtcgggagggcctaagtccgtgtgcggtgcccttcggccggcctgagccccagagtcagctcccctttctcgcccagcgcccccaggccgctcccggggctcacgctcttcctgctgcccacattcctgcaccccctcatgagggtagtcccagagaccaggcgatggcatctgcactattcacagcggattcccaggcaatggtgaagatcgaggacatggctgtgtccctcattctggaggaatggggatgtcagaatctggctcggaggaatctcagtagggacaacaggcaggagaattatgggagcgcatttccccagggtggtgaaaacaggaatgagaacgaggagtcaacctcaaaggctgaaacctcggaagattcagcatcacgcggggagacaacaggaagatcccagaaagagtttggagagaaacgtgaccaggagggcaaaacaggagaaagacagcagaaaaaccctgaggagaaaaccaggaaagagaaaagagattcagggccagctataggaaaggacaaaaaaaccatcacaggagagagaggtccaagggagaaggggaaaggattgggaagaagcttcagtctgagctccaacttcaccacccctgaagaagttcccacgggaacaaagtctcacagatgtgatgaatgtggtaaatgcttcacgagaagttcaagccttatccgccataaaataatccacactggagaaaagccctatgaatgtagtgagtgtgggaaagccttcagtcttaactccaaccttgtcctgcatcagaggatccacacaggagagaaacctcatgaatgtaacgagtgtggcaaggccttcagccacagttccaatctcatcctccatcagcgcatccactctggagagaaaccttatgaatgtaatgagtgcgggaaggccttcagccagagctcggacctcaccaagcatcagagaattcacacgggggagaaaccctatgaatgtagtgaatgtggaaaagctttcaaccgaaactcatacctgattttgcatcggagaattcacactcgagaaaagccctacaagtgcactaagtgtggcaaggccttcacccgcagctccaccctcactctgcatcacagaatccatgccagagagagagcctctgagtacagcccagcctcccttgatgcatttggcgcgttcctgaaaagttgtgtgtaaaggaagaatttgccatcaagccatttcccccttttgtttctaaaattatttcagagatgtgtgctcctggagggaaaaagaaatacagcctcaacagattaaaaaacaaaagtcacacttaaggatccttctagtcacatcagcagtgttctgcctttatgtagtagttgggcatataatccttccacacagcccctgcagggaaaggctaatcttacggataatccacgtgagatttccacacaagagaaaagcacacgcatagtgaaatgtcagtcttttcagtaatgaggatacctttaaggcactcttggactctcggcaaccacaacataatagttgaaagatcaagattggctccacgaaagtgatacggaggttaggatgctacttgctgcaaacaagccctactttggccaacatcctgcttatttctcaaaaaagagggacagtgaaaacaaaaacgacattgggacatgctgctcaaggtagttatatatacgataagttgtatatatgatcactggtagcctaccaaagctgtagaaatctaggactgtgctaatcagtatcaaaccaaagatttctatctcttcccgaaagagagggtatgtgcaccagtctacagttccaaaggactgcaacaaatgtagatggttctgtcctcatccctgagatcagttctactgaaatggcaacaacaactccaaatacatctctcccttcttgaaatccctaaagcactatcgcactcctaaatgcatttctccacaagttagcacttgattgtatactgtcttttaatccttcattgtttcatgtatgaagtttttaatcaccccctaacccccaaaaaagattcggttgtcaagggatatatttctatccctgccagcacagtgctggacatagtgagtactgaacacctaagaggcactcattcagactgacttctacaggacttctacgtgtgtgataaaagcctgtgaatcgtgagtccctgaaatatggtagcctggcccagcttctaaagaggaccttcgtagccacaaggcatgctaaacctctagggtctgatgctgtttttgttccaaatataaacgaaaggcactagtcagccgcctgcatagactttctaaacagtgagtaaataccatggaatgtcagaaatgactttatcatcgtcatcttgaagaaaaatatgaacactgatgaaggtcattttttttttttgacatctttctgtggcaaagctcttagaattctttgcagttagctgctgaacagtatgatgatttggggattttctgaatcatttgtacttagatactggagttcagaagatgtgatttttgttgcttttcagaaaaaggaacgtggtagggagtgttttttcccacgcttttccagtaactttgcaaaagcattaattgttcactggcaattactaaatgtattttgttgctctgagaaactcagcagtgtactgagatgtggctggctgtgccatcgtcatagtgcacagtgacttttctgtttcttatcactaaagactgaggtgaggttatgaaactttcattggtcccatcgttgtgcgcagggtgcaactggctacctagaagctgatggcaggagactgtttcacacacaggagattgtgagctgtgtaagtagtcatcgccactcaagtaggacaagggtcctacccaaggctaggaccgccctgcggaaacagaaacatagactgagaacaaacctcaagactatcagtgtgacctccccataacaagagaaccccatatatagtttgagactttcccttgagaaacttatactaaaactattactcatcagtcattcactgatcagcagctaaagtccatgagaccaaatggttttatatggaaccaacgaagtgggagctaaaactgcacagtggtcattctttggcctctccttggctttatgacttaaaccaactacaacttccctatagcttctaagcagtttcatcagcattacttgggaaaacgtgttgcaagtcaaccagtcactaggatatttctacccatgcaacggaagaaaaacccattactccagaagagtatatctaagtaactaaaatggaggcagaaaatgttttaaggattttcttcaaagaataagccacagcaatggttttgtagaaaactcctgtgcttttgagcaaggacttttgccctctagaaagcaactgaggccaggtgcggtggctcacgcctgtaatcccagcactttgggaggccgaggtgagcggatcacctgaggtcaggagttttgagaccagcctggccaacatggtaaaatcccgtctctactaaaattataaaaattagccgggcatgatggtgggcacctgtaatcccagctacttgggaggctgaggcaggagaatcacttgaacccaggaggcagaggttgcagtgagccaagattgcacactgcactccagcctgggtgactagcaaaactccatctc

SEQ ID NO: 3737 - DNA, 7122 bp, Homo sapiens
gactcgcctctccgcgcccgacccgggagtagcggacacaccccctcccggcccggctgtccgcctccgcccagcctttcctcagcctgcttcatttttctcccagtcgtccagcctcccggtttccgactttgcactaagagggatgcactctggaaaaccacattgcgcggtcacatcttgtttggagaagaggccaggcttttgcatcttagagtatacgttcaccttttcaagggcctggcatagatttgattaatcagcctggaataccctgttcctgccgacctggccgtttttacctccgtaccttatcacactcccaggaacattaagcagggagcgcttggagtcttctttgggtccccaccttgagctagacgtgaagttgacccctgggctgcagcatggctgtcgccctcgactctcagatcgacgcgcccctggaggttgagggatgcctaataatgaaggtggaaaaggaccctgagtgggcatcagagcccattctggaaggatcggatagctctgagaccttccgcaaatgcttcaggcaattctgttatgaggatgtgactggaccccatgaagctttcagtaaactctgggaactttgctgccggtggctgaagccagaaatgcgttccaaggagcaaatacttgagctgctggtgattgagcagtttctcaccattttacccgagaagattcaggcttgggcacagaagcagtgtccgcaaagtggagaggaagcggtggccctggtagtgcatttggagaaagagactggaagactaagacagcaggtcagcagtcccgtgcaccgggagaagcactccccacttggagcagcgtgggaggtggcagacttccagccagagcaggtggagacccaacccagggcggtgtctcgggaggaacctggaagcctccactcaggacaccaggaacagctgaaccgaaagcgagaacgtcggcccttacccaagaatgctcggccttctccctgggttcctgcccttgctgatgaatggaataccctagatcaggaagtgacaaccacacggcttcctgctgggtcccaggaaccagtgaaagatgtccacgtggccagaggcttttcctacagaaagagtgtgcatcagattcctgcccaaagggacctctaccgggatttcaggaaggagaatgttgggaacgtggtctccctgggaagtgcagtgtctacatctaacaagataacccggttggaacagagaaaggagccatggactctaggtctgcattcctctaacaagagaagtatcctacgaagcaactacgtcaaggaaaagtcagttcatgctattcaggtccctgcaaggagtgcaggaaaaacatggagagagcagcagcagtggggtttagaagatgaaaagatagcaggtgtgcattggagctatgaggaaacaaagactttcctggcaattctcaaagagtctcgcttttatgaaacacttcaggcctgtccccgaaatagccaagtgtatggtgctgtggctgaatggttgcgagaatgtggcttccttagaaccccagaacagtgtcgaaccaagttcaaaagtctccagaaaagctatcgaaaggtgagaaatggccacatgctagaaccctgcgccttctttgaggacatggatgctttgttgaaccctgcagcccgtgctccgtccactgataaaccaaaggagatgatacctgtccccagactgaagagaattgccatcagtgctaaggaacacatcagcttggtggaggaggaggaagctgcagaagattctgatgatgatgaaataggcatcgaatttatccgcaagtctgaaatccatggtgcccctgtcttgtttcagaatctcagtggcgtgcactggggctatgaagaaaccaagacttttcttgatatcctccgtgagactcggttttatgaagcgcttcaagcctgtcatcggaagagcaaattgtatggggctgtagctgaacagcttcgagagtgcggcttcctccggacaccagaacagtgccgaaccaagttcaaaagccttcagaagagttaccgcaaggtgaaaaatggccacgtgctagagtcctgcgcgttctacaaggagatggatgccctgattaactctcgggcatctgctccttcccccagcaccccagaggaagtcccatcaccttcaaggcaagaaagagggggtattgaggttgaaccccaggaacctacaggctgggaacctgaagagacctcacaggaggcagtaatagaagactcttgcagtgagagaatgagcgaggaggaaattgtgcaagagccagagttccagggacctccaggtctactgcagagcccaaatgattttgaaatcggaagtagcatcaaggaggatccaacacagatagtatataaggacatggaacagcatagggcattaatagaaaagtctaaaagagttgtttcccagagtaccgaccccagcaaatatcgcaaaagggaatgcatctcaggaagacaatgggaaaatcttcaaggaattagacagggaaagccgatgtctcagcctagagatttagggaaagccgttgtgcatcagaggccttttgtggggaagagaccctacagacttctcaaatatggagaaagctttggaaggagcactcgtctgatgtgccggatgacccaccacaaggagaatccttacaagtgtggtgtctgtgggaagtgctttggtagaagcaggagcctgatcagacaccaaagaatccacacaggcgaaaaaccttttaaatgtcttgactgtggaaaaagctttaatgactcctcaaattttggtgcccaccagagaatccacacaggagagaaaccctacagatgcggagagtgtggaaaatgctttagtcagagctctagtcttattatacatcagagaacgcacaccggtgagaagccctatcagtgtggagagtgtgggaaaagtttcaccaacagttctcatttcagcgcccaccggagagttcacactggggagaatccctacaaatgtgtggactgtgaaaaaagtttcaataactgtacgagatttcgagaacatcggagaatacacactggagagaagccctatggatgtgcccagtgtggcaaacgtttcagtaagagttctgttcttaccaaacatcgggaagttcatgtgagagaaaagcctctgccacaccctccatctctgtattgccctgagaacccacataagggaaagactgatgaatttaggaaaactttttgatgatgatcttctcttcctaaatgcccccttagccattttaccctaatctcattcttggaagcaatcttttcttagctatgaagtgtaatttccaagataaacttgagaatataaataaactaaacactttcatcctgttctcacctctgcctctaacttcatcagtctgttcctcctcttctgtgtgtctcagcttctcctttaagaatgtggcgaagatacattgtccgagttcagaatgaaatacccttcagtacattgaggccactgcaactggattgctaagttcggcaacattcaagatcttccatatgggtgagagttgtcttcaaggatataaaaaatgccaaaagtttttttgttgttattacctactccgtgagatcctggatgaaacttgataacagattttcacatttagatagaactttgaggagtctgatcggaactacatcaaatccatcttggttttgaagagatccacaaaagaagagtgaagattttatagctttcctcagaagtctgttacagtgtacctttttttttttttttgtcaagaagttgatccaaatagctagggcagaatccctgtattgtcactgaaatcctgttactaatgccttgccctccatggaggtgagaagcaattgatcacccctcatccttttctgtacccgaagacttaaatcccctggctgctgcttctccagcctataagtaatcccaggtcctcctactgtttctcatagccctgcacttgcctctcagttgctctgggtgctcctgccggcctcttccgaactaccatgccctcctcagatagaataggaggcctgctcgtggtgtgtctcactaaagcaaagtaggatttcagatgcgttctagttctatcctctaacttctctggctcttatctagaacatgactggcatgttggcatatttcgtacctcccacccctgcactgcagtataatattataatagtgtttctaaaactttaaggggatagggaagaggtaatagacacctgaagcatttctaagaccagttggactcctttggcctgctgtcgatcagatagccacctcagcttagaccagcgctctcaggtctggctgttaaatctcccagtctcttttcctgaggcttctagtccctgttcaccgcatcagaaacctaactgtagtgtgccaagtaacttaacacaactctagagctcactgggtgaaaagtgggaacatttataaaaacttcaatccagaaatccagaacaccgtttttgttttcctcatttacttgttttgtctgaaaaatctctttgagaacccccggcagtaacccagtaaacactgaaggaaaagttctgatgggggatggttaattgacttttgaagttacagatgaaacccagagatttgattttccatggccagttgcttcaggatggagtcagtggcgtttattcccttagtatgtaggtgacccagggtggctttgctttggcaagggagaagtcacaagtttaatgggaagggaaccggagttagggctgtttgtgggtgattattttgctcttctctctccctttctttgtcaaatgctcttatttgaagccatctggaaatgatatttttccttttggtatgtttcaatcttttgaaacttgttcagcaaagtacctaggagggtaggcactgtagaaagaaatctaatttatggtgccagaatagggtgtggcctgttggaaggcaggtgactcaggtagacattgataaatgtttctgatttacatttgttggaaatattatgactgttcacatctcaataggttgatttttctgtgttgtccaagttatagatttctaatgctaagtacagttccatgttggtagtgtgcgtagcacagtaagatgtttgtggtgccagtgggcttgtgtttatattgtgtagatgttctggaattccagctctagagaagatgtaaattaatagaaatcaccacttaataatatgtacacaggattgatattatgtggaagcatgattcaggaaagtagatgacttattcataaatatgaagcactgttacatgtaaggccatgttctagccacagtgaatgatagaaaaaggaaggaaggggcatggtgcctgggctcaaggaactcacagtttgatagaggaagcatcacagcaaaagttggggccacttacaccatggcagttacagaaggccaggagctcagtcatgagaacatcaccttcccctgcagaagagttgcgctaagttgcccagaatcatattctgtaccttcatctctcaaccttccccagtggcaggaaagggtcaagcaagacccattccctctctagtgggacaaactgattctgtttaactctcatatgcctgggagcaagctgaggtggaatttgggttcccctatctctactcctaattgtaaatgggctgtctagacatgtgttacattaatttgatgaactttgttctgaagaaatggaaggtctcccccccattttagaccaacactacctgtctccctgcattttatttgttttcacctggtacatgtaagtcaaaatgaataatcatgttctgaccaatgtgtcttttagatcacataacattgcctttatgaagattcatagaaaaaggtttttttatctagatctcagtgccaaggaaagctctgatcctaagcgcagtatgtgtacacacacacgtctacatgtgtgtgtagatctgtatgtatgtattacaaacactgtgatttttgtaacttaagctgctttttctctctttgttctggctgctggaaagttcaacaaaacttacagcccacctcaaccaactaccccaacctatatttatttaatttcatcttatttccttgtaaattgtgtcaaatcctgtttttgaaaagcagcatagactgacaacttttcactatcatcttatcgaaggcattttggaaactggggtcgtatgtcccacctaggcttgctttgttactgccacaaatacctccagttcttaccagtgatgttattatgcattcaacctaattcattcatctggaaagaaacagttttttaaaaagggaaacctcacacgtaaatggctcagggcagcctggccttggtggaatgagcatgagactggaagctgaaagaagcaagttttaatcttgtcactaaatgagtgttgtttgacacatcatagcctctctgggcctcggctcctcatctgaagagaagttgaacttaactgctaagttgctctggctctaatgtttcatgaggctgtggagcgtgatatagatgcggaagaggttagaagaccaggctgccggcccagctgtcctgtgcctgccacatctggccataccaaatccatcgcatgcttcaggaaagggaggggatgctgtgacagcaaactcagcccaggagcttgttggggaaggagaaagggcaagtccctcgtggtccacagcaggcaccccccaagcacctcgataaccagtggcaggtaggctgaagtgaaggaagcctctgtcaggaggtctggcgcccagtgacagacaagacagctgtgagggagctggggcagccctggctaaaggaatgtctgagtaacttgtgaaactggaagcctctgcctctgaatgcattccaagacctggtgcaaatggatgtccattcattgttttgtatcagtgttcacttagatgtcttcttgaaaacttgtttgtggaataaatgtctaaaataaatggctcccactggtttctgcc

SEQ ID NO: 3738 - DNA, 3492 bp, Homo sapiens
ctcccccagcccctcgcccgccaggacgcctcgcgcgggccccgcggcgctcggtggcaggcggcgcatgcgtgactgcggttcccagcgccccccgcgctctccgcgggccgagtggacgaggccgaacgcgagcagcctgccgctgccccctgcgagccctggcttcgccccgcagctcttctcccttccgggcggaacagtttttgcggcctttcctcggcggcagcggtttcctcaggacggtcggggccgtcgtgggcccgaaagagcccggcgccgctctcggaatccggcggccccagcggcacccgcggcggcctggacgtgctgcggtgacccgagcccggaacctggcgccgggcggggcctgcacatccggccccacccactcggggactcgcctctccgcgcccgacccgggagtagcggacacaccccctcccggcccggctgtccgcctccgcccagcctttcctcagcctgcttcatttttctcccagtcgtccagcctcccggtttccgactttgcactaagagggatgcactctggaaaaccacattgcgcggtcacatcttgtttggagaagaggccaggcttttgcatcttagagtatacgttcaccttttcaagggcctggcatagatttgattaatcagcctggaataccctgttcctgccgacctggccgtttttacctccgtaccttatcacactcccaggaacattaagcagggagcgcttggagtcttctttgggtccccaccttgagctagacgtgaagttgacccctgggctgcagcatggctgtcgccctcgactctcagatcgacgcgcccctggaggttgagggatgcctaataatgaaggtggaaaaggaccctgagtgggcatcagagcccattctggaaggatcggatagctctgagaccttccgcaaatgcttcaggcaattctgttatgaggatgtgactggaccccatgaagctttcagtaaactctgggaactttgctgccggtggctgaagccagaaatgcgttccaaggagcaaatacttgagctgctggtgattgagcagtttctcaccattttacccgagaagattcaggcttgggcacagaagcagtgtccgcaaagtggagaggaagcggtggccctggtagtgcatttggagaaagagactggaagactaagacagcaggtcagcagtcccgtgcaccgggagaagcactccccacttggagcagcgtgggaggtggcagacttccagccagagcaggtggagacccaacccagggcggtgtctcgggaggaacctggaagcctccactcaggacaccaggaacagctgaaccgaaagcgagaacgtcggcccttacccaagaatgctcggccttctccctgggttcctgcccttgctgatgaatggaataccctagatcaggaagtgacaaccacacggcttcctgctgggtcccaggaaccagtgaaagatgtccacgtggccagaggcttttcctacagaaagagtgtgcatcagattcctgcccaaagggacctctaccgggatttcaggaaggagaatgttgggaacgtggtctccctgggaagtgcagtgtctacatctaacaagataacccggttggaacagagaaaggagccatggactctaggtctgcattcctctaacaagagaagtatcctacgaagcaactacgtcaaggaaaagtcagttcatgctattcaggtccctgcaaggagtgcaggaaaaacatggagagagcagcagcagtggggtttagaagatgaaaagatagcaggtgtgcattggagctatgaggaaacaaagactttcctggcaattctcaaagagtctcgcttttatgaaacacttcaggcctgtccccgaaatagccaagtgtatggtgctgtggctgaatggttgcgagaatgtggcttccttagaaccccagaacagtgtcgaaccaagttcaaaagtctccagaaaagctatcgaaaggtgagaaatggccacatgctagaaccctgcgccttctttgaggacatggatgctttgttgaaccctgcagcccgtgctccgtccactgataaaccaaaggagatgatacctgtccccagactgaagagaattgccatcagtgctaaggaacacatcagcttggtggaggaggaggaagctgcagaagattctgatgatgatgaaataggcatcgaatttatccgcaagtctgaaatccatggtgcccctgtcttgtttcagaatctcagtggcgtgcactggggctatgaagaaaccaagacttttcttgatatcctccgtgagactcggttttatgaagcgcttcaagcctgtcatcggaagagcaaattgtatggggctgtagctgaacagcttcgagagtgcggcttcctccggacaccagaacagtgccgaaccaagttcaaaagccttcagaagagttaccgcaaggtgaaaaatggccacgtgctagagtcctgcgcgttctacaaggagatggatgccctgattaactctcgggcatctgctccttcccccagcaccccagaggaagtcccatcaccttcaaggcaagaaagagggggtattgaggttgaaccccaggaacctacaggctgggaacctgaagagacctcacaggaggcagtaatagaagactcttgcagtgagagaatgagcgaggaggaaattgtgcaagagccagagttccagggacctccaggtctactgcagagcccaaatgattttgaaatcggaagtagcatcaaggaggatccaacacagatagtatataaggacatggaacagcatagggcattaatagaaaagtctaaaagagttgtttcccagagtaccgaccccagcaaatatcgcaaaagggaatgcatctcaggaagacaatgggaaaatcttcaaggaattagacagggaaagccgatgtctcagcctagagatttagggaaagccgttgtgcatcagaggccttttgtggggaagagaccctacagacttctcaaatatggagaaagctttggaaggagcactcgtctgatgtgccggatgacccaccacaaggagaatccttacaagtgtggtgtctgtgggaagtgctttggtagaagcaggagcctgatcagacaccaaagaatccacacaggcgaaaaaccttttaaatgtcttgactgtggaaaaagctttaatgactcctcaaattttggtgcccaccagagaatccacacaggagagaaaccctccatctctgtattgccctgagaacccacataagggaaagactgatgaatttaggaaaactttttgatgatgatcttctcttcctaaatgcccccttagccattttaccctaatctcattcttggaagcaatcttttcttagctatgaagtgtaatttccaagataaacttgagaatataaataaactaaacactttc

SEQ ID NO: 3739 - DNA, 4178 bp, Homo sapiens
gttccgggaacagctggcccctgcgactcgcgggtgtgacgttgaagatgtcggccttctgagccgactgcggtggtcaagagtgtaacacagccagcctcgaagacttccctctgagttggaatgataatgaccgaatcccgagaagttatagacttagaccccccagctgagacttcccaggagcaggaagaccttttcatagtgaaggtggaagaagaagactgcacctggatgcaggagtacaacccgccaacgtttgagactttttaccagcgcttcaggcacttccagtaccatgaggcttcaggaccccgggaggctctcagccaactccgggtgctctgctgtgagtggctgaggcccgagctgcacacgaaggagcagatcctggagctgctggtgctggagcagttcctgaccatcctgcctgaagagttccagccctgggtgagggaacatcaccctgaaagtggagaagaggcggtggccgtgatagaaaatatacagcgagaacttgaggaacgcagacagcagattgttgcctgccctgatgtgcttcctcggaagatggcaacacctggagcagtgcaggagtcctgcagcccccatcccctgaccgtggacacccagcctgagcaagcgccacagaagcctcgtctcctggaggaaaatgcccttcctgttctccaagttccttcccttcccctgaaggacagccaggagctgacagcttcacttctctcaactgggtcccagaagttggtgaaaattgaagaggtggctgatgtggctgtatccttcatcctggaggaatgggggcatttggaccagtcccagaagtccctttatagggatgacaggaaggagaactatgggagtattacttccatgggttatgagtccagggacaatatggagctcatagtgaagcagatttctgatgactctgaatcacactgggtggcgccagaacacaccgaaaggagcgttcctcaggatccagactttgcagaagtcagtgaccttaaaggcatggtacaaaggtggcaggtcaaccccactgtggggaaatcaaggcagaatccttcccagaaaagggatctggatgcaatcacagacatcagccctaagcaaagcacacatggcgagagagggcacagatgcagcgattgtggcaaattcttcctccaagcctcaaactttattcagcatcggcgcatccacactggagaaaaaccgtttaagtgcggagaatgtgggaagagctacaatcagcgggtgcacctcacccagcaccagcgcgtccacacaggggagaaaccctacaaatgtcaggtgtgcggaaaggctttccgggtgagttcccacctggttcagcaccacagtgtccacagcggagagaggccctatggctgcaatgagtgtgggaagaacttcggtcgccattcgcatctgatcgaacacctaaaacgccacttcagggagaaatcccagagatgcagtgacaaaagaagtaagaacacaaaattaagtgttaagaagaaaatttcagaatattcagaagcagacatggaactatctggaaaaacccaaagaaatgtttctcaagttcaagattttggagaaggctgtgagtttcaaggcaagctggatagaaagcagggaattcccatgaaagagatactaggacaaccatcttcaaagaggatgaactacagtgaagtcccatatgtccacaaaaaatcctccactggagagagaccacataaatgtaacgagtgtgggaaaagcttcattcagagtgcacatcttattcaacatcaaagaatacacactggggagaaaccattcaggtgtgaggaatgtgggaaaagctacaaccaacgcgtgcacctaactcagcatcagcgcgtccacacaggtgagaagccctacacctgtcccttatgtgggaaagccttcagagtgaggtcccaccttgttcagcatcagagcgtgcacagtggggagagacccttcaagtgtaacgaatgtgggaaaggctttgggaggcgttcccacctggctggacatcttcgactccactcccgagagaaatcccatcagtgtcgtgaatgtggggaaatcttttttcagtacgttagcctaattgaacatcaggtgctccacatgggtcagaaaaatgaaaaaaatggcatctgtgaggaagcatatagttggaacttgacagtgattgaagacaagaagattgagttacaagagcagccttatcagtgtgatatctgtggaaaagcctttggttatagctcagacctcattcagcattacagaactcatacagcagagaagccctatcaatgtgatatatgtagagaaaatgttggccagtgttcccacaccaaacaacatcaaaaaatctactccagcacaaaatcccatcaatgtcatgaatgtggcagaggcttcactctgaagtcacatcttaatcaacatcagagaatccatactggtgagaaaccttttcaatgtaaagaatgtggaatgaatttcagctggagttgtagcctctttaaacacctgagaagccatgagaggacagatcccataaataccttaagtgtagaggggtctctgttgtagaatagctcttaattttagagaaaccttcctggagggaaaccatactcctataatgagcaaagtaacaacttcaagcatttttccagcgttaccatcaaactcacaaataggttgaaatcctttagttataactcagcctttaggaacaccggagaacccacaataatagaaatcttttcgtgttccccattgagaaatgctttagttagcatcttcatgcttggaaatctagacaagaagagaatccatggatggacatggtcgaggaattcggaaagcctgcagttgacattcagtcttcacttgaaactcaaaactgacactaggaacagcttcatgagttcagtagaagtaagctttatttgtagcttctgccttgtttgacggcgtatctattcagggaagcgcacagtaaaagaattccttagcatgatgtctgttttggtacctcagcaatgaaccttttctagaaattattattccaaccactagaataccctagtcactattcccactttgagcattaacccctttgaaaagaaatggacttaaagtatctctgttttggcaaaattcaggttcaggggctggatggtatgtgtttctgctgccttattcaatccaccacttctctgtgaaacactctaccttgtttttggtttgattctactgatgtcagggtttagccggtagaaggagtagttcagtttgtcaattcaggagaaactgtactggtcagtcacatcttacggcgaagggagagggaccttaggggagcagagaagacaggcaaagttgtggactgtttgatcttgtattacccacaggaatgagggcagctaaacccatagaaggagttggaccaaggcgaattacgagtcctggtcccagcagtatgtgtgctgacttctgggtgccccagaaatagacctctcctgtagagtggtgatatacagaatgagtttcagtttgcattgcagctgggattgaaagtaatcagtcgtgagcaggcaggcaggaggtcctgttagccctgccttccaggaaggttggggtgggagttttgagtgggaaagaggatgacatgtgtgagagagttctgagcctgtttgctagggagagtgagtgagtgctcttgggcactgctcaggccgtttctgctgacttgcctggcttacaataaatgcccaataaatatttgttgaccatatgtgttgtacactgtggtgccctgtccagtcccctctaccaagctgagacccccatccccagctgctctgagtttgggctgcaagtgctcacagctcttgttctccagaaactggagaattgccctcaggagatgagagccatctcacctcacccaggagtcacttcctctctacaccccaacacctggttcatttgattaaagcggagaaaactccagggtgctatgactgctctggcacccttggatcaggccaagctagactttttctgagccttcatccgtgctaagctctctcccttctctatcctgtttcattccctcc

SEQ ID NO: 3740 - DNA, 4344 bp, Homo sapiens
cttccccgccccacggaaaggggaggagcttgggctgtttgaatggctttgggatggagcaggggagagagtggctccgtttgcctccccgctttggtgatgctgtgcgagcggcttcgggggccctggagacgtccgagtcactgagggtgggctgggactcggggcccgcgtcccatctccccgccgattggtccgccccccgtgcgagtgtaacacagccagcctcgaagacttccctctgagttggaatgataatgaccgaatcccgagaagttatagacttagaccccccagctgagacttcccaggagcaggaagaccttttcatagtgaaggtggaagaagaagactgcacctggatgcaggagtacaacccgccaacgtttgagactttttaccagcgcttcaggcacttccagtaccatgaggcttcaggaccccgggaggctctcagccaactccgggtgctctgctgtgagtggctgaggcccgagctgcacacgaaggagcagatcctggagctgctggtgctggagcagttcctgaccatcctgcctgaagagttccagccctgggtgagggaacatcaccctgaaagtggagaagaggcggtggccgtgatagaaaatatacagcgagaacttgaggaacgcagacagcagattgttgcctgccctgatgtgcttcctcggaagatggcaacacctggagcagtgcaggagtcctgcagcccccatcccctgaccgtggacacccagcctgagcaagcgccacagaagcctcgtctcctggaggaaaatgcccttcctgttctccaagttccttcccttcccctgaaggacagccaggagctgacagcttcacttctctcaactgggtcccagaagttggtgaaaattgaagaggtggctgatgtggctgtatccttcatcctggaggaatgggggcatttggaccagtcccagaagtccctttatagggatgacaggaaggagaactatgggagtattacttccatgggttatgagtccagggacaatatggagctcatagtgaagcagatttctgatgactctgaatcacactgggtggcgccagaacacaccgaaaggagcgttcctcaggatccagactttgcagaagtcagtgaccttaaaggcatggtacaaaggtggcaggtcaaccccactgtggggaaatcaaggcagaatccttcccagaaaagggatctggatgcaatcacagacatcagccctaagcaaagcacacatggcgagagagggcacagatgcagcgattgtggcaaattcttcctccaagcctcaaactttattcagcatcggcgcatccacactggagaaaaaccgtttaagtgcggagaatgtgggaagagctacaatcagcgggtgcacctcacccagcaccagcgcgtccacacaggggagaaaccctacaaatgtcaggtgtgcggaaaggctttccgggtgagttcccacctggttcagcaccacagtgtccacagcggagagaggccctatggctgcaatgagtgtgggaagaacttcggtcgccattcgcatctgatcgaacacctaaaacgccacttcagggagaaatcccagagatgcagtgacaaaagaagtaagaacacaaaattaagtgttaagaagaaaatttcagaatattcagaagcagacatggaactatctggaaaaacccaaagaaatgtttctcaagttcaagattttggagaaggctgtgagtttcaaggcaagctggatagaaagcagggaattcccatgaaagagatactaggacaaccatcttcaaagaggatgaactacagtgaagtcccatatgtccacaaaaaatcctccactggagagagaccacataaatgtaacgagtgtgggaaaagcttcattcagagtgcacatcttattcaacatcaaagaatacacactggggagaaaccattcaggtgtgaggaatgtgggaaaagctacaaccaacgcgtgcacctaactcagcatcagcgcgtccacacaggtgagaagccctacacctgtcccttatgtgggaaagccttcagagtgaggtcccaccttgttcagcatcagagcgtgcacagtggggagagacccttcaagtgtaacgaatgtgggaaaggctttgggaggcgttcccacctggctggacatcttcgactccactcccgagagaaatcccatcagtgtcgtgaatgtggggaaatcttttttcagtacgttagcctaattgaacatcaggtgctccacatgggtcagaaaaatgaaaaaaatggcatctgtgaggaagcatatagttggaacttgacagtgattgaagacaagaagattgagttacaagagcagccttatcagtgtgatatctgtggaaaagcctttggttatagctcagacctcattcagcattacagaactcatacagcagagaagccctatcaatgtgatatatgtagagaaaatgttggccagtgttcccacaccaaacaacatcaaaaaatctactccagcacaaaatcccatcaatgtcatgaatgtggcagaggcttcactctgaagtcacatcttaatcaacatcagagaatccatactggtgagaaaccttttcaatgtaaagaatgtggaatgaatttcagctggagttgtagcctctttaaacacctgagaagccatgagaggacagatcccataaataccttaagtgtagaggggtctctgttgtagaatagctcttaattttagagaaaccttcctggagggaaaccatactcctataatgagcaaagtaacaacttcaagcatttttccagcgttaccatcaaactcacaaataggttgaaatcctttagttataactcagcctttaggaacaccggagaacccacaataatagaaatcttttcgtgttccccattgagaaatgctttagttagcatcttcatgcttggaaatctagacaagaagagaatccatggatggacatggtcgaggaattcggaaagcctgcagttgacattcagtcttcacttgaaactcaaaactgacactaggaacagcttcatgagttcagtagaagtaagctttatttgtagcttctgccttgtttgacggcgtatctattcagggaagcgcacagtaaaagaattccttagcatgatgtctgttttggtacctcagcaatgaaccttttctagaaattattattccaaccactagaataccctagtcactattcccactttgagcattaacccctttgaaaagaaatggacttaaagtatctctgttttggcaaaattcaggttcaggggctggatggtatgtgtttctgctgccttattcaatccaccacttctctgtgaaacactctaccttgtttttggtttgattctactgatgtcagggtttagccggtagaaggagtagttcagtttgtcaattcaggagaaactgtactggtcagtcacatcttacggcgaagggagagggaccttaggggagcagagaagacaggcaaagttgtggactgtttgatcttgtattacccacaggaatgagggcagctaaacccatagaaggagttggaccaaggcgaattacgagtcctggtcccagcagtatgtgtgctgacttctgggtgccccagaaatagacctctcctgtagagtggtgatatacagaatgagtttcagtttgcattgcagctgggattgaaagtaatcagtcgtgagcaggcaggcaggaggtcctgttagccctgccttccaggaaggttggggtgggagttttgagtgggaaagaggatgacatgtgtgagagagttctgagcctgtttgctagggagagtgagtgagtgctcttgggcactgctcaggccgtttctgctgacttgcctggcttacaataaatgcccaataaatatttgttgaccatatgtgttgtacactgtggtgccctgtccagtcccctctaccaagctgagacccccatccccagctgctctgagtttgggctgcaagtgctcacagctcttgttctccagaaactggagaattgccctcaggagatgagagccatctcacctcacccaggagtcacttcctctctacaccccaacacctggttcatttgattaaagcggagaaaactccagggtgctatgactgctctggcacccttggatcaggccaagctagactttttctgagccttcatccgtgctaagctctctcccttctctatcctgtttcattccctccctcaaaggcgtttcccaaataaatcacactgtcaatca

SEQ ID NO: 3741 - DNA, 288 bp, Homo sapiens
ttcaggcacttccagtaccatgaggcttcaggaccccgggaggctctcagccaactccgggtgctctgctgtgagtggctgaggcccgagctgcacacgaaggagcagatcctggagctgctggtgctggagcagttcctgaccatcctgcctgaagagttccagccctgggtgagggaacatcaccctgaaagtggagaagaggcggtggccgtgatagaaaatatacagcgagaacttgaggaacgcagacagcaggtgagccgggctcagtggctcacacttgta

SEQ ID NO: 3742 - DNA, 3111 bp, Homo sapiens
gactcgcgggtgtgacgttgaagatgtcggccttctgagccgactgcggtggtcaagaggttgcatgctactgaaagtgtccttcagaagatattaaagagcagaaaaacaattgtttcagtgtaacacagccagcctcgaagacttccctctgagttggaatgataatgaccgaatcccgagaagttatagacttagaccccccagctgagacttcccaggagcaggaagaccttttcatagtgaaggtggaagaagaagactgcacctggatgcaggagtacaacccgccaacgtttgagactttttaccagcgcttcaggcacttccagtaccatgaggcttcaggaccccgggaggctctcagccaactccgggtgctctgctgtgagtggctgaggcccgagctgcacacgaaggagcagatcctggagctgctggtgctggagcagttcctgaccatcctgcctgaagagttccagccctgggtgagggaacatcaccctgaaagtggagaagaggcggtggccgtgatagaaaatatacagcgagaacttgaggaacgcagacagcagattgttgcctgccctgatgtgcttcctcggaagatggcaacacctggagcagtgcaggagtcctgcagcccccatcccctgaccgtggacacccagcctgagcaagcgccacagaagcctcgtctcctggaggaaaatgcccttcctgttctccaagttccttcccttcccctgaaggacagccaggagctgacagcttcacttctctcaactgggtcccagaagttggtgaaaattgaagaggtggctgatgtggctgtatccttcatcctggaggaatgggggcatttggaccagtcccagaagtccctttatagggatgacaggaaggagaactatgggagtattacttccatgggttatgagtccagggacaatatggagctcatagtgaagcagatttctgatgactctgaatcacactgggtggcgccagaacacaccgaaaggagcgttcctcaggatccagactttgcagaagtcagtgaccttaaaggcatggtacaaaggtggcaggtcaaccccactgtggggaaatcaaggcagaatccttcccagaaaagggatctggatgcaatcacagacatcagccctaagcaaagcacacatggcgagagagggcacagatgcagcgattgtggcaaattcttcctccaagcctcaaactttattcagcatcggcgcatccacactggagaaaaaccgtttaagtgcggagaatgtgggaagagctacaatcagcgggtgcacctcacccagcaccagcgcgtccacacaggggagaaaccctacaaatgtcaggtgtgcggaaaggctttccgggtgagttcccacctggttcagcaccacagtgtccacagcggagagaggccctatggctgcaatgagtgtgggaagaacttcggtcgccattcgcatctgatcgaacacctaaaacgccacttcagggagaaatcccagagatgcagtgacaaaagaagtaagaacacaaaattaagtgttaagaagaaaatttcagaatattcagaagcagacatggaactatctggaaaaacccaaagaaatgtttctcaagttcaagattttggagaaggctgtgagtttcaaggcaagctggatagaaagcagggaattcccatgaaagagatactaggacaaccatcttcaaagaggatgaactacagtgaagtcccatatgtccacaaaaaatcctccactggagagagaccacataaatgtaacgagtgtgggaaaagcttcattcagagtgcacatcttattcaacatcaaagaatacacactggggagaaaccattcaggtgtgaggaatgtgggaaaagctacaaccaacgcgtgcacctaactcagcatcagcgcgtccacacaggtgagaagccctacacctgtcccttatgtgggaaagccttcagagtgaggtcccaccttgttcagcatcagagcgtgcacagtggggagagacccttcaagtgtaacgaatgtgggaaaggctttgggaggcgttcccacctggctggacatcttcgactccactcccgagagaaatcccatcagtgtcgtgaatgtggggaaatcttttttcagtacgttagcctaattgaacatcaggtgctccacatgggtcagaaaaatgaaaaaaatggcatctgtgaggaagcatatagttggaacttgacagtgattgaagacaagaagattgagttacaagagcagccttatcagtgtgatatctgtggaaaagcctttggttatagctcagacctcattcagcattacagaactcatacagcagagaagccctatcaatgtgatatatgtagagaaaatgttggccagtgttcccacaccaaacaacatcaaaaaatctactccagcacaaaatcccatcaatgtcatgaatgtggcagaggcttcactctgaagtcacatcttaatcaacatcagagaatccatactggtgagaaaccttttcaatgtaaagaatgtggaatgaatttcagctggagttgtagcctctttaaacacctgagaagccatgagaggacagatcccataaataccttaagtgtagaggggtctctgttgtagaatagctcttaattttagagaaaccttcctggagggaaaccatactcctataatgagcaaagtaacaacttcaagcatttttccagcgttaccatcaaactcacaaataggttgaaatcctttagttataactcagcctttaggaacaccggagaacccacaataatagaaatcttttcgtgttccccattgagaaatgctttagttagcatcttcatgcttggaaatctagacaagaagagaatccatggatggacatggtcgaggaattcggaaagcctgcagttgacattcagtcttcacttgaaactcaaaactgacactaggaacagcttcatgagttcagtagaagtaagctttatttgtagcttctgccttgtttgacggcgtatctattcagggaagcgcacagtaaaagaattccttagca

SEQ ID NO: 3743 - DNA, 3310 bp, Homo sapiens
ttactaagagatggggtctcactatgttgcccaggctggagtgcaatggtgcgatcccggctcactgcatcctcagcctcccgggtccaagtgattctcctgcctcagcctcccaagtggctgagattacaggctcgcgccaccacgcccagctaagtttttgtatttttagtagagacggggtttcaccatgttggccaggctggtctcgaactcctggcctcaggtgatccacccacctcggcctcccaaagtgctggcattacaggtgtgagtcaccgagcccggccaagggagggtatttctaatagacaggggtctcgctatgttgcccgagctggtctcgaactcttgggctcaagcgatcctgcttcttcagcctgtccactagctaggcttacaagcgtgggaccccgcgcctggctgaagagaggtatcattaaggacgagacccccttggccagggaagccctgcgtaagcaacgcccctctcttcaaagggatgccccgctccctccgcccactcccagccttccagccttggctcccgaggacacgactccgggccctgccaccttctgataggctcgcgagaccgaggctgcaaagagagccgccccccattggccaaccggcgagtcccgcgcgccacctcctgggagatgtagttccgggaacagctggcccctgcgactcgcgggtgtgacgttgaagatgtcggccttctgagccgactgcggtggtcaagagtgtaacacagccagcctcgaagacttccctctgagttggaatgataatgaccgaatcccgagaagttatagacttagaccccccagctgagacttcccaggagcaggaagaccttttcatagtgaaggtggaagaagaagactgcacctggatgcaggagtacaacccgccaacgtttgagactttttaccagcgcttcaggcacttccagtaccatgaggcttcaggaccccgggaggctctcagccaactccgggtgctctgctgtgagtggctgaggcccgagctgcacacgaaggagcagatcctggagctgctggtgctggagcagttcctgaccatcctgcctgaagagttccagccctgggtgagggaacatcaccctgaaagtggagaagaggcggtggccgtgatagaaaatatacagcgagaacttgaggaacgcagacagcagattgttgcctgccctgatgtgcttcctcggaagatggcaacacctggagcagtgcaggagtcctgcagcccccatcccctgaccgtggacacccagcctgagcaagcgccacagaagcctcgtctcctggaggaaaatgcccttcctgttctccaagttccttcccttcccctgaaggacagccaggagctgacagcttcacttctctcaactgggtcccagaagttggtgaaaattgaagaggtggctgatgtggctgtatccttcatcctggaggaatgggggcatttggaccagtcccagaagtccctttatagggatgacaggaaggagaactatgggagtattacttccatgggttatgagtccagggacaatatggagctcatagtgaagcagatttctgatgactctgaatcacactgggtggcgccagaacacaccgaaaggagcgttcctcaggatccagactttgcagaagtcagtgaccttaaaggcatggtacaaaggtggcaggtcaaccccactgtggggaaatcaaggcagaatccttcccagaaaagggatctggatgcaatcacagacatcagccctaagcaaagcacacatggcgagagagggcacagatgcagcgattgtggcaaattcttcctccaagcctcaaactttattcagcatcggcgcatccacactggagaaaaaccgtttaagtgcggagaatgtgggaagagctacaatcagcgggtgcacctcacccagcaccagcgcgtccacacaggggagaaaccctacaaatgtcaggtgtgcggaaaggctttccgggtgagttcccacctggttcagcaccacagtgtccacagcggagagaggccctatggctgcaatgagtgtgggaagaacttcggtcgccattcgcatctgatcgaacacctaaaacgccacttcagggagaaatcccagagatgcagtgacaaaagaagtaagaacacaaaattaagtgttaagaagaaaatttcagaatattcagaagcagacatggaactatctggaaaaacccaaagaaatgtttctcaagttcaagattttggagaaggctgtgagtttcaaggcaagctggatagaaagcagggaattcccatgaaagagatactaggacaaccatcttcaaagaggatgaactacagtgaagtcccatatgtccacaaaaaatcctccactggagagagaccacataaatgtaacgagtgtgggaaaagcttcattcagagtgcacatcttattcaacatcaaagaatacacactggggagaaaccattcaggtgtgaggaatgtgggaaaagctacaaccaacgcgtgcacctaactcagcatcagcgcgtccacacaggtgagaagccctacacctgtcccttatgtgggaaagccttcagagtgaggtcccaccttgttcagcatcagagcgtgcacagtggggagagacccttcaagtgtaacgaatgtgggaaaggctttgggaggcgttcccacctggctggacatcttcgactccactcccgagagaaatcccatcagtgtcgtgaatgtggggaaatcttttttcagtacgttagcctaattgaacatcaggtgctccacatgggtcagaaaaatgaaaaaaatggcatctgtgaggaagcatatagttggaacttgacagtgattgaagacaagaagattgagttacaagagcagccttatcagtgtgatatctgtggaaaagcctttggttatagctcagacctcattcagcattacagaactcatacagcagagaagccctatcaatgtgatatatgtagagtggtgatatacagaatgagtttcagtttgcattgcagctgggattgaaagtaatcagtcgtgagcaggcaggcaggaggtcctgttagccctgccttccaggaaggttggggtgggagttttgagtgggaaagaggatgacatgtgtgagagagttctgagcctgtttgctagggagagtgagtgagtgctcttgggcactgctcaggccgtttctgctgacttgcctggcttacaataaatgcccaataaatatttgttgaccat

SEQ ID NO: 3744 - DNA, 1934 bp, Homo sapiens
ggaccaagatggcggcgccctgtgagggacaagcgtttgccgtaggggttgaaaagaattggggtgcagtagttcgctccccagaagggaccccccagaaaatccggcagctgatagatgaggggattgccccggaagagggaggcgtggacgcaaccacacccgcttgaggctctctatgaatctctgagagtcttagagaaggacacgtctgccacatcccagtcagttaatggatcaccccaagcggaacaaccttcattggaatctacaagcaaagaagccttctttagcagagtggaaacattttcttctttgaaatgggcaggtaagccctttgagctgtctccactcgtctgtgcaaaatatggctgggtcacagtggaatgtgatatgctcaagtgctctagctgtcaagcttttctctgtgccagtttacaaccagcttttgactttgacagatataagcaacgatgtgctgagctgaagaaagccttgtgtactgcccatgagaagttctgtttctggccagacagcccatccccagaccgatttgggatgttgcccctggatgagcctgctattcttgttagtgaattcctagatcgttttcaaagcctttgtcacttggacctccagcttccttccctaaggccggaggacttgaaaactatgtgcttgacagaagacaagatcagtcttctcctacacttgcttgaagatgaacttgatcaccgaactgatgagagaaaaactacaatcaaattaggctcagacatccaagtccacgtcactgcctgtattctctctgtgtgtggctgggcgtgtagttcctctttggaatccatgcagctctccctgataacatgttcgcaatgtatgaggaaggtggggctctggggcttccagcagattgaatcgtccatgactgacctggatgcatcctttggcctgaccagctccccaatcccaggccttgaggggcgaccagagcgcttacctctggtgcctgaatctcctcggaggatgatgacccggagccaggatgccactttctccccaggctcagagcaggctgaaaagagccctggtcccattgtctctcgaactcggagctgggactcttccagtcctgttgaccgtcctgagccagaggctgctagccccaccaccagaactcgcccagtgacccgaagcatgggaacaggagacacccctggcctggaggtaccatctagccctctgcggaaagccaagcgagctcgcctctgctcctccagcagttcggacacatcttcccgaagcttctttgatcccacctctcagcatagagactggtgcccttgggtgaatatcacacttggcaaagaaagcagggagaatggtggaactgaaccagatgccagcgccccagcagagccaggctggaaagcagtgctgaccatcctcttggcgcacaaacagtctagccagccagctgaaacggactccatgagtctctctgagaaatcaaggaaagtattccgaatatttcggcagtgggaatctctgtgctcatgctgaagatactccagcgccttcctggagatagctggaatgagagtgactttttgaaaaattaaggctgagttcctttcggtcagctgacactaagtttttcctgttctgggttaatcataaggagccccctgccatagcaaaggcagtgagtgtcaactatctgcatctggctgagagagacccgtttcctttcagggatgtggacagggtaagggcagcaagcatggttctgttaaaggagtgtgggattaacagactagaaggaagactaaggacctgaccacccatttcagcatcttcaatgtggagcagtgttctgaggactcttctatcctaggactatgacagtgtgtattaataaaatatttgctaag

SEQ ID NO: 3745 - DNA, 1972 bp, Homo sapiens
gcctcaagaggcggatattaacctcccaggacggaagttccggagccttcaaactctcggggaagcaactcggcagcggaccaagatggcggcgccctgtgagggacaagcgtttgccgtaggggttgaaaagaattggggtgcagtagttcgctccccagaagggaccccccagaaaatccggcagctgatagatgaggggattgccccggaagagggaggcgtggacgcgaaggacacgtctgccacatcccagtcagttaatggatcaccccaagcggaacaaccttcattggaatctacaagcaaagaagccttctttagcagagtggaaacattttcttctttgaaatgggcaggtaagccctttgagctgtctccactcgtctgtgcaaaatatggctgggtcacagtggaatgtgatatgctcaagtgctctagctgtcaagcttttctctgtgccagtttacaaccagcttttgactttgacagatataagcaacgatgtgctgagctgaagaaagccttgtgtactgcccatgagaagttctgtttctggccagacagcccatccccagaccgatttgggatgttgcccctggatgagcctgctattcttgttagtgaattcctagatcgttttcaaagcctttgtcacttggacctccagcttccttccctaaggccggaggacttgaaaactatgtgcttgacagaagacaagatcagtcttctcctacacttgcttgaagatgaacttgatcaccgaactgatgagagaaaaactacaatcaaattaggctcagacatccaagtccacgtcactgcctgtattctctctgtgtgtggctgggcgtgtagttcctctttggaatccatgcagctctccctgataacatgttcgcaatgtatgaggaaggtggggctctggggcttccagcagattgaatcgtccatgactgacctggatgcatcctttggcctgaccagctccccaatcccaggccttgaggggcgaccagagcgcttacctctggtgcctgaatctcctcggaggatgatgacccggagccaggatgccactttctccccaggctcagagcaggctgaaaagagccctggtcccattgtctctcgaactcggagctgggactcttccagtcctgttgaccgtcctgagccagaggctgctagccccaccaccagaactcgcccagtgacccgaagcatgggaacaggagacacccctggcctggaggtaccatctagccctctgcggaaagccaagcgagctcgcctctgctcctccagcagttcggacacatcttcccgaagcttctttgatcccacctctcagcatagagactggtgcccttgggtgaatatcacacttggcaaagaaagcagggagaatggtggaactgaaccagatgccagcgccccagcagagccaggctggaaagcagtgctgaccatcctcttggcgcacaaacagtctagccagccagctgaaacggactccatgagtctctctgagaaatcaaggaaagtattccgaatatttcggcagtgggaatctctgtgctcatgctgaagatactccagcgccttcctggagatagctggaatgagagtgactttttgaaaaattaaggctgagttcctttcggtcagctgacactaagtttttcctgttctgggttaatcataaggagccccctgccatagcaaaggcagtgagtgtcaactatctgcatctggctgagagagacccgtttcctttcagggatgtggacagggtaagggcagcaagcatggttctgttaaaggagtgtgggattaacagactagaaggaagactaaggacctgaccacccatttcagcatcttcaatgtggagcagtgttctgaggactcttctatcctaggactatgacagtgtgtattaataaaatatttgctaagattctca

SEQ ID NO: 3746 - DNA, 1676 bp, Homo sapiens
ggaccaagatggcggcgccctgtgagggacaagcgtttgccgtaggggttgaaaagaattggggtgcagtagttcgctccccagaagggaccccccagaaaatccggcagctgatagatgaggggattgccccggaagagggaggcgtggacgcgaaggacacgtctgccacatcccagtcagttaatggatcaccccaagcggaacaaccttcattggaatctacaagcaaagaagccttctttagcagagtggaaacattttcttctttgaaatgggcaggtaagccctttgagctgtctccactcgtctgtgcaaaatatggctgggtcacagtggaatgtgatatgctcaagtgctctagctgtcaagcttttctctgtgccagtttacaaccagcttttgactttgacagatataagcaacgatgtgctgagctgaagaaagccttgtgtactgcccatgagaagttctgtttctggccagacagcccatccccagaccgatttgggatgttgcccctggatgagcctgctattcttgttagtgaattcctagatcgttttcaaagcctttgtcacttggacctccagcttccttccctaaggccggaggacttgaaaactatgtgcttgacagaagacaagatcagtcttctcctacacttgcttgaagatgaacttgatcaccgaactgatgagagaaaaactacaatcaaattaggctcagacatccaagtccacgtcactgcctgtattctctctgtgtgtggctgggcgtgtagttcctctttggaatccatgcagctctccctgataacatgttcgcaatgtatgaggaaggtggggctctggggcttccagcagattgaatcgtccatgactgacctggatgcatcctttggcctgaccagctccccaatcccaggccttgaggggcgaccagagcgcttacctctggtgcctgaatctcctcggaggatgatgacccggagccaggatgccactttctccccaggctcagagcaggacacatcttcccgaagcttctttgatcccacctctcagcatagagactggtgcccttgggtgaatatcacacttggcaaagaaagcagggagaatggtggaactgaaccagatgccagcgccccagcagagccaggctggaaagcagtgctgaccatcctcttggcgcacaaacagtctagccagccagctgaaacggactccatgagtctctctgagaaatcaaggaaagtattccgaatatttcggcagtgggaatctctgtgctcatgctgaagatactccagcgccttcctggagatagctggaatgagagtgactttttgaaaaattaaggctgagttcctttcggtcagctgacactaagtttttcctgttctgggttaatcataaggagccccctgccatagcaaaggcagtgagtgtcaactatctgcatctggctgagagagacccgtttcctttcagggatgtggacagggtaagggcagcaagcatggttctgttaaaggagtgtgggattaacagactagaaggaagactaaggacctgaccacccatttcagcatcttcaatgtggagcagtgttctgaggactcttctatcctaggactatgacagtgtgtattaataaaatatttgctaaga

SEQ ID NO: 3747 - DNA, 1945 bp, Homo sapiens
gaaaagggggcgccgggccgctctagccggtgaggccggcgggctctctgtggctgcggctgggaaaccgcgcggaggaggtgcccggccggggaccagccctggtccagcgcctccctctctcagcatggacgaggagagcctggagtcggccttgcagacctaccgtgcgcagctgcagcaggtggagctggccttgggcgccggcctggattcgtctgagcaggctgacctgcgccagctgcagggggacctgaaggagctcatcgagctcaccgaggccagcctggtgtctgtcaggaagagcagcttgttggccgcgctggacgaagagcgcccgggccgccaggaagatgctgagtaccaggctttccgggaggccatcactgaggcggtggaggcaccagcagcggcccgtgggtccggatcagagaccgttcctaaagcagaggcggggccagaatctgcggcaggtgggcaggaggaggaagagggagaggacgaggaagagctgagtgggacaaaggtgagcgcgccctactacagctcctggggcactctggagtatcacaacgccatggtggtgggaacggaagaggcggaggatggctcggcgggtgtccgtgtgctttacctgtaccccactcacaagtctctgaagccgtgcccgttcttcctggagggaaagtgccgctttaaggagaactgcaggttctcccatgggcaggtggtctctctggatgagctgcgccccttccaggacccagacctgagctccctgcaggccggctctgcgtgtctggccaagcaccaggatggcctctggcacgcagcacgcatcaccgatgtggacaacggctactacacagtcaagtttgactcgctgctgctgagggaggccgtggtggagggggacggcatcctgcccccactgcgcacagaggccacagagtccgactcagacagcgacggtacgggtgactccagctatgccagagtggtggggtcggacgccgtggactctgcacagtcctctgccctctgtccgtctcttgcagtggtggggtcagatgctgtggactctgggacctgcagctctgcctttgctggctgggaggtgcacacgcgaggtataggctccagactcctcaccaagatgggctatgagtttggcaagggtttgggccgacacgcggaaggccgggtggagcccatccatgctgtggtgttgcctcgagggaagtcgctggaccagtgtgtggagaccctgcagaagcagaccagggttggcaaggctggcaccaacaagccccccaggtgccggggaagaggggccaggcctgggggccgcccagctcctcggaatgtgtttgacttcctcaatgaaaagctgcaaggtcaggctcctggggccctagaagccggggcggccccagcggggaggaggagcaaggacatgtaccatgccagcaagagtgccaagcgggccctgagcctgcggctcttccagactgaggagaagatcgagcgaacccagcgggacatcaggagcatccaggaggctctcgcccgcaacgctggccggcatagcgtggcgtcagcccagctgcaggagaagctggcaggagcccagcgccagctggggcagctccgggctcaggaagccggcctgcagcaggagcagaggaaggcagacacccacaagaagatgactgagttctagagaccccacaagcactatggacgaagcgtgggaccccagcacgggctgccctcaggaagaccagtgttgcccgaggaggggccggcctgctggcctggggcgtgcagacactgctgagtggagacagagctgcggggtcccatctggacacttacttgcccacctgccagtgtcttgggcatttccttggcaaggacattaaagtgatttcatcacagtgtc

SEQ ID NO: 3748 - DNA, 1871 bp, Homo sapiens
aagcacttccggaagcggcggcgctcgggaggaagtgccgatcggctgctggggcgaaaagggggcgccgggccgctctagccgccctggtccagcgcctccctctctcagcatggacgaggagagcctggagtcggccttgcagacctaccgtgcgcagctgcagcaggtggagctggccttgggcgccggcctggattcgtctgagcaggctgacctgcgccagctgcagggggacctgaaggagctcatcgagctcaccgaggccagcctggtgtctgtcaggaagagcagcttgttggccgcgctggacgaagagcgcccgggccgccaggaagatgctgagtaccaggctttccgggaggccatcactgaggcggtggaggcaccagcagcggcccgtgggtccggatcagagaccgttcctaaagcagaggcggggccagaatctgcggcaggtgggcaggaggaggaagagggagaggacgaggaagagctgagtgggacaaaggtgagcgcgccctactacagctcctggggcactctggagtatcacaacgccatggtggtgggaacggaagaggcggaggatggctcggcgggtgtccgtgtgctttacctgtaccccactcacaagtctctgaagccgtgcccgttcttcctggagggaaagtgccgctttaaggagaactgcaggttctcccatgggcaggtggtctctctggatgagctgcgccccttccaggacccagacctgagctccctgcaggccggctctgcgtgtctggccaagcaccaggatggcctctggcacgcagcacgcatcaccgatgtggacaacggctactacacagtcaagtttgactcgctgctgctgagggaggccgtggtggagggggacggcatcctgcccccactgcgcacagaggccacagagtccgactcagacagcgacggtacgggtgactccagctatgccagagtggtggggtcagatgctgtggactctgggacctgcagctctgcctttgctggctgggaggtgcacacgcgaggtataggctccagactcctcaccaagatgggctatgagtttggcaagggtttgggccgacacgcggaaggccgggtggagcccatccatgctgtggtgttgcctcgagggaagtcgctggaccagtgtgtggagaccctgcagaagcagaccagggttggcaaggctggcaccaacaagccccccaggtgccggggaagaggggccaggcctgggggccgcccagctcctcggaatgtgtttgacttcctcaatgaaaagctgcaaggtcaggctcctggggccctagaagccggggcggccccagcggggaggaggagcaaggacatgtaccatgccagcaagagtgccaagcgggccctgagcctgcggctcttccagactgaggagaagatcgagcgaacccagcgggacatcaggagcatccaggaggctctcgcccgcaacgctggccggcatagcgtggcgtcagcccagctgcaggagaagctggcaggagcccagcgccagctggggcagctccgggctcaggaagccggcctgcagcaggagcagaggaaggcagacacccacaagaagatgactgagttctagagaccccacaagcactatggacgaagcgtgggaccccagcacgggctgccctcaggaagaccagtgttgcccgaggaggggccggcctgctggcctggggcgtgcagacactgctgagtggagacagagctgcggggtcccatctggacacttacttgcccacctgccagtgtcttgggcatttccttggcaaggacattaaagtgatttcatcacagtgtca

SEQ ID NO: 3749 - DNA, 1896 bp, Homo sapiens
cggcgctcgggaggaagtgccgatcggctgctggggcgaaaagggggcgccgggccgctctagccggtgaggccggcgggctctctgtggctgcggctgggaaaccgcgcggaggaggtgcccggccggggaccagccctggtccagcgcctccctctctcagcatggacgaggagagcctggagtcggccttgcagacctaccgtgcgcagctgcagcaggtggagctggccttgggcgccggcctggattcgtctgagcaggctgacctgcgccagctgcagggggacctgaaggagctcatcgagctcaccgaggccagcctggtgtctgtcaggaagagcagcttgttggccgcgctggacgaagagcgcccgggccgccaggaagatgctgagtaccaggctttccgggaggccatcactgaggcggtggaggcaccagcagcggcccgtgggtccggatcagagaccgttcctaaagcagaggcggggccagaatctgcggcaggtgggcaggaggaggaagagggagaggacgaggaagagctgagtgggacaaaggtgagcgcgccctactacagctcctggggcactctggagtatcacaacgccatggtggtgggaacggaagaggcggaggatggctcggcgggtgtccgtgtgctttacctgtaccccactcacaagtctctgaagccgtgcccgttcttcctggagggaaagtgccgctttaaggagaactgcaggttctcccatgggcaggtggtctctctggatgagctgcgccccttccaggacccagacctgagctccctgcaggccggctctgcgtgtctggccaagcaccaggatggcctctggcacgcagcacgcatcaccgatgtggacaacggctactacacagtcaagtttgactcgctgctgctgagggaggccgtggtggagggggacggcatcctgcccccactgcgcacagaggccacagagtccgactcagacagcgacgtggtggggtcagatgctgtggactctgggacctgcagctctgcctttgctggctgggaggtgcacacgcgaggtataggctccagactcctcaccaagatgggctatgagtttggcaagggtttgggccgacacgcggaaggccgggtggagcccatccatgctgtggtgttgcctcgagggaagtcgctggaccagtgtgtggagaccctgcagaagcagaccagggttggcaaggctggcaccaacaagccccccaggtgccggggaagaggggccaggcctgggggccgcccagctcctcggaatgtgtttgacttcctcaatgaaaagctgcaaggtcaggctcctggggccctagaagccggggcggccccagcggggaggaggagcaaggacatgtaccatgccagcaagagtgccaagcgggccctgagcctgcggctcttccagactgaggagaagatcgagcgaacccagcgggacatcaggagcatccaggaggctctcgcccgcaacgctggccggcatagcgtggcgtcagcccagctgcaggagaagctggcaggagcccagcgccagctggggcagctccgggctcaggaagccggcctgcagcaggagcagaggaaggcagacacccacaagaagatgactgagttctagagaccccacaagcactatggacgaagcgtgggaccccagcacgggctgccctcaggaagaccagtgttgcccgaggaggggccggcctgctggcctggggcgtgcagacactgctgagtggagacagagctgcggggtcccatctggacacttacttgcccacctgccagtgtcttgggcatttccttggcaaggacattaaagtgatttcatcacagtgtca

SEQ ID NO: 3750 - DNA, 1890 bp, Homo sapiens
gggcgaaaagggggcgccgggccgctctagccggtgaggccggcgggctctctgtggctgcggctgggaaaccgcgcggaggaggtgcccggccggggaccagccctggtccagcgcctccctctctcagcatggacgaggagagcctggagtcggccttgcagacctaccgtgcgcagctgcagcaggtggagctggccttgggcgccggcctggattcgtctgagcaggctgacctgcgccagctgcagggggacctgaaggagctcatcgagctcaccgaggccagcctggtgtctgtcaggaagagcagcttgttggccgcgctggacgaagagcgcccgggccgccaggaagatgctgagtaccaggctttccgggaggccatcactgaggcggtggaggcaccagcagcggcccgtgggtccggatcagagaccgttcctaaagcagaggcggggccagaatctgcggcaggtgggcaggaggaggaagagggagaggacgaggaagagctgagtgggacaaaggtgagcgcgccctactacagctcctggggcactctggagtatcacaacgccatggtggtgggaacggaagaggcggaggatggctcggcgggtgtccgtgtgctttacctgtaccccactcacaagtctctgaagccgtgcccgttcttcctggagggaaagtgccgctttaaggagaactgcaggttctcccatgggcaggtggtctctctggatgagctgcgccccttccaggacccagacctgagctccctgcaggccggctctgcgtgtctggccaagcaccaggatggcctctggcacgcagcacgcatcaccgatgtggacaacggctactacacagtcaagtttgactcgctgctgctgagggaggccgtggtggagggggacggcatcctgcccccactgcgcacagaggccacagagtccgactcagacagcgacggtacgggtgactccagctatgccagagtggtggggtcagatgctgtggactctgggacctgcagctctgcctttgctggctgggaggtgcacacgcgaggtataggctccagactcctcaccaagatgggctatgagtttggcaagggtttgggccgacacgcggaaggccgggtggagcccatccatgctgtggtgttgcctcgagggaagtcgctggaccagtgtgtggagaccctgcagaagcagaccagggttggcaaggctggcaccaacaagccccccaggtgccggggaagaggggccaggcctgggggccgcccagctcctcggaatgtgtttgacttcctcaatgaaaagctgcaaggtcaggctcctggggccctagaagccggggcggccccagcggggaggaggagcaaggacatgtaccatgccagcaagagtgccaagcgggccctgagcctgcggctcttccagactgaggagaagatcgagcgaacccagcgggacatcaggagcatccaggaggctctcgcccgcaacgctggccggcatagcgtggcgtcagcccagctgcaggagaagctggcaggagcccagcgccagctggggcagctccgggctcaggaagccggcctgcagcaggagcagaggaaggcagacacccacaagaagatgactgagttctagagaccccacaagcactatggacgaagcgtgggaccccagcacgggctgccctcaggaagaccagtgttgcccgaggaggggccggcctgctggcctggggcgtgcagacactgctgagtggagacagagctgcggggtcccatctggacacttacttgcccacctgccagtgtcttgggcatttccttggcaaggacattaaagtgatttcatcacagtgtca

SEQ ID NO: 3751 - DNA, 427 bp, Homo sapiens
ggaggaagtgccgatcggctgctggggcgaaaagggggcgccgggccgctctagccggtgaggccggcgggctctctgtggctgcggctgggaaaccgcgcggaggagccctggtccagcgcctccctctctcagcatggacgaggagagcctggagtcggccttgcagacctaccgtgcgcagctgcagcaggtggagctggccttgggcgccggcctggattcgtctgagcaggctgacctgcgccagctgcagggggacctgaaggagctcatcgagctcaccgaggccagcctggtgtctgtcaggaagagcagcttgttggccgcgctggacgaagagcgcccgggccgccaggaagatgctgagtaccaggctttccgggaggccatcactgaggcggtggaggcaccagcagcggcccgt

SEQ ID NO: 3752 - DNA, 1904 bp, Homo sapiens
ggggaacacactcgctgcagccccgcctgggccacggcaccctcgagcgccagccccgcgccccacccgggagcagcgagccaccggcgcgctccccaggagcccctgcaggcgccggccctggtccagcgcctccctctctcagcatggacgaggagagcctggagtcggccttgcagacctaccgtgcgcagctgcagcaggtggagctggccttgggcgccggcctggattcgtctgagcaggctgacctgcgccagctgcagggggacctgaaggagctcatcgagctcaccgaggccagcctggtgtctgtcaggaagagcagcttgttggccgcgctggacgaagagcgcccgggccgccaggaagatgctgagtaccaggctttccgggaggccatcactgaggcggtggaggcaccagcagcggcccgtgggtccggatcagagaccgttcctaaagcagaggcggggccagaatctgcggcaggtgggcaggaggaggaagagggagaggacgaggaagagctgagtgggacaaaggtgagcgcgccctactacagctcctggggcactctggagtatcacaacgccatggtggtgggaacggaagaggcggaggatggctcggcgggtgtccgtgtgctttacctgtaccccactcacaagtctctgaagccgtgcccgttcttcctggagggaaagtgccgctttaaggagaactgcaggttctcccatgggcaggtggtctctctggatgagctgcgccccttccaggacccagacctgagctccctgcaggccggctctgcgtgtctggccaagcaccaggatggcctctggcacgcagcacgcatcaccgatgtggacaacggctactacacagtcaagtttgactcgctgctgctgagggaggccgtggtggagggggacggcatcctgcccccactgcgcacagaggccacagagtccgactcagacagcgacggtacgggtgactccagctatgccagagtggtggggtcagatgctgtggactctgggacctgcagctctgcctttgctggctgggaggtgcacacgcgaggtataggctccagactcctcaccaagatgggctatgagtttggcaagggtttgggccgacacgcggaaggccgggtggagcccatccatgctgtggtgttgcctcgagggaagtcgctggaccagtgtgtggagaccctgcagaagcagaccagggttggcaaggctggcaccaacaagccccccaggtgccggggaagaggggccaggcctgggggccgcccagctcctcggaatgtgtttgacttcctcaatgaaaagctgcaaggtcaggctcctggggccctagaagccggggcggccccagcggggaggaggagcaaggacatgtaccatgccagcaagagtgccaagcgggccctgagcctgcggctcttccagactgaggagaagatcgagcgaacccagcgggacatcaggagcatccaggaggctctcgcccgcaacgctggccggcatagcgtggcgtcagcccagctgcaggagaagctggcaggagcccagcgccagctggggcagctccgggctcaggaagccggcctgcagcaggagcagaggaaggcagacacccacaagaagatgactgagttctagagaccccacaagcactatggacgaagcgtgggaccccagcacgggctgccctcaggaagaccagtgttgcccgaggaggggccggcctgctggcctggggcgtgcagacactgctgagtggagacagagctgcggggtcccatctggacacttacttgcccacctgccagtgtcttgggcatttccttggcaaggacattaaagtgatttcatcacagtgtc

SEQ ID NO: 3753 - DNA, 2627 bp, Homo sapiens
ttccattggaaactgattgggcagatttgaaaattaagctttcacaatcacaatttttatgagagttcattcagttttggagaagtcgaggaaagaattgggaattgaaattttgatgtggcctgataggatcaggtggggcttttgataggaagtgagtgttttgggttgtttcttgactggattatgatgcggaatacagcgggtagagggccgattaagttttagtcattagtgtagcttttcagtatacacgccttttcattttcagtccctttcagaagaaaagaccacaggcatcagaaatcaatcaacttgctaatttatgccagattccactggagatctgccttcccaagactttactgactggtgaagaacaggaaatgaacaattcccagggaagagtgaccttcgaggatgtcactgtgaacttcacccagggggagtggcagcggctgaatcccgaacagagaaacttgtacagggatgtgatgctggagaattacagcaaccttgtctctgtgggacaaggggaaaccaccaaacccgatgtgatcttgaggttggaacaaggaaaggagccatggttggaggaagaggaagtgctgggaagtggccgtgcagaaaaaaatggggacattggagggcagatttggaagccaaaggatgtgaaagagagtctcgcaagagaagtcccatcaatcaataaggaaacgctgactacgcagaaaggtgtagaatgtgacggatctaagaaaatacttccactgggcatagatgatgtatcttccttgcaacactatgtacaaaataattctcacgatgataatggatacagaaaattagttggcaataatccatccaaatttgtaggacaacaactgaaatgtaatgcctgtagaaagttattcagttcaaagtcacgccttcaaagtcacctgaggaggcatgcctgtcaaaaaccctttgaatgtcatagctgtggaagagcattcggggagaagtggaagcttgataaacatcagaaaactcacgcagaggaaaggccctataaatgtgagaactgtggaaatgcctacaagcagaagtcaaatctctttcaacatcagaaaatgcatactaaagagaaaccctatcagtgtaagacatgtggaaaagccttttcctggaaatcatcctgcattaatcatgagaaaattcataatgccaagaaatcctatcagtgtaatgaatgtgagaaatccttcaggcagaactcaaccctcattcaacataaaaaagttcacactggacaaaaaccctttcaatgtacggactgtggaaaggctttcatttacaagtcagatcttgtgaaacaccagagaatacacacgggagagaaaccctataaatgtagcatatgtgagaaggccttttcccagaaatccaatgtcatcgatcatgagaaaattcacactgggaagagagcttatgagtgtgatctatgtggaaatacctttatccagaagaaaaacctcattcaacataaaaaaatccatactggggaaaagccctatgaatgtaacagatgtggaaaagccttctttcagaagtcaaaccttcatagccatcagaaaactcatagcggagagaggacctatagatgtagtgaatgtggaaaaaccttcatccggaaattaaaccttagtttgcataaaaaaacccatactggacaaaaaccttatggatgttctgaatgcggtaaagccttcgctgacaggtcataccttgttaggcaccagaaaagaattcactccagataggagccccatgcacttaaaaaaacatgggaagatatggttgcctggaattgtcaccccagaattccatgttgaaatggcctctaatttggaggctatttttgaaggtagcgaggacttattatcacagtatcctttgaaaacccattcggcatactcactcagcaaatgtttattaagtataaatatttattagatgccttttgtgtaccaggaactcttaaacactgaagatgtagcaataaaccaaatgtgctaaaaccctgatggagttttattccagtgaataatgaccagtggtatccatatctttaaaaacgtttaaaagactatacttttggccaggcgtggtggctcaaatgcctgtaatcccagtactttgggaggctgaggtgggcgcatcacctgaggtcaggagttcgagaccagcatgaccaacatggtgaaaccctgtctctaccaaaaatacaaaaattagccaggcatagttgtgggcacctgtaatcccagctacccgggaggctgaggcaggagaattgcttgaacctgggaggtagaggttgcagtgagccaatattgcaccattgcactcctgcctgggcaacaagagcaaaatttcatctcaaaaataagataaaataaaataaacaaataagacagcactttatacttttagggatgatttctataattcatgagtggagaggtttctctagaggtgtaggggactggaaaccacatccaggaagtacagctttctctcctgagcatgaaggtatcttggcatttcttcactgcaattgccatttgccttttttgtttttc

SEQ ID NO: 3754 - DNA, 3185 bp, Homo sapiens
gggggggcagtagttttaaagtagacacccgcccttgcctcagagaagatggagtcttgctctgtcaccaggctggagtgcagtggcgcaatctcggctcactgcagcctccacctcccgggttcaagcgattcccctgcctcagcctcccaaatagctgggactacagacgccatttggaatgaacaggaaaaggctgaactttttacagataagttttgtcaagtatgtggagtgatgctacagtttgaatcacaaagaatttcacattatgagggtgaaaaacatgctcaaaatgttagtttttattttcaaatgcatggggaacaaaatgaagtgcctggtaagaaaatgaagatgcatgttgagaattttcaggtgcataggtatgaaggagtggacaaaaacaaattttgtgatctctgcaacatgatgtttagctctccacttattgctcagtctcactatgtgggaaaggtccatgctaaaaaactgaagcaattaatggaggaacatgatcaggcatctccatcaggatttcaaccagagatggcatttagtatgagaacctatgtttgccatatttgtagtattgcttttacatctttagatatgttccggtcccacatgcaaggaagtgaacatcaaattaaagaatccattgttatcaatctagtgaagaattcaaggaagacacaagactcttaccaaaatgagtgtgcagattacatcaatgtgcagaaagccagaggactagaggccaagacttgtttcagaaagatggaagagagttctttggaaacccgtagatacagagaagtggtcgattccagacccagacatagaatgtttgaacaaagactcccatttgagactttccggacatacgcagcaccatacaatatttcacaagcaatggaaaagcagttacctcattcaaagaagacatatgactctttccaagatgaacttgaagattacatcaaagtacagaaagccagaggactagatccaaagacttgtttcagaaagatgagagagaactctgtggatactcatgggtacagagaaatggttgattctggacccagatcaagaatgtgtgagcaaagattttcacatgaggcttcccagacctaccaacgaccataccatatttcaccagtggaaagccagttacctcagtggctaccaacccattcaaagaggacatatgattctttccaagatgaacttgaagattacataaaagtgcagaaagccagaggactagagccaaaaacttgtttcagaaagataggagatagctctgtagaaacacacaggaacagagaaatggttgatgtcagacccagacatagaatgttggagcaaaagctcccatgtgagactttccagacctattcaggaccatatagtatttcacaagtagtggaaaaccagttacctcattgcttaccagctcatgatagcaaacagagactagattctattagctactgtcaactcaccagagactgtttcccagaaaaaccagtacccttgagccttaatcagcaagaaaataactctggctcatacagtgtagaatctgaagtttacaagcacctctcttcagaaaacaatactgctgaccatcaagcaggtcataaacagaaacatcagaagagaaaacgacacctagaagaaggcaaagaaaggccagagaaagagcagtccaagcataaaaggaaaaagagttatgaagatacagatttagacaaagacaagagcatcagacaaaggaaaagagaggaggatagagtcaaggtcagttcaggaaagcttaagcatcgaaaaaagaaaaaaagccatgatgtaccctccgagaaagaagaacgtaagcacaggaaagagaaaaagaaatctgttgaagaaaggacagaagaggaaatgctttgggatgagtctattcttggattttgaatgtttagttttgtttacccaaggttgaattgaaaaaaaaaaacagtcaatatggatttagaaaaaggaacacctgatgaagaaaaggagaggtagatacagtcagtgtcacttcaggacacttaggttttttttgtataaaaatttaaattgaattaaaagaaggaaaaaaaaagcccaaacttaacctctgagaaaagaacataagaactcaaggagaacataagagaaaaggaaacctgttacagaaaagacaagaatctgtgttttggaatgagtctattcttgggtattgaacttttagttttgtttgcccaaggattaattgaggaaatcagctaagaaaatggactttagacaaaagcaagaggatcagatgaagaaaaggagaggtagatacagtcagtgtcacttcaggaaagctatttaaaaaaacttgaaatttaattgaaagaagaaacaacaacaaaaaagcctaaacctagcctctgaacaacactaacatgagaacacaagaacttaagagaaaaagaaacctactcaagaaaagacagaagagacagtgatttgggatgagtctactctaggattttcaactttttagttttgttccttcaaagttgaaggaaaaaaagtttggttttataaaattcatgttattgtaatttttctaggtggatggctactttaatctctaaaaaagccaagtgaagtaaaagtattcagtatgccttttcctcaagttactttccttcattttcttaaaaaagaaaaaaaattattaaatgtttctcacatatctcacatataatgtaatttccctaaatgaagttgtctctacttctgctcatcaaattgctgtgatagtgaattatttattcatgggagataatttattttaaaggacagaattaccaagcgttacaaaatcagttctttccttggttttgtgttagtgttggtggtattttattgttgtttttctgtgtttatgtgtctcagctttctccaaggaatatgtatgaaataacttaaactgattttttctttgttaaatctaatttgcagtgtatttttgcattttctagttctgaaagtggaaaatgaaacagtctataataaacttagatgatatatagttttaaaacggtctcaaaaagtactgatataaggtcagtctatattctggaaatgtttatattaaagtgttttaatttcta

SEQ ID NO: 3755 - DNA, 3185 bp, Homo sapiens
aattgtccgcgcgcctcgctgcgatggcggcggcgccgagcacagtcaccccgctggcggcggagtcttcccctcaggaagctaccgtctctgccgcctcctcctcctcctacaccgcctgcgcggcagcggcggcggcggcggcggcggcggcagtaattgttcctgcctcctccgccacctccgcccctgcctgcccgcctgccggtggctgtggcgacggcggcggcggcggctttggcggctccactatggcggcggcggggagggggggcagtagttttaaagtagacacccgcccttgcctcagagaagacgccatttggaatgaacaggaaaaggctgaactttttacagataagttttgtcaagtatgtggagtgatgctacagtttgaatcacaaagaatttcacattatgagggtgaaaaacatgctcaaaatgttagtttttattttcaaatgcatggggaacaaaatgaagtgcctggtaagaaaatgaagatgcatgttgagaattttcaggtgcataggtatgaaggagtggacaaaaacaaattttgtgatctctgcaacatgatgtttagctctccacttattgctcagtctcactatgtgggaaaggtccatgctaaaaaactgaagcaattaatggaggaacatgatcaggcatctccatcaggatttcaaccagagatgggagtgcctcttactacttctgcagagtcaacattcctgaagccccttcctgtcaagcctcctacaggcaccttctcactactagtgtattttattcccctttcatattctctcttccacccacttcttttcctccactcactattatttttcagttctttctttacccagcctttctccttcatgtgaaaatgttcattcttctctcctccttgaagctctattctttgtcatatgtaactctttatgctctggttcttctctatttctgtttcttttttgttttctctatgggctctttttttattcattacctaaatgtaggtattcccatggtttcatccttgaccttactctacaaacacgatttctatttccctgatttcatttctcatctgtatgcttatgacctttctgtcaagtattagattcacatatccaaatggcagctactgcttcacctggatgcctcatagccatttcaaatccacctagtcattcaaagtagaaacccacagaattttgctttcagcttttatcctgagagtggggctcactgaacctctctcctttctaaaatctgtggaaattacttttggtaactaaggcactgcagtgatctcagcatttagtatgagaacctatgtttgccatatttgtagtattgcttttacatctttagatatgttccggtcccacatgcaaggaagtgaacatcaaattaaagaatccattgttatcaatctagtgaagaattcaaggaagacacaagactcttaccaaaatgagtgtgcagattacatcaatgtgcagaaagccagaggactagaggccaagacttgtttcagaaagatggaagagagttctttggaaacccgtagatacagagaagtggtcgattccagacccagacatagaatgtttgaacaaagactcccatttgagactttccggacatacgcagcaccatacaatatttcacaagcaatggaaaagcagttacctcattcaaagaagacatatgactctttccaagatgaacttgaagattacatcaaagtacagaaagccagaggactagatccaaagacttgtttcagaaagatgagagagaactctgtggatactcatgggtacagagaaatggttgattctggacccagatcaagaatgtgtgagcaaagattttcacatgaggcttcccagacctaccaacgaccataccatatttcaccagtggaaagccagttacctcagtggctaccaacccattcaaagaggacatatgattctttccaagatgaacttgaagattacataaaagtgcagaaagccagaggactagagccaaaaacttgtttcagaaagataggagatagctctgtagaaacacacaggaacagagaaatggttgatgtcagacccagacatagaatgttggagcaaaagctcccatgtgagactttccagacctattcaggaccatatagtatttcacaagtagtggaaaaccagttacctcattgcttaccagctcatgatagcaaacagagactagattctattagctactgtcaactcaccagagactgtttcccagaaaaaccagtacccttgagccttaatcagcaagaaaataactctggctcatacagtgtagaatctgaagtttacaagcacctctcttcagaaaacaatactgctgaccatcaagcaggtcataaacagaaacatcagaagagaaaacgacacctagaagaaggcaaagaaaggccagagaaagagcagtccaagcataaaaggaaaaagagttatgaagatacagatttagacaaagacaagagcatcagacaaaggaaaagagaggaggatagagtcaaggtcagttcaggaaagcttaagcatcgaaaaaagaaaaaaagccatgatgtaccctccgagaaagaagaacgtaagcacaggaaagagaaaaagaaatctgttgaagaaaggacagaagaggaaatgctttgggatgagtctattcttggattttgaatgtttagttttgtttacccaaggttgaattgaaaaaaaaaaacagtcaatatggatttagaaaaaggaacacctgatgaagaaaaggagaggtagatacagtcagtgtcacttcaggacacttaggttttttttgtataaaaatttaaattgaattaaaagaaggaaaaaaaaagcccaaacttaacctctgagaaaagaacataagaactcaaggagaacataagagaaaaggaaacctgttacagaaaagacaagaatctgtgttttggaatgagtctattcttgggtattgaacttttagttttgtttgcccaaggattaattgaggaaatcagctaagaaaatggactttagacaaaagcaagaggatcagatgaagaaaaggagaggtagatacagtcagtgtcacttcaggaaagctatttaaaaaaacttgaaatttaattg

SEQ ID NO: 3756 - DNA, 2367 bp, Homo sapiens
atggagtcttgctctgtcaccaggctggagtgcagtggcgcaatctcggctcactgcagcctccacctcccgggttcaagcgattcccctgcctcagcctcccaaatagctgggactacagacgccatttggaatgaacaggaaaaggctgaactttttacagataagttttgtcaagtatgtggagtgatgctacagtttgaatcacaaagaatttcacattatgagggtgaaaaacatgctcaaaatgttagtttttattttcaaatgcatggggaacaaaatgaagtgcctggtaagaaaatgaagatgcatgttgagaattttcaggtgcataggtatgaaggagtggacaaaaacaaattttgtgatctctgcaacatgatgtttagctctccacttattgctcagtctcactatgtgggaaaggtccatgctaaaaaactgaagcaattaatggaggaacatgatcaggcatctccatcaggatttcaaccagagatggcatttagtatgagaacctatgtttgccatatttgtagtattgcttttacatctttagatatgttccggtcccacatgcaaggaagtgaacatcaaattaaagaatccattgttatcaatctagtgaagaattcaaggaagacacaagactcttaccaaaatgagtgtgcagattacatcaatgtgcagaaagccagaggactagaggccaagacttgtttcagaaagatggaagagagttctttggaaacccgtagatacagagaagtggtcgattccagacccagacatagaatgtttgaacaaagactcccatttgagactttccggacatacgcagcaccatacaatatttcacaagcaatggaaaagcagttacctcattcaaagaagacatatgactctttccaagatgaacttgaagattacatcaaagtacagaaagccagaggactagatccaaagacttgtttcagaaagatgagagagaactctgtggatactcatgggtacagagaaatggttgattctggacccagatcaagaatgtgtgagcaaagattttcacatgaggcttcccagacctaccaacgaccataccatatttcaccagtggaaagccagttacctcagtggctaccaacccattcaaagaggacatatgattctttccaagatgaacttgaagattacataaaagtgcagaaagccagaggactagagccaaaaacttgtttcagaaagataggagatagctctgtagaaacacacaggaacagagaaatggttgatgtcagacccagacatagaatgttggagcaaaagctcccatgtgagactttccagacctattcaggaccatatagtatttcacaagtagtggaaaaccagttacctcattgcttaccagctcatgatagcaaacagagactagattctattagctactgtcaactcaccagagactgtttcccagaaaaaccagtacccttgagccttaatcagcaagaaaataactctggctcatacagtgtagaatctgaagtttacaagcacctctcttcagaaaacaatactgctgaccatcaagcaggtcataaacagaaacatcagaagagaaaacgacacctagaagaaggcaaagaaaggccagagaaagagcagtccaagcataaaaggaaaaagagttatgaagatacagatttagacaaagacaagagcatcagacaaaggaaaagagaggaggatagagtcaaggtcagttcaggaaagcttaagcatcgaaaaaagaaaaaaagccatgatgtaccctccgagaaagaagaacgtaagcacaggaaagagaaaaagaaatctgttgaagaaaggacagaagaggaaatgctttgggatgagtctattcttggattttgaatgtttagttttgtttacccaaggttgaattgaaaaaaaaaaacagtcaatatggatttagaaaaaggaacacctgatgaagaaaaggagaggtagatacagtcagtgtcacttcaggacacttaggttttttttgtataaaaatttaaattgaattaaaagaaggaaaaaaaaagcccaaacttaacctctgagaaaagaacataagaactcaaggagaacataagagaaaaggaaacctgttacagaaaagacaagaatctgtgttttggaatgagtctattcttgggtattgaacttttagttttgtttgcccaaggattaattgaggaaatcagctaagaaaatggactttagacaaaagcaagaggatcagatgaagaaaaggagaggtagatacagtcagtgtcacttcaggaaagctatttaaaaaaacttgaaatttaattg

SEQ ID NO: 3757 - DNA, 1652 bp, Homo sapiens
agaaaccctccagtccttagctcgtttagaacacaagactccaagcttattggagggctatcttgccttacggctccaagccgctttttacggcgtttttcagctcgccattcacttcgctgtgaagatggcgtcgggcagcgggacaaaaaacttggactttcgccgaaagtgggacaaagatgaatatgagaaactcgccgagaagaggctcacggaagagagagaaaagaaagatggaaaaccagtgcagcctgtcaagcgagagcttttacggcatagggactacaaggtggacttggaatccaagcttgggaagacaattgtcattaccaagacaacccctcaatctgagatgggaggatattactgcaatgtctgtgactgtgtggtgaaggactccatcaactttctggatcacattaatggaaagaaacatcagagaaacctgggcatgtctatgcgtgtggaacgttccaccctggatcaggtgaagaaacgttttgaggtcaacaagaagaagatggaagagaagcagaaggattatgattttgaggaaaggatgaaggagctcagagaagaggaggaaaaggccaaagcgtacaagaaagagaaacagaaggagaagaaaaggagggctgaggaggacttgacatttgaggaggacgatgagatggcagctgtgatgggcttctctggctttggttccaccaagaagagttactgaggctttctgtgcttggcctgactttggcctatgctggacctaactttgcgtgtgtgtgtgtgtagtagggggtcatttctttttgggtaatgggaaagttcttaagagtgtcaatggggagggatagagggtgggggctcatggtttccctctactttgggagagggcacagattgcagaggtaatgctgtggcatattgcttctgcctcagtgtatcactggagtcacaggaccctgcccacctgagttcccaataaagaaaaacctccccttctgaggctgctttcccaaaactccccctgcatctttatctcttcatctatcccacctcttgtctgaacatcccacctttatcctgtgttctgcctttgttttaattttaactcatgttcatcctgcaacagaagcattctctaggtcccagtttccagttgattgcatatccttgatcagccctttttcccatcctgccctatggttctctagccacctgtgcatgcatgtgtatttctgcctggttctatggtgtgtggatgtgtgtgcatgaatctgtcatatagagggggtccgagctggaatcctagagcattgctgccctggggcctgatgttcttggcttcctcagagcatgtaacaggaaattaaatgggatgagtgtttggtgtggtttgtgtctgatgagttttttaacattcaggtgtagattgtttcagcttctcatgtttcattttcctgaagatttatgtttttgtctaccttgtgagcaggcttttggaagaacctgtttgatgcaaaaaagaaaatgaaaaacaaaacaaaaaatccccaaaaccttattatgggagcccgtcggtcttagaagctgtttgacatgtataataaatggcattgactgggcctgttttacatttggtgagaacattc

SEQ ID NO: 3758 - DNA, 9406 bp, Homo sapiens
ctccatcctggggcggaagtggggagagcagcagtttaaaggttctgttgcagcagtttaaaggatccactcagccgccttaaccgccaaccagcaggctaagggaggaacagaatgaacaatgtttggatcccaatgactggagatgaaagttgcaaaagctctgcccaggcttctaccaaggattaactttccagggcatctgctgaactgctcttcggggctgtctgctgagattggcggcgggaccctcccgcctctcactcgtgcctttgttccccacgccggcctaaccccgcgcccctgcgctcgcggccagggcacctgacccacgcgccgcccgccggggatgcgggagccgccactgctaccgctgccaccgctgccgggcctgctccgccaagcacatgcgcagtggcgacgccgagccggcgccctcagtctcctcctccaccgcctcccggttccgcagtcacttcctgcagctgtttccctgtgggtcgggttggactgacttttgacagtcagccttcggctgcggagggggctcggcggcggccggcggagaaagttgctccgagaagaggctgggtcgagctgggccgagccgggcgcgcagggcgggcgtcgcgggcgtcccgggcggacgcggcgcggagactgccggcgcgtcccgggggttccgatttgaagaccttgcttctcatcacccactggattatgccccaggcttccctacccaatgatcctcttgcaacacgccgtgcttcctccacctaagcagccctcaccctcgcctcctatgtcagtggccaccaggtctacaggaaccttgcagcttccaccacagaagccttttgggcaggaggcttccttgcctcttgcaggggaagaagagttatcgaagggaggggagcaagactgtgccctggaggagctatgtaagcccctgtactgcaaactctgcaatgtcaccttgaactctgcacagcaagcccaggctcattatcagggtaaaaatcatggtaagaaactccgaaattactatgcagcaaatagctgtcctcctcctgctagaatgagcaatgtggtcgagcctgcagctactccagttgttccagtccctccgcagatgggctcctttaagccaggaggccgagtgatcctggccacggagaatgattactgtaagctctgtgatgcctccttcagttccccagctgtggctcaggctcactatcaagggaagaatcatgccaagaggctgcggctggcggaagctcagagtaactcattctcggaatcctcagagctgggtcaacggcgggccaggaaagaagggaatgagtttaagatgatgcctaacaggagaaatatgtatacagtacagaataattcagcaggtccttacttcaatccccgctctcggcagagaattccacgtgatctggccatgtgtgttactccaagtggccagttttactgctcaatgtgtaatgttggagctggcgaagagatggaattccggcagcatttagagagcaagcaacataagagcaaggtgtctgaacagcggtacaggaatgagatggagaatctgggatatgtatagtgattatcatattaagatagagcagcttttcctgcctgttgtttgccttttgtcaacttgccctgctttgtggtctttttgatatgagtacattcctctgcttaatgttaatacatgtaacccacagtggtaccatgagatgtcaaaacctgggggcccgggggcggggcggggggaggtgggtgtgaagaacgtgcttcttaggtcataacgcttttgcagggtcaatggtgttgagccgctcatagcatgtgacctacctaccccatcagaaataactttttatcttgctcaagttctggtcaactagtagcctgacggcttagaactttgactatttaaaagtttcattttcttttgcaattttagttttatgtactgttaaagaattgtactgaattctttttagatcacagtaaaaataggttggcagagatttcagtttcccagggcttaaccagaaccgccacctcaatgcattgtcagtagaatacattattagaaactgttaaggtctttcccgggacatttttttctgccattttcttttgcaattgtagttttatgtactgttaaagaattgtattgaattctttttagatcaaagtaaaaataggtcagcagagatttcagtttcccagggcttaaccagaaccgccacctcaatgcattgtcagtaggatacattattagaaactgttagggtctttcccaggacatttttttttctgtatcatgtctccccatcattgaagcgcaaattttcttgaattcaaatactcccaatgagcttgtatacttccaaacagctaaacttgatttccagttgtggatttcacacatataattgccgccttcttccctcctcttttttcccccctagttgaatcagcttgtctaacaagcccattttcatgccccagctgtgctgtgggttttccaagcctcatatttgaatattcaatgagtttaagatggatatgatttcaaaaaatagggccgggcgcggtggctcacgcctgtaatcccagcactttgggaggccgaagcaggcggatcacgaggtcaggaggtcgagatcatcctggctaacacagtgaaaccccatctctactaaaaatacaaaacattagccgggcgtggtggtgggtgcctgtagtcccagctactctggaggctgaggcaggagaatggcgtgaacccgggaggcggagcttgcagtgagccgagatcgcgccactgcactccagcctgggtgacagagcgagactccgtctcaaaaaaaaaaaaaaaaaaaaaaaaaaaatatatatatatatagatatattttccagcagtttttaggaaacaaaggtgtgtttgattttccaatttagagttacttcattgatagtaacatgcgcttatatcatgatctaaaccataagttcagattgcttgatattttgttttgccagacttttttgataatctgattcttacggtttacttacattttcctctgtcttgccagtctggtggccatcctgaaaaatatcaccacctgctgttttatacacagaggaattttttaaaaagcaaataaagtttcactatcttcgtttccagtagaaatatacacgaactatggttttattctttgtaattcggctttcttgaagatactaacaagtatatgatagatcactttggcatctgataattatatcagtattattatttttgtttttttgcgtttaaaataagaagttgtatgaacccaggaggtggaggttgcagtcagccaagaatcgtgccactgcactccagtctgggcgacagagcaatactccgtctccaaaaaaaaaaaaaaagaagctataatatatatctagattaactaatggagtgctctgtgaatattcattaactacattttatctatttactatattttatatgggtaagaccagtggtcatccgtatttcttttgaaagcccacttgatcaggaagtttatattttaagcagtatgtttgcacaatggtcagttcacatttgattgcttgtattactaattagaggtaaaacttctattttttcttgataattctgtaggcaaaaaaaattggggaaggcaaattacaatcattcttcttctgtaatactttgggacaatttttaaacaactcagacccatgtttaaaaacgagttttgtgtgattaacccttgtatagtatccagttactgtcttctcttgaagtggtggttctttgagaagtagaattattttgtaacttttcttctcccagaaacagaagaatcaaatactattctgttaggattctatctagacctgtgactcttagtataataacccttttattattattattattattattttttcagtaatctataaagtagagttgcttagttttgagcaatttagggcttttcttattggccagtaggttattcattttgctgctaaatataattttttggttaattttaacattatagtgctggccgcttggttctatgattacctaaaaatctagtttttttcctccataggtagatgtgtgtgtatgcatacccccacacacacacgtacatatatgttgtcatagagaggtatttcaacccttatttcaaataacagtagaagatacgaacatgaatttatattttgtaaaaatgtcattcatccactttgttttccattggaaatagttttataagaagggttccccttgctctctccacttaacaatttcattatatacgtagaaaaagcagccgacttaagggcttgatgttttttcaggccttgtggattcaggtttccagtttcccagtgcccttaatggatgttatgaatgcataagcacattttcttttaaagaaagaagttagatttatagtgttatttcttacttgctatatttctttgcactaaaaaagagctatgtgtttgttttataggacactttagtaccgtattgcctacaataactcagtttgctccttaaattccaaactctgggaagttgataaataacttccatgatcacttgtaaaagttacatgcacatctgaaaaaaaatcacaaatctctatgacagtaggttatgttttgagcttgttaccttgcagtattcttctctgttccataggtgaaaacaaagggtgacagaggttatcaggcaggaaatgcctaaatagatacatctctgcatggtacaatttctcatattcatgtattccataaacagtgttttttctctgtttaagcagactgttgtttcttctgagtcagtgatatgtgatcttcgttggtttcattttgtgaagctcagtctgtctctgtaacatactttaggatttgcaccttgtgctccccaggaattatgttagtgtccttttctatgctgtcttcaaggatggacagaggcctaaaccacaacaacaacaaaaattagaaaaaaaaatacttagatttcggtaatcatccataggaactcatagcatcagtctcttttctctgtgaataatatctttgtgtaagttgtcataaaaaatcaacgttagaagatgacaattagaattcttcttaggtattgagggtaagaagttgtaaagaaagaaaattcgtgtttcaactaaaagattggattgcatatacctttgaagtggttttgtaaaaaaagttcagttactaaactgagtgtgccctgtaatccttttgagtgcactgaagatgctttgaaaatactttgttggtcttcacattgtgcatcatgtcctgcaacttgtaaatatgtgcatgttgtttatgtttgtctgcctgtctcttattgcactaaattctgcaaggtgaataatttttttataccatttatttggaaaaagttcctcctccaactcttcttcactgaccttttaattagttggtaaacttagaaaaccaggtaggatttttgaagccctgagtttaaaagaagaatcgtggctatttgacatcatccttacattcccctgacttaaaaagctaacaagaagcacgagatcttccacctcattttagaaagcttttctacagaactatatgcttgcttatagctacctatctacagtttgaacagggagaaagggagatatgtatgtctggttacatcttccttcactcttgaattggctgggacagcaagcaacaacagtttgaggtccagtgacctacgtaaaatgagtgtcgtttgtgtcaggggacacatgtaactgtgcaacatggtattttctacagggagggctaggaagggtggttttggaacctaacctactttgtgtcttcattgtcagaactaaggttggaaatgccctttaaagaacttggtgaggcatatgctaggacaatagagctgctttagaaagaaattgagacatgttttgtcaggacagataaaagtttaatgcaggcttttgaacagatgttttaaaacaaatttgaccttaccaactatttttttcttctagccaaatcattgtacaggagtttcatatatgataaaaagtgttttgttattgtttttgctttcttggcaggggagaacccctaccattgtgagcagttactgtcactctggctgaatggacaaatagctgtgtaaatagcttctcataaaacgcttctactgatagctgtttgactttttcttcccgttatgaatgggaggaacatttgtaaacttcctttctgggtagctaccaaaaaacgtactggcttatggtcccatgtgaccttgtctccgttaagcccagaatctgagtgcctttagcaagtgttagcatttcacagagagaagagagacagaattattgctattaatcaccattcataaataggagcttggaataacaaaggtctgtgtgaattctgttctacgtcttttttttcccttttttaaataaatgtcaatttgatatcaagtaaaactattgtcattattgatcagaaaccatacattctgaaaatgaatccagttttcccaagctggcagaagtcagagatcatttttcaccttgatctgtgttgcgtttgtacttagtgaatggcagtgtggttgattggaagagcttgacactgatgtttggaaaaattctttattctagtggtcattttcaaacttgtcttctgtagagaggggaaaaattatgtatttgcagctaaagcgaagagactggcacaataattattaattgtgttagttcatttctatattaaatgaagcatcttcacaaatcaggtttgaagccattaaaagcaaaattttccctagtttaattaatttaaaattctaaattgcctgactacttagaatcttagaaacgccctgctagactgattttattatagaaatgttaacatgttcctcaacattttctcaagaaaattttcagacatatatcaaagttgaaaaaactttgcagtataaccactgctagattctgccatcaacatttgactatacttgtattgccatgtatctgttcatattctctatccctcttttcatccatcgatccatcagattttttttttaaagaacattccaaagtaaattttaggcaatacactgccctaaattcttagcatgggtgtcattaattaaggtttagtattcgtttaaatatctattttgaaagtggtgtatgaagttgataatctgagccaattaacatacttttttttttttcctcctgtggacttttgtcttccagtttctctttttgtgtgtacttagggtgagggaggacaattcctttcaaacacaagtttattttagaattggtcatttttaagtgcttgtcataaattttaaagtttcaatataatttttcttttccccacttctgataatgtatttttgccaaactatgcagcttcttcaaaaaactgtaaattactgattggggtttatgaaatcagcgaatacctcatttcaatctgttgctgcttttctccctcttgtcacttctcctttcactactttcagctgctctaccagaaggtagaggggagtaaagggtcaaacccctatataattagctgttttaaacaactctaggagagcagattaagtagcttagtaagttgaaactattaatttttctaaagaatttgatttgaattccttgagaattgtaattatccacacttcctccagctataattagcagaattaaaaatgattgtactgtacaatgagttgttgaaattgtaagccttagtaaccatctttagctttattgtagtcatgtttagaaaaaattatttttacatatgcctttatttttatgcccactttttgtggataagattctttagataaaatctaaagaattttaagtgactttctccaggtcatgaagattcaatgggtagaattgaatcagaattgaaatgttccagattcatattcttgtgtgtgtttgataaaattcatggcttccaaagtaactgaacacttcctttgggcccttggagggaaaatccatatttttactaattacacttttttttttagacatctggcagttctttgaacttaaacatattctcatggccatagttccaaattaagcccgacgcagttgctaaaaatcttgctgcactgttgaatactaataatgcaacatttattggatgtttttgcattttgatgaccttcatgattcatttataagtctttgtaagtgcttaagtgaccccctcactagtgaaaataataaatgttctatatcatttattattatttgtgtattctctacatgatatatttttttaaggaagagtaactccacatgtcagaatgagtgatattatcctagggcaaagcgcaaatagggcagtttgtttctactctgcaaatatggcatgtataggaacaaaactcttttggagtggctggtcattgttctgccctcttttggtacctgagtacctttctggggttttgtaaatcgtgtgtcatttgtaagaatttcacgttaactctgcgttacttggtgttcacctgtggtatccttgactgaccataatgatttagtttgggtatgatgtgtctgctttgaaatgccttactggagtatgtcagatcctgctttaaagcattccatatatctgctgggacaataagttgcttctccttggaaatatgctctagattcagaagcaaaaccgattttgctttcaccattaaggttgcattttaatgcagttattgttttaaattagagaataaaatgtaaaaccaagggaggctttagaaccctttattgaatggcatggcaaacttttaaaactgcttttgctatttcactagaactatctttgataaaggatatagctaaaaaatgtcagcccaaactgtgtgtaattagggttgtttattaaaattttctctaaatgtcatacagaggcttaagatctgtgtatgctgttgggtcggagtgccagtcactgctttggaagtctgtgttctggggctgcagaatgacaaacgtgtcatgggattaaaaccaatcaactgtgaattgtgaaattgaaactactctttcggttttattttctttagcatattgagtatagaaatctgaaacttatttaaaatttatactgcttttgttgatggctcattttggctgtgtatcctcacttatgtactgatttctgataaaggcttgacattattataacacgcattttgtgttccagtttaataaaacggtttctgagtcttgtctgaaaa

SEQ ID NO: 3759 - DNA, 743 bp, Homo sapiens
gctttcaggacgagcccctggagcgccggggactagcggttcctttccgatgctctttccatctgccctccacgtgacagggcttgcgctgcttctatttatcagtttgcttgtttcaggcatttcacgtggaccaggtggatcatctgtgcgtgcagctgccttggccctctcagttgcccccgccccgtgggagtcgggggattccatccttcgtgatggcatccataccgggttgagatttgaagaccttgcttctcatcacccactggattatgccccaggcttccctacccaatgatcctcttgcaacacgccgtgcttcctccacctaagcagccctcaccctcgcctcctatgtcagtggccaccaggtctacaggaaccttgcagcttccaccacagaagccttttgggcaggaggcttccttgcctcttgcaggggaagaagagttatcgaagggaggggagcaagactgtgccctggaggagctatgtaagcccctgtactgcaaactctgcaatgtcaccttgaactctgcacagcaagcccaggctcattatcagggtaaaaatcatggtaagaaactccgaaattactatgcagcaaatagctgtcctcctcctgctagaatgagcaatgtggtcgagcctgcagctactccagttgttccagtccctccgcagatgggctcctttaagccaggaggccgagtgatcctggccacggagaatgattactg

SEQ ID NO: 3760 - DNA, 2944 bp, Homo sapiens
atccactcagccgccttaaccgccaaccagcaggctaagggaggaacagaatgaacaatgtttggatcccaatgactggagatgaaagttgcaaaagctctgcccaggcttctaccaaggattaactttccagggcatctgctgaactgctcttcggggctgtctgctgagattggcggcgggaccctcccgcctctcactcgtgcctttgttccccacgccggcctaaccccgcgcccctgcgctcgcggccagggcacctgacccacgcgccgcccgccggggatgcgggagccgccactgctaccgctgccaccgctgccgggcctgctccgccaagcacatgcgcagtggcgacgccgagccggcgccctcagtctcctcctccaccgcctcccggttccgcagtcacttcctgcagctgtttccctgtgggtcgggttggactgacttttgacagtcagccttcggctgcggagggggctcggcggcggccggcggagaaagttgctccgagaagaggctgggtcgagctgggccgagccgggcgcgcagggcgggcgtcgcgggcgtcccgggcggacgcggcgcggagactgccggcgcgtcccgggggttccggcatttcacgtggaccaggtggatcatctgtgcgtgcagctgccttggccctctcagttgcccccgccccgtgggagtcgggggattccatccttcgtgatggcatccataccgggttgagatttgaagaccttgcttctcatcacccactggattatgccccaggcttccctacccaatgatcctcttgcaacacgccgtgcttcctccacctaagcagccctcaccctcgcctcctatgtcagtggccaccaggtctacaggaaccttgcagcttccaccacagaagccttttgggcaggaggcttccttgcctcttgcaggggaagaagagttatcgaagggaggggagcaagactgtgccctggaggagctatgtaagcccctgtactgcaaactctgcaatgtcaccttgaactctgcacagcaagcccaggctcattatcagggtaaaaatcatggtaagaaactccgaaattactatgcagcaaatagctgtcctcctcctgctagaatgagcaatgtggtcgagcctgcagctactccagttgttccagtccctccgcagatgggctcctttaagccaggaggccgagtgatcctggccacggagaatgattactgtaagctctgtgatgcctccttcagttccccagctgtggctcaggctcactatcaagggaagaatcatgccaagaggctgcggctggcggaagctcagagtaactcattctcggaatcctcagagctgggtcaacggcgggccaggaaagaagggaatgagtttaagatgatgcctaacaggagaaatatgtatacagtacagaataattcaggtccttacttcaatccccgctctcggcagagaattccacgtgatctggccatgtgtgttactccaagtggccagttttactgctcaatgtgtaatgttggagctggcgaagagatggaattccggcagcatttagagagcaagcaacataagagcaaggtgtctgaacagcggtacaggaatgagatggagaatctgggatatgtatagtgattatcatattaagatagagcagcttttcctgcctgttgtttgccttttgtcaacttgccctgctttgtggtctttttgatatgagtacattcctctgcttaatgttaatacatgtaacccacagtggtaccatgagatgtcaaaacctgggggcccgggggcggggcggggggaggtgggtgtgaagaacgtgcttcttaggtcataacgcttttgcagggtcaatggtgttgagccgctcatagcatgtgacctacctaccccatcagaaataactttttatcttgctcaagttctggtcaactagtagcctgacggcttagaactttgactatttaaaagtttcattttcttttgcaattttagttttatgtactgttaaagaattgtactgaattctttttagatcacagtaaaaataggttggcagagatttcagtttcccagggcttaaccagaaccgccacctcaatgcattgtcagtagaatacattattagaaactgttaaggtctttcccgggacatttttttctgccattttcttttgcaattgtagttttatgtactgttaaagaattgtattgaattctttttagatcaaagtaaaaataggtcagcagagatttcagtttcccagggcttaaccagaaccgccacctcaatgcattgtcagtaggatacattattagaaactgttagggtctttcccaggacatttttttttctgtatcatgtctccccatcattgaagcgcaaattttcttgaattcaaatactcccaatgagcttgtatacttccaaacagctaaacttgatttccagttgtggatttcacacatataattgccgccttcttccctcctcttttttcccccctagttgaatcagcttgtctaacaagcccattttcatgccccagctgtgctgtgggttttccaagcctcatatttgaatattcaatgagtttaagatggatatgatttcaaaaaatagggccgggcgcggtggctcacgcctgtaatcccagcactttgggaggccgaagcaggcggatcacgaggtcaggaggtcgagatcatcctggctaacacagtgaaaccccatctctactaaaaatacaaaacattagccgggcgtggtggtgggtgcctgtagtcccagctactctggaggctgaggcaggagaatggcgtgaacccgggaggcggagcttgcagtgagccgagatcgcgccactgcactccagcctgggtgacagagcgagactccgtctc

SEQ ID NO: 3761 - DNA, 2466 bp, Homo sapiens
cagttggtccgagctgccgaaaggtctggtcgcagagacaggaacgtgtaatcctcagcgtgctccagcccacagcttcgctctactgctcggcagggcagctggcctctgggcaccggcggcccctctgcctcgcggaaaagcctgatgaagtcctccgatattgatcaggatttattcacagacagttactgcaaggtgtgcagtgcacagctgatctccgaatcgcagcgtgtggcccactacgagagtcgaaaacatgcaagcaaagtccgactgtattacatgcttcaccccagggatggagggtgtcctgccaagaggctccggtcagaaaatggaagtgatgccgacatggtggataagaacaagtgctgcacactctgcaacatgtcattcacttcagcggtggtggccgattcccattatcaaggcaaaatccacgccaagaggttaaaactcttgctaggagagaagaccccattaaagaccacagcaacacccctgagcccacttaagcccccacggatggacactgctccggtggtcgcatctccctatcaaagaagagattcagacagatactgtgggctctgtgcagcctggtttaataaccctctgatggcccagcaacattatgatggcaagaaacacaaaaagaatgcggcaagagttgctttgttagaacaactggggacaaccctggatatgggggaactgagaggtctgaggcgcaattacagatgtaccatctgcagtgtctccctaaactcaatagaacagtatcatgcccatctgaaaggatctaaacaccagaccaacctgaagaataagtagtgaaagcatcaatcaagacataagaacaaaacattagcatttctctgccgtggagaattgcttatcaaccaccagaggaggcttctttcttgaacaataaacatttcttataaggattcacagattcacatacgactgatcttgatttttggaaatgaatgaggtttcttttttctttttcctttttttaattttggggtaagttatgatatttggatggatttttaaattctttcctgataacatatttagcacatgttctaaattataatcctatagcaaacagttggagcattattcaaactgaaagtggaaaaatttaaatttccaatttattctagatttcctcagagcataattattctgttaaatcctcaatgagtgtgatgtaaaccacctctatccagaaatatacattcttttctcatcatgttggacacagttgagggtgacatgcacagaactggaacagatcactattagtggaaaataccaaatggacaaataaataccagtcgttttctccgttctccaagcacaggagccaggtttaccatctgaacaatgaagacgaagggagtaaataaaggaagaattctcatcttttttcctgatcattcaaagaacagtttctcaaggttaagccaagtcctccttgcaagttgccaaataatagcttaggaaaagaattagtctgcctgcatgatgatcttcttaggcaaaaacgtcttcacagcccttgaccttggtgaatttttttccccaaaagcatccaaaagaagaattataaaccccagaatgagatggaaataaacaagtatttttttttatgatgtttggcctgaactgtgggctttaattgggggatactgatcgtttggaaagaagtgagaaaattctgaagaaatggcggccttgggctaggcggggtcccctatttcttctgtttctcactgaagtcctactgctgagccaagactcagtcactctggaaagagcatgaccgataaagaaaacagttcctttctgatggggagcgtctgagtgcagatcatgaggctctttctctaggtttaattcttttccatggtgaccggacttggtgtcttgtagcctggttacgaagtgggacgttgagcttctactgacgatgccctgcatggaccagctgggatctggctggggctgccctgtgtccctaacgaccataggcaatccatcttcttgtgtcagcaatttctggacacccactgttttccaccaagagctgaggtggcaacaactcagtgagcaataaacaaaatgacacagaaatgcacagtgttgttatgaaggagcctgtttacctgtgttcaaaatctggcaccattcccttgagcagggcccgctcaggagggaccaggtctgccagtttctgtgcctgcagagagacgaagccccacgagccacaccctactctacaagaggaaagggggttggatgggaagaatctattttgctgttttggaaagcacacagccgacctacaaacctcctgtgatggtgtttcttcggatgtgtaaaataaggctttatttgtcaattccgctgtaaaataagcattgtccgagtaaaaacagcagcaacaac

SEQ ID NO: 3762 - DNA, 2250 bp, Homo sapiens
cgctagcacagttggtccgagctgccgaaaggtctggtcgcagagacaggaacgtgtaatcctcagcgtgctccagcccacagcttcgctctactgctcggcagggcagctggcctctgggcaccggcggcccctctgcctcgcggaaaagcctgatgaagtcctccgatattgatcaggatttattcacagacagttactgcaaggtgtgcagtgcacagctgatctccgaatcgcagcgtgtggcccactacgagagtcgaaaacatgcaagcaaagtccgactgtattacatgcttcaccccagggatggagggtgtcctgccaagaggctccggtcagaaaatggaagtgatgccgacatggtggataagaacaagtgctgcacactctgcaacatgtcattcacttcagcggtggtggccgattcccattatcaaggcaaaatccacgccaagaggttaaaactcttgctaggagagaagaccccattaaagaccacaggtctgaggcgcaattacagatgtaccatctgcagtgtctccctaaactcaatagaacagtatcatgcccatctgaaaggatctaaacaccagaccaacctgaagaataagtagtgaaagcatcaatcaagacataagaacaaaacattagcatttctctgccgtggagaattgcttatcaaccaccagaggaggcttctttcttgaacaataaacatttcttataaggattcacagattcacatacgactgatcttgatttttggaaatgaatgaggtttcttttttctttttcctttttttaattttggggtaagttatgatatttggatggatttttaaattctttcctgataacatatttagcacatgttctaaattataatcctatagcaaacagttggagcattattcaaactgaaagtggaaaaatttaaatttccaatttattctagatttcctcagagcataattattctgttaaatcctcaatgagtgtgatgtaaaccacctctatccagaaatatacattcttttctcatcatgttggacacagttgagggtgacatgcacagaactggaacagatcactattagtggaaaataccaaatggacaaataaataccagtcgttttctccgttctccaagcacaggagccaggtttaccatctgaacaatgaagacgaagggagtaaataaaggaagaattctcatcttttttcctgatcattcaaagaacagtttctcaaggttaagccaagtcctccttgcaagttgccaaataatagcttaggaaaagaattagtctgcctgcatgatgatcttcttaggcaaaaacgtcttcacagcccttgaccttggtgaatttttttccccaaaagcatccaaaagaagaattataaaccccagaatgagatggaaataaacaagtatttttttttatgatgtttggcctgaactgtgggctttaattgggggatactgatcgtttggaaagaagtgagaaaattctgaagaaatggcggccttgggctaggcggggtcccctatttcttctgtttctcactgaagtcctactgctgagccaagactcagtcactctggaaagagcatgaccgataaagaaaacagttcctttctgatggggagcgtctgagtgcagatcatgaggctctttctctaggtttaattcttttccatggtgaccggacttggtgtcttgtagcctggttacgaagtgggacgttgagcttctactgacgatgccctgcatggaccagctgggatctggctggggctgccctgtgtccctaacgaccataggcaatccatcttcttgtgtcagcaatttctggacacccactgttttccaccaagagctgaggtggcaacaactcagtgagcaataaacaaaatgacacagaaatgcacagtgttgttatgaaggagcctgtttacctgtgttcaaaatctggcaccattcccttgagcagggcccgctcaggagggaccaggtctgccagtttctgtgcctgcagagagacgaagccccacgagccacaccctactctacaagaggaaagggggttggatgggaagaatctattttgctgttttggaaagcacacagccgacctacaaacctcctgtgatggtgtttcttcggatgtgtaaaataaggctttatttgtcaattccgctgtaaaataagcattgtccgagtaaaaacagcagcaacaacaaaa

SEQ ID NO: 3763 - DNA, 690 bp, Homo sapiens
ctttggaccgttcacaggctaattgggaaaagtggacaggcctgcctgaagcctgatgaagtcctccgatattgatcaggatttattcacagacagttactgcaaggtgtgcagtgcacagctgatctccgaatcgcagcgtgtggcccactacgagagtcgaaaacatgcaagcaaagtccgactgtattacatgcttcaccccagggatggagggtgtcctgccaagaggctccggtcagaaaatggaagtgatgccgacatggtggataagaacaagtgctgcacactctgcaacatgtcattcacttcagcggtggtggccgattcccattatcaaggcaaaatccacgccaagaggttaaaactcttgctaggagagaagaccccattaaagaccacagcaacacccctgagcccacttaagcccccacggatggacactgctccggtggtcgcatctccctatcaaagaagagattcagacagatactgtgggctctgtgcagcctggtttaataaccctctgatggcccagcaacattatgatggcaagaaacacaaaaagaatgcggcaagagttgctttgttagaacaactggggacaaccctggatatgggggaactgagaggtctgaggcgcaattacagatgtaccatctgcagtgtctccctaaactcaatagaaca

SEQ ID NO: 3764 - DNA, 3643 bp, Homo sapiens
cagataaaaactgtcagacccggcctgtaggctgctccattgccaatgaactccatgaaccccatgaaacctgccctgccccctgcgccacacggtgatggttcattcgcatatgagtctgtgccttggcaacaaagcgccactcagccggctggatcgctgtctgtggtcactactgtgtggggagttggcaacgcgacacagagccaggttttggggaaccccatgggccctgcagggagtccctctggcagctccatgatgcctggtgtggcagggggcagctccgccttgacctccccacagtgcctgggacagcaggcgtttgctgaaggcggcgccaacaagggctacgtgcagcaaggcgtgtacagccgcgggggctaccctggggcccccggcttcaccaccgggtatgcaggcggcccggggggcctgggcctcccctcacatgctgcaagaccctccactgacttcacgcaagcggcagctgctgcagctgtggctgctgcggcagccactgccaccgccacagccacagccaccgtggctgctctccaggagaagcagagccaggagctgagccagtatggagcgatgggggccggacagtcttttaacagccagtttctgcagcatggaggtccccgggggcctagtgtccccgctggcatgaaccctactggcataggaggggtaatgggcccctctggcctctcccccttggctatgaaccccacccgggcagcaggaatgacacccttgtatgcagggcagcgtctgccccaacatgggtatcctgggcctccccaggcccagccactgccccgacagggggtcaagagaacctactctgaggtgtatccagggcagcagtatctgcaaggaggccagtatgcacccagcaccgcccagtttgcgcccagccctgggcagccccctgccccctccccttcctaccctgggcacaggctgcccctgcagcagggcatgacccagtccctgtccgtgcctggccccacgggactgcattataagcctacccgttccatcccgggctatcccagttccccactgccagggaaccccacgccacccatgaccccaagcagcagcgtcccttacatgtcaccaaaccaagaggtcaagtctcccttcttgcctgatctcaagcccaacctcaactccttgcactcatcgccctctggaagcgggccttgtgacgagttgcggctgaccttccctgtgcgcgatggggtggtcctggagcccttccgcctgcagcacaacctggctgtaagcaaccatgtcttccagctgcgagactcagtctacaagaccctgataatgaggcctgacctggagctgcaattcaagtgctaccaccacgaggaccggcagatgaacaccaactggccagcctcggtgcaggtcagcgtcaatgccacgccgctcaccatcgagcgtggcgacaacaagacctcgcacaagccactctacctgaagcatgtgtgccagccaggccgcaacaccatccagatcaccgtcaccgcctgctgctgctcccacctcttcgtgctgcagctagtgcaccgcccatccgtccgctcggtgctgcagggcctcctcaaaaagcgcctcctgcctgctgagcactgcatcaccaagataaagcggaacttcagcagcggcaccatccctggcacccctgggcccaacggagaggacggggtggagcagacagctatcaaggtgtccctgaagtgccccatcaccttccgcaggatccagctccctgcccgaggtcatgactgtcgccacatacagtgctttgacctggagtcgtacctgcagctcaactgtgagcgggggacttggaggtgtcctgtgtgcaacaagacagctttgctggagggcctggaggtggaccagtacatgctgggcatcctgatttacattcagaactctgactatgaggagatcaccatcgaccccacgtgcagctggaagccagtgcccgtgaagcctgacatgcacatcaaggaggagccggatgggccagcactgaagcgctgccgcaccgtgagccccgcccacgtgctcatgcccagcgtgatggagatgatcgccgccctgggccccggcgctgccccctttgcccccctgcagcccccctcagtccctgcccccagcgactaccctggccagggttccagcttcctggggcctggaactttccctgagtccttcccacccaccacgcccagcaccccaacccttgctgagttcaccccgggaccaccccccatctcctaccagtctgacattcccagcagcctcctgacttcagagaagtctaccgcctgcctcccaagccagatggcaccagcaggtcacctggaccccactcacaatcctgggacaccaggactacacacctccaaccttggggcccctccaggtccccagctgcaccattcaaaccctcccccagcgtcccggcagtccttgggccaagcgagcttaggacctacgggtgaactggccttcagtcctgccacaggcgtgatggggccccccagcatgtctggagccggggaggccccagaaccagctctggacctgctcccggaactgaccaaccctgatgagctactgtcctacttgggcccacccgacctccctacgaacaacaatgacgacctgctttctctgtttgagaacaactgatcctgtgtttaccccaagcccggcggggacacgctcacagatgtcaccacagccctgcccttcatgcccagccccatgggacacccggtggtctttcccaaacctcccccaaaacacacctggagccagagccttctgccgccagccctgcccctgaattggaagcagccctgtgctcgatgggaggggctcccaggccggcagcccttgccacctccctctgccaagcctgctgctgcagaacggtttttgctgaggtgcccctgcccagccctgtccagccttgtccacacacacatctcacgcccctggtctcacagcctcacaccttgtccttccacccctgcctgcccccacccagcctgcttcttgtccagcattgatccttctgtttcaacaactcctccactgggcagagctgggcatctggcagggctggctctgtcccctgggcctttggctccagtggcccctgtgcccagcagtccagctcttggaacctcgctgaatggcagcctcttgggggcctggagctctggcagcccagccgtgtgtggtgtcaggttcctctccccaccccagcttcaagcagaggcctcggggtgggggagctacaaagcacaacaatgtacatagtgtagaaacactaacagctgggagaggggagccagctgtccagccagcatgttcctgttgtacagcccggtctccctgcgcgctctgctccttcccatgtgcagacagatcagggaggaacctccaatgggtgggggacagtgagcttcggcctggccgaggtgggtgggtgggctctcagattcagctctgtgtaaagattctctagcgggctgcgctcccaagttccccttctctgtgaaagtgaagaattagtacagctgtgttttttaaagcc

SEQ ID NO: 3765 - DNA, 5141 bp, Homo sapiens
cgcatggagcggcgcgggccgggggccgccacggcgaggggccgggccaggccgggcggagccagagcagctgagttccagataaaaactgtcagacccggcctgtaggctgctccattgccaatgaactccatgaaccccatgaaacctgccctgccccctgcgccacacggtgatggttcattcgcatatgagtctgtgccttggcaacaaagcgccactcagccggctggatcgctgtctgtggtcactactgtgtggggagttggcaacgcgacacagagccaggttttggggaaccccatgggccctgcagggagtccctctggcagctccatgatgcctggtgtggcagggggcagctccgccttgacctccccacagtgcctgggacagcaggcgtttgctgaaggcggcgccaacaagggctacgtgcagcaaggcgtgtacagccgcgggggctaccctggggcccccggcttcaccaccgggtatgcaggcggcccggggggcctgggcctcccctcacatgctgcaagaccctccactgacttcacgcaagcggcagctgctgcagctgtggctgctgcggcagccactgccaccgccacagccacagccaccgtggctgctctccaggagaagcagagccaggagctgagccagtatggagcgatgggggccggacagtcttttaacagccagtttctgcagcatggaggtccccgggggcctagtgtccccgctggcatgaaccctactggcataggaggggtaatgggcccctctggcctctcccccttggctatgaaccccacccgggcagcaggaatgacacccttgtatgcagggcagcgtctgccccaacatgggtatcctgggcctccccaggcccagccactgccccgacagggggtcaagagaacctactctgaggtgtatccagggcagcagtatctgcaaggaggccagtatgcacccagcaccgcccagtttgcgcccagccctgggcagccccctgccccctccccttcctaccctgggcacaggctgcccctgcagcagggcatgacccagtccctgtccgtgcctggccccacgggactgcattataagcccacagagcagttcaacgggcagggcgccagcttcaacgggggcagcgtcagctacagccaacctggcctgagtgggcctacccgttccatcccgggctatcccagttccccactgccagggaaccccacgccacccatgaccccaagcagcagcgtcccttacatgtcaccaaaccaagaggtcaagtctcccttcttgcctgatctcaagcccaacctcaactccttgcactcatcgccctctggaagcgggccttgtgacgagttgcggctgaccttccctgtgcgcgatggggtggtcctggagcccttccgcctgcagcacaacctggctgtaagcaaccatgtcttccagctgcgagactcagtctacaagaccctgataatgaggcctgacctggagctgcaattcaagtgctaccaccacgaggaccggcagatgaacaccaactggccagcctcggtgcaggtcagcgtcaatgccacgccgctcaccatcgagcgtggcgacaacaagacctcgcacaagccactctacctgaagcatgtgtgccagccaggccgcaacaccatccagatcaccgtcaccgcctgctgctgctcccacctcttcgtgctgcagctagtgcaccgcccatccgtccgctcggtgctgcagggcctcctcaaaaagcgcctcctgcctgctgagcactgcatcaccaagataaagcggaacttcagcagcggcaccatccctggcacccctgggcccaacggagaggacggggtggagcagacagctatcaaggtgtccctgaagtgccccatcaccttccgcaggatccagctccctgcccgaggtcatgactgtcgccacatacagtgctttgacctggagtcgtacctgcagctcaactgtgagcgggggacttggaggtgtcctgtgtgcaacaagacagctttgctggagggcctggaggtggaccagtacatgctgggcatcctgatttacattcagaactctgactatgaggagatcaccatcgaccccacgtgcagctggaagccagtgcccgtgaagcctgacatgcacatcaaggaggagccggatgggccagcactgaagcgctgccgcaccgtgagccccgcccacgtgctcatgcccagcgtgatggagatgatcgccgccctgggccccggcgctgccccctttgcccccctgcagcccccctcagtccctgcccccagcgactaccctggccagggttccagcttcctggggcctggaactttccctgagtccttcccacccaccacgcccagcaccccaacccttgctgagttcaccccgggaccaccccccatctcctaccagtctgacattcccagcagcctcctgacttcagagaagtctaccgcctgcctcccaagccagatggcaccagcaggtcacctggaccccactcacaatcctgggacaccaggactacacacctccaaccttggggcccctccaggtccccagctgcaccattcaaaccctcccccagcgtcccggcagtccttgggccaagcgagcttaggacctacgggtgaactggccttcagtcctgccacaggcgtgatggggccccccagcatgtctggagccggggaggccccagaaccagctctggacctgctcccggaactgaccaaccctgatgagctactgtcctacttgggcccacccgacctccctacgaacaacaatgacgacctgctttctctgtttgagaacaactgatcctgtgtttaccccaagcccggcggggacacgctcacagatgtcaccacagccctgcccttcatgcccagccccatgggacacccggtggtctttcccaaacctcccccaaaacacacctggagccagagccttctgccgccagccctgcccctgaattggaagcagccctgtgctcgatgggaggggctcccaggccggcagcccttgccacctccctctgccaagcctgctgctgcagaacggtttttgctgaggtgcccctgcccagccctgtccagccttgtccacacacacatctcacgcccctggtctcacagcctcacaccttgtccttccacccctgcctgcccccacccagcctgcttcttgtccagcattgatccttctgtttcaacaactcctccactgggcagagctgggcatctggcagggctggctctgtcccctgggcctttggctccagtggcccctgtgcccagcagtccagctcttggaacctcgctgaatggcagcctcttgggggcctggagctctggcagcccagccgtgtgtggtgtcaggttcctctccccaccccagcttcaagcagaggcctcggggtgggggagctacaaagcacaacaatgtacatagtgtagaaacactaacagctgggagaggggagccagctgtccagccagcatgttcctgttgtacagcccggtctccctgcgcgctctgctccttcccatgtgcagacagatcagggaggaacctccaatgggtgggggacagtgagcttcggcctggccgaggtgggtgggtgggctctcagattcagctctgtgtaaagattctctagcgggctgcgctcccaagttccccttctctgtgaaagtgaagaattagtacagctgtgttttttaaagccacctctctgtctccaccccatgggcccacacccaggtgggggaggaggaagccactgcatctgttggctcagggccccagcctgtgcgagcagggcgcctgggctgttgtgtctcctgtctgtgccgatctctattaaaggactccctcttggtgggcctggccgagtccctcctttgtgctcccagggactattttctcctcgtaagccagcgacctgcctaaagcttgggctgtgcctgcaaagcttgtgcaggacctgggggccaggtcgaccttcaagtggcttttggggccccaggttgagctctggatgtttcaagccaaggctcggctattcccgccccatagtaaatttccttttccctggaattttccaagttggcttcagctgaagagctgttttgtgaagcatcccaggcttgcccaggagagacatttgccactatgtcaccttatctgggcttgccctggggcactgagacagttgtttggcagccccagcccagccaggggctcatccttctcagctcttgtccctgggaggcctctgcttgtcacttcccagagattgcagaggtgtgtcctgcctaccatctgcctgtccagcttggtgggggtccgggtcaccatttcctccagtcctgggccccatccttgagggccttcccagccagccagcaggagaggcaagaactgggggaacacaggaacctaggggaggaggggagcgctgggcatcctcaggctggcggccaaggcctgcccctggaggcactagaggagggcatctgtctgtgggagcccagaggctgcagggaggaggaggagggaggtatctggtgtgagcgttgcccctgcgacatttgggaccacacaggtgggcttccttattccctgacaaagcctctgtttccagctcttccgccctctctggatgagggaacagaagtggaggaaacaaaagaagcagcagcacgcacagtcctgtcgctgggtgcggagacagcctggcaaagtcccactcagccatggcctgatgcaggccccaggccctcctttcttgggtgtcaaatgactgtgtcctggacatctgatgcaccacctgccctgcctgttgcaaacgtgatgctcccggatggagtggagaaactaggagactgggacaagcaaaaggctgcaaacaacccagaagcccatcctcagaagactggagaaatgattgaggaatgcatgggcaccgtggccctgtgctccatcacaaacacctctcagaaacaacgtgggatgaaaaagcaagacagttcatacagtatgatgccatttttataaagctcaaaacc

SEQ ID NO: 3766 - DNA, 2772 bp, Homo sapiens
atgaactccatgaaccccatgaaacctgccctgccccctgcgccacacggtgatggttcattcgcatatgagtctgtgccttggcaacaaagcgccactcagccggctggatcgctgtctgtggtcactactgtgtggggagttggcaacgcgacacagagccaggttttggggaaccccatgggccctgcagggagtccctctggcagctccatgatgcctggtgtggcagggggcagctccgccttgacctccccacagtgcctgggacagcaggcgtttgctgaaggcggcgccaacaagggctacgtgcagcaaggcgtgtacagccgcgggggctaccctggggcccccggcttcaccaccgggtatgcaggcggcccggggggcctgggcctcccctcacatgctgcaagaccctccactgacttcacgcaagcggcagctgctgcagctgtggctgctgcggcagccactgccaccgccacagccacagccaccgtggctgctctccaggagaagcagagccaggagctgagccagtatggagcgatgggggccggacagtcttttaacagccagtttctgcagcatggaggtccccgggggcctagtgtccccgctggcatgaaccctactggcataggaggggtaatgggcccctctggcctctcccccttggctatgaaccccacccgggcagcaggaatgacacccttgtatgcagggcagcgtctgccccaacatgggtatcctgggcctccccaggcccagccactgccccgacagggggtcaagagaacctactctgaggtgtatccagggcagcagtatctgcaaggaggccagtatgcacccagcaccgcccagtttgcgcccagccctgggcagccccctgccccctccccttcctaccctgggcacaggctgcccctgcagcagggcatgacccagtccctgtccgtgcctggccccacgggactgcattataagcccacagagcagttcaacgggcagggcgccagcttcaacgggggcagcgtcagctacagccaacctggcctgagtgggcctacccgttccatcccgggctatcccagttccccactgccagggaaccccacgccacccatgaccccaagcagcagcgtcccttacatgtcaccaaaccaagaggtcaagtctcccttcttgcctgatctcaagcccaacctcaactccttgcactcatcgccctctggaagcgggccttgtgacgagttgcggctgaccttccctgtgcgcgatggggtggtcctggagcccttccgcctgcagcacaacctggctgtaagcaaccatgtcttccagctgcgagactcagtctacaagaccctgataatgaggcctgacctggagctgcaattcaagtgctaccaccacgaggaccggcagatgaacaccaactggccagcctcggtgcaggtcagcgtcaatgccacgccgctcaccatcgagcgtggcgacaacaagacctcgcacaagccactctacctgaagcatgtgtgcgccaggccgcaacaccatccatcaccgtcaccgcctgctgctgcgtgcgtgtcctgctcccacctcttcgtgctgcagctagtgcaccgcccatccgtccgctcggtgctgcagggcctcctcaaaaagcgcctcctgcctgctgagcactgcatcaccaagataaagcggaacttcagcagcggcaccatccctggcacccctgggcccaacggagaggacggggtggagcagacagctatcaaggtgtccctgaagtgccccatcaccttccgcaggatccagctccctgcccgaggtcatgactgtcgccacatacagtgctttgacctggagtcgtacctgcagctcaactgtgagcgggggacttggaggtgtcctgtgtgcaacaagacagctttgctggagggcctggaggtggaccagtacatgctgggcatcctgatttacattcagaactctgactatgaggagatcaccatcgaccccacgtgcagctggaagccagtgcccgtgaagcctgacatgcacatcaaggaggagccggatgggccagcactgaagcgctgccgcaccgtgagccccgcccacgtgctcatgcccagcgtgatggagatgatcgccgccctgggccccggcgctgccccctttgcccccctgcagcccccctcagtccctgcccccagcgactaccctggccagggttccagcttcctggggcctggaactttccctgagtccttcccacccaccacgcccagcaccccaacccttgctgagttcaccccgggaccaccccccatctcctaccagtctgacattcccagcagcctcctgacttcagagaagtctaccgcctgcctcccaagccagatggcaccagcaggtcacctggaccccactcacaatcctgggacaccaggactacacacctccaaccttggggcccctccaggtccccagctgcaccattcaaaccctcccccagcgtcccggcagtccttgggccaagcgagcttaggacctacgggtgaactggccttcagtcctgccacaggcgtgatggggccccccagcatgtctggagccggggaggccccagaaccagctctggacctgctcccggaactgaccaaccctgatgagctactgtcctacttgggcccacccgacctccctacgaacaacaatgacgacctgctttctctgtttgagaacaactga

SEQ ID NO: 3767 - DNA, 5089 bp, Homo sapiens
gtcgggcagccagagcagctgagttccagataaaaactgtcagacccggcctgtaggctgctccattgccaatgaactccatgaaccccatgaaacctgccctgccccctgcgccacacggtgatggttcattcgcatatgagtctgtgccttggcaacaaagcgccactcagccggctggatcgctgtctgtggtcactactgtgtggggagttggcaacgcgacacagagccaggttttggggaaccccatgggccctgcagggagtccctctggcagctccatgatgcctggtgtggcagggggcagctccgccttgacctccccacagtgcctgggacagcaggcgtttgctgaaggcggcgccaacaagggctacgtgcagcaaggcgtgtacagccgcgggggctaccctggggcccccggcttcaccaccgggtatgcaggcggcccggggggcctgggcctcccctcacatgctgcaagaccctccactgacttcacgcaagcggcagctgctgcagctgtggctgctgcggcagccactgccaccgccacagccacagccaccgtggctgctctccaggagaagcagagccaggagctgagccagtatggagcgatgggggccggacagtcttttaacagccagtttctgcagcatggaggtccccgggggcctagtgtccccgctggcatgaaccctactggcataggaggggtaatgggcccctctggcctctcccccttggctatgaaccccacccgggcagcaggaatgacacccttgtatgcagggcagcgtctgccccaacatgggtatcctgggcctccccaggcccagccactgccccgacagggggtcaagagaacctactctgaggtgtatccagggcagcagtatctgcaaggaggccagtatgcacccagcaccgcccagtttgcgcccagccctgggcagccccctgccccctccccttcctaccctgggcacaggctgcccctgcagcagggcatgacccagtccctgtccgtgcctggccccacgggactgcattataagcccacagagcagttcaacgggcagggcgccagcttcaacgggggcagcgtcagctacagccaacctggcctgagtgggcctacccgttccatcccgggctatcccagttccccactgccagggaaccccacgccacccatgaccccaagcagcagcgtcccttacatgtcaccaaaccaagaggtcaagtctcccttcttgcctgatctcaagcccaacctcaactccttgcactcatcgccctctggaagcgggccttgtgacgagttgcggctgaccttccctgtgcgcgatggggtggtcctggagcccttccgcctgcagcacaacctggctgtaagcaaccatgtcttccagctgcgagactcagtctacaagaccctgataatgaggcctgacctggagctgcaattcaagtgctaccaccacgaggaccggcagatgaacaccaactggccagcctcggtgcaggtcagcgtcaatgccacgccgctcaccatcgagcgtggcgacaacaagacctcgcacaagccactctacctgaagcatgtgtgccagccaggccgcaacaccatccagatcaccgtcaccgcctgctgctgctcccacctcttcgtgctgcagctagtgcaccgcccatccgtccgctcggtgctgcagggcctcctcaaaaagcgcctcctgcctgctgagcactgcatcaccaagataaagcggaacttcagcagcggcaccatccctggcacccctgggcccaacggagaggacggggtggagcagacagctatcaaggtgtccctgaagtgccccatcaccttccgcaggatccagctccctgcccgaggtcatgactgtcgccacatacagtgctttgacctggagtcgtacctgcagctcaactgtgagcgggggacttggaggtgtcctgtgtgcaacaagacagctttgctggagggcctggaggtggaccagtacatgctgggcatcctgatttacattcagaactctgactatgaggagatcaccatcgaccccacgtgcagctggaagccagtgcccgtgaagcctgacatgcacatcaaggaggagccggatgggccagcactgaagcgctgccgcaccgtgagccccgcccacgtgctcatgcccagcgtgatggagatgatcgccgccctgggccccggcgctgccccctttgcccccctgcagcccccctcagtccctgcccccagcgactaccctggccagggttccagcttcctggggcctggaactttccctgagtccttcccacccaccacgcccagcaccccaacccttgctgagttcaccccgggaccaccccccatctcctaccagtctgacattcccagcagcctcctgacttcagagaagtctaccgcctgcctcccaagccagatggcaccagcaggtcacctggaccccactcacaatcctgggacaccaggactacacacctccaaccttggggcccctccaggtccccagctgcaccattcaaaccctcccccagcgtcccggcagtccttgggccaagcgagcttaggacctacgggtgaactggccttcagtcctgccacaggcgtgatggggccccccagcatgtctggagccggggaggccccagaaccagctctggacctgctcccggaactgaccaaccctgatgagctactgtcctacttgggcccacccgacctccctacgaacaacaatgacgacctgctttctctgtttgagaacaactgatcctgtgtttaccccaagcccggcggggacacgctcacagatgtcaccacagccctgcccttcatgcccagccccatgggacacccggtggtctttcccaaacctcccccaaaacacacctggagccagagccttctgccgccagccctgcccctgaattggaagcagccctgtgctcgatgggaggggctcccaggccggcagcccttgccacctccctctgccaagcctgctgctgcagaacggtttttgctgaggtgcccctgcccagccctgtccagccttgtccacacacacatctcacgcccctggtctcacagcctcacaccttgtccttccacccctgcctgcccccacccagcctgcttcttgtccagcattgatccttctgtttcaacaactcctccactgggcagagctgggcatctggcagggctggctctgtcccctgggcctttggctccagtggcccctgtgcccagcagtccagctcttggaacctcgctgaatggcagcctcttgggggcctggagctctggcagcccagccgtgtgtggtgtcaggttcctctccccaccccagcttcaagcagaggcctcggggtgggggagctacaaagcacaacaatgtacatagtgtagaaacactaacagctgggagaggggagccagctgtccagccagcatgttcctgttgtacagcccggtctccctgcgcgctctgctccttcccatgtgcagacagatcagggaggaacctccaatgggtgggggacagtgagcttcggcctggccgaggtgggtgggtgggctctcagattcagctctgtgtaaagattctctagcgggctgcgctcccaagttccccttctctgtgaaagtgaagaattagtacagctgtgttttttaaagccacctctctgtctccaccccatgggcccacacccaggtgggggaggaggaagccactgcatctgttggctcagggccccagcctgtgcgagcagggcgcctgggctgttgtgtctcctgtctgtgccgatctctattaaaggactccctcttggtgggcctggccgagtccctcctttgtgctcccagggactattttctcctcgtaagccagcgacctgcctaaagcttgggctgtgcctgcaaagcttgtgcaggacctgggggccaggtcgaccttcaagtggcttttggggccccaggttgagctctggatgtttcaagccaaggctcggctattcccgccccatagtaaatttccttttccctggaattttccaagttggcttcagctgaagagctgttttgtgaagcatcccaggcttgcccaggagagacatttgccactatgtcaccttatctgggcttgccctggggcactgagacagttgtttggcagccccagcccagccaggggctcatccttctcagctcttgtccctgggaggcctctgcttgtcacttcccagagattgcagaggtgtgtcctgcctaccatctgcctgtccagcttggtgggggtccgggtcaccatttcctccagtcctgggccccatccttgagggccttcccagccagccagcaggagaggcaagaactgggggaacacaggaacctaggggaggaggggagcgctgggcatcctcaggctggcggccaaggcctgcccctggaggcactagaggagggcatctgtctgtgggagcccagaggctgcagggaggaggaggagggaggtatctggtgtgagcgttgcccctgcgacatttgggaccacacaggtgggcttccttattccctgacaaagcctctgtttccagctcttccgccctctctggatgagggaacagaagtggaggaaacaaaagaagcagcagcacgcacagtcctgtcgctgggtgcggagacagcctggcaaagtcccactcagccatggcctgatgcaggccccaggccctcctttcttgggtgtcaaatgactgtgtcctggacatctgatgcaccacctgccctgcctgttgcaaacgtgatgctcccggatggagtggagaaactaggagactgggacaagcaaaaggctgcaaacaacccagaagcccatcctcagaagactggagaaatgattgaggaatgcatgggcaccgtggccctgtgctccatcacaaacacctctcagaaacaacgtgggatgaaaaagcaagacagttcatacagtatgatgccatttttataaagctcaaaacc

SEQ ID NO: 3768 - DNA, 747 bp, Homo sapiens
cgggcggcggcgcgatggcgcgggtggcggcggccccggggcggcgggcggcgcggagggcgggctgagcgcatggagcggcgcgggccgggggccgccacggcgaggggccgggccaggccgggcggagatttcacagggacacacacggaacatgtgacttggtctgagaccgtggtgattacggataggatggacacagactcaccaccaagttctggcaagctagaaccagagggcatcccttgatgcttagtgtggaaacaggagaagtgaaggaatcttaacttccagaggggcacagggtcaaggataccagacctggagactggaagtcttttcagagagactgtcctcagagaggagaccagaggcatgagttcgggtcggcaggaaatccccctgtgcagtgaagaccagagcagctgagttccagataaaaactgtcagacccggcctgtaggctgctccattgccaatgaactccatgaaccccatgaaacctgccctgccccctgcgccacacggtgatggttcattcgcatatgagtctgtgccttggcaacaaagcgccactcagccggctggatcgctgtctgtggtcactactgtgtggggagttggcaacgcgacacagagccaggttttggggaaccccatgggccctgcagggagtccctctggcagctccatgatgcctggtgtggcagggggcagctccgccttgacctccccacagtgcctggg

SEQ ID NO: 3769 - DNA, 4175 bp, Homo sapiens
gggcggggtcggcggggccgtttcgcttcgaagattgtttcagaagcgttgggcggggcgtccctgagagaaattagaatctggaaactgttcttcaggaagaaacccattagtttggaactggagaattcctttgcatcagatactaaaatgaaagaaccacttttaggtggtgagtgtgacaaggcagtggcatcacagctggggctgctagatgaaattaagacagaacccgacaatgctcaagagtattgtcataggcaacagtccagaactcaggagaatgaactgaaaataaatgctgtgttttcagagagtgcttcacagttgactgcaggcattcagctttctctggcatcatctggcgtgaataaaatgcttccttcagtttcaaccacagctattcaggtttcctgtgctggttgtaaaaaaattctccagaaggggcaaactgcttatcagaggaaaggatctgctcaacttttctgctccataccatgcatcactgaatacatttcatctgccagttcaccagttccttctaagagaacttgttcaaactgctcaaaagacattttaaatccaaaggatgtgattagtgtccagctggaagacactacctcttgcaaaactttttgcagcctatcttgtctttcatcatatgaagaaaaaagaaaaccatttgttaccatatgtactaatagcattttgaccaagtgcagcatgtgccagaagactgctattattcagtatgaagtaaaataccaaaatgtgaaacataatctttgcagtaatgcctgcctttcaaagtttcactctgctaacaacttcatcatgaactgctgtgagaactgtggcacttactgttacaccagctctagtctgtcccacatacttcagatggaaggacagtctcattactttaatagttcaaagagtattacagcatataagcagaaacctgccaaaccacttatatctgttccttgcaaaccattgaagccctcagatgaaatgattgagactacgagtgatttggggaagacagagcttttctgctctattaattgtttctctgcatacagtaaagctaagatggaatcttcttcagtaagtgttgtttctgtggtgcatgatacttcaacagagcttctttctccaaagaaagatacgactccagttataagcaatatagtgtcattggcagacaccgatgttgccttgcccatcatgaacactgatgtcttacaagatacagtttcttcagtaacagcaacagcagatgtcattgtggatctttctaagagttcacctagtgaacccagtaatgctgttgctagtagtagtacggaacagccaagcgtttcaccatcttcatcagtattcagtcagcatgcaattggttccagtacagaagtacaaaaagacaatatgaaatctatgaaaataagtgatgaactatgtcacccaaaatgtacatccaaagtacaaaaagttaaaggtaaatcacgaagtattaaaaaatcttgttgtgcagattttgagtgtttggaaaacagtaaaaaagatgtggcattctgttattcatgccagttgttctgccaaaaatattttagctgtggaagagagtcatttgcaacccacggaacttctaattggaaaaaaaccctggaaaaattcagaaagcatgaaaaaagtgaaatgcatttgaagtcattggaattttggagagaataccaattttgtgatggagctgtcagtgacgatttatctattcattcgaaacagattgagggaaataaaaagtacctaaagcttataattgaaaatattttatttcttggaaagcagtgtttacccttaagaggaaacgaccagtcagtttcatctgtgaataaaggcaattttttagaattgttagaaatgagagcaaaagataaaggagaagaaacatttcgacttatgaattcacaagttgacttctataacagtacacaaattcaaagtgatattatcgaaataataaagactgaaatgttgcaggatattgtgaatgagatcaatgactcctcagcattttcaatcatatgtgatgagacaatcaatagtgccatgaaagaacagctttcaatttgtgtaagatacccacaaaaatcatcaaaggctatcttaattaaggaaagattcttgggttttgttgatactgaggagatgactgggacccacttacataggactatcaaaacttatctgcagcaaattggagttgatatggataaaatacatggccaggcctatgatagcaccactaatttgaagataaaatttaataaaatagcagcagaattcaagaaagaagaaccaagagctttatacatacattgttatgcacactttttggatttatcaataattaggttttgtaaagaagtaaaagaactccgaagtgctctaaaaactctcagttctttgttcaacactatttgtatgtctggggaaatgttggcaaattttcgaaacatttataggctaagtcaaaacaaaacatgcaagaaacatatatcacaatcatgttggacagtccatgatcgtacattactatctgtgattgacagtcttccagagattattgaaacattggaagttatagcaagccattcttcaaatacaagtttcgccgatgaattgagtcatttgctgacattggtttccaaatttgaatttgtcttttgtttgaaattcctgtatcgagtgctgagtgttacaggaattctttccaaagagcttcaaaataaaaccatagacattttttctttgtcttcaaaaatagaagcaattttggaatgtttatcatctgaaagaaatgacgtatactttaaaacaatctgggatggaacagaggaaatatgtcaaaaaataacctgtaaaggttttaaagttgaaaaaccttctcttcagaaaagaagaaaaattcagaaatcagtagatcttggcaattcagataatatgttttttcctacttcaacagaagaacaatataaaattaatatctattaccaaggattagatactatattacaaaatttaaagttatgtttttcggagtttgattattgcaaaataaagcaaatttcagaactgttatttaaatggaatgaaccattaaatgaaacaacagcaaaacatgttcaggaattttataaacttgatgaggacattatcccagaacttagattttatcgacattatgcaaagcttaactttgtcatagatgatagttgcataaacttcgtcagtctcggctgtttgtttattcagcatggtcttcacagtaatattccttgtctctcaaagctattatatattgctttgtcttggccaattacttcagcaagtactgagaactcattttctaccctgcctcgtcttaagacatatttatgtaataccatgggacaagagaagcttactggcccagccctaatggctgttgagcaggagttggtaaataaactaatggagcctgaaagactcaatgaaattgtggaaaagtttatcagtcagatgaaagaaatataatacatgctcatttgaacttacctaaaagacttgtatttccattgggatgttttcatttcaaaattgttcaaaattcaaaagacacagaacgataaacagtgaagtctccttccctcctttagaactcattttctcttcccaaaaagtgttatcttttccttaaatatccctctagaggtatttttcctaagtggtattgtacggtgtatactgttcttcagcttgtcttctctgtgtaacatatttttgagattgtcccatgtcgttacatgaagagtttcttgattcttggtctataattgcagatgttattgtatgaatgtaccataatatatttgagcagtccctgctgacatttttttcctaaccttttgctattataaataatgattcattttataaccttttatataggtcacattgcacatgagtgagtttactgtaagctggaaatctaaagttagaattactaggttaagatatgtgcatttttacttttgatagatattggcaagttgccatctataaggattgtgccagtttacagtcccacccacaatgcatgagagtgcctattaaatctttgtaagtgttat

SEQ ID NO: 3770 - DNA, 3980 bp, Homo sapiens
gcttcgaagattgtttcagaagcgttgggcggggcgtccctgagagaaattagagtattgtcataggcaacagtccagaactcaggagaatgaactgaaaataaatgctgtgttttcagagagtgcttcacagttgactgcaggcattcagctttctctggcatcatctggcgtgaataaaatgcttccttcagtttcaaccacagctattcaggtttcctgtgctggttgtaaaaaaattctccagaaggggcaaactgcttatcagaggaaaggatctgctcaacttttctgctccataccatgcatcactgaatacatttcatctgccagttcaccagttccttctaagagaacttgttcaaactgctcaaaagacattttaaatccaaaggatgtgattagtgtccagctggaagacactacctcttgcaaaactttttgcagcctatcttgtctttcatcatatgaagaaaaaagaaaaccatttgttaccatatgtactaatagcattttgaccaagtgcagcatgtgccagaagactgctattattcagtatgaagtaaaataccaaaatgtgaaacataatctttgcagtaatgcctgcctttcaaagtttcactctgctaacaacttcatcatgaactgctgtgagaactgtggcacttactgttacaccagctctagtctgtcccacatacttcagatggaaggacagtctcattactttaatagttcaaagagtattacagcatataagcagaaacctgccaaaccacttatatctgttccttgcaaaccattgaagccctcagatgaaatgattgagactacgagtgatttggggaagacagagcttttctgctctattaattgtttctctgcatacagtaaagctaagatggaatcttcttcagtaagtgttgtttctgtggtgcatgatacttcaacagagcttctttctccaaagaaagatacgactccagttataagcaatatagtgtcattggcagacaccgatgttgccttgcccatcatgaacactgatgtcttacaagatacagtttcttcagtaacagcaacagcagatgtcattgtggatctttctaagagttcacctagtgaacccagtaatgctgttgctagtagtagtacggaacagccaagcgtttcaccatcttcatcagtattcagtcagcatgcaattggttccagtacagaagtacaaaaagacaatatgaaatctatgaaaataagtgatgaactatgtcacccaaaatgtacatccaaagtacaaaaagttaaaggtaaatcacgaagtattaaaaaatcttgttgtgcagattttgagtgtttggaaaacagtaaaaaagatgtggcattctgttattcatgccagttgttctgccaaaaatattttagctgtggaagagagtcatttgcaacccacggaacttctaattggaaaaaaaccctggaaaaattcagaaagcatgaaaaaagtgaaatgcatttgaagtcattggaattttggagagaataccaattttgtgatggagctgtcagtgacgatttatctattcattcgaaacagattgagggaaataaaaagtacctaaagcttataattgaaaatattttatttcttggaaagcagtgtttacccttaagaggaaacgaccagtcagtttcatctgtgaataaaggcaattttttagaattgttagaaatgagagcaaaagataaaggagaagaaacatttcgacttatgaattcacaagttgacttctataacagtacacaaattcaaagtgatattatcgaaataataaagactgaaatgttgcaggatattgtgaatgagatcaatgactcctcagcattttcaatcatatgtgatgagacaatcaatagtgccatgaaagaacagctttcaatttgtgtaagatacccacaaaaatcatcaaaggctatcttaattaaggaaagattcttgggttttgttgatactgaggagatgactgggacccacttacataggactatcaaaacttatctgcagcaaattggagttgatatggataaaatacatggccaggcctatgatagcaccactaatttgaagataaaatttaataaaatagcagcagaattcaagaaagaagaaccaagagctttatacatacattgttatgcacactttttggatttatcaataattaggttttgtaaagaagtaaaagaactccgaagtgctctaaaaactctcagttctttgttcaacactatttgtatgtctggggaaatgttggcaaattttcgaaacatttataggctaagtcaaaacaaaacatgcaagaaacatatatcacaatcatgttggacagtccatgatcgtacattactatctgtgattgacagtcttccagagattattgaaacattggaagttatagcaagccattcttcaaatacaagtttcgccgatgaattgagtcatttgctgacattggtttccaaatttgaatttgtcttttgtttgaaattcctgtatcgagtgctgagtgttacaggaattctttccaaagagcttcaaaataaaaccatagacattttttctttgtcttcaaaaatagaagcaattttggaatgtttatcatctgaaagaaatgacgtatactttaaaacaatctgggatggaacagaggaaatatgtcaaaaaataacctgtaaaggttttaaagttgaaaaaccttctcttcagaaaagaagaaaaattcagaaatcagtagatcttggcaattcagataatatgttttttcctacttcaacagaagaacaatataaaattaatatctattaccaaggattagatactatattacaaaatttaaagttatgtttttcggagtttgattattgcaaaataaagcaaatttcagaactgttatttaaatggaatgaaccattaaatgaaacaacagcaaaacatgttcaggaattttataaacttgatgaggacattatcccagaacttagattttatcgacattatgcaaagcttaactttgtcatagatgatagttgcataaacttcgtcagtctcggctgtttgtttattcagcatggtcttcacagtaatattccttgtctctcaaagctattatatattgctttgtcttggccaattacttcagcaagtactgagaactcattttctaccctgcctcgtcttaagacatatttatgtaataccatgggacaagagaagcttactggcccagccctaatggctgttgagcaggagttggtaaataaactaatggagcctgaaagactcaatgaaattgtggaaaagtttatcagtcagatgaaagaaatataatacatgctcatttgaacttacctaaaagacttgtatttccattgggatgttttcatttcaaaattgttcaaaattcaaaagacacagaacgataaacagtgaagtctccttccctcctttagaactcattttctcttcccaaaaagtgttatcttttccttaaatatccctctagaggtatttttcctaagtggtattgtacggtgtatactgttcttcagcttgtcttctctgtgtaacatatttttgagattgtcccatgtcgttacatgaagagtttcttgattcttggtctataattgcagatgttattgtatgaatgtaccataatatatttgagcagtccctgctgacatttttttcctaaccttttgctattataaataatgattcattttataaccttttatataggtcacattgcacatgagtgagtttactgtaagctggaaatctaaagttagaattactaggttaagatatgtgcatttttacttttgatagatattggcaagttgccatctataaggattgtgccagtttacagtcccacccacaatgcatgagagtgcctattaaatctttgtaagtgtta

SEQ ID NO: 3771 - DNA, 4203 bp, Homo sapiens
gcttcgaagattgtttcagaagcgttgggcggggcgtccctgagagaaattagttcaagcgattctcgtgcctcagcctcccgagtagctgggattacaggaatctggaaactgttcttcaggaagaaacccattagtttggaactggagaattcctttgcatcagatactaaaatgaaagaaccacttttaggtggtgagtgtgacaaggcagtggcatcacagctggggctgctagatgaaattaagacagaacccgacaatgctcaagagtattgtcataggcaacagtccagaactcaggagaatgaactgaaaataaatgctgtgttttcagagagtgcttcacagttgactgcaggcattcagctttctctggcatcatctggcgtgaataaaatgcttccttcagtttcaaccacagctattcaggtttcctgtgctggttgtaaaaaaattctccagaaggggcaaactgcttatcagaggaaaggatctgctcaacttttctgctccataccatgcatcactgaatacatttcatctgccagttcaccagttccttctaagagaacttgttcaaactgctcaaaagacattttaaatccaaaggatgtgattagtgtccagctggaagacactacctcttgcaaaactttttgcagcctatcttgtctttcatcatatgaagaaaaaagaaaaccatttgttaccatatgtactaatagcattttgaccaagtgcagcatgtgccagaagactgctattattcagtatgaagtaaaataccaaaatgtgaaacataatctttgcagtaatgcctgcctttcaaagtttcactctgctaacaacttcatcatgaactgctgtgagaactgtggcacttactgttacaccagctctagtctgtcccacatacttcagatggaaggacagtctcattactttaatagttcaaagagtattacagcatataagcagaaacctgccaaaccacttatatctgttccttgcaaaccattgaagccctcagatgaaatgattgagactacgagtgatttggggaagacagagcttttctgctctattaattgtttctctgcatacagtaaagctaagatggaatcttcttcagtaagtgttgtttctgtggtgcatgatacttcaacagagcttctttctccaaagaaagatacgactccagttataagcaatatagtgtcattggcagacaccgatgttgccttgcccatcatgaacactgatgtcttacaagatacagtttcttcagtaacagcaacagcagatgtcattgtggatctttctaagagttcacctagtgaacccagtaatgctgttgctagtagtagtacggaacagccaagcgtttcaccatcttcatcagtattcagtcagcatgcaattggttccagtacagaagtacaaaaagacaatatgaaatctatgaaaataagtgatgaactatgtcacccaaaatgtacatccaaagtacaaaaagttaaaggtaaatcacgaagtattaaaaaatcttgttgtgcagattttgagtgtttggaaaacagtaaaaaagatgtggcattctgttattcatgccagttgttctgccaaaaatattttagctgtggaagagagtcatttgcaacccacggaacttctaattggaaaaaaaccctggaaaaattcagaaagcatgaaaaaagtgaaatgcatttgaagtcattggaattttggagagaataccaattttgtgatggagctgtcagtgacgatttatctattcattcgaaacagattgagggaaataaaaagtacctaaagcttataattgaaaatattttatttcttggaaagcagtgtttacccttaagaggaaacgaccagtcagtttcatctgtgaataaaggcaattttttagaattgttagaaatgagagcaaaagataaaggagaagaaacatttcgacttatgaattcacaagttgacttctataacagtacacaaattcaaagtgatattatcgaaataataaagactgaaatgttgcaggatattgtgaatgagatcaatgactcctcagcattttcaatcatatgtgatgagacaatcaatagtgccatgaaagaacagctttcaatttgtgtaagatacccacaaaaatcatcaaaggctatcttaattaaggaaagattcttgggttttgttgatactgaggagatgactgggacccacttacataggactatcaaaacttatctgcagcaaattggagttgatatggataaaatacatggccaggcctatgatagcaccactaatttgaagataaaatttaataaaatagcagcagaattcaagaaagaagaaccaagagctttatacatacattgttatgcacactttttggatttatcaataattaggttttgtaaagaagtaaaagaactccgaagtgctctaaaaactctcagttctttgttcaacactatttgtatgtctggggaaatgttggcaaattttcgaaacatttataggctaagtcaaaacaaaacatgcaagaaacatatatcacaatcatgttggacagtccatgatcgtacattactatctgtgattgacagtcttccagagattattgaaacattggaagttatagcaagccattcttcaaatacaagtttcgccgatgaattgagtcatttgctgacattggtttccaaatttgaatttgtcttttgtttgaaattcctgtatcgagtgctgagtgttacaggaattctttccaaagagcttcaaaataaaaccatagacattttttctttgtcttcaaaaatagaagcaattttggaatgtttatcatctgaaagaaatgacgtatactttaaaacaatctgggatggaacagaggaaatatgtcaaaaaataacctgtaaaggttttaaagttgaaaaaccttctcttcagaaaagaagaaaaattcagaaatcagtagatcttggcaattcagataatatgttttttcctacttcaacagaagaacaatataaaattaatatctattaccaaggattagatactatattacaaaatttaaagttatgtttttcggagtttgattattgcaaaataaagcaaatttcagaactgttatttaaatggaatgaaccattaaatgaaacaacagcaaaacatgttcaggaattttataaacttgatgaggacattatcccagaacttagattttatcgacattatgcaaagcttaactttgtcatagatgatagttgcataaacttcgtcagtctcggctgtttgtttattcagcatggtcttcacagtaatattccttgtctctcaaagctattatatattgctttgtcttggccaattacttcagcaagtactgagaactcattttctaccctgcctcgtcttaagacatatttatgtaataccatgggacaagagaagcttactggcccagccctaatggctgttgagcaggagttggtaaataaactaatggagcctgaaagactcaatgaaattgtggaaaagtttatcagtcagatgaaagaaatataatacatgctcatttgaacttacctaaaagacttgtatttccattgggatgttttcatttcaaaattgttcaaaattcaaaagacacagaacgataaacagtgaagtctccttccctcctttagaactcattttctcttcccaaaaagtgttatcttttccttaaatatccctctagaggtatttttcctaagtggtattgtacggtgtatactgttcttcagcttgtcttctctgtgtaacatatttttgagattgtcccatgtcgttacatgaagagtttcttgattcttggtctataattgcagatgttattgtatgaatgtaccataatatatttgagcagtccctgctgacatttttttcctaaccttttgctattataaataatgattcattttataaccttttatataggtcacattgcacatgagtgagtttactgtaagctggaaatctaaagttagaattactaggttaagatatgtgcatttttacttttgatagatattggcaagttgccatctataaggattgtgccagtttacagtcccacccacaatgcatgagagtgcctattaaatctttgtaagtgttatcaaa

SEQ ID NO: 3772 - DNA, 1825 bp, Homo sapiens
agcattcttataggagtctccagcctctctttgcagttttcaagacaggaagttgacttcttccttgcagctccttccacagtgaacaacttggctgtcagagaggttctgattacaaaacccagtccagccacaaaaagcttctgcagaagcctgcctaatgtttacaaacctacgatgcagccactacaattatccccatttcaaggtcgaagaaatggagatttatagaagttgtcaaatcgcttactagcacacagctaataagtagtaaagccatctctcaaatccaggaaatctaactgccctgcctgagctctgagtcaagggtcctactttggctgccagccagcgacgacttcaagggaatctggaaactgttcttcaggaagaaacccattagtttggaactggagaattcctttgcatcagatactaaaatgaaagaaccacttttaggtggtgagtgtgacaaggcagtggcatcacagctggggctgctagatgaaattaagacagaacccgacaatgctcaagagtattgtcataggcaacagtccagaactcaggagaatgaactgaaaataaatgctgtgttttcagagagtgcttcacagttgactgcaggcattcagctttctctggcatcatctggcgtgaataaaatgcttccttcagtttcaaccacagctattcaggtttcctgtgctggttgtaaaaaaattctccagaaggggcaaactgcttatcagaggaaaggatctgctcaacttttctgctccataccatgcatcactgaatacatttcatctgccagttcaccagttccttctaagagaacttgttcaaactgctcaaaagacattttaaatccaaaggatgtgattagtgtccagctggaagacactacctcttgcaaaactttttgcagcctatcttgtctttcatcatatgaagaaaaaagaaaaccatttgttaccatatgtactaatagcattttgaccaagtgcagcatgtgccagaagactgctattattcagtatgaagtaaaataccaaaatgtgaaacataatctttgcagtaatgcctgcctttcaaagtttcactctgctaacaacttcatcatgaactgctgtgagaactgtggcacttactgttacaccagctctagtctgtcccacatacttcagatggaaggacagtctcattactttaatagttcaaagagtattacagcatataagcagaaacctgccaaaccacttatatctgttccttgcaaaccattgaagccctcagatgaaatgattgagactacgagtgatttggggaagacagagcttttctgctctattaattgtttctctgcatacagtaaagctaagatggaatcttcttcagtaagtgttgtttctgtggtgcatgatacttcaacagagcttctttctccaaagaaagatacgactccagttataagcaatatagtgtcattggcagacaccgatgttgccttgcccatcatgaacactgatgtcttacaagatacagtttcttcagtaacagcaacagcagatgtcattgtggatctttctaagagttcacctagtgaacccagtaatgctgttgctagtagtagtacggaacagccaagcgtttcaccatcttcatcagtattcagtcagcatgcaattggttccagtacagaagtacaaaaagacaatatgaaatctatgaaaataagtgatgaactatgtcacccaaaatgtacatccaaagtacaaaaagttaaaggtaaatcacgaagtattaaaaaatcttgttgtgc

SEQ ID NO: 3773 - DNA, 3268 bp, Homo sapiens
cgcgaaaagccgggactggacctcgcggagttgtgcttgtcgccgaagcggggtgggcttgttcgttccgcgcagccgcagccagaaccgggtgacgcttatccccgctgtctttccagtccagggccgctgagagtgggggtggctgggagcagcgcagcctccggaggaggaggcggaggccgaggaccaggaatcaccttcaagcctatgtcgtgaggctttggcagaaattaagaaggaaatatctccattgttcattggcatggaaaaatgttcagtgggaggattagagttgactgaacagactcctgctttattagggaatatggccatggcaactagtctcatggacataggggattcatttggtcatccagcttgtcctttagtcagtagatctaggaactcaccagtggaagatgatgatgatgatgatgatgttgtgtttattgaatctatacaacctccttcaatttctgctccagcaatagctgatcaaagaaacttcatatttgcatcatcaaaaaatgaaaagcctcaaggaaattattctgtaattcctccttcttcaagagatttggcatctcagaaaggaaatataagtgagacaattgttattgatgatgaagaggacatagaaacaaatggaggagcagagaaaaagtcttcctgttttatcgaatggggacttcctggaactaaaaacaaaaccaacgatttggatttctccacttccagtctttcaagaagtaagaccaagactggagtaagaccttttaaccctggtagaatgaatgtggcaggagacttatttcagaatggagaatttgcaactcatcatagtcctgattcttggatctcccagtcagcttcatttcccagtaatcagaaacagccaggggtggattctttatcaccagtggccttacttcgtaagcagaatttccagcctacagcccaacaacaacttactaaaccagctaaaatcacttgtgcaaattgcaaaaagcctttacagaagggacagacagcttatcaacgaaaaggatcagctcacctcttttgctctaccacctgcctttcttccttctctcataaacgtactcaaaacacacgaagcataatatgtaaaaaagatgcatctacaaagaaggctaatgtcattcttccagtagaatcaagcaaatccttccaagaattttatagtacatcttgtttgtctccctgtgaaaacaactggaatcttaaaaaaggagtttttaataagtcaagatgtacaatttgtagtaaattagcagagattcgccatgaagtcagcgtaaataatgtaacacataaactgtgcagtaaccattgctttaataagtacagattggccaatggtctaataatgaactgctgtgaacactgtggagagtacatgcctagtaagagtactggaaacaacatcctggtgattggaggtcagcagaagagattttgctgccaaagttgtattaacgaatataaacagatgatggaaacaaaatcaaaaaaattaacagcatcagaaaatagaaaaaggaatgcttttagagaagaaaatgagaaacaattatatggatcgtcaaatacacttttgaaaaaaatagagggaatcccagaaaaaaaggaaaagacttcacagctacagctttcagtagaatgtggcacggatacattactgatccaagagaatgtgaatttacctccttcttccacgtcaaccatagctgatacatttcaagagcaactggaagagaaaaattttgaagactccattgtaccagttgtgctttccgcagatccaggtacgtggccccgaattttgaatattaaacaacgggacactcttgttgaaaatgttccgcctcaagtaagaaattttaactttccaaaagataatacagggaggaagttttcagaaacttattatacacggattcttccaaatggtgaaaaaaccactagatcctggttactttattcaacctcaaaagattctgtgttttgtctatattgcaaactctttggggaaggaaaaaatcaactgaaaaatgaaaatgggtgcaaagattggcaacatttatcacatattcttagtaaacatgaagaaagtgaaatgcacgtcaacaatagtgttaagtactcaaaattaaaatctgatctgaaaaaaaataaagctattgatgctgcagaacacagattatatgaaaatgagaaaaatgatggtgtgctgttgttgtacacgtaatatacctgagttgttttttggcatgatgatcagaatcttacattactcagaaaacatctgtcctgcaatagtcagtactattgtgttgtaagtctcctctacagagtaacttgcagcagttccttagcaataagtatgatagcaaataaatagcaaagaatgtttccattctaaatctaaaactaattagattcaatcatcattaggcaatgacttcattaggcaatgaagattaacaataggtaattgttaatcttcaaaatctatcaatttacacctatttaaaaattggcatttaatgactgccatttgatgggtttggttaatattctgttcttggccgggcgcaatggctcacgcctgtaatccaagaactttgggaggctcaggcgggtagatcaattgaggtcagaagttcaagaccagcctggccaacgtggcaaaacctcgtctttactaaaaatacaaaaattagccaggtgtggtggcacacacctgtagtcccagctactcaggaggctgaggcaggagaatcgcttgaacccaggaggcagaggttgcagtgagctgagattgcaccactgcagtccagcctgagcaacagagcgagagtcagtctcaaaagaaagaaaaatattatgttctaattaccttgaaagaggaaagaaaggcttgaattgatcaataccagtttgaataagatacttatgtgaacaagcattctcaacattattattaaagtaaaactactcagtttacagaatgggatctgaaactacagctttttgctattaaaccaaatacttgtgatctactttgtttgagcaaaacagcattatttgttatgttaatgatggttaatttccattttattggttttatgtttattttaatttgtaaatgttttagcatttattattgtatgtgaactatatttacctattttatgttgataaaaatataaaaaatattaaaataagtatatattaagtt

SEQ ID NO: 3774 - DNA, 1382 bp, Homo sapiens
tttccagtccagggccgctgagagtgggggtggctgggagcagcgcagcctccggaggaggaggcggaggccgaggaccaggaatcaccttcaagcctatgtcgtgaggctttggcagaaattaagaaggaaatatctccattgttcattggcatggaaaaatgttcagtgggaggattagagttgactgaacagactcctgctttattagggaatatggccatggcaactagtctcatggacataggggattcatttggtcatccagcttgtcctttagtcagtagatctaggaactcaccagtggaagatgatgatgatgatgatgatgttgtgtttattgaatctatacaacctccttcaatttctgctccagcaatagctgatcaaagaaacttcatatttgcatcatcaaaaaatgaaaagcctcaaggaaattattctgtaattcctccttcttcaagagatttggcatctcagaaaggaaatataagtgagacaattgttattgatgatgaagaggacatagaaacaaatggaggagcagagaaaaagtcttcctgttttatcgaatggggacttcctggaactaaaaacaaaaccaacgatttggatttctccacttccagtctttcaagaagtaagaccaagactggagtaagaccttttaaccctggtagaatgaatgtggcaggagacttatttcagaatggagaatttgcaactcatcatagtcctgattcttggatctcccagtcagcttcatttcccagtaatcagaaacagccaggggtggattctttatcaccagtggccttacttcgtaagcagaatttccagcctacagcccaacaacaacttactaaaccagctaaaatcacttgtgcaaattgcaaaaagcctttacagaagggacagacagcttatcaacgaaaaggatcagctcacctcttttgctctaccacctgcctttcttccttctctcataaacgtactcaaaacacacgaagcataatatgtaaaaaagatgcatctacaaagaaggctaatgtcattcttccagtagaatcaagcaaatccttccaagaattttatagtacatcttgtttgtctccctgtgaaaacaactggaatcttaaaaaaggagtttttaataagtcaagatgtacaatttgtagtaaattagcagaggtctggatttttatacctaagttgttgtttaggctaacagtgataattttaacttttaagtgctattatgtactctttcatctacataatgcacgtgttctggatgtataacatgaagctgaaaggaagaataaggatatgttagaactatcttatgggatattttataaataaaattccatttgcatagc

SEQ ID NO: 3775 - DNA, 1092 bp, Homo sapiens
gctgagagtgggggtggctgggagcagcgcagcctccggaggaggaggcggaggccgaggaccaggaatcaccttcaagcctatgtcgtgaggctttggcagaaattaagaaggaaatatctccattgttcattggcatggaaaaatgttcagtgggaggattagagttgactgaacagactcctgctttattagggaatatggccatggcaactagtctcatggacataggggattcatttggtcatccagcttgtcctttagtcagtagatctaggaactcaccagtggaagatgatgatgatgatgatgatgttgtgtttattgaatctatacaacctccttcaatttctgctccagcaatagctgatcaaagaaacttcatatttgcatcatcaaaaaatgaaaagcctcaaggaaattattctgtaattcctccttcttcaagagatttggcatctcagaaaggaaatataagtgagacaattgttattgatgatgaagaggacatagaaacaaatggaggagcagagaaaaagtcttcctgttttatcgaatggggacttcctggaactaaaaacaaaaccaacgatttggatttctccacttccagtctttcaagaagtaagaccaagactggagtaagaccttttaaccctggtagaatgaatgtggcaggagacttatttcagaatggagaatttgcaactcatcatagtcctgagatgcatctacaaagaaggctaatgtcattcttccagtagaatcaagcaaatccttccaagaattttatagtacatcttgtttgtctccctgtgaaaacaactggaatcttaaaaaaggagtttttaataagtcaagatgtacaatttgtagtaaattagcagaggtctggatttttatacctaagttgttgtttaggctaacagtgataattttaacttttaagtgctattatgtactctttcatctacataatgcacgtgttctggatgtataacatgaagctgaaaggaagaataaggatatgttagaactatcttatgggatattttataaataaaattccatttgcatagcatggaaagtaca

SEQ ID NO: 3776 - DNA, 2702 bp, Homo sapiens
ggaattccagaagagaaaataatccctgtctagatgcagaggacttggttcctattccagtgctcctccggtagcagggaggcgacagaaggtgtccaactatccattaccaagaagaaatctattcgtttgagcctgagacactctttgaggtaaaaaattagaatgaaagaacctttggatggtgaatgtggcaaagcagtggtaccacagcaggagcttctggacaaaattaaagaagaaccagacaatgctcaagagtatggatgtgtccaacagccaaaaactcaagaaagtaaattgaaaattggtggtgtgtcttcagttaatgagagacctattgcccagcagttgaacccaggctttcagctttcttttgcatcatctggcccaagtgtgttgcttccttcagttccagctgttgctattaaggttttttgttctggttgtaaaaaaatgctttataagggccaaactgcatatcataagacaggatctactcagctcttctgctccacacgatgcatcaccagacattcttcacctgcctgcctgccacctcctcccaagaaaacctgcacaaactgctcgaagtataaaattcttaacatccctttttactttaccttttttttagtgtgtatattgtttagttcaaacatactgttgatactttaaatctcttcagcatgtatctgtagaaataactttttagttaatggaagaattcaccaattttaaagttttgcaacattaaataagtgacttggtgttagaatattgcctaaaccagttttctatcactttaaattttactatggaaagaaataacaaatgacatgtgggaattgcaggactatcctgtaattgtagacacccaccatttaaatttatttaacagttatcttgaaagctattgggtatagcataaaataatatcactcttttaatagtatacaaaagctatttaattctttaaaaagtaaaaactctacatggtcgcaaaaatgtgtttatttctaatgtccttgtggggtcattgttgctttacaataatgcttagatgcagagagaggaaaaaacagcaacaaagtcacataaatctttccctgacttagtacatttgaaggatttggcatattttgcctatttctgtggtagtgtaatttgaggaatacagtgtgttgttaatagtcactacaggcaaaaaacagtaagagcttgcttttaaattgtggctctgtcatttatctctgtgacttcgggctagatgtttaactttctaagcctccatttctcatcagtaaataatagttgcttcctaggactttaatgagacagtgttagcaaatggcctagcacatagcaagtacttaaaaaatggaatcctgttattattaataataaaaattatatcgtgcgattatttataattaacataaataaatataataaatatatgtgtatataatacatattactatgtatacttaacatatcacttgtaggcccctattttgtctttggctgtgtttatctgctttgtgtcttgacttaaactatttaaaagtagatcctgctatatggaaatttccaagtaaagaggagagaggatttttttttttctttgttgcccatggtagagtgatcacagctcactgcagccttgaactccccgggctcagatgatcctcccacctcagcctttcaaatagctgggaccacaggcgcataccaccatgcccgactaatttttgtatttttttgtagagatggttttgctatgttgcccaggctggtctcaaactcctgggctcaagcaattagcctgcctcagcctcctaaagtgctgggactattggtgtgagccatcacatgtggccaggagagaggaattttaaaatatttatatactctaaattagtttgttgcaaaataccattctaattaatgcttttatgtcattctcatgaaactaatctgaaagagtaaacttagttttctatttttagatattgtttcaacataccaaataccaaaataaaattaaataattttaaagaacataacacaacttatacatccaaatgcctattgttttcttaaaagtagtcacccccgtcagtgactttttagcataaggttaggagacagattcttatcttttcagcatgcatttgatttttacaaattttcaaaggctgcttgataccttaatcaggccaatatattagctaattaaattaagtcatactgttaaaacatgatatttataaaattaaaagttaaaaaatagtctaagggtttatcttaagttttatcttaaaaaaattagaaaaatgttttgagctatgttattgttggaaggtgtggtttttctacggtaaatgttacgatataacactcatttgcatgtgtaaggttcagagtacacttataatttatgtgcacagattttcattataaagtcattctctttgatttacatatttttacttgctatttttgtacttattatgccactggcagattcaccttattaagtgaaactctttattgctctgttttcagtagaaaaatcacttttcaaaattaatacttcatctgtgtataagcatattcttttggtttctaagatttgctgtcatatttttaaagttgagttttaaagaattaaaataatttttgttgttgttattttc

SEQ ID NO: 3777 - DNA, 4330 bp, Homo sapiens
gagggcggagaccaaggctgcgcaggcgtggttggccggtcgttgcgttgggatggatcaggcggaattccagaagagaaaataatccctgtctagatgcagaggacttggttcctattccagtgctcctccggtagcagggaggcgacagaaggtgtccaactatccattaccaagaagaaatctattcgtttgagcctgagacactctttgaggtaaaaaattagaatgaaagaacctttggatggtgaatgtggcaaagcagtggtaccacagcaggagcttctggacaaaattaaagaagaaccagacaatgctcaagagtatggatgtgtccaacagccaaaaactcaagaaagtaaattgaaaattggtggtgtgtcttcagttaatgagagacctattgcccagcagttgaacccaggctttcagctttcttttgcatcatctggcccaagtgtgttgcttccttcagttccagctgttgctattaaggttttttgttctggttgtaaaaaaatgctttataagggccaaactgcatatcataagacaggatctactcagctcttctgctccacacgatgcatcaccagacattcttcacctgcctgcctgccacctcctcccaagaaaacctgcacaaactgctcgaaagacattttaaatcctaaggatgtgatcacaactcgctttgagaattcctatcctagcaaagatttctgcagccaatcatgcttgtcatcttatgagctaaagaaaaaacctgttgttaccatatataccaaaagcatttcaactaagtgcagtatgtgtcagaagaatgctgatactcgatttgaagttaaatatcaaaatgtggtacatggtctttgtagtgatgcctgtttttcaaaatttcactctacaaacaacctcaccatgaactgttgtgagaactgtgggagctattgctatagtagctctggtccttgccaatcccagaaggtttttagttcaacaagtgtcacggcatacaagcagaattctgcccaaattcctccatatgccctggggaagtcattgaggccctcagctgaaatgattgagactacaaatgattcaggaaaaacagagcttttctgctctattaattgcttatctgcttacagagttaagactgttacttcttcaggtgtccaggtttcatgtcatagttgtaaaacctcagcaatccctcagtatcacctagccatgtcaaatggaactatatacagcttctgcagctccagttgtgtggttgctttccagaatgtatttagcaagccaaaaggaacaaactcttcggcggtgcccctgtctcagggccaagtggttgtaagcccgccctcctccaggtcagcagtgtcaataggaggaggtaacacctctgccgtttcccccagctccatccgtggctctgctgcagccagcctccaacctcttgctgaacaatcccagcaagttgctttaacccatacagttgttaaactcaagtgtcagcactgtaaccatctatttgccacaaaaccagaacttcttttttacaagggtaaaatgtttctgttttgtggcaagaattgctctgatgaatacaagaagaaaaataaagttgtggcaatgtgtgactactgtaaactgcagaaaattataaaggagactgtgcgattctcaggggttgataagccattctgtagtgaagtttgcaaattcctctctgcccgtgactttggagaacgatggggaaactactgtaagatgtgcagctactgttcacagacatccccaaatttggtagaaaatcgattggagggcaagttagaagagttttgttgtgaagattgtatgtccaaatttacagttctgttttatcagatggccaagtgtgatggttgtaaacgacagggtaaactaagcgagtccataaagtggcgaggcaacattaaacatttctgtaacctattttgtgtcttggagttttgtcatcagcaaattatgaatgactgtcttccacaaaataaagtaaatatttctaaagcaaaaactgctgtgacggagctcccttctgcaaggacagatacaacaccagttataaccagtgtgatgtcattggcaaaaatacctgctaccttatctacagggaacactaacagtgttttaaaaggtgcagttactaaagaggcagcaaagatcattcaagatgaaagtacacaggaagatgctatgaaatttccatcttcccaatcttcccagccttccaggcttttaaagaacaaaggcatatcatgcaaacccgtcacacagaccaaggccacttcttgcaaaccacatacacagcacaaagaatgtcagacagatttacctatgcctaatgaaaaaaatgatgcagaacttgattctccaccttcaaagaaaaaaagattaggttttttccagacttatgatacagaatatttaaaagttggttttattatctgtcctggatcaaaagaaagttcaccaaggccacagtgtgtcatttgtggagagatcttatccagtgaaaacatgaagccagcaaatctttctcatcatttgaagacaaaacattcagaattagaaaacaaaccagtagatttttttgaacaaaaatctttagaaatggaatgtcaaaatagttctttaaaaaagtgtttactagttgaaaagtcacttgtgaaagcttcttatttaattgctttccaaactgctgcaagcaagaagccattctccattgctgaagaattaattaaaccatatttagtagaaatgtgttcagaagttttgggttcaagtgctggagacaaaatgaaaactattccactttctaatgttacaattcaacacaggattgatgaactatctgcagacattgaagaccagctgattcaaaaggtcagagagtcaaagtggtttgcccttcagatagatgagtcatcagaaatctcaaatatcacacttcttttgtgctatattcgtttcattgattatgattgtcgtgatgtaaaagaagaattattattttgcattgaaatgcctactcaaataactggctttgaaatatttgaactaataaataaatatattgatagtaaatctctgaattggaaacattgtgttggtctctgtaccgatggggctgcaagcatgactggcaggtattctggtttaaaagcaaaaattcaagaagttgccatgaatacagcggcatttacacattgttttattcaccgtgaacgtttagtggcagaaaagttgtctccatgtttacataaaattcttttgcagtcagcacaaattttaagttttataaagagcaatgcattaaattcacgtatgttaacaattttgtgtgaagagatgggatctgagcatgtgagtttaccgcttcatgctgaagtacgttggatatcaagagggagaatgttaaaaagattatttgaattacgacatgagattgaaatatttttaagtcaaaagcattcagatttggccaagtattttcatgatgaggaatgggttggaaagctggcctacttatcagatatattttcacttataaatgaattaaatttaagtctccaaggaactttgactactttcttcaatttgtgtaataaaattgatgtatttaagagaaagttaaaaatgtggttgaagcgcacacaagagaatgattatgacatgttcccttcattttctgaattctcaaattcatcaggcttaaatatgacagacatcacaaggattatttttgagcacctggaaggactttctcaagtgttcagtgactgttttccaccagaacaagacttgcgttcaggaaatttgtggataattcacccttttatgaatcaccaaaataataatctcaccgacttcgaagaagaaaagctaacagagctatcttcagatttaggattacaagcactatttaaatcagtgtctgtaactcagttttggataaatgcaaagacaagttacccagaactccatgaaagggcaatgaaatttttattacccttttcaactgtttatttatgtgatgctgccttttcagctttgactgagtcaaaacaaaaaaatctgttgggttctggccctgccctaagacttgcagtcacatctttaattccaaggatagaaaaattagtgaaggagaaagagtagcaatatgcacattgcttaacagtgaagtcaataatcctgtgttaagttttgtataagtatcctaaaagataatttcctaatgtggatttgtgttttcagtgattaaatgttttaataatttttc

SEQ ID NO: 3778 - DNA, 1473 bp, Homo sapiens
agggacgcgttgacattcactggctagtccaccgctctcagtcggagaccacattgcctcgaaggcgattgtgaagcggggctctgaggggcttgatgccccccacccctcacacggagaccttgaaagaggtgtccaactatccattaccaagaagaaatctattcgtttgagcctgagacactctttgaggtaaaaaattagaatgaaagaacctttggatggtgaatgtggcaaagcagtggtaccacagcaggagcttctggacaaaattaaagaagaaccagacaatgctcaagagtatggatgtgtccaacagccaaaaactcaagaaagtaaattgaaaattggtggtgtgtcttcagttaatgagagacctattgcccagcagttgaacccaggctttcagctttcttttgcatcatctggcccaagtgtgttgcttccttcagttccagctgttgctattaaggttttttgttctggttgtaaaaaaatgctttataagggccaaactgcatatcataagacaggatctactcagctcttctgctccacacgatgcatcaccagacattcttcacctgcctgcctgccacctcctcccaagaaaacctgcacaaactgctcgaagtataaaattcttaacatccctttttactttaccttttttttagtgtgtatattgtttagttcaaacatactgttgatactttaaatctcttcagcatgtatctgtagaaataactttttagttaatggaagaattcaccaattttaaagttttgcaacattaaataagtgacttggtgttagaatattgcctaaaccagttttctatcactttaaattttactatggaaagaaataacaaatgacatgtgggaattgcaggactatcctgtaattgtagacacccaccatttaaatttatttaacagttatcttgaaagctattgggtatagcataaaataatatcactcttttaatagtatacaaaagctatttaattctttaaaaagtaaaaactctacatggtcgcaaaaatgtgtttatttctaatgtccttgtggggtcattgttgctttacaataatgcttagatgcagagagaggaaaaaacagcaacaaagtcacataaatctttccctgacttagtacatttgaaggatttggcatattttgcctatttctgtggtagtgtaatttgaggaatacagtgtgttgttaatagtcactacaggcaaaaaacagtaagagcttgcttttaaattgtggctctgtcatttatctctgtgacttcgggctagatgtttaactttctaagcctccatttctcatcagtaaataatagttgcttcctaggactttaatgagacagtgttagcaaatggcctagcacatagcaagtacttaaaaaatggaatcctgttattattaataataaaaattatatcgtgcgattatttataa

SEQ ID NO: 3779 - DNA, 2400 bp, Homo sapiens
gagggcggagaccaaggctgcgcaggcgtggttggccggtcgttgcgttgggatggatcaggcggaattccagaagagaaaataatccctgtctagatgcagaggacttggttcctattccagtgctcctccggtagcagggaggcgacagaaggtgtccaactatccattaccaagaagaaatctattcgtttgagcctgagacactctttgaggtaaaaaattagaatgaaagaacctttggatggtgaatgtggcaaagcagtggtaccacagcaggagcttctggacaaaattaaagaagaaccagacaatgctcaagagtatggatgtgtccaacagccaaaaactcaagaaagtaaattgaaaattggtggtgtgtcttcagttaatgagagacctattgcccagcagttgaacccaggctttcagctttcttttgcatcatctggcccaagtgtgttgcttccttcagttccagctgttgctattaaggttttttgttctggttgtaaaaaaatgctttataagggccaaactgcatatcataagacaggatctactcagctcttctgctccacacgatgcatcaccagacattcttcacctgcctgcctgccacctcctcccaagaaaacctgcacaaactgctcgaaagacattttaaatcctaaggatgtgatcacaactcgctttgagaattcctatcctagcaaagatttctgcagccaatcatgcttgtcatcttatgagctaaagaaaaaacctgttgttaccatatataccaaaagcatttcaactaagtgcagtatgtgtcagaagaatgctgatactcgatttgaagttaaatatcaaaatgtggtacatggtctttgtagtgatgcctgtttttcaaaatttcactctacaaacaacctcaccatgaactgttgtgagaactgtgggagctattgctatagtagctctggtccttgccaatcccagaaggtttttagttcaacaagtgtcacggcatacaagcagaattctgcccaaattcctccatatgccctggggaagtcattgaggccctcagctgaaatgattgagactacaaatgattcaggaaaaacagagcttttctgctctattaattgcttatctgcttacagagttaagactgttacttcttcaggtgtccaggtttcatgtcatagttgtaaaacctcagcaatccctcagtatcacctagccatgtcaaatggaactatatacagcttctgcagctccagttgtgtggttgctttccagaatgtatttagcaagccaaaaggaacaaactcttcggcggtgcccctgtctcagggccaagtggttgtaagcccgccctcctccaggtcagcagtgtcaataggaggaggtaacacctctgccgtttcccccagctccatccgtggctctgctgcagccagcctccaacctcttgctgaacaatcccagcaagttgctttaacccatacagttgttaaactcaagtgtcagcactgtaaccatctatttgccacaaaaccagaacttcttttttacaagggtaaaatgtttctgttttgtggcaagaattgctctgatgaatacaagaagaaaaataaagttgtggcaatgtgtgactactgtaaactgcagaaaattataaaggagactgtgcgattctcaggggttgataagccattctgtagtgaagtttgcaaattcctctctgcccgtgactttggagaacgatggggaaactactgtaagatgtgcagctactgttcacagacatccccaaatttggtagaaaatcgattggagggcaagttagaagagttttgttgtgaagattgtatgtccaaatttacagttctgttttatcagatggccaagtgtgatggttgtaaacgacagggtaaactaagcgagtccataaagtggcgaggcaacattaaacatttctgtaacctattttgtgtcttggagttttgtcatcagcaaattatgaatgactgtcttccacaaaataaagtaaatatttctaaagcaaaaactgctgtgacggagctcccttctgcaaggacagatacaacaccagttataaccagtgtgatgtcattggcaaaaatacctgctaccttatctacagggaacactaacagtgttttaaaaggtgcagttactaaagaggcagcaaagatcattcaagatgaaagtacacaggaagatgctatgaaatttccatcttcccaatcttcccagccttccaggcttttaaagaacaaaggcatatcatgcaaacccgtcacacagaccaaggccacttcttgcaaaccacatacacagcacaaagaatgtcagacagaatgccctgttcgtgcagtttgctga

SEQ ID NO: 3780 - DNA, 807 bp, Homo sapiens
tcgttagtcctcaatgatgggagtgggaattcttggtgggaaggagaatttcggaaagcgtgcggttctcagaggagggatgagcgcccgtagatattttgtggcgagtgtccaactatccattaccaagaagaaatctattcgtttgagcctgagacactctttgaggtaaaaaattagaatgaaagaacctttggatggtgaatgtggcaaagcagtggtaccacagcaggagcttctggacaaaattaaagaagaaccagacaatgctcaagagtatggatgtgtccaacagccaaaaactcaagaaagtaaattgaaaattggtggtgtgtcttcagttaatgagagacctattgcccagcagttgaacccaggctttcagctttcttttgcatcatctggcccaagtgtgttgcttccttcagttccagctgttgctattaaggttttttgttctggttgtaaaaaaatgctttataagggccaaactgcatatcataagacaggatctactcagctcttctgctccacacgatgcatcaccagacattcttcacctgcctgcctgccacctcctcccaagaaaacctgcacaaactgctcgaaagacattttaaatcctaaggatgtgatcacaactcgctttgagaattcctatcctagcaaagatttctgcagccaatcatgcttgtcatcttatgagctaaagaaaaaacctgttgttaccatatataccaaaagcatttcaactaagtgcagtatgtgtcagaagaatgctgatactcgatttgaagttaaatatca

SEQ ID NO: 3781 - DNA, 4393 bp, Homo sapiens
agtgttcttgcagggctgctgatgggtggtcctgttcttttcgcggtcctgtttgcgcagagatgaaacggggaacttagcgtatccctaccgctctttttgatgacaggagtaaagggctgttcagactacctaaacaatgttgttaagagaagcactcgtacttctcagacttcgctgttccggaccccgcgagccaggggcaggcaccgggtccacccggggctgagctgcggcggcgcctgacaatgccccctcgcgccccggcctcggcgcccgctcccggctccagcgcgcctgcacgtacgtagccttcacgtgtgtgtggatacggagtgcatgtgtggagacagaggaatatgctccaacaaatttcggatagaggcgccgaagacaggacgtggggaagctaaagaagtaaacaggtcatggcacgtttaacaaaaagacgacaggcggatacaaaagctatccagcatctttgggcagccattgagattatacggaaccagaagcagattgccaacattgaccgtattacaaagtatatgtctcgagtccacggtatgcaccctaaagagaccacccgtcagctgagcttagctgtgaaagatggtcttattgtcgaaactctaacagtgggctgcaaaggttcaaaagctggtattgaacaagaaggatattggttgccaggagatgagattgactgggaaacagaaaatcatgactggtattgttttgaatgccatttgcctggagaggtgttgatatgtgacctgtgttttcgtgtgtatcattccaagtgtttgtctgatgagttcaggcttagagacagcagtagtccctggcagtgcccagtttgcaggagcattaagaagaagaatacaaacaaacaggagatgggcacatacctcagattcattgtctcccgcatgaaggagagggctatagatcttaataaaaaggggaaggacaataaacacccgatgtacaggaggctggtgcactcagctgtggacgttcccaccattcaagagaaagtgaatgaagggaaataccgaagttatgaagagttcaaagctgatgcccaattgcttctccacaataccgtgattttctatggagcagacagtgagcaagctgacattgcgaggatgctatataaagacacatgtcatgagctggatgaactgcagctttgcaagaattgcttttacttgtcaaatgctcgtcctgacaactggttctgttatccttgtatacctaatcatgagctggtttgggctaaaatgaaaggttttgggttttggccagccaaagtcatgcagaaagaagacaatcaagtcgacgttcgcttctttggccaccaccaccagagggcctggattccttctgaaaacattcaagatatcacagtcaacattcatcggctgcacgtgaagcgcagtatgggttggaaaaaggcctgtgatgagctggagctgcatcagcgtttcctacgagaagggagattttggaaatctaagaatgaggaccgaggtgaggaagaggcagaatccagtatctcctccaccagtaatgagcagctaaaggtcactcaagaaccaagagcaaagaaaggacgacgtaatcaaagtgtggagcccaaaaaggaagaaccagagcctgaaacagaagcagtaagttctagccaggaaatacccacgatgcctcagcccatcgaaaaagtctccgtgtcaactcagacaaagaagttaagtgcctcttcaccaagaatgctgcatcggagcacccagaccacaaacgacggcgtgtgtcagagcatgtgccatgacaaatacaccaagatcttcaatgacttcaaagaccggatgaagtcggaccacaagcgggagacagagcgtgttgtccgagaagctctggagaagctgcgttctgaaatggaagaagaaaagagacaagctgtaaataaagctgtagccaacatgcagggtgagatggacagaaaatgtaagcaagtaaaggaaaagtgtaaggaagaatttgtagaagaaatcaagaagctggcaacacagcacaagcaactgatttctcagaccaagaagaagcagtggtgctacaactgtgaggaggaggccatgtaccactgctgctggaacacatcctactgctccatcaagtgccagcaggagcactggcacgcggagcacaagcgcacctgccgccggaaaagatgaagctggcccttcccggagtcaccccgatgattactcttttcagacacagcggtttttgtttccaagaagccaaaattgtttagaatttgcttcccattttgcaccagcctttaaacacttttcgtgaagaaattttgcacagtagtttaaatcttttgttaatgctcctccgaagtttttcagggggtaaaagtaacatcagtggagggtattattttaaataaattttaattgagaatttgttgcattttcagcaaattttaaaacatttttaggttttacagagattttaacctttaaacaacagatctttaaaaaacaggtgaatacaagtgagtttaacaaagaaacatttagaatagatctgaatgtaagaactacagaactgtttcagaaataaaacatactaccttgatgtgacatttttttcttaaccttgttgagctggttttgttcagcttaatttactgttcaaaggcattatctgttggtcacaccagtgggtatatgattgaatttagggaacagggttgacacagcagggctagtcctgcatattttttcttaaatatttcccaattgtgtttttcattatttcttttcaatatataacttttataacaaattattagctttgatcttgtagtttaaaattgcagggaactggggtaatcttttactgagctggatcttagagaaaatgaatatttaaattttaaagtttgcacatttcatctttgtcctaacatgagtgcttgtaacaaaataaacaacaaaaacaaagccaaaaactacctttatccatatgtgaaattatagatgaggcatacgaatttgtttaatgcttcccttcccttcccacatatcatctcactgcctattatctggtgtcacctcatgtatcgtaagttaatactaaaagaagagaaagcacttaagtttcacagaagccgttatgtttgtagtaatgggtcattgcctactaatgaactccatcactgtacacagaatgaagaataatgcatgttaattttcttgtattaaagatgccgtgatttgtaaaaagtctgtattttgcggaatgtctggattaagaagcattaccaataggaatggatcgatagttgaataatgattttttatacatagatatataaaatacagccaggaaaacttaaattacttttcttttaaaatatctcacaatttatgtggtatttttaaagactgatcttagaccaagtcaaattcccatttatcatttagttattttttgaggttagagaataatttgtacatatttatttagacctttgatatttattaaagcaattactcacaatggaagtgaaagaatcaggagaaaagccttttaaaaagtattctccaggtttgtcagggtcactctaaagataaaaatgtaactaagtcttctgtgaaatatcatccatctaatcttgatgctgttgcagatggtggtgacacaagttaattgacaaactactgccaaatggtgcacaatattttgtaaaaagtacccagtagccccatttcatacaatgtacctaaattatgcagtaacttggcatcatcgttccctccttgttgctgtgtaattagtcagtgttgccacagtgtgtggcgctgatggagatgtcagaaccgagaacacttaaccttctttgattgtttttcaagttttaagacttcgatccacccctatgagagcaagtaattgtggaaatatttttggtgtaaaatcattccagagtatgtaatatttaactgatagctgcatgaaagtgagattcgtgttactttggcttttctgtctctgttgacacggttgcacatttccaagttactacagcgtgaaaactgtgtgtttaaaaaaaaacaaaattaaaaaaagagattgtggcctggttttgtaaaagttttaggtaaaattacaattgattgttttaggaatcattattaaaaattttctgcaaatcataaagctatatcgaggtgttgagcttagccactatgcacattgtaattattcattgtggctgtccagttctatgatgcattctggcattttgtaagctgctctgactagcaatatatagattcatttaatgtgttaacattggttaataaatgtattt

SEQ ID NO: 3782 - DNA, 2709 bp, Homo sapiens
ctaaagaagtaaacaggtcatggcacgtttaacaaaaagacgacaggcggatacaaaagctatccagcatctttgggcagccattgagattatacggaaccagaagcagattgccaacattgaccgtattacaaaatgtgaaacaactacattattcttgaacctatggtgatttttacatcattacacagatatgtcattttcattagttgtatcattgttataaactggtatatgtctcgagtccacggtatgcaccctaaagagaccacccgtcagctgagcttagctgtgaaagatggtcttattgtcgaaactctaacagtgggctgcaaaggttcaaaagctggtattgaacaagaaggatattggttgccaggagatgagattgactgggaaacagaaaatcatgactggtattgttttgaatgccatttgcctggagaggtgttgatatgtgacctgtgttttcgtgtgtatcattccaagtgtttgtctgatgagttcaggcttagagacagcagtagtccctggcagtgcccagtttgcaggagcattaagaagaagaatacaaacaaacaggagatgggcacatacctcagattcattgtctcccgcatgaaggagagggctatagatcttaataaaaaggggaaggacaataaacacccgatgtacaggaggctggtgcactcagctgtggacgttcccaccattcaagagaaagtgaatgaagggaaataccgaagttatgaagagttcaaagctgatgcccaattgcttctccacaataccgtgattttctatggagcagacagtgagcaagctgacattgcgaggatgctatataaagacacatgtcatgagctggatgaactgcagctttgcaagaattgcttttacttgtcaaatgctcgtcctgacaactggttctgttatccttgtatacctaatcatgagctggtttgggctaaaatgaaaggttttgggttttggccagccaaagtcatgcagaaagaagacaatcaagtcgacgttcgcttctttggccaccaccaccagagggcctggattccttctgaaaacattcaagatatcacagtcaacattcatcggctgcacgtgaagcgcagtatgggttggaaaaaggcctgtgatgagctggagctgcatcagcgtttcctacgagaagggagattttggaaatctaagaatgaggaccgaggtgaggaagaggcagaatccagtatctcctccaccagtaatgagcagctaaaggtcactcaagaaccaagagcaaagaaaggacgacgtaatcaaagtgtggagcccaaaaaggaagaaccagagcctgaaacagaagcagtaagttctagccaggaaatacccacgatgcctcagcccatcgaaaaagtctccgtgtcaactcagacaaagaagttaagtgcctcttcaccaagaatgctgcatcggagcacccagaccacaaacgacggcgtgtgtcagagcatgtgccatgacaaatacaccaagatcttcaatgacttcaaagaccggatgaagtcggaccacaagcgggagacagagcgtgttgtccgagaagctctggagaagctgcgttctgaaatggaagaagaaaagagacaagctgtaaataaagctgtagccaacatgcagggtgagatggacagaaaatgtaagcaagtaaaggaaaagtgtaaggaagaatttgtagaagaaatcaagaagctggcaacacagcacaagcaactgatttctcagaccaagaagaagcagtggtgctacaactgtgaggaggaggccatgtaccactgctgctggaacacatcctactgctccatcaagtgccagcaggagcactggcacgcggagcacaagcgcacctgccgccggaaaagatgaagctggcccttcccggagtcaccccgatgattactcttttcagacacagcggtttttgtttccaagaagccaaaattgtttagaatttgcttcccattttgcaccagcctttaaacacttttcgtgaagaaattttgcacagtagtttaaatcttttgttaatgctcctccgaagtttttcagggggtaaaagtaacatcagtggagggtattattttaaataaattttaattgagaatttgttgcattttcagcaaattttaaaacatttttaggttttacagagattttaacctttaaacaacagatctttaaaaaacaggtgaatacaagtgagtttaacaaagaaacatttagaatagatctgaatgtaagaactacagaactgtttcagaaataaaacatactaccttgatgtgacatttttttcttaaccttgttgagctggttttgttcagcttaatttactgttcaaaggcattatctgttggtcacaccagtgggtatatgattgaatttagggaacagggttgacacagcagggctagtcctgcatattttttcttaaatatttcccaattgtgtttttcattatttcttttcaatatataacttttataacaaattattagctttgatcttgtagtttaaaattgcagggaactggggtaatcttttactgagctggatcttagagaaaatgaatatttaaattttaaagtttgcacatttcatctttgtcctaacatgagtgcttgtaacaaaataaacaacaaaaacaaagcc

SEQ ID NO: 3783 - DNA, 4229 bp, Homo sapiens
gcggccgccccgcgcgcatcgccatgtgagcggctgccgcggcttcgcggggacccaactttcccgggcggcggcgcccaacttcccgccgcccgctccggccccgcaggcccgcggcgccaggggaagacgcgagtaagtgcgggcggcggtgccctcccggccctcaccccgcacgcggcgacccggccgcctagcctccctcgctcaggcgcgaccgcggcgttctctgagctaaagaagtaaacaggtcatggcacgtttaacaaaaagacgacaggcggatacaaaagctatccagcatctttgggcagccattgagattatacggaaccagaagcagattgccaacattgaccgtattacaaagtatatgtctcgagtccacggtatgcaccctaaagagaccacccgtcagctgagcttagctgtgaaagatggtcttattgtcgaaactctaacagtgggctgcaaaggttcaaaagctggtattgaacaagaaggatattggttgccaggagatgagattgactgggaaacagaaaatcatgactggtattgttttgaatgccatttgcctggagaggtgttgatatgtgacctgtgttttcgtgtgtatcattccaagtgtttgtctgatgagttcaggcttagagacagcagtagtccctggcagtgcccagtttgcaggagcattaagaagaagaatacaaacaaacaggagatgggcacatacctcagattcattgtctcccgcatgaaggagagggctatagatcttaataaaaaggggaaggacaataaacacccgatgtacaggaggctggtgcactcagctgtggacgttcccaccattcaagagaaagtgaatgaagggaaataccgaagttatgaagagttcaaagctgatgcccaattgcttctccacaataccgtgattttctatggagcagacagtgagcaagctgacattgcgaggatgctatataaagacacatgtcatgagctggatgaactgcagctttgcaagaattgcttttacttgtcaaatgctcgtcctgacaactggttctgttatccttgtatacctaatcatgagctggtttgggctaaaatgaaaggttttgggttttggccagccaaagtcatgcagaaagaagacaatcaagtcgacgttcgcttctttggccaccaccaccagagggcctggattccttctgaaaacattcaagatatcacagtcaacattcatcggctgcacgtgaagcgcagtatgggttggaaaaaggcctgtgatgagctggagctgcatcagcgtttcctacgagaagggagattttggaaatctaagaatgaggaccgaggtgaggaagaggcagaatccagtatctcctccaccagtaatgagcagctaaaggtcactcaagaaccaagagcaaagaaaggacgacgtaatcaaagtgtggagcccaaaaaggaagaaccagagcctgaaacagaagcagtaagttctagccaggaaatacccacgatgcctcagcccatcgaaaaagtctccgtgtcaactcagacaaagaagttaagtgcctcttcaccaagaatgctgcatcggagcacccagaccacaaacgacggcgtgtgtcagagcatgtgccatgacaaatacaccaagatcttcaatgacttcaaagaccggatgaagtcggaccacaagcgggagacagagcgtgttgtccgagaagctctggagaagctgcgttctgaaatggaagaagaaaagagacaagctgtaaataaagctgtagccaacatgcagggtgagatggacagaaaatgtaagcaagtaaaggaaaagtgtaaggaagaatttgtagaagaaatcaagaagctggcaacacagcacaagcaactgatttctcagaccaagaagaagcagtggtgctacaactgtgaggaggaggccatgtaccactgctgctggaacacatcctactgctccatcaagtgccagcaggagcactggcacgcggagcacaagcgcacctgccgccggaaaagatgaagctggcccttcccggagtcaccccgatgattactcttttcagacacagcggtttttgtttccaagaagccaaaattgtttagaatttgcttcccattttgcaccagcctttaaacacttttcgtgaagaaattttgcacagtagtttaaatcttttgttaatgctcctccgaagtttttcagggggtaaaagtaacatcagtggagggtattattttaaataaattttaattgagaatttgttgcattttcagcaaattttaaaacatttttaggttttacagagattttaacctttaaacaacagatctttaaaaaacaggtgaatacaagtgagtttaacaaagaaacatttagaatagatctgaatgtaagaactacagaactgtttcagaaataaaacatactaccttgatgtgacatttttttcttaaccttgttgagctggttttgttcagcttaatttactgttcaaaggcattatctgttggtcacaccagtgggtatatgattgaatttagggaacagggttgacacagcagggctagtcctgcatattttttcttaaatatttcccaattgtgtttttcattatttcttttcaatatataacttttataacaaattattagctttgatcttgtagtttaaaattgcagggaactggggtaatcttttactgagctggatcttagagaaaatgaatatttaaattttaaagtttgcacatttcatctttgtcctaacatgagtgcttgtaacaaaataaacaacaaaaacaaagccaaaaactacctttatccatatgtgaaattatagatgaggcatacgaatttgtttaatgcttcccttcccttcccacatatcatctcactgcctattatctggtgtcacctcatgtatcgtaagttaatactaaaagaagagaaagcacttaagtttcacagaagccgttatgtttgtagtaatgggtcattgcctactaatgaactccatcactgtacacagaatgaagaataatgcatgttaattttcttgtattaaagatgccgtgatttgtaaaaagtctgtattttgcggaatgtctggattaagaagcattaccaataggaatggatcgatagttgaataatgattttttatacatagatatataaaatacagccaggaaaacttaaattacttttcttttaaaatatctcacaatttatgtggtatttttaaagactgatcttagaccaagtcaaattcccatttatcatttagttattttttgaggttagagaataatttgtacatatttatttagacctttgatatttattaaagcaattactcacaatggaagtgaaagaatcaggagaaaagccttttaaaaagtattctccaggtttgtcagggtcactctaaagataaaaatgtaactaagtcttctgtgaaatatcatccatctaatcttgatgctgttgcagatggtggtgacacaagttaattgacaaactactgccaaatggtgcacaatattttgtaaaaagtacccagtagccccatttcatacaatgtacctaaattatgcagtaacttggcatcatcgttccctccttgttgctgtgtaattagtcagtgttgccacagtgtgtggcgctgatggagatgtcagaaccgagaacacttaaccttctttgattgtttttcaagttttaagacttcgatccacccctatgagagcaagtaattgtggaaatatttttggtgtaaaatcattccagagtatgtaatatttaactgatagctgcatgaaagtgagattcgtgttactttggcttttctgtctctgttgacacggttgcacatttccaagttactacagcgtgaaaactgtgtgtttaaaaaaaaacaaaattaaaaaaagagattgtggcctggttttgtaaaagttttaggtaaaattacaattgattgttttaggaatcattattaaaaattttctgcaaatcataaagctatatcgaggtgttgagcttagccactatgcacattgtaattattcattgtggctgtccagttctatgatgcattctggcattttgtaagctgctctgactagcaatatatagattcatttaatgtgttaacattggttaataaatgtatttaaaaaaaacta

SEQ ID NO: 3784 - DNA, 2285 bp, Homo sapiens
agtgttcttgcagggctgctgatgggtggtcctgttcttttcgcggtcctgtttgcgcagagatgaaacggggaacttagcgtatccctaccgctctttttgatgacaggagtaaagggctgttcagactacctaaacaatgttgttaagagaagcactcgtacttctcagacttcgctgttccggaccccgcgagccaggggcaggcaccgggtccacccggggctgagctgcggcggcgcctgacaatgccccctcgcgccccggcctcggcgcccgctcccggctccagcgcgcctgcacgtacgtagccttcacgtgtgtgtggatacggagtgcatgtgtggagacagaggaatatgctccaacaaatttcggatagaggcgccgaagacaggacgtggggaagctaaagaagtaaacaggtcatggcacgtttaacaaaaagacgacaggcggatacaaaagctatccagcatctttgggcagccattgagattatacggaaccagaagcagattgccaacattgaccgtattacaaagtatatgtctcgagtccacggtatgcaccctaaagagaccacccgtcagctgagcttagctgtgaaagatggtcttattgtcgaaactctaacagtgggctgcaaaggttcaaaagctggtattgaacaagaaggatattggttgccaggagatgagattgactgggaaacagaaaatcatgactggtattgttttgaatgccatttgcctggagaggtgttgatatgtgacctgtgttttcgtgtgtatcattccaagtgtttgtctgatgagttcaggcttagagacagcagtagtccctggcagtgcccagtttgcaggagcattaagaagaagaatacaaacaaacaggagatgggcacatacctcagattcattgtctcccgcatgaaggagagggctatagatcttaataaaaaggggaaggacaataaacacccgatgtacaggaggctggtgcactcagctgtggacgttcccaccattcaagagaaagtgaatgaagggaaataccgaagttatgaagagttcaaagctgatgcccaattgcttctccacaataccgtgattttctatggagcagacagtgagcaagctgacattgcgaggatgctatataaagacacatgtcatgagctggatgaactgcagctttgcaagaattgcttttacttgtcaaatgctcgtcctgacaactggttctgttatccttgtatacctaatcatgagctggtttgggctaaaatgaaaggttttgggttttggccagccaaagtcatgcagaaagaagacaatcaagtcgacgttcgcttctttggccaccaccaccagagggcctggattccttctgaaaacattcaagatatcacagtcaacattcatcggctgcacgtgaagcgcagtatgggttggaaaaaggcctgtgatgagctggagctgcatcagcgtttcctacgagaagggagattttggaaatctaagaatgaggaccgaggtgaggaagaggcagaatccagtatctcctccaccagtaatgagcagctaaaggtcactcaagaaccaagagcaaagaaaggacgacgtaatcaaagtgtggagcccaaaaaggaagaaccagagcctgaaacagaagcagtaagttctagccaggaaatacccacgatgcctcagcccatcgaaaaagtctccgtgtcaactcagacaaagaagttaagtgcctcttcaccaagaatgctgcatcggagcacccagaccacaaacgacggcgtgtgtcagagcatgtgccatgacaaatacaccaagatcttcaatgacttcaaagaccggatgaagtcggaccacaagcgggagacagagcgtgttgtccgagaagctctggagaagctgcgttctgaaatggaagaagaaaagagacaagctgtaaataaagctgtagccaacatgcagggtgagatggacagaaaatgtaagcaagtaaaggaaaagtgtaaggaagaatttgtagaagaaatcaagaagctggcaacacagcacaagcaactgatttctcagaccaagaagaagcagtgggtaaataccagtcttttttagacccttatttctgaaaatgtaccacaggtatgatgcccgttaattcagaaggtagctgtggcacatgcagaagatgtttctgaaataagatcaaatgtgaaatggtcagctttagttttaaaaattttattaaaagtcctatgatctctc

SEQ ID NO: 3785 - DNA, 2683 bp, Homo sapiens
gctaaagaagtaaacaggtcatggcacgtttaacaaaaagacgacaggcggatacaaaagctatccagcatctttgggcagccattgagattatacggaaccagaagcagattgccaacattgaccgtattacaaaatgtgaaacaactacattattcttgaacctatggtgatttttacatcattacacagatatgtcattttcattagttgtatcattgttataaactggtatatgtctcgagtccacggtatgcaccctaaagagaccacccgtcagctgagcttagctgtgaaagatggtcttattgtcgaaactctaacagtgggctgcaaaggttcaaaagctggtattgaacaagaaggatattggttgccaggagatgagattgactgggaaacagaaaatcatgactggtattgttttgaatgccatttgcctggagaggtgttgatatgtgacctgtgttttcgtgtgtatcattccaagtgtttgtctgatgagttcaggcttagagacagcagtagtccctggcagtgcccagtttgcaggagcattaagaagaagaatacaaacaaacaggagatgggcacatacctcagattcattgtctcccgcatgaaggagagggctatagatcttaataaaaaggggaaggacaataaacacccgatgtacaggaggctggtgcactcagctgtggacgttcccaccattcaagagaaagtgaatgaagggaaataccgaagttatgaagagttcaaagctgatgcccaattgcttctccacaataccgtgattttctatggagcagacagtgagcaagctgacattgcgaggatgctatataaagacacatgtcatgagctggatgaactgcagctttgcaagaattgcttttacttgtcaaatgctcgtcctgacaactggttctgttatccttgtatacctaatcatgagctggtttgggctaaaatgaaaggttttgggttttggccagccaaagtcatgcagaaagaagacaatcaagtcgacgttcgcttctttggccaccaccaccagagggcctggattccttctgaaaacattcaagatatcacagtcaacattcatcggctgcacgtgaagcgcagtatgggttggaaaaaggcctgtgatgagctggagctgcatcagcgtttcctacgagaagggagattttggaaatctaagaatgaggaccgaggtgaggaagaggcagaatccagtatctcctccaccagtaatgagcagctaaaggtcactcaagaaccaagagcaaagaaaggacgacgtaatcaaagtgtggagcccaaaaaggaagaaccagagcctgaaacagaagcagtaagttctagccaggaaatacccacgatgcctcagcccatcgaaaaagtctccgtgtcaactcagacaaagaagttaagtgcctcttcaccaagaatgctgcatcggagcacccagaccacaaacgacggcgtgtgtcagagcatgtgccatgacaaatacaccaagatcttcaatgacttcaaagaccggatgaagtcggaccacaagcgggagacagagcgtgttgtccgagaagctctggagaagctgcgttctgaaatggaagaagaaaagagacaagctgtaaataaagctgtagccaacatgcagggtgagatggacagaaaatgtaagcaagtaaaggaaaagtgtaaggaagaatttgtagaagaaatcaagaagctggcaacacagcacaagcaactgatttctcagaccaagaagaagcagtggtgctacaactgtgaggaggaggccatgtaccactgctgctggaacacatcctactgctccatcaagtgccagcaggagcactggcacgcggagcacaagcgcacctgccgccggaaaagatgaagctggcccttcccggagtcaccccgatgattactcttttcagacacagcggtttttgtttccaagaagccaaaattgtttagaatttgcttcccattttgcaccagcctttaaacacttttcgtgaagaaattttgcacagtagtttaaatcttttgttaatgctcctccgaagtttttcagggggtaaaagtaacatcagtggagggtattattttaaataaattttaattgagaatttgttgcattttcagcaaattttaaaacatttttaggttttacagagattttaacctttaaacaacagatctttaaaaaacaggtgaatacaagtgagtttaacaaagaaacatttagaatagatctgaatgtaagaactacagaactgtttcagaaataaaacatactaccttgatgtgacatttttttcttaaccttgttgagctggttttgttcagcttaatttactgttcaaaggcattatctgttggtcacaccagtgggtatatgattgaatttagggaacagggttgacacagcagggctagtcctgcatattttttcttaaatatttcccaattgtgtttttcattatttcttttcaatatataacttttataacaaattattagctttgatcttgtagtttaaaattgcagggaactggggtaatcttttactgagctggatcttagagaaaatgaatatttaaattttaaagtttgcacatttcatctttgtcctaacatgagtgcttgt

SEQ ID NO: 3786 - DNA, 3898 bp, Homo sapiens
gcggcgggaaggaggcggcaccggaggggagggccgggcgcggcggcggcggcggtggaggagccggagcataatgctaaagaagtaaacaggtcatggcacgtttaacaaaaagacgacaggcggatacaaaagctatccagcatctttgggcagccattgagattatacggaaccagaagcagattgccaacattgaccgtattacaaagtatatgtctcgagtccacggtatgcaccctaaagagaccacccgtcagctgagcttagctgtgaaagatggtcttattgtcgaaactctaacagtgggctgcaaaggttcaaaagctggtattgaacaagaaggatattggttgccaggagatgagattagcattaagaagaagaatacaaacaaacaggagatgggcacatacctcagattcattgtctcccgcatgaaggagagggctatagatcttaataaaaaggggaaggacaataaacacccgatgtacaggaggctggtgcactcagctgtggacgttcccaccattcaagagaaagtgaatgaagggaaataccgaagttatgaagagttcaaagctgatgcccaattgcttctccacaataccgtgattttctatggagcagacagtgagcaagctgacattgcgaggatgctatataaagacacatgtcatgagctggatgaactgcagctttgcaagaattgcttttacttgtcaaatgctcgtcctgacaactggttctgttatccttgtatacctaatcatgagctggtttgggctaaaatgaaaggttttgggttttggccagccaaagtcatgcagaaagaagacaatcaagtcgacgttcgcttctttggccaccaccaccagagggcctggattccttctgaaaacattcaagatatcacagtcaacattcatcggctgcacgtgaagcgcagtatgggttggaaaaaggcctgtgatgagctggagctgcatcagcgtttcctacgagaagggagattttggaaatctaagaatgaggaccgaggtgaggaagaggcagaatccagtatctcctccaccagtaatgagcagctaaaggtcactcaagaaccaagagcaaagaaaggacgacgtaatcaaagtgtggagcccaaaaaggaagaaccagagcctgaaacagaagcagtaagttctagccaggaaatacccacgatgcctcagcccatcgaaaaagtctccgtgtcaactcagacaaagaagttaagtgcctcttcaccaagaatgctgcatcggagcacccagaccacaaacgacggcgtgtgtcagagcatgtgccatgacaaatacaccaagatcttcaatgacttcaaagaccggatgaagtcggaccacaagcgggagacagagcgtgttgtccgagaagctctggagaagctgcgttctgaaatggaagaagaaaagagacaagctgtaaataaagctgtagccaacatgcagggtgagatggacagaaaatgtaagcaagtaaaggaaaagtgtaaggaagaatttgtagaagaaatcaagaagctggcaacacagcacaagcaactgatttctcagaccaagaagaagcagtggtgctacaactgtgaggaggaggccatgtaccactgctgctggaacacatcctactgctccatcaagtgccagcaggagcactggcacgcggagcacaagcgcacctgccgccggaaaagatgaagctggcccttcccggagtcaccccgatgattactcttttcagacacagcggtttttgtttccaagaagccaaaattgtttagaatttgcttcccattttgcaccagcctttaaacacttttcgtgaagaaattttgcacagtagtttaaatcttttgttaatgctcctccgaagtttttcagggggtaaaagtaacatcagtggagggtattattttaaataaattttaattgagaatttgttgcattttcagcaaattttaaaacatttttaggttttacagagattttaacctttaaacaacagatctttaaaaaacaggtgaatacaagtgagtttaacaaagaaacatttagaatagatctgaatgtaagaactacagaactgtttcagaaataaaacatactaccttgatgtgacatttttttcttaaccttgttgagctggttttgttcagcttaatttactgttcaaaggcattatctgttggtcacaccagtgggtatatgattgaatttagggaacagggttgacacagcagggctagtcctgcatattttttcttaaatatttcccaattgtgtttttcattatttcttttcaatatataacttttataacaaattattagctttgatcttgtagtttaaaattgcagggaactggggtaatcttttactgagctggatcttagagaaaatgaatatttaaattttaaagtttgcacatttcatctttgtcctaacatgagtgcttgtaacaaaataaacaacaaaaacaaagccaaaaactacctttatccatatgtgaaattatagatgaggcatacgaatttgtttaatgcttcccttcccttcccacatatcatctcactgcctattatctggtgtcacctcatgtatcgtaagttaatactaaaagaagagaaagcacttaagtttcacagaagccgttatgtttgtagtaatgggtcattgcctactaatgaactccatcactgtacacagaatgaagaataatgcatgttaattttcttgtattaaagatgccgtgatttgtaaaaagtctgtattttgcggaatgtctggattaagaagcattaccaataggaatggatcgatagttgaataatgattttttatacatagatatataaaatacagccaggaaaacttaaattacttttcttttaaaatatctcacaatttatgtggtatttttaaagactgatcttagaccaagtcaaattcccatttatcatttagttattttttgaggttagagaataatttgtacatatttatttagacctttgatatttattaaagcaattactcacaatggaagtgaaagaatcaggagaaaagccttttaaaaagtattctccaggtttgtcagggtcactctaaagataaaaatgtaactaagtcttctgtgaaatatcatccatctaatcttgatgctgttgcagatggtggtgacacaagttaattgacaaactactgccaaatggtgcacaatattttgtaaaaagtacccagtagccccatttcatacaatgtacctaaattatgcagtaacttggcatcatcgttccctccttgttgctgtgtaattagtcagtgttgccacagtgtgtggcgctgatggagatgtcagaaccgagaacacttaaccttctttgattgtttttcaagttttaagacttcgatccacccctatgagagcaagtaattgtggaaatatttttggtgtaaaatcattccagagtatgtaatatttaactgatagctgcatgaaagtgagattcgtgttactttggcttttctgtctctgttgacacggttgcacatttccaagttactacagcgtgaaaactgtgtgtttaaaaaaaaacaaaattaaaaaaagagattgtggcctggttttgtaaaagttttaggtaaaattacaattgattgttttaggaatcattattaaaaattttctgcaaatcataaagctatatcgaggtgttgagcttagccactatgcacattgtaattattcattgtggctgtccagttctatgatgcattctggcattttgtaagctgctctgactagcaatatatagattcatttaatgtgttaacattggttaataaatgtattt

SEQ ID NO: 3787 - DNA, 1774 bp, Homo sapiens
gtgtgtgtggatacggagtgcatgtgtggagacagaggaatatgctccaacaaatttcggatagaggcgccgaagacaggacgtggggaagctaaagaagtaaacaggtcatggcacgtttaacaaaaagacgacaggcggatacaaaagctatccagcatctttgggcagccattgagattatacggaaccagaagcagattgccaacattgaccgtattacaaagtatatgtctcgagtccacggtatgcaccctaaagagaccacccgtcagctgagcttagctgtgaaagatggtcttattgtcgaaactctaacagtgggctgcaaaggttcaaaagctggtattgaacaagaaggatattggttgccaggagatgagattagcattaagaagaagaatacaaacaaacaggagatgggcacatacctcagattcattgtctcccgcatgaaggagaggaaagtgaatgaagggaaataccgaagttatgaagagttcaaagctgatgcccaattgcttctccacaataccgtgattttctatggagcagacagtgagcaagctgacattgcgaggatgctatataaagacacatgtcatgagctggatgaactgcagctttgcaagaattgcttttacttgtcaaatgctcgtcctgacaactggttctgttatccttgtatacctaatcatgagctggtttgggctaaaatgaaaggttttgggttttggccagccaaagtcatgcagaaagaagacaatcaagtcgacgttcgcttctttggccaccaccaccagagggcctggattccttctgaaaacattcaagatatcacagtcaacattcatcggctgcacgtgaagcgcagtatgggttggaaaaaggcctgtgatgagctggagctgcatcagcgtttcctacgagaagggagattttggaaatctaagaatgaggaccgaggtgaggaagaggcagaatccagtatctcctccaccagtaatgagcagctaaaggtcactcaagaaccaagagcaaagaaaggacgacgtaatcaaagtgtggagcccaaaaaggaagaaccagagcctgaaacagaagcagtaagttctagccaggaaatacccacgatgcctcagcccatcgaaaaagtctccgtgtcaactcagacaaagaagttaagtgcctcttcaccaagaatgctgcatcggagcacccagaccacaaacgacggcgtgtgtcagagcatgtgccatgacaaatacaccaagatcttcaatgacttcaaagaccggatgaagtcggaccacaagcgggagacagagcgtgttgtccgagaagctctggagaagctgcgttctgaaatggaagaagaaaagagacaagctgtaaataaagctgtagccaacatgcagggtgagatggacagaaaatgtaagcaagtaaaggaaaagtgtaaggaagaatttgtagaagaaatcaagaagctggcaacacagcacaagcaactgatttctcagaccaagaagaagcagtggtgctacaactgtgaggaggaggccatgtaccactgctgctggaacacatcctactgctccatcaagtgccagcaggagcactggcacgcggagcacaagcgcacctgccgccggaaaagatgaagctggcccttcccggagtcaccccgatgattactcttttcagacacagcggtttttgtttccaagaagccaaaattgtttagaatttgcttcccattttgcaccagcct

SEQ ID NO: 3788 - DNA, 4393 bp, Homo sapiens; identical to SEQ ID NO: 3781

SEQ ID NO: 3789 - DNA, 1664 bp, Homo sapiens
gcggcgggaaggaggcggcaccggaggggagggccgggcgcggcggcggcggcggtggaggagccggagcataatgctaaagaagtaaacaggtcatggcacgtttaacaaaaagacgacaggcggatacaaaagctatccagcatctttgggcagccattgagattatacggaaccagaagcagattgccaacattgaccgtattacaaagtatatgtctcgagtccacggtatgcaccctaaagagaccacccgtcagctgagcttagctgtgaaagatggtcttattgtcgaaactctaacagtgggctgcaaaggttcaaaagctggtattgaacaagaaggatattggttgccaggagatgagattagcattaagaagaagaatacaaacaaacaggagatgggcacatacctcagattcattgtctcccgcatgaaggagagggctatagatcttaataaaaaggggaaggacaataaacacccgatgtacaggaggctggtgcactcagctgtggacgttcccaccattcaagagaaagtgaatgaagggaaataccgaagttatgaagagttcaaagctgatgcccaattgcttctccacaataccgtgattttctatggagcagacagtgagcaagctgacattgcgaggatgctatataaagacacatgtcatgagatacctaatcatgagctggtttgggctaaaatgaaaggttttgggttttggccagccaaagtcatgcagaaagaagacaatcaagtcgacgttcgcttctttggccaccaccaccagagggcctggattccttctgaaaacattcaagatatcacagtcaacattcatcggctgcacgtgaagcgcagtatgggttggaaaaaggcctgtgatgagctggagctgcatcagcgtttcctacgagaagggagattttggaaatctaagaatgaggaccgaggtgaggaagaggcagaatccagtatctcctccaccagtaatgagcagctaaaggtcactcaagaaccaagagcaaagaaaggacgacgtaatcaaagtgtggagcccaaaaaggaagaaccagagcctgaaacagaagcagtaagttctagccaggaaatacccacgatgcctcagcccatcgaaaaagtctccgtgtcaactcagacaaagaagttaagtgcctcttcaccaagaatgctgcatcggagcacccagaccacaaacgacggcgtgtgtcagagcatgtgccatgacaaatacaccaagatcttcaatgacttcaaagaccggatgaagtcggaccacaagcgggagacagagcgtgttgtccgagaagctctggagaagctgcgttctgaaatggaagaagaaaagagacaagctgtaaataaagctgtagccaacatgcagggtgagatggacagaaaatgtaagcaagtaaaggaaaagtgtaaggaagaatttgtagaagaaatcaagaagctggcaacacagcacaagcaactgatttctcagaccaagaagaagcagtggtgctacaactgtgaggaggaggccatgtaccactgctgctggaacacatcctactgctccatcaagtgccagcaggagcactggcacgcggagcacaagcgcacctgccgccggaaaagatga

SEQ ID NO: 3790 - DNA, 2065 bp, Homo sapiens
ccggggctgagctgcggcggcgcctgacaatgccccctcgcgccccggcctcggcgcccgctcccggctccagcgcgcctgcacgtacgtagccttcacgtgtgtgtggatacggagtgcatgtgtggagacagaggaatatgctccaacaaatttcggatagaggcgccgaagacaggacgtggggaagctaaagaagtaaacaggtcatggcacgtttaacaaaaagacgacaggcggatacaaaagctatccagcatctttgggcagccattgagattatacggaaccagaagcagattgccaacattgaccgtattacaaagtatatgtctcgagtccacggtatgcaccctaaagagaccacccgtcagctgagcttagctgtgaaagatggtcttattgtcgaaactctaacagtgggctgcaaaggttcaaaagctggtattgaacaagaaggatattggttgccaggagatgagattgactgggaaacagaaaatcatgactggtattgttttgaatgccatttgcctggagaggtgttgatatgtgacctgtgttttcgtgtgtatcattccaagtgtttgtctgatgagttcaggcttagagacagcagtagtccctggcagtgcccagtttgcaggagcattaagaagaagaatacaaacaaacaggagatgggcacatacctcagattcattgtctcccgcatgaaggagagggctatagatcttaataaaaaggggaaggacaataaacacccgatgtacaggaggctggtgcactcagctgtggacgttcccaccattcaagagaaagtgaatgaagggaaataccgaagttatgaagagttcaaagctgatgcccaattgcttctccacaataccgtgattttctatggagacagtgagcaagctgacattgcgaggatgctatataaagacacatgtcatgagctggatgaactgcagctttgcaagaattgcttttacttgtcaaatgctcgtcctgacaactggttctgttatccttgtatacctaatcatgagctggtttgggctaaaatgaaaggttttgggttttggccagccaaagtcatgcagaaagaagacaatcaagtcgacgttcgcttctttggccaccaccaccagagggcctggattccttctgaaaacattcaagatatcacagtcaacattcatcggctgcacgtgaagcgcagtatgggttggaaaaaggcctgtgatgagctggagctgcatcagcgtttcctacgagaagggagattttggaaatctaagaatgaggaccgaggtgaggaagaggcagaatccagtatctcctccaccagtaatgagcagctaaaggtcactcaagaaccaagagcaaagaaaggacgacgtaatcaaagtgtggagcccaaaaaggaagaaccagagcctgaaacagaagcagtaagttctagccaggaaatacccacgatgcctcagcccatcgaaaaagtctccgtgtcaactcagacaaagaagttaagtgcctcttcaccaagaatgctgcatcggagcacccagaccacaaacgacggcgtgtgtcagagcatgtgccatgacaaatacaccaagatcttcaatgacttcaaagaccggatgaagtcggaccacaagcgggagacagagcgtgttgtccgagaagctctggagaagctgcgttctgaaatggaagaagaaaagagacaagctgtaaataaagctgtagccaacatgcagggtgagatggacagaaaatgtaagcaagtaaaggaaaagtgtaaggaagaatttgtagaagaaatcaagaagctggcaacacagcacaagcaactgatttctcagaccaagaagaagcagtgggtaaataccagtcttttttagacccttatttctgaaaatgtaccacaggtatgatgcccgttaattcagaaggtagctgtggcacatgcagaagatgtttctgaaataagatcaaatgtgaaatggtcagctttagttttaaaaattttattaaaagtcctatgatctctcaa

SEQ ID NO: 3791 - DNA, 1427 bp, Homo sapiens
tgaaagatggtcttattgtcgaaactctaacagtgggctgcaaaggttcaaaagctggtattgaacaagaaggatattggttgccaggagatgagattagcattaagaagaagaatacaaacaaacaggagatgggcacatacctcagattcattgtctcccgcatgaaggagagggctatagatcttaataaaaaggggaaggacaataaacacccgatgtacaggaggctggtgcactcagctgtggacgttcccaccattcaagagctggatgaactgcagctttgcaagaattgcttttacttgtcaaatgctcgtcctgacaactggttctgttatccttgtatacctaatcatgagctggtttgggctaaaatgaaaggttttgggttttggccagccaaagtcatgcagaaagaagacaatcaagtcgacgttcgcttctttggccaccaccaccagagggcctggattccttctgaaaacattcaagatatcacagtcaacattcatcggctgcacgtgaagcgcagtatgggttggaaaaaggcctgtgatgagctggagctgcatcagcgtttcctacgagaagggagattttggaaatctaagaatgaggaccgaggtgaggaagaggcagaatccagtatctcctccaccagtaatgagcagctaaaggtcactcaagaaccaagagcaaagaaaggacgacgtaatcaaagtgtggagcccaaaaaggaagaaccagagcctgaaacagaagcagtaagttctagccaggaaatacccacgatgcctcagcccatcgaaaaagtctccgtgtcaactcagacaaagaagttaagtgcctcttcaccaagaatgctgcatcggagcacccagaccacaaacgacggcgtgtgtcagagcatgtgccatgacaaatacaccaagatcttcaatgacttcaaagaccggatgaagtcggaccacaagcgggagacagagcgtgttgtccgagaagctctggagaagctgcgttctgaaatggaagaagaaaagagacaagctgtaaataaagctgtagccaacatgcagggtgagatggacagaaaatgtaagcaagtaaaggaaaagtgtaaggaagaatttgtagaagaaatcaagaagctggcaacacagcacaagcaactgatttctcagaccaagaagaagcagtggtgctacaactgtgaggaggaggccatgtaccactgctgctggaacacatcctactgctccatcaagtgccagcaggagcactggcacgcggagcacaagcgcacctgccgccggaaaagatgaagctggcccttcccggagtcaccccgatgattactcttttcagacacagcggtttttgtttccaagaagccaaaattgtttagaatttgcttcccattttgc

SEQ ID NO: 3792 - DNA, 1449 bp, Homo sapiens
atgtctcgagtccacggtatgcaccctaaagagaccacccgtcagctgagcttagctgtgaaagatggtcttattgtcgaaactctaacagtgggctgcaaaggttcaaaagctggtattgaacaagaaggatattggttgccaggagatgagattagcattaagaagaagaatacaaacaaacaggagatgggcacatacctcagattcattgtctcccgcatgaaggagagggctatagatcttaataaaaaggggaaggacaataaacacccgatgtacaggaggctggtgcactcagctgtggacgttcccaccattcaagagaaagtgaatgaagggaaataccgaagttatgaagagttcaaagctgatgcccaattgcttctccacaataccgtgattttctatggagcagacagtgagcaagctgacattgcgaggatgctatataaagacacatgtcatgagatacctaatcatgagctggtttgggctaaaatgaaaggttttgggttttggccagccaaagtcatgcagaaagaagacaatcaagtcgacgttcgcttctttggccaccaccaccagagggcctggattccttctgaaaacattcaagatatcacagtcaacattcatcggctgcacgtgaagcgcagtatgggttggaaaaaggcctgtgatgagctggagctgcatcagcgtttcctacgagaagggagattttggaaatctaagaatgaggaccgaggtgaggaagaggcagaatccagtatctcctccaccagtaatgagcagctaaaggtcactcaagaaccaagagcaaagaaaggacgacgtaatcaaagtgtggagcccaaaaaggaagaaccagagcctgaaacagaagcagtaagttctagccaggaaatacccacgatgcctcagcccatcgaaaaagtctccgtgtcaactcagacaaagaagttaagtgcctcttcaccaagaatgctgcatcggagcacccagaccacaaacgacggcgtgtgtcagagcatgtgccatgacaaatacaccaagatcttcaatgacttcaaagaccggatgaagtcggaccacaagcgggagacagagcgtgttgtccgagaagctctggagaagctgcgttctgaaatggaagaagaaaagagacaagctgtaaataaagctgtagccaacatgcagggtgagatggacagaaaatgtaagcaagtaaaggaaaagtgtaaggaagaatttgtagaagaaatcaagaagctggcaacacagcacaagcaactgatttctcagaccaagaagaagcagtggtgctacaactgtgaggaggaggccatgtaccactgctgctggaacacatcctactgctccatcaagtgccagcaggagcactggcacgcggagcacaagcgcacctgccgccggaaaagatga

SEQ ID NO: 3793 - DNA, 4142 bp, Homo sapiens
cggctttacactccgatttgccggggcagccaatcggggatgagcttttattaggcggccagatcatcagccgaagtgccaaaccctttttctgtgagaactaggagcctgtcctccatgttttataagtattgacattacacagtgttaacaatgcatccacagagtcccaaatctgccagcctgttctctcttcctaactgtggaaaaatgagacggttgcttgaacatttgttggcttggctgaagaggaaataaaaacagaacaggaggtggtagagggcatggatatctctactcgctccaaagatcctggctctgcagagagaacagcccagaaaagaaagttccccagccctccacattcttccaatggccactcgccgcaggacacatcaacaagccccattaaaaagaaaaagaaacctggcttactgaacagtaacaataaggagcagtcagaactaagacatggtccgttttactatatgaagcagccactcaccacagaccctgttgatgttgtaccgcaggatggacggaatgatttctactgctgggtttgtcaccgggaaggccaagtcctttgctgtgagctctgtccccgggtttatcacgctaagtgtctgagactgacatcggaaccagagggggactggttttgtcctgaatgtgagaaaattacagtagcagaatgcatcgagacccagagtaaagccatgacaatgctcaccattgaacagttatcctacctgctcaagtttgccattcagaaaatgaaacagccagggacagatgcattccagaagcccgttccattggaacagcaccctgactatgcggaatacatcttccatccaatggacctttgtacattggaaaagaatgcgaaaaagaaaatgtatggctgcacagaagccttcctggctgatgcaaagtggattttgcacaactgcatcatttataatgggggaaatcacaaattgacgcaaatagcgaaagtagtcatcaaaatctgtgaacatgagatgaatgaaatcgaagtatgtccagaatgttatctagctgcttgccaaaaacgagataactggttttgtgagccttgtagcaatccacatcctttggtctgggccaaactgaaggggtttccattctggcctgcaaaagctctaagggataaagacgggcaggtcgatgcccgattctttggacaacatgacagggcctgggttccaataaataattgctacctcatgtctaaagaaattcctttttctgtgaaaaagactaagagcatcttcaacagtgccatgcaagagatggaggtttacgtggagaacatccgcaggaagtttggggtttttaattactctccatttaggacaccctacacacccaacagccagtatcaaatgctgctcgatcccaccaaccccagcgccggcactgccaagatagacaagcaggagaaggtcaagctcaactttgacatgacggcatcccccaagatcctgatgagcaagcctgtgctgagtgggggcacaggccgccggatttccttgtcggatatgccgcgctcccccatgagcacaaactcttctgtgcacacgggctccgacgtggagcaggatgctgagaagaaggccacgtcgagccacttcagtgcgagcgaggagtccatggacttcctggataagagcacagcttcaccagcctccaccaagacgggacaagcagggagtttatccggcagcccaaagcccttctctcctcaactgtcagctcctatcacgacgaaaacggacaaaacctccaccaccggcagcatcctgaatcttaacctgggtcatcgaagcaaagctgagatggatttgaaggagctgagcgagtcggtccagcaacagtccacccctgttcctctcatctctcccaagcgccagattcgtagcaggttccagctgaatcttgacaagaccatagagagttgcaaagcacaattaggcataaatgaaatctcggaagatgtctatacggccgtagagcacagcgattcggaggattctgagaagtcagatagtagcgatagtgagtatatcagtgatgatgagcagaagtctaagaacgagccagaagacacagaggacaaagaaggttgtcagatggacaaagagccatctgctgttaaaaaaaagcccaagcctacaaacccagtggagattaaagaggagctgaaaagcacgtcaccagccagcgagaaggcagaccctggagcagtcaaggacaaggccagccctgagcctgagaaggacttttccgaaaaggcaaaaccttcacctcaccccataaaggataaactgaagggaaaagatgagacggattccccaacagtccatttgggcctggactctgattcagagagcgaacttgtcatagatttaggagaagaccattctgggcgggagggtcgaaaaaataagaaggaacccaaagaaccatctcccaaacaggatgttgtaggtaaaactccaccatccacgacggtgggcagccattctcccccggaaacaccggtgctcacccgctcttccgcccaaacttccgcggctggcgccacagccaccaccagcacgtcctccacggtcaccgtcacggccccggcccccgccgccacaggaagcccagtgaaaaagcagaggccgcttttaccgaaggagactgccccggccgtgcagcgggtcgtgtggaactcatcaactgtccagcagaaggagatcacacagagcccatccacgtccaccatcaccctggtgaccagcacacagtcatcgcccctggtcaccagctcggggtccatgagcacccttgtgtcctcagtcaacgctgacctgcccatcgccactgcctcagctgatgtcgccgctgatattgccaagtacactagcaaaatgatggatgcaataaaaggaacaatgacagaaatatacaacgatctttctaaaaacactactggaagcacaatagctgagattcgcaggctgaggatcgagatagagaagctccagtggctgcaccagcaagagctctccgaaatgaaacacaacttagagctgaccatggcggagatgcggcagagcctggagcaggagcgggaccggctcatcgccgaggtgaagaagcagctggagttggagaagcagcaggcggtggatgagaccaagaagaagcagtggtgcgccaactgcaagaaggaggccatcttttactgctgttggaacactagctactgtgactacccctgccagcaagcccactggcctgagcacatgaagtcctgcacccagtcagctactgctcctcagcaggaagcggatgctgaggtgaacacagaaacactaaataagtcctcccaggggagctcctcgagcacacaatcagcaccttcagaaacggccagcgcctccaaagagaaggagacgtcagctgagaaaagcaaggagagtggctcgacccttgacctttctggctccagagagacgccctcctccattctcttaggctccaaccaaggctctgttagcaaaaggtgtgacaagcaacctgcctatgccccaaccaccacagaccaccagccgcaccccaactaccccgcccagaagtaccattcccggagtaataaatccagttggagcagcagtgatgagaagaggggatcgacacgttccgatcacaacaccagtaccagcacgaagagcctcctcccgaaagagtctcggctggacaccttctgggactagcagtgaatcgggacacaaaccacccaccccattgggagaaaaacccagacgccaggaaaagaagaaacaacaaaggcaggagaacagccactttcagacttgaaaatgacaaaaccctcagttgagcctgagcccccggcgcgggggctgctacactacaggacacccagcatcggctttgactgcagactgttcacccacacgagccctgtgcttttggtgtaaataatgtacaatttgtggatgtcattgaatctagaggactttcccctttttatatttgtattaactttaacttattaaaaaaaaaaaaagaaaaagaaaaacgatttaaaaaaaaaaaaaaaa

SEQ ID NO: 3794 - DNA, 5362 bp, Homo sapiens
ggagtgtagaggaaataaaatcatgtctgtggctcatgacagcattccatattcagttgttgggttgtgttgttgttgttgtgtgtgtttttaataataccatgtaactgtttaaaaaaatttcctttttgatcaagtcccaaatctgccagcctgttctctcttcctaactgtggaaaaatgagacggttgcttgaacatttgttggcttggctgaagaggaaataaaaacagaacaggaggtggtagagggcatggatatctctactcgctccaaagatcctggctctgcagagagaacagcccagaaaagaaagttccccagccctccacattcttccaatggccactcgccgcaggacacatcaacaagccccattaaaaagaaaaagaaacctggcttactgaacagtaacaataaggagcagtcagaactaagacatggtccgttttactatatgaagcagccactcaccacagaccctgttgatgttgtaccgcaggatggacggaatgatttctactgctgggtttgtcaccgggaaggccaagtcctttgctgtgagctctgtccccgggtttatcacgctaagtgtctgagactgacatcggaaccagagggggactggttttgtcctgaatgtgagaaaattacagtagcagaatgcatcgagacccagagtaaagccatgacaatgctcaccattgaacagttatcctacctgctcaagtttgccattcagaaaatgaaacagccagggacagatgcattccagaagcccgttccattggaacagcaccctgactatgcggaatacatcttccatccaatggacctttgtacattggaaaagaatgcgaaaaagaaaatgtatggctgcacagaagccttcctggctgatgcaaagtggattttgcacaactgcatcatttataatgggggaaatcacaaattgacgcaaatagcgaaagtagtcatcaaaatctgtgaacatgagatgaatgaaatcgaagtatgtccagaatgttatctagctgcttgccaaaaacgagataactggttttgtgagccttgtagcaatccacatcctttggtctgggccaaactgaaggggtttccattctggcctgcaaaagctctaagggataaagacgggcaggtcgatgcccgattctttggacaacatgacagggcctgggttccaataaataattgctacctcatgtctaaagaaattcctttttctgtgaaaaagactaagagcatcttcaacagtgccatgcaagagatggaggtttacgtggagaacatccgcaggaagtttggggtttttaattactctccatttaggacaccctacacacccaacagccagtatcaaatgctgctcgatcccaccaaccccagcgccggcactgccaagatagacaagcaggagaaggtcaagctcaactttgacatgacggcatcccccaagatcctgatgagcaagcctgtgctgagtgggggcacaggccgccggatttccttgtcggatatgccgcgctcccccatgagcacaaactcttctgtgcacacgggctccgacgtggagcaggatgctgagaagaaggccacgtcgagccacttcagtgcgagcgaggagtccatggacttcctggataagagcacagcttcaccagcctccaccaagacgggacaagcagggagtttatccggcagcccaaagcccttctctcctcaactgtcagctcctatcacgacgaaaacggacaaaacctccaccaccggcagcatcctgaatcttaacctggatcgaagcaaagctgagatggatttgaaggagctgagcgagtcggtccagcaacagtccacccctgttcctctcatctctcccaagcgccagattcgtagcaggttccagctgaatcttgacaagaccatagagagttgcaaagcacaattaggcataaatgaaatctcggaagatgtctatacggccgtagagcacagcgattcggaggattctgagaagtcagatagtagcgatagtgagtatatcagtgatgatgagcagaagtctaagaacgagccagaagacacagaggacaaagaaggttgtcagatggacaaagagccatctgctgttaaaaaaaagcccaagcctacaaacccagtggagattaaagaggagctgaaaagcacgtcaccagccagcgagaaggcagaccctggagcagtcaaggacaaggccagccctgagcctgagaaggacttttccgaaaaggcaaaaccttcacctcaccccataaaggataaactgaagggaaaagatgagacggattccccaacagtccatttgggcctggactctgattcagagagcgaacttgtcatagatttaggagaagaccattctgggcgggagggtcgaaaaaataagaaggaacccaaagaaccatctcccaaacaggatgttgtaggtaaaactccaccatccacgacggtgggcagccattctcccccggaaacaccggtgctcacccgctcttccgcccaaacttccgcggctggcgccacagccaccaccagcacgtcctccacggtcaccgtcacggccccggcccccgccgccacaggaagcccagtgaaaaagcagaggccgcttttaccgaaggagactgccccggccgtgcagcgggtcgtgtggaactcatcaagtaagtttcaaacgtcctcccaaaagtggcacatgcagaagatgcagcgtcagcagcagcagcagcagcagcaaaaccagcagcagcagcctcagtcttcccaggggacgagatatcagaccagacaggctgtgaaagctgtccagcagaaggagatcacacagagcccatccacgtccaccatcaccctggtgaccagcacacagtcatcgcccctggtcaccagctcggggtccatgagcacccttgtgtcctcagtcaacgctgacctgcccatcgccactgcctcagctgatgtcgccgctgatattgccaagtacactagcaaaatgatggatgcaataaaaggaacaatgacagaaatatacaacgatctttctaaaaacactactggaagcacaatagctgagattcgcaggctgaggatcgagatagagaagctccagtggctgcaccagcaagagctctccgaaatgaaacacaacttagagctgaccatggcggagatgcggcagagcctggagcaggagcgggaccggctcatcgccgaggtgaagaagcagctggagttggagaagcagcaggcggtggatgagaccaagaagaagcagtggtgcgccaactgcaagaaggaggccatcttttactgctgttggaacactagctactgtgactacccctgccagcaagcccactggcctgagcacatgaagtcctgcacccagtcagctactgctcctcagcaggaagcggatgctgaggtgaacacagaaacactaaataagtcctcccaggggagctcctcgagcacacaatcagcaccttcagaaacggccagcgcctccaaagagaaggagacgtcagctgagaaaagcaaggagagtggctcgacccttgacctttctggctccagagagacgccctcctccattctcttaggctccaaccaaggctctgaccattcccggagtaataaatccagttggagcagcagtgatgagaagaggggatcgacacgttccgatcacaacaccagtaccagcacgaagagcctcctcccgaaagagtctcggctggacaccttctgggactagcagtgaatcgggacacaaaccacccaccccattgggagaaaaacccagacgccaggaaaagaagaaacaacaaaggcaggagaacagccactttcagacttgaaaatgacaaaaccctcagttgagcctgagcccccggcgcgggggctgctacactacaggacacccagcatcggctttgactgcagactgttcacccacacgagccctgtgcttttggtgtaaataatgtacaatttgtggatgtcattgaatctagaggactttcccctttttatatttgtattaactttaacttattaaaaaaaaaaaaagaaaaagaaaaacgatttaaaaaaaaaaaaaaaagcaaccaaccccaacaacaaaaaagaatgttttggtattggagaagggatggtcagttagcctgtctgtcacacgacggaatggatactgggcccggggaccactttcatactcacgtcctcatccttggatacccaggggagggcgaaccgttttcgctcgtgtgtctgtacgcagcatgttgggatcgggagtttcggcacagactatcccatcaagccgttggctcctttcagctactacgttaccacgttcctaaaacgcaagctctccggaccagacggacacagggagaagctagtttctttcatgtgattgaaatgatgactctactcctaaaagggaaaaaacaatatccttgtttacagaagagaaacaaacaagccccactcagctcagtcacaggagagaacacagaaagtcttaggatcatgaactctgaaaaaaagagaaaccttatctttgctttgtggttcctttaaacacactcacacacacttggtcagagatgctgtgcttcttggaagcaaggactcaaaggcaaggtgcacgcagaggacgtttgagtctgggatgaagcatgtacgtattatttatatgatggaatttcacgtttttatgtaagcatgaaacacaggcagtatgagagaaagcaaggcccgtcatgctgtccgtacactacgtatgctgtagagccattttgtatgttgtgtaaaacaaaaagcattgatgaaaaagcaaaaggtgatgtatgtatatgagaaaattaattgtacgatatcattccagtacgttttgttgtacattttagtcttgtttactttctcttcattgttaagaggatgcgaactgtacagtttccagctagttacccatattagagaagaaataagagagtattagaagaaaacaggagagaaagaacatttgtgaattgcagttgtcaaaaaaaaaaaatagcctagctggccttatttgtgaagcataattgcttttagcatatggaagtattttttcacattttctttgtataaaatttgtattaaacttaaatatctttttgatggtggtgtttctttgtgactgagccagtagactcacactatatgcttttttgggtttgcccgttccttcccccacccccccagttttttcagatttctttacctttttttaattaaactgttttggaaaaatgc

SEQ ID NO: 3795 - DNA, 3832 bp, Homo sapiens
ataagtattgacattacacagtgttaacaatgcatccacagagcttggctgaagaggaaataaaaacagaacaggaggtggtagagggcatggatatctctactcgctccaaagatcctggctctgcagagagaacagcccagaaaagaaagttccccagccctccacattcttccaatggccactcgccgcaggacacatcaacaagccccattaaaaagaaaaagaaacctggcttactgaacagtaacaataaggagcagtcagaactaagacatggtccgttttactatatgaagcagccactcaccacagaccctgttgatgttgtaccgcaggatggacggaatgatttctactgctgggtttgtcaccgggaaggccaagtcctttgctgtgagctctgtccccgggtttatcacgctaagtgtctgagactgacatcggaaccagagggggactggttttgtcctgaatgtgagaaaattacagtagcagaatgcatcgagacccagagtaaagccatgacaatgctcaccattgaacagttatcctacctgctcaagtttgccattcagaaaatgaaacagccagggacagatgcattccagaagcccgttccattggaacagcaccctgactatgcggaatacatcttccatccaatggacctttgtacattggaaaagaatgcgaaaaagaaaatgtatggctgcacagaagccttcctggctgatgcaaagtggattttgcacaactgcatcatttataatgggggaaatcacaaattgacgcaaatagcgaaagtagtcatcaaaatctgtgaacatgagatgaatgaaatcgaagtatgtccagaatgttatctagctgcttgccaaaaacgagataactggttttgtgagccttgtagcaatccacatcctttggtctgggccaaactgaaggggtttccattctggcctgcaaaagctctaagggataaagacgggcaggtcgatgcccgattctttggacaacatgacagggcctgggttccaataaataattgctacctcatgtctaaagaaattcctttttctgtgaaaaagactaagagcatcttcaacagtgccatgcaagagatggaggtttacgtggagaacatccgcaggaagtttggggtttttaattactctccatttaggacaccctacacacccaacagccagtatcaaatgctgctcgatcccaccaaccccagcgccggcactgccaagatagacaagcaggagaaggtcaagctcaactttgacatgacggcatcccccaagatcctgatgagcaagcctgtgctgagtgggggcacaggccgccggatttccttgtcggatatgccgcgctcccccatgagcacaaactcttctgtgcacacgggctccgacgtggagcaggatgctgagaagaaggccacgtcgagccacttcagtgcgagcgaggagtccatggacttcctggataagagcacagcttcaccagcctccaccaagacgggacaagcagggagtttatccggcagcccaaagcccttctctcctcaactgtcagctcctatcacgacgaaaacggacaaaacctccaccaccggcagcatcctgaatcttaacctggatcgaagcaaagctgagatggatttgaaggagctgagcgagtcggtccagcaacagtccacccctgttcctctcatctctcccaagcgccagattcgtagcaggttccagctgaatcttgacaagaccatagagagttgcaaagcacaattaggcataaatgaaatctcggaagatgtctatacggccgtagagcacagcgattcggaggattctgagaagtcagatagtagcgatagtgagtatatcagtgatgatgagcagaagtctaagaacgagccagaagacacagaggacaaagaaggttgtcagatggacaaagagccatctgctgttaaaaaaaagcccaagcctacaaacccagtggagattaaagaggagctgaaaagcacgtcaccagccagcgagaaggcagaccctggagcagtcaaggacaaggccagccctgagcctgagaaggacttttccgaaaaggcaaaaccttcacctcaccccataaaggataaactgaagggaaaagatgagacggattccccaacagtccatttgggcctggactctgattcagagagcgaacttgtcatagatttaggagaagaccattctgggcgggagggtcgaaaaaataagaaggaacccaaagaaccatctcccaaacaggatgttgtaggtaaaactccaccatccacgacggtgggcagccattctcccccggaaacaccggtgctcacccgctcttccgcccaaacttccgcggctggcgccacagccaccaccagcacgtcctccacggtcaccgtcacggccccggcccccgccgccacaggaagcccagtgaaaaagcagaggccgcttttaccgaaggagactgccccggccgtgcagcgggtcgtgtggaactcatcaactgtccagcagaaggagatcacacagagcccatccacgtccaccatcaccctggtgaccagcacacagtcatcgcccctggtcaccagctcggggtccatgagcacccttgtgtcctcagtcaacgctgacctgcccatcgccactgcctcagctgatgtcgccgctgatattgccaagtacactagcaaaatgatggatgcaataaaaggaacaatgacagaaatatacaacgatctttctaaaaacactactggaagcacaatagctgagattcgcaggctgaggatcgagatagagaagctccagtggctgcaccagcaagagctctccgaaatgaaacacaacttagagctgaccatggcggagatgcggcagagcctggagcaggagcgggaccggctcatcgccgaggtgaagaagcagctggagttggagaagcagcaggcggtggatgagaccaagaagaagcagtggtgcgccaactgcaagaaggaggccatcttttactgctgttggaacactagctactgtgactacccctgccagcaagcccactggcctgagcacatgaagtcctgcacccagtcagctactgctcctcagcaggaagcggatgctgaggtgaacacagaaacactaaataagtcctcccaggggagctcctcgagcacacaatcagcaccttcagaaacggccagcgcctccaaagagaaggagacgtcagctgagaaaagcaaggagagtggctcgacccttgacctttctggctccagagagacgccctcctccattctcttaggctccaaccaaggctctgaccattcccggagtaataaatccagttggagcagcagtgatgagaagaggggatcgacacgttccgatcacaacaccagtaccagcacgaagagcctcctcccgaaagagtctcggctggacaccttctgggactagcagtgaatcgggacacaaaccacccaccccattgggagaaaaacccagacgccaggaaaagaagaaacaacaaaggcaggagaacagccactttcagacttgaaaatgacaaaaccctcagttgagcctgagcccccggcgcgggggctgctacactacaggacacccagcatcggctttgactgcagactgttcacccacacgagccctgtgcttttggtgtaaataatgtacaatttgtggatgtcattgaatctagaggactttcccctttttatatttgtattaactttaacttattaaaaaaaaaaaaagaaaaa

SEQ ID NO: 3796 - DNA, 3861 bp, Homo sapiens
ataagtattgacattacacagtgttaacaatgcatccacagagtcccaaatctgccagcctgttctctcttcctaactgtggaaaaatgagacggttgcttgaacatttgttggcttggctgaagaggaaataaaaacagaacaggaggtggtagagggcatggatatctctactcgctccaaagatcctggctctgcagagagaacagcccagaaaagaaagttccccagccctccacattcttccaatggccactcgccgcaggacacatcaacaagccccattaaaaagaaaaagaaacctggcttactgaacagtaacaataaggagcagtcagaactaagacatggtccgttttactatatgaagcagccactcaccacagaccctgttgatgttgtaccgcaggatggacggaatgatttctactgctgggtttgtcaccgggaaggccaagtcctttgctgtgagctctgtccccgggtttatcacgctaagtgtctgagactgacatcggaaccagagggggactggttttgtcctgaatgtgagaaaattacagtagcagaatgcatcgagacccagagtaaagccatgacaatgctcaccattgaacagttatcctacctgctcaagtttgccattcagaaaatgaaacagccagggacagatgcattccagaagcccgttccattggaacagcaccctgactatgcggaatacatcttccatccaatggacctttgtacattggaaaagaatgcgaaaaagaaaatgtatggctgcacagaagccttcctggctgatgcaaagtggattttgcacaactgcatcatttataatgggggaaatcacaaattgacgcaaatagcgaaagtagtcatcaaaatctgtgaacatgagatgaatgaaatcgaagtatgtccagaatgttatctagctgcttgccaaaaacgagataactggttttgtgagccttgtagcaatccacatcctttggtctgggccaaactgaaggggtttccattctggcctgcaaaagctctaagggataaagacgggcaggtcgatgcccgattctttggacaacatgacagggcctgggttccaataaataattgctacctcatgtctaaagaaattcctttttctgtgaaaaagactaagagcatcttcaacagtgccatgcaagagatggaggtttacgtggagaacatccgcaggaagtttggggtttttaattactctccatttaggacaccctacacacccaacagccagtatcaaatgctgctcgatcccaccaaccccagcgccggcactgccaagatagacaagcaggagaaggtcaagctcaactttgacatgacggcatcccccaagatcctgatgagcaagcctgtgctgagtgggggcacaggccgccggatttccttgtcggatatgccgcgctcccccatgagcacaaactcttctgtgcacacgggctccgacgtggagcaggatgctgagaagaaggccacgtcgagccacttcagtgcgagcgaggagtccatggacttcctggataagagcacagcttcaccagcctccaccaagacgggacaagcagggagtttatccggcagcccaaagcccttctctcctcaactgtcagctcctatcacgacgaaaacggacaaaacctccaccaccggcagcatcctgaatcttaacctggatcgaagcaaagctgagatggatttgaaggagctgagcgagtcggtccagcaacagtccacccctgttcctctcatctctcccaagcgccagattcgtagcaggttccagctgaatcttgacaagaccatagagagttgcaaagcacaattaggcataaatgaaatctcggaagatgtctatacggccgtagagcacagcgattcggaggattctgagaagtcagatagtagcgatagtgagtatatcagtgatgatgagcagaagtctaagaacgagccagaagacacagaggacaaagaaggttgtcagatggacaaagagccatctgctgttaaaaaaaagcccaagcctacaaacccagtggagattaaagaggagctgaaaagcacgtcaccagccagcgagaaggcagaccctggagcagtcaaggacaaggccagccctgagcctgagaaggacttttccgaaaaggcaaaaccttcacctcaccccataaaggataaactgaagggaaaagatgagacggattccccaacagtccatttgggcctggactctgattcagagagcgaacttgtcatagatttaggagaagaccattctgggcgggagggtcgaaaaaataagaaggaacccaaagaaccatctcccaaacaggatgttgtaggtaaaactccaccatccacgacggtgggcagccattctcccccggaaacaccggtgctcacccgctcttccgcccaaacttccgcggctggcgccacagccaccaccagcacgtcctccacggtcaccgtcacggccccggcccccgccgccacaggaagcccagtgaaaaagcagaggccgcttttaccgaaggagactgccccggccgtgcagcgggtcgtgtggaactcatcaagtaagtttcaaacgtcctcccaaaagtggcacatgcagaagatgcagcgtcagcagcagcagcagcagcagcaaaaccagcagcagcagcctcagtcttcccaggggacgagatatcagaccagacaggctgtgaaagctgtccagcagaaggagatcacacagagcccatccacgtccaccatcaccctggtgaccagcacacagtcatcgcccctggtcaccagctcggggtccatgagcacccttgtgtcctcagtcaacgctgacctgcccatcgccactgcctcagctgatgtcgccgctgatattgccaagtacactagcaaaatgatggatgcaataaaaggaacaatgacagaaatatacaacgatctttctaaaaacactactggaagcacaatagctgagattcgcaggctgaggatcgagatagagaagctccagtggctgcaccagcaagagctctccgaaatgaaacacaacttagagctgaccatggcggagatgcggcagagcctggagcaggagcgggaccggctcatcgccgaggtgaagaagcagctggagttggagaagcagcaggcggtggatgagaccaagaagaagcagtggtgcgccaactgcaagaaggaggccatcttttactgctgttggaacactagctactgtgactacccctgccagcaagcccactggcctgagcacatgaagtcctgcacccagtcagctactgctcctcagcaggaagcggatgctgaggtgaacacagaaacactaaataagtcctcccaggggagctcctcgagcacacaatcagcaccttcagaaacggccagcgcctccaaagagaaggagacgtcagctgagaaaagcaaggagagtggctcgacccttgacctttctggctccagagagacgccctcctccattctcttaggctccaaccaaggctctgttagcaaaaggtgtgacaagcaacctgcctatgccccaaccaccacagaccaccagccgcaccccaactaccccgcccagaagtaccattcccggagtaataaatccagttggagcagcagtgatgagaagaggggatcgacacgttccgatcacaacaccagtaccagcacgaagagcctcctcccgaaagagtctcggctggacaccttctgggactagcagtgaatcgggacacaaaccacccaccccattgggagaaaaacccagacgccagg

SEQ ID NO: 3797 - DNA, 4991 bp, Homo sapiens
atgttttataagtattgacattacacagtgttaacaatgcatccacagagcttggctgaagaggaaataaaaacagaacaggaggtggtagagggcatggatatctctactcgctccaaagatcctggctctgcagagagaacagcccagaaaagaaagttccccagccctccacattcttccaatggccactcgccgcaggacacatcaacaagccccattaaaaagaaaaagaaacctggcttactgaacagtaacaataaggagcaggatggacggaatgatttctactgctgggtttgtcaccgggaaggccaagtcctttgctgtgagctctgtccccgggtttatcacgctaagtgtctgagactgacatcggaaccagagggggactggttttgtcctgaatgtgagaaaattacagtagcagaatgcatcgagacccagagtaaagccatgacaatgctcaccattgaacagttatcctacctgctcaagtttgccattcagaaaatgaaacagccagggacagatgcattccagaagcccgttccattggaacagcaccctgactatgcggaatacatcttccatccaatggacctttgtacattggaaaagaatgcgaaaaagaaaatgtatggctgcacagaagccttcctggctgatgcaaagtggattttgcacaactgcatcatttataatgggggaaatcacaaattgacgcaaatagcgaaagtagtcatcaaaatctgtgaacatgagatgaatgaaatcgaagtatgtccagaatgttatctagctgcttgccaaaaacgagataactggttttgtgagccttgtagcaatccacatcctttggtctgggccaaactgaaggggtttccattctggcctgcaaaagctctaagggataaagacgggcaggtcgatgcccgattctttggacaacatgacagggcctgggttccaataaataattgctacctcatgtctaaagaaattcctttttctgtgaaaaagactaagagcatcttcaacagtgccatgcaagagatggaggtttacgtggagaacatccgcaggaagtttggggtttttaattactctccatttaggacaccctacacacccaacagccagtatcaaatgctgctcgatcccaccaaccccagcgccggcactgccaagatagacaagcaggagaaggtcaagctcaactttgacatgacggcatcccccaagatcctgatgagcaagcctgtgctgagtgggggcacaggccgccggatttccttgtcggatatgccgcgctcccccatgagcacaaactcttctgtgcacacgggctccgacgtggagcaggatgctgagaagaaggccacgtcgagccacttcagtgcgagcgaggagtccatggacttcctggataagagcacagcttcaccagcctccaccaagacgggacaagcagggagtttatccggcagcccaaagcccttctctcctcaactgtcagctcctatcacgacgaaaacggacaaaacctccaccaccggcagcatcctgaatcttaacctggatcgaagcaaagctgagatggatttgaaggagctgagcgagtcggtccagcaacagtccacccctgttcctctcatctctcccaagcgccagattcgtagcaggttccagctgaatcttgacaagaccatagagagttgcaaagcacaattaggcataaatgaaatctcggaagatgtctatacggccgtagagcacagcgattcggaggattctgagaagtcagatagtagcgatagtgagtatatcagtgatgatgagcagaagtctaagaacgagccagaagacacagaggacaaagaaggttgtcagatggacaaagagccatctgctgttaaaaaaaagcccaagcctacaaacccagtggagattaaagaggagctgaaaagcacgtcaccagccagcgagaaggcagaccctggagcagtcaaggacaaggccagccctgagcctgagaaggacttttccgaaaaggcaaaaccttcacctcaccccataaaggataaactgaagggaaaagatgagacggattccccaacagtccatttgggcctggactctgattcagagagcgaacttgtcatagatttaggagaagaccattctgggcgggagggtcgaaaaaataagaaggaacccaaagaaccatctcccaaacaggatgttgtaggtaaaactccaccatccacgacggtgggcagccattctcccccggaaacaccggtgctcacccgctcttccgcccaaacttccgcggctggcgccacagccaccaccagcacgtcctccacggtcaccgtcacggccccggcccccgccgccacaggaagcccagtgaaaaagcagaggccgcttttaccgaaggagactgccccggccgtgcagcgggtcgtgtggaactcatcaactgtccagcagaaggagatcacacagagcccatccacgtccaccatcaccctggtgaccagcacacagtcatcgcccctggtcaccagctcggggtccatgagcacccttgtgtcctcagtcaacgctgacctgcccatcgccactgcctcagctgatgtcgccgctgatattgccaagtacactagcaaaatgatggatgcaataaaaggaacaatgacagaaatatacaacgatctttctaaaaacactactggaagcacaatagctgagattcgcaggctgaggatcgagatagagaagctccagtggctgcaccagcaagagctctccgaaatgaaacacaacttagagctgaccatggcggagatgcggcagagcctggagcaggagcgggaccggctcatcgccgaggtgaagaagcagctggagttggagaagcagcaggcggtggatgagaccaagaagaagcagtggtgcgccaactgcaagaaggaggccatcttttactgctgttggaacactagctactgtgactacccctgccagcaagcccactggcctgagcacatgaagtcctgcacccagtcagctactgctcctcagcaggaagcggatgctgaggtgaacacagaaacactaaataagtcctcccaggggagctcctcgagcacacaatcagcaccttcagaaacggccagcgcctccaaagagaaggagacgtcagctgagaaaagcaaggagagtggctcgacccttgacctttctggctccagagagacgccctcctccattctcttaggctccaaccaaggctctgaccattcccggagtaataaatccagttggagcagcagtgatgagaagaggggatcgacacgttccgatcacaacaccagtaccagcacgaagagcctcctcccgaaagagtctcggctggacaccttctgggactagcagtgaatcgggacacaaaccacccaccccattgggagaaaaacccagacgccaggaaaagaagaaacaacaaaggcaggagaacagccactttcagacttgaaaatgacaaaaccctcagttgagcctgagcccccggcgcgggggctgctacactacaggacacccagcatcggctttgactgcagactgttcacccacacgagccctgtgcttttggtgtaaataatgtacaatttgtggatgtcattgaatctagaggactttcccctttttatatttgtattaactttaacttattaaaaaaaaaaaaagaaaaagaaaaacgatttaaaaaaaaaaaaaaaagcaaccaaccccaacaacaaaaaagaatgttttggtattggagaagggatggtcagttagcctgtctgtcacacgacggaatggatactgggcccggggaccactttcatactcacgtcctcatccttggatacccaggggagggcgaaccgttttcgctcgtgtgtctgtacgcagcatgttgggatcgggagtttcggcacagactatcccatcaagccgttggctcctttcagctactacgttaccacgttcctaaaacgcaagctctccggaccagacggacacagggagaagctagtttctttcatgtgattgaaatgatgactctactcctaaaagggaaaaaacaatatccttgtttacagaagagaaacaaacaagccccactcagctcagtcacaggagagaacacagaaagtcttaggatcatgaactctgaaaaaaagagaaaccttatctttgctttgtggttcctttaaacacactcacacacacttggtcagagatgctgtgcttcttggaagcaaggactcaaaggcaaggtgcacgcagaggacgtttgagtctgggatgaagcatgtacgtattatttatatgatggaatttcacgtttttatgtaagcatgaaacacaggcagtatgagagaaagcaaggcccgtcatgctgtccgtacactacgtatgctgtagagccattttgtatgttgtgtaaaacaaaaagcattgatgaaaaagcaaaaggtgatgtatgtatatgagaaaattaattgtacgatatcattccagtacgttttgttgtacattttagtcttgtttactttctcttcattgttaagaggatgcgaactgtacagtttccagctagttacccatattagagaagaaataagagagtattagaagaaaacaggagagaaagaacatttgtgaattgcagttgtcaaaaaaaaaaaatagcctagctggccttatttgtgaagcataattgcttttagcatatggaagtattttttcacattttctttgtataaaatttgtattaaacttaaatatctttttgatggtggtgtttctttgtgactgagccagtagactcacactatatgcttttttgggtttgcccgttccttcccccacccccccagttttttcagatttctttacctttttttaattaaactgttttggaaaaatgc

SEQ ID NO: 3798 - DNA, 3411 bp, Homo sapiens
atgcatccacagagcttggctgaagaggaaataaaaacagaacaggaggtggtagagggcatggatatctctactcgctccaaagatcctggctctgcagagagaacagcccagaaaagaaagttccccagccctccacattcttccaatggccactcgccgcaggacacatcaacaagccccattaaaaagaaaaagaaacctggcttactgaacagtaacaataaggagcaggatggacggaatgatttctactgctgggtttgtcaccgggaaggccaagtcctttgctgtgagctctgtccccgggtttatcacgctaagtgtctgagactgacatcggaaccagagggggactggttttgtcctgaatgtgagaaaattacagtagcagaatgcatcgagacccagagtaaagccatgacaatgctcaccattgaacagttatcctacctgctcaagtttgccattcagaaaatgaaacagccagggacagatgcattccagaagcccgttccattggaacagcaccctgactatgcggaatacatcttccatccaatggacctttgtacattggaaaagaatgcgaaaaagaaaatgtatggctgcacagaagccttcctggctgatgcaaagtggattttgcacaactgcatcatttataatgggggaaatcacaaattgacgcaaatagcgaaagtagtcatcaaaatctgtgaacatgagatgaatgaaatcgaagtatgtccagaatgttatctagctgcttgccaaaaacgagataactggttttgtgagccttgtagcaatccacatcctttggtctgggccaaactgaaggggtttccattctggcctgcaaaagctctaagggataaagacgggcaggtcgatgcccgattctttggacaacatgacagggcctgggttccaataaataattgctacctcatgtctaaagaaattcctttttctgtgaaaaagactaagagcatcttcaacagtgccatgcaagagatggaggtttacgtggagaacatccgcaggaagtttggggtttttaattactctccatttaggacaccctacacacccaacagccagtatcaaatgctgctcgatcccaccaaccccagcgccggcactgccaagatagacaagcaggagaaggtcaagctcaactttgacatgacggcatcccccaagatcctgatgagcaagcctgtgctgagtgggggcacaggccgccggatttccttgtcggatatgccgcgctcccccatgagcacaaactcttctgtgcacacgggctccgacgtggagcaggatgctgagaagaaggccacgtcgagccacttcagtgcgagcgaggagtccatggacttcctggataagagcacagcttcaccagcctccaccaagacgggacaagcagggagtttatccggcagcccaaagcccttctctcctcaactgtcagctcctatcacgacgaaaacggacaaaacctccaccaccggcagcatcctgaatcttaacctggatcgaagcaaagctgagatggatttgaaggagctgagcgagtcggtccagcaacagtccacccctgttcctctcatctctcccaagcgccagattcgtagcaggttccagctgaatcttgacaagaccatagagagttgcaaagcacaattaggcataaatgaaatctcggaagatgtctatacggccgtagagcacagcgattcggaggattctgagaagtcagatagtagcgatagtgagtatatcagtgatgatgagcagaagtctaagaacgagccagaagacacagaggacaaagaaggttgtcagatggacaaagagccatctgctgttaaaaaaaagcccaagcctacaaacccagtggagattaaagaggagctgaaaagcacgtcaccagccagcgagaaggcagaccctggagcagtcaaggacaaggccagccctgagcctgagaaggacttttccgaaaaggcaaaaccttcacctcaccccataaaggataaactgaagggaaaagatgagacggattccccaacagtccatttgggcctggactctgattcagagagcgaacttgtcatagatttaggagaagaccattctgggcgggagggtcgaaaaaataagaaggaacccaaagaaccatctcccaaacaggatgttgtaggtaaaactccaccatccacgacggtgggcagccattctcccccggaaacaccggtgctcacccgctcttccgcccaaacttccgcggctggcgccacagccaccaccagcacgtcctccacggtcaccgtcacggccccggcccccgccgccacaggaagcccagtgaaaaagcagaggccgcttttaccgaaggagactgccccggccgtgcagcgggtcgtgtggaactcatcaactgtccagcagaaggagatcacacagagcccatccacgtccaccatcaccctggtgaccagcacacagtcatcgcccctggtcaccagctcggggtccatgagcacccttgtgtcctcagtcaacgctgacctgcccatcgccactgcctcagctgatgtcgccgctgatattgccaagtacactagcaaaattcgcaggctgaggatcgagatagagaagctccagtggctgcaccagcaagagctctccgaaatgaaacacaacttagagctgaccatggcggagatgcggcagagcctggagcaggagcgggaccggctcatcgccgaggtgaagaagcagctggagttggagaagcagcaggcggtggatgagaccaagaagaagcagtggtgcgccaactgcaagaaggaggccatcttttactgctgttggaacactagctactgtgactacccctgccagcaagcccactggcctgagcacatgaagtcctgcacccagtcagctactgctcctcagcaggaagcggatgctgaggtgaacacagaaacactaaataagtcctcccaggggagctcctcgagcacacaatcagcaccttcagaaacggccagcgcctccaaagagaaggagacgtcagctgagaaaagcaaggagagtggctcgacccttgacctttctggctccagagagacgccctcctccattctcttaggctccaaccaaggctctgttagcaaaaggtgtgacaagcaacctgcctatgccccaaccaccacagaccaccagccgcaccccaactaccccgcccagaagtaccattcccggagtaataaatccagttggagcagcagtgatgagaagaggggatcgacacgttccgatcacaacaccagtaccagcacgaagagcctcctcccgaaagagtctcggctggacaccttctgggactag

SEQ ID NO: 3799 - DNA, 4075 bp, Homo sapiens
ataagtattgacattacacagtgttaacaatgcatccacagagtcccaaatctgccagcctgttctctcttcctaactgtggaaaaatgagacggttgcttgaacatttgttggcagcattcctgcctgaagtattcagctcctctaggctgttacaagccaaataatggttcccttgaatgcagccttcctccatgatcaatacacctttgaatgttttcatcgctgcagaaatccttcaacttggctgaagaggaaataaaaacagaacaggaggtggtagagggcatggatatctctactcgctccaaagatcctggctctgcagagagaacagcccagaaaagaaagttccccagccctccacattcttccaatggccactcgccgcaggacacatcaacaagccccattaaaaagaaaaagaaacctggcttactgaacagtaacaataaggagcaggatggacggaatgatttctactgctgggtttgtcaccgggaaggccaagtcctttgctgtgagctctgtccccgggtttatcacgctaagtgtctgagactgacatcggaaccagagggggactggttttgtcctgaatgtgagaaaattacagtagcagaatgcatcgagacccagagtaaagccatgacaatgctcaccattgaacagttatcctacctgctcaagtttgccattcagaaaatgaaacagccagggacagatgcattccagaagcccgttccattggaacagcaccctgactatgcggaatacatcttccatccaatggacctttgtacattggaaaagaatgcgaaaaagaaaatgtatggctgcacagaagccttcctggctgatgcaaagtggattttgcacaactgcatcatttataatgggggaaatcacaaattgacgcaaatagcgaaagtagtcatcaaaatctgtgaacatgagatgaatgaaatcgaagtatgtccagaatgttatctagctgcttgccaaaaacgagataactggttttgtgagccttgtagcaatccacatcctttggtctgggccaaactgaaggggtttccattctggcctgcaaaagctctaagggataaagacgggcaggtcgatgcccgattctttggacaacatgacagggcctgggttccaataaataattgctacctcatgtctaaagaaattcctttttctgtgaaaaagactaagagcatcttcaacagtgccatgcaagagatggaggtttacgtggagaacatccgcaggaagtttggggtttttaattactctccatttaggacaccctacacacccaacagccagtatcaaatgctgctcgatcccaccaaccccagcgccggcactgccaagatagacaagcaggagaaggtcaagctcaactttgacatgacggcatcccccaagatcctgatgagcaagcctgtgctgagtgggggcacaggccgccggatttccttgtcggatatgccgcgctcccccatgagcacaaactcttctgtgcacacgggctccgacgtggagcaggatgctgagaagaaggccacgtcgagccacttcagtgcgagcgaggagtccatggacttcctggataagagcacagcttcaccagcctccaccaagacgggacaagcagggagtttatccggcagcccaaagcccttctctcctcaactgtcagctcctatcacgacgaaaacggacaaaacctccaccaccggcagcatcctgaatcttaacctggatcgaagcaaagctgagatggatttgaaggagctgagcgagtcggtccagcaacagtccacccctgttcctctcatctctcccaagcgccagattcgtagcaggttccagctgaatcttgacaagaccatagagagttgcaaagcacaattaggcataaatgaaatctcggaagatgtctatacggccgtagagcacagcgattcggaggattctgagaagtcagatagtagcgatagtgagtatatcagtgatgatgagcagaagtctaagaacgagccagaagacacagaggacaaagaaggttgtcagatggacaaagagccatctgctgttaaaaaaaagcccaagcctacaaacccagtggagattaaagaggagctgaaaagcacgtcaccagccagcgagaaggcagaccctggagcagtcaaggacaaggccagccctgagcctgagaaggacttttccgaaaaggcaaaaccttcacctcaccccataaaggataaactgaagggaaaagatgagacggattccccaacagtccatttgggcctggactctgattcagagagcgaacttgtcatagatttaggagaagaccattctgggcgggagggtcgaaaaaataagaaggaacccaaagaaccatctcccaaacaggatgttgtaggtaaaactccaccatccacgacggtgggcagccattctcccccggaaacaccggtgctcacccgctcttccgcccaaacttccgcggctggcgccacagccaccaccagcacgtcctccacggtcaccgtcacggccccggcccccgccgccacaggaagcccagtgaaaaagcagaggccgcttttaccgaaggagactgccccggccgtgcagcgggtcgtgtggaactcatcaagtaagtttcaaacgtcctcccaaaagtggcacatgcagaagatgcagcgtcagcagcagcagcagcagcagcaaaaccagcagcagcagcctcagtcttcccaggggacgagatatcagaccagacaggctgtgaaagctgtccagcagaaggagatcacacagagcccatccacgtccaccatcaccctggtgaccagcacacagtcatcgcccctggtcaccagctcggggtccatgagcacccttgtgtcctcagtcaacgctgacctgcccatcgccactgcctcagctgatgtcgccgctgatattgccaagtacactagcaaaatgatggatgcaataaaaggaacaatgacagaaatatacaacgatctttctaaaaacactactggaagcacaatagctgagattcgcaggctgaggatcgagatagagaagctccagtggctgcaccagcaagagctctccgaaatgaaacacaacttagagctgaccatggcggagatgcggcagagcctggagcaggagcgggaccggctcatcgccgaggtgaagaagcagctggagttggagaagcagcaggcggtggatgagaccaagaagaagcagtggtgcgccaactgcaagaaggaggccatcttttactgctgttggaacactagctactgtgactacccctgccagcaagcccactggcctgagcacatgaagtcctgcacccagtcagctactgctcctcagcaggaagcggatgctgaggtgaacacagaaacactaaataagtcctcccaggggagctcctcgagcacacaatcagcaccttcagaaacggccagcgcctccaaagagaaggagacgtcagctgagaaaagcaaggagagtggctcgacccttgacctttctggctccagagagacgccctcctccattctcttaggctccaaccaaggctctgaccattcccggagtaataaatccagttggagcagcagtgatgagaagaggggatcgacacgttccgatcacaacaccagtaccagcacgaagagcctcctcccgaaagagtctcggctggacaccttctgggactagcagtgaatcgggacacaaaccacccaccccattgggagaaaaacccagacgccaggaaaagaagaaacaacaaaggcaggagaacagccactttcagacttgaaaatgacaaaaccctcagttgagcctgagcccccggcgcgggggctgctacactacaggacacccagcatcggctttgactgcagactgttcacccacacgagccctgtgcttttggtgtaaataatgtacaatttgtggatgtcattgaatctagaggactttcccctttttatatttgtattaactttaacttatt

SEQ ID NO: 3800 - DNA, 175 bp, Homo sapiens
atcaggtgtgggtttcctcccccagccctggataaggatgagggaatgtctttaagcttggctgaagaggaaataaaaacagaacaggaggtggtagagggcatggatatctctactcgctccaaagatcctggctctgcagagagaacagcccagaaaagaaagttccccagcc

SEQ ID NO: 3801 - DNA, 341 bp, Homo sapiens
tttaggaaggtggctttgaaactcgcagggctgcttaaacaagagctacagctattgaacaaactgctaccattttagcttcaacacaggaatgaggcagtgttgccagacgccattttaagaatcctgcataaatagcttagctaccgatgactctgcctgttttagcttggctgaagaggaaataaaaacagaacaggaggtggtagagggcatggatatctctactcgctccaaagatcctggctctgcagagagaacagcccagaaaagaaagttccccagccctccacattcttccaatggccactcgccgcaggacacatcaacaagccccatta

SEQ ID NO: 3802 - DNA, 3463 bp, Homo sapiens
gttaattctcaggctctgttgggggtggtcagaaatctaatttcttggctgaagaggaaataaaaacagaacaggaggtggtagagggcatggatatctctactcgctccaaagatcctggctctgcagagagaacagcccagaaaagaaagttccccagccctccacattcttccaatggccactcgccgcaggacacatcaacaagccccattaaaaagaaaaagaaacctggcttactgaacagtaacaataaggagcaggatggacggaatgatttctactgctgggtttgtcaccgggaaggccaagtcctttgctgtgagctctgtccccgggtttatcacgctaagtgtctgagactgacatcggaaccagagggggactggttttgtcctgaatgtgagacagatgcattccagaagcccgttccattggaacagcaccctgactatgcggaatacatcttccatccaatggacctttgtacattggaaaagaatgcgaaaaagaaaatgtatggctgcacagaagccttcctggctgatgcaaagtggattttgcacaactgcatcatttataatgggggaaatcacaaattgacgcaaatagcgaaagtagtcatcaaaatctgtgaacatgagatgaatgaaatcgaagtatgtccagaatgttatctagctgcttgccaaaaacgagataactggttttgtgagccttgtagcaatccacatcctttggtctgggccaaactgaaggggtttccattctggcctgcaaaagctctaagggataaagacgggcaggtcgatgcccgattctttggacaacatgacagggcctgggttccaataaataattgctacctcatgtctaaagaaattcctttttctgtgaaaaagactaagagcatcttcaacagtgccatgcaagagatggaggtttacgtggagaacatccgcaggaagtttggggtttttaattactctccatttaggacaccctacacacccaacagccagtatcaaatgctgctcgatcccaccaaccccagcgccggcactgccaagatagacaagcaggagaaggtcaagctcaactttgacatgacggcatcccccaagatcctgatgagcaagcctgtgctgagtgggggcacaggccgccggatttccttgtcggatatgccgcgctcccccatgagcacaaactcttctgtgcacacgggctccgacgtggagcaggatgctgagaagaaggccacgtcgagccacttcagtgcgagcgaggagtccatggacttcctggataagagcacagcttcaccagcctccaccaagacgggacaagcagggagtttatccggcagcccaaagcccttctctcctcaactgtcagctcctatcacgacgaaaacggacaaaacctccaccaccggcagcatcctgaatcttaacctggatcgaagcaaagctgagatggatttgaaggagctgagcgagtcggtccagcaacagtccacccctgttcctctcatctctcccaagcgccagattcgtagcaggttccagctgaatcttgacaagaccatagagagttgcaaagcacaattaggcataaatgaaatctcggaagatgtctatacggccgtagagcacagcgattcggaggattctgagaagtcagatagtagcgatagtgagtatatcagtgatgatgagcagaagtctaagaacgagccagaagacacagaggacaaagaaggttgtcagatggacaaagagccatctgctgttaaaaaaaagcccaagcctacaaacccagtggagattaaagaggagctgaaaagcacgtcaccagccagcgagaaggcagaccctggagcagtcaaggacaaggccagccctgagcctgagaaggacttttccgaaaaggcaaaaccttcacctcaccccataaaggataaactgaagggaaaagatgagacggattccccaacagtccatttgggcctggactctgattcagagagcgaacttgtcatagatttaggagaagaccattctgggcgggagggtcgaaaaaataagaaggaacccaaagaaccatctcccaaacaggatgttgtaggtaaaactccaccatccacgacggtgggcagccattctcccccggaaacaccggtgctcacccgctcttccgcccaaacttccgcggctggcgccacagccaccaccagcacgtcctccacggtcaccgtcacggccccggcccccgccgccacaggaagcccagtgaaaaagcagaggccgcttttaccgaaggagactgccccggccgtgcagcgggtcgtgtggaactcatcaactgtccagcagaaggagatcacacagagcccatccacgtccaccatcaccctggtgaccagcacacagtcatcgcccctggtcaccagctcggggtccatgagcacccttgtgtcctcagtcaacgctgacctgcccatcgccactgcctcagctgatgtcgccgctgatattgccaagtacactagcaaaatgatggatgcaataaaaggaacaatgacagaaatatacaacgatctttctaaaaacactactggaagcacaatagctgagattcgcaggctgaggatcgagatagagaagctccagtggctgcaccagcaagagctctccgaaatgaaacacaacttagagctgaccatggcggagatgcggcagagcctggagcaggagcgggaccggctcatcgccgaggtgaagaagcagctggagttggagaagcagcaggcggtggatgagaccaagaagaagcagtggtgcgccaactgcaagaaggaggccatcttttactgctgttggaacactagctactgtgactacccctgccagcaagcccactggcctgagcacatgaagtcctgcacccagtcagctactgctcctcagcaggaagcggatgctgaggtgaacacagaaacactaaataagtcctcccaggggagctcctcgagcacacaatcagcaccttcagaaacggccagcgcctccaaagagaaggagacgtcagctgagaaaagcaaggagagtggctcgacccttgacctttctggctccagagagacgccctcctccattctcttaggctccaaccaaggctctgttagcaaaaggtgtgacaagcaacctgcctatgccccaaccaccacagaccaccagccgcaccccaactaccccgcccagaagtaccattcccggagtaataaatccagttggagcagcagtgatgagaagaggggatcgacacgttccgatcacaacaccagtaccagcacgaagagcctcctcccgaaagagtctcggctggacaccttctgggactagcagtgaatcgggacacaaaccacccaccccattgggagaaaaacccagacgccagg

SEQ ID NO: 3803 - DNA, 3567 bp, Homo sapiens
atgcatccacagagcttggctgaagaggaaataaaaacagaacaggaggtggtagagggcatggatatctctactcgctccaaagatcctggctctgcagagagaacagcccagaaaagaaagttccccagccctccacattcttccaatggccactcgccgcaggacacatcaacaagccccattaaaaagaaaaagaaacctggcttactgaacagtaacaataaggagcagtcagaactaagacatggtccgttttactatatgaagcagccactcaccacagaccctgttgatgttgtaccgcaggatggacggaatgatttctactgctgggtttgtcaccgggaaggccaagtcctttgctgtgagctctgtccccgggtttatcacgctaagtgtctgagactgacatcggaaccagagggggactggttttgtcctgaatgtgagaaaattacagtagcagaatgcatcgagacccagagtaaagccatgacaatgctcaccattgaacagttatcctacctgctcaagtttgccattcagaaaatgaaacagccagggacagatgcattccagaagcccgttccattggaacagcaccctgactatgcggaatacatcttccatccaatggacctttgtacattggaaaagaatgcgaaaaagaaaatgtatggctgcacagaagccttcctggctgatgcaaagtggattttgcacaactgcatcatttataatgggggaaatcacaaattgacgcaaatagcgaaagtagtcatcaaaatctgtgaacatgagatgaatgaaatcgaagtatgtccagaatgttatctagctgcttgccaaaaacgagataactggttttgtgagccttgtagcaatccacatcctttggtctgggccaaactgaaggggtttccattctggcctgcaaaagctctaagggataaagacgggcaggtcgatgcccgattctttggacaacatgacagggcctgggttccaataaataattgctacctcatgtctaaagaaattcctttttctgtgaaaaagactaagagcatcttcaacagtgccatgcaagagatggaggtttacgtggagaacatccgcaggaagtttggggtttttaattactctccatttaggacaccctacacacccaacagccagtatcaaatgctgctcgatcccaccaaccccagcgccggcactgccaagatagacaagcaggagaaggtcaagctcaactttgacatgacggcatcccccaagatcctgatgagcaagcctgtgctgagtgggggcacaggccgccggatttccttgtcggatatgccgcgctcccccatgagcacaaactcttctgtgcacacgggctccgacgtggagcaggatgctgagaagaaggccacgtcgagccacttcagtgcgagcgaggagtccatggacttcctggataagagcacagcttcaccagcctccaccaagacgggacaagcagggagtttatccggcagcccaaagcccttctctcctcaactgtcagctcctatcacgacgaaaacggacaaaacctccaccaccggcagcatcctgaatcttaacctggatcgaagcaaagctgagatggatttgaaggagctgagcgagtcggtccagcaacagtccacccctgttcctctcatctctcccaagcgccagattcgtagcaggttccagctgaatcttgacaagaccatagagagttgcaaagcacaattaggcataaatgaaatctcggaagatgtctatacggccgtagagcacagcgattcggaggattctgagaagtcagatagtagcgatagtgagtatatcagtgatgatgagcagaagtctaagaacgagccagaagacacagaggacaaagaaggttgtcagatggacaaagagccatctgctgttaaaaaaaagcccaagcctacaaacccagtggagattaaagaggagctgaaaagcacgtcaccagccagcgagaaggcagaccctggagcagtcaaggacaaggccagccctgagcctgagaaggacttttccgaaaaggcaaaaccttcacctcaccccataaaggataaactgaagggaaaagatgagacggattccccaacagtccatttgggcctggactctgattcagagagcgaacttgtcatagatttaggagaagaccattctgggcgggagggtcgaaaaaataagaaggaacccaaagaaccatctcccaaacaggatgttgtaggtaaaactccaccatccacgacggtgggcagccattctcccccggaaacaccggtgctcacccgctcttccgcccaaacttccgcggctggcgccacagccaccaccagcacgtcctccacggtcaccgtcacggccccggcccccgccgccacaggaagcccagtgaaaaagcagaggccgcttttaccgaaggagactgccccggccgtgcagcgggtcgtgtggaactcatcaactgtccagcagaaggagatcacacagagcccatccacgtccaccatcaccctggtgaccagcacacagtcatcgcccctggtcaccagctcggggtccatgagcacccttgtgtcctcagtcaacgctgacctgcccatcgccactgcctcagctgatgtcgccgctgatattgccaagtacactagcaaaatgatggatgcaataaaaggaacaatgacagaaatatacaacgatctttctaaaaacactactggaagcacaatagctgagattcgcaggctgaggatcgagatagagaagctccagtggctgcaccagcaagagctctccgaaatgaaacacaacttagagctgaccatggcggagatgcggcagagcctggagcaggagcgggaccggctcatcgccgaggtgaagaagcagctggagttggagaagcagcaggcggtggatgagaccaagaagaagcagtggtgcgccaactgcaagaaggaggccatcttttactgctgttggaacactagctactgtgactacccctgccagcaagcccactggcctgagcacatgaagtcctgcacccagtcagctactgctcctcagcaggaagcggatgctgaggtgaacacagaaacactaaataagtcctcccaggggagctcctcgagcacacaatcagcaccttcagaaacggccagcgcctccaaagagaaggagacgtcagctgagaaaagcaaggagagtggctcgacccttgacctttctggctccagagagacgccctcctccattctcttaggctccaaccaaggctctgttagcaaaaggtgtgacaagcaacctgcctatgccccaaccaccacagaccaccagccgcaccccaactaccccgcccagaagtaccattcccggagtaataaatccagttggagcagcagtgatgagaagaggggatcgacacgttccgatcacaacaccagtaccagcacgaagagcctcctcccgaaagagtctcggctggacaccttctgggactag

SEQ ID NO: 3804 - DNA, 3637 bp, Homo sapiens
cacagaccctgttgatgttgtaccgcaggatggacggaatgatttctactgctgggtttgtcaccgggaaggccaagtcctttgctgtgagctctgtccccgggtttatcacgctaagtgtctgagactgacatcggaaccagagggggactggttttgtcctgaatgtgagaaaattacagtagcagaatgcatcgagacccagagtaaagccatgacaatgctcaccattgaacagttatcctacctgctcaagtttgccattcagaaaatgaaacagccagggacagatgcattccagaagcccgttccattggaacagcaccctgactatgcggaatacatcttccatccaatggacctttgtacattggaaaagaatgcgaaaaagaaaatgtatggctgcacagaagccttcctggctgatgcaaagtggattttgcacaactgcatcatttataatgggggaaatcacaaattgacgcaaatagcgaaagtagtcatcaaaatctgtgaacatgagatgaatgaaatcgaagtatgtccagaatgttatctagctgcttgccaaaaacgagataactggttttgtgagccttgtagcaatccacatcctttggtctgggccaaactgaaggggtttccattctggcctgcaaaagctctaagggataaagacgggcaggtcgatgcccgattctttggacaacatgacagggcctgggttccaataaataattgctacctcatgtctaaagaaattcctttttctgtgaaaaagactaagagcatcttcaacagtgccatgcaagagatggaggtttacgtggagaacatccgcaggaagtttggggtttttaattactctccatttaggacaccctacacacccaacagccagtatcaaatgctgctcgatcccaccaaccccagcgccggcactgccaagatagacaagcaggagaaggtcaagctcaactttgacatgacggcatcccccaagatcctgatgagcaagcctgtgctgagtgggggcacaggccgccggatttccttgtcggatatgccgcgctcccccatgagcacaaactcttctgtgcacacgggctccgacgtggagcaggatgctgagaagaaggccacgtcgagccacttcagtgcgagcgaggagtccatggacttcctggataagagcacagcttcaccagcctccaccaagacgggacaagcagggagtttatccggcagcccaaagcccttctctcctcaactgtcagctcctatcacgacgaaaacggacaaaacctccaccaccggcagcatcctgaatcttaacctgggtcatcgaagcaaagctgagatggatttgaaggagctgagcgagtcggtccagcaacagtccacccctgttcctctcatctctcccaagcgccagattcgtagcaggttccagctgaatcttgacaagaccatagagagttgcaaagcacaattaggcataaatgaaatctcggaagatgtctatacggccgtagagcacagcgattcggaggattctgagaagtcagatagtagcgatagtgagtatatcagtgatgatgagcagaagtctaagaacgagccagaagacacagaggacaaagaaggttgtcagatggacaaagagccatctgctgttaaaaaaaagcccaagcctacaaacccagtggagattaaagaggagctgaaaagcacgtcaccagccagcgagaaggcagaccctggagcagtcaaggacaaggccagccctgagcctgagaaggacttttccgaaaaggcaaaaccttcacctcaccccataaaggataaactgaagggaaaagatgagacggattccccaacagtccatttgggcctggactctgattcagagagcgaacttgtcatagatttaggagaagaccattctgggcgggagggtcgaaaaaataagaaggaacccaaagaaccatctcccaaacaggatgttgtaggtaaaactccaccatccacgacggtgggcagccattctcccccggaaacaccggtgctcacccgctcttccgcccaaacttccgcggctggcgccacagccaccaccagcacgtcctccacggtcaccgtcacggccccggcccccgccgccacaggaagcccagtgaaaaagcagaggccgcttttaccgaaggagactgccccggccgtgcagcgggtcgtgtggaactcatcaactgtccagcagaaggagatcacacagagcccatccacgtccaccatcaccctggtgaccagcacacagtcatcgcccctggtcaccagctcggggtccatgagcacccttgtgtcctcagtcaacgctgacctgcccatcgccactgcctcagctgatgtcgccgctgatattgccaagtacactagcaaaatgatggatgcaataaaaggaacaatgacagaaatatacaacgatctttctaaaaacactactggaagcacaatagctgagattcgcaggctgaggatcgagatagagaagctccagtggctgcaccagcaagagctctccgaaatgaaacacaacttagagctgaccatggcggagatgcggcagagcctggagcaggagcgggaccggctcatcgccgaggtgaagaagcagctggagttggagaagcagcaggcggtggatgagaccaagaagaagcagtggtgcgccaactgcaagaaggaggccatcttttactgctgttggaacactagctactgtgactacccctgccagcaagcccactggcctgagcacatgaagtcctgcacccagtcagctactgctcctcagcaggaagcggatgctgaggtgaacacagaaacactaaataagtcctcccaggggagctcctcgagcacacaatcagcaccttcagaaacggccagcgcctccaaagagaaggagacgtcagctgagaaaagcaaggagagtggctcgacccttgacctttctggctccagagagacgccctcctccattctcttaggctccaaccaaggctctgttagcaaaaggtgtgacaagcaacctgcctatgccccaaccaccacagaccaccagccgcaccccaactaccccgcccagaagtaccattcccggagtaataaatccagttggagcagcagtgatgagaagaggggatcgacacgttccgatcacaacaccagtaccagcacgaagagcctcctcccgaaagagtctcggctggacaccttctgggactagcagtgaatcgggacacaaaccacccaccccattgggagaaaaacccagacgccaggaaaagaagaaacaacaaaggcaggagaacagccactttcagacttgaaaatgacaaaaccctcagttgagcctgagcccccggcgcgggggctgctacactacaggacacccagcatcggctttgactgcagactgttcacccacacgagccctgtgcttttggtgtaaataatgtacaatttgtggatgtcattgaatctagaggactttcccctttttatatttgtattaactttaacttattaaaaaaaaaaaaagaaaaagaaaaacgatttaaaaaaaaaaaaaaaa

SEQ ID NO: 3805 - DNA, 3864 bp, Homo sapiens
gtcacatggctcagtagccattagccatagcttgattttgcaaactggcaagggcctggcacacctttccttccaccagggcatggtgtttctggaagagtttgaagctagatcctgcttggctgaagaggaaataaaaacagaacaggaggtggtagagggcatggatatctctactcgctccaaagatcctggctctgcagagagaacagcccagaaaagaaagttccccagccctccacattcttccaatggccactcgccgcaggacacatcaacaagccccattaaaaagaaaaagaaacctggcttactgaacagtaacaataaggagcagtcagaactaagacatggtccgttttactatatgaagcagccactcaccacagaccctgttgatgttgtaccgcaggatggacggaatgatttctactgctgggtttgtcaccgggaaggccaagtcctttgctgtgagctctgtccccgggtttatcacgctaagtgtctgagactgacatcggaaccagagggggactggttttgtcctgaatgtgagaaaattacagtagcagaatgcatcgagacccagagtaaagccatgacaatgctcaccattgaacagttatcctacctgctcaagtttgccattcagaaaatgaaacagccagggacagatgcattccagaagcccgttccattggaacagcaccctgactatgcggaatacatcttccatccaatggacctttgtacattggaaaagaatgcgaaaaagaaaatgtatggctgcacagaagccttcctggctgatgcaaagtggattttgcacaactgcatcatttataatgggggaaatcacaaattgacgcaaatagcgaaagtagtcatcaaaatctgtgaacatgagatgaatgaaatcgaagtatgtccagaatgttatctagctgcttgccaaaaacgagataactggttttgtgagccttgtagcaatccacatcctttggtctgggccaaactgaaggggtttccattctggcctgcaaaagctctaagggataaagacgggcaggtcgatgcccgattctttggacaacatgacagggcctgggttccaataaataattgctacctcatgtctaaagaaattcctttttctgtgaaaaagactaagagcatcttcaacagtgccatgcaagagatggaggtttacgtggagaacatccgcaggaagtttggggtttttaattactctccatttaggacaccctacacacccaacagccagtatcaaatgctgctcgatcccaccaaccccagcgccggcactgccaagatagacaagcaggagaaggtcaagctcaactttgacatgacggcatcccccaagatcctgatgagcaagcctgtgctgagtgggggcacaggccgccggatttccttgtcggatatgccgcgctcccccatgagcacaaactcttctgtgcacacgggctccgacgtggagcaggatgctgagaagaaggccacgtcgagccacttcagtgcgagcgaggagtccatggacttcctggataagagcacagcttcaccagcctccaccaagacgggacaagcagggagtttatccggcagcccaaagcccttctctcctcaactgtcagctcctatcacgacgaaaacggacaaaacctccaccaccggcagcatcctgaatcttaacctggatcgaagcaaagctgagatggatttgaaggagctgagcgagtcggtccagcaacagtccacccctgttcctctcatctctcccaagcgccagattcgtagcaggttccagctgaatcttgacaagaccatagagagttgcaaagcacaattaggcataaatgaaatctcggaagatgtctatacggccgtagagcacagcgattcggaggattctgagaagtcagatagtagcgatagtgagtatatcagtgatgatgagcagaagtctaagaacgagccagaagacacagaggacaaagaaggttgtcagatggacaaagagccatctgctgttaaaaaaaagcccaagcctacaaacccagtggagattaaagaggagctgaaaagcacgtcaccagccagcgagaaggcagaccctggagcagtcaaggacaaggccagccctgagcctgagaaggacttttccgaaaaggcaaaaccttcacctcaccccataaaggataaactgaagggaaaagatgagacggattccccaacagtccatttgggcctggactctgattcagagagcgaacttgtcatagatttaggagaagaccattctgggcgggagggtcgaaaaaataagaaggaacccaaagaaccatctcccaaacaggatgttgtaggtaaaactccaccatccacgacggtgggcagccattctcccccggaaacaccggtgctcacccgctcttccgcccaaacttccgcggctggcgccacagccaccaccagcacgtcctccacggtcaccgtcacggccccggcccccgccgccacaggaagcccagtgaaaaagcagaggccgcttttaccgaaggagactgccccggccgtgcagcgggtcgtgtggaactcatcaagtaagtttcaaacgtcctcccaaaagtggcacatgcagaagatgcagcgtcagcagcagcagcagcagcagcaaaaccagcagcagcagcctcagtcttcccaggggacgagatatcagaccagacaggctgtgaaagctgtccagcagaaggagatcacacagagcccatccacgtccaccatcaccctggtgaccagcacacagtcatcgcccctggtcaccagctcggggtccatgagcacccttgtgtcctcagtcaacgctgacctgcccatcgccactgcctcagctgatgtcgccgctgatattgccaagtacactagcaaaatgatggatgcaataaaaggaacaatgacagaaatatacaacgatctttctaaaaacactactggaagcacaatagctgagattcgcaggctgaggatcgagatagagaagctccagtggctgcaccagcaagagctctccgaaatgaaacacaacttagagctgaccatggcggagatgcggcagagcctggagcaggagcgggaccggctcatcgccgaggtgaagaagcagctggagttggagaagcagcaggcggtggatgagaccaagaagaagcagtggtgcgccaactgcaagaaggaggccatcttttactgctgttggaacactagctactgtgactacccctgccagcaagcccactggcctgagcacatgaagtcctgcacccagtcagctactgctcctcagcaggaagcggatgctgaggtgaacacagaaacactaaataagtcctcccaggggagctcctcgagcacacaatcagcaccttcagaaacggccagcgcctccaaagagaaggagacgtcagctgagaaaagcaaggagagtggctcgacccttgacctttctggctccagagagacgccctcctccattctcttaggctccaaccaaggctctgttagcaaaaggtgtgacaagcaacctgcctatgccccaaccaccacagaccaccagccgcaccccaactaccccgcccagaagtaccattcccggagtaataaatccagttggagcagcagtgatgagaagaggggatcgacacgttccgatcacaacaccagtaccagcacgaagagcctcctcccgaaagagtctcggctggacaccttctgggactagcagtgaatcgggacacaaaccacccaccccattgggagaaaaacccagacgccagg

SEQ ID NO: 3806 - DNA, 3405 bp, Homo sapiens
atgcatccacagagcttggctgaagaggaaataaaaacagaacaggaggtggtagagggcatggatatctctactcgctccaaagatcctggctctgcagagagaacagcccagaaaagaaagttccccagccctccacattcttccaatggccactcgccgcaggacacatcaacaagccccattaaaaagaaaaagaaacctggcttactgaacagtaacaataaggagcaggatggacggaatgatttctactgctgggtttgtcaccgggaaggccaagtcctttgctgtgagctctgtccccgggtttatcacgctaagtgtctgagactgacatcggaaccagagggggactggttttgtcctgaatgtgagaaaattacagtagcagaatgcatcgagacccagagtaaagccatgacaatgctcaccattgaacagttatcctacctgctcaagtttgccattcagaaaatgaaacagccagggacagatgcattccagaagcccgttccattggaacagcaccctgactatgcggaatacatcttccatccaatggacctttgtacattggaaaagaatgcgaaaaagaaaatgtatggctgcacagaagccttcctggctgatgcaaagtggattttgcacaactgcatcatttataatgggggaaatcacaaattgacgcaaatagcgaaagtagtcatcaaaatctgtgaacatgagatgaatgaaatcgaagtatgtccagaatgttatctagctgcttgccaaaaacgagataactggttttgtgagccttgtagcaatccacatcctttggtctgggccaaactgaaggggtttccattctggcctgcaaaagctctaagggataaagacgggcaggtcgatgcccgattctttggacaacatgacagggcctgggttccaataaataattgctacctcatgtctaaagaaattcctttttctgtgaaaaagactaagagcatcttcaacagtgccatgcaagagatggaggtttacgtggagaacatccgcaggaagtttggggtttttaattactctccatttaggacaccctacacacccaacagccagtatcaaatgctgctcgatcccaccaaccccagcgccggcactgccaagatagacaagcaggagaaggtcaagctcaactttgacatgacggcatcccccaagatcctgatgagcaagcctgtgctgagtgggggcacaggccgccggatttccttgtcggatatgccgcgctcccccatgagcacaaactcttctgtgcacacgggctccgacgtggagcaggatgctgagaagaaggccacgtcgagccacttcagtgcgagcgaggagtccatggacttcctggataagagcacagatcgaagcaaagctgagatggatttgaaggagctgagcgagtcggtccagcaacagtccacccctgttcctctcatctctcccaagcgccagattcgtagcaggttccagctgaatcttgacaagaccatagagagttgcaaagcacaattaggcataaatgaaatctcggaagatgtctatacggccgtagagcacagcgattcggaggattctgagaagtcagatagtagcgatagtgagtatatcagtgatgatgagcagaagtctaagaacgagccagaagacacagaggacaaagaaggttgtcagatggacaaagagccatctgctgttaaaaaaaagcccaagcctacaaacccagtggagattaaagaggagctgaaaagcacgtcaccagccagcgagaaggcagaccctggagcagtcaaggacaaggccagccctgagcctgagaaggacttttccgaaaaggcaaaaccttcacctcaccccataaaggataaactgaagggaaaagatgagacggattccccaacagtccatttgggcctggactctgattcagagagcgaacttgtcatagatttaggagaagaccattctgggcgggagggtcgaaaaaataagaaggaacccaaagaaccatctcccaaacaggatgttgtaggtaaaactccaccatccacgacggtgggcagccattctcccccggaaacaccggtgctcacccgctcttccgcccaaacttccgcggctggcgccacagccaccaccagcacgtcctccacggtcaccgtcacggccccggcccccgccgccacaggaagcccagtgaaaaagcagaggccgcttttaccgaaggagactgccccggccgtgcagcgggtcgtgtggaactcatcaagtaagtttcaaacgtcctcccaaaagtggcacatgcagaagatgcagcgtcagcagcagcagcagcagcagcaaaaccagcagcagcagcctcagtcttcccaggggacgagatatcagaccagacaggctgtgaaagctgtccagcagaaggagatcacacagagcccatccacgtccaccatcaccctggtgaccagcacacagtcatcgcccctggtcaccagctcggggtccatgagcacccttgtgtcctcagtcaacgctgacctgcccatcgccactgcctcagctgatgtcgccgctgatattgccaagtacactagcaaaatgatggatgcaataaaaggaacaatgacagaaatatacaacgatctttctaaaaacactactggaagcacaatagctgagattcgcaggctgaggatcgagatagagaagctccagtggctgcaccagcaagagctctccgaaatgaaacacaacttagagctgaccatggcggagatgcggcagagcctggagcaggagcgggaccggctcatcgccgaggtgaagaagcagctggagttggagaagcagcaggcggtggatgagaccaagaagaagcagtggtgcgccaactgcaagaaggaggccatcttttactgctgttggaacactagctactgtgactacccctgccagcaagcccactggcctgagcacatgaagtcctgcacccagtcagctactgctcctcagcaggaagcggatgctgaggtgaacacagaaacactaaataagtcctcccaggggagctcctcgagcacacaatcagcaccttcagaaacggccagcgcctccaaagagaaggagacgtcagctgagaaaagcaaggagagtggctcgacccttgacctttctggctccagagagacgccctcctccattctcttaggctccaaccaaggctctgaccattcccggagtaataaatccagttggagcagcagtgatgagaagaggggatcgacacgttccgatcacaacaccagtaccagcacgaagagcctcctcccgaaagagtctcggctggacaccttctgggactag

SEQ ID NO: 3807 - DNA, 2964 bp, Homo sapiens
gaaaggacgcgccggagccgggtgagtggccccgcaactgcccctgcccctgattcttccttgcctcgccgcgaaccccggcgcccgcgccgacccgccactgcctctgcccttttccagataacagaaagtaacgtgaaggaattcaggtgactcagacatggaggagagaagacctcatctggatgccaggcccaggaattcccataccaaccacagaggccctgtggatggagagttaccaccaagagctagaaatcaggccaataacccaccagccaatgctctccgaggaggagccagccaccctggaaggcatcctagggccaacaaccatcctgctgcttactggcagagggaagagagatttagggccatgggcaggaacccacatcaaggaaggaggaaccaggaggggcatgccagcgacgaagctagagaccaaagacatgaccaggagaatgacaccaggtggagaaatggcaaccaggactgtaggaaccgcagaccaccatggtccaatgacaacttccagcagtggcggactccccaccagaagcctacagaacagccacagcaggcgaagaaactgggctacaagttcttagaaagtcttctgcagaaagacccttctgaggtggtcatcacacttgccacaagtttagggctgaaagagctcctttctcattcttccatgaaatctaacttccttgagctcatctgtcaggttcttcggaaggcttgtagctccaaaatggatcgccagagtgttctccatgtactgggcatattgaaaaactccaaatttctcaaagtctgcctgcctgcttatgtggtagggatgatcactgaacccatccctgacatccgaaaccagtatccagagcacataagcaacatcatctccctcctccaggaccttgtaagtgtcttccctgccagctctgtgcaggaaacttccatgctggtttccctcctgccaacctctcttaatgctctgagagcctctggtgttgacatagaagaggaaacggagaagaacctggaaaaggtacagactatcattgaacatctgcaggaaaagaggcgagagggcactttgagagtggatacctacactctagtgcagcctgaggcagaagaccatgttgagagctaccgaaccatgcccatttaccctacctacaatgaagtgcacttggatgagaggcccttccttcgccccaatatcatttctggaaaatacgacagcactgctatctatctggatacccacttccggctcctgcgagaagatttcgtcagacctttacgggaaggtattttggaacttctccaaagctttgaagaccagggcctgaggaagagaaagtttgatgacatccgaatctactttgacaccaggattatcacccccatgtgttcatcatcaggcatagtctacaaggtgcagtttgacacaaaaccactgaagtttgttcgctggcagaattccaaacgattgctctatgggtctttggtatgcatgtccaaggacaacttcgagacatttctttttgccaccgtatctaacagggagcaggaagatctctgccgaggaattgtccagctctgcttcaatgagcaaagccaacagctgctagcagaggtccagccctctgactctttcctcatggtagagacaactgcatactttgaggcctacaggcacgtcctggaaggactccaggaggtccaggaggaagatgttcccttccagaggaatatcgtggagtgtaactctcatgtgaaggagccaaggtacttgctaatggggggcagatacgactttacccccttaatagagaatccttcagccactggggaatttctaagaaatgtcgagggtttgagacatcccagaattaatgtcttagatcctggccagtggccctcaaaagaagccctgaagctggatgactcccagatggaagccttgcagtttgctctcacaagggaactggctattattcaaggacctcctggaacaggcaaaacctatgtgggtctaaaaattgttcaggccctcctaaccaacgagtctgtttggcaaattagcctccagaagttccccatcttggttgtgtgttatactaatcatgctttggaccagtttctggaaggcatctacaattgtcagaagaccagcattgtgcgggtgggtggaaggagcaacagtgaaatcctgaagcagttcaccctaagggagctgaggaacaagcgggaattccgccgcaacctccccatgcacctccgaagggcctacatgagtatcatgacacagatgaaggagtcagagcaagagcttcatgaaggagccaagaccctggagtgcaccatgcgtggtgtcctacgggaacagtacctgcagaagtacatctcaccccagcactgggaaagtctcatgaatggaccagtgcaggatagtgaatggatttgcttccagcactggaagcattccatgatgctggagtggctaggtcttggtgtcggttctttcacgcaaagtgtttctccagcaggacctgagaatacagcccaggcagaaggggatgaggaggaagaaggggaggaggagagttcgctgatagagatcgcagaggaagctgacctgattcaagcagaccgggtgattgaggaggaagaggtggtgaggccccagcggcggaagaaggaagagagtggagcagaccaggagttggctaaaatgcttctggccatgaggctagaccattgtggcactgggacagcagctggacaggagcaagccacaggagagtggcagacccagcgcaaccagaaaaagaaaatgaaaaaaagagtgaaggatgagcttcgcaaactgaacaccatgactgcagccgaggccaacgagatcgaggatgtttggcagctggacctcagttctcgctggcagctttatag

SEQ ID NO: 3808 - DNA, 7212 bp, Homo sapiens
gccccagcactcgccggcggcagtgaaaggacgcgccggagccggataacagaaagtaacgtgaaggaattcaggtgactcagacatggaggagagaagacctcatctggatgccaggcccaggaattcccataccaaccacagaggccctgtggatggagagttaccaccaagagctagaaatcaggccaataacccaccagccaatgctctccgaggaggagccagccaccctggaaggcatcctagggccaacaaccatcctgctgcttactggcagagggaagagagatttagggccatgggcaggaacccacatcaaggaaggaggaaccaggaggggcatgccagcgacgaagctagagaccaaagacatgaccaggagaatgacaccaggtggagaaatggcaaccaggactgtaggaaccgcagaccaccatggtccaatgacaacttccagcagtggcggactccccaccagaagcctacagaacagccacagcaggcgaagaaactgggctacaagttcttagaaagtcttctgcagaaagacccttctgaggtggtcatcacacttgccacaagtttagggctgaaagagctcctttctcattcttccatgaaatctaacttccttgagctcatctgtcaggttcttcggaaggcttgtagctccaaaatggatcgccagagtgttctccatgtactgggcatattgaaaaactccaaatttctcaaagtctgcctgcctgcttatgtggtagggatgatcactgaacccatccctgacatccgaaaccagtatccagagcacataagcaacatcatctccctcctccaggaccttgtaagtgtcttccctgccagctctgtgcaggaaacttccatgctggtttccctcctgccaacctctcttaatgctctgagagcctctggtgttgacatagaagaggaaacggagaagaacctggaaaaggtacagactatcattgaacatctgcaggaaaagaggcgagagggcactttgagagtggatacctacactctagtgcagcctgaggcagaagaccatgttgagagctaccgaaccatgcccatttaccctacctacaatgaagtgcacttggatgagaggcccttccttcgccccaatatcatttctggaaaatacgacagcactgctatctatctggatacccacttccggctcctgcgagaagatttcgtcagacctttacgggaaggtattttggaacttctccaaagctttgaagaccagggcctgaggaagagaaagtttgatgacatccgaatctactttgacaccaggattatcacccccatgtgttcatcatcaggcatagtctacaaggtgcagtttgacacaaaaccactgaagtttgttcgctggcagaattccaaacgattgctctatgggtctttggtatgcatgtccaaggacaacttcgagacatttctttttgccaccgtatctaacagggagcaggaagatctctgccgaggaattgtccagctctgcttcaatgagcaaagccaacagctgctagcagaggtccagccctctgactctttcctcatggtagagacaactgcatactttgaggcctacaggcacgtcctggaaggactccaggaggtccaggaggaagatgttcccttccagaggaatatcgtggagtgtaactctcatgtgaaggagccaaggtacttgctaatggggggcagatacgactttacccccttaatagagaatccttcagccactggggaatttctaagaaatgtcgagggtttgagacatcccagaattaatgtcttagatcctggccagtggccctcaaaagaagccctgaagctggatgactcccagatggaagccttgcagtttgctctcacaagggaactggctattattcaaggacctcctggaacaggcaaaacctatgtgggtctaaaaattgttcaggccctcctaaccaacgagtctgtttggcaaattagcctccagaagttccccatcttggttgtgtgttatactaatcatgctttggaccagtttctggaaggcatctacaattgtcagaagaccagcattgtgcgggtgggtggaaggagcaacagtgaaatcctgaagcagttcaccctaagggagctgaggaacaagcgggaattccgccgcaacctccccatgcacctccgaagggcctacatgagtatcatgacacagatgaaggagtcagagcaagagcttcatgaaggagccaagaccctggagtgcaccatgcgtggtgtcctacgggaacagtacctgcagaagtacatctcaccccagcactgggaaagtctcatgaatggaccagtgcaggatagtgaatggatttgcttccagcactggaagcattccatgatgctggagtggctaggtcttggtgtcggttctttcacgcaaagtgtttctccagcaggacctgagaatacagcccaggcagaaggggatgaggaggaagaaggggaggaggagagttcgctgatagagatcgcagaggaagctgacctgattcaagcagaccgggtgattgaggaggaagaggtggtgaggccccagcggcggaagaaggaagagagtggagcagaccaggagttggctaaaatgcttctggccatgaggctagaccattgtggcactgggacagcagctggacaggagcaagccacaggagagtggcagacccagcgcaaccagaaaaagaaaatgaaaaaaagagtgaaggatgagcttcgcaaactgaacaccatgactgcagccgaggccaacgagatcgaggatgtttggcagctggacctcagttctcgctggcagctttataggctctggctacagttgtaccaggctgacacccgccggaagatcctcagctatgaacgccagtaccgcacatcagcagaaagaatggccgagctgagactccaggaagacctgcacattcttaaagatgcccaggttgtaggaatgacaaccacaggtgctgccaaataccgccagatcctacagaaggtggagccgaggattgtcatagtggaagaagctgcggaagtccttgaggcccataccattgccacattgagcaaagcttgccagcacctcattttgattggggaccaccagcagctgcgccccagtgccaacgtgtatgatctggccaagaacttcaaccttgaggtgtccctttttgaacggctagtgaaagtaaacattccctttgtccgtctgaattaccagcaccgtatgtgccctgaaattgcccgccttttgaccccccacatttaccaggatctggagaatcatccatctgttcttaagtatgagaagattaagggggtgtcttccaaccttttctttgtagaacacaactttcctgaacaggaaatccaagagggcaaaagccatcagaaccagcatgaggctcactttgtggtagagctgtgcaagtacttcctgtgccaggaatacctgccttcccagatcaccatcctcactacctataccgggcagctcttctgcctgcgcaaactgatgcctgccaagacatttgctggcgtcagggtccatgttgtggacaaataccaaggggaagagaatgacatcatcctcctctcgctagtgcggagcaaccaagaaggcaaggtgggttttctgcagatatccaaccgcatctgtgtggccttgtcccgagccaagaagggaatgtactgcatcggaaacatgcagatgctggccaaggtgcccctgtggagcaagatcattcatacacttcgagagaacaatcaaataggccccatgctccggctctgctgccagaaccaccctgaaacccacaccttagtatccaaagcttctgacttccaaaaagtacccgaaggaggctgcagcctgccctgcgagttccgcctgggctgtgggcatgtctgcacccgtgcctgccacccttatgactcttcacacaaggagttccaatgcatgaagccatgccagaaggtcatctgtcaggaagggcaccggtgtccccttgtttgcttccaggagtgtcagccttgtcaggtgaaggtgcccaaaaccattcctcggtgcggccatgaacaaatggtcccttgttccgtgcctgagtcagatttctgctgccaggagccttgctccaagtctctgagatgtgggcacagatgcagccacccatgtggtgaggactgtgtgcagctgtgttcagaaatggtcaccataaaactcaagtgtgggcacagtcaaccggtaaaatgtggtcatgtggaaggcctcctgtatggtggtctgctagtcaagtgtaccacaaagtgtggcactatcttggactgcgggcatccttgcccaggctcctgccacagctgcttcgaagggcgtttccatgaacgctgtcagcagccctgcaagcgcctgcttatctgctcacacaagtgccaggaaccatgcattggtgagtgcccaccctgccagcggacctgtcagaaccgctgtgtccacagccagtgcaagaagaaatgtggggagctgtgtagtccctgcgtggaaccctgtgtctggcgctgccagcactaccagtgcaccaaactctgctctgagccctgcaaccgacccccatgctatgtgccttgtactaagctgctagtttgtggccacccctgcattggtctctgtggggagccatgccccaagaaatgccggatctgccacatggatgaggtcacccaaatattctttggctttgaggatgagcctgatgcccgctttgtgcagctggaagactgcagccacatctttgaggtgcaagccctagaccgctacatgaatgaacagaaggatgatgaagtcgccatcagattgaaagtctgccctatctgccaggtgcccatccgcaaaaacctgaggtatggaactagcataaaacagcggctagaagagattgaaatcatcaaggaaaagatccagggctcagcaggggaaatagcaaccagccaggaacggcttaaggccctgctggagaggaagagcctcctccaccagctgcttcctgaagacttcctgatgttaaaggagaagctggcccagaaaaatctgtcagtgaaggacctgggtctggttgagaattacatcagcttctatgaccacctggccagcctgtgggattccctgaaaaagatgcatgtcttagaagagaaaagagtgaggactcgactagaacaggtccatgagtggctggccaagaagcgcttgagcttcactagccaggaactaagtgacctccgaagtgaaatccagaggctcacatacctggtgaaccttctgacccgctacaagatagcagagaagaaggtgaaagatagcatagcagtagaggtctatagtgtccagaatatccttgagaaaacatgtaagttcacccaagaggatgaacaacttgtgcaggaaaagatggaagctctgaaagccacccttccctgctctggcctgggcatctcagaggaagagcgagtgcagattgtcagtgccataggttatcctcgtggtcactggttcaagtgccgcaatggccatatctatgtgattggcgattgtgggggagccatggagaggggcacgtgtcctgactgtaaggaagtgattggtggcacaaatcatactctggaaagaagcaaccagcttgcttctgaaatggatggagcccagcatgctgcctggtctgacacggccaacaacctgatgaactttgaggagatccaggggatgatgtaggaagatggtacaccactgccttttgccctcgccactgaatgactggggccagctccctaatgaaggaactgaagtttgttttttattatcatcctttttaggctgggcgcagtggcttacgcctgtaatcccagcactttgggaggccgaggcaggcggatcacgaggtcaggagttcgagaccagcctgaccaacatggcgaaaccccgtctctactaaaaatacaaaaattagctgggcgttatggcgggcgcctgtaatcccagctacttgggaggctgaggcagaagaatcgcttaaacccaggaggcggaggttgcagtgagctgagatcatgccattgcactccagtctgggcgacaggagcaagactctgtctcaaaaaaaaaaaaatcattctttttagtcttagcacctacttaaggatccacttttagggctcacccacatttgtttctagatttacccctgcgctagagtaagcactttatctccagaactgagagcaaagttaacaaatctcaccccttctctcctgcaaattagtggacagactccctggaacatgtttggggcttccacctagggccacctagtggtatctctgggtctttacttggtcagatgtttattctacattgttccccaggaacagagtatgagctcattgatgcagaccgattctaattgccaggccctaatttgcagactaactctcataataaacagaggcccatagttgtttatgaactgcttatcccttaaaggagcacaagaacccctccctgccctccttgggcaccctgcctccaggagatggaggcacgtgataagacaaaagactgcaccaactcaccctgacacagttacatagtcactgagagtggggaagatgggacagcccacatgctgcataagatgggccttatgcagcaggcccaggtcgtcattaaggagtgacccctttcctgtaacctgcactttgggatggtagaagtttctttacctgctgacaggtttggtggcactgctggttacccctgggccctgaatggagctaaaatcacatttggtaccagcagcacctatcccaagtgtgatccttcatcccaacactccctcttggagctgttccctgggtagagctagcatgccagcagcttctgcaggctccaaacccaggccagaagccagacccaggcctgctgcctgcatctgcattccctccttccagtgttccttagaacagacatttaggtatctcaggtcctttctaagtgtccctttcctatgtatgcatttcctttttttgtctttactatgcactttagcttataaagccaattaaaaacaatgattgagaaaatca

SEQ ID NO: 3809 - DNA, 5235 bp, Homo sapiens
ttcctcgccatgtcgcgcttcacacgcaccaaaccgctcgacgggttccccttcctctggggccggctgaggcccgcaaaggccttgggcgcagtcatctcccgccccccgcggtccgctcccctcagccgcgcccgcctgagcccgccggctccgccgccggggggagctgaggtgacgccctcctcgagggcggaggcgccggccgtgcctgggccaggccctcgtgctctccaccctgggcccccgcctcctccttctcctcctctgggccgcccgcccggctccgcccagggtctgcggggaacggaaaccgaaagtgcgcggcgccgggcggggccaccgacctgcctgggccgaagccccagcactcgccggcggcagtgaaaggacgcgccggagccggttttccagataacagaaagtaacgtgaaggaattcaggtgactcagacatggaggagagaagacctcatctggatgccaggcccaggaattcccataccaaccacagaggccctgtggatggagagttaccaccaagagctagaaatcaggccaataacccaccagccaatgctctccgaggaggagccagccaccctggaaggcatcctagggccaacaaccatcctgctgcttactggcagagggaagagagatttagggccatgggcaggaacccacatcaaggaaggaggaaccaggaggggcatgccagcgacgaagctagagaccaaagacatgaccaggagaatgacaccaggtggagaaatggcaaccaggactgtaggaaccgcagaccaccatggtccaatgacaacttccagcagtggcggactccccaccagaagcctacagaacagccacagcaggcgaagaaactgggctacaagttcttagaaagtcttctgcagaaagacccttctgaggtggtcatcacacttgccacaagtttagggctgaaagagctcctttctcattcttccatgaaatctaacttccttgagctcatctgtcaggttcttcggaaggcttgtagctccaaaatggatcgccagagtgttctccatgtactgggcatattgaaaaactccaaatttctcaaagtctgcctgcctgcttatgtggtagggatgatcactgaacccatccctgacatccgaaaccagtatccagagcacataagcaacatcatctccctcctccaggaccttgtaagtgtcttccctgccagctctgtgcaggaaacttccatgctggtttccctcctgccaacctctcttaatgctctgagagcctctggtgttgacatagaagaggaaacggagaagaacctggaaaaggtacagactatcattgaacatctgcaggaaaagaggcgagagggcactttgagagtggatacctacactctagtgcagcctgaggcagaagaccatgttgagagctaccgaaccatgcccatttaccctacctacaatgaagtgcacttggatgagaggcccttccttcgccccaatatcatttctggaaaatacgacagcactgctatctatctggatacccacttccggctcctgcgagaagatttcgtcagacctttacgggaaggtattttggaacttctccaaagctttgaagaccagggcctgaggaagagaaagtttgatgacatccgaatctactttgacaccaggattatcacccccatgtgttcatcatcaggcatagtctacaaggtgcagtttgacacaaaaccactgaagtttgttcgctggcagaattccaaacgattgctctatgggtctttggtatgcatgtccaaggacaacttcgagacatttctttttgccaccgtatctaacagggagcaggaagatctctgccgaggaattgtccagctctgcttcaatgagcaaagccaacagctgctagcagaggtccagccctctgactctttcctcatggtagagacaactgcatactttgaggcctacaggcacgtcctggaaggactccaggaggtccaggaggaagatgttcccttccagaggaatatcgtggagtgtaactctcatgtgaaggagccaaggtacttgctaatggggggcagatacgactttacccccttaatagagaatccttcagccactggggaatttctaagaaatgtcgagggtttgagacatcccagaattaatgtcttagatcctggccagtggccctcaaaagaagccctgaagctggatgactcccagatggaagccttgcagtttgctctcacaagggaactggctattattcaaggacctcctggaacaggcaaaacctatgtgggtctaaaaattgttcaggccctcctaaccaacgagtctgtttggcaaattagcctccagaagttccccatcttggttgtgtgttatactaatcatgctttggaccagtttctggaaggcatctacaattgtcagaagaccagcattgtgcgggtgggtggaaggagcaacagtgaaatcctgaagcagttcaccctaagggagctgaggaacaagcgggaattccgccgcaacctccccatgcacctccgaagggcctacatgagtatcatgacacagatgaaggagtcagagcaagagcttcatgaaggagccaagaccctggagtgcaccatgcgtggtgtcctacgggaacagtacctgcagaagtacatctcaccccagcactgggaaagtctcatgaatggaccagtgcaggatagtgaatggatttgcttccagcactggaagcattccatgatgctggagtggctaggtcttggtgtcggttctttcacgcaaagtgtttctccagcaggacctgagaatacagcccaggcagaaggggatgaggaggaagaaggggaggaggagagttcgctgatagagatcgcagaggaagctgacctgattcaagcagaccgggtgattgaggaggaagaggtggtgaggccccagcggcggaagaaggaagagagtggagcagaccaggagttggctaaaatgcttctggccatgaggctagaccattgtggcactgggacagcagctggacaggagcaagccacaggagagtggcagacccagcgcaaccagaaaaagaaaatgaaaaaaagagtgaaggatgagcttcgcaaactgaacaccatgactgcagccgaggccaacgagatcgaggatgtttggcagctggacctcagttctcgctggcagctttataggctctggctacagttgtaccaggctgacacccgccggaagatcctcagctatgaacgccagtaccgcacatcagcagaaagaatggccgagctgagactccaggaagacctgcacattcttaaagatgcccaggttgtaggaatgacaaccacaggtgctgccaaataccgccagatcctacagaaggtggagccgaggattgtcatagtggaagaagctgcggaagtccttgaggcccataccattgccacattgagcaaagcttgccagcacctcattttgattggggaccaccagcagctgcgccccagtgccaacgtgtatgatctggccaagaacttcaaccttgaggtgtccctttttgaacggctagtgaaagtaaacattccctttgtccgtctgaattaccagcaccgtatgtgccctgaaattgcccgccttttgaccccccacatttaccaggatctggagaatcatccatctgttcttaagtatgagaagattaaggccaagtcaaattcctgcagagctttggcaactgggatgagaagaaagcataagatttcagggatgattttatctttttttaagcttacgataagaagtgcacgttttcaattgctcctctcgggctcttggaccactgcctccttccccttctccaggagccgctttgctgtattgatctgtagagataacaaaaggatgcctgccgtgaaacccgtatctactaacacaggaagccacgggctgcaaatgcctggggctctgatgggagaaacatttcagaagggcagcaccagcagggatgcagcagcttgcttactgagcagccttgtgaacaagatcccgcctcgcagcctcacctgggcttctgactgctgcatctctttttcctccgcctctagctgcagaactgcatacacatctttctccattttctcaatcttgtcccggaatttgaggatgacatctcaatgggagaaaataaaaaggatttacaaataagggtaggccaggcatggtggctcacacctgtaacccggcactctgggagattgaggtgggaggattgcttgagcccaggaatttgaggccagcctgggcaacgtggccagactctgtctctacaaaaaaaaaaaaaaaaaaaaaaaaagccaggcacagtggctcatgcctgtaatcccacgctttgggaggccaaggcaggtggatcacctgaggtcaggagtttgagaccagcttggccaatgctgtgaaaccccgtctctattaaaaatacaaaaatcagctgggtgtgggggcacacgcctgtaatcccagctactactcagaaggctgaggcaggagaactgcttgaacccacgaggcggaggctgcagtaagccaagatgacaccactacactccagcctgggcaaaagagcgagactccatctaaaaaaaaaaaaaaaattagccatcatggtggcacacacctgtagtcccacctactcaggaggctgaggagaagaactgcttgaacccaggagttcgaggcaacagtaagctatgatcgcacccctgtaccccagcctgggcaacaaagcaagaccttatcttaaacaaaataaggcagtggctcaagcctgtaatcccagcactttgggaggccaaggcgggtggatcacgaggtcaagagatcgagaccatcctggacaacatggtgaaaccccacctgtactaaaaatataaaaattagctgggcgtggtggcatgcacctgtagtcccagctacttgggaggctgaggcaggaggatcacttgaacccgggacgcagaggttgcaatgggccgagatcgcaccactgcactccagcctggcaacagagcaagactccatctcaaaaataaattaaataaaataaaataagggtgactactaatactgtgtaactgatgaaaataatttagctgtgcatttactgacataggaaa

SEQ ID NO: 3810 - DNA, 7371 bp, Homo sapiens
gtgcctgggccaggccctcgtgctctccaccctgggcccccgcctcctccttctcctcctctgggccgcccgcccggctccgcccagggtctgcggggaacggaaaccgaaagtgcgcggcgccgggcggggccaccgacctgcctgggccgaagccccagcactcgccggcggcagtgaaaggacgcgccggagccggttttccagataacagaaagtaacgtgaaggaattcaggtgactcagacatggaggagagaagacctcatctggatgccaggcccaggaattcccataccaaccacagaggccctgtggatggagagttaccaccaagagctagaaatcaggccaataacccaccagccaatgctctccgaggaggagccagccaccctggaaggcatcctagggccaacaaccatcctgctgcttactggcagagggaagagagatttagggccatgggcaggaacccacatcaaggaaggaggaaccaggaggggcatgccagcgacgaagctagagaccaaagacatgaccaggagaatgacaccaggtggagaaatggcaaccaggactgtaggaaccgcagaccaccatggtccaatgacaacttccagcagtggcggactccccaccagaagcctacagaacagccacagcaggcgaagaaactgggctacaagttcttagaaagtcttctgcagaaagacccttctgaggtggtcatcacacttgccacaagtttagggctgaaagagctcctttctcattcttccatgaaatctaacttccttgagctcatctgtcaggttcttcggaaggcttgtagctccaaaatggatcgccagagtgttctccatgtactgggcatattgaaaaactccaaatttctcaaagtctgcctgcctgcttatgtggtagggatgatcactgaacccatccctgacatccgaaaccagtatccagagcacataagcaacatcatctccctcctccaggaccttgtaagtgtcttccctgccagctctgtgcaggaaacttccatgctggtttccctcctgccaacctctcttaatgctctgagagcctctggtgttgacatagaagaggaaacggagaagaacctggaaaaggtacagactatcattgaacatctgcaggaaaagaggcgagagggcactttgagagtggatacctacactctagtgcagcctgaggcagaagaccatgttgagagctaccgaaccatgcccatttaccctacctacaatgaagtgcacttggatgagaggcccttccttcgccccaatatcatttctggaaaatacgacagcactgctatctatctggatacccacttccggctcctgcgagaagatttcgtcagacctttacgggaaggtattttggaacttctccaaagctttgaagaccagggcctgaggaagagaaagtttgatgacatccgaatctactttgacaccaggattatcacccccatgtgttcatcatcaggcatagtctacaaggtgcagtttgacacaaaaccactgaagtttgttcgctggcagaattccaaacgattgctctatgggtctttggtatgcatgtccaaggacaacttcgagacatttctttttgccaccgtatctaacagggagcaggaagatctctgccgaggaattgtccagctctgcttcaatgagcaaagccaacagctgctagcagaggtccagccctctgactctttcctcatggtagagacaactgcatactttgaggcctacaggcacgtcctggaaggactccaggaggtccaggaggaagatgttcccttccagaggaatatcgtggagtgtaactctcatgtgaaggagccaaggtacttgctaatggggggcagatacgactttacccccttaatagagaatccttcagccactggggaatttctaagaaatgtcgagggtttgagacatcccagaattaatgtcttagatcctggccagtggccctcaaaagaagccctgaagctggatgactcccagatggaagccttgcagtttgctctcacaagggaactggctattattcaaggacctcctggaacaggcaaaacctatgtgggtctaaaaattgttcaggccctcctaaccaacgagtctgtttggcaaattagcctccagaagttccccatcttggttgtgtgttatactaatcatgctttggaccagtttctggaaggcatctacaattgtcagaagaccagcattgtgcgggtgggtggaaggagcaacagtgaaatcctgaagcagttcaccctaagggagctgaggaacaagcgggaattccgccgcaacctccccatgcacctccgaagggcctacatgagtatcatgacacagatgaaggagtcagagcaagagcttcatgaaggagccaagaccctggagtgcaccatgcgtggtgtcctacgggaacagtacctgcagaagtacatctcaccccagcactgggaaagtctcatgaatggaccagtgcaggatagtgaatggatttgcttccagcactggaagcattccatgatgctggagtggctaggtcttggtgtcggttctttcacgcaaagtgtttctccagcaggacctgagaatacagcccaggcagaaggggatgaggaggaagaaggggaggaggagagttcgctgatagagatcgcagaggaagctgacctgattcaagcagaccgggtgattgaggaggaagaggtggtgaggccccagcggcggaagaaggaagagagtggagcagaccaggagttggctaaaatgcttctggccatgaggctagaccattgtggcactgggacagcagctggacaggagcaagccacaggagagtggcagacccagcgcaaccagaaaaagaaaatgaaaaaaagagtgaaggatgagcttcgcaaactgaacaccatgactgcagccgaggccaacgagatcgaggatgtttggcagctggacctcagttctcgctggcagctttataggctctggctacagttgtaccaggctgacacccgccggaagatcctcagctatgaacgccagtaccgcacatcagcagaaagaatggccgagctgagactccaggaagacctgcacattcttaaagatgcccaggttgtaggaatgacaaccacaggtgctgccaaataccgccagatcctacagaaggtggagccgaggattgtcatagtggaagaagctgcggaagtccttgaggcccataccattgccacattgagcaaagcttgccagcacctcattttgattggggaccaccagcagctgcgccccagtgccaacgtgtatgatctggccaagaacttcaaccttgaggtgtccctttttgaacggctagtgaaagtaaacattccctttgtccgtctgaattaccagcaccgtatgtgccctgaaattgcccgccttttgaccccccacatttaccaggatctggagaatcatccatctgttcttaagtatgagaagattaagggggtgtcttccaaccttttctttgtagaacacaactttcctgaacaggaaatccaagagggcaaaagccatcagaaccagcatgaggctcactttgtggtagagctgtgcaagtacttcctgtgccaggaatacctgccttcccagatcaccatcctcactacctataccgggcagctcttctgcctgcgcaaactgatgcctgccaagacatttgctggcgtcagggtccatgttgtggacaaataccaaggggaagagaatgacatcatcctcctctcgctagtgcggagcaaccaagaaggcaaggtgggttttctgcagatatccaaccgcatctgtgtggccttgtcccgagccaagaagggaatgtactgcatcggaaacatgcagatgctggccaaggtgcccctgtggagcaagatcattcatacacttcgagagaacaatcaaataggccccatgctccggctctgctgccagaaccaccctgaaacccacaccttagtatccaaagcttctgacttccaaaaagtacccgaaggaggctgcagcctgccctgcgagttccgcctgggctgtgggcatgtctgcacccgtgcctgccacccttatgactcttcacacaaggagttccaatgcatgaagccatgccagaaggtcatctgtcaggaagggcaccggtgtccccttgtttgcttccaggagtgtcagccttgtcaggtgaaggtgcccaaaaccattcctcggtgcggccatgaacaaatggtcccttgttccgtgcctgagtcagatttctgctgccaggagccttgctccaagtctctgagatgtgggcacagatgcagccacccatgtggtgaggactgtgtgcagctgtgttcagaaatggtcaccataaaactcaagtgtgggcacagtcaaccggtaaaatgtggtcatgtggaaggcctcctgtatggtggtctgctagtcaagtgtaccacaaagtgtggcactatcttggactgcgggcatccttgcccaggctcctgccacagctgcttcgaagggcgtttccatgaacgctgtcagcagccctgcaagcgcctgcttatctgctcacacaagtgccaggaaccatgcattggtgagtgcccaccctgccagcggacctgtcagaaccgctgtgtccacagccagtgcaagaagaaatgtggggagctgtgtagtccctgcgtggaaccctgtgtctggcgctgccagcactaccagtgcaccaaactctgctctgagccctgcaaccgacccccatgctatgtgccttgtactaagctgctagtttgtggccacccctgcattggtctctgtggggagccatgccccaagaaatgccggatctgccacatggatgaggtcacccaaatattctttggctttgaggatgagcctgatgcccgctttgtgcagctggaagactgcagccacatctttgaggtgcaagccctagaccgctacatgaatgaacagaaggatgatgaagtcgccatcagattgaaagtctgccctatctgccaggtgcccatccgcaaaaacctgaggtatggaactagcataaaacagcggctagaagagattgaaatcatcaaggaaaagatccagggctcagcaggggaaatagcaaccagccaggaacggcttaaggccctgctggagaggaagagcctcctccaccagctgcttcctgaagacttcctgatgttaaaggagaagctggcccagaaaaatctgtcagtgaaggacctgggtctggttgagaattacatcagcttctatgaccacctggccagcctgtgggattccctgaaaaagatgcatgtcttagaagagaaaagagtgaggactcgactagaacaggtccatgagtggctggccaagaagcgcttgagcttcactagccaggaactaagtgacctccgaagtgaaatccagaggctcacatacctggtgaaccttctgacccgctacaagatagcagagaagaaggtgaaagatagcatagcagtagaggtctatagtgtccagaatatccttgagaaaacatgtaagttcacccaagaggatgaacaacttgtgcaggaaaagatggaagctctgaaagccacccttccctgctctggcctgggcatctcagaggaagagcgagtgcagattgtcagtgccataggttatcctcgtggtcactggttcaagtgccgcaatggccatatctatgtgattggcgattgtgggggagccatggagaggggcacgtgtcctgactgtaaggaagtgattggtggcacaaatcatactctggaaagaagcaaccagcttgcttctgaaatggatggagcccagcatgctgcctggtctgacacggccaacaacctgatgaactttgaggagatccaggggatgatgtaggaagatggtacaccactgccttttgccctcgccactgaatgactggggccagctccctaatgaaggaactgaagtttgttttttattatcatcctttttaggctgggcgcagtggcttacgcctgtaatcccagcactttgggaggccgaggcaggcggatcacgaggtcaggagttcgagaccagcctgaccaacatggcgaaaccccgtctctactaaaaatacaaaaattagctgggcgttatggcgggcgcctgtaatcccagctacttgggaggctgaggcagaagaatcgcttaaacccaggaggcggaggttgcagtgagctgagatcatgccattgcactccagtctgggcgacaggagcaagactctgtctcaaaaaaaaaaaaatcattctttttagtcttagcacctacttaaggatccacttttagggctcacccacatttgtttctagatttacccctgcgctagagtaagcactttatctccagaactgagagcaaagttaacaaatctcaccccttctctcctgcaaattagtggacagactccctggaacatgtttggggcttccacctagggccacctagtggtatctctgggtctttacttggtcagatgtttattctacattgttccccaggaacagagtatgagctcattgatgcagaccgattctaattgccaggccctaatttgcagactaactctcataataaacagaggcccatagttgtttatgaactgcttatcccttaaaggagcacaagaacccctccctgccctccttgggcaccctgcctccaggagatggaggcacgtgataagacaaaagactgcaccaactcaccctgacacagttacatagtcactgagagtggggaagatgggacagcccacatgctgcataagatgggccttatgcagcaggcccaggtcgtcattaaggagtgacccctttcctgtaacctgcactttgggatggtagaagtttctttacctgctgacaggtttggtggcactgctggttacccctgggccctgaatggagctaaaatcacatttggtaccagcagcacctatcccaagtgtgatccttcatcccaacactccctcttggagctgttccctgggtagagctagcatgccagcagcttctgcaggctccaaacccaggccagaagccagacccaggcctgctgcctgcatctgcattccctccttccagtgttccttagaacagacatttaggtatctcaggtcctttctaagtgtccctttcctatgtatgcatttcctttttttgtctttactatgcactttagcttataaagccaattaaaaacaatgattgagaaaa

SEQ ID NO: 3811 - DNA, 2992 bp, Homo sapiens
gtgcctgggccaggccctcgtgctctccaccctgggcccccgcctcctccttctcctcctctgggccgcccgcccggctccgcccagggtctgcggggaacggaaaccgaaagtgcgcggcgccgggcggggccaccgacctgcctgggccgaagccccagcactcgccggcggcagtgaaaggacgcgccggagccggttttccagataacagaaagtaacgtgaaggaattcaggtgactcagacatggaggagagaagacctcatctggatgccaggcccaggaattcccataccaaccacagaggccctgtggatggagagttaccaccaagagctagaaatcaggccaataacccaccagccaatgctctccgaggaggagccagccaccctggaaggcatcctagggccaacaaccatcctgctgcttactggcagagggaagagagatttagggccatgggcaggaacccacatcaaggaaggaggaaccaggaggggcatgccagcgacgaagctagagaccaaagacatgaccaggagaatgacaccaggtggagaaatggcaaccaggactgtaggaaccgcagaccaccatggtccaatgacaacttccagcagtggcggactccccaccagaagcctacagaacagccacagcaggcgaagaaactgggctacaagttcttagaaagtcttctgcagaaagacccttctgaggtggtcatcacacttgccacaagtttagggctgaaagagctcctttctcattcttccatgaaatctaacttccttgagctcatctgtcaggttcttcggaaggcttgtagctccaaaatggatcgccagagtgttctccatgtactgggcatattgaaaaactccaaatttctcaaagtctgcctgcctgcttatgtggtagggatgatcactgaacccatccctgacatccgaaaccagtatccagagcacataagcaacatcatctccctcctccaggaccttgtaagtgtcttccctgccagctctgtgcaggaaacttccatgctggtttccctcctgccaacctctcttaatgctctgagagcctctggtgttgacatagaagaggaaacggagaagaacctggaaaaggtacagactatcattgaacatctgcaggaaaagaggcgagagggcactttgagagtggatacctacactctagtgcagcctgaggcagaagaccatgttgagagctaccgaaccatgcccatttaccctacctacaatgaagtgcacttggatgagaggcccttccttcgccccaatatcatttctggaaaatacgacagcactgctatctatctggatacccacttccggctcctgcgagaagatttcgtcagacctttacgggaaggtattttggaacttctccaaagctttgaagaccagggcctgaggaagagaaagtttgatgacatccgaatctactttgacaccaggattatcacccccatgtgttcatcatcaggcatagtctacaaggtgcagtttgacacaaaaccactgaagtttgttcgctggcagaattccaaacgattgctctatgggtctttggtatgcatgtccaaggacaacttcgagacatttctttttgccaccgtatctaacagggagcaggaagatctctgccgaggaattgtccagctctgcttcaatgagcaaagccaacagctgctagcagaggtccagccctctgactctttcctcatggtagagacaactgcatactttgaggcctacaggcacgtcctggaaggactccaggaggtccaggaggaagatgttcccttccagaggaatatcgtggagtgtaactctcatgtgaaggagccaaggtacttgctaatggggggcagatacgactttacccccttaatagagaatccttcagccactggggaatttctaagaaatgtcgagggtttgagacatcccagaattaatgtcttagatcctggccagtggccctcaaaagaagccctgaagctggatgactcccagatggaagccttgcagtttgctctcacaagggaactggctattattcaaggacctcctggaacaggcaaaacctatgtgggtctaaaaattgttcaggccctcctaaccaacgagtctgtttggcaaattagcctccagaagttccccatcttggttgtgtgttatactaatcatgctttggaccagtttctggaaggcatctacaattgtcagaagaccagcattgtgcgggtgggtggaaggagcaacagtgaaatcctgaagcagttcaccctaagggagctgaggaacaagcgggaattccgccgcaacctccccatgcacctccgaagggcctacatgagtatcatgacacagatgaaggagtcagagcaagagcttcatgaaggagccaagaccctggagtgcaccatgcgtggtgtcctacgggaacagtacctgcagaagtacatctcaccccagcactgggaaagtctcatgaatggaccagtgcaggatagtgaatggatttgcttccagcactggaagcattccatgatgctggagtggctaggtcttggtgtcggttctttcacgcaaagtgtttctccagcaggacctgagaatacagcccaggcagaaggggatgaggaggaagaaggggaggaggagagttcgctgatagagatcgcagaggaagctgacctgattcaagcagaccgggtgattgaggaggaagaggtggtgaggccccagcggcggaagaaggaagagagtggagcagaccaggagttggctaaaatgcttctggccatgaggctagaccattgtggcactgggacagcagctggacaggagcaagccacaggagagtggcagacccagcgcaaccagaaaaagaaaatgaaaaaaagagagaaggaggaaaaaaaggagagagagaagaggaggaagaaaaaa

SEQ ID NO: 3812 - DNA, 2122 bp, Homo sapiens
tccaaaatggatcgccagagtgttctccatgtactgggcatattgaaaaactccaaatttctcaaagtctgcctgcctgcttatgtggtagggatgatcactgaacccatccctgacatccgaaaccagtatccagagcacataagcaacatcatctccctcctccaggaccttgtaagtgtcttccctgccagctctgtgcaggaaacttccatgctggtttccctcctgccaacctctcttaatgctctgagagcctctggtgttgacatagaagaggaaacggagaagaacctggaaaaggtacagactatcattgaacatctgcaggaaaagaggcgagagggcactttgagagtggatacctacactctagtgcagcctgaggcagaagaccatgttgagagctaccgaaccatgcccatttaccctacctacaatgaagtgcacttggatgagaggcccttccttcgccccaatatcatttctggaaaatacgacagcactgctatctatctggatacccacttccggctcctgcgagaagatttcgtcagacctttacgggaaggtattttggaacttctccaaagctttgaagaccagggcctgaggaagagaaagtttgatgacatccgaatctactttgacaccaggattatcacccccatgtgttcatcatcaggcatagtctacaaggtgcagtttgacacaaaaccactgaagtttgttcgctggcagaattccaaacgattgctctatgggtctttggtatgcatgtccaaggacaacttcgagacatttctttttgccaccgtatctaacagggagcaggaagatctctgccgaggaattgtccagctctgcttcaatgagcaaagccaacagctgctagcagaggtccagccctctgactctttcctcatggtagagacaactgcatactttgaggcctacaggcacgtcctggaaggactccaggaggtccaggaggaagatgttcccttccagaggaatatcgtggagtgtaactctcatgtgaaggagccaaggtacttgctaatggggggcagatacgactttacccccttaatagagaatccttcagccactggggaatttctaagaaatgtcgagggtttgagacatcccagaattaatgtcttagatcctggccagtggccctcaaaagaagccctgaagctggatgactcccagatggaagccttgcagtttgctctcacaagggaactggctattattcaaggacctcctggaacaggcaaaacctatgtgggtctaaaaattgttcaggccctcctaaccaacgagtctgtttggcaaattagcctccagaagttccccatcttggttgtgtgttatactaatcatgctttggaccagtttctggaaggcatctacaattgtcagaagaccagcattgtgcgggtgggtggaaggagcaacagtgaaatcctgaagcagttcaccctaagggagctgaggaacaagcgggaattccgccgcaacctccccatgcacctccgaagggcctacatgagtatcatgacacagatgaaggagtcagagcaagagcttcatgaaggagccaagaccctggagtgcaccatgcgtggtgtcctacgggaacagtacctgcagaagtacatctcaccccagcactgggaaagtctcatgaatggaccagtgcaggatagtgaatggatttgcttccagcactggaagcattccatgatgctggagtggctaggtcttggtgtcggttctttcacgcaaagtgtttctccagcaggacctgagaatacagcccaggcagaaggggatgaggaggaagaaggggaggaggagagttcgctgatagagatcgcagaggaagctgacctgattcaagcagaccgggtgattgaggaggaagaggtggtgaggccccagcggcggaagaaggaagagagtggagcagaccaggagttggctaaaatgcttctggccatgaggctagaccattgtggcactgggacagcagctggacaggagcaagccacaggagagtggcagacagtaccctgcctggtattgatgtctgcagacccagcgcaaccag

SEQ ID NO: 3813 - DNA, 1174 bp, Homo sapiens
cagttttccagataacagaaagtaacgtgaaggaattcaggtgactcagacatggaggagagaagacctcatctggatgccaggcccaggaattcccataccaaccacagaggccctgtggatggagagttaccaccaagagctgagatcatgccattgcactccagtctgggcgacaggagcaagactctgtctcaaaaaaaaaaatcattctttttagtcttagcacctacttaaggatccacttttagggctcacccacatttgtttctagatttacccctgcgctagagtaagcactttatctccagaactgagagcaaagttaacaaatctcaccccttctctcctgcaaattagtggacagactccctggaacatgtttggggcttccacctagggccacctagtggtatctctgggtctttacttggtcagatgtttattctacattgttccccaggaacagagtatgagctcattgatgcagaccgattctaattgccaggccctaatttgcagactaactctcataataaacagaggcccatagttgtttatgaactgcttatcccttaaaggagcacaagaacccctccctgccctccttgggcaccctgcctccaggagatggaggcacgtgataagacaaaagactgcaccaactcaccctgacacagttacatagtcactgagagtggggaagatgggacagcccacatgctgcataagatgggccttatgcagcaggcccaggtcgtcattaaggagtgacccctttcctgtaacctgcactttgggatggtagaagtttctttacctgctgacaggtttggtggcactgctggttacccctgggccctgaatggagctaaaatcacatttggtaccagcagcacctatcccaagtgtgatccttcatcccaacactccctcttggagctgttccctgggtagagctagcatgccagcagcttctgcaggctccaaacccaggccagaagccagacccaggcctgctgcctgcatctgcattccctccttccagtgttccttagaacagacatttaggtatctcaggtcctttctaagtgtccctttcctatgtatgcatttcctttttttgtctttactatgcactttagcttataaagccaattaaaaacaatgattg

SEQ ID NO: 3814 - DNA, 2821 bp, Homo sapiens
gctggtggcgttcaagatgtcgaccaagaatttccgagtcagtgacggggactggatttgccctgacaaaaaatgtggaaatgtaaactttgctagaagaaccagctgtaatcgatgtggtcgggagaaaacaactgaggccaagatgatgaaagctgggggcactgaaataggaaagacacttgcagaaaagagccgaggcctatttagtgctaatgactggcaatgtaaaacttgcagcaatgtgaattgggccagaagatcagagtgtaatatgtgtaatactccaaagtatgctaaattagaagaaagaacaggatatggtggtggttttaatgaaagagaaaatgttgaatatatagaaagagaagaatctgatggtgaatatgatgagtttggacgtaaaaagaaaaaatacagagggaaagcagttggtcctgcatctatattaaaggaagttgaagataaagaatcagagggagaagaagaggatgaggatgaagatctttctaaatataagttagatgaggatgaggatgaagatgacgctgatctctcaaaatataatcttgatgccagtgaagaagaagatagtaataaaaagaaatctaatagacgaagtcgctcaaagtctcgatcttcacattcacgatcttcatcacgctcatcctccccctcaagttcaaggtctaggtccaggtcccgttcaagaagttcttccagttcgcagtcaagatctcgttccagttccagagaacgttcgagatctcgtgggtcgaaatcaagatccagctccaggtcccacaggggctcttcttccccacgaaaaagatcttattcaagttcatcatcttctcctgagaggaacagaaagagaagtcgttctagatcttcttcatctggtgatcgcaaaaaaagacgaacaagatcacggtcacccgaaagccaggtgattggtgaaaacactaaacaaccctgagcccagggccaacccctacggaacaccactactttacccagacgccacaggtcatcatctggatcatcccattctggttcccgttcaagttcaaaaaagaaataatgtattaaaatttacatcttaaaaaaatccagtacagtgcatgaagcatatttttaaagaagttggtgtcttacttggtcagaagtgctaaatctgctagtagaggtgcatgcctttcattgcttttcaaaacaatacagctgtgtttatttgtgaagttaaaagtaaatagcattttaagccataatgtcccaaaatagatgttctgtcattcattatttacaaccatttgcttcatttaaaaccatttcagctataacaaagtactttgcttcctaatttaaacccatttttgtcatttccaaatacatcctgtccattggctaagacaggattacctaggcttgcctgaactttgggcatggaagaaagactggaaactagttggaaacaacatacttatggaaaagaaagtcagcctttttatgctgttaacagatgtcagagtgattctcaccaaaaaaagttaaactatgttgtaagcagccaactgtaaatgtctattttgaaattccctatgctaagggtgccttagaatcattgtgtctcttttatccagctttacttttttgctccacatttaatgcaaaagaatcttgtgatgtctacaaggagagaagtgggatatattttcctttctgacacataatttggggcaaaaaagaaagtcttaagagtttatcttttctctgctgatacggttgcttgataaagacatctcaaaatgtttaccaatgttttaagaagctttgtgtgatattcttccaaatgtagttaccaaatataatatggtagaaaaggctaaatcatacttaatgagcaaattgaagtaagcttttaaagtatatttctcttttggtgaaaggccaatggagacattgtgaatttaagtgaacatttgcctcaagatgttaactataaacacactgcatacaattttcttctgaataacaaatgaatgcttattgctgcatgatgtaagcaaaagtcattatttttcctattcatttgaaataagttatggcttaaaatgcttttggagtttatttctcaaaattaaaatctggtcacatgagctttagtttgttttctggtttaaaaaataaaaaggtttctcttaacagtatttccagtgacaatgcaaggtaagtatatcaaaggaaatcaacagttgtgcttgggggctttttgttatgggatattgatttcttgttttttttccgtaacattgtctgctgcaatttaaataaaaattacgacattttaagatatttcatagacaaaccaaacaaaaatatatgtttttactttaaagtgaatgtttttctcttcagctgatctaaaaatgaaagcaagatatcttatgtagaaatattttgataatatttttacagtgagctttcccatgtttttatgtcttaagtttctttgctgcgtttatgtaggttgcacaagaacttttactcacttgtaattgtgcctcagactttttgaaagtctaccttctaaattgccccgacgatctagattctacatgttaccattggtttattcttgtgctttctgtatttaaaactttggctgtactaagcaaatgcaaggttataatttagctaatagtagtttacagacaattctgatgattatgatttcatttggtttaactaagctgtactagttcatttcataaggaaatgatactgtagacaaatgtaaataaagcctgtgagtcaagca

SEQ ID NO: 3815 - DNA, 3078 bp, Homo sapiens
ccgaggcttctagtgccacgaaggcctcctgcctgggttgtccttatggcgcctgtgagtttagttctagaaaagatatttgtattttaacttttccatctaacaaacagtagcacaggcatcttagtctggacaacaacgtacaagctgaattcctggctagttccctcattatcaaaccctgacacagtagtaggcgcgagtcaggcagtgtggggacagccccgagttgccgaaagtccccggcccgttttcctcctgtgaagacatagctgcgggtggctgtgctggtggcgttcaagatgtcgaccaagaatttccgagtcagtgacggggactggatttgccctgacaaaaaatgtggaaatgtaaactttgctagaagaaccagctgtaatcgatgtggtcgggagaaaacaactgaggccaagatgatgaaagctgggggcactgaaataggaaagacacttgcagaaaagagccgaggcctatttagtgctaatgactggcaatgtaaaacttgcagcaatgtgaattgggccagaagatcagagtgtaatatgtgtaatactccaaagtatgctaaattagaagaaagaacaggatatggtggtggttttaatgaaagagaaaatgttgaatatatagaaagagaagaatctgatggtgaatatgatgagtttggacgtaaaaagaaaaaatacagagggaaagcagttggtcctgcatctatattaaaggaagttgaagataaagaatcagagggagaagaagaggatgaggatgaagatctttctaaatataagttagatgaggatgaggatgaagatgacgctgatctctcaaaatataatcttgatgccagtgaagaagaagatagtaataaaaagaaatctaatagacgaagtcgctcaaagtctcgatcttcacattcacgatcttcatcacgctcatcctccccctcaagttcaaggtctaggtccaggtcccgttcaagaagttcttccagttcgcagtcaagatctcgttccagttccagagaacgttcgagatctcgtgggtcgaaatcaagatccagctccaggtcccacaggggctcttcttccccacgaaaaagatcttattcaagttcatcatcttctcctgagaggaacagaaagagaagtcgttctagatcttcttcatctggtgatcgcaaaaaaagacgaacaagatcacggtcacccgaaagacgccacaggtcatcatctggatcatcccattctggttcccgttcaagttcaaaaaagaaataatgtattaaaatttacatcttaaaaaaatccagtacagtgcatgaagcatatttttaaagaagttggtgtcttacttggtcagaagtgctaaatctgctagtagaggtgcatgcctttcattgcttttcaaaacaatacagctgtgtttatttgtgaagttaaaagtaaatagcattttaagccataatgtcccaaaatagatgttctgtcattcattatttacaaccatttgcttcatttaaaaccatttcagctataacaaagtactttgcttcctaatttaaacccatttttgtcatttccaaatacatcctgtccattggctaagacaggattacctaggcttgcctgaactttgggcatggaagaaagactggaaactagttggaaacaacatacttatggaaaagaaagtcagcctttttatgctgttaacagatgtcagagtgattctcaccaaaaaaagttaaactatgttgtaagcagccaactgtaaatgtctattttgaaattccctatgctaagggtgccttagaatcattgtgtctcttttatccagctttacttttttgctccacatttaatgcaaaagaatcttgtgatgtctacaaggagagaagtgggatatattttcctttctgacacataatttggggcaaaaaagaaagtcttaagagtttatcttttctctgctgatacggttgcttgataaagacatctcaaaatgtttaccaatgttttaagaagctttgtgtgatattcttccaaatgtagttaccaaatataatatggtagaaaaggctaaatcatacttaatgagcaaattgaagtaagcttttaaagtatatttctcttttggtgaaaggccaatggagacattgtgaatttaagtgaacatttgcctcaagatgttaactataaacacactgcatacaattttcttctgaataacaaatgaatgcttattgctgcatgatgtaagcaaaagtcattatttttcctattcatttgaaataagttatggcttaaaatgcttttggagtttatttctcaaaattaaaatctggtcacatgagctttagtttgttttctggtttaaaaaataaaaaggtttctcttaacagtatttccagtgacaatgcaaggtaagtatatcaaaggaaatcaacagttgtgcttgggggctttttgttatgggatattgatttcttgttttttttccgtaacattgtctgctgcaatttaaataaaaattacgacattttaagatatttcatagacaaaccaaacaaaaatatatgtttttactttaaagtgaatgtttttctcttcagctgatctaaaaatgaaagcaagatatcttatgtagaaatattttgataatatttttacagtgagctttcccatgtttttatgtcttaagtttctttgctgcgtttatgtaggttgcacaagaacttttactcacttgtaattgtgcctcagactttttgaaagtctaccttctaaattgccccgacgatctagattctacatgttaccattggtttattcttgtgctttctgtatttaaaactttggctgtactaagcaaatgcaaggttataatttagctaatagtagtttacagacaattctgatgattatgatttcatttggtttaactaagctgtactagttcatttcataaggaaatgatactgtagacaaatgtaaataaagcctgtgagtcaagcatcaagtggtgtttgttagaaataaactagagatttttaaactctga

SEQ ID NO: 3816 - DNA, 2168 bp, Homo sapiens
ggcgacggagcctggctgtgggcccatctttggaaaaaagatctgggaatgattgtctagcctccagcctcaacttacttgatgcttgagagactcaaagccccgtggtcagctgccctgcaaagaaagtattttgaccttggcatttggacagctcccatctctcccatggccctgacaatgctgaatgggctcctgattaaggactcaagcccacctatgctgctgcaccaggttaacaagactgcccagttagataccttcaactaccagagctgctttatgcaaagtgtctttgaccatttccctgagatcttatttatccaccggacctataacccaaggggtaaggtcttatataccttcctggtggatggacctcgggtgcagctggagggtcatcttgcccgagcagtctactttgccatccctgccaaggaggacactgaaggcctggcccagatgttccaagtattcaagaagtttaatccagcatgggagagagtctgtaccatcctggtggatcctcatttccttccactgcctatcctagctatggagttccccacagctgaggtccttctctcagccttccacatttgtaagttcctccaggccaagttctatcagctgtcccttgaacggcccgtggaaaggctgctcctgacctccctgcagagcacaatgtgctcagccacagcaggcaacctgagaaagttgtatacactcctgagcaactgcatccctccagccaagctgcccgagcttcactcacactggctgctcaacgaccgcatctggctggctcaccgctggagaagccgagctgagagcagccactacttccagagcctcgaggtcaccacccacatcctcagccagttctttggtaccaccccatctgagaaacaaggtatggcttctctgttccgttacatgcagcagaactctgcagacaaggcaaacttcaaccagggcctgtgtgcccagaacaatcatgctccctcagacaccatccccgaaagccccaaactggagcagctggtagaatcccacatccagcactccctcaatgccatctgcacagggccagcagcccaactgtgcctgggcgagcttgctgtggtccagaaatccacacacctcattggctctggctcagaaaagatgaacatacagatcctggaagatacccataaggtgcagccccagccccctgccagctgcagctgctactttaaccaggccttccacctgccctgccgccacatcctagccatgctcagtgcccgccgccaggtgctccagcccgacatgctgccggctcagtggacggcaggctgtgctaccagtctagacagcatcctgggcagcaagtggagtgagaccctggataagcacctggcagtgactcacctcaccgaggaggtgggtcagctgttgcagcactgcaccaaggaggagtttgagcggaggtatagcaccctgcgggaactggccgacagctggattgggccttatgagcaggtccaactctgattattctcgatgcccagagatgctcatgcacctgtgcacactcacatccacccatacacacacacacacacacacacacacacacacacacactcccttacactgttgtacttccgtgggccctccttccagaacaaggacaacaaggacaaggttgaagggtcttctcatctaccatggcctgctacctagcatgtgtctagctcaatgagacaggagtcagcaaatcttaatctgtttagtttactcaggtggccacatacagtctctgttgtatattcttggttttgttttaatattttttttctttttttttttttttttttttttgagaaggagtctgtctccagcctgggagggtgagactccatctaaaaaaaataaaataaatggcaacccctggtctaagataagagataaaacatcaggtggtgaggttgaggtttggggcttggtagcagttgccccagtcatgagatgactcacttaacccgtctcctttaagtgagctgggctgggaggcttcctacaggggaagaggcccctctggggagctgactcagccaggctccctgaacttttttccttgtcccatcctggggtcaataaaactgaatgttgcatattct

SEQ ID NO: 3817 - DNA, 2769 bp, Homo sapiens
aaatagggagaaatggcgacggagcctggctgtgggcccatctttggaaaaaagatctgggaatgattgtctagcctccagcctcaacttacttgatgcttgagagactcaaagccccgtggtcagctgccctgcaaagaaagtattttgaccttggcatttggacagctcccatctctcccatggccctgacaatgctgaatgggctcctgattaaggactcaagcccacctatgctgctgcaccaggttaacaagactgcccagttagataccttcaactaccagagctgctttatgcaaagtgtctttgaccatttccctgagatcttatttatccaccggacctataacccaaggggtaaggtcttatataccttcctggtggatggacctcgggtgcagctggagggtcatcttgcccgagcagtctactttgccatccctgccaaggaggacactgaaggcctggcccagatgttccaagtattcaagaagtttaatccagcatgggagagagtctgtaccatcctggtggatcctcatttccttccactgcctatcctagctatggagttccccacagctgaggtccttctctcagccttccacatttgtaagttcctccaggccaagttctatcagctgtcccttgaacggcccgtggaaaggctgctcctgacctccctgcagagcacaatgtgctcagccacagcaggcaacctgagaaagttgtatacactcctgagcaactgcatccctccagccaagctgcccgagcttcactcacactggctgctcaacgaccgcatctggctggctcaccgctggagaagccgagctgagagcagccactacttccagagcctcgaggtcaccacccacatcctcagccagttctttggtaccaccccatctgagaaacaaggtatggcttctctgttccgttacatgcagcagaactctgcagacaaggcaaacttcaaccagggcctgtgtgcccagaacaatcatgctccctcagacaccatccccgaaagccccaaactggagcagctggtagaatcccacatccagcactccctcaatgccatctgcacagggccagcagcccaactgtgcctgggcgagcttgctgtggtccagaaatccacacacctcattggctctggctcagaaaagatgaacatacagatcctggaagatacccataaggtgcagccccagccccctgccagctgcagctgctactttaaccaggccttccacctgccctgccgccacatcctagccatgctcagtgcccgccgccaggtgctccagcccgacatgctgccggctcagtggacggcaggctgtgctaccagtctagacagcatcctgggcagcaagtggagtgagaccctggataagcacctggcagtgactcacctcaccgaggaggtgggtcagctgttgcagcactgcaccaaggaggagtttgagcggaggtatagcaccctgcgggaactggccgacagctggattgggccttatgagcaggtccaactctgattattctcgatgcccagagatgctcatgcacctgtgcacactcacatccacccatacacacacacacacacacacacacacacacacacacactcccttacactgttgtacttccgtgggccctccttccagaacaaggacaacaaggacaaggttgaagggtcttctcatctaccatggcctgctacctagcatgtgtctagctcaatgagacaggagtcagcaaatcttaatctgtttagtttactcaggtggccacatacagtctctgttgtatattcttggttttgttttaatattttttttctttttttttttttttttttttttgagaaggagtctgtctccgtcacccaggctggagtgcagtggcgcaatctctgctcactgcaagctccacctcctgggttcacaccattctcctgcctcagcctcccgagtatctgggactacaggcgcccgccacaatgccgggctaattttttgtatttttagtagagacggggtttcaccgtgttagccaggatggtctcgatctcctgacttcgtgatctgcccgcctcggcctcccaaagtgctgggattacaggcgtgagccatcgcacccggcctgttttaacattttcataaggtaaaaacctttcttagctcaaaggtctttaaaaaagcaggcaatccagctgggcatggtggctcacgcctgtaatcccagcattttgggaggctgaggtggacagatgacttgaggtcaggagttcaagaccagcctggccaacatagtgaaaccctgtctctactaaaaatacacaaattagccaggtgtggtggcgggggccctgtaatcccagctactcgggaggctgaggcaggagaatcgcttgaacctgggaggcagaggttgcagtaggccaagatcctgctgccactgcactccagcctgggagggtgagactccatctaaaaaaaataaaataaatggcaacccctggtctaagataagagataaaacatcaggtggtgaggttgaggtttggggcttggtagcagttgccccagtcatgagatgactcacttaacccgtctcctttaagtgagctgggctgggaggcttcctacaggggaagaggcccctctggggagctgactcagccaggctccctgaacttttttccttgtcccatcctggggtcaataaaactgaatgttgcatattcta

SEQ ID NO: 3818 - DNA, 2008 bp, Homo sapiens
cctgccccggcggggggtcaggatcctccacaggtaggcgcagtcagctggagcgtcgcggcggtccgccggtcgtggagggcgtgtcctgcggcgcgatggccgtagtgttgccggcggttgtggaggagctcctgagcgagatggcggcggcggtgcaggagagcgcgcgaattcctgatgaatatctgttatcgctgaagtttctctttggctcatcagccacccaggccttggacctagttgatcgacagtccatcaccttaatctcatcacccagtggaaggcgtgtttaccaggtccttggaagttccagtaaaacatacacatgtttggcttcttgtcattactgttcatgtcctgcatttgcattctcagtgctacggaagagtgacagcatcctgtgcaagcatctcttggcagtttacctgagtcaggttatgaggacctgtcagcagctaagtgtctctgacaagcagttgactgacatattattgatggagaagaaacaagaagcataaaaggtacagattgagcatcattctttcaaaatagaatcctgtcaagaaatgcattgaaagcgtcatgattcacatggaaaagaggtgaaatggatcttcagacacttcatgttactgtcccttttccctccaggactgcaggaggtgctgtgggttggagccgtgggctgtggagggtttgtgtatgatgagaagccctgtacagtcttgtcaagaaataccctgagccagtctctgagacgcttcggtaaaaaatgtccctggatggaatcaagattttaaattcaaataaagcctaatatcatgttgtgtccacattatttagtctttttttttttcttttgagatggagtctcactttgtcgcccaggctggggtgcagtggcgtgatctcagctcactgcaagctccgcctcccgggttcacgccattctcctgcctcagcctcccgagtagctgggactacaggtacccgccaccatgcccggctaaatttttgtattttttttttagtagagatggggtttcaccgtgttagccaggatggtctccatctcctgacctagtggtctgcccgcctcgacctcccaaagtgctggaattacatgcatgagccactgcgcctgaccctatttagtcttaagtaactaactgaattactagtaatttttaaaaggttggaatggtgggccaaacagtaagatgaagtttcgacgagtaggtcagttcttttccttgggtccaggaaactattgagcagcaacagaagatcagagcagagatgtggctaaacagtagcaggtatgaaaagacttagaggttctggtttctgtaagcttcaaatatctgtgatgcttgtgccaaaacagcttaagtagactgtattgtttgagagttagtatcgagaacaagggaagaactggtttcactctgcacttctgatctttacaacagggcaattgaaggaacagactaaaaatcgtgtcctggaaggaaactacaggtactaccagggattttcagtctgaagaagaaaagacaaaatagatgacagaaggagtattagaagggagagcgatgagactcagttggacaccgagagagcaaagaagcaataatacgtgaagatgaaaatgaaatcaatttcagcataagaagacaagaacttatggtaaagctgcccacagccagaagaggatcctagaaggacaggaattccctgtctgcagcatttcataagcatgtaatattgttgcagggatactgcagaaggagttgaagcagtggacagacagatgatataggtgattttacagcctaagaaagccctgtgcttgtgcccccaaaacatgaggtgctagtgaatgaatgctgggggaaagcccagggcctaggtgttgcaatgttctgtggttggcagatgctttttgttttgttaaaaagtgcaacagataaaatttatcaatacttttctgctactcaggaaa

SEQ ID NO: 3819 - DNA, 703 bp, Homo sapiens
ggcggggggtcaggatcctccacaggtaggcgcagtcagctggagcgtcgcggcggtccgccggtcgtggagggcgtgtcctgcggcgcgatggccgtagtgttgccggcggttgtggaggagctcctgagcgagatggcggcggcggtgcaggagagcgcgcgaattcctgatgaatatctgttatcgctgaagtttctctttggctcatcagccacccaggccttggacctagttgatcgacagtccatcaccttaatctcatcacccagtggaaggcgtgtttaccaggtccttggaagttccagtaaaacatacacatgtttggcttcttgtcattactgttcatgtcctgcatttgcattctcagtgctacggaagagtgacagcatcctgtgcaagcatctcttggcagtttacctgagtcaggttatgaggacctgtcagcagctaagtgtctctgacaagcagttgactgacatattattgatggagaagaaacaagaagcataaaaggactgcaggaggtgctgtgggttggagccgtgggctgtggagggtttgtgtatgatgagaagccctgtacagtcttgtcaagaaataccctgagccagtctctgagacgcttcggtaaaaaatgtccctggatggaatcaagattttaaattcaaataaagcctaatatcatgttgtgtccacatta

SEQ ID NO: 3820 - DNA, 2468 bp, Homo sapiens
aggagcgggaggcggggacccacctggaagcgccgcggcgccgctatcgagcttcctgcagcggtggccacccgagcaagtgccgtggcgggggcggagagcggccacggcggcggcgcctccccaagtggcccgttgcgtccgaccccgcgtgaaagatatcaagttattctagtacaaccatataaataaataatacctgaagtctcagtgtaacatggacaattaacagtgatgacagataaatacagacgcatggggatcaaatactaggcaaaacgctttttaaaagtgtatcaggcttttaagaaacactgcaggatcctgtctatcttaatgctgatagagctcagctaaaaatttaggaggttctagtattcttcatggctgaagctgagagagtctgaaaccctgatgcttaagctccattctagatcatagctccaactccttcaggatataaggaaaagagattatatttccacaatgatagatctttggttgtacagttatcagagactattacagacgattgctgtactcgaggctcagcgttctcaagcagtccaagaccttgaaagtttaggcaggcaccagagagaagcactgaaaaatcccattggatttgtggaaaaactccagaagaaggctgatattgggcttccatatccacagagagttgttcaattgcctgagatcgtatgggaccaatatacccatagccttgggaattttgaaagagaatttaaaaatcgtaaaagacatactagaagagttaagctagtttttgataaagtaggtttacctgctagaccaaaaagtcctttagatcctaagaaggatggagagtccctttcatattctatgttgcctttgagtgatggtccagaaggctcaagcagtcgtcctcagatgataagaggacgcttgtgtgatgataccaaacctgaaacatttaaccagttgtggactgttgaagaacagaaaaagctggaacagctactcatcaaataccctcctgaagaagtagaatctcgacgctggcagaagatagcagatgaattgggcaacaggacagcaaaacaggttgccagccgagtacagaagtatttcataaagctaactaaagctggcattccagtaccaggcagaacaccaaacttatatatatactccaaaaagtcttcaacaagcagacgacagcaccctcttaataagcatctctttaagccttccactttcatgacttcacatgaaccgccagtgtatatggatgaagatgatgaccgatcttgttttcatagccacatgaacactgctgttgaagatgcatcagatgacgaaagtattcctatcatgtataggaatttacctgaatataaagaactattacagtttaaaaagttaaagaagcagaaacttcagcaaatgcaagctgaaagtggatttgtgcaacatgtgggctttaagtgtgataactgtggcatagaacccatccagggtgttcggtggcattgccaggattgtcctccagaaatgtctttggatttctgtgattcttgttcagactgtctacatgaaacagatattcacaaggaagatcaccaattagaacctatttataggtcagagacattcttagacagagactactgtgtgtctcagggcaccagttacaattaccttgacccaaactactttccagcaaacagatgacatggaagagaacatcatttactagtcctcttcaacacatagcaatggtatcattgttaattatgtgcacagtttggaaagattctctgctttcccagaaatgacactcacagcatgagagcttcctgagtgttctcgtcaagtacagctctgcaccgttgtggctctagatcactgttcagcagctgaacattcctggtgagcaaaggtttccctggtgaatttttcaccactgcgttttaggtggtgatcttaaatgggtgagatggaacgagagcacacattaaagagagagtaaattccaaaggtttcaaagaacttggtcataaatatgataatgagaagacaaagtatttatattaaaacagtttagtagccttcagttttgtgaaaatagttttcagcacagaaactgacttctttagacaaagttttaaccaatgatggtgtttgcttctaggatatacactttaaaagaactcactgtcccagtggtggtcattgatggcctttagtaaattggagctgcttaatcatattgatatctaatttcttttaaccacaatgaattgtccttaattaccaacagtgaagcactacaggaggcaactgtggcattgcttccttaaccagctcatggtgtgtgaatgttataaaattgtcactcagatatattttttaaatgtaatgttatataagatgatcatgtgatgtgtacaaactatggtgaaaagtgccagtggtagtaactg

SEQ ID NO: 3821 - DNA, 4328 bp, Homo sapiens
gttggcagagcagttgtcctggatggcggagccttgggttccgggggcctgggacctgcaactctttctacaagatatcaagttattctagtacaaccatataaataaataatacctgaagtctcagtgtaacatggacaattaacagtgatgacagataaatacagacgcatggggatcaaatactaggcaaaacgctttttaaaagtgtatcaggcttttaagaaacactgcaggatcctgtctatcttaatgctgatagagctcagctaaaaatttaggaggttctagtattcttcatggctgaagctgagagagtctgaaaccctgatgcttaagctccattctagatcatagctccaactccttcaggatataaggaaaagagattatatttccacaatgatagatctttggttgtacaggtttcccaatgagtggatcatgatgaccgtattgtagggacttgccatagtatggctgcttcccgatctactcgtgttacaagatcaacagtggggttaaacggcttggatgaatctttttgtggtagaactttaaggaatcgtagcattgcgcatcctgaagaaatctcttctaattctcaagtacgatcaagatcaccaaagaagagaccagagcctgtgccaattcagaaaggaaataataatgggagaaccactgatttaaaacagcagagtacccgagaatcatgggtaagccctaggaaaagaggactttcttcttcagaaaaggataacatagaaaggcaggctatagaaaattgtgagagaaggcaaacagaacctgtttcaccagttttaaaaagaattaagcgttgtcttagatctgaagcaccaaacagttcagaagaagattctcctataaaatcagacaaggagtcagtagaacagaggagtacagtagtggacaatgatgcagattttcaagggactaaacgagcttgtcgatgtcttatactggatgattgtgagaaaagggaaattaaaaaggtgaatgtcagtgaggaagggccacttaattctgcagtagttgaagaaatcacaggctatttggctgtcaatggtgttgatgacagtgattcagctgttataaactgtgatgactgtcagcctgatgggaacactaaacaaaatagcattggttcctatgtgttacaggaaaaatcagtagctgaaaatggggatacggatacccaaacttcaatgttccttgatagtaggaaggaggacagttatatagaccataaggtgccttgcacagattcacaagtgcaggtcaagttggaggaccacaaaatagtaactgcctgcttgcctgtggaacatgttaatcagctgactactgagccagctacagggcccttttctgaaactcagtcatctttaagggattctgaggaggaagtagatgtggtgggagatagcagtgcctcaaaagagcagtgtaaagaaaacaccaataacgaactggacacaagtcttgagagtatgccagcctccggagaacctgaaccatctcctgttctagactgtgtttcagctcaaatgatgtctttatcagaacctcaagaacatcgttatactctgagaacctcaccacgaagggcagcccctaccagaggtagtcccactaaaaacagttctccttacagagaaaatggacaatttgaggagaataatcttagtcctaatgaaacaaatgcaactgttagtgataatgtaagtcaatctcctacaaatcctggtgaaatttctcaaaatgaaaaagggatatgttgtgactctcaaaataatggaagtgaaggagtaagtaaaccaccctcagaggcaagactcaatattggacatttgccatctgccaaagagagtgccagtcagcacattacagaagaggaagatgatgatcctgatgtttattactttgaatcagatcatgtggcactgaaacacaacaaagattatcagagactattacagacgattgctgtactcgaggctcagcgttctcaagcagtccaagaccttgaaagtttaggcaggcaccagagagaagcactgaaaaatcccattggatttgtggaaaaactccagaagaaggctgatattgggcttccatatccacagagagttgttcaattgcctgagatcgtatgggaccaatatacccatagccttgggaattttgaaagagaatttaaaaatcgtaaaagacatactagaagagttaagctagtttttgataaagtaggtttacctgctagaccaaaaagtcctttagatcctaagaaggatggagagtccctttcatattctatgttgcctttgagtgatggtccagaaggctcaagcagtcgtcctcagatgataagaggacgcttgtgtgatgataccaaacctgaaacatttaaccagttgtggactgttgaagaacagaaaaagctggaacagctactcatcaaataccctcctgaagaagtagaatctcgacgctggcagaagatagcagatgaattgggcaacaggacagcaaaacaggttgccagccgagtacagaagtatttcataaagctaactaaagctggcattccagtaccaggcagaacaccaaacttatatatatactccaaaaagtcttcaacaagcagacgacagcaccctcttaataagcatctctttaagccttccactttcatgacttcacatgaaccgccagtgtatatggatgaagatgatgaccgatcttgttttcatagccacatgaacactgctgttgaagatgcatcagatgacgaaagtattcctatcatgtataggaatttacctgaatataaagaactattacagtttaaaaagttaaagaagcagaaacttcagcaaatgcaagctgaaagtggatttgtgcaacatgtgggctttaagtgtgataactgtggcatagaacccatccagggtgttcggtggcattgccaggattgtcctccagaaatgtctttggatttctgtgattcttgttcagactgtctacatgaaacagatattcacaaggaagatcaccaattagaacctatttataggtcagagacattcttagacagagactactgtgtgtctcagggcaccagttacaattaccttgacccaaactactttccagcaaacagatgacatggaagagaacatcatttactagtcctcttcaacacatagcaatggtatcattgttaattatgtgcacagtttggaaagattctctgctttcccagaaatgacactcacagcatgagagcttcctgagtgttctcgtcaagtacagctctgcaccgttgtggctctagatcactgttcagcagctgaacattcctggtgagcaaaggtttccctggtgaatttttcaccactgcgttttaggtggtgatcttaaatgggtgagatggaacgagagcacacattaaagagagagtaaattccaaaggtttcaaagaacttggtcataaatatgataatgagaagacaaagtatttatattaaaacagtttagtagccttcagttttgtgaaaatagttttcagcacagaaactgacttctttagacaaagttttaaccaatgatggtgtttgcttctaggatatacactttaaaagaactcactgtcccagtggtggtcattgatggcctttagtaaattggagctgcttaatcatattgatatctaatttcttttaaccacaatgaattgtccttaattaccaacagtgaagcactacaggaggcaactgtggcattgcttccttaaccagctcatggtgtgtgaatgttataaaattgtcactcagatatattttttaaatgtaatgttatataagatgatcatgtgatgtgtacaaactatggtgaaaagtgccagtggtagtaactgtgtaaagtttctaattcacaacattaattcctttaaaatacacagccttctgcctctgtatttggagttgtcagtacaactcatcaaagaaaactgcctaatataaaaatcatatatatggtaataatttccctcttttgtagtctgcacaagatccataaaagattgtatttttattactatttaaacaagtgattaaatttagtctgcacagtgagcaagggttcacatgcattcttttatactgctggattttgttgtgcatcatttaaaacattttgtatgtttcttcttatctgtgtatacagtatgttcttgaatgatgttcatttgtcaggagaactgtgagaaataaactatgtggatactgtctgtttatattatagaa

SEQ ID NO: 3822 - DNA, 561 bp, Homo sapiens
atcgagcttcctgcagcggtggccacccgagcaagtgccgtggcgggggcggagagcggccacggcggcggcgcctccccaagtggcccgttgcgtccgaccccgcgtgaaagatatcaagttattctagtacaaccatataaataaataatacctgaagtctcagtgtaacatggacaattaacagtgatgacagataaatacagacgcatggggatcaaatactaggcaaaacgctttttaaaagaaaaatttaggaggttctagtattcttcatggctgaagctgagagagtctgaaaccctgatgcttaagctccattctagatcatagctccaactccttcaggatataaggaaaagagattatatttccacaatgatagatctttggttgtacaggtttcccaatgagtggatcatgatgaccgtattgtagggacttgccatagtatggctgcttcccgatctactcgtgttacaagatcaacagtggggttaaacggcttggatgaatctttttgtggtagaactttaaggaatcgtagcattgcgcatcctg

SEQ ID NO: 3823 - DNA, 603 bp, Homo sapiens
gattctcgcgggacctcgttggcagagcagttgtcctggatggcggagccttgggttccgggggcctgggacctgcaactctttctacaagatatcaagttattctagtacaaccatataaataaataatacctgaagtctcagtgtaacatggacaattaacagtgatgacagataaatacagacgcatggggatcaaatactaggcaaaacgctttttaaaagaaaaatttaggaggttctagtattcttcatggctgaagctgagagagtctgaaaccctgatgcttaagctccattctagatcatagctccaactccttcaggatataaggaaaagagattatatttccacaatgatagatctttggttgtacaggtttcccaatgagtggatcatgatgaccgtattgtagggacttgccatagtatggctgcttcccgatctactcgtgttacaagatcaacagtggggttaaacggcttggatgaatctttttgtggtagaactttaaggaatcgtagcattgcgcatcctgaagaaatctcttctaattctcaagtacgatcaagatcaccaaagaagagaccagagcctgtgcc

SEQ ID NO: 3824 - DNA, 864 bp, Homo sapiens
gccgcgggcgcagagctggcgctctagcccacggagttggttaactcctctcaccggcccctggaaagggttccaagtcctttagtacccgacgctgtctgggaattccgggcgtttcggctccttggtcgcagaggcaggaggcgtgcgtggcaggagggttcgggttatatactcctaggtcctgggacagaatagttacgacctctgggacaggaactcttctctcttttgttaataaacttccaactccctcctcagacccgaccgcatgtctgtcatggacctcgccaatacttgctccagctttcagtcggacctggatttctgttcagattgcggctcggtcctgcctctgcccggggctcaggatacggtcacctgtattcgctgtggcttcaacatcaacgttcgggactttgaggggaaggttgtgaagacttcggttgtgttccaccaactggggacagccatgcctatgtcggtggaggaagggcctgagtgccagggacctgtggttgacaggcgctgccctcgatgtggtcatgaaggaatggcataccacaccagacagatgcgttcagccgatgaagggcaaactgtcttctacacctgtaccaactgcaagttccaggagaaggaagactcttgacctttttcctgggcaactctacagtccctccctcctttcggaaggtgaaggatactgggtttttagatgccttgtccatcctgtctggttgcaatgttttgctcccagaagagaatcagatcatcatgtggggattaccattgttcctggagtactcctacccttagttgaatttccttattaaagttatatttttctataagaccctgaca

SEQ ID NO: 3825 - DNA, 743 bp, Homo sapiens
gggcgcagagctggcgctctagcccacggagttggttaactcctctcaccggcccctggaaagggttccaagtcctttagtacccgacgctgtctgggaattccgggcgtttcggctccttggtcgcagaggcaggaggcacccgaccgcatgtctgtcatggacctcgccaatacttgctccagctttcagtcggacctggatttctgttcagattgcggctcggtcctgcctctgcccggggctcaggatacggtcacctgtattcgctgtggcttcaacatcaacgttcgggactttgaggggaaggttgtgaagacttcggttgtgttccaccaactggggacagccatgcctatgtcggtggaggaagggcctgagtgccagggacctgtggttgacaggcgctgccctcgatgtggtcatgaaggaatggcataccacaccagacagatgcgttcagccgatgaagggcaaactgtcttctacacctgtaccaactgcaagttccaggagaaggaagactcttgacctttttcctgggcaactctacagtccctccctcctttcggaaggtgaaggatactgggtttttagatgccttgtccatcctgtctggttgcaatgttttgctcccagaagagaatcagatcatcatgtggggattaccattgttcctggagtactcctacccttagttgaatttccttattaaagttatatttttctataagaccctgaca

SEQ ID NO: 3826 - DNA, 736 bp, Homo sapiens
gcgggcgcagagctggcgctctagcccacggagttggttaactcctctcaccggcccctggaaagggttccaagtcctttagtacccgacgctgtctgggaattccgggcgtttcggctccttggtcgcagagacccgaccgcatgtctgtcatggacctcgccaatacttgctccagctttcagtcggacctggatttctgttcagattgcggctcggtcctgcctctgcccggggctcaggatacggtcacctgtattcgctgtggcttcaacatcaacgttcgggactttgaggggaaggttgtgaagacttcggttgtgttccaccaactggggacagccatgcctatgtcggtggaggaagggcctgagtgccagggacctgtggttgacaggcgctgccctcgatgtggtcatgaaggaatggcataccacaccagacagatgcgttcagccgatgaagggcaaactgtcttctacacctgtaccaactgcaagttccaggagaaggaagactcttgacctttttcctgggcaactctacagtccctccctcctttcggaaggtgaaggatactgggtttttagatgccttgtccatcctgtctggttgcaatgttttgctcccagaagagaatcagatcatcatgtggggattaccattgttcctggagtactcctacccttagttgaatttccttattaaagttatatttttctataagaccctgaca

SEQ ID NO: 3827 - DNA, 754 bp, Homo sapiens
gcagagctggcgctctagcccacggagttggttaactcctctcaccggcccctggaaagggttccaagtcctttagtacccgacgctgtctgggaattccgggcgtttcggctccttggtcgcagaggcaggaggcgtgcgtggcaggaggacccgaccgcatgtctgtcatggacctcgccaatacttgctccagctttcagtcggacctggatttctgttcagattgcggctcggtcctgcctctgcccggggctcaggatacggtcacctgtattcgctgtggcttcaacatcaacgttcgggactttgaggggaaggttgtgaagacttcggttgtgttccaccaactggggacagccatgcctatgtcggtggaggaagggcctgagtgccagggacctgtggttgacaggcgctgccctcgatgtggtcatgaaggaatggcataccacaccagacagatgcgttcagccgatgaagggcaaactgtcttctacacctgtaccaactgcaagttccaggagaaggaagactcttgacctttttcctgggcaactctacagtccctccctcctttcggaaggtgaaggatactgggtttttagatgccttgtccatcctgtctggttgcaatgttttgctcccagaagagaatcagatcatcatgtggggattaccattgttcctggagtactcctacccttagttgaatttccttattaaagttatatttttctataagaccctgaca

SEQ ID NO: 3828 - DNA, 736 bp, Homo sapiens
gcgggcgcagagctggcgctctagcccacggagttggttaactcctctcaccggcccctggaaagggttccaagtgctttagtacccgacgctgtctgggaattccgggcgtttcggctccttggtcgcagagacccgaccgcatgtctgtcatggacctcgccaatacttgctccagctttcagtcggacctggatttctgttcagattgcggctcggtcctgcctctgcccggggctcaggatacggtcacctgtattcgctgtggcttcaacatcaacgttcgggactttgaggggaaggttgtgaagacttcggttgtgttccaccaactggggacagccatgcctatgtcggtggaggaagggcctgagtgccagggacctgtggttgacaggcgctgccctcgatgtggtcatgaaggaatggcataccacaccagacaaatgcgttcagccgatgaagggcaaactgtcttctacacctgtaccaactgcaagttccaggagaaggaagactcttgacctttttcctgggcaactctgcagtccctccctcctttcggaaggtgaaggatactgggtttttagatgccttgtccatcctgtctggttgcaatgttttgctcccagaagagaatcagatcatcatgtggggattaccattgttcctggagtactcctacccttagttgaatttccttattaaagttatatttttctataagaccctgaca

SEQ ID NO: 3829 - DNA, 755 bp, Homo sapiens
gcagagctggcgctctagcccacggagttggttaactcctctcaccggcccctggaaagggttccaagtgctttagtacccgacgctgtctgggaattccgggcgtttcggctccttggtcgcagaggcaggagggcgtgcgtggcaggaggacccgaccgcatgtctgtcatggacctcgccaatacttgctccagctttcagtcggacctggatttctgttcagattgcggctcggtcctgcctctgcccggggctcaggatacggtcacctgtattcgctgtggcttcaacatcaacgttcgggactttgaggggaaggttgtgaagacttcggttgtgttccaccaactggggacagccatgcctatgtcggtggaggaagggcctgagtgccagggacctgtggttgacaggcgctgccctcgatgtggtcatgaaggaatggcataccacaccagacaaatgcgttcagccgatgaagggcaaactgtcttctacacctgtaccaactgcaagttccaggagaaggaagactcttgacctttttcctgggcaactctgcagtccctccctcctttcggaaggtgaaggatactgggtttttagatgccttgtccatcctgtctggttgcaatgttttgctcccagaagagaatcagatcatcatgtggggattaccattgttcctggagtactcctacccttagttgaatttccttattaaagttatatttttctataagaccctgaca

SEQ ID NO: 3830 - DNA, 744 bp, Homo sapiens
gggcgcagagctggcgctctagcccacggagttggttaactcctctcaccggcccctggaaagggttccaagtgctttagtacccgacgctgtctgggaattccgggcgtttcggctccttggtcgcagaggcaggagggcacccgaccgcatgtctgtcatggacctcgccaatacttgctccagctttcagtcggacctggatttctgttcagattgcggctcggtcctgcctctgcccggggctcaggatacggtcacctgtattcgctgtggcttcaacatcaacgttcgggactttgaggggaaggttgtgaagacttcggttgtgttccaccaactggggacagccatgcctatgtcggtggaggaagggcctgagtgccagggacctgtggttgacaggcgctgccctcgatgtggtcatgaaggaatggcataccacaccagacaaatgcgttcagccgatgaagggcaaactgtcttctacacctgtaccaactgcaagttccaggagaaggaagactcttgacctttttcctgggcaactctgcagtccctccctcctttcggaaggtgaaggatactgggtttttagatgccttgtccatcctgtctggttgcaatgttttgctcccagaagagaatcagatcatcatgtggggattaccattgttcctggagtactcctacccttagttgaatttccttattaaagttatatttttctataagaccctgaca

SEQ ID NO: 3831 - DNA, 865 bp, Homo sapiens
gccgcgggcgcagagctggcgctctagcccacggagttggttaactcctctcaccggcccctggaaagggttccaagtgctttagtacccgacgctgtctgggaattccgggcgtttcggctccttggtcgcagaggcaggagggcgtgcgtggcaggagggttcgggttatatactcctaggtcctgggacagaatagttacgacctctgggacaggaactcttctctcttttgttaataaacttccaactccctcctcagacccgaccgcatgtctgtcatggacctcgccaatacttgctccagctttcagtcggacctggatttctgttcagattgcggctcggtcctgcctctgcccggggctcaggatacggtcacctgtattcgctgtggcttcaacatcaacgttcgggactttgaggggaaggttgtgaagacttcggttgtgttccaccaactggggacagccatgcctatgtcggtggaggaagggcctgagtgccagggacctgtggttgacaggcgctgccctcgatgtggtcatgaaggaatggcataccacaccagacaaatgcgttcagccgatgaagggcaaactgtcttctacacctgtaccaactgcaagttccaggagaaggaagactcttgacctttttcctgggcaactctgcagtccctccctcctttcggaaggtgaaggatactgggtttttagatgccttgtccatcctgtctggttgcaatgttttgctcccagaagagaatcagatcatcatgtggggattaccattgttcctggagtactcctacccttagttgaatttccttattaaagttatatttttctataagaccctgaca

SEQ ID NO: 3832 - DNA, 754 bp, Homo sapiens; identical to SEQ ID NO: 3827

SEQ ID NO: 3833 - DNA, 864 bp, Homo sapiens; identical to SEQ ID NO: 3824

SEQ ID NO: 3834 - DNA, 864 bp, Homo sapiens; identical to SEQ ID NO: 3824

SEQ ID NO: 3835 - DNA, 736 bp, Homo sapiens; identical to SEQ ID NO: 3826

SEQ ID NO: 3836 - DNA, 736 bp, Homo sapiens
gcgggcgcagagctggcgctctagcccacggagttggttaactcctctcaccggcccctggaaagggttccaagtcctttagtacccgacgctgtctgggaattccgggcgtttcggctccttggtcgcagagacccgaccgcatgtctgtcatggacctcgccaatacttgctccagctttcagtcggacctggatttctgttcagattgcggctcggtcctgcctctgcccggggctcaggatacggtcacctgtattcgctgtggcttcaacatcaacgttcgggactttgaggggaaggttgtgaagacttcggttgtgttccaccaactggggacagccatgcctatgtcggtggaggaagggcctgagtgccagggacctgtggttgacaggcgctgccctcgatgtggtcatgaaggaatggcataccacaccagacagatgcgttcagccgatgaagggcaaactgtcttctacacctgtaccaactgcaagttccaggagaaggaagactcttgacctttttcctgggcaactctacagtccctccctcctttcggaaggtgcaggatactgggtttttagatgccttgtccatcctgtctggttgcaatgttttgctcccagaagagaatcagatcatcatgtggggattaccattgttcctggagtactcctacccttagttgaatttccttattaaagttatatttttctataagaccctgaca

SEQ ID NO: 3837 - DNA, 736 bp, Homo sapiens; identical to SEQ ID NO: 3826

SEQ ID NO: 3838 - DNA, 736 bp, Homo sapiens; identical to SEQ ID NO: 3826

SEQ ID NO: 3839 - DNA, 754 bp, Homo sapiens; identical to SEQ ID NO: 3827

SEQ ID NO: 3840 - DNA, 743 bp, Homo sapiens; identical to SEQ ID NO: 3825

SEQ ID NO: 3841 - DNA, 754 bp, Homo sapiens; identical to SEQ ID NO: 3827

SEQ ID NO: 3842 - DNA, 864 bp, Homo sapiens; identical to SEQ ID NO: 3824

SEQ ID NO: 3843 - DNA, 743 bp, Homo sapiens; identical to SEQ ID NO: 3825

SEQ ID NO: 3844 - DNA, 864 bp, Homo sapiens; identical to SEQ ID NO: 3824

SEQ ID NO: 3845 - DNA, 736 bp, Homo sapiens; identical to SEQ ID NO: 3826

SEQ ID NO: 3846 - DNA, 743 bp, Homo sapiens; identical to SEQ ID NO: 3825

SEQ ID NO: 3847 - DNA, 743 bp, Homo sapiens; identical to SEQ ID NO: 3825

SEQ ID NO: 3848 - DNA, 743 bp, Homo sapiens; identical to SEQ ID NO: 3825

SEQ ID NO: 3849 - DNA, 864 bp, Homo sapiens; identical to SEQ ID NO: 3824

SEQ ID NO: 3850 - DNA, 754 bp, Homo sapiens; identical to SEQ ID NO: 3827

SEQ ID NO: 3851 - DNA, 736 bp, Homo sapiens; identical to SEQ ID NO: 3826

SEQ ID NO: 3852 - DNA, 743 bp, Homo sapiens
gggcgcagagctggcgctctagcccacggagttggttaactcctctcaccggcccctggaaagggttccaagtcctttagtacccgacgctgtctgggaattccgggcgtttcggctccttggtcgcagaggcaggaggcacccgaccgcatgtctgtcatggacctcgccaatacttgctccagctttcagtcggacctggatttctgttcagattgcggctcggtcctgcctctgcccggggctcaggatacggtcacctgtattcgctgtggcttcaacatcaacgttcgggactttgaggggaaggttgtgaagacttcggttgtgttccaccaactggggacagccatgcctatgtcggtggaggaagggcctgagtgccagggacctgtggttgacaggcgctgccctcgatgtggtcatgaaggaatggcataccacaccagacagatgcgttcagccgatgaagggcaaactgtcttctacacctgtaccaactgcaagttccaggagaaggaagactcttgacctttttcctgggcaactctacagtccctccctcctttcggaaggtgcaggatactgggtttttagatgccttgtccatcctgtctggttgcaatgttttgctcccagaagagaatcagatcatcatgtggggattaccattgttcctggagtactcctacccttagttgaatttccttattaaagttatatttttctataagaccctgaca

SEQ ID NO: 3853 - DNA, 754 bp, Homo sapiens
gcagagctggcgctctagcccacggagttggttaactcctctcaccggcccctggaaagggttccaagtcctttagtacccgacgctgtctgggaattccgggcgtttcggctccttggtcgcagaggcaggaggcgtgcgtggcaggaggacccgaccgcatgtctgtcatggacctcgccaatacttgctccagctttcagtcggacctggatttctgttcagattgcggctcggtcctgcctctgcccggggctcaggatacggtcacctgtattcgctgtggcttcaacatcaacgttcgggactttgaggggaaggttgtgaagacttcggttgtgttccaccaactggggacagccatgcctatgtcggtggaggaagggcctgagtgccagggacctgtggttgacaggcgctgccctcgatgtggtcatgaaggaatggcataccacaccagacagatgcgttcagccgatgaagggcaaactgtcttctacacctgtaccaactgcaagttccaggagaaggaagactcttgacctttttcctgggcaactctacagtccctccctcctttcggaaggtgcaggatactgggtttttagatgccttgtccatcctgtctggttgcaatgttttgctcccagaagagaatcagatcatcatgtggggattaccattgttcctggagtactcctacccttagttgaatttccttattaaagttatatttttctataagaccctgaca

SEQ ID NO: 3854 - DNA, 754 bp, Homo sapiens; identical to SEQ ID NO: 3827

SEQ ID NO: 3855 - DNA, 864 bp, Homo sapiens
gccgcgggcgcagagctggcgctctagcccacggagttggttaactcctctcaccggcccctggaaagggttccaagtcctttagtacccgacgctgtctgggaattccgggcgtttcggctccttggtcgcagaggcaggaggcgtgcgtggcaggagggttcgggttatatactcctaggtcctgggacagaatagttacgacctctgggacaggaactcttctctcttttgttaataaacttccaactccctcctcagacccgaccgcatgtctgtcatggacctcgccaatacttgctccagctttcagtcggacctggatttctgttcagattgcggctcggtcctgcctctgcccggggctcaggatacggtcacctgtattcgctgtggcttcaacatcaacgttcgggactttgaggggaaggttgtgaagacttcggttgtgttccaccaactggggacagccatgcctatgtcggtggaggaagggcctgagtgccagggacctgtggttgacaggcgctgccctcgatgtggtcatgaaggaatggcataccacaccagacagatgcgttcagccgatgaagggcaaactgtcttctacacctgtaccaactgcaagttccaggagaaggaagactcttgacctttttcctgggcaactctacagtccctccctcctttcggaaggtgcaggatactgggtttttagatgccttgtccatcctgtctggttgcaatgttttgctcccagaagagaatcagatcatcatgtggggattaccattgttcctggagtactcctacccttagttgaatttccttattaaagttatatttttctataagaccctgaca

SEQ ID NO: 3856 - DNA, 2579 bp, Homo sapiens
atggacctcccggcgctgctccccgccccgactgcgcgcggagggcaacatggcggcggccccggcccgctccgccgagccccagcgccgctcggcgcgagccccgcgcgccgccgcctgctactggtgcggggccctgaagatggcgggcccggggcgcggcccggggaggcctccgggccaagcccgccgcccgccgaggacgacagcgacggcgactctttcttggtgctgctggaagtgccgcacggcggcgctgccgccgaggctgccggatcacaggaggccgagcctggctcccgtgtcaacctggcgagccgccccgagcagggccccagcggcccggccgccccccccggccctggcgtagccccggcgggcgccgtcaccatcagcagccaggacctgctggtgcgtctcgaccgcggcgtcctcgcgctgtctgcgccgcccggccccgcaaccgcgggcgccgccgctccccgccgcgcgccccaggcctccggccccagcacgcccggctaccgctgccccgagccgcagtgcgcgctggccttcgccaagaagcaccagctcaaggtgcacctgctcacgcacggcggcggtcagggccggcggcccttcaagtgcccactggagggctgtggttgggccttcacaacgtcctacaagctcaagcggcacctgcagtcgcacgacaagctgcggcccttcggctgtccagtgggcggctgtggcaagaagttcactacggtctataacctcaaggcgcacatgaagggccacgagcaggagagcctgttcaagtgcgaggtgtgcgccgagcgcttccccacgcacgccaagctcagctcccaccagcgcagccacttcgagcccgagcgcccttacaagtgtgactttcccggctgtgagaagacatttatcacagtgagtgccctgttttcccataaccgagcccacttcagggaacaagagctcttttcctgctcctttcctgggtgcagcaagcagtatgataaagcctgtcggctgaaaattcacctgcggagccatacaggtgaaagaccatttatttgtgactctgacagctgtggctggaccttcaccagcatgtccaaacttctaaggcacagaaggaaacatgacgatgaccggaggtttacctgccctgtcgagggctgtgggaaatcattcaccagagcagagcatctgaaaggccacagcataacccacctaggcacaaagccgttcgagtgtcctgtggaaggatgttgcgcgaggttctccgctcgtagcagtctgtacattcactctaagaaacacgtgcaggatgtgggtgctccgaaaagccgttgcccagtttctacctgcaacagactcttcacctccaagcacagcatgaaggcgcacatggtcagacagcacagccggcgccaagatctcttacctcagctagaagctccgagttctcttactcccagcagtgaactcagcagcccaggccaaagtgagctcactaacatggatcttgctgcactcttctctgacacacctgccaatgctagtggttctgcaggtgggtcggatgaggctctgaactccggaatcctgactattgacgtcacttctgtgagctcctctctgggagggaacctccctgctaataatagctccctagggccgatggaacccctggtcctggtggcccacagtgatattcccccaagcctggacagccctctggttctcgggacagcagccacggttctgcagcagggcagcttcagtgtggatgacgtgcagactgtgagtgcaggagcattaggctgtctggtggctctgcccatgaagaacttgagtgacgacccactggctttgacctccaatagtaacttagcagcacatatcaccacaccgacctcttcgagcaccccccgagaaaatgccagtgtcccggaactgctggctccaatcaaggtggagccggactcgccttctcgcccaggagcagttgggcagcaggaaggaagccatgggctgccccagtccacgttgcccagtccagcagagcagcacggtgcccaggacacagagctcagtgcaggcactggcaacttctatttggtatgaagcactctattcagtcaccaccatataggtcacttctctcatactcggtcttgaggatattctggattaatcctttctatgcagacgtttctggtttacaaaaggacgcagccctggactacaagtctggaactgacaagttcttatgaccttgacaaatcaccttaacccatctgagccttaaattctcatttatttcctgcataaggagatttggctaaatgctttctgaggtcctttggagtcctgtggctccatggtaatgtgctcctttccttgaagattgggggttttgtaatgttgagatactttgcctctatgcttgtcagctcatgaccagtcctagaagaggagtcgagacataagccaccttcagaggttcaatggaaactttaaaaccataccaaactcttttttaaaattagaattaacaagaaaaaaaaaaa

SEQ ID NO: 3857 - DNA, 3405 bp, Homo sapiens
gggcgcgggcagctctgcgtccgaagctgctccgacgccgtcgctgggaccaagatggacctcccggcgctgctccccgccccgactgcgcgcggagggcaacatggcggcggccccggcccgctccgccgagccccagcgccgctcggcgcgagccccgcgcgccgccgcctgctactggtgcggggccctgaagatggcgggcccggggcgcggcccggggaggcctccgggccaagcccgccgcccgccgaggacgacagcgacggcgactctttcttggtgctgctggaagtgccgcacggcggcgctgccgccgaggctgccggatcacaggaggccgagcctggctcccgtgtcaacctggcgagccgccccgagcagggccccagcggcccggccgccccccccggccctggcgtagccccggcgggcgccgtcaccatcagcagccaggacctgctggtgcgtctcgaccgcggcgtcctcgcgctgtctgcgccgcccggccccgcaaccgcgggcgccgccgctccccgccgcgcgccccaggcctccggccccagcacgcccggctaccgctgccccgagccgcagtgcgcgctggccttcgccaagaagcaccagctcaaggtgcacctgctcacgcacggcggcggtcagggccggcggcccttcaagtgcccactggagggctgtggttgggccttcacaacgtcctacaagctcaagcggcacctgcagtcgcacgacaagctgcggcccttcggctgtccagtgggcggctgtggcaagaagttcactacggtctataacctcaaggcgcacatgaagggccacgagcaggagagcctgttcaagtgcgaggtgtgcgccgagcgcttccccacgcacgccaagctcagctcccaccagcgcagccacttcgagcccgagcgcccttacaagtgtgactttcccggctgtgagaagacatttatcacagtgagtgccctgttttcccataaccgagcccacttcagggaacaagagctcttttcctgctcctttcctgggtgcagcaagcagtatgataaagcctgtcggctgaaaattcacctgcggagccatacaggtgaaagaccatttatttgtgactctgacagctgtggctggaccttcaccagcatgtccaaacttctaaggcacagaaggaaacatgacgatgaccggaggtttacctgccctgtcgagggctgtgggaaatcattcaccagagcagagcatctgaaaggccacagcataacccacctaggcacaaagccgttcgagtgtcctgtggaaggatgttgcgcgaggttctccgctcgtagcagtctgtacattcactctaagaaacacgtgcaggatgtgggtgctccgaaaagccgttgcccagtttctacctgcaacagactcttcacctccaagcacagcatgaaggcgcacatggtcagacagcacagccggcgccaagatctcttacctcagctagaagctccgagttctcttactcccagcagtgaactcagcagcccaggccaaagtgagctcactaacatggatcttgctgcactcttctctgacacacctgccaatgctagtggttctgcaggtgggtcggatgaggctctgaactccggaatcctgactattgacgtcacttctgtgagctcctctctgggagggaacctccctgctaataatagctccctagggccgatggaacccctggtcctggtggcccacagtgatattcccccaagcctggacagccctctggttctcgggacagcagccacggttctgcagcagggcagcttcagtgtggatgacgtgcagactgtgagtgcaggagcattaggctgtctggtggctctgcccatgaagaacttgagtgacgacccactggctttgacctccaatagtaacttagcagcacatatcaccacaccgacctcttcgagcaccccccgagaaaatgccagtgtcccggaactgctggctccaatcaaggtggagccggactcgccttctcgcccaggagcagttgggcagcaggaaggaagccatgggctgccccagtccacgttgcccagtccagcagagcagcacggtgcccaggacacagagctcagtgcaggcactggcaacttctatttggaaagtgggggctcagcaagaactgattaccgagccattcaactagccaaggaaaaaaagcagagaggagcggggagcaatgcaggagcctcacagtctactcagagaaaaataaaagaaggcaaaatgagtcctccccatttccatgcaagccagaacagttggttgtgtgggagcctcgtggtgcccagcggaggacggccaggaccagctccagcagctggggtgcagtgcggggcgcagggcgtccaggtccagctggtgcaggatgacccctccggcgaaggtgtcctgccctcggcccgcggcccagccaccttcctccccttcctcactgtggacctgcccgtctacgtcctccaggaggtgctcccctcatctggaggccctgctggaccggaggccacccagttcccaggaagcactatcaacctgcaggatctgcagtgacggcagcctcggcctgggcaggcccaaggccacggtctaggacacaccttccctgagactcatgacatgagcctggggagacctcatttggtttccgttcagaagaccagcgtagcccttttgagacttttgggtacatttatcaaaaatgttttccttttgttttaccaggaatgagttcgggctatactctttgaaactgcctttgtgagcaaagtgctttggcaaggcaagggtctccctcagcagggctaggtgcactacagcctctttccccgtgtcccgttggatctgagctgtgtagcacttgttgcattacaaagaaaaagacttctgcaggaaatagggtagagaacaggctgtctagtcagatgcagcttgatctgtggcaaaaccaagtgtggtctttcagcttcagtgtgttagcatcccagcacctgggatggggtttgtgggcaagttgattttgccacactgtagggcccaggtggtcccattgccaccgtgaagccaaattctagcccaagtctggtagagcagtcgggcagctagttttcgggggaggatgatgtggtgggacagaggacctcagtggcctattacggagccctcttcccagactaaattcatagccgagagctcggggggatggtagagttaaaatttaaaataattttctaaattctgtatttggatattagtgtttaagtggtaatttggcaacagtttataaagtgatgttctgaataccataaattatgtgtaggactgtga

SEQ ID NO: 3858 - protein, 181 aa, Homo sapiens
MMDNRGNSSLPDKLPIFPDSARLPLTRSFYLEPMVTFHVHPEAPVSSPYSEELPRLPFPSDSLILGNYSEPCPFSFPMPYPNYRGCEYSYGPAFTRKRNERERQRVKCVNEGYAQLRHHLPEEYLEKRLSKVETLRAAIKYINYLQSLLYPDKAETKNNPGKVSSMIATTSHHADPMFRIV

SEQ ID NO: 3859 - protein, 181 aa, Homo sapiens; identical to SEQ ID NO: 3858

SEQ ID NO: 3860 - protein, 173 aa, Homo sapiens
MMETRKPAERLALPYSLRTAPLGVPGTLPGLPRRDPLRVALRLDAACWEWARSGCARGWQYLPVPLDSAFEPAFLRKRNERERQRVRCVNEGYARLRDHLPRELADKRLSKVETLRAAIDYIKHLQELLERQAWGLEGAAGAVPQRRAECNSDGESKASSAPSPSSEPEEGGS

SEQ ID NO: 3861 - protein, 272 aa, Homo sapiens
MEAEESEKAATEQEPLEGTEQTLDAEEEQEESEEAACGSKKRVVPGIVYLGHIPPRFRPLHVRNLLSAYGEVGRVFFQAEDRFVRRKKKAAAAAGGKKRSYTKDYTEGWVEFRDKRIAKRVAASLHNTPMGARRRSPFRYDLWNLKYLHRFTWSHLSEHLAFERQVRRQRLRAEVAQAKRETDFYLQSVERGQRFLAADGDPARPDGSWTFAQRPTEQELRARKAARPGGRERARLATAQDKARSNKGLLARIFGAPPPSESMEGPSLVRDS

SEQ ID NO: 3862 - protein, 1131 aa, Homo sapiens
MFQIPVENLDNIRKVRKKVKGILVDIGLDSCKELLKDLKGFDPGEKYFHNTSWGDVSLWEPSGKKVRYRTKPYCCGLCKYSTKVLTSFKNHLHRYHEDEIDQELVIPCPNCVFASQPKVVGRHFRMFHAPVRKVQNYTVNILGETKSSRSDVISFTCLKCNFSNTLYYSMKKHVLVAHFHYLINSYFGLRTEEMGEQPKTNDTVSIEKIPPPDKYYCKKCNANASSQDALMYHILTSDIHRDLENKLRSVISEHIKRTGLLKQTHIAPKPAAHLAAPANGSAPSAPAQPPCFHLALPQNSPSPAAGQPVTVAQGAPGSLTHSPPAAGQSHMTLVSSPLPVGQNSLTLQPPAPQPVFLSHGVPLHQSVNPPVLPLSQPVGPVNKSVGTSVLPINQTVRPGVLPLTQPVGPINRPVGPGVLPVSPSVTPGVLQAVSPGVLSVSRAVPSGVLPAGQMTPAGQMTPAGVIPGQTATSGVLPTGQMVQSGVLPVGQTAPSRVLPPGQTAPLRVISAGQVVPSGLLSPNQTVSSSAVVPVNQGVNSGVLQLSQPVVSGVLPVGQPVRPGVLQLNQTVGTNILPVNQPVRPGASQNTTFLTSGSILRQLIPTGKQVNGIPTYTLAPVSVTLPVPPGGLATVAPPQMPIQLLPSGAAAPMAGSMPGMPSPPVLVNAAQSVFVQASSSAADTNQVLKQAKQWKTCPVCNELFPSNVYQVHMEVAHKHSESKSGEKLEPEKLAACAPFLKWMREKTVRCLSCKCLVSEEELIHHLLMHGLGCLFCPCTFHDIKGLSEHSRNRHLGKKKLPMDYSNRGFQLDVDANGNLLFPHLDFITILPKEKLGEREVYLAILAGIHSKSLVPVYVKVRPQAEGTPGSTGKRVSTCPFCFGPFVTTEAYELHLKERHHIMPTVHTVLKSPAFKCIHCCGVYTGNMTLAAIAVHLVRCRSAPKDSSSDLQAQPGFIHNSELLLVSGEVMHDSSFSVKRKLPDGHLGAEDQRHGEEQPPILNADAAPGPEKVTSVVPFKRQRNESRTEGPIVKDEALQILALDPKKYEGRSYEEKKQFLKDYFHKKPYPSKKEIELLSSLFWVWKIDVASFFGKRRYICMKAIKNHKPSVLLGFDMSELKNVKHRLNFEYEP

SEQ ID NO: 3863 - protein, 171 aa, Homo sapiens
MFQIPVENLDNIRKVRKKVKGILVDIGLDSCKELLKDLKGFDPGEKYFHNTSWGDVSLWEPSGKKVRYRTKPYCCGLCKYSTKVLTSFKNHLHRYHEDEIDQELVIPCPNCVFASQPKVVGRHFRMFHAPVRKVQNYTVNILGETKSSRSDVISFTCLKCNFSNTLYYSMK

SEQ ID NO: 3864 - protein, 503 aa, Homo sapiens
MAAAITDMADLEELSRLSPLPPGSPGSAARGRAEPPEEEEEEEEEEEEAEAEAVAALLLNGGSGGGGGGGGGGVGGGEAETMSEPSPESASQAGEDEDEEEDDEEEEDESSSSGGGEEESSAESLVGSSGGSSSDETRSLSPGAASSSSGDGDGKEGLEEPKGPRGSQGGGGGGSSSSSVVSSGGDEGYGTGGGGSSATSGGRRGSLEMSSDGEPLSRMDSEDSISSTIMDVDSTISSGRSTPAMMNGQGSTTSSSKNIAYNCCWDQCQACFNSSPDLADHIRSIHVDGQRGGVFVCLWKGCKVYNTPSTSQSWLQRHMLTHSGDKPFKCVVGGCNASFASQGGLARHVPTHFSQQNSSKVSSQPKAKEESPSKAGMNKRRKLKNKRRRSLPRPHDFFDAQTLDAIRHRAICFNLSAHIESLGKGHSVVFHSTVIAKRKEDSGKIKLLLHWMPEDILPDVWVNESERHQLKTKVVHLSKLPKDTALLLDPNIYRTMPQKRLKR

SEQ ID NO: 3865 - protein, 301 aa, Homo sapiens
MYTRRYSSISSTIMDVDSTISSGRSTPAMMNGQGSTTSSSKNIAYNCCWDQCQACFNSSPDLADHIRSIHVDGQRGGVFVCLWKGCKVYNTPSTSQSWLQRHMLTHSGDKPFKCVVGGCNASFASQGGLARHVPTHFSQQNSSKVSSQPKAKEESPSKAGMNKRRKLKNKRRRSLPRPHDFFDAQTLDAIRHRAICFNLSAHIESLGKGHSVVFHSTVIAKRKEDSGKIKLLLHWMPEDILPDVWVNESERHQLKTKVVHLSKLPKDTALLLDPNIYRTMPQKRLKRTLIRKVFNLYLSKQ

SEQ ID NO: 3866 - protein, 517 aa, Homo sapiens
MAAAITDMADLEELSRLSPLPPGSPGSAARGRAEPPEEEEEEEEEEEEAEAEAVAALLLNGGSGGGGGGGGGGVGGGEAETMSEPSPESASQAGEDEDEEEDDEEEEDESSSSGGGEEESSAESLVGSSGGSSSDETRSLSPGAASSSSGDGDGKEGLEEPKGPRGSQGGGGGGSSSSSVVSSGGDEGYGTGGGGSSATSGGRRGSLEMSSDGEPLSRMDSEDSISSTIMDVDSTISSGRSTPAMMNGQGSTTSSSKNIAYNCCWDQCQACFNSSPDLADHIRSIHVDGQRGGVFVCLWKGCKVYNTPSTSQSWLQRHMLTHSGDKPFKCVVGGCNASFASQGGLARHVPTHFSQQNSSKVSSQPKAKEESPSKAGMNKRRKLKNKRRRSLPRPHDFFDAQTLDAIRHRAICFNLSAHIESLGKGHSVVFHSTVIAKRKEDSGKIKLLLHWMPEDILPDVWVNESERHQLKTKVVHLSKLPKDTALLLDPNIYRTMPQKRLKRTLIRKVFNLYLSKQ

SEQ ID NO: 3867 - protein, 437 aa, Homo sapiens
MAAAITDMADLEELSRLSPLPPGSPGSAARGRAEPPEEEEEDESSSSGGGEEESSAESLVGSSGGSSSDETRSLSPGAASSSSGDGDGKEGLEEPKGPRGSQGGGGGGSSSSSVVSSGGDEGYGTGGGGSSATSGGRRGSLEMSSDGEPLSRMDSEDSISSTIMDVDSTISSGRSTPAMMNGQGSTTSSSKNIAYNCCWDQCQACFNSSPDLADHIRSIHVDGQRGGVFVCLWKGCKVYNTPSTSQSWLQRHMLTHSGDKPFKCVVGGCNASFASQGGLARHVPTHFSQQNSSKVSSQPKAKEESPSKAGMNKRRKLKNKRRRSLPRPHDFFDAQTLDAIRHRAICFNLSAHIESLGKGHSVVFHSTVIAKRKEDSGKIKLLLHWMPEDILPDVWVNESERHQLKTKVVHLSKLPKDTALLLDPNIYRTMPQKRLKR

SEQ ID NO: 3868 - protein, 1226 aa, Homo sapiens
MDSFDLALLQEWDLESLCVYEPDRNALRRKERERRNQETQQDDGTFNSSYSLFSEPYKTNKGDELSNRIQNTLGNYDEMKDFLTDRSNQSHLVGVPKPGVPQTPVNKIDEHFVADSRAQNQPSSICSTTTSTPAAVPVQQSKRGTMGWQKAGHPPSDGQQRATQQGSLRTLLGDGVGRQQPRAKQVCNVEVGLQTQERPPAMAAKHSSSGHCVQNFPPSLASKPSLVQQKPTAYVRPMDGQDQAPDESPKLKSSSETSVHCTSYRGVPASKPEPARAKAKLSKFSIPKQGEESRSGETNSCVEEIIREMTWLPPLSAIQAPGKVEPTKFPFPNKDSQLVSSGHNNPKKGDAEPESPDSGTSNTSMLEDDLKLSSDEEENEQQAAQRTALRALSDSAVVQQPNCRTSVPSSKGSSSSSSSGSSSSSSDSESSSGSDSETESSSSESEGSKPPHFSSPEAEPASSNKWQLDKWLNKVNPHKPPILIQNESHGSESNQYYNPVKEDVQDCGKVPDVCQPSLREKEIKSTCKEEQRPRTANKAPGSKGVKQKSPPAAVAVAVSAAAPPPAVPCAPAENAPAPARRSAGKKPTRRTERTSAGDGANCHRPEEPAAADALGTSVVVPPEPTKTRPCGNNRASHRKELRSSVTCEKRRTRGLSRIVPKSKEFIETESSSSSSSSDSDLESEQEEYPLSKAQTVAASASSGNDQRLKEAAANGGSGPRAPVGSINARTTSDIAKELEEQFYTLVPFGRNELLSPLKDSDEIRSLWVKIDLTLLSRIPEHLPQEPGVLSAPATKDSESAPPSHTSDTPAEKALPKSKRKRKCDNEDDYREIKKSQGEKDSSSRLATSTSNTLSANHCNMNINSVAIPINKNEKMLRSPISPLSDASKHKYTSEDLTSSSRPNGNSLFTSASSSKKPKADSQLQPHGGDLTKAAHNNSENIPLHKSRPQTKPWSPGSNGHRDCKRQKLVFDDMPRSADYFMQEAKRMKHKADAMVEKFGKALNYAEAALSFIECGNAMEQGPMESKSPYTMYSETVELIRYAMRLKTHSGPNATPEDKQLAALCYRCLALLYWRMFRLKRDHAVKYSKALIDYFKNSSKAAQAPSPWGASGKSTGTPSPMSPNPSPASSVGSQGSLSNASALSPSTIVSIPQRIHQMAANHVSITNSILHSYDYWEMADNLAKENREFFNDLDLLMGPVTLHSSMEHLVQYSQQGLHWLRNSAHLS

SEQ ID NO: 3869 - protein, 1251 aa, Homo sapiens
MDSFDLALLQEWDLESLWGEDILNQRNDSLVVEFQSSASRCRSVYEPDRNALRRKERERRNQETQQDDGTFNSSYSLFSEPYKTNKGDELSNRIQNTLGNYDEMKDFLTDRSNQSHLVGVPKPGVPQTPVNKIDEHFVADSRAQNQPSSICSTTTSTPAAVPVQQSKRGTMGWQKAGHPPSDGQQRATQQGSLRTLLGDGVGRQQPRAKQVCNVEVGLQTQERPPAMAAKHSSSGHCVQNFPPSLASKPSLVQQKPTAYVRPMDGQDQAPDESPKLKSSSETSVHCTSYRGVPASKPEPARAKAKLSKFSIPKQGEESRSGETNSCVEEIIREMTWLPPLSAIQAPGKVEPTKFPFPNKDSQLVSSGHNNPKKGDAEPESPDSGTSNTSMLEDDLKLSSDEEENEQQAAQRTALRALSDSAVVQQPNCRTSVPSSKGSSSSSSSGSSSSSSDSESSSGSDSETESSSSESEGSKPPHFSSPEAEPASSNKWQLDKWLNKVNPHKPPILIQNESHGSESNQYYNPVKEDVQDCGKVPDVCQPSLREKEIKSTCKEEQRPRTANKAPGSKGVKQKSPPAAVAVAVSAAAPPPAVPCAPAENAPAPARRSAGKKPTRRTERTSAGDGANCHRPEEPAAADALGTSVVVPPEPTKTRPCGNNRASHRKELRSSVTCEKRRTRGLSRIVPKSKEFIETESSSSSSSSDSDLESEQEEYPLSKAQTVAASASSGNDQRLKEAAANGGSGPRAPVGSINARTTSDIAKELEEQFYTLVPFGRNELLSPLKDSDEIRSLWVKIDLTLLSRIPEHLPQEPGVLSAPATKDSESAPPSHTSDTPAEKALPKSKRKRKCDNEDDYREIKKSQGEKDSSSRLATSTSNTLSANHCNMNINSVAIPINKNEKMLRSPISPLSDASKHKYTSEDLTSSSRPNGNSLFTSASSSKKPKADSQLQPHGGDLTKAAHNNSENIPLHKSRPQTKPWSPGSNGHRDCKRQKLVFDDMPRSADYFMQEAKRMKHKADAMVEKFGKALNYAEAALSFIECGNAMEQGPMESKSPYTMYSETVELIRYAMRLKTHSGPNATPEDKQLAALCYRCLALLYWRMFRLKRDHAVKYSKALIDYFKNSSKAAQAPSPWGASGKSTGTPSPMSPNPSPASSVGSQGSLSNASALSPSTIVSIPQRIHQMAANHVSITNSILHSYDYWEMADNLAKENREFFNDLDLLMGPVTLHSSMEHLVQYSQQGLHWLRNSAHLS

SEQ ID NO: 3870 - protein, 1226 aa, Homo sapiens; identical to SEQ ID NO: 3868

SEQ ID NO: 3871 - protein, 99 aa, Homo sapiens
MDSFDLALLQEWDLESLCVYEPDRNALRRKERERRNQETQQDDGTFNSSYSLFSEPYKTNKGDELSNRIQNTLGNYDEMKDFLTDRSNQSHLVGVPKPG

SEQ ID NO: 3872 - protein, 155 aa, Homo sapiens
MDSFDLALLQEWDLESLCVYEPDRNALRRKERERRNQETQQDDGTFNSSYSLFSEPYKTNKGDELSNRIQNTLGNYDEMKDFLTDRSNQSHLVGVPKPGVPQTPVNKIDEHFVADSRAQNQPSSICSTTTSTPAAVPVQQSKRGTMGWQKAGHPP

SEQ ID NO: 3873 - protein, 114 aa, Homo sapiens
MDSFDLALLQEWDLESLCVYEPDRNALRRKERERRNQETQQDDGTFNSSYSLFSEPYKTNKGDELSNRIQNTLGNYDEMKDFLTDRSNQSHLVGVPKPGVPQTPVNKIDEHFVA

SEQ ID NO: 3874 - protein, 17 aa, Homo sapiens
MDSFDLALLQEWDLESL

SEQ ID NO: 3875 - protein, 161 aa, Homo sapiens
MDSFDLALLQEWDLESLCVYEPDRNALRRKERERRNQETQQDDGTFNSSYSLFSEPYKTNKGDELSNRIQNTLGNYDEMKDFLTDRSNQSHLVGVPKPGVPQTPVNKIDEHFVADSRAQNQPSSICSTTTSTPAAVPVQQSKRGTMGWQKAGHPPSDGQQR

SEQ ID NO: 3876 - protein, 781 aa, Homo sapiens
MDSFDLALLQEWDLESLWGEDILNQRNDSLVVEFQSSASRCRSVYEPDRNALRRKERERRNQETQQDDGTFNSSYSLFSEPYKTNKGDELSNRIQNTLGNYDEMKDFLTDRSNQSHLVGVPKPGVPQTPVNKIDEHFVADSRAQNQPSSICSTTTSTPAAVPVQQSKRGTMGWQKAGHPPSDGQQRATQQGSLRTLLGDGVGRQQPRAKQVCNVEVGLQTQERPPAMAAKHSSSGHCVQNFPPSLASKPSLVQQKPTAYVRPMDGQDQAPDESPKLKSSSETSVHCTSYRGVPASKPEPARAKAKLSKFSIPKQGEESRSGETNSCVEEIIREMTWLPPLSAIQAPGKVEPTKFPFPNKDSQLVSSGHNNPKKGDAEPESPDSGTSNTSMLEDDLKLSSDEEENEQQAAQRTALRALSDSAVVQQPNCRTSVPSSKGSSSSSSSGSSSSSSDSESSSGSDSETESSSSESEGSKPPHFSSPEAEPASSNKWQLDKWLNKVNPHKPPILIQNESHGSESNQYYNPVKEDVQDCGKVPDVCQPSLREKEIKSTCKEEQRPRTANKAPGSKGVKQKSPPAAVAVAVSAAAPPPAVPCAPAENAPAPARRSAGKKPTRRTERTSAGDGANCHRPEEPAAADALGTSVVVPPEPTKTRPCGNNRASHRKELRSSVTCEKRRTRGLSRIVPKSKEFIETESSSSSSSSDSDLESEQEEYPLSKAQTVAASASSGNDQRLKEAAANGGSGPRAPVGSINARTTSDIAKELEEQFYTLVPLAGTNFSPL

SEQ ID NO: 3877 - protein, 869 aa, Homo sapiens
MDSFDLALLQEWDLESLCVYEPDRNALRRKERERRNQETQQDDGTFNSSYSLFSEPYKTNKGDELSNRIQNTLGNYDEMKDFLTDRSNQSHLVGVPKPGVPQTPVNKIDEHFVADSRAQNQPSSICSTTTSTPAAVPVQQSKRGTMGWQKAGHPPSDGQQRATQQGSLRTLLGDGVGRQQPRAKQVCNVEVGLQTQERPPAMAAKHSSSGHCVQNFPPSLASKPSLVQQKPTAYVRPMDGQDQAPDESPKLKSSSETSVHCTSYRGVPASKPEPARAKAKLSKFSIPKQGEESRSGETNSCVEEIIREMTWLPPLSAIQAPGKVEPTKFPFPNKDSQLVSSGHNNPKKGDAEPESPDSGTSNTSMLEDDLKLSSDEEENEQQAAQRTALRALSDSAVVQQPNCRTSVPSSKGSSSSSSSGSSSSSSDSESSSGSDSETESSSSESEGSKPPHFSSPEAEPASSNKWQLDKWLNKVNPHKPPILIQNESHGSESNQYYNPVKEDVQDCGKVPDVCQPSLREKEIKSTCKEEQRPRTANKAPGSKGVKQKSPPAAVAVAVSAAAPPPAVPCAPAENAPAPARRSAGKKPTRRTERTSAGDGANCHRPEEPAAADALGTSVVVPPEPTKTRPCGNNRASHRKELRSSVTCEKRRTRGLSRIVPKSKEFIETESSSSSSSSDSDLESEQEEYPLSKAQTVAASASSGNDQRLKEAAANGGSGPRAPVGSINARTTSDIAKELEEQFYTLVPFGRNELLSPLKDSDEIRSLWVKIDLTLLSRIPEHLPQEPGVLSAPATKDSESAPPSHTSDTPAEKALPKSKRKRKCDNEDDYREIKKSQGEKDSSSRLATSTSNTLSANHCNMNINSMQLPI

SEQ ID NO: 3878 - protein, 129 aa, Homo sapiens
MDSFDLALLQEWDLESLCVYEPDRNALRRKERERRNQETQQDDGTFNSSYSLFSEPYKTNKGDELSNRIQNTLGNYDEMKDFLTDRSNQSHLVGVPKPGVPQTPVNKIDEHFVADSRAQNQPSSICSTT

SEQ ID NO: 3879 - protein, 1021 aa, Homo sapiens
MTLRLDAGGIPSLAPRVYISGSPSQRFLPRKRNKGESAGRDSLLAGSARFGSRGEAQLQGSELLSRNSGESLVRIRSCGQELITCLSRPETGGKFEVDTQRPVCPPSRARAARASAAAVAAAATLTPPTMDSFDLALLQEWDLESLWGEDILNQRNDSLVVEFQSSASRCRSVYEPDRNALRRKERERRNQETQQDDGTFNSSYSLFSEPYKTNKGDELSNRIQNTLGNYDEMKDFLTDRSNQSHLVGVPKPGVPQTPVNKIDEHFVADSRAQNQPSSICSTTTSTPAAVPVQQSKRGTMGWQKAGHPPSDGQQRATQQGSLRTLLGDGVGRQQPRAKQVCNVEVGLQTQERPPAMAAKHSSSGHCVQNFPPSLASKPSLVQQKPTAYVRPMDGQDQAPDESPKLKSSSETSVHCTSYRGVPASKPEPARAKAKLSKFSIPKQGEESRSGETNSCVEEIIREMTWLPPLSAIQAPGKVEPTKFPFPNKDSQLVSSGHNNPKKGDAEPESPDSGTSNTSMLEDDLKLSSDEEENEQAAQRTALRALSDSAVVQQPNCRTSVPSSKGSSSSSSSGSSSSSSDSESSSGSDSETESSSSESEGSKPPHFSSPEAEPASSNKWQLDKWLNKVNPHKPPILIQNESHGSESNQYYNPVKEDVQDCGKVPDVCQPSLREKEIKSTCKEEQRPRTANKAPGSKGVKQKSPPAAVAVAVSAAAPPPAVPCAPAENAPAPARRSAGKKPTRRTERTSAGDGANCHRPEEPAAADALGTSVVVPPEPTKTRPCGNNRASHRKELRSSVTCEKRRTRGLSRIVPKSKEFIETESSSSSSSSDSDLESEQEEYPLSKAQTVAASASSGNDQRLKEAAANGGSGPRAPVGSINARTTSDIAKELEEQFYTLVPFGRNELLSPLKDSDEIRSLWVKIDLTLLSRIPEHLPQEPGVLSAPATKDSESAPPSHTSDTPAEKALPKSKRKRKCDNEDDYREIKKSQGEKDSSSRLATSTSNTLSANHCNMNINSLSLP

SEQ ID NO: 3880 - protein, 5795 aa, Homo sapiens
MCDCFHMVLPTWPGTPGSVSGRQLQPGEPGAETEDDHSVTEGPADEGIRPRPQGSSPVYEYTTEAADFGLQEDAPGRQGSAGRRRSWWKRDSGDSRTFFRMSRPEAVQEATEVTLKTEVEAGASGYSVTGGGDQGIFVKQVLKDSSAAKLFNLREGDQLLSTTVFFENIKYEDALKILQYSEPYKVQFKIRRQLPAPQDEEWASSDAQHGPQGKEKEDTDVADGCRETPTKTLEGDGDQERLISKPRVGRGRQSQRERLSWPKFQSIKSKRGPGPQRSHSSSEAYEPRDAHDVSPTSTDTEAQLTVERQEQKAGPGSQRRRKFLNLRFRTGSGQGPSSTGQPGRGFQSGVGRAGVLEELGPWGDSLEETGAATGSRREERAEQDREVMPAQSMPLPTELGDPRLCEGTPQEGGLRAARLHGKTLEGQAQETAVAQRKPRAQPTPGMSREGEGEGLQSLEIGIARLSLRDTTEGGTQIGPPEIRVRVHDLKTPKFAFSTEKEPERERRLSTPQRGKRQDASSKAGTGLKGEEVEGAGWMPGREPTTHAEAQGDEGDGEEGLQRTRITEEQDKGREDTEGQIRMPKFKIPSLGWSPSKHTKTGREKATEDTEQGREGEATATADRREQRRTEEGLKDKEDSDSMTNTTKIQLIHDEKRLKKEQILTEKEVATKDSKFKMPKFKMPLFGASAPGKSMEASVDVSAPKVEADVSLLSMQGDLKTTDLSVQTPSADLEVQDGQVDVKLPEGPLPEGASLKGHLPKVQRPSLKMPKVDLKGPKLDLKGPKAEVTAPDVKMSLSSMEVDVQAPRAKLDGARLEGDLSLADKEVTAKDSKFKMPKFKMPSFGVSAPGKSMEDSVDVSAPKVEADVSLSSMQGDLKATDLSIQPPSADLEVQAGQVDVKLPEGPVPEGAGPKVHLPKVEMPSFKMPKVDLKGPQIDVKGPKLDLKGPKAEVTAPDGEVSLPSMEVDVQAQKAKLDGAWLEGDLSLADKDVTAKDSKFKMPKFKMPSFGVSAPGKSIKALVDVSAPKVEADLSLPSMQGDLKTTDLSIQPASTDLKVQADQVDVKLPEGHLPEGAGLKGHLPKVEMPSFKMPKVALKGPQVDVKGPKLDLKSPKAEVTAPDVEVSLPSVEVDVEAPGAKLDSARLEGELSLADKDVTAKDSRFKMPKFKMPSFGASAPGKSIEASVDVSAPKVEADVSLPSMQGDLKTTDLSIQPPSADLEVHAGQVDVKLLEGHVPEGAGFKGHLPKVQMPSLKMPKVDLKGPQVEVRGPKLDLKGHKAEVTAHEVAVSLPSVEVDMQAPGAKLDGAQLDGDLSLADKDVTAKDSKFKMPKFKMPSFGVSAPGKSIEASVDLSAPKVEADMSLPSMQGDLKTTDLSIQPPSTDLELQAGQLDVKLPEGPVPEGAGLKGHLPKLQMPSFKVPKVDLKGPEIDIKGPKLDLKDPKVEVTAPDVEVSLPSVEVDVEAPGAKLDGGRLEEDMSLADKDLTTKDSKFKMPKFKMPSFGVSAPGKSIEASVDVSAPKVEADVSLPSMQGDLKATDLSIQPPSADLEVQAGQVDVKLPEGPVSEGAGLKGHLPKVQMPSFKMPKVDLKGPQIDVKGPKLDLKGPKVEVTAPDVKMSLSSMEVDVQAPRAKLDGAQLEGDLSLADKAVTAKDSKFKMPKFKMPSFGVSAPGKSIEASVDVSEPKVEADVSLPSMQGDLKTTDLSIQSPSADLEVQAGQVNVKLPEGPLPEGAGFKGHLPKVQMPSLKMPKVALKGPQMDVKGPKLDLKGPKAEVMAPDVEVSLPSVEVDVEAPGAKLDSVRLEGDLSLADKDVTAKDSKFKMPKFKMPSFGVSAPGKSIEASVDVSAPKVEAEVSLPSMQGDLKTTDLCIPLPSADLVVQAGQVDMKLPEGQVPEGAGLKGHLPKVDMPSFKMPKVDLKGPQTDVKGAKLDLKGPKAEVTAPDVEVSLPSMEVDVQAQKAKLDGARLEGDLSLADKDMTAKDSKFKMPKFKMPSFGVSAPGRSIEASVDVPAPKVEADVSLPSMQGDLKTTDLSIQPPSADLKVQTGQVDVKLPEGHVPEGAGLKGHLPKVEMPSLKMPKVDLKGPQVDIKGPKLDLKDPKVEMRVPDVEVSLPSMEVDVQAPRAKLDSAHLQGDLTLANKDLTTKDSKFKMPKFKMPSFGVSAPGKSIEASVDVSPPKVEADMSLPSMQGDLKTTDLSIQPLSADVKVQAGQVDVKLLEGPVPEEVGLKGHLPKLQMPSFKVPKVDLKGPEIDIKGPKLDLKDPKVEVTAPDVEVSLPSVEVDVKAPGAKLDGARLEGDMSLADKDVTAKDSKFKMPKFKMLSFGVSALGKSIEASADVSALKVEADVSLPSMQGDLKTTDLSVQPPSADLEVQAGQVDVKLPEGPVPEGAGLKGHLPKLQMPSFKMPKVDLKGPQIDVKGPKLDLKGPKTDVMAPDVEVSQPSVEVDVEAPGAKLDGAWLEGDLSVADKDVTTKDSRFKIPKFKMPSFGVSAPGKSIEASVDVSAPKVEADGSLSSMQGDLKATDLSIQPPSADLEVQAGQVDVKLPEGPVPEGAGLKGHLPKVQMPSFKMPEMDLKGPQLDVKGPKLDLKGPKAEVTAPDVEMSLSSMEVDVQAPRAKLDGARLEGDLSLADKGVTAKDSKFKMPKFKMPSFRVSAPGESIEALVDVSELKVEADMSLPSMQGDLKTTDISIQPPSAQLEVQAGQVDVKLPEGHVPEGAGLKGHLPKLQMPSFKMPEVDLKGPQIDVKGPNVDLKGPKAEVTAPDVKMSLSSMEVDVQAPRAKLDGARLEGDLSLADKGMTAKDSKFKMPKFKMPSFGVSAPGKSIEASVDVSELKVEADGSFPSMQGDLKTTDIRIQPPSAQLEVQAGQVDVKLPEGHVPEGAGLKGHLPKVQMPSFKMPKVDLKGPQIDVKGPKLDLKGPKAEVTAPDVEVSLPSVEVDVEAPRAKLDGARLEGDLSLADKDVTAKDSKFKMPKFKMPSFGVSAPGKSIEVSVDVSAPKVEAEVSLPSMQGDLKTTDISIEPPSAQLEVQAGQVDLKLPEGHVPEGAGLKGHLPKLQMPSFKMPKVDRKGPQIDVKGPKLDLKGPKTDVTAPDVEVSQPGMEVDVEAPGAKLDGARLEGDLSLADKDVTAKDSKFKMPKFKMPSFGVSAPGKSIEVLVDVSAPKVEADLSLPSMQGDLKNTDISIEPPSAQLEVQAGQVDVKLPEGHVLEGAGLKGHLPKLQMPSFKMPKVDRKGPQIDIKGPKLDLKGPKMDVTAPDVEVSQPSMEVDVEAPGAKLDGARLEGDLSLADKDVTAKDSKFKMPKFKMPSYRASAPGKSIQASVDVSAPKAEADVSLPSMQGDLKTTDLSIQLPSVDLEVQAGQVDVKLPEGHVPEGAGLKGHLPKVEMPSFKMPKVDLKSPQVDIKGPKLDLKVPKAEVTVPDVEVSLPSVEVDVQAPRAKLDGARLEGDLSLAEKDVTAKDSKFKMPKFKMPSFGVSAPGRSIEASLDVSAPKVEADVSLSSMQGDLKATDLSIQPPSADLEVQAVQVDVELLEGPVPEGAGLKGHLPKVEMPSLKTPKVDLKGPQIDVKGPKLDLKGPKAEVRVPDVEVSLPSVEVDVQAPKAKLDAGRLEGDLSLADKDVTAKDSKFKMPKFKMPSFRVSAPGKSMEASVDVSAPKVEADVSLPSMQGDLKTTDLSIQPPSADLKVQAGQMDVKLPEGQVPEGAGLKEHLPKVEMPSLKMPKVDLKGPQVDIKGPKLDLKVSKAEVTAPDVEVSLPSVEVDVQAPRAKLDSAQLEGDLSLADKDVTAKDSKFKMPKFKMPSFGVSAPGKSIEASVHVSAPKVEADVSLPSMQGDLKTTDLSIQPHSADLTVQARQVDMKLLEGHVPEEAGLKGHLPKVQMPSFKMPKVDLKGPEIDIKGPKLDLKDPKVEVTAPDVEVSLPSVEVDVEAPGAKLDGARLEGDLSLADKDMTAKDSKFKMPKFKMPSFGVSAPGKSMEASVDVTAPKVEADVSLPSMQGDLKATDLSVQPPSADLEVQAGQVDVKLPEGPVPEGASLKGHLPKVQMPSFKMPKVDLKGPQIDVKGPKLDLKGPKAEVTAPDVKMSLSSMEVDVQAPRAKLDGVQLEGDLSLADKDVTAKDSKFKMPKFKMPSFGVSAPGKSMEASVDVSELKAKADVSLPSMQGDLKTTDLSIQSPSADLEVQAGQVDVKLPEGPLPKGAGLKGHLPKVQMPCLKMPKVALKGPQVDVKGPKLDLKGPKADVMTPVVEVSLPSMEVDVEAPGAKLDSVRLEGDLSLADKDMTAKDSKFKMPKFKMPSFGVSAPGKSIEASLDVSALKVEADVSLPSMQGDLKTTHLSIQPPSADLEVQAGQEDVKLPEGPVHEGAGLKGHLPKLQMPSFKVPKVDLKGPQIDVNVPKLDLKGPKVEVTSPNLDVSLPSMEVDIQAPGAKLDSTRLEGDLSLADKDVTAKDSKFKMPKFKMPSFGMLSPGKSIEVSVDVSAPKMEADMSIPSMQGDLKTTDLRIQAPSADLEVQAGQVDLKLPEGHMPEVAGLKGHLPKVEMPSFKMPKVDLKGPQVDVKGPKLDLKGPKAEVMAPDVEVSLPSVETDVQAPGSMLDGARLEGDLSLAHEDVAGKDSKFQGPKLSTSGFEWSSKKVSMSSSEIEGNVTFHEKTSTFPIVESVVHEGDLHDPSRDGNLGLAVGEVGMDSKFKKLHFKVPKVSFSSTKTPKDSLVPGAKSSIGLSTIPLSSSECSSFELQQVSACSEPSMQMPKVGFAGFPSSRLDLTGPHFESSILSPCEDVTLTKYQVTVPRAALAPELALEIPSGSQADIPLPKTECSTDLQPPEGVPTSQAESHSGPLNSMIPVSLGQVSFPKFYKPKFVFSVPQMAVPEGDLHAAVGAPVMSPLSPGERVQCPLPSTQLPSPGTCVSQGPEELVASLQTSVVAPGEAPSEDADHEGKGSPLKMPKIKLPSFRWSPKKETGPKVDPECSVEDSKLSLVLDKDEVAPQSAIHMDLPPERDGEKGRSTKPGFAMPKLALPKMKASKSGVSLPQRDVDPSLSSATAGGSFQDTEKASSDGGRGGLGATASATGSEGVNLHRPQVHIPSLGFAKPDLRSSKAKVEVSQPEADLPLPKHDLSTEGDSRGCGLGDVPVSQPCGEGIAPTPEDPLQPSCRKPDAEVLTVESPEEEAMTKYSQESWFKMPKFRMPSLRRSFRDRGGAGKLEVAQTQAPAATGGEAAAKVKEFLVSGSNVEAAMSLQLPEADAEVTASESKSSTDILRCDLDSTGLKLHLSTAGMTGDELSTSEVRIHPSKGPLPFQMPGMRLPETQVLPGEIDETPLSKPGHDLASMEDKTEKWSSQPEGPLKLKASSTDMPSQISVVNVDQLWEDSVLTVKFPKLMVPRFSFPAPSSEDDVFIPTVREVQCPEANIDTALCKESPGLWGASILKAGAGVPGEQPVDLNLPLEAPPISKVRVHIQGAQVESQEVTIHSIVTPEFVDLSVPRTFSTQIVRESEIPTSEIQTPSYGFSLLKVKIPEPHTQARVYTTMTQHSRTQEGTEEAPIQATPGVDSISGDLQPDTGEPFEMISSSVNVLGQQTLTFEVPSGHQLADSCSDEEPAEILEFPPDDSQEATTPLADEGRAPKDKPESKKSGLLWFWLPNIGFSSSVDETGVDSKNDVQRSAPIQTQPEARPEAELPKKQEKAGWFRFPKLGFSSSPTKKSKSTEDGAELEEQKLQEETITFFDARESFSPEEKEEGELIGPVGTGLDSRVMVTSAARTELILPEQDRKADDESKGSGLGPNEG

SEQ ID NO: 3881 - protein, 78 aa, Homo sapiens
MGQGQQAMCHEALSHIWVPFDLKRWLLYTFCNWFDVTFQLQLCILRTLKRFCRSILYNLKDRKTFWLPQAYLSFLLIQ

SEQ ID NO: 3882 - protein, 192 aa, Homo sapiens
MACGATLKRPMEFEAALLSPGSPKRRRCAPLPGPTPGLRPPDAEPPPPFQTQTPPQSLQQPAPPGSERRLPTPEQIFQNIKQEYSRYQRWRHLEVVLNQSEACASESQPHSSALTAPSSPGSSWMKKDQPTFTLRQVGIICERLLKDYEDKIREEYEQILNTKLAEQYESFVKFTHDQIMRRYGTRPTSYVS

SEQ ID NO: 3883 - protein, 147 aa, Homo sapiens
MACGATLKRPMEFEAALLSPGSPKRRRCAPLPGPTPGLRPPDAEPPPPFQTQTPPQSLQQPAPPGSERRLPTPEQIFQNIKQEYSRYQRWRHLEVVLNQSEACASESQPHSSALTAPSSPEQYESFVKFTHDQIMRRYGTRPTSYVS

SEQ ID NO: 3884 - protein, 203 aa, Homo sapiens
MACGATLKRTLDFDPLLSPASPKRRRCAPLSAPTSAAASPLSAAAATAASFSAAAASPQKYLRMEPSPFGDVSSRLTTEQILYNIKQEYKRMQKRRHLETSFQQTDPCCTSDAQPHAFLLSGPASPGTSSAASSPLKKEQPLFTLRQVGMICERLLKEREEKVREEYEEILNTKLAEQYDAFVKFTHDQIMRRYGEQPASYVS

SEQ ID NO: 3885 - protein, 1907 aa, Homo sapiens
MEVAWLVYVLGQQPLARQGEGQSRLVPGRGLVLWLPGLPRSSPSWPAVDLAPLAPARPRGPLICHTGHEQAGREPGPGSSTKGPVLHDQDTRCAFLPRPPGPLQTRRYCRHQGRQGSGLGAGPGAGTWAPAPPGVSKPRCPGRARPGEGQQQVTTARPPAINRGARQPRAGAAAAGRGPGAGAWRTGEAAASAGPAVGEGGAMGSRRAPSRGWGAGGRSGAGGDGEDDGPVWIPSPASRSYLLSVRPETSLSSNRLSHPSSGRSTFCSIIAQLTEETQPLFETTLKSRSVSEDSDVRFTCIVTGYPEPEVTWYKDDTELDRYCGLPKYEITHQGNRHTLQLYRCREEDAAIYQASAQNSKGIVSCSGVLEVGTMTEYKIHQRWFAKLKRKAAAKLREIEQSWKHEKAVPGEVDTLRKLSPDRFQRKRRLSGAQAPGPSVPTREPEGGTLAAWQEGETETAQHSGLGLINSFASGEVTTNGEAAPENGEDGEHGLLTYICDAMELGPQRALKEESGAKKKKKDEESKQGLRKPELEKAAQSRRSSENCIPSSDEPDSCGTQGPVGVEQVQTQPRGRAARGPGSSGTDSTRKPASAVGTPDKAQKAPGPGPGQEVYFSLKDMYLENTQAVRPLGEEGPQTLSVRAPGESPKGKAPLRARSEGVPGAPGQPTHSLTPQPTRPFNRKRFAPPKPKGEATTDSKPISSLSQAPECGAQSLGKAPPQASVQVPTPPARRRHGTRDSTLQGQAGHRTPGEVLECQTTTAPTMSASSSSDVASIGVSTSGSQGIIEPMDMETQEDGRTSANQRTGSKKNVQADGKIQVDGRTRGDGTQTAQRTRADRKTQVDAGTQESKRPQSDRSAQKGMMTQGRAETQLETTQAGEKIQEDRKAQADKGTQEDRRMQGEKGMQGEKGTQSEGSAPTAMEGQSEQEVATSLGPPSRTPKLPPTAGPRAPLNIECFVQTPEGSCFPKKPGCLPRSEEAVVTASRNHEQTVLGPLSGNLMLPAQPPHEGSVEQVGGERCRGPQSSGPVEAKQEDSPFQCPKEERPGGVPCMDQGGCPLAGLSQEVPTMPSLPGTGLTASPKAGPCSTPTSQHGSTATFLPSEDQVLMSSAPTLHLGLGTPTQSHPPETMATSSEGACAQVPDVEGRTPGPRSCDPGLIDSLKNYLLLLLKLSSTETSGAGGESQVGAATGGLVPSATLTPTVEVAGLSPRTSRRILERVENNHLVQSAQTLLLSPCTSRRLTGLLDREVQAGRQALAAARGSWGPGPSSLTVPAIVVDEEDPGLASEGASEGEGEVSPEGPGLLGASQESSMAGRLGEAGGQAAPGQGPSAESIAQEPSQEEKFPGEALTGLPAATPEELALGARRKRFLPKVRAAGDGEATTPEERESPTVSPRGPRKSLVPGSPGTPGRERRSPTQGRKASMLEVPRAEEELAAGDLGPSPKAGGLDTEVALDEGKQETLAKPRKAKDLLKAPQVIRKIRVEQFPDASGSLKLWCQFFNILSDSVLTWAKDQRPVGEVGRSAGDEGPAALAIVQASPVDCGVYRCTIHNEHGSASTDFCLSPEVLSGFISREEGEVGEEIEMTPMVFAKGLADSGCWGDKLFGRLVSEELRGGGYGCGLRKASQAKVIYGLEPIFESGRTCIIKVSSLLVFGPSSETSLVGRNYDVTIQGCKIQNMSREYCKIFAAEARAAPGFGEVPEIIPLYLIYRPANNIPYATLEEDLGKPLESYCSREWGCAEAPTASGSSEAMQKCQTFQHWLYQWTNGSFLVTDLAGVDWKMTDVQIATKLRGYQGLKESCFPALLDRFASSHQCNAYCELLGLTPLKGPEAAHPQAKAKGSKSPSAGRKGSQLSPQPQKKGLPSPQGTRKSAPSSKATPQASEPVTTQLLGQPPTQEEGSKAQGMR

SEQ ID NO: 3886 - protein, 74 aa, Homo sapiens
MDSEVQRDGRILDLIDDAWREDKLPYEDVAIPLNELPEPEQDNGGTTESVKEQEMKWTDLALQYLHENVPPIGN

SEQ ID NO: 3887 - protein, 74 aa, Homo sapiens; identical to SEQ ID NO: 3886

SEQ ID NO: 3888 - protein, 74 aa, Homo sapiens; identical to SEQ ID NO: 3886

SEQ ID NO: 3889 - protein, 74 aa, Homo sapiens; identical to SEQ ID NO: 3886

SEQ ID NO: 3890 - protein, 615 aa, Homo sapiens
MCSEARLARRLRDALREEEPWAVEELLRCGADPNLVLEDGAAAVHLAAGARHPRGLRCLGALLRQGGDPNARSVEALTPLHVAAAWGCRRGLELLLSQGADPALRDQDGLRPLDLALQQGHLECARVLQDLDTRTRTRTRIGAETQEPEPAPGTPGLSGPTDETLDSIALQKQPCRGDNRDIGLEADPGPPSLPVPLETVDKHGSSASPPGHWDYSSDASFVTAVEVSGAEDPASDTPPWAGSLPPTRQGLLHVVHANQRVPRSQGTEAELNARLQALTLTPPNAAGFQSSPSSMPLLDRSPAHSPPRTPTPGASDCHCLWEHQTSIDSDMATLWLTEDEASSTGGREPVGPCRHLPVSTVSDLELLKGLRALGENPHPITPFTRQLYHQQLEEAQIAPGPEFSGHSLELAAALRTGCIPDVQADEDALAQQFEQPDPARRWREGVVKSSFTYLLLDPRETQDLPARAFSLTPAERLQTFIRAIFYVGKGTRARPYVHLWEALGHHGRSRKQPHQACPKVRQILDIWASGCGVVSLHCFQHVVAVEAYTREACIVEALGIQTLTNQKQGHCYGVVAGWPPARRRRLGVHLLHRALLVFLAEGERQLHPQDIQARG

SEQ ID NO: 3891 - protein, 439 aa, Homo sapiens
MWTPVRRGAAWLGTLLGPGEGPPEPRGGAAHAHKPPAGSRKSTDQAVRFGPSQGMCSEARLARRLRDALREEEPWAVEELLRCGADPNLVLEDGAAAVHLAAGARHPRGLRCLGALLRQGGDPNARSVEALTPLHVAAAWGCRRGLELLLSQGADPALRDQDGLRPLDLALQQGHLECARVLQDLDTRTRTRTRIGAETQEPEPAPGTPGLSGPTDETLDSIALQKQPCRGDNRDIGLEADPGPPSLPVPLETVDKHGSSASPPGHWDYSSDASFVTAVEVSGAEDPASDTPPWAGSLPPTRQGLLHVVHANQRVPRSQGTEAELNARLQALTLTPPNAAGFQSSPSSMPLLDRSPAHSPPRTPTPGASDCHCLWEHQTSIDSDMATLWLTEDEASSTGGREPVGPCRHLPVSTVSDLELLKGLRALGRLRTCQPEPSH

SEQ ID NO: 3892 - protein, 606 aa, Homo sapiens
MCSEARLARRLRDALREEEPWAVEELLRCGADPNLVLEDGAAAVHLAAGARHPRGLRCLGALLRQGGDPNARSVEALTPLHVAAAWGCRRGLELLLSQGADPALRDQDGLRPLDLALQQGHLECARVLQDLDTRTRTRTRIGAETQEPEPAPGTPGLSGPTDETLDSIALQKQPCRGDNRDIGLEADPGPPSLPVPLETVDKHGSSASPPGHWDYSSDASFVTAVEVSGAEDPASDTPPWAGSLPPTRQGLLHVVHANQRVPRSQGTEAELNARLQALTLTPPNAAGFQSSPSSMPLLDRSPAHSPPRTPTPGASDCHCLWEHQTSIDSDMATLWLTEDEASSTGGREPVGPCRHLPVSTVSDLELLKGLRALGPEFSGHSLELAAALRTGCIPDVQADEDALAQQFEQPDPARRWREGVVKSSFTYLLLDPRETQDLPARAFSLTPAERLQTFIRAIFYVGKGTRARPYVHLWEALGHHGRSRKQGSRRSPTRSKGTAMEWWQAGHLLVAGAWGCTCCTVPSLSSWLKASDSFIPRTSRPGAECWGVGHPAWGEMFECSSCPMLTAAPISGFRRGVCVCVCVCVCVCVCVCVCVCREHPGRSPPG

SEQ ID NO: 3893 - protein, 615 aa, Homo sapiens; identical to SEQ ID NO: 3890

SEQ ID NO: 3894 - protein, 239 aa, Homo sapiens
MEKEKGNDDGIPDQENSLDFSEHFNQLELLETHGHLIPTGTQSLWVGNSDEDEEQDDKNEEWYRLQEKKMEKDPSRLLLWAAEKNRLTTVRRLLSEKATHVNTRDEDEYTPLHRAAYSGHLDIVQELIAQGADVHAVTVDGWTPLHSACKWNNTRVASFLLQHDADINAQTKGLLTPLHLAAGNRDSKDTLELLLMNRYVKPGLKNNLEETAFDIARRTSIYHYLFEIVEGCTNSSPQS

SEQ ID NO: 3895 - protein, 239 aa, Homo sapiens; identical to SEQ ID NO: 3894

SEQ ID NO: 3896 - protein, 1485 aa, Homo sapiens
MAAPAQPKKIVAPTVSQINAEFVTQLACKYWAPHIKKKSPFDIKVIEDIYEKEIVKSRFAIRKIMLLEFSQYLENYLWMNYSPEVSSKAYLMSICCMVNEKFRENVPAWEIFKKKPDHFPFFFKHILKAALAETDGEFSLHEQTVLLLFLDHCFNSLEVDLIRSQVQQLISLPMWMGLQLARLELELKKTPKLRKFWNLIKKNDEKMDPEAREQAYQERRFLSQLIQKFISVLKSVPLSEPVTMDKVHYCERFIELMIDLEALLPTRRWFNTILDDSHLLVHCYLSNLVRREEDGHLFSQLLDMLKFYTGFEINDQTGNALTENEMTTIHYDRITSLQRAAFAHFPELYDFALSNVAEVDTRESLVKFFGPLSSNTLHQVASYLCLLPTLPKNEDTTFDKEFLLELLVSRHERRISQIQQLNQMPLYPTEKIIWDENIVPTEYYSGEGCLALPKLNLQFLTLHDYLLRNFNLFRLESTYEIRQDIEDSVSRMKPWQSEYGGVVFGGWARMAQPIVAFTVVEVAKPNIGENWPTRVRADVTINLNVRDHIKDEWEGLRKHDVCFLITVRPTKPYGTKFDRRRPFIEQVGLVYVRGCEIQGMLDDKGRVIEDGPEPRPNLRGESRTFRVFLDPNQYQQDMTNTIQNGAEDVYETFNIIMRRKPKENNFKAVLETIRNLMNTDCVVPDWLHDIILGYGDPSSAHYSKMPNQIATLDFNDTFLSIEHLKASFPGHNVKVTVEDPALQIPPFRITFPVRSGKGKKRKDADVEDEDTEEAKTLIVEPHVIPNRGPYPYNQPKRNTIQFTHTQIEAIRAGMQPGLTMVVGPPGTGKTDVAVQIISNIYHNFPEQRTLIVTHSNQALNQLFEKIMALDIDERHLLRLGHGEEELETEKDFSRYGRVNYVLARRIELLEEVKRLQKSLGVPGDASYTCETAGYFFLYQVMSRWEEYISKVKNKGSTLPDVTEVSTFFPFHEYFANAPQPIFKGRSYEEDMEIAEGCFRHIKKIFTQLEEFRASELLRSGLDRSKYLLVKEAKIIAMTCTHAALKRHDLVKLGFKYDNILMEEAAQILEIETFIPLLLQNPQDGFSRLKRWIMIGDHHQLPPVIKNMAFQKYSNMEQSLFTRFVRVGVPTVDLDAQGRARASLCNLYNWRYKNLGNLPHVQLLPEFSTANAGLLYDFQLINVEDFQGVGESEPNPYFYQNLGEAEYVVALFMYMCLLGYPADKISILTTYNGQKHLIRDIINRRCGNNPLIGRPNKVTTVDRFQGQQNDYILLSLVRTRAVGHLRDVRRLVVAMSRARLGLYIFARVSLFQNCFELTPAFSQLTARPLHLHIIPTEPFPTTRKNGERPSHEVQIIKNMPQMANFVYNMYMHLIQTTHHYHQTLLQLPPAMVEEGEEVQNQETELETEEEAMTVQADIIPSPTDTSCRQETPAFQTDTTPSETGATSTPEAIPALSETTPTVVGAVSAPAEANTPQDATSAPEETK

SEQ ID NO: 3897 - protein, 360 aa, Homo sapiens
MQIIRHSEQTLKTALISKNPVLVSQYEKLNAGEQRLMNEAFQPASDLFGPITLHSPSDWITSHPEAPQDFEQFFSDPYRKTPSPNKRSIYIQSIGSLGNTRIISEEYIKWLTGYCKAYFYGLRVKLLEPVPVSVTRCSFRVNENTHNLQIHAGDILKFLKKKKPEDAFCVVGITMIDLYPRDSWNFVFGQASLTDGVGIFSFARYGSDFYSMHYKGKVKKLKKTSSSDYSIFDNYYIPEITSVLLLRSCKTLTHEIGHIFGLRHCQWLACLMQGSNHLEEADRRPLNLCPICLHKLQCAVGFSIVERYKALVRWIDDESSDTPGATPEHSHEDNGNLPKPVEAFKEWKEWIIKCLAVLQK

SEQ ID NO: 3898 - protein, 329 aa, Homo sapiens
MILMKMGFSGIVVHQESVCATYGSGLSSTCIVDVGDQKTSVCCVEDGVSHRNTRIFSWNQDISGLQDHEFQIRHPDSPALLYQFRLGDEKLQAPMALFYPATFGIVGQKMTTLQHRSQGDPEDPHDEHYLLATQSKQEQSAKATADRKSASKPIGFEGDLRGQSSDLPERLHSQEVDLGSAQGDGLMAGNDSEEALTALMSRKTAISLFEGKALGLDKAILHSIDCCSSDDTKKKMYSSILVVGGGLMFHKAQEFLQHRILNKMPPSFRRIIENVDVITRPKDMDPRLIAWKGGAVLACLDTTQELWIYQREWQRFGVRMLRERAAFVW

SEQ ID NO: 3899 - protein, 624 aa, Homo sapiens
MTQAEKGDTENGKEKGGEKEKEQRGVKRPIVPALVPESLQEQIQSNFIIVIHPGSTTLRIGRATDTLPASIPHVIARRHKQQGQPLYKDSWLLREGLNKPESNEQRQNGLKMVDQAIWSKKMSNGTRRIPVSPEQARSYNKQMRPAILDHCSGNKWTNTSHHPEYLVGEEALYVNPLDCYNIHWPIRRGQLNIHPGPGGSLTAVLADIEVIWSHAIQKYLEIPLKDLKYYRCILLIPDIYNKQHVKELVNMILMKMGFSGIVVHQESVCATYGSGLSSTCIVDVGDQKTSVCCVEDGVSHRNTRLCLAYGGSDVSRCFYWLMQRAGFPYRECQLTNKMDCLLLQHLKETFCHLDQDISGLQDHEFQIRHPDSPALLYQFRLGDEKLQAPMALFYPATFGIVGQKMTTLQHRSQGDPEDPHDEHYLLATQSKQEQSAKATADRKSASKPIGFEGDLRGQSSDLPERLHSQEVDLGSAQGDGLMAGNDSEEALTALMSRKTAISLFEGKALGLDKAILHSIDCCSSDDTKKKMYSSILVVGGGLMFHKAQEFLQHRILNKMPPSFRRIIENVDVITRPKDMDPRLIAWKGGAVLACLDTTQELWIYQREWQRFGVRMLRERAAFVW

SEQ ID NO: 3900 - protein, 787 aa, Homo sapiens
MAATTANPEMTSDVPSLGPAIASGNSGPGIQGGGAIVQRAIKRRPGLDFDDDGEGNSKFLRCDDDQMSNDKERFARSDDEQSSADKERLARENHSEIERRRRNKMTAYITELSDMVPTCSALARKPDKLTILRMAVSHMKSLRGTGNTSTDGSYKPSFLTDQELKHLILEAADGFLFIVSCETGRVVYVSDSVTPVLNQPQSEWFGSTLYDQVHPDDVDKLREQLSTSENALTGRILDLKTGTVKKEGQQSSMRMCMGSRRSFICRMRCGSSSVDPVSVNRLSFVRNRCRNGLGSVKDGEPHFVVVHCTGYIKAWPPAGVSLPDDDPEAGQGSKFCLVAIGRLQVTSSPNCTDMSNVCQPTEFISRHNIEGIFTFVDHRCVATVGYQPQELLGKNIVEFCHPEDQQLLRDSFQQVVKLKGQVLSVMFRFRSKNQEWLWMRTSSFTFQNPYSDEIEYIICTNTNVKNSSQEPRPTLSNTIQRPQLGPTANLPLEMGSGQLAPRQQQQQTELDMVPGRDGLASYNHSQVVQPVTTTGPEHSKPLEKSDGLFAQDRDPRFSEIYHNINADQSKGISSSTVPATQQLFSQGNTFPPTPRPAENFSGLAPPVTIVQPSASAGQMLAQISRHSNPTQGATPTWTPTTRSGFSAQQVATQATAKTRTSQFGVGSFQTPSSFSSMSLPGAPTASPGAAAYPSLTNRGSNFAPETGQTAGQFQTRTAEGVGVWPQWQGQQPHHRSSSSEQHVQQPPAQQPGQPEVFQEMLSMLGDQSNSYNNEEFPDLTMFPPFSE

SEQ ID NO: 3901 - protein, 789 aa, Homo sapiens
MAATTANPEMTSDVPSLGPAIASGNSGPGIQGGGAIVQRAIKRRPGLDFDDDGEGNSKFLRCDDDQMSNDKERFARSDDEQSSADKERLARENHSEIERRRRNKMTAYITELSDMVPTCSALARKPDKLTILRMAVSHMKSLRGTGNTSTDGSYKPSFLTDQELKHLILEAADGFLFIVSCETGRVVYVSDSVTPVLNQPQSEWFGSTLYDQVHPDDVDKLREQLSTSENALTGRILDLKTGTVKKEGQQSSMRMCMGSRRSFICRMRCGSSSVDPVSVNRLSFVRNRCRNGLGSVKDGEPHFVVVHCTGYIKAWPPAGVSLPDDDPEAGQGSKFCLVAIGRLQVTSSPNCTDMSNVCQPTEFISRHNIEGIFTFVDHRCVATVGYQPQELLGKNIVEFCHPEDQQLLRDSFQQVVKLKGQVLSVMFRFRSKNQEWLWMRTSSFTFQNPYSDEIEYIICTNTNVKNSSQEPRPTLSNTIQRPQLGPTANLPLEMGSGQLAPRQQQQQTELDMVPGRDGLASYNHSQVVQPVTTTGPEHSKPLEKSDGLFAQDRDPRFSEIYHNINADQSKGISSSTVPATQQLFSQGNTFPPTPRPAENFRNSGLAPPVTIVQPSASAGQMLAQISRHSNPTQGATPTWTPTTRSGFSAQQVATQATAKTRTSQFGVGSFQTPSSFSSMSLPGAPTASPGAAAYPSLTNRGSNFAPETGQTAGQFQTRTAEGVGVWPQWQGQQPHHRSSSSEQHVQQPPAQQPGQPEVFQEMLSMLGDQSNSYNNEEFPDLTMFPPFSE

SEQ ID NO: 3902 - protein, 588 aa, Homo sapiens
MAAEEEAAAGGKVLREENQCIAPVVSSRVSPGTRPTAMGSFSSHMTEFPRKRKGSDSDPSQEAHSQTEKRRRDKMNNLIEELSAMIPQCNPMARKLDKLTVLRMAVQHLRSLKGLTNSYVGSNYRPSFLQDNELRHLILKTAEGFLFVVGCERGKILFVSKSVSKILNYDQASLTGQSLFDFLHPKDVAKVKEQLSSFDISPREKLIDAKTGLQVHSNLHAGRTRVYSGSRRSFFCRIKSCKISVKEEHGCLPNSKKKEHRKFYTIHCTGYLRSWPPNIVGMEEERNSKKDNSNFTCLVAIGRLQPYIVPQNSGEINVKPTEFITRFAVNGKFVYVDQRATAILGYLPQELLGTSCYEYFHQDDHNNLTDKHKAVLQSKEKILTDSYKFRAKDGSFVTLKSQWFSFTNPWTKELEYIVSVNTLVLGHSEPGEASFLPCSSQSSEESSRQSCMSVPGMSTGTVLGAGSIGTDIANEILDLQRLQSSSYLDDSSPTGLMKDTHTVNCRSMSNKELFPPSPSEMGELEATRQNQSTVAVHSHEPLLSDGAQLDFDALCDNDDTAMAAFMNYLEAEGGLGDPGDFSDIQWTL

SEQ ID NO: 3903 - protein, 636 aa, Homo sapiens
MAAEEEAAAGGKVLREENQCIAPVVSSRVSPGTRPTAMGSFSSHMTEFPRKRKGSDSDPSQSGIMTEKVVEKLSQNPLTYLLSTRIEISASSGSRVEDGEHQVKMKAFREAHSQTEKRRRDKMNNLIEELSAMIPQCNPMARKLDKLTVLRMAVQHLRSLKGLTNSYVGSNYRPSFLQDNELRHLILKTAEGFLFVVGCERGKILFVSKSVSKILNYDQASLTGQSLFDFLHPKDVAKVKEQLSSFDISPREKLIDAKTGLQVHSNLHAGRTRVYSGSRRSFFCRIKSCKISVKEEHGCLPNSKKKEHRKFYTIHCTGYLRSWPPNIVGMEEERNSKKDNSNFTCLVAIGRLQPYIVPQNSGEINVKPTEFITRFAVNGKFVYVDQRATAILGYLPQELLGTSCYEYFHQDDHNNLTDKHKAVLQSKEKILTDSYKFRAKDGSFVTLKSQWFSFTNPWTKELEYIVSVNTLVLGHSEPGEASFLPCSSQSSEESSRQSCMSVPGMSTGTVLGAGSIGTDIANEILDLQRLQSSSYLDDSSPTGLMKDTHTVNCRSMSNKELFPPSPSEMGELEATRQNQSTVAVHSHEPLLSDGAQLDFDALCDNDDTAMAAFMNYLEAEGGLGDPGDFSDIQWTL

SEQ ID NO: 3904 - protein, 622 aa, Homo sapiens
MAAEEEAAAGGKVLREENQCIAPVVSSRVSPGTRPTAMGSFSSHMTEFPRKRKGSDSDPSQSGIMTEKVVEKLSQNPLTYLLSTRIEISASSGSREAHSQTEKRRRDKMNNLIEELSAMIPQCNPMARKLDKLTVLRMAVQHLRSLKGLTNSYVGSNYRPSFLQDNELRHLILKTAEGFLFVVGCERGKILFVSKSVSKILNYDQASLTGQSLFDFLHPKDVAKVKEQLSSFDISPREKLIDAKTGLQVHSNLHAGRTRVYSGSRRSFFCRIKSCKISVKEEHGCLPNSKKKEHRKFYTIHCTGYLRSWPPNIVGMEEERNSKKDNSNFTCLVAIGRLQPYIVPQNSGEINVKPTEFITRFAVNGKFVYVDQRATAILGYLPQELLGTSCYEYFHQDDHNNLTDKHKAVLQSKEKILTDSYKFRAKDGSFVTLKSQWFSFTNPWTKELEYIVSVNTLVLGHSEPGEASFLPCSSQSSEESSRQSCMSVPGMSTGTVLGAGSIGTDIANEILDLQRLQSSSYLDDSSPTGLMKDTHTVNCRSMSNKELFPPSPSEMGELEATRQNQSTVAVHSHEPLLSDGAQLDFDALCDNDDTAMAAFMNYLEAEGGLGDPGDFSDIQWTL

SEQ ID NO: 3905 - protein, 599 aa, Homo sapiens
MAAEEEAAAGGEVAGGEATAPGKVLREENQCIAPVVSSRVSPGTRPTAMGSFSSHMTEFPRKRKGSDSDPSQEAHSQTEKRRRDKMNNLIEELSAMIPQCNPMARKLDKLTVLRMAVQHLRSLKGLTNSYVGSNYRPSFLQDNELRHLILKTAEGFLFVVGCERGKILFVSKSVSKILNYDQASLTGQSLFDFLHPKDVAKVKEQLSSFDISPREKLIDAKTGLQVHSNLHAGRTRVYSGSRRSFFCRIKSCKISVKEEHGCLPNSKKKEHRKFYTIHCTGYLRSWPPNIVGMEEERNSKKDNSNFTCLVAIGRLQPYIVPQNSGEINVKPTEFITRFAVNGKFVYVDQRATAILGYLPQELLGTSCYEYFHQDDHNNLTDKHKAVLQSKEKILTDSYKFRAKDGSFVTLKSQWFSFTNPWTKELEYIVSVNTLVLGHSEPGEASFLPCSSQSSEESSRQSCMSVPGMSTGTVLGAGSIGTDIANEILDLQRLQSSSYLDDSSPTGLMKDTHTVNCRSMSNKELFPPSPSEMGELEATRQNQSTVAVHSHEPLLSDGAQLDFDALCDNDDTAMAAFMNYLEAEGGLGDPGDFSDIQWTL

SEQ ID NO: 3906 - protein, 551 aa, Homo sapiens
MGSFSSHMTEFPRKRKGSDSDPSQEAHSQTEKRRRDKMNNLIEELSAMIPQCNPMARKLDKLTVLRMAVQHLRSLKGLTNSYVGSNYRPSFLQDNELRHLILKTAEGFLFVVGCERGKILFVSKSVSKILNYDQASLTGQSLFDFLHPKDVAKVKEQLSSFDISPREKLIDAKTGLQVHSNLHAGRTRVYSGSRRSFFCRIKSCKISVKEEHGCLPNSKKKEHRKFYTIHCTGYLRSWPPNIVGMEEERNSKKDNSNFTCLVAIGRLQPYIVPQNSGEINVKPTEFITRFAVNGKFVYVDQRATAILGYLPQELLGTSCYEYFHQDDHNNLTDKHKAVLQSKEKILTDSYKFRAKDGSFVTLKSQWFSFTNPWTKELEYIVSVNTLVLGHSEPGEASFLPCSSQSSEESSRQSCMSVPGMSTGTVLGAGSIGTDIANEILDLQRLQSSSYLDDSSPTGLMKDTHTVNCRSMSNKELFPPSPSEMGELEATRQNQSTVAVHSHEPLLSDGAQLDFDALCDNDDTAMAAFMNYLEAEGGLGDPGDFSDIQWTL

SEQ ID NO: 3907 - protein, 602 aa, Homo sapiens
MAAEEEAAAGGKVLREENQCIAPVVSSRVSPGTRPTAMGSFSSHMTEFPRKRKGSDSDPSQVEDGEHQVKMKAFREAHSQTEKRRRDKMNNLIEELSAMIPQCNPMARKLDKLTVLRMAVQHLRSLKGLTNSYVGSNYRPSFLQDNELRHLILKTAEGFLFVVGCERGKILFVSKSVSKILNYDQASLTGQSLFDFLHPKDVAKVKEQLSSFDISPREKLIDAKTGLQVHSNLHAGRTRVYSGSRRSFFCRIKSCKISVKEEHGCLPNSKKKEHRKFYTIHCTGYLRSWPPNIVGMEEERNSKKDNSNFTCLVAIGRLQPYIVPQNSGEINVKPTEFITRFAVNGKFVYVDQRATAILGYLPQELLGTSCYEYFHQDDHNNLTDKHKAVLQSKEKILTDSYKFRAKDGSFVTLKSQWFSFTNPWTKELEYIVSVNTLVLGHSEPGEASFLPCSSQSSEESSRQSCMSVPGMSTGTVLGAGSIGTDIANEILDLQRLQSSSYLDDSSPTGLMKDTHTVNCRSMSNKELFPPSPSEMGELEATRQNQSTVAVHSHEPLLSDGAQLDFDALCDNDDTAMAAFMNYLEAEGGLGDPGDFSDIQWTL

SEQ ID NO: 3908 - protein, 2285 aa, Homo sapiens
MAAQVAPAAASSLGNPPPPPPSELKKAEQQQREEAGGEAAAAAAAERGEMKAAAGQESEGPAVGPPQPLGKELQDGAESNGGGGGGGAGSGGGPGAEPDLKNSNGNAGPRPALNNNLTEPPGGGGGGSSDGVGAPPHSAAAALPPPAYGFGQPYGRSPSAVAAAAAAVFHQQHGGQQSPGLAALQSGGGGGLEPYAGPQQNSHDHGFPNHQYNSYYPNRSAYPPPAPAYALSSPRGGTPGSGAAAAAGSKPPPSSSASASSSSSSFAQQRFGAMGGGGPSAAGGGTPQPTATPTLNQLLTSPSSARGYQGYPGGDYSGGPQDGGAGKGPADMASQCWGAAAAAAAAAAASGGAQQRSHHAPMSPGSSGGGGQPLARTPQPSSPMDQMGKMRPQPYGGTNPYSQQQGPPSGPQQGHGYPGQPYGSQTPQRYPMTMQGRAQSAMGGLSYTQQIPPYGQQGPSGYGQQGQTPYYNQQSPHPQQQQPPYSQQPPSQTPHAQPSYQQQPQSQPPQLQSSQPPYSQQPSQPPHQQSPAPYPSQQSTTQQHPQSQPPYSQPQAQSPYQQQQPQQPAPSTLSQQAAYPQPQSQQSQQTAYSQQRFPPPQELSQDSFGSQASSAPSMTSSKGGQEDMNLSLQSRPSSLPDLSGSIDDLPMGTEGALSPGVSTSGISSSQGEQSNPAQSPFSPHTSPHLPGIRGPSPSPVGSPASVAQSRSGPLSPAAVPGNQMPPRPPSGQSDSIMHPSMNQSSIAQDRGYMQRNPQMPQYSSPQPGSALSPRQPSGGQIHTGMGSYQQNSMGSYGPQGGQYGPQGGYPRQPNYNALPNANYPSAGMAGGINPMGAGGQMHGQPGIPPYGTLPPGRMSHASMGNRPYGPNMANMPPQVGSGMCPPPGGMNRKTQETAVAMHVAANSIQNRPPGYPNMNQGGMMGTGPPYGQGINSMAGMINPQGPPYSMGGTMANNSAGMAASPEMMGLGDVKLTPATKMNNKADGTPKTESKSKKSSSSTTTNEKITKLYELGGEPERKMWVDRYLAFTEEKAMGMTNLPAVGRKPLDLYRLYVSVKEIGGLTQVNKNKKWRELATNLNVGTSSSAASSLKKQYIQCLYAFECKIERGEDPPPDIFAAADSKKSQPKIQPPSPAGSGSMQGPQTPQSTSSSMAEGGDLKPPTPASTPHSQIPPLPGMSRSNSVGIQDAFNDGSDSTFQKRNSMTPNPGYQPSMNTSDMMGRMSYEPNKDPYGSMRKAPGSDPFMSSGQGPNGGMGDPYSRAAGPGLGNVAMGPRQHYPYGGPYDRVRTEPGIGPEGNMSTGAPQPNLMPSNPDSGMYSPSRYPPQQQQQQQQRHDSYGNQFSTQGTPSGSPFPSQQTTMYQQQQQNYKRPMDGTYGPPAKRHEGEMYSVPYSTGQGQPQQQQLPPAQPQPASQQQAAQPSPQQDVYNQYGNAYPATATAATERRPAGGPQNQFPFQFGRDRVSAPPGTNAQQNMPPQMMGGPIQASAEVAQQGTMWQGRNDMTYNYANRQSTGSAPQGPAYHGVNRTDEMLHTDQRANHEGSWPSHGTRQPPYGPSAPVPPMTRPPPSNYQPPPSMQNHIPQVSSPAPLPRPMENRTSPSKSPFLHSGMKMQKAGPPVPASHIAPAPVQPPMIRRDITFPPGSVEATQPVLKQRRRLTMKDIGTPEAWRVMMSLKSGLLAESTWALDTINILLYDDNSIMTFNLSQLPGLLELLVEYFRRCLIEIFGILKEYEVGDPGQRTLLDPGRFSKVSSPAPMEGGEEEEELLGPKLEEEEEEEVVENDEEIAFSGKDKPASENSEEKLISKFDKLPVKIVQKNDPFVVDCSDKLGRVQEFDSGLLHWRIGGGDTTEHIQTHFESKTELLPSRPHAPCPPAPRKHVTTAEGTPGTTDQEGPPPDGPPEKRITATMDDMLSTRSSTLTEDGAKSSEAIKESSKFPFGISPAQSHRNIKILEDEPHSKDETPLCTLLDWQDSLAKRCVCVSNTIRSLSFVPGNDFEMSKHPGLLLILGKLILLHHKHPERKQAPLTYEKEEEQDQGVSCNKVEWWWDCLEMLRENTLVTLANISGQLDLSPYPESICLPVLDGLLHWAVCPSAEAQDPFSTLGPNAVLSPQRLVLETLSKLSIQDNNVDLILATPPFSRLEKLYSTMVRFLSDRKNPVCREMAVVLLANLAQGDSLAARAIAVQKGSIGNLLGFLEDSLAATQFQQSQASLLHMQNPPFEPTSVDMMRRAARALLALAKVDENHSEFTLYESRLLDISVSPLMNSLVSQVICDVLFLIGQS

SEQ ID NO: 3909 - protein, 1902 aa, Homo sapiens
MDQMGKMRPQPYGGTNPYSQQQGPPSGPQQGHGYPGQPYGSQTPQRYPMTMQGRAQSAMGGLSYTQQIPPYGQQGPSGYGQQGQTPYYNQQSPHPQQQQPPYSQQPPSQTPHAQPSYQQQPQSQPPQLQSSQPPYSQQPSQPPHQQSPAPYPSQQSTTQQHPQSQPPYSQPQAQSPYQQQQPQQPAPSTLSQQAAYPQPQSQQSQQTAYSQQRFPPPQELSQDSFGSQASSAPSMTSSKGGQEDMNLSLQSRPSSLPDLSGSIDDLPMGTEGALSPGVSTSGISSSQGEQSNPAQSPFSPHTSPHLPGIRGPSPSPVGSPASVAQSRSGPLSPAAVPGNQMPPRPPSGQSDSIMHPSMNQSSIAQDRGYMQRNPQMPQYSSPQPGSALSPRQPSGGQIHTGMGSYQQNSMGSYGPQGGQYGPQGGYPRQPNYNALPNANYPSAGMAGGINPMGAGGQMHGQPGIPPYGTLPPGRMSHASMGNRPYGPNMANMPPQVGSGMCPPPGGMNRKTQETAVAMHVAANSIQNRPPGYPNMNQGGMMGTGPPYGQGINSMAGMINPQGPPYSMGGTMANNSAGMAASPEMMGLGDVKLTPATKMNNKADGTPKTESKSKKSSSSTTTNEKITKLYELGGEPERKMWVDRYLAFTEEKAMGMTNLPAVGRKPLDLYRLYVSVKEIGGLTQVNKNKKWRELATNLNVGTSSSAASSLKKQYIQCLYAFECKIERGEDPPPDIFAAADSKKSQPKIQPPSPAGSGSMQGPQTPQSTSSSMAEGGDLKPPTPASTPHSQIPPLPGMSRSNSVGIQDAFNDGSDSTFQKRNSMTPNPGYQPSMNTSDMMGRMSYEPNKDPYGSMRKAPGSDPFMSSGQGPNGGMGDPYSRAAGPGLGNVAMGPRQHYPYGGPYDRVRTEPGIGPEGNMSTGAPQPNLMPSNPDSGMYSPSRYPPQQQQQQQQRHDSYGNQFSTQGTPSGSPFPSQQTTMYQQQQQNYKRPMDGTYGPPAKRHEGEMYSVPYSTGQGQPQQQQLPPAQPQPASQQQAAQPSPQQDVYNQYGNAYPATATAATERRPAGGPQNQFPFQFGRDRVSAPPGTNAQQNMPPQMMGGPIQASAEVAQQGTMWQGRNDMTYNYANRQSTGSAPQGPAYHGVNRTDEMLHTDQRANHEGSWPSHGTRQPPYGPSAPVPPMTRPPPSNYQPPPSMQNHIPQVSSPAPLPRPMENRTSPSKSPFLHSGMKMQKAGPPVPASHIAPAPVQPPMIRRDITFPPGSVEATQPVLKQRRRLTMKDIGTPEAWRVMMSLKSGLLAESTWALDTINILLYDDNSIMTFNLSQLPGLLELLVEYFRRCLIEIFGILKEYEVGDPGQRTLLDPGRFSKVSSPAPMEGGEEEEELLGPKLEEEEEEEVVENDEEIAFSGKDKPASENSEEKLISKFDKLPVKIVQKNDPFVVDCSDKLGRVQEFDSGLLHWRIGGGDTTEHIQTHFESKTELLPSRPHAPCPPAPRKHVTTAEGTPGTTDQEGPPPDGPPEKRITATMDDMLSTRSSTLTEDGAKSSEAIKESSKFPFGISPAQSHRNIKILEDEPHSKDETPLCTLLDWQDSLAKRCVCVSNTIRSLSFVPGNDFEMSKHPGLLLILGKLILLHHKHPERKQAPLTYEKEEEQDQGVSCNKVEWWWDCLEMLRENTLVTLANISGQLDLSPYPESICLPVLDGLLHWAVCPSAEAQDPFSTLGPNAVLSPQRLVLETLSKLSIQDNNVDLILATPPFSRLEKLYSTMVRFLSDRKNPVCREMAVVLLANLAQGDSLAARAIAVQKGSIGNLLGFLEDSLAATQFQQSQASLLHMQNPPFEPTSVDMMRRAARALLALAKVDENHSEFTLYESRLLDISVSPLMNSLVSQVICDVLFLIGQS

SEQ ID NO: 3910 - protein, 2068 aa, Homo sapiens
MAAQVAPAAASSLGNPPPPPPSELKKAEQQQREEAGGEAAAAAAAERGEMKAAAGQESEGPAVGPPQPLGKELQDGAESNGGGGGGGAGSGGGPGAEPDLKNSNGNAGPRPALNNNLTEPPGGGGGGSSDGVGAPPHSAAAALPPPAYGFGQPYGRSPSAVAAAAAAVFHQQHGGQQSPGLAALQSGGGGGLEPYAGPQQNSHDHGFPNHQYNSYYPNRSAYPPPAPAYALSSPRGGTPGSGAAAAAGSKPPPSSSASASSSSSSFAQQRFGAMGGGGPSAAGGGTPQPTATPTLNQLLTSPSSARGYQGYPGGDYSGGPQDGGAGKGPADMASQCWGAAAAAAAAAAASGGAQQRSHHAPMSPGSSGGGGQPLARTPQPSSPMDQMGKMRPQPYGGTNPYSQQQGPPSGPQQGHGYPGQPYGSQTPQRYPMTMQGRAQSAMGGLSYTQQIPPYGQQGPSGYGQQGQTPYYNQQSPHPQQQQPPYSQQPPSQTPHAQPSYQQQPQSQPPQLQSSQPPYSQQPSQPPHQQSPAPYPSQQSTTQQHPQSQPPYSQPQAQSPYQQQQPQQPAPSTLSQQAAYPQPQSQQSQQTAYSQQRFPPPQELSQDSFGSQASSAPSMTSSKGGQEDMNLSLQSRPSSLPDLSGSIDDLPMGTEGALSPGVSTSGISSSQGEQSNPAQSPFSPHTSPHLPGIRGPSPSPVGSPASVAQSRSGPLSPAAVPGNQMPPRPPSGQSDSIMHPSMNQSSIAQDRGYMQRNPQMPQYSSPQPGSALSPRQPSGGQIHTGMGSYQQNSMGSYGPQGGQYGPQGGYPRQPNYNALPNANYPSAGMAGGINPMGAGGQMHGQPGIPPYGTLPPGRMSHASMGNRPYGPNMANMPPQVGSGMCPPPGGMNRKTQETAVAMHVAANSIQNRPPGYPNMNQGGMMGTGPPYGQGINSMAGMINPQGPPYSMGGTMANNSAGMAASPEMMGLGDVKLTPATKMNNKADGTPKTESKSKKSSSSTTTNEKITKLYELGGEPERKMWVDRYLAFTEEKAMGMTNLPAVGRKPLDLYRLYVSVKEIGGLTQVNKNKKWRELATNLNVGTSSSAASSLKKQYIQCLYAFECKIERGEDPPPDIFAAADSKKSQPKIQPPSPAGSGSMQGPQTPQSTSSSMAEGGDLKPPTPASTPHSQIPPLPGMSRSNSVGIQDAFNDGSDSTFQKRNSMTPNPGYQPSMNTSDMMGRMSYEPNKDPYGSMRKAPGSDPFMSSGQGPNGGMGDPYSRAAGPGLGNVAMGPRQHYPYGGPYDRVRTEPGIGPEGNMSTGAPQPNLMPSNPDSGMYSPSRYPPQQQQQQQQRHDSYGNQFSTQGTPSGSPFPSQQTTMYQQQQQVSSPAPLPRPMENRTSPSKSPFLHSGMKMQKAGPPVPASHIAPAPVQPPMIRRDITFPPGSVEATQPVLKQRRRLTMKDIGTPEAWRVMMSLKSGLLAESTWALDTINILLYDDNSIMTFNLSQLPGLLELLVEYFRRCLIEIFGILKEYEVGDPGQRTLLDPGRFSKVSSPAPMEGGEEEEELLGPKLEEEEEEEVVENDEEIAFSGKDKPASENSEEKLISKFDKLPVKIVQKNDPFVVDCSDKLGRVQEFDSGLLHWRIGGGDTTEHIQTHFESKTELLPSRPHAPCPPAPRKHVTTAEGTPGTTDQEGPPPDGPPEKRITATMDDMLSTRSSTLTEDGAKSSEAIKESSKFPFGISPAQSHRNIKILEDEPHSKDETPLCTLLDWQDSLAKRCVCVSNTIRSLSFVPGNDFEMSKHPGLLLILGKLILLHHKHPERKQAPLTYEKEEEQDQGVSCNKVEWWWDCLEMLRENTLVTLANISGQLDLSPYPESICLPVLDGLLHWAVCPSAEAQDPFSTLGPNAVLSPQRLVLETLSKLSIQDNNVDLILATPPFSRLEKLYSTMVRFLSDRKNPVCREMAVVLLANLAQGDSLAARAIAVQKGSIGNLLGFLEDSLAATQFQQSQASLLHMQNPPFEPTSVDMMRRAARALLALAKVDENHSEFTLYESRLLDISVSPLMNSLVSQVICDVLFLIGQS

SEQ ID NO: 3911 - protein, 613 aa, Homo sapiens
MMSLKSGLLAESTWALDTINILLYDDNSIMTFNLSQLPGLLELLVEYFRRCLIEIFGILKEYEVGDPGQRTLLDPGRFSKVSSPAPMEGGEEEEELLGPKLEEEEEEEVVENDEEIAFSGKDKPASENSEEKLISKFDKLPVKIVQKNDPFVVDCSDKLGRVQEFDSGLLHWRIGGGDTTEHIQTHFESKTELLPSRPHAPCPPAPRKHVTTAEGTPGTTDQEGPPPDGPPEKRITATMDDMLSTRSSTLTEDGAKSSEAIKESSKFPFGISPAQSHRNIKILEDEPHSKDETPLCTLLDWQDSLAKRCVCVSNTIRSLSFVPGNDFEMSKHPGLLLILGKLILLHHKHPERKQAPLTYEKEEEQDQGVSCNKVEWWWDCLEMLRENTLVTLANISGQLDLSPYPESICLPVLDGLLHWAVCPSAEAQDPFSTLGPNAVLSPQRLVLETLSKLSIQDNNVDLILATPPFSRLEKLYSTMVRFLSDRKNPVCREMAVVLLANLAQGDSLAARAIAVQKGSIGNLLGFLEDSLAATQFQQSQASLLHMQNPPFEPTSVDMMRRAARALLALAKVDENHSEFTLYESRLLDISVSPLMNSLVSQVICDVLFLIGQS

SEQ ID NO: 3912 - protein, 2231 aa, Homo sapiens
METGLLPNHKLKTVGEAPAAPPHQQHHHHHHAHHHHHHAHHLHHHHALQQQLNQFQQQQQQQQQQQQQQQQQQHPISNNNSLGGAGGGAPQPGPDMEQPQHGGAKDSAAGGQADPPGPPLLSKPGDEDDAPPKMGEPAGGRYEHPGLGALGTQQPPVAVPGGGGGPAAVPEFNNYYGSAAPASGGPGGRAGPCFDQHGGQQSPGMGMMHSASAAAAGAPGSMDPLQNSHEGYPNSQCNHYPGYSRPGAGGGGGGGGGGGGGSGGGGGGGGAGAGGAGAGAVAAAAAAAAAAAGGGGGGGYGGSSAGYGVLSSPRQQGGGMMMGPGGGGAASLSKAAAGSAAGGFQRFAGQNQHPSGATPTLNQLLTSPSPMMRSYGGSYPEYSSPSAPPPPPSQPQSQAAAAGAAAGGQQAAAGMGLGKDMGAQYAAASPAWAAAQQRSHPAMSPGTPGPTMGRSQGSPMDPMVMKRPQLYGMGSNPHSQPQQSSPYPGGSYGPPGPQRYPIGIQGRTPGAMAGMQYPQQQMPPQYGQQGVSGYCQQGQQPYYSQQPQPPHLPPQAQYLPSQSQQRYQPQQDMSQEGYGTRSQPPLAPGKPNHEDLNLIQQERPSSLPDLSGSIDDLPTGTEATLSSAVSASGSTSSQGDQSNPAQSPFSPHASPHLSSIPGGPSPSPVGSPVGSNQSRSGPISPASIPGSQMPPQPPGSQSESSSHPALSQSPMPQERGFMAGTQRNPQMAQYGPQQTGPSMSPHPSPGGQMHAGISSFQQSNSSGTYGPQMSQYGPQGNYSRPPAYSGVPSASYSGPGPGMGISANNQMHGQGPSQPCGAVPLGRMPSAGMQNRPFPGNMSSMTPSSPGMSQQGGPGMGPPMPTVNRKAQEAAAAVMQAAANSAQSRQGSFPGMNQSGLMASSSPYSQPMNNSSSLMNTQAPPYSMAPAMVNSSAASVGLADMMSPGESKLPLPLKADGKEEGTPQPESKSKDSYSSQGISQPPTPGNLPVPSPMSPSSASISSFHGDESDSISSPGWPKTPSSPKSSSSTTTGEKITKVYELGNEPERKLWVDRYLTFMEERGSPVSSLPAVGKKPLDLFRLYVCVKEIGGLAQVNKNKKWRELATNLNVGTSSSAASSLKKQYIQYLFAFECKIERGEEPPPEVFSTGDTKKQPKLQPPSPANSGSLQGPQTPQSTGSNSMAEVPGDLKPPTPASTPHGQMTPMQGGRSSTISVHDPFSDVSDSSFPKRNSMTPNAPYQQGMSMPDVMGRMPYEPNKDPFGGMRKVPGSSEPFMTQGQMPNSSMQDMYNQSPSGAMSNLGMGQRQQFPYGASYDRRHEPYGQQYPGQGPPSGQPPYGGHQPGLYPQQPNYKRHMDGMYGPPAKRHEGDMYNMQYSSQQQEMYNQYGGSYSGPDRRPIQGQYPYPYSRERMQGPGQIQTHGIPPQMMGGPLQSSSSEGPQQNMWAARNDMPYPYQNRQGPGGPTQAPPYPGMNRTDDMMVPDQRINHESQWPSHVSQRQPYMSSSASMQPITRPPQPSYQTPPSLPNHISRAPSPASFQRSLENRMSPSKSPFLPSMKMQKVMPTVPTSQVTGPPPQPPPIRREITFPPGSVEASQPVLKQRRKITSKDIVTPEAWRVMMSLKSGLLAESTWALDTINILLYDDSTVATFNLSQLSGFLELLVEYFRKCLIDIFGILMEYEVGDPSQKALDHNAARKDDSQSLADDSGKEEEDAECIDDDEEDEEDEEEDSEKTESDEKSSIALTAPDAAADPKEKPKQASKFDKLPIKIVKKNNLFVVDRSDKLGRVQEFNSGLLHWQLGGGDTTEHIQTHFESKMEIPPRRRPPPPLSSAGRKKEQEGKGDSEEQQEKSIIATIDDVLSARPGALPEDANPGPQTESSKFPFGIQQAKSHRNIKLLEDEPRSRDETPLCTIAHWQDSLAKRCICVSNIVRSLSFVPGNDAEMSKHPGLVLILGKLILLHHEHPERKRAPQTYEKEEDEDKGVACSKDEWWWDCLEVLRDNTLVTLANISGQLDLSAYTESICLPILDGLLHWMVCPSAEAQDPFPTVGPNSVLSPQRLVLETLCKLSIQDNNVDLILATPPFSRQEKFYATLVRYVGDRKNPVCREMSMALLSNLAQGDALAARAIAVQKGSIGNLISFLEDGVTMAQYQQSQHNLMHMQPPPLEPPSVDMMCRAAKALLAMARVDENRSEFLLHEGRLLDISISAVLNSLVASVICDVLFQIGQL

SEQ ID NO: 3913 - protein, 2249 aa, Homo sapiens
MAHNAGAAAAAGTHSAKSGGSEAALKEGGSAAALSSSSSSSAAAAAASSSSSSGPGSAMETGLLPNHKLKTVGEAPAAPPHQQHHHHHHAHHHHHHAHHLHHHHALQQQLNQFQQQQQQQQQQQQQQQQQQHPISNNNSLGGAGGGAPQPGPDMEQPQHGGAKDSAAGGQADPPGPPLLSKPGDEDDAPPKMGEPAGGRYEHPGLGALGTQQPPVAVPGGGGGPAAVPEFNNYYGSAAPASGGPGGRAGPCFDQHGGQQSPGMGMMHSASAAAAGAPGSMDPLQNSHEGYPNSQCNHYPGYSRPGAGGGGGGGGGGGGGSGGGGGGGGAGAGGAGAGAVAAAAAAAAAAAGGGGGGGYGGSSAGYGVLSSPRQQGGGMMMGPGGGGAASLSKAAAGSAAGGFQRFAGQNQHPSGATPTLNQLLTSPSPMMRSYGGSYPEYSSPSAPPPPPSQPQSQAAAAGAAAGGQQAAAGMGLGKDMGAQYAAASPAWAAAQQRSHPAMSPGTPGPTMGRSQGSPMDPMVMKRPQLYGMGSNPHSQPQQSSPYPGGSYGPPGPQRYPIGIQGRTPGAMAGMQYPQQQDSGDATWKETFWLMPPQYGQQGVSGYCQQGQQPYYSQQPQPPHLPPQAQYLPSQSQQRYQPQQDMSQEGYGTRSQPPLAPGKPNHEDLNLIQQERPSSLPDLSGSIDDLPTGTEATLSSAVSASGSTSSQGDQSNPAQSPFSPHASPHLSSIPGGPSPSPVGSPVGSNQSRSGPISPASIPGSQMPPQPPGSQSESSSHPALSQSPMPQERGFMAGTQRNPQMAQYGPQQTGPSMSPHPSPGGQMHAGISSFQQSNSSGTYGPQMSQYGPQGNYSRPPAYSGVPSASYSGPGPGMGISANNQMHGQGPSQPCGAVPLGRMPSAGMQNRPFPGNMSSMTPSSPGMSQQGGPGMGPPMPTVNRKAQEAAAAVMQAAANSAQSRQGSFPGMNQSGLMASSSPYSQPMNNSSSLMNTQAPPYSMAPAMVNSSAASVGLADMMSPGESKLPLPLKADGKEEGTPQPESKSKKSSSSTTTGEKITKVYELGNEPERKLWVDRYLTFMEERGSPVSSLPAVGKKPLDLFRLYVCVKEIGGLAQVNKNKKWRELATNLNVGTSSSAASSLKKQYIQYLFAFECKIERGEEPPPEVFSTGDTKKQPKLQPPSPANSGSLQGPQTPQSTGSNSMAEVPGDLKPPTPASTPHGQMTPMQGGRSSTISVHDPFSDVSDSSFPKRNSMTPNAPYQQGMSMPDVMGRMPYEPNKDPFGGMRKVPGSSEPFMTQGQMPNSSMQDMYNQSPSGAMSNLGMGQRQQFPYGASYDRRHEPYGQQYPGQGPPSGQPPYGGHQPGLYPQQPNYKRHMDGMYGPPAKRHEGDMYNMQYSSQQQEMYNQYGGSYSGPDRRPIQGQYPYPYSRERMQGPGQIQTHGIPPQMMGGPLQSSSSEGPQQNMWAARNDMPYPYQNRQGPGGPTQAPPYPGMNRTDDMMVPDQRINHESQWPSHVSQRQPYMSSSASMQPITRPPQPSYQTPPSLPNHISRAPSPASFQRSLENRMSPSKSPFLPSMKMQKVMPTVPTSQVTGPPPQPPPIRREITFPPGSVEASQPVLKQRRKITSKDIVTPEAWRVMMSLKSGLLAESTWALDTINILLYDDSTVATFNLSQLSGFLELLVEYFRKCLIDIFGILMEYEVGDPSQKALDHNAARKDDSQSLADDSGKEEEDAECIDDDEEDEEDEEEDSEKTESDEKSSIALTAPDAAADPKEKPKQASKFDKLPIKIVKKNNLFVVDRSDKLGRVQEFNSGLLHWQLGGGDTTEHIQTHFESKMEIPPRRRPPPPLSSAGRKKEQEGKGDSEEQQEKSIIATIDDVLSARPGALPEDANPGPQTESSKFPFGIQQAKSHRNIKLLEDEPRSRDETPLCTIAHWQDSLAKRCICVSNIVRSLSFVPGNDAEMSKHPGLVLILGKLILLHHEHPERKRAPQTYEKEEDEDKGVACSKDEWWWDCLEVLRDNTLVTLANISGQLDLSAYTESICLPILDGLLHWMVCPSAEAQDPFPTVGPNSVLSPQRLVLETLCKLSIQDNNVDLILATPPFSRQEKFYATLVRYVGDRKNPVCREMSMALLSNLAQGDALAARAIAVQKGSIGNLISFLEDGVTMAQYQQSQHNLMHMQPPPLEPPSVDMMCRAAKALLAMARVDENRSEFLLHEGRLLDISISAVLNSLVASVICDVLFQIGQL

SEQ ID NO: 3914 - protein, 2236 aa, Homo sapiens
MAHNAGAAAAAGTHSAKSGGSEAALKEGGSAAALSSSSSSSAAAAAASSSSSSGPGSAMETGLLPNHKLKTVGEAPAAPPHQQHHHHHHAHHHHHHAHHLHHHHALQQQLNQFQQQQQQQQQQQQQQQQQQHPISNNNSLGGAGGGAPQPGPDMEQPQHGGAKDSAAGGQADPPGPPLLSKPGDEDDAPPKMGEPAGGRYEHPGLGALGTQQPPVAVPGGGGGPAAVPEFNNYYGSAAPASGGPGGRAGPCFDQHGGQQSPGMGMMHSASAAAAGAPGSMDPLQNSHEGYPNSQCNHYPGYSRPGAGGGGGGGGGGGGGSGGGGGGGGAGAGGAGAGAVAAAAAAAAAAAGGGGGGGYGGSSAGYGVLSSPRQQGGGMMMGPGGGGAASLSKAAAGSAAGGFQRFAGQNQHPSGATPTLNQLLTSPSPMMRSYGGSYPEYSSPSAPPPPPSQPQSQAAAAGAAAGGQQAAAGMGLGKDMGAQYAAASPAWAAAQQRSHPAMSPGTPGPTMGRSQGSPMDPMVMKRPQLYGMGSNPHSQPQQSSPYPGGSYGPPGPQRYPIGIQGRTPGAMAGMQYPQQQMPPQYGQQGVSGYCQQGQQPYYSQQPQPPHLPPQAQYLPSQSQQRYQPQQDMSQEGYGTRSQPPLAPGKPNHEDLNLIQQERPSSLPDLSGSIDDLPTGTEATLSSAVSASGSTSSQGDQSNPAQSPFSPHASPHLSSIPGGPSPSPVGSPVGSNQSRSGPISPASIPGSQMPPQPPGSQSESSSHPALSQSPMPQERGFMAGTQRNPQMAQYGPQQTGPSMSPHPSPGGQMHAGISSFQQSNSSGTYGPQMSQYGPQGNYSRPPAYSGVPSASYSGPGPGMGISANNQMHGQGPSQPCGAVPLGRMPSAGMQNRPFPGNMSSMTPSSPGMSQQGGPGMGPPMPTVNRKAQEAAAAVMQAAANSAQSRQGSFPGMNQSGLMASSSPYSQPMNNSSSLMNTQAPPYSMAPAMVNSSAASVGLADMMSPGESKLPLPLKADGKEEGTPQPESKSKKSSSSTTTGEKITKVYELGNEPERKLWVDRYLTFMEERGSPVSSLPAVGKKPLDLFRLYVCVKEIGGLAQVNKNKKWRELATNLNVGTSSSAASSLKKQYIQYLFAFECKIERGEEPPPEVFSTGDTKKQPKLQPPSPANSGSLQGPQTPQSTGSNSMAEVPGDLKPPTPASTPHGQMTPMQGGRSSTISVHDPFSDVSDSSFPKRNSMTPNAPYQQGMSMPDVMGRMPYEPNKDPFGGMRKVPGSSEPFMTQGQMPNSSMQDMYNQSPSGAMSNLGMGQRQQFPYGASYDRRHEPYGQQYPGQGPPSGQPPYGGHQPGLYPQQPNYKRHMDGMYGPPAKRHEGDMYNMQYSSQQQEMYNQYGGSYSGPDRRPIQGQYPYPYSRERMQGPGQIQTHGIPPQMMGGPLQSSSSEGPQQNMWAARNDMPYPYQNRQGPGGPTQAPPYPGMNRTDDMMVPDQRINHESQWPSHVSQRQPYMSSSASMQPITRPPQPSYQTPPSLPNHISRAPSPASFQRSLENRMSPSKSPFLPSMKMQKVMPTVPTSQVTGPPPQPPPIRREITFPPGSVEASQPVLKQRRKITSKDIVTPEAWRVMMSLKSGLLAESTWALDTINILLYDDSTVATFNLSQLSGFLELLVEYFRKCLIDIFGILMEYEVGDPSQKALDHNAARKDDSQSLADDSGKEEEDAECIDDDEEDEEDEEEDSEKTESDEKSSIALTAPDAAADPKEKPKQASKFDKLPIKIVKKNNLFVVDRSDKLGRVQEFNSGLLHWQLGGGDTTEHIQTHFESKMEIPPRRRPPPPLSSAGRKKEQEGKGDSEEQQEKSIIATIDDVLSARPGALPEDANPGPQTESSKFPFGIQQAKSHRNIKLLEDEPRSRDETPLCTIAHWQDSLAKRCICVSNIVRSLSFVPGNDAEMSKHPGLVLILGKLILLHHEHPERKRAPQTYEKEEDEDKGVACSKDEWWWDCLEVLRDNTLVTLANISGQLDLSAYTESICLPILDGLLHWMVCPSAEAQDPFPTVGPNSVLSPQRLVLETLCKLSIQDNNVDLILATPPFSRQEKFYATLVRYVGDRKNPVCREMSMALLSNLAQGDALAARAIAVQKGSIGNLISFLEDGVTMAQYQQSQHNLMHMQPPPLEPPSVDMMCRAAKALLAMARVDENRSEFLLHEGRLLDISISAVLNSLVASVICDVLFQIGQL

SEQ ID NO: 3915 - protein, 723 aa, Homo sapiens
MPPQYGQQGVSGYCQQGQQPYYSQQPQPPHLPPQAQYLPSQSQQRYQPQQDMSQEGYGTRSQPPLAPGKPNHEDLNLIQQERPSSLPDLSGSIDDLPTGTEATLSSAVSASGSTSSQGDQSNPAQSPFSPHASPHLSSIPGGPSPSPVGSPVGSNQSRSGPISPASIPGSQMPPQPPGSQSESSSHPALSQSPMPQERGTQRNPQMAQYGPQQTGPSMSPHPSPGGQMHAGISSFQQSNSSGTYGPQMSQYGPQGNYSRPPAYSGVPSASYSGPGPGMGISANNQMHGQGPSQPCGAVPLGRMPSAGMQNRPFPGNMSSMTPSSPGMSQQGGPGMGPPMPTVNRKAQEAAAAVMQAAANSAQSRQGSFPGMNQSGLMASSSPYSQPMNNSSSLMNTQAPPYSMAPAMVNSSAASVGLADMMSPGESKLPLPLKADGKEEGTPQPESKSKDSYSSQGISQPPTPGNLPVPSPMSPSSASISSFHGDESDSISSPGWPKTPSSPKSSSSTTTGEKITKVYELGNEPERKLWVDRYLTFMEERGSPVSSLPAVGKKPLDLFRLYVCVKEIGGLAQVNKNKKWRELATNLNVGTSSSAASSLKKQYIQYLFAFECKIERGEEPPPEVFSTGDTKKQPKLQPPSPVVQMEPRACDTGGSGRKASWSRPAPRARAGGSRHTQASGGRRQRHPGLQKPLDSLPPTQQVASPIPVPSLGKVSGNIFVVKGK

SEQ ID NO: 3916 - protein, 2289 aa, Homo sapiens
MAHNAGAAAAAGTHSAKSGGSEAALKEGGSAAALSSSSSSSAAAAAASSSSSSGPGSAMETGLLPNHKLKTVGEAPAAPPHQQHHHHHHAHHHHHHAHHLHHHHALQQQLNQFQQQQQQQQQQQQQQQQQQHPISNNNSLGGAGGGAPQPGPDMEQPQHGGAKDSAAGGQADPPGPPLLSKPGDEDDAPPKMGEPAGGRYEHPGLGALGTQQPPVAVPGGGGGPAAVPEFNNYYGSAAPASGGPGGRAGPCFDQHGGQQSPGMGMMHSASAAAAGAPGSMDPLQNSHEGYPNSQCNHYPGYSRPGAGGGGGGGGGGGGGSGGGGGGGGAGAGGAGAGAVAAAAAAAAAAAGGGGGGGYGGSSAGYGVLSSPRQQGGGMMMGPGGGGAASLSKAAAGSAAGGFQRFAGQNQHPSGATPTLNQLLTSPSPMMRSYGGSYPEYSSPSAPPPPPSQPQSQAAAAGAAAGGQQAAAGMGLGKDMGAQYAAASPAWAAAQQRSHPAMSPGTPGPTMGRSQGSPMDPMVMKRPQLYGMGSNPHSQPQQSSPYPGGSYGPPGPQRYPIGIQGRTPGAMAGMQYPQQQMPPQYGQQGVSGYCQQGQQPYYSQQPQPPHLPPQAQYLPSQSQQRYQPQQDMSQEGYGTRSQPPLAPGKPNHEDLNLIQQERPSSLPDLSGSIDDLPTGTEATLSSAVSASGSTSSQGDQSNPAQSPFSPHASPHLSSIPGGPSPSPVGSPVGSNQSRSGPISPASIPGSQMPPQPPGSQSESSSHPALSQSPMPQERGFMAGTQRNPQMAQYGPQQTGPSMSPHPSPGGQMHAGISSFQQSNSSGTYGPQMSQYGPQGNYSRPPAYSGVPSASYSGPGPGMGISANNQMHGQGPSQPCGAVPLGRMPSAGMQNRPFPGNMSSMTPSSPGMSQQGGPGMGPPMPTVNRKAQEAAAAVMQAAANSAQSRQGSFPGMNQSGLMASSSPYSQPMNNSSSLMNTQAPPYSMAPAMVNSSAASVGLADMMSPGESKLPLPLKADGKEEGTPQPESKSKDSYSSQGISQPPTPGNLPVPSPMSPSSASISSFHGDESDSISSPGWPKTPSSPKSSSSTTTGEKITKVYELGNEPERKLWVDRYLTFMEERGSPVSSLPAVGKKPLDLFRLYVCVKEIGGLAQVNKNKKWRELATNLNVGTSSSAASSLKKQYIQYLFAFECKIERGEEPPPEVFSTGDTKKQPKLQPPSPANSGSLQGPQTPQSTGSNSMAEVPGDLKPPTPASTPHGQMTPMQGGRSSTISVHDPFSDVSDSSFPKRNSMTPNAPYQQGMSMPDVMGRMPYEPNKDPFGGMRKVPGSSEPFMTQGQMPNSSMQDMYNQSPSGAMSNLGMGQRQQFPYGASYDRRHEPYGQQYPGQGPPSGQPPYGGHQPGLYPQQPNYKRHMDGMYGPPAKRHEGDMYNMQYSSQQQEMYNQYGGSYSGPDRRPIQGQYPYPYSRERMQGPGQIQTHGIPPQMMGGPLQSSSSEGPQQNMWAARNDMPYPYQNRQGPGGPTQAPPYPGMNRTDDMMVPDQRINHESQWPSHVSQRQPYMSSSASMQPITRPPQPSYQTPPSLPNHISRAPSPASFQRSLENRMSPSKSPFLPSMKMQKVMPTVPTSQVTGPPPQPPPIRREITFPPGSVEASQPVLKQRRKITSKDIVTPEAWRVMMSLKSGLLAESTWALDTINILLYDDSTVATFNLSQLSGFLELLVEYFRKCLIDIFGILMEYEVGDPSQKALDHNAARKDDSQSLADDSGKEEEDAECIDDDEEDEEDEEEDSEKTESDEKSSIALTAPDAAADPKEKPKQASKFDKLPIKIVKKNNLFVVDRSDKLGRVQEFNSGLLHWQLGGGDTTEHIQTHFESKMEIPPRRRPPPPLSSAGRKKEQEGKGDSEEQQEKSIIATIDDVLSARPGALPEDANPGPQTESSKFPFGIQQAKSHRNIKLLEDEPRSRDETPLCTIAHWQDSLAKRCICVSNIVRSLSFVPGNDAEMSKHPGLVLILGKLILLHHEHPERKRAPQTYEKEEDEDKGVACSKDEWWWDCLEVLRDNTLVTLANISGQLDLSAYTESICLPILDGLLHWMVCPSAEAQDPFPTVGPNSVLSPQRLVLETLCKLSIQDNNVDLILATPPFSRQEKFYATLVRYVGDRKNPVCREMSMALLSNLAQGDALAARAIAVQKGSIGNLISFLEDGVTMAQYQQSQHNLMHMQPPPLEPPSVDMMCRAAKALLAMARVDENRSEFLLHEGRLLDISISAVLNSLVASVICDVLFQIGQL

SEQ ID NO: 3917 - protein, 273 aa, Homo sapiens
AAVMQAAANSAQSRQGSFPGMNQSGLMASSSPYSQPMNNSSSLMNTQAPPYSMAPAMVNSSAASVGLADMMSPGESKLPLPLKADGKEEGTPQPESKSKKSSSSTTTGEKITKVYELGNEPERKLWVDRYLTFMEERGSPVSSLPAVGKKPLDLFRLYVCVKEIGGLAQVNKNKKWRELATNLNVGTSSSAASSLKKQYIQYLFAFECKIERGEEPPPEVFSTGDTKKQPKLQPPSPGKWRRCSHWPRKAQAPGLGGSGKVVSQSGQQGTWDF

SEQ ID NO: 3918 - protein, 350 aa, Homo sapiens
MSQEGYGTRSQPPLAPGKPNHEDLNLIQQERPSSLPVEVLASEDAAFGLKDLSGSIDDLPTGTEATLSSAVSASGSTSSQGDQSNPAQSPFSPHASPHLSSIPGGPSPSPVGSPVGSNQSRSGPISPASIPGSQMPPQPPGSQSESSSHPALSQSPMPQERGFMAGTQRNPQMAQYGPQQTGPSMSPHPSPGGQMHAGISSFQQSNSSGTYGPQMSQYGPQGNYSRPPAYSGVPSASYSGPGPGMGISANNQMHGQGPSQPCGAVPLGRMPSAGMQNRPFPGNMSSMTPSSPGMSQQGGPGMGPPMPTVNRKAQEAAAAVMQAAANSAQSRYATQEHAPGRYAVCLPVTT

SEQ ID NO: 3919 - protein, 1835 aa, Homo sapiens
MANSTGKAPPDERRKGLAFLDELRQFHHSRGSPFKKIPAVGGKELDLHGLYTRVTTLGGFAKVSEKNQWGEIVEEFNFPRSCSNAAFALKQYYLRYLEKYEKVHHFGEDDDEVPPGNPKPQLPIGAIPSSYNYQQHSVSDYLRQSYGLSMDFNSPNDYNKLVLSLLSGLPNEVDFAINVCTLLSNESKHVMQLEKDPKIITLLLANAGVFDDTLGSFSTVFGEEWKEKTDRDFVKFWKDIVDDNEVRDLISDRNKSHEGTSGEWIWESLFHPPRKLGINDIEGQRVLQIAVILRNLSFEEGNVKLLAANRTCLRFLLLSAHSHFISLRQLGLDTLGNIAAELLLDPVDFKTTHLMFHTVTKCLMSRDRFLKMRGMEILGNLCKAEDNGVLICEYVDQDSYREIICHLTLPDVLLVISTLEVLYMLTEMGDVACTKIAKVEKSIDMLVCLVSMDIQMFGPDALAAVKLIEHPSSSHQMLSEIRPQAIEQVQTQTHVASAPASRAVVAQHVAPPPGIVEIDSEKFACQWLNAHFEVNPDCSVSRAEMYSEYLSTCSKLARGGILTSTGFYKCLRTVFPNHTVKRVEDSSSNGQAHIHVVGVKRRAIPLPIQMYYQQQPVSTSVVRVDSVPDVSPAPSPAGIPHGSQTIGNHFQRTPVANQSSNLTATQMSFPVQGVHTVAQTVSRIPQNPSPHTHQQQNAPVTVIQSKAPIPCEVVKATVIQNSIPQTGVPVSIAVGGGPPQSSVVQNHSTGPQPVTVVNSQTLLHHPSVIPQQSPLHTVVPGQIPSGTPVTVIQQAVPQSHMFGRVQNIPACTSTVSQGQQLITTSPQPVQTSSQQTSAGSQSQDTVIIAPPQYVTTSASNIVSATSVQNFQVATGQMVTIAGVPSPQASRVGFQNIAPKPLPSQQVSSTVVQQPIQQPQQPTQQSVVIVSQPAQQGQTYAPAIHQIVLANPAALPAGQTVQLTGQPNITPSSSPSPVPATNNQVPTAMSSSSTPQSQGPPPTVSQMLSVKRQQQQQHSPAPPPQQVQVQVQQPQQVQMQVQPQQSNAGVGQPASGESSLIKQLLLPKRGPSTPGGKLILPAPQIPPPNNARAPSPQVVYQVASNQAAGFGVQGQTPAQQLLVGQQNVQLVPSAMPPSGGVQTVPISNLQILPGPLISNSPATIFQGTSGNQVTITVVPNTSFAPATVSQGNATQLIAPAGITMSGTQTGVGLPVQTLPATQASPAGQSSCTTATPPFKGDKIICQKEEEAKEATGLHVHERKIEVMENPSCRRGATNTSNGDTKENEMHVGSLLNGRKYSDSSLPPSNSGKIQSETNQCSLISNGPSLELGENGASGKQNSEQIDMQDIKSDLRKPLVNGICDFDKGDGSHLSKNIPNHKTSNHVGNGEISPMEPQGTLDITQQDTAKGDQLERISNGPVLTLGGSSVSSIQEASNAATQQFSGTDLLNGPLASSLNSDVPQQRPSVVVSPHSTTSVIQGHQIIAVPDSGSKVSHSPALSSDVRSTNGTAECKTVKRPAEDTDRETVAGIPNKVGVRIVTISDPNNAGCSATMVAVPAGADPSTVAKVAIESAVQQKQQHPPTYVQNVVPQNTPMPPSPAVQVQGQPNSSQPSPFSGSSQPGDPMRKPGQNFMCLWQSCKKWFQTPSQVFYHAATEHGGKDVYPGQCLWEGCEPFQRQRFSFITHLQDKHCSKDALLAGLKQDEPGQAGSQKSSTKQPTVGGTSSTPRAQKAIVNHPSAALMALRRGSRNLVFRDFTDEKEGPITKHIRLTAALILKNIGKYSECGRRLLKRHENNLSVLAISNMEASSTLAKCLYELNFTVQSKEQEKDSEMLQ

SEQ ID NO: 3920 - protein, 952 aa, Homo sapiens
MMMRYHQAIQSHSFLLVQFHLPTITSNTVCRIICVKVMGCPWTLIRQMIIINWCFHCYLDSQMKWTLLLTYALSYQMKASTSCNLKKILKSSPVPATNNQVPTAMSSSSTPQSQGPPPTVSQMLSVKRQQQQQHSPAPPPQQVQVQVQQPQQVQMQVQPQQSNAGVGQPASGESSLIKQLLLPKRGPSTPGGKLILPAPQIPPPNNARAPSPQVVYQVASNQAAGFGVQGQTPAQQLLVGQQNVQLVPSAMPPSGGVQTVPISNLQILPGPLISNSPATIFQGTSGNQVTITVVPNTSFAPATVSQGNATQLIAPAGITMSGTQTGVGLPVQTLPATQASPAGQSSCTTATPPFKGDKIICQKEEEAKEATGLHVHERKIEVMENPSCRRGATNTSNGDTKENEMHVGSLLNGRKYSDSSLPPSNSGKIQSETNQCSLISNGPSLELGENGASGKQNSEQIDMQDIKSDLRKPLVNGICDFDKGDGSHLSKNIPNHKTSNHVGNGEISPMEPQGTLDITQQDTAKGDQLERISNGPVLTLGGSSVSSIQEASNAATQQFSGTDLLNGPLASSLNSDVPQQRPSVVVSPHSTTSVIQGHQIIAVPDSGSKVSHSPALSSDVRSTNGTAECKTVKRPAEDTDRETVAGIPNKVGVRIVTISDPNNAGCSATMVAVPAGADPSTVAKVAIESAVQQKQQHPPTYVQNVVPQNTPMPPSPAVQVQGQPNSSQPSPFSGSSQPGDPMRKPGQNFMCLWQSCKKWFQTPSQVFYHAATEHGGKDVYPGQCLWEGCEPFQRQRFSFITHLQDKHCSKDALLAGLKQDEPGQAGSQKSSTKQPTVGGTSSTPRAQKAIVNHPSAALMALRRGSRNLVFRDFTDEKEGPITKHIRLTAALILKNIGKYSECGRRLLKRHENNLSVLAISNMEASSTLAKCLYELNFTVQSKEQEKDSEMLQ

SEQ ID NO: 3921 - protein, 1445 aa, Homo sapiens
MRGMEILGNLCKAEDNGVLICEYVDQDSYREIICHLTLPDVLLVISTLEVLYMLTEMGDVACTKIAKVEKSIAAVKLIEHPSSSHQMLSEIRPQAIEQVQTQTHVASAPASRAVVAQHVAPPPGIVEIDSEKFACQWLNAHFEVNPDCSVSRAEMYSEYLSTCSKLARGGILTSTGFYKCLRTVFPNHTVKRVEDSSSNGQAHIHVVGVKRRAIPLPIQMYYQQQPVSTSVVRVDSVPDVSPAPSPAGIPHGSQTIGNHFQRTPVANQSSNLTATQMSFPVQGVHTVAQTVSRIPQNPSPHTHQQQNAPVTVIQSKAPIPCEVVKATVIQNSIPQTGVPVSIAVGGGPPQSSVVQNHSTGPQPVTVVNSQTLLHHPSVIPQQSPLHTVVPGQIPSGTPVTVIQQAVPQSHMFGRVQNIPACTSTVSQGQQLITTSPQPVQTSSQQTSAGSQSQDTVIIAPPQYVTTSASNIVSATSVQNFQVATGQMVTIAGVPSPQASRVGFQNIAPKPLPSQQVSSTVVQQPIQQPQQPTQQSVVIVSQPAQQGQTYAPAIHQIVLANPAALPAGQTVQLTGQPNITPSSSPSPVPATNNQVPTAMSSSSTPQSQGPPPTVSQMLSVKRQQQQQHSPAPPPQQVQVQVQQPQQVQMQVQPQQSNAGVGQPASGESSLIKQLLLPKRGPSTPGGKLILPAPQIPPPNNARAPSPQVVYQVASNQAAGFGVQGQTPAQQLLVGQQNVQLVPSAMPPSGGVQTVPISNLQILPGPLISNSPATIFQGTSGNQVTITVVPNTSFAPATVSQGNATQLIAPAGITMSGTQTGVGLPVQTLPATQASPAGQSSCTTATPPFKGDKIICQKEEEAKEATGLHVHERKIEVMENPSCRRGATNTSNGDTKENEMHVGSLLNGRKYSDSSLPPSNSGKIQSETNQCSLISNGPSLELGENGASGKQNSEQIDMQDIKSDLRKPLVNGICDFDKGDGSHLSKNIPNHKTSNHVGNGEISPMEPQGTLDITQQDTAKGDQLERISNGPVLTLGGSSVSSIQEASNAATQQFSGTDLLNGPLASSLNSDVPQQRPSVVVSPHSTTSVIQGHQIIAVPDSGSKVSHSPALSSDVRSTNGTAECKTVKRPAEDTDRETVAGIPNKVGVRIVTISDPNNAGCSATMVAVPAGADPSTVAKVAIESAVQQKQQHPPTYVQNVVPQNTPMPPSPAVQVQGQPNSSQPSPFSGSSQPGDPMRKPGQNFMCLWQSCKKWFQTPSQVFYHAATEHGGKDVYPGQCLWEGCEPFQRQRFSFITHLQDKHCSKDALLAGLKQDEPGQAGSQKSSTKQPTVGGTSSTPRAQKAIVNHPSAALMALRRGSRNLVFRDFTDEKEGPITKHIRLTAALILKNIGKYSECGRRLLKRHENNLSVLAISNMEASSTLAKCLYELNFTVQSKEQEKDSEMLQ

SEQ ID NO: 3922 - protein, 952 aa, Homo sapiens; identical to SEQ ID NO: 3920

SEQ ID NO: 3923 - protein, 347 aa, Homo sapiens
MKMEEMSLSGLDNSKLEAIAQEIYADLVEDSCLGFCFEVHRAVKCGYFFLDDTDPDSMKDFEIVDQPGLDIFGQVFNQWKSKECVCPNCSRSIAASRFAPHLEKCLGMGRNSSRIANRRIANSNNMNKSESDQEDNDDINDNDWSYGSEKKAKKRKSDKNPNSPRRSKSLKHKNGELSNSDPFKYNNSTGISYETLGPEELRSLLTTQCGVISEHTKKMCTRSLRCPQHTDEQRRTVRIYFLGPSAVLPEVESSLDNDSFDMTDSQALISRLQWDGSSDLSPSDSGSSKTSENQGWGLGTNSSESRKTKKKKSHLSLVGTASGLGSNKKKKPKPPAPPTPSIYDDIN

SEQ ID NO: 3924 - protein, 354 aa, Homo sapiens
MKMEEMSLSGLDNSKLEAIAQEIYADLVEDSCLGFCFEVHRAVKCGYFFLDDTDPDSMKDFEIVDQPGLDIFGQVFNQWKSKECVCPNCSRSIAASRFAPHLEKCLGMGRNSSRIANRRIANSNNMNKSESDQEDNDDINDNDWSYGSEKKAKKRKSDKLWYLPFQNPNSPRRSKSLKHKNGELSNSDPFKYNNSTGISYETLGPEELRSLLTTQCGVISEHTKKMCTRSLRCPQHTDEQRRTVRIYFLGPSAVLPEVESSLDNDSFDMTDSQALISRLQWDGSSDLSPSDSGSSKTSENQGWGLGTNSSESRKTKKKKSHLSLVGTASGLGSNKKKKPKPPAPPTPSIYDDIN

SEQ ID NO: 3925 - protein, 129 aa, Homo sapiens
MCTRSLRCPQHTDEQRRTVRIYFLGPSAVLPEVESSLDNDSFDMTDSQALISRLQWDGSSDLSPSDSGSSKTSENQGWGLGTNSSESRKTKKKKSHLSLVGTASGLGSNKKKKPKPPAPPTPSIYDDIN

SEQ ID NO: 3926 - protein, 899 aa, Homo sapiens
MPTLGWLPENRDISEDQSSAEQTQALASQASQFLAKVESFERLIQAGRLMPQDQVKGFQRLKAAHAALEEEYLKACREQHPAQPLAGSKGTPGRFDPRRELEAEIYRLGSCLEELKEHIDQTQQEPEPPGSDSALDSTPALPCLHQPTHLPAPSGQAPMPAIKTSCPEPATTTAAASTGPCPLHVNVEVSSGNSEVEDRPQDPLARLRHKELQMEQVYHGLMERYLSVKSLPEAMRMEEEEEGEEEEEEEGGGDSLEVDGVAATPGKAEATRVLPRQCPVQAEKSHGAPLEEATEKMVSMKPPGFQASLARDGHMSGLGKAEAAPPGPGVPPHPPGTKSAASHQSSMTSLEGSGISERLPQKPLHRGGGPHLEETWMASPETDSGFVGSETSRVSPLTQTPEHRLSHISTAGTLAQPFAASVPRDGASYPKARGSLIPRRATEPSTPRSQAQRYLSSPSGPLRQRAPNFSLERTLAAEMAVPGSEFEGHKRISEQPLPNKTISPPPAPAPAAAPLPCGPTETIPSFLLTRAGRDQAICELQEEVSRLRLRLEDSLHQPLQGSPTRPASAFDRPARTRGRPADSPATWGSHYGSKSTERLPGEPRGEEQIVPPGRQRARSSSVPREVLRLSLSSESELPSLPLFSEKSKTTKDSPQAARDGKRGVGSAGWPDRVTFRGQYTGHEYHVLSPKAVPKGNGTVSCPHCRPIRTQDAGGAVTGDPLGPPPADTLQCPLCGQVGSPPEADGPGSATSGAEKATTRRKASSTPSPKQRSKQAGSSPRPPPGLWYLATAPPAPAPPAFAYISSVPIMPYPPAAVYYAPAGPTSAQPAAKWPPTASPPPARRHRHSIQLDLGDLEELNKALSRAVQAAESVRSTTRQMRSSLSADLRQAHSLRGSCLF

SEQ ID NO: 3927 - protein, 1439 aa, Homo sapiens
MASSETEIRWAEPGLGKGPQRRRWAWAEDKRDVDRSSSQSWEEERLFPNATSPELLEDFRLAQQHLPPLEWDPHPQPDGHQDSESGETSGEEAEAEDVDSPASSHEPLAWLPQQGRQLDMTEEEPDGTLGSLEVEEAGESSSRLGYEAGLSLEGHGNTSPMALGHGQARGWVASGEQASGDKLSEHSEVNPSVELSPARSWSSGTVSLDHPSDSLDSTWEGETDGPQPTALAETLPEGPSHHLLSPDGRTGGSVARATPMEFQDSSAPPAQSPQHATDRWRRETTRFFCPQPKEHIWKQTKTSPKPLPSRFIGSISPLNPQPRPTRQGRPLPRQGATLAGRSSSNAPKYGRGQLNYPLPDFSKVGPRVRFPKDESYRPPKSRSHNRKPQAPARPLIFKSPAEIVQEVLLSSGEAALAKDTPPAHPITRVPQEFQTPEQATELVHQLQEDYHRLLTKYAEAENTIDQLRLGAKVNLFSDPPQPNHSIHTGMVPQGTKVLSFTIPQPRSAEWWPGPAEDPQASAASGWPSARGDLSPSSLTSMPTLGWLPENRDISEDQSSAEQTQALASQASQFLAKVESFERLIQAGRLMPQDQVKGFQRLKAAHAALEEEYLKACREQHPAQPLAGSKGTPGRFDPRRELEAEIYRLGSCLEELKEHIDQTQQEPEPPGSDSALDSTPALPCLHQPTHLPAPSGQAPMPAIKTSCPEPATTTAAASTGPCPLHVNVEVSSGNSEVEDRPQDPLARLRHKELQMEQVYHGLMERYLSVKSLPEAMRMEEEEEGEEEEEEEGGGDSLEVDGVAATPGKAEATRVLPRQCPVQAEKSHGAPLEEATEKMVSMKPPGFQASLARDGHMSGLGKAEAAPPGPGVPPHPPGTKSAASHQSSMTSLEGSGISERLPQKPLHRGGGPHLEETWMASPETDSGFVGSETSRVSPLTQTPEHRLSHISTAGTLAQPFAASVPRDGASYPKARGSLIPRRATEPSTPRSQAQRYLSSPSGPLRQRAPNFSLERTLAAEMAVPGSEFEGHKRISEQPLPNKTISPPPAPAPAAAPLPCGPTETIPSFLLTRAGRDQAICELQEEVSRLRLRLEDSLHQPLQGSPTRPASAFDRPARTRGRPADSPATWGSHYGSKSTERLPGEPRGEEQIVPPGRQRARSSSVPREVLRLSLSSESELPSLPLFSEKSKTTKDSPQAARDGKRGVGSAGWPDRVTFRGQYTGHEYHVLSPKAVPKGNGTVSCPHCRPIRTQDAGGAVTGDPLGPPPADTLQCPLCGQVGSPPEADGPGSATSGAEKATTRRKASSTPSPKQRSKQAGSSPRPPPGLWYLATAPPAPAPPAFAYISSVPIMPYPPAAVYYAPAGPTSAQPAAKWPPTASPPPARRHRHSIQLDLGDLEELNKALSRAVQAAESVRSTTRQMRSSLSADLRQAHSLRGSCLF

SEQ ID NO: 3928 - protein, 831 aa, Homo sapiens
MASSETEIRWAEPGLGKGPQRRRWAWAEDKRDVDRSSSQSWEEERLFPNATSPELLEDFRLAQQHLPPLEWDPHPQPDGHQDSESGETSGEEAEAEDVDSPASSHEPLAWLPQQGRQLDMTEEEPDGTLGSLEVEEAGESSSRLGYEAGLSLEGHGNTSPMALGHGQARGWVASGEQASGDKLSEHSEVNPSVELSPARSWSSGTVSLDHPSDSLDSTWEGETDGPQPTALAETLPEGPSHHLLSPDGRTGGSVARATPMEFQDSSAPPAQSPQHATDRWRRETTRFFCPQPKEHIWKQTKTSPKPLPSRFIGSISPLNPQPRPTRQGRPLPRQGATLAGRSSSNAPKYGRGQLNYPLPDFSKVGPRVRFPKDESYRPPKSRSHNRKPQAPARPLIFKSPAEIVQEVLLSSGEAALAKDTPPAHPITRVPQEFQTPEQATELVHQLQEDYHRLLTKYAEAENTIDQLRLGAKVNLFSDPPQPNHSIHTGMVPQGTKVLSFTIPQPRSAEWWPGPAEDPQASAASGWPSARGDLSPSSLTSMPTLGWLPENRDISEDQSSAEQTQALASQASQFLAKVESFERLIQAGRLMPQDQVKGFQRLKAAHAALEEEYLKACREQHPAQPLAGSKGTPGRFDPRRELEAEIYRLGSCLEELKEHIDQTQQEPEPPGSDSALDSTPALPCLHQPTHLPAPSGQAPMPAIKTSCPEPATTTAAASTGPCPLHVNVEVSSGNSEVEDRPQDPLARLRHKELQMEQVYHGLMERYLSVKSLPEAMRMEEEEEGEEEEEEEGGGDSLEVDGVAATPGKAEATRVLPRQCPVQAEKSHGAPLE

SEQ ID NO: 3929 - protein, 405 aa, Homo sapiens
LNLCLSIFLTPACYHHCRRQHWPLPIARKCGAVPGSEFEGHKRISEQPLPNKTISPPPAPAPAAAPLPCGPTETIPSFLLTRAGRDQAICELQEEVSRLRLRLEDSLHQPLQGSPTRPASAFDRPARTRGRPADSPATWGSHYGSKSTERLPGEPRGEEQIVPPGRQRARSSSVPREVLRLSLSSESELPSLPLFSEKSKTTKDSPQAARDGKRGVGSAGWPDRVTFRGQYTGHEYHVLLRRSQKAMAQSPVPTAGPLGPRMRVVLSQGTHWDRLPLIPFSVPCVVKLGLPQRQMVQAQPPLGQRRPPRGEKHLQLPAPSRGASRRGRRHAHPPDCGIWQQRPQHQPLQPLPTSPRFPSCLIHLPLCTMRLQDLPQPNQLPSGRPQPLPHQPGDTGTPSSSTWAT

SEQ ID NO: 3930 - protein, 1358 aa, Homo sapiens
MLRSEWPVFPEAEAEDVDSPASSHEPLAWLPQQGRQLDMTEEEPDGTLGSLEVEEAGESSSRLGYEAGLSLEGHGNTSPMALGHGQARGWVASGEQASGDKLSEHSEVNPSVELSPARSWSSGTVSLDHPSDSLDSTWEGETDGPQPTALAETLPEGPSHHLLSPDGRTGGSVARATPMEFQDSSAPPAQSPQHATDRWRRETTRFFCPQPKEHIWKQTKTSPKPLPSRFIGSISPLNPQPRPTRQGRPLPRQGATLAGRSSSNAPKYGRGQLNYPLPDFSKVGPRVRFPKDESYRPPKSRSHNRKPQAPARPLIFKSPAEIVQEVLLSSGEAALAKDTPPAHPITRVPQEFQTPEQATELVHQLQEDYHRLLTKYAEAENTIDQLRLGAKVNLFSDPPQPNHSIHTGMVPQGTKVLSFTIPQPRSAEWWPGPAEDPQASAASGWPSARGDLSPSSLTSMPTLGWLPENRDISEDQSSAEQTQALASQASQFLAKVESFERLIQAGRLMPQDQVKGFQRLKAAHAALEEEYLKACREQHPAQPLAGSKGTPGRFDPRRELEAEIYRLGSCLEELKEHIDQTQQEPEPPGSDSALDSTPALPCLHQPTHLPAPSGQAPMPAIKTSCPEPATTTAAASTGPCPLHVNVEVSSGNSEVEDRPQDPLARLRHKELQMEQVYHGLMERYLSVKSLPEAMRMEEEEEGEEEEEEEGGGDSLEVDGVAATPGKAEATRVLPRQCPVQAEKSHGAPLEEATEKMVSMKPPGFQASLARDGHMSGLGKAEAAPPGPGVPPHPPGTKSAASHQSSMTSLEGSGISERLPQKPLHRGGGPHLEETWMASPETDSGFVGSETSRVSPLTQTPEHRLSHISTAGTLAQPFAASVPRDGASYPKARGSLIPRRATEPSTPRSQAQRYLSSPSGPLRQRAPNFSLERTLAAEMAVPGSEFEGHKRISEQPLPNKTISPPPAPAPAAAPLPCGPTETIPSFLLTRAGRDQAICELQEEVSRLRLRLEDSLHQPLQGSPTRPASAFDRPARTRGRPADSPATWGSHYGSKSTERLPGEPRGEEQIVPPGRQRARSSSVPREVLRLSLSSESELPSLPLFSEKSKTTKDSPQAARDGKRGVGSAGWPDRVTFRGQYTGHEYHVLSPKAVPKGNGTVSCPHCRPIRTQDAGGAVTGDPLGPPPADTLQCPLCGQVGSPPEADGPGSATSGAEKATTRRKASSTPSPKQRSKQAGSSPRPPPGLWYLATAPPAPAPPAFAYISSVPIMPYPPAAVYYAPAGPTSAQPAAKWPPTASPPPARRHRHSIQLDLGDLEELNKALSRAVQAAESVRSTTRQMRSSLSADLRQAHSLRGSCLF

SEQ ID NO: 3931 - protein, 384 aa, Homo sapiens
MSAGGGTRGYSPRSPGATSQAICELQEEVSRLRLRLEDSLHQPLQGSPTRPASAFDRPARTRGRPADSPATWGSHYGSKSTERLPGEPRGEEQIVPPGRQRARSSSVPREVLRLSLSSESELPSLPLFSEKSKTTKDSPQAARDGKRGVGSAGWPDRVTFRGQYTGHEYHVLSPKAVPKGNGTVSCPHCRPIRTQDAGGAVTGDPLGPPPADTLQCPLCGQVGSPPEADGPGSATSGAEKATTRRKASSTPSPKQRSKQAGSSPRPPPGLWYLATAPPAPAPPAFAYISSVPIMPYPPAAVYYAPAGPTSAQPAAKWPPTASPPPARRHRHSIQLDLGDLEELNKALSRAVQAAESVRSTTRQMRSSLSADLRQAHSLRGSCLF

SEQ ID NO: 3932 - protein, 1439 aa, Homo sapiens; identical to SEQ ID NO: 3927

SEQ ID NO: 3933 - protein, 572 aa, Homo sapiens
MASSETEIRWAEPGLGKGPQRRRWAWAEDKRDVDRSSSQSWEEERLFPNATSPELLEDFRLAQQHLPPLEWDPHPQPDGHQDSESGETSGEEAEAEDVDSPASSHEPLAWLPQQGRQLDMTEEEPDGTLGSLEVEEAGESSSRLGYEAGLSLEGHGNTSPMALGHGQARGWVASGEQASGDKLSEHSEVNPSVELSPARSWSSGTVSLDHPSDSLDSTWEGETDGPQPTALAETLPEGPSHHLLSPDGRTGGSVARATPMEFQDSSAPPAQSPQHATDRWRRETTRFFCPQPKEHIWKQTKTSPKPLPSRFIGSISPLNPQPRPTRQGRPLPRQGATLAGRSSSNAPKYGRGQLNYPLPDFSKVGPRVRFPKDESYRPPKSRSHNRKPQAPARPLIFKSPAEIVQEVLLSSGEAALAKDTPPAHPITRVPQEFQTPEQATELVHQLQVSGTHGCGCVTKAPVGLGWRLIGVGRPGVEAGWGGEAWDRAWLGWEALGRRLVGWGGLGWRLARVGSPGMEASGVGRPGVGSPGVEPGGVGRPGVEAGWGRKPWDRGWWGGEAWGGGWLGQEALG

SEQ ID NO: 3934 - protein, 671 aa, Homo sapiens
PGFGTKNSQAGPLKLGRQDGGGARERAAQGDVDRSSSQSWEEERLFPNATSPELLEDFRGPAAPAAPGVGPTPAARWASGFRVRRDFGRRTGGSVARATPMEFQDSSAPPAQSPQHATDRWRRETTRFFCPQPKEHIWKQTKTSPKPLPSRFIGSISPLNPQPRPTRQGRPLPRQGATLAGRSSSNAPKYGRGQLNYPLPDFSKVGPRVRFPKDESYRPPKSRSHNRKPQAPARPLIFKSPAEIVQEVLLSSGEAALAKDTPPAHPITRVPQEFQTPEQATELVHQLQEDYHRLLTKYAEAENTIDQLRLGAKVNLFSDPPQPNHSIHTGMVPQGTKVLSFTIPQPRSAEWWPGPAEDPQASAASGWPSARGDLSPSSLTSMPTLGWLPENRDISEDQSSAEQTQALASQASQFLAKVESFERLIQAGRLMPQDQVKGFQRLKAAHAALEEEYLKACREQHPAQPLAGSKGTPGRFDPRRELEAEIYRLGSCLEELKEHIDQTQQEPEPPGSDSALDSTPALPCLHQPTHLPAPSGQAPMPAIKTSCPEPATTTAAASTGPCPLHVNVEVSSGNSEVEDRPQDPLARLRHKELQMEQVYHGLMERYLSVKSLPEAMRMEEEEEGEEEEEEEGGGDSLEVDGVAATPGKAEATRVLPRQCPVQAEKSHGAPL

SEQ ID NO: 3935 - protein, 823 aa, Homo sapiens
MAASEAAAAAGSAALAAGARAVPAATTGAAAAASGPWVPPGPRLRGSRPRPAGATQQPAVPAPPAGELIQPSVSELSRAVRTNILCTVRGCGKILPNSPALNMHLVKSHRLQDGIVNPTIRKDLKTGPKFYCCPIEGCPRGPERPFSQFSLVKQHFMKMHAEKKHKCSKCSNSYGTEWDLKRHAEDCGKTFRCTCGCPYASRTALQSHIYRTGHEIPAEHRDPPSKKRKMENCAQNQKLSNKTIESLNNQPIPRPDTQELEASEIKLEPSFEDSCGSNTDKQTLTTPPRYPQKLLLPKPKVALVKLPVMQFSVMPVFVPTADSSAQPVVLGVDQGSATGAVHLMPLSVGTLILGLDSEACSLKESLPLFKIANPIAGEPISTGVQVNFGKSPSNPLQELGNTCQKNSISSINVQTDLSYASQNFIPSAQWATADSSVSSCSQTDLSFDSQVSLPISVHTQTFLPSSKVTSSIAAQTDAFMDTCFQSGGVSRETQTSGIESPTDDHVQMDQAGMCGDIFESVHSSYNVATGNIISNSLVAETVTHSLLPQNEPKTLNQDIEKSAPIINFSAQNSMLPSQNMTDNQTQTIDLLSDLENILSSNLPAQTLDHRSLLSDTNPGPDTQLPSGPAQNPGIDFDIEEFFSASNIQTQTEESELSTMTTEPVLESLDIETQTDFLLADTSAQSYGCRGNSNFLGLEMFDTQTQTDLNFFLDSSPHLPLGSILKHSSFSVSTDSSDTETQTEGVSTAKNIPALESKVQLNSTETQTMSSGFETLGSLFFTSNETQTAMDDFLLADLAWNTMESQFSSVETQTSAEPHTVSNF

SEQ ID NO: 3936 - protein, 594 aa, Homo sapiens
MENCAQNQKLSNKTIESLNNQPIPRPDTQELEASEIKLEPSFEDSCGSNTDKQTLTTPPRYPQKLLLPKPKVALVKLPVMQFSVMPVFVPTADSSAQPVVLGVDQGSATGAVHLMPLSVGTLILGLDSEACSLKESLPLFKIANPIAGEPISTGVQVNFGKSPSNPLQELGNTCQKNSISSINVQTDLSYASQNFIPSAQWATADSSVSSCSQTDLSFDSQVSLPISVHTQTFLPSSKVTSSIAAQTDAFMDTCFQSGGVSRETQTSGIESPTDDHVQMDQAGMCGDIFESVHSSYNVATGNIISNSLVAETVTHSLLPQNEPKTLNQDIEKSAPIINFSAQNSMLPSQNMTDNQTQTIDLLSDLENILSSNLPAQTLDHRSLLSDTNPGPDTQLPSGPAQNPGIDFDIEEFFSASNIQTQTEESELSTMTTEPVLESLDIETQTDFLLADTSAQSYGCRGNSNFLGLEMFDTQTQTDLNFFLDSSPHLPLGSILKHSSFSVSTDSSDTETQTEGVSTAKNIPALESKVQLNSTETQTMSSGFETLGSLFFTSNETQTAMDDFLLADLAWNTMESQFSSVETQTSAEPHTVSNF

SEQ ID NO: 3937 - protein, 321 aa, Homo sapiens
MKHIPVLEDGPWKTVCVKELNGLKKLKRKGKEPARRANGYKTFRLDLEAPEPRAVATNGLRDRTHRLQPVPVPVPVPVPVAPAVPPRGGTDTAGERGGSRAPEVSDARKRCFALGAVGPGLPTPPPPPPPAPQSQAPGGPEAQPFREPGLRPRILLCAPPARPAPSAPPAPPAPPESTVRPAPPTRPGESSYSSISHVIYNNHQDSSASPRKRPGEATAASSEIKALQQTRRLLANARERTRVHTISAAFEALRKQVPCYSYGQKLSKLAILRIACNYILSLARLADLDYSADHSNLSFSECVQRCTRTLQAEGRAKKRKE

SEQ ID NO: 3938 - protein, 387 aa, Homo sapiens
MTMEGASGSSFGIDTILSSASSGSPGMMNGDFRPLGEARTADFRSQATPSPCSEIDTVGTAPSSPISVTMEPPEPHLVADATQHHHHLHHSQQPPPPAAAPTQSLQPLPQQQQPLPPQQPPPPPPQQLGSAASAPRTSTSSFLIKDILGDSKPLAACAPYSTSVSSPHHTPKQESNAVHESFRPKLEQEDSKTKLDKREDSQSDIKCHGTKEEGDREITSSRESPPVRAKKPRKARTAFSDHQLNQLERSFERQKYLSVQDRMDLAAALNLTDTQVKTWYQNRRTKWKRQTAVGLELLAEAGNYSALQRMFPSPYFYHPSLLGSMDSTTAAAAAAAMYSSMYRTPPAPHPQLQRPLVPRVLIHGLGPGGQPALNPLSSPIPGTPHPR

SEQ ID NO: 3939 - protein, 106 aa, Homo sapiens
MMTLVPRARTRAGQDHYSHPCPRFSQVLLTEGIMTYCLTKNLSDVNILHRLLKNGNVRNTLLQSKVGLLTYYVKLYPGEVTLLTRPSIQMRLCCITGSVSRPRSQK

SEQ ID NO: 3940 - protein, 106 aa, Homo sapiens; identical to SEQ ID NO: 3939

SEQ ID NO: 3941 - protein, 189 aa, Homo sapiens
MKTKNRPPRRRAPVQDTEATPGEGTPDGSLPNPGPEPAKGLRSRPARAAARAPGEGRRRRPGPSGPGGRRDSSIQRRLESNERERQRMHKLNNAFQALREVIPHVRADKKLSKIETLTLAKNYIKSLTATILTMSSSRLPGLEGPGPKLYQHYQQQQQVAGGALGATEAQPQGHLQRYSTQIHSFREGT

SEQ ID NO: 3942 - protein, 235 aa, Homo sapiens
MLRGAPGLGLTARKGAEDSAEDLGGPCPEPGGDSGVLGANGASCSRGEAEEPAGRRRARPVRSKARRMAANVRERKRILDYNEAFNALRRALRHDLGGKRLSKIATLRRAIHRIAALSLVLRASPAPRGPCGHLECHGPAARGDTGDTGASPPPPAGPSLARPDAARPSVPSAPRCASCPPHAPLARPSAVAEGPGLAQASGGSWRRCPGASSAGPPPWPRGYLRSAPGMGHPRS

SEQ ID NO: 3943 - protein, 274 aa, Homo sapiens
MHLCGGNGLLTQTDPKEQQRQLKKQKNRAAAQRSRQKHTDKADALHQQHESLEKDNLALRKEIQSLQAELAWWSRTLHVHERLCPMDCASCSAPGLLGCWDQAEGLLGPGPQGQHGCREQLELFQTPGSCYPAQPLSPGPQPHDSPSLLQCPLPSLSLGPAVVAEPPVQLSPSPLLFASHTGSSLQGSSSKLSALQPSLTAQTAPPQPLELEHPTRGKLGSSPDNPSSALGLARLQSREHKPALSAATWQGLVVDPSPHPLLAFPLLSSAQVHF

SEQ ID NO: 3944 - protein, 676 aa, Homo sapiens
MKKFSRMPKSEGGSGGGAAGGGAGGAGAGAGCGSGGSSVGVRVFAVGRHQVTLEESLAEGGFSTVFLVRTHGGIRCALKRMYVNNMPDLNVCKREITIMKELSGHKNIVGYLDCAVNSISDNVWEVLILMEYCRAGQVVNQMNKKLQTGFTEPEVLQIFCDTCEAVARLHQCKTPIIHRDLKVENILLNDGGNYVLCDFGSATNKFLNPQKDGVNVVEEEIKKYTTLSYRAPEMINLYGGKPITTKADIWALGCLLYKLCFFTLPFGESQVAICDGNFTIPDNSRYSRNIHCLIRFMLEPDPEHRPDIFQVSYFAFKFAKKDCPVSNINKCCKQLLRHGALLTEILLFLQLFLNMTASEAAARKSQIKARITDTIGPTETSIAPRQRPKANSATTATPSVLTIQSSATPVKVLAPGEFGNHRPKGALRPGNGPEILLGQGPPQQPPQQHRVLQQLQQGDWRLQQLHLQHRHPHQQQQQQQQQQQQQQQQQQQQQQQQQQQHHHHHHHHLLQDAYMQQYQHATQQQQMLQQQFLMHSVYQPQPSASQYPTMMPQYQQAFFQQQMLAQHQPSQQQASPEYLTSPQEFSPALVSYTSSLPAQVGTIMDSSYSANRSVADKEAIANFTNQKNISNPPDMSGWNPFGEDNFSKLTEEELLDREFDLLRSSKGHLKAYFASQ

SEQ ID NO: 3945 - protein, 1161 aa, Homo sapiens
MKKFSRMPKSEGGSGGGAAGGGAGGAGAGAGCGSGGSSVGVRVFAVGRHQVTLEESLAEGGFSTVFLVRTHGGIRCALKRMYVNNMPDLNVCKREITIMKELSGHKNIVGYLDCAVNSISDNVWEVLILMEYCRAGQVVNQMNKKLQTGFTEPEVLQIFCDTCEAVARLHQCKTPIIHRDLKVENILLNDGGNYVLCDFGSATNKFLNPQKDGVNVVEEEIKKYTTLSYRAPEMINLYGGKPITTKADIWALGCLLYKLCFFTLPFGESQVAICDGNFTIPDNSRYSRNIHCLIRFMLEPDPEHRPDIFQVSYFAFKFAKKDCPVSNINNSSIPSALPEPMTASEAAARKSQIKARITDTIGPTETSIAPRQRPKANSATTATPSVLTIQSSATPVKVLAPGEFGNHRPKGALRPGNGPEILLGQGPPQQPPQQHRVLQQLQQGDWRLQQLHLQHRHPHQQQQQQQQQQQQQQQQQQQQQQQQQQQHHHHHHHHLLQDAYMQQYQHATQQQQMLQQQFLMHSVYQPQPSASQYPTMMPQYQQAFFQQQMLAQHQPSQQQASPEYLTSPQEFSPALVSYTSSLPAQVGTIMDSSYSANRSVADKEAIANFTNQKNISNPPDMSGWNPFGEDNFSKLTEEELLDREFDLLRSNRLEERASSDKNVDSLSAPHNHPPEDPFGSVPFISHSGSPEKKAEHSSINQENGTANPIKNGKTSPASKDQRTGKKTSVQGQVQKGNDESESDFESDPPSPKSSEEEEQDDEEVLQGEQGDFNDDDTEPENLGHRPLLMDSEDEEEEEKHSSDSDYEQAKAKYSDMSSVYRDRSGSGPTQDLNTILLTSAQLSSDVAVETPKQEFDVFGAVPFFAVRAQQPQQEKNEKNLPQHRFPAAGLEQEEFDVFTKAPFSKKVNVQECHAVGPEAHTIPGYPKSVDVFGSTPFQPFLTSTSKSESNEDLFGLVPFDEITGSQQQKVKQRSLQKLSSRQRRTKQDMSKSNGKRHHGTPTSTKKTLKPTYRTPERARRHKKVGRRDSQSSNEFLTISDSKENISVALTDGKDRGNVLQPEESLLDPFGAKPFHSPDLSWHPPHQGLSDIRADHNTVLPGRPRQNSLHGSFHSADVLKMDDFGAVPFTELVVQSITPHQSQQSQPVELDPFGAAPFPSKQ

SEQ ID NO: 3946 - protein, 662 aa, Homo sapiens
MKKFSRMPKSEGGSGGGAAGGGAGGAGAGAGCGSGGSSVGVRVFAVGRHQVTLEESLAEGGFSTVFLVRTHGGIRCALKRMYVNNMPDLNVCKREITIMKELSGHKNIVGYLDCAVNSISDNVWEVLILMEYCRAGQVVNQMNKKLQTGFTEPEVLQIFCDTCEAVARLHQCKTPIIHRDLKVENILLNDGGNYVLCDFGSATNKFLNPQKDGVNVVEEEIKKYTTLSYRAPEMINLYGGKPITTKADIWALGCLLYKLCFFTLPFGESQVAICDGNFTIPDNSRYSRNIHCLIRFMLEPDPEHRPDIFQVSYFAFKFAKKDCPVSNINNSSIPSALPEPMTASEAAARKSQIKARITDTIGPTETSIAPRQRPKANSATTATPSVLTIQSSATPVKVLAPGEFGNHRPKGALRPGNGPEILLGQGPPQQPPQQHRVLQQLQQGDWRLQQLHLQHRHPHQQQQQQQQQQQQQQQQQQQQQQQQQQQHHHHHHHHLLQDAYMQQYQHATQQQQMLQQQFLMHSVYQPQPSASQYPTMMPQYQQAFFQQQMLAQHQPSQQQASPEYLTSPQEFSPALVSYTSSLPAQVGTIMDSSYSANRSVADKEAIANFTNQKNISNPPDMSGWNPFGEDNFSKLTEEELLDREFDLLRSSKGHLKAYFASQ

SEQ ID NO: 3947 - protein, 1282 aa, Homo sapiens
MEAKDQKKHRKKNSGPKAAKKKKRLLQDLQLGDEEDARKRNPKAFAVQSAVRMARSFHRTQDLKTKKHHIPVVDRTPLEPPPIVVVVMGPPKVGKSTLIQCLIRNFTRQKLTEIRGPVTIVSGKKRRLTIIECGCDINMMIDLAKVADLVLMLIDASFGFEMETFEFLNICQVHGFPKIMGVLTHLDSFKHNKQLKKTKKRLKHRFWTEVYPGAKLFYLSGMVHGEYQNQEIHNLGRFITVMKFRPLTWQTSHPYILADRMEDLTNPEDIRTNIKCDRKVSLYGYLRGAHLKNKSQIHMPGVGDFAVSDISFLPDPCALPEQQKKRCLNEKEKLVYAPLSGVGGVLYDKDAVYVDLGGSHVFQDEVGPTHELVQSLISTHSTIDAKMASSRVTLFSDSKPLGSEDIDNQGLMMPKEEKQMDLNTGRMRRKAIFGDEDESGDSDDEEDDEMSEDDGLENGSSDEEAEEEENAEMTDQYMAVKGIKRRKLELEEDSEMDLPAFADSDDDLERSSAEEGEAEEADESSEEEDCTAGEKGISGSKAAGEGSKAGLSPANCQSDRVNLEKSLLMKKAALPTFDSGHCTAEEVFASEDESEESSSLSAEEEDSENEEAIRKKLSKPSQVSSGQKLGPQNFIDETSDIENLLKEEEDYKEENNDSKETSGALKWKEDLSRKAAEAFLRQQQAAPNLRKLIYGTVTEDNEEEDDDTLEELGGLFRVNQPDRECKHKADSLDCSRFLVEAPHDWDLEEVMNSIRDCFVTGKWEDDKDAAKVLAEDEELYGDFEDLETGDVHKGKSGPNTQNEDIEKEVKEEIDPDEEESAKKKHLDKKRKLKEMFDAEYDEGESTYFDDLKGEMQKQAQLNRAEFEDQDDEARVQYEGFRPGMYVRIEIENVPCEFVQNFDPHYPIILGGLGNSEGNVGYVQMRLKKHRWYKKILKSRDPIIFSVGWRRFQTIPLYYIEDHNGRQRLLKYTPQHMHCGAAFWGPITPQGTGFLAIQSVSGIMPDFRIAATGVVLDLDKSIKIVKKLKLTGFPYKIFKNTSFIKGMFNSALEVAKFEGAVIRTVSGIRGQIKKALRAPEGAFRASFEDKLLMSDIVFMRTWYPVSIPAFYNPVTSLLKPVGEKDTWSGMRTTGQLRLAHGVRLKANKDSLYKPILRQKKHFNSLHIPKALQKALPFKNKPKTQAKAGKVPKDRRRPAVIREPHERKILALLDALSTVHSQKMKKAKEQRHLHNKEHFRAKQKEEEEKLKRQKDLRKKLFRIQGQKERRNQKSSLKGAEGQLQ

SEQ ID NO: 3948 - protein, 302 aa, Homo sapiens
MVSYHKQACEIPPTVNPRKKLWAFPSDSSRDLPSPKKAKTEEMPQLNFGMADPTQMGGLSMLLLAGEHALGTPEVSSGTCRPDVSESPELRQKSPLFQFAEISSSTSHSDASTKQCQTSALFQFAEISSNTSQLGGAEPVKRCGKSALFQLAEMCLASEGMKMEESKLIKAKESDGGRIKELEKGKEEKEIKMEKTDETRLQKEAEFEKSAKENLRDSKELRNFEALQIDDIMAIKMEDPKEIRKEELEEDHKCSHFPDFSYSASSKIIISDVPSRKDHMCHPHGIMIIEDPAALNKPEKLK

SEQ ID NO: 3949 - protein, 941 aa, Homo sapiens
MKGSNRNKDHSAEGEGVGKRPKRKCLQWHPLLAKKLLDFSEEEEEEDEEEDIDKVQLLGADGLEQDVGETEDDESPEQRARRPMNAFLLFCKRHRSLVRQEHPRLDNRGATKILADWWAVLDPKEKQKYTDMAKEYKDAFMKANPGYKWCPTTNKPVKSPTPTVNPRKKLWAFPSDSSRDLPSPKKAKTEEMPQLNFGMADPTQMGGLSMLLLAGEHALGTPEVSSGTCRPDVSESPELRQKSPLFQFAEISSSTSHSDASTKQCQTSALFQFAEISSNTSQLGGAEPVKRCGKSALFQLAEMCLASEGMKMEESKLIKAKESDGGRIKELEKGKEEKEIKMEKTDETRLQKEAEFEKSAKENLRDSKELRNFEALQIDDIMAIKMEDPKEIRKEELEEDHKCSHFPDFSYSASSKIIISDVPSRKDHMCHPHGIMIIEDPAALNKPEKLKKKKKKSKMDRHGNDKSTPKKTCKKRQSSESDIESVIYTIEAVAKGDWGIEKLGDTPRKKVRTSSSGKGSILDAKPPKKKVKSREKKMSKEKSSDTTKESRPPDFISISASKNISGETPEGIKAEPLTPMEDALPPSLSGQAKPEDSDCHRKIETCGSRKSERSCKGALYKTLVSEGMLTSLRANVDRGKRSSGKGNSSDHEGCWNEESWTFSQSGTSGSKKFKKTKPKEDCLLGSAKLDEEFEKKFNSLPQYSPVTFDRKCVPVPRKKKKTGNVSSEPTKTSKGPFQSQKKNLFHKIVSKYKHKKEKPNVPEKGSGDKWSNKQLFLDAIHPTEAIFSEDRNTMEPVHKVKNIPSIFNTPEPTTTQEPLVGSQKRKARKTKITHLVRTADGRVSPAGGTLDDKPKEQLQRSLPKATETDCNDKCSHNTEVGETRSSTPEMPAVSAFFSLAALAEVAAMENVHRGQRSTPLTHDGQPKEMPQAPVLISCADQ

SEQ ID NO: 3950 - protein, 448 aa, Homo sapiens
MKGSNRNKDHSAEGEGVGKRPKRKCLQWHPLLAKKLLDFSEEEEEEDEEEDIDKVQLLGADGLEQDVGETEDDESPEQRARRPMNAFLLFCKRHRSLVRQEHPRLDNRGATKILADWWAVLDPKEKQKYTDMAKEYKDAFMKANPGYKWCPTTNKPVKSPTPTVNPRKKLWAFPSDSSRDLPSPKKAKTEEMPQLNFGMADPTQMGGLSMLLLAGEHALGTPEVSSGTCRPDVSESPELRQKSPLFQFAEISSSTSHSDASTKQCQTSALFQFAEISSNTSQLGGAEPVKRCGKSALFQLAEMCLASEGMKMEESKLIKAKESDGGRIKELEKGKEEKEIKMEKTDETRLQKEAEFEKSAKENLRDSKELRNFEALQIDDIMAIKMEDPKEIRKEELEEDHKCSHFPDFSYSASSKIIISDVPSRKDHMCHPHGIMIIEDPAALNKPE

SEQ ID NO: 3951 - protein, 911 aa, Homo sapiens
MKGSNRNKDHSAEGEGVGKRPKRKCLQWHPLLAKKLLDFSEEEEEEDEEEDIDKVQLLGADGLEQDVGETEDDESPEQRARRPMNAFLLFCKRHRSLVRQEHPRLDNRGATKILADWWAVLDPKEKQKYTDMAKEYKDAFMKANPGYKWCPTTNKPVKSPTPTVNPRKKLWAFPSDSSRDLPSPKKAKTEEMPQLNFGMADPTQMGGLSMLLLAGEHALGTPEVSSGTCRPDVSESPELRQKSPLFQFAEISSSTSHSDASTKQCQTSALFQFAEISSNTSQLGGAEPVKRCGKSALFQLAEMCLASEGMKMEESKLIKAKESDGGRIKELEKGKEEKEIKMEKTDETRLQKEAEFEKSAKENLRDSKELRNFEALQIDDIMAIKMEDPKEIRKEELEEDHKCSHFPDFSYSASSKIIISDVPSRKDHMCHPHGIMIIEDPAALNKPEKLKKKKKKSKMDRHGNDKSTPKKTCKKRQSSESDIESVIYTIEAVAKGDWGIEKLGDTPRKKVRTSSSGKGSILDAKPPKKKVKSREKKMSKEKSSDTTKESRPPDFISISASKNISGETPEGIKAEPLTPMEDALPPSLSGQAKPEDSDCHRKIETCGSRKSERSCKGALYKTLVSEGMLTSLRANVDRGKRSSGKGNSSDHEGCWNEESWTFSQSGTSGSKKFKKTKPKEDCLLGSAKLDEEFEKKFNSLPQYSPVTFDRKCVPVPRKKKKTGNVSSEPTKTSKGSGDKWSNKQLFLDAIHPTEAIFSEDRNTMEPVHKVKNIPSIFNTPEPTTTQEPLVGSQKRKARKTKITHLVRTADGRVSPAGGTLDDKPKEQLQRSLPKATETDCNDKCSHNTEVGETRSSTPEMPAVSAFFSLAALAEVAAMENVHRGQRSTPLTHDGQPKEMPQAPVLISCADQ

SEQ ID NO: 3952 - protein, 149 aa, Homo sapiens
MKGSNRNKDHSAEGEGVGKRPKRKCLQWHPLLAKKLLDFSEEEEEEDEEEDIDKVQLLGADGLEQDVGETEDDESPEQRARRPMNAFLLFCKRHRSLVRQEHPRLDNRGATKILADWWAVLDPKEKQKYTDMAKEYKDAFMKANPGYKW

SEQ ID NO: 3953 - protein, 911 aa, Homo sapiens; identical to SEQ ID NO: 3951

SEQ ID NO: 3954 - protein, 24 aa, Homo sapiens
MKGSNRNKDHSAEGEGVGKRPKRK

SEQ ID NO: 3955 - protein, 193 aa, Homo sapiens
MKGSNRNKDHSAEGEGVGKRPKRKCLQWHPLLAKKLLDFSEEEEEEDEEEDIDKVQLLGADGLEQDVGETEDDESPEQRARRPMNAFLLFCKRHRSLVRQEHPRLDNRGATKILADWWAVLDPKEKQKYTDMAKEYKDAFMKANPGYKWCPTTNKPVKSPTPTVNPRKKLWAFPSDSSRDLPSPKKAKTEEMP

SEQ ID NO: 3956 - protein, 166 aa, Homo sapiens
MKGSNRNKDHSAEGEGVGKRPKRKCLQWHPLLAKKLLDFSEEEEEEDEEEDIDKVQLLGADGLEQDVGETEDDESPEQRARRPMNAFLLFCKRHRSLVRQEHPRLDNRGATKILADWWAVLDPKEKQKYTDMAKEYKDAFMKANPGYKWCPTTNKPVKSPTPTVNP

SEQ ID NO: 3957 - protein, 103 aa, Homo sapiens
MKGSNRNKDHSAEGEGVGKRPKRKCLQWHPLLAKKLLDFSEEEEEEDEEEDIDKVQLLGADGLEQDVGETEDDESPEQRARRPMNAFLLFCKRHRSLVRQEHP

SEQ ID NO: 3958 - protein, 159 aa, Homo sapiens
MKGSNRNKDHSAEGEGVGKRPKRKCLQWHPLLAKKLLDFSEEEEEEDEEEDIDKVQLLGADGLEQDVGETEDDESPEQRARRPMNAFLLFCKRHRSLVRQEHPRLDNRGATKILADWWAVLDPKEKQKYTDMAKEYKDAFMKANPGYKWCPTTNKPVKS

SEQ ID NO: 3959 - protein, 114 aa, Homo sapiens
MKGSNRNKDHSAEGEGVGKRPKRKCLQWHPLLAKKLLDFSEEEEEEDEEEDIDKVQLLGADGLEQDVGETEDDESPEQRARRPMNAFLLFCKRHRSLVRQEHPRLDNRGATKIL

SEQ ID NO: 3960 - protein, 144 aa, Homo sapiens
MKGSNRNKDHSAEGEGVGKRPKRKCLQWHPLLAKKLLDFSEEEEEEDEEEDIDKVQLLGADGLEQDVGETEDDESPEQRARRPMNAFLLFCKRHRSLVRQEHPRLDNRGATKILADWWAVLDPKEKQKYTDMAKEYKDAFMKAN

SEQ ID NO: 3961 - protein, 13 aa, Homo sapiens
MKGSNRNKDHSAE

SEQ ID NO: 3962 - protein, 205 aa, Homo sapiens
MKGSNRNKDHSAEGEGVGKRPKRKCLQWHPLLAKKLLDFSEEEEEEDEEEDIDKVQLLGADGLEQDVGETEDDESPEQRARRPMNAFLLFCKRHRSLVRQEHPRLDNRGATKILADWWAVLDPKEKQKYTDMAKEYKDAFMKANPGYKWCPTTNKPVKSPTPTVNPRKKLWAFPSDSSRDLPSPKKAKTEEMPQLNFGMADPTQM

SEQ ID NO: 3963 - protein, 71 aa, Homo sapiens
MKGSNRNKDHSAEGEGVGKRPKRKCLQWHPLLAKKLLDFSEEEEEEDEEEDIDKVQLLGADGLEQDVGETE

SEQ ID NO: 3964 - protein, 85 aa, Homo sapiens
MKGSNRNKDHSAEGEGVGKRPKRKCLQWHPLLAKKLLDFSEEEEEEDEEEDIDKVQLLGADGLEQDVGETEDDESPEQRARRPMN

SEQ ID NO: 3965 - protein, 98 aa, Homo sapiens
MKGSNRNKDHSAEGEGVGKRPKRKCLQWHPLLAKKLLDFSEEEEEEDEEEDIDKVQLLGADGLEQDVGETEDDESPEQRARRPMNAFLLFCKRHRSLV

SEQ ID NO: 3966 - protein, 821 aa, Homo sapiens
MDPECAQLLPALCAVLVDPRQPVADDTCLEKLLDWFKTVTEGESSVVLLQEHPCLVELLSHVLKVQDLSSGVLSFSLRLAGTFAAQENCFQYLQQGELLPGLFGEPGPLGRATWAVPTVRSGWIQGLRSLAQHPSALRFLADHGAVDTIFSLQGDSSLFVASAASQLLVHVLALSMRGGAEGQPCLPGGDWPACAQKIMDHVEESLCSAATPKVTQALNVLTTTFGRCQSPWTEALWVRLSPRVACLLERDPIPAAHSFVDLLLCVARSPVFSSSDGSLWETVARALSCLGPTHMGPLALGILKLEHCPQALRTQAFQVLLQPLACVLKATVQAPGPPGLLDGTADDATTVDTLLASKSSCAGLLCRTLAHLEELQPLPQRPSPWPQASLLGATVTVLRLCDGSAAPASSVGGHLCGTLAGCVRVQRAALDFLGTLSQGTGPQELVTQALAVLLECLESPGSSPTVLKKAFQATLRWLLSSPKTPGCSDLGPLIPQFLRELFPVLQKRLCHPCWEVRDSALEFLTQLSRHWGGQADFRCALLASEVPQLALQLLQDPESYVRASAVTAMGQLSSQGLHAPTSPEHAEARQSLFLELLHILSVDSEGFPRRAVMQVFTEWLRDGHADAAQDTEQFVATVLQAASRDLDWEVRAQGLELALVFLGQTLGPPRTHCPYAVALPEVAPAQPLTEALRALCHVGLFDFAFCALFDCDRPVAQKSCDLLLFLRDKIASYSSLREARGSPNTASAEATLPRWRAGEQAQPPGDQEPEAVLAMLRSLDLEGLRSTLAESSDHVEKSPQSLLQDMLATGGFLQGDEADCY

SEQ ID NO: 3967 - protein, 323 aa, Homo sapiens
MPVHSRGDKKETNHHDEMEVDYAENEGSSSEDEDTESSSVSEDGDSSEMDDEDCERRRMECLDEMSNLEKQFTDLKDQLYKERLSQVDAKLQEVIAGKAPEYLEPLATLQENMQIRTKVAGIYRELCLESVKNKYECEIQASRQHCESEKLLLYDTVQSELEEKIRRLEEDRHSIDITSELWNDELQSRKKRKDPFSPDKKKPVVVSGPYIVYMLQDLDILEDWTTIRKAMATLGPHRVKTEPPVKLEKHLHSARSEEGRLYYDGEWYIRGQTICIDKKDECPTSAVITTINHDEVWFKRPDGSKSKLYISQLQKGKYSIKHS

SEQ ID NO: 3968 - protein, 275 aa, Homo sapiens
MDDEDCERRRMECLDEMSNLEKQFTDLKDQLYKERLSQVDAKLQEVIAGKAPEYLEPLATLQENMQIRTKVAGIYRELCLESVKNKYECEIQASRQHCESEKLLLYDTVQSELEEKIRRLEEDRHSIDITSELWNDELQSRKKRKDPFSPDKKKPVVVSGPYIVYMLQDLDILEDWTTIRKAMATLGPHRVKTEPPVKLEKHLHSARSEEGRLYYDGEWYIRGQTICIDKKDECPTSAVITTINHDEVWFKRPDGSKSKLYISQLQKGKYSIKHS

SEQ ID NO: 3969 - protein, 1058 aa, Homo sapiens
MRRKGRCHRGSAARHPSSPCSVKHSPTRETLTYAQAQRMVEIEIEGRLHRISIFDPLEIILEDDLTAQEMSECNSNKENSERPPVCLRTKRHKNNRVKKKNEALPSAHGTPASASALPEPKVRIVEYSPPSAPRRPPVYYKFIEKSAEELDNEVEYDMDEEDYAWLEIVNEKRKGDCVPAVSQSMFEFLMDRFEKESHCENQKQGEQQSLIDEDAVCCICMDGECQNSNVILFCDMCNLAVHQECYGVPYIPEGQWLCRHCLQSRARPADCVLCPNKGGAFKKTDDDRWGHVVCALWIPEVGFANTVFIEPIDGVRNIPPARWKLTCYLCKQKGVGACIQCHKANCYTAFHVTCAQKAGLYMKMEPVKELTGGGTTFSVRKTAYCDVHTPPGCTRRPLNIYGDVEMKNGVCRKESSVKTVRSTSKVRKKAKKAKKALAEPCAVLPTVCAPYIPPQRLNRIANQVAIQRKKQFVERAHSYWLLKRLSRNGAPLLRRLQSSLQSQRSSQQRENDEEMKAAKEKLKYWQRLRHDLERARLLIELLRKREKLKREQVKVEQVAMELRLTPLTVLLRSVLDQLQDKDPARIFAQPVSLKEVPDYLDHIKHPMDFATMRKRLEAQGYKNLHEFEEDFDLIIDNCMKYNARDTVFYRAAVRLRDQGGVVLRQARREVDSIGLEEASGMHLPERPAAAPRRPFSWEDVDRLLDPANRAHLGLEEQLRELLDMLDLTCAMKSSGSRSKRAKLLKKEIALLRNKLSQQHSQPLPTGPGLEGFEEDGAALGPEAGEEVLPRLETLLQPRKRSRSTCGDSEVEEESPGKRLDAGLTNGFGGARSEQEPGGGLGRKATPRRRCASESSISSSNSPLCDSSFNAPKCGRGKPALVRRHTLEDRSELISCIENGNYAKAARIAAEVGQSSMWISTDAAASVLEPLKVVWAKCSGYPSYPALIIDPKMPRVPGHHNGVTIPAPPLDVLKIGEHMQTKSDEKLFLVLFFDNKRSWQWLPKSKMVPLGIDETIDKLKMMEGRNSSIRKAVRIAFDRAMNHLSRVHGEPTSDLSDID

SEQ ID NO: 3970 - protein, 784 aa, Homo sapiens
MQSRKCLKRDCDQQADGLCRFGSFDCFRSSRRSSSTTRAWTSASRTRTSDRLNRIANQVAIQRKKQFVERAHSYWLLKRLSRNGAPLLRRLQSSLQSQRSSQQRENDEEMKAAKEKLKYWQRLRHDLERARLLIELLRKREKLKREQVKVEQVAMELRLTPLTVLLRSVLDQLQDKDPARIFAQPVSLKEVPDYLDHIKHPMDFATMRKRLEAQGYKNLHEFEEDFDLIIDNCMKYNARDTVFYRAAVRLRDQGGVVLRQARREVDSIGLEEASGMHLPERPAAAPRRPFSWEDVDRLLDPANRAHLGLEEQLRELLDMLDLTCAMKSSGSRSKRAKLLKKEIALLRNKLSQQHSQPLPTGPGLEGFEEDGAALGPEAGEEGDKSPPKLEPSDALPLPSNSETNSEPPTLKPVELNPEQSKLFKRVTFDNESHSACTQSALVSGRPPEPTRASSGDVPAAAASAVAEPASDVNRRTSVLFCKSKSVSPPKSAKNTETQPTSPQLGTKTFLSVVLPRLETLLQPRKRSRSTCGDSEVEEESPGKRLDAGLTNGFGGARSEQEPGGGLGRKATPRRRCASESSISSSNSPLCDSSFNAPKCGRGKPALVRRHTLEDRSELISCIENGNYAKAARIAAEVGQSSMWISTDAAASVLEPLKVVWAKCSGYPSYPALIIDPKMPRVPGHHNGVTIPAPPLDVLKIGEHMQTKSDEKLFLVLFFDNKRSWQWLPKSKMVPLGIDETIDKLKMMEGRNSSIRKAVRIAFDRAMNHLSRVHGEPTSDLSDID

SEQ ID NO: 3971 - protein, 1058 aa, Homo sapiens; identical to SEQ ID NO: 3969

SEQ ID NO: 3972 - protein, 649 aa, Homo sapiens
MKAAKEKLKREQVKVEQVAMELRLTPLTVLLRSVLDQLQDKDPARIFAQPVSLKEVPDYLDHIKHPMDFATMRKRLEAQGYKNLHEFEEDFDLIIDNCMKYNARDTVFYRAAVRLRDQGGVVLRQARREVDSIGLEEASGMHLPERPAAAPRRPFSWEDVDRLLDPANRAHLGLEEQLRELLDMLDLTCAMKSSGSRSKRAKLLKKEIALLRNKLSQQHSQPLPTGPGLEGFEEDGAALGPEAGEEGDKSPPKLEPSDALPLPSNSETNSEPPTLKPVELNPEQSKLFKRVTFDNESHSACTQSALVSGRPPEPTRASSGDVPAAAASAVAEPASDVNRRTSVLFCKSKSVSPPKSAKNTETQPTSPQLGTKTFLSVVLPRLETLLQPRKRSRSTCGDSEVEEESPGKRLDAGLTNGFGGARSEQEPGGGLGRKATPRRRCASESSISSSNSPLCDSSFNAPKCGRGKPALVRRHTLEDRSELISCIENGNYAKAARIAAEVGQSSMWISTDAAASVLEPLKVVWAKCSGYPSYPALIIDPKMPRVPGHHNGVTIPAPPLDVLKIGEHMQTKSDEKLFLVLFFDNKRSWQWLPKSKMVPLGIDETIDKLKMMEGRNSSIRKAVRIAFDRAMNHLSRVHGEPTSDLSDID

SEQ ID NO: 3973 - protein, 995 aa, Homo sapiens
MRRKGRCHRGSAARHPSSPCSVKHSPTRETLTYAQAQRMVEIEIEGRLHRISIFDPLEIILEDDLTAQEMSECNSNKENSERPPVCLRTKRHKNNRVKKKNEALPSAHGTPASASALPEPKVRIVEYSPPSAPRRPPVYYKFIEKSAEELDNEVEYDMDEEDYAWLEIVNEKRKGDCVPAVSQSMFEFLMDRFEKESHCENQKQGEQQSLIDEDAVCCICMDGECQNSNVILFCDMCNLAVHQECYGVPYIPEGQWLCRHCLQSRARPADCVLCPNKGGAFKKTDDDRWGHVVCALWIPEVGFANTVFIEPIDGVRNIPPARWKLTCYLCKQKGVGACIQCHKANCYTAFHVTCAQKAGLYMKMEPVKELTGGGTTFSVRKTAYCDVHTPPGCTRRPLNIYGDVEMKNGVCRKESSVKTVRSTSKVRKKAKKAKKALAEPCAVLPTVCAPYIPPQRLNRIANQVAIQRKKQFVERAHSYWLLKRLSRNGAPLLRRLQSSLQSQRSSQQRENDEEMKAAKEKLKYWQRLRHDLERARLLIELLRKREKLKREQVKVEQVAMELRLTPLTVLLRSVLDQLQDKDPARIFAQPVSLKEVPDYLDHIKHPMDFATMRKRLEAQGYKNLHEFEEDFDLIIDNCMKYNARDTVFYRAAVRLRDQGGVVLRQARREVDSIGLEEASGMHLPERPAAAPRRPFSWEDVDRLLDPANRAHLGLEEQLRELLDMLDLTCAMKSSGSRSKRAKLLKKEIALLRNKLSQQHSQPLPTGPGLEGFEEDGAALGPEAGEEGDKSPPKLEPSDALPLPSNSETNSEPPTLKPVELNPEQSKLFKRVTFDNESHSACTQSALVSGRPPEPTRASSGDVPAAAASAVAEPASDVNRRTSVLFCKSKSSFRGWRLFCSQGKGRGAHAETPRWRRSPQESAWTQVSPTALGVRGASRSRAAAWGGRPHPDDAVPPSPASPPATARSATRALMRPNVGGANRLLCDGTRWRTAVS

SEQ ID NO: 3974 - protein, 746 aa, Homo sapiens
MKMEPVKELTGGGTTFSVRKTAYCDVHTPPGCTRRPLNIYGDVEMKNGVCRKESSVKTVRSTSKVRKKAKKAKKALAEPCAVLPTVCAPYIPPQRFIRMQSRKCLKRDCDQQADGLCRFGSFDCFRSSRRSSSTTRAWTSASRTRTSDRLNRIANQVAIQRKKQFVERAHSYWLLKRLSRNGAPLLRRLQSSLQSQRSSQQRENDEEMKAAKEKLKYWQRLRHDLERARLLIELLRKREKLKREQVKVEQVAMELRLTPLTVLLRSVLDQLQDKDPARIFAQPVPDYLDHIKHPMDFATMRKRLEAQGYKNLHEFEEDFDLIIDNCMKYNARDTVFYRAAVRLRDQGGVVLRQARREVDSIGLEEASGMHLPERPAAAPRRPFSWEDVDRLLDPANRAHLGLEEQLRELLDMLDLTCAMKSSGSRSKRAKLLKKEIALLRNKLSQQHSQPLPTGPGLEGFEEDGAALGPEAGEEVLPRLETLLQPRKRSRSTCGDSEVEEESPGKRLDAGLTNGFGGARSEQEPGGGLGRKATPRRRCASESSISSSNSPLCDSSFNAPKCGRGKPALVRRHTLEDRSELISCIENGNYAKAARIAAEVGQSSMWISTDAAASVLEPLKVVWAKCSGYPSYPALIIDPKMPRVPGHHNGVTIPAPPLDVLKIGEHMQTKSDEKLFLVLFFDNKRSWQWLPKSKMVPLGIDETIDKLKMMEGRNSSIRKAVRIAFDRAMNHLSRVHGEPTSDLSDID

SEQ ID NO: 3975 - protein, 726 aa, Homo sapiens
MSTATTVAPAGIPATPGPVNPPPPEVSNPSKPGRKTNQLQYMQNVVVKTLWKHQFAWPFYQPVDAIKLNLPDYHKIIKNPMDMGTIKKRLENNYYWSASECMQDFNTMFTNCYIYNKPTDDIVLMAQALEKIFLQKVAQMPQEEVELLPPAPKGKGRKPAAGAQSAGTQQVAAVSSVSPATPFQSVPPTVSQTPVIAATPVPTITANVTSVPVPPAAAPPPPATPIVPVVPPTPPVVKKKGVKRKADTTTPTTSAITASRSESPPPLSDPKQAKVVARRESGGRPIKPPKKDLEDGEVPQHAGKKGKLSEHLRYCDSILREMLSKKHAAYAWPFYKPVDAEALELHDYHDIIKHPMDLSTVKRKMDGREYPDAQGFAADVRLMFSNCYKYNPPDHEVVAMARKLQDVFEMRFAKMPDEPVEAPALPAPAAPMVSKGAESSRSSEESSSDSGSSDSEEERATRLAELQEQLKAVHEQLAALSQAPVNKPKKKKEKKEKEKKKKDKEKEKEKHKVKAEEEKKAKVAPPAKQAQQKKAPAKKANSTTTAGRQLKKGGKQASASYDSEEEEEGLPMSYDEKRQLSLDINRLPGEKLGRVVHIIQSREPSLRDSNPDEIEIDFETLKPTTLRELERYVKSCLQKKQRKPFSASGKKQAAKSKEELAQEKKKELEKRLQDVSGQLSSSKKPARKEKPGSAPSGGPSRLSSSSSSESGSSSSSGSSSDSSDSE

SEQ ID NO: 3976 - protein, 556 aa, Homo sapiens
MSTATTVAPAGIPATPGPVNPPPPEVSNPSKPGRKTNQLQYMQNVVVKTLWKHQFAWPFYQPVDAIKLNLPDYHKIIKNPMDMGTIKKRLENNYYWSASECMQDFNTMFTNCYIYNKPTDDIVLMAQALEKIFLQKVAQMPQEEVELLPPAPKGKGRKPAAGAQSAGTQQVAAVSSVSPATPFQSVPPTVSQTPVIAATPVPTITANVTSVPVPPAAAPPPPATPIVPVVPPTPPVVKKKGVKRKADTTTPTTSAITASRSESPPPLSDPKQAKVVARRESGGRPIKPPKKDLEDGEVPQHAGKKGKLSEHLRYCDSILREMLSKKHAAYAWPFYKPVDAEALELHDYHDIIKHPMDLSTVKRKMDGREYPDAQGFAADVRLMFSNCYKYNPPDHEVVAMARKLQDVFEMRFAKMPDEPVEAPALPAPAAPMVSKGAESSRSSEESSSDSGSSDSEEERATRLAELQEQLKAVHEQLAALSQAPVNKPKKKKEKKEKEKKKKDKEKEKEKHKVKAEEEKKAKVAPPAKQAQQKKAPAKKANSTTTAGRDHFLTCGV

SEQ ID NO: 3977 - protein, 556 aa, Homo sapiens; identical to SEQ ID NO: 3976

SEQ ID NO: 3978 - protein, 74 aa, Homo sapiens
MSTATTVAPAGIPATPGPVNPPPPEVSNPSKPGRKTNQLQYMQNVVVKTLWKHQFAWPFYQPVDAIKLNLPDYH

SEQ ID NO: 3979 - protein, 20 aa, Homo sapiens
MSTATTVAPAGIPATPGPVN

SEQ ID NO: 3980 - protein, 405 aa, Homo sapiens
MLSKKHAAYAWPFYKPVDAEALELHDYHDIIKHPMDLSTVKRKMDGREYPDAQGFAADVRLMFSNCYKYNPPDHEVVAMARKLQDVFEMRFAKMPDEPVEAPALPAPAAPMVSKGAESSRSSEESSSDSGSSDSEEERATRLAELQEQLKAVHEQLAALSQAPVNKPKKKKEKKEKEKKKKDKEKEKEKHKVKAEEEKKAKVAPPAKQAQQKKAPAKKANSTTTAGRQLKKGGKQASASYDSEEEEEGLPMSYDEKRQLSLDINRLPGEKLGRVVHIIQSREPSLRDSNPDEIEIDFETLKPTTLRELERYVKSCLQKKQRKPFSASGKKQAAKSKEELAQEKKKELEKRLQDVSGQLSSSKKPARKEKPGSAPSGGPSRLSSSSSSESGSSSSSGSSSDSSDSE

SEQ ID NO: 3981 - protein, 353 aa, Homo sapiens
MAATKRKRRGGFAVQAKKPKRNEIDAEPPAKRHATAEEVEEEERDRIPGPVCKGKWKNKERILIFSSRGINFRTRHLMQDLRMLMPHSKADTKMDRKDKLFVINEVCEMKNCNKCIYFEAKKKQDLYMWLSNSPHGPSAKFLVQNIHTLAELKMTGNCLKGSRPLLSFDPAFDELPHYALLKELLIQIFSTPRYHPKSQPFVDHVFTFTILDNRIWFRNFQIIEEDAALVEIGPRFVLNLIKIFQGSFGGPTLYENPHYQSPNMHRRVIRSITAAKYREKQQVKDVQKLRKKEPKTLLPHDPTADVFVTPAEEKPIEIQWVKPEPKVDLKARKKRIYKRQRKMKQRMDSGKTK

SEQ ID NO: 3982 - protein, 475 aa, Homo sapiens
MAGRPHPYDGNSSDPENWDRKLHSRPRKLYKHSSTSSRIAKGGVDHTKMSLHGASGGHERSRDRRRSSDRSRDSSHERTESQLTPCIRNVTSPTRQHHVEREKDHSSSRPSSPRPQKASPNGSISSAGNSSRNSSQSSSDGSCKTAGEMVFVYENAKEGARNIRTSERVTLIVDNTRFVVDPSIFTAQPNTMLGRMFGSGREHNFTRPNEKGEYEVAEGIGSTVFRAILDYYKTGIIRCPDGISIPELREACDYLCISFEYSTIKCRDLSALMHELSNDGARRQFEFYLEEMILPLMVASAQSGERECHIVVLTDDDVVDWDEEYPPQMGEEYSQIIYSTKLYRFFKYIENRDVAKSVLKERGLKKIRLGIEGYPTYKEKVKKRPGGRPEVIYNYVQRPFIRMSWEKEEGKSRHVDFQCVKSKSITNLAAAAADIPQDQLVVMHPTPQVDELDILPIHPPSGNSDLDPDAQNPML

SEQ ID NO: 3983 - protein, 64 aa, Homo sapiens
MAGRPHPYDGNSSDPENWDRKLHSRPRKLYKHSSTSSRIAKGGVDHTKMSLHGASGGHERSRDR

SEQ ID NO: 3984 - protein, 66 aa, Homo sapiens
MAGRPHPYDGNSSDPENWDRKLHSRPRKLYKHSSTSSRIAKGGVDHTKMSLHGASGGHERSRDRRR

SEQ ID NO: 3985 - protein, 378 aa, Homo sapiens
MARCGEGSAAPMVLLGSAGVCSKGLQRKGPCERRRLKATVSEQLSQDLLRLLREEFHTDVTFSVGCTLFKAHKAVLLARVPDFYFHTIGQTSNSLTNQEPIAVENVEALEFRTFLQIIYSSNRNIKNYEEEILRKKIMEIGISQKQLDISFPKCENSSDCSLQKHEIPEDISDRDDDFISNDNYDLEPASELGEDLLKLYVKPCCPDIDIFVDGKRFKAHRAILSARSSYFAAMLSGCWAESSQEYVTLQGISHVELNVMMHFIYGGTLDIPDKTNVGQILNMADMYGLEGLKEVAIYILRRDYCNFFQKPVPRTLTSILECLIIAHSVGVESLFADCMKWIVKHFARFWSERSFANIPPEIQKSCLNMLIQSLVSIT

SEQ ID NO: 3986 - protein, 305 aa, Homo sapiens
MARCGEGSAAPMVLLGSAGVCSKGLQRKGPCERRRLKATVSEQLSQDLLRLLREEFHTDVTFSVGCTLFKAHKAVLLARVPDFYFHTIGQTSNSLTNQEPIAVENVEALEFRTFLQIIYSSNRNIKNYEEEILRKKIMEIGISQKQLDISFPKCENSSDCSLQKHEIPEDISDRDDDFISNDNYDLEPASELGEDLLKLYVKPCCPDIDIFVDGKRFKAHRAILSARSSYFAAMLSGCWAESSQEYVTLQGISHVELNVMMHFIYGGTLDIPDKTNVGYVFLFNNLKYKRVRFCFVELCCKVLMK

SEQ ID NO: 3987 - protein, 283 aa, Homo sapiens
MARCGEGSAAPMVLLGSAGVCSKGLQRKGPCERRRLKATVSEQLSQDLLRLLREEFHTDVTFSVGCTLFKAHKAVLLARVPDFYFHTIGQTSNSLTNQEPIAVENVEALEFRTFLQIIYSSNRNIKNYEEEILRKKIMEIGISQKQLDISFPKCENSSDCSLQKHEIPEDISDRDDDFISNDNYDLEPASELGEDLLKLYVKPCCPDIDIFVDGKRFKAHRAILSARSSYFAAMLSGCWAESSQEYVTLQGISHVELNVMMHFIYGGTLDIPDKTNVGLFPEH

SEQ ID NO: 3988 - protein, 144 aa, Homo sapiens
MPKVKRSRKAPPDGWELIEPTLDELDQKMREAETEPHEGKRKVESLWPIFRIHHQKTRYIFDLFYKRKAISRELYEYCIKEGYADKNLIAKWKKQGYENLCCLRCIQTRDTNFGTNCICRVPKSKLEVGRIIECTHCGCRGCSG

SEQ ID NO: 3989 - protein, 144 aa, Homo sapiens; identical to SEQ ID NO: 3988

SEQ ID NO: 3990 - protein, 103 aa, Homo sapiens
MPKVKRSRKAPPDGWELIEPTLDELDQKMREELYEYCIKEGYADKNLIAKWKKQGYENLCCLRCIQTRDTNFGTNCICRVPKSKLEVGRIIECTHCGCRGCSG

SEQ ID NO: 3991 - protein, 508 aa, Homo sapiens
MIYEESKMNLEQERPFVCSAPGCSQRFPTEDHLMIHRHKHEMTLKFPSIKTDNMLSDQTPTPTRFLKNCEEVGLFSELDCSLEHEFRKAQEEESSKRNISMHNAVGGAMTGPGTHQLSSARLPNHDTNVVIQQAMPSPQSSSVITQAPSTNRQIGPVPGSLSSLLHLHNRQRQPMPASMPGTLPNPTMPGSSAVLMPMERQMSVNSSIMGMQGPNLSNPCASPQVQPMHSEAKMRLKAALTHHPAAMSNGNMNTMGHMMEMMGSRQDQTPHHHMHSHPHQHQTLPPHHPYPHQHQHPAHHPHPQPHHQQNHPHHHSHSHLHAHPAHHQTSPHPPLHTGNQAQVSPATQQMQPTQTIQPPQPTGGRRRRVVDEDPDERRRKFLERNRAAATRCRQKRKVWVMSLEKKAEELTQTNMQLQNEVSMLKNEVAQLKQLLLTHKDCPITAMQKESQGYLSPESSPPASPVPACSQQQVIQHNTITTSSSVSEVVGSSTLSQLTTHRTDLNPIL

SEQ ID NO: 3992 - protein, 369 aa, Homo sapiens
MFCTSGGNSASVMSMRPVPGSLSSLLHLHNRQRQPMPASMPGTLPNPTMPGSSAVLMPMERQMSVNSSIMGMQGPNLSNPCASPQVQPMHSEAKMRLKAALTHHPAAMSNGNMNTMGHMMEMMGSRQDQTPHHHMHSHPHQHQTLPPHHPYPHQHQHPAHHPHPQPHHQQNHPHHHSHSHLHAHPAHHQTSPHPPLHTGNQAQVSPATQQMQPTQTIQPPQPTGGRRRRVVDEDPDERRRKFLERNRAAATRCRQKRKVWVMSLEKKAEELTQTNMQLQNEVSMLKNEVAQLKQLLLTHKDCPITAMQKESQGYLSPESSPPASPVPACSQQQVIQHNTITTSSSVSEVVGSSTLSQLTTHRTDLNPIL

SEQ ID NO: 3993 - protein, 475 aa, Homo sapiens
MIHRHKHEMTLKFPSIKTDNMLSDQTPTPTRFLKNCEEVGLFSELDCSLEHEFRKAQEEESSKRNISMHNAVGGAMTGPGTHQLSSARLPNHDTNVVIQQAMPSPQSSSVITQAPSTNRQIGPVPGSLSSLLHLHNRQRQPMPASMPGTLPNPTMPGSSAVLMPMERQMSVNSSIMGMQGPNLSNPCASPQVQPMHSEAKMRLKAALTHHPAAMSNGNMNTMGHMMEMMGSRQDQTPHHHMHSHPHQHQTLPPHHPYPHQHQHPAHHPHPQPHHQQNHPHHHSHSHLHAHPAHHQTSPHPPLHTGNQAQVSPATQQMQPTQTIQPPQPTGGRRRRVVDEDPDERRRKFLERNRAAATRCRQKRKVWVMSLEKKAEELTQTNMQLQNEVSMLKNEVAQLKQLLLTHKDCPITAMQKESQGYLSPESSPPASPVPACSQQQVIQHNTITTSSSVSEVVGSSTLSQLTTHRTDLNPIL

SEQ ID NO: 3994 - protein, 501 aa, Homo sapiens
MNLEQERPFVCSAPGCSQRFPTEDHLMIHRHKHEMTLKFPSIKTDNMLSDQTPTPTRFLKNCEEVGLFSELDCSLEHEFRKAQEEESSKRNISMHNAVGGAMTGPGTHQLSSARLPNHDTNVVIQQAMPSPQSSSVITQAPSTNRQIGPVPGSLSSLLHLHNRQRQPMPASMPGTLPNPTMPGSSAVLMPMERQMSVNSSIMGMQGPNLSNPCASPQVQPMHSEAKMRLKAALTHHPAAMSNGNMNTMGHMMEMMGSRQDQTPHHHMHSHPHQHQTLPPHHPYPHQHQHPAHHPHPQPHHQQNHPHHHSHSHLHAHPAHHQTSPHPPLHTGNQAQVSPATQQMQPTQTIQPPQPTGGRRRRVVDEDPDERRRKFLERNRAAATRCRQKRKVWVMSLEKKAEELTQTNMQLQNEVSMLKNEVAQLKQLLLTHKDCPITAMQKESQGYLSPESSPPASPVPACSQQQVIQHNTITTSSSVSEVVGSSTLSQLTTHRTDLNPIL

SEQ ID NO: 3995 - protein, 475 aa, Homo sapiens; identical to SEQ ID NO: 3993

SEQ ID NO: 3996 - protein, 115 aa, Homo sapiens
MNLEQERPFVCSAPGCSQRFPTEDHLMIHRHKHEMTLKFPSIKTDNMLSDQTPTPTRFLKNCEEVGLFSELDCSLEHEFRKAQEEESSKRNISMHNAVGGAMTGPGTHQLSSARL

SEQ ID NO: 3997 - protein, 150 aa, Homo sapiens
MSKISQQNSTPGVNGISVIHTQAHASGLQQVPQLVPAGPGGGGKAVAPSKQSKKSSPMDRNSDEYRQRRERNNMAVKKSRLKSKQKAQDTLQRVNQLKEENERLEAKIKLLTKELSVLKDLFLEHAHNLADNVQSISTENTTADGDNAGQ

SEQ ID NO: 3998 - protein, 502 aa, Homo sapiens
METLQESLNTLLKQLEEEKKTLESQVKYYALKLEQESKAYQKINNERRTYLAEMSQGSGLHQVSKRQQVDQLPRMQENLVKTLLLKEELDPLKAKIDILLVGDVTVGYLADTVQKLFANIAEVTITISDTKEAAALLDDCIFNMVLLKVPSSLSAEELEAIKLIRFGKKKNTHSLFVFIIPENFKGCISGHGMDIALTEPLTMEKMSNVVKYWTTCPSNTVKTENATGPEELGLPLQRSYSEHLGYFPTDLFACSESLRNGNGLELNASLSEFEKNKKISLLHSSKEKLRRERIKYCCEQLRTLLPYVKGRKNDAASVLEATVDYVKYIREKISPAVMAQITEALQSNMRFCKKQQTPIELSLPGTVMAQRENSVMSTYSPERGLQFLTNTCWNGCSTPDAESSLDEAVRVPSSSASENAIGDPYKTHISSAALSLNSLHTVRYYSKVTPSYDATAVTNQNISIHLPSAMPPVSKLLPRHCTSGLGQTCTTHPNCLQQFWAY

SEQ ID NO: 3999 - protein, 510 aa, Homo sapiens
MEEPQAGDAARFSCPPNFTAKPPASESPRFSLEALTGPDTELWLIQAPADFAPECFNGRHVPLSGSQIVKGKLAGKRHRYRVLSSCPQAGEATLLAPSTEAGGGLTCASAPQGTLRILEGPQQSLSGSPLQPIPASPPPQIPPGLRPRFCAFGGNPPVTGPRSALAPNLLTSGKKKKEMQVTEAPVTQEAVNGHGALEVDMALGSPEMDVRKKKKKKNQQLKEPEAAGPVGTEPTVETLEPLGVLFPSTTKKRKKPKGKETFEPEDKTVKQEQINTEPLEDTVLSPTKKRKRQKGTEGMEPEEGVTVESQPQVKVEPLEEAIPLPPTKKRKKEKGQMAMMEPGTEAMEPVEPEMKPLESPGGTMAPQQPEGAKPQAQAALAAPKKKTKKEKQQDATVEPETEVVGPELPDDLEPQAAPTSTKKKKKKKERGHTVTEPIQPLEPELPGEGQPEARATPGSTKKRKKQSQESRMPETVPQEEMPGPPLNSESGEEAPTGRDKKRKQQQQQPV

SEQ ID NO: 4000 - protein, 481 aa, Homo sapiens
MRHSKRTHCPDWDSRESWGHESYRGSHKRKRRSHSSTQENRHCKPHHQFKESDCHYLEARSLNERDYRDRRYVDEYRNDYCEGYVPRHYHRDIESGYRIHCSKSSVRSRRSSPKRKRNRHCSSHQSRSKSHRRKRSRSIEDDEEGHLICQSGDVLRARYEIVDTLGEGAFGKVVECIDHGMDGMHVAVKIVKNVGRYREAARSEIQVLEHLNSTDPNSVFRCVQMLEWFDHHGHVCIVFELLGLSTYDFIKENSFLPFQIDHIRQMAYQICQSINFLHHNKLTHTDLKPENILFVKSDYVVKYNSKMKRDERTLKNTDIKVVDFGSATYDDEHHSTLVSTRHYRAPEVILALGWSQPCDVWSIGCILIEYYLGFTVFQTHDSKEHLAMMERILGPIPQHMIQKTRKRKYFHHNQLDWDEHSSAGRYVRRRCKPLKEFMLCHDEEHEKLFDLVRRMLEYDPTQRITLDEALQHPFFDLLKKK

SEQ ID NO: 4001 - protein, 54 aa, Homo sapiens
MRHSKRTHCPDWDSRESWGHESYRGSHKRKRRSHSSTQENRHCKPHHQFKESDW

SEQ ID NO: 4002 - protein, 53 aa, Homo sapiens
MRHSKRTHCPDWDSRESWGHESYRGSHKRKRRSHSSTQENRHCKPHHQFKESD

SEQ ID NO: 4003 - protein, 143 aa, Homo sapiens
MRHSKRTHCPDWDSRESWGHESYRGSHKRKRRSHSSTQENRHCKPHHQFKESDCHYLEARSLNERDYRDRRYVDEYRNDYCEGYVPRHYHRDIESGYRIHCSKSSVRSRRSSPKRKRNRHCSSHQSRSMKSWTLWVKEPLAKL

SEQ ID NO: 4004 - protein, 89 aa, Homo sapiens
MRHSKRTHCPDWDSRESWGHESYRGSHKRKRRSHSSTQENRHCKPHHQFKESDWTCVDIKTNALTLIRLGYLKGYSEIFTGHSVDILKN

SEQ ID NO: 4005 - protein, 373 aa, Homo sapiens
MRHSKRTHCPDWDSRESWGHESYRGSHKRKRRSHSSTQENRHCKPHHQFKESDCHYLEARSLNERDYRDRRYVDEYRNDYCEGYVPRHYHRDIESGYRIHCSKSSVRSRRSSPKRKRNRHCSSHQSRSKSHRRKRSRSIEDDEEGHLICQSGDVLRARYEIVDTLGEGAFGKVVECIDHGMDGMHVAVKIVKNVGRYREAARSEIQVLEHLNSTDPNSVFRCVQMLEWFDHHGHVCIVFELLGLSTYDFIKENSFLPFQIDHIRQMAYQICQSINFLHHNKLTHTDLKPENILFVKSDYVVKYNSKMKRDEHSSAGRYVRRRCKPLKEFMLCHDEEHEKLFDLVRRMLEYDPTQRITLDEALQHPFFDLLKKK

SEQ ID NO: 4006 - protein, 870 aa, Homo sapiens
MFSQQQQQQLQQQQQQLQQLQQQQLQQQQLQQQQLLQLQQLLQQSPPQAPLPMAVSRGLPPQQPQQPLLNLQGTNSASLLNGSMLQRALLLQQLQGLDQFAMPPATYDTAGLTMPTATLGNLRGYGMASPGLAAPSLTPPQLATPNLQQFFPQATRQSLLGPPPVGVPMNPSQFNLSGRNPQKQARTSSSTTPNRKDSSSQTMPVEDKSDPPEGSEEAAEPRMDTPEDQDLPPCPEDIAKEKRTPAPEPEPCEASELPAKRLRSSEEPTEKEPPGQLQVKAQPQARMTVPKQTQTPDLLPEALEAQVLPRFQPRVLQVQAQVQSQTQPRIPSTDTQVQPKLQKQAQTQTSPEHLVLQQKQVQPQLQQEAEPQKQVQPQVQPQAHSQGPRQVQLQQEAEPLKQVQPQVHTQAQPSVQPQEHPPAQVSVQPPEQTHEQPHTQPQVSLLAPEQTPVVVHVCGLEMPPDAVEAGGGMEKTLPEPVGTQVSMEEIQNESACGLDVGECENRAREMPGVWGAGGSLKVTILQSSDSRAFSTVPLTPVPRPSDSVSSTPAATSTPSKQALQFFCYICKASCSSQQEFQDHMSEPQHQQRLGEIQHMSQACLLSLLPVPRDVLETEDEEPPPRRWCNTCQLYYMGDLIQHRRTQDHKIAKQSLRPFCTVCNRYFKTPRKFVEHVKSQGHKDKAKELKSLEKEIAGQDEDHFITVDAVGCFEGDEEEEEDDEDEEEIEVEEELCKQVRSRDISREEWKGSETYSPNTAYGVDFLVPVMGYICRICHKFYHSNSGAQLSHCKSLGHFENLQKYKAAKNPSPTTRPVSRRCAINARNALTALFTSSGRPPSQPNTQDKTPSKVTARPSQPPLPRRSTRLKT

SEQ ID NO: 4007 - protein, 252 aa, Homo sapiens
MFSQQQQQQLQQQQQQLQQLQQQQLQQQQLQQQQLLQLQQLLQQSPPQAPLPMAVSRGLPPQQPQQPLLNLQGTNSASLLNGSMLQRALLLQQLQGLDQFAMPPATYDTAGLTMPTATLGNLRGYGMASPGLAAPSLTPPQLATPNLQQFFPQATRQSLLGPPPVGVPMNPSQFNLSGRNPQKQARTSSSTTPNRKDSSSQTMPVEDKSDPPEGSEEAAEPRMDTPEDQDLPPCPEDIAKEKRTPAPEPEPC

SEQ ID NO: 4008 - protein, 869 aa, Homo sapiens
MFSQQQQQQLQQQQQQLQQLQQQQLQQQQLQQQQLLQLQQLLQQSPPQAPLPMAVSRGLPPQQPQQPLLNLQGTNSASLLNGSMLQRALLLQQLQGNLRGYGMASPGLAAPSLTPPQLATPNLQQFFPQATRQSLLGPPPVGVPMNPSQFNLSGRNPQKQARTSSSTTPNRKTMPVEDKSDPPEGSEEAAEPRMDTPEDQDLPPCPEDIAKEKRTPAPEPEPCEASELPAKRLRSSEEPTEKEPPGQLQVKAQPQARMTVPKQTQTPDLLPEALEAQVLPRFQPRVLQVQAQVQSQTQPRIPSTDTQVQPKLQKQAQTQTSPEHLVLQQKQVQPQLQQEAEPQKQVQPQVQPQAHSQGPRQVQLQQEAEPLKQVQPQVQPQAHSQPPRQVQLQLQKQVQTQTYPQVHTQAQPSVQPQEHPPAQVSVQPPEQTHEQPHTQPQVSLLAPEQTPVVVHVCGLEMPPDAVEAGGGMEKTLPEPVGTQVSMEEIQNESACGLDVGECENRAREMPGVWGAGGSLKVTILQSSDSRAFSTVPLTPVPRPSDSVSSTPAATSTPSKQALQFFCYICKASCSSQQEFQDHMSEPQHQQRLGEIQHMSQACLLSLLPVPRDVLETEDEEPPPRRWCNTCQLYYMGDLIQHRRTQDHKIAKQSLRPFCTVCNRYFKTPRKFVEHVKSQGHKDKAKELKSLEKEIAGQDEDHFITVDAVGCFEGDEEEEEDDEDEEEIEVEEELCKQVRSRDISREEWKGSETYSPNTAYGVDFLVPVMGYICRICHKFYHSNSGAQLSHCKSLGHFENLQKYKAAKNPSPTTRPVSRRCAINARNALTALFTSSGRPPSQPNTQDKTPSKVTARPSQPPLPRRSTRLKT

SEQ ID NO: 4009 - protein, 870 aa, Homo sapiens; identical to SEQ ID NO: 4006

SEQ ID NO: 4010 - protein, 898 aa, Homo sapiens
MFSQQQQQQLQQQQQQLQQLQQQQLQQQQLQQQQLLQLQQLLQQSPPQAPLPMAVSRGLPPQQPQQPLLNLQGTNSASLLNGSMLQRALLLQQLQGLDQFAMPPATYDTAGLTMPTATLGNLRGYGMASPGLAAPSLTPPQLATPNLQQFFPQATRQSLLGPPPVGVPMNPSQFNLSGRNPQKQARTSSSTTPNRKDSSSQTMPVEDKSDPPEGSEEAAEPRMDTPEDQDLPPCPEDIAKEKRTPAPEPEPCEASELPAKRLRSSEEPTEKEPPGQLQVKAQPQARMTVPKQTQTPDLLPEALEAQVLPRFQPRVLQVQAQVQSQTQPRIPSTDTQVQPKLQKQAQTQTSPEHLVLQQKQVQPQLQQEAEPQKQVQPQVQPQAHSQGPRQVQLQQEAEPLKQVQPQVQPQAHSQPPRQVQLQLQKQVQTQTYPQVHTQAQPSVQPQEHPPAQVSVQPPEQTHEQPHTQPQVSLLAPEQTPVVVHVCGLEMPPDAVEAGGGMEKTLPEPVGTQVSMEEIQNESACGLDVGECENRAREMPGVWGAGGSLKVTILQSSDSRAFSTVPLTPVPRPSDSVSSTPAATSTPSKQALQFFCYICKASCSSQQEFQDHMSEPQHQQRLGEIQHMSQACLLSLLPVPRDVLETEDEEPPPRRWCNTCQLYYMGDLIQHRRTQDHKIAKQSLRPFCTVCNRYFKTPRKFVEHVKSQGHKDKAKELKSLEKEIAGQDEDHFITVDAVGCFEGDEEEEEDDEDEEEIEVEEELCKQVRSRDISREEWKGSETYSPNTAYGVDFLVPVMGYICRICHKFYHSNSGAQLSHCKSLGHFENLQKYKAAKNPSPTTRPVSRRCAINARNALTALFTSSGRPPSQPNTQDKTPSKVTARPSQPPLPRRSTRLKT

SEQ ID NO: 4011 - protein, 414 aa, Homo sapiens
MFSQQQQQQLQQQQQQLQQLQQQQLQQQQLQQQQLLQLQQLLQQSPPQAPLPMAVSRGLPPQQPQQPLLNLQGTNSASLLNGSMLQRALLLQQLQGNLRGYGMASPGLAAPSLTPPQLATPNLQQFFPQATRQSLLGPPPVGVPMNPSQFNLSGRNPQKQARTSSSTTPNRKDSSSQTMPVEDKSDPPEGSEEAAEPRMDTPEDQDLPPCPEDIAKEKRTPAPEPEPCEASELPAKRLRSSEEPTEKEPPGQLQVKAQPQARMTVPKQTQTPDLLPEALEAQVLPRFQPRVLQVQAQVQSQTQPRIPSTDTQVQPKLQKQAQTQTSPEHLVLQQKQVQPQLQQEAEPQKQVQPQVQPQAHSQGPRQVQLQQEAEPLKQVQPQVQPQAHSQPHLPQVLSQQLRGTALPLQVPGPL

SEQ ID NO: 4012 - protein, 842 aa, Homo sapiens
MFSQQQQQQLQQQQQQLQQLQQQQLQQQQLQQQQLLQLQQLLQQSPPQAPLPMAVSRGLPPQQPQQPLLNLQGTNSASLLNGSMLQRALLLQQLQGLDQFAMPPATYDTAGLTMPTATLGNLRGYGMASPGLAAPSLTPPQLATPNLQQFFPQATRQSLLGPPPVGVPMNPSQFNLSGRNPQKQARTSSSTTPNRKDSSSQTMPVEDKSDPPEGSEEAAEPRMDTPEDQDLPPCPEDIAKEKRTPAPEPEPCEASELPAKRLRSSEEPTEKEPPGQLQVKAQPQARMTVPKQTQTPDLLPEALEAQVLPRFQPRVLQVQAQVQSQTQPRIPSTDTQVQPKLQKQAQTQTSPEHLVLQQKQVQPQLQQEAEPQKQVQPQVHTQAQPSVQPQEHPPAQVSVQPPEQTHEQPHTQPQVSLLAPEQTPVVVHVCGLEMPPDAVEAGGGMEKTLPEPVGTQVSMEEIQNESACGLDVGECENRAREMPGVWGAGGSLKVTILQSSDSRAFSTVPLTPVPRPSDSVSSTPAATSTPSKQALQFFCYICKASCSSQQEFQDHMSEPQHQQRLGEIQHMSQACLLSLLPVPRDVLETEDEEPPPRRWCNTCQLYYMGDLIQHRRTQDHKIAKQSLRPFCTVCNRYFKTPRKFVEHVKSQGHKDKAKELKSLEKEIAGQDEDHFITVDAVGCFEGDEEEEEDDEDEEEIEVEEELCKQVRSRDISREEWKGSETYSPNTAYGVDFLVPVMGYICRICHKFYHSNSGAQLSHCKSLGHFENLQKYKAAKNPSPTTRPVSRRCAINARNALTALFTSSGRPPSQPNTQDKTPSKVTARPSQPPLPRRSTRLKT

SEQ ID NO: 4013 - protein, 818 aa, Homo sapiens
MFSQQQQQQLQQQQQQLQQLQQQQLQQQQLQQQQLLQLQQLLQQSPPQAPLPMAVSRGLPPQQPQQPLLNLQGTNSASLLNGSMLQRALLLQQLQGNLRGYGMASPGLAAPSLTPPQLATPNLQQFFPQATRQSLLGPPPVGVPMNPSQFNLSGRNPQKQARTSSSTTPNRKDSSSQTMPVEDKSDPPEGSEEAAEPRMDTPEDQDLPPCPEDIAKEKRTPAPEPEPCEASELPAKRLRSSEEPTEKEPPGQLQVKAQPQARMTVPKQTQTPDLLPEALEAQVLPRFQPRVLQVQAQVQSQTQPRIPSTDTQVQPKLQKQAQTQTSPEHLVLQQKQVQPQLQQEAEPQKQVQPQVHTQAQPSVQPQEHPPAQVSVQPPEQTHEQPHTQPQVSLLAPEQTPVVVHVCGLEMPPDAVEAGGGMEKTLPEPVGTQVSMEEIQNESACGLDVGECENRAREMPGVWGAGGSLKVTILQSSDSRAFSTVPLTPVPRPSDSVSSTPAATSTPSKQALQFFCYICKASCSSQQEFQDHMSEPQHQQRLGEIQHMSQACLLSLLPVPRDVLETEDEEPPPRRWCNTCQLYYMGDLIQHRRTQDHKIAKQSLRPFCTVCNRYFKTPRKFVEHVKSQGHKDKAKELKSLEKEIAGQDEDHFITVDAVGCFEGDEEEEEDDEDEEEIEVEEELCKQVRSRDISREEWKGSETYSPNTAYGVDFLVPVMGYICRICHKFYHSNSGAQLSHCKSLGHFENLQKYKAAKNPSPTTRPVSRRCAINARNALTALFTSSGRPPSQPNTQDKTPSKVTARPSQPPLPRRSTRLKT

SEQ ID NO: 4014 - protein, 898 aa, Homo sapiens; identical to SEQ ID NO: 4010

SEQ ID NO: 4015 - protein, 820 aa, Homo sapiens
PLPMAVSRGLPPQQPQQPLLNLQGTNSASLLNGSMLQRALLLQQLQGNLRGYGMASPGLAAPSLTPPQLATPNLQQFFPQATRQSLLGPPPVGVPMNPSQFNLSGRNPQKQARTSSSTTPNRKTMPVEDKSDPPEGSEEAAEPRMDTPEDQDLPPCPEDIAKEKRTPAPEPEPCEASELPAKRLRSSEEPTEKEPPGQLQVKAQPQARMTVPKQTQTPDLLPEALEAQVLPRFQPRVLQVQAQVQSQTQPRIPSTDTQVQPKLQKQAQTQTSPEHLVLQQKQVQPQLQQEAEPQKQVQPQVQPQAHSQGPRQVQLQQEAEPLKQVQPQVQPQAHSQPPRQVQLQLQKQVQTQTYPQVHTQAQPSVQPQEHPPAQVSVQPPEQTHEQPHTQPQVSLLAPEQTPVVVHVCGLEMPPDAVEAGGGMEKTLPEPVGTQVSMEEIQNESACGLDVGECENRAREMPGVWGAGGSLKVTILQSSDSRAFSTVPLTPVPRPSDSVSSTPAATSTPSKQALQFFCYICKASCSSQQEFQDHMSEPQHQQRLGEIQHMSQACLLSLLPVPRDVLETEDEEPPPRRWCNTCQLYYMGDLIQHRRTQDHKIAKQSLRPFCTVCNRYFKTPRKFVEHVKSQGHKDKAKELKSLEKEIAGQDEDHFITVDAVGCFEGDEEEEEDDEDEEEIEVEEELCKQVRSRDISREEWKGSETYSPNTAYGVDFLVPVMGYICRICHKFYHSNSGAQLSHCKSLGHFENLQKYKAAKNPSPTTRPVSRRCAINARNALTALFTSSGRPPSQPNTQDKTPSKVTARPSQPPLPRRSTRLKT

SEQ ID NO: 4016 - protein, 168 aa, Homo sapiens
MFSQQQQQQLQQQQQQLQQLQQQQLQQQQLQQQQLLQLQQLLQQSPPQAPLPMAVSRGLPPQQPQQPLLNLQGTNSASLLNGSMLQRALLLQQLQGLDQFAMPPATYDTAGLTMPTATLGNLRGYGMASPGLAAPSLTPPQLATPNLQQFFPQATRQSLLGPPPVGVP

SEQ ID NO: 4017 - protein, 837 aa, Homo sapiens
MFSQQQQQQLQQQQQAPLPMAVSRGLPPQQPQQPLLNLQGTNSASLLNGSMLQRALLLQQLQGLDQFAMPPATYDTAGLTMPTATLGNLRGYGMASPGLAAPSLTPPQLATPNLQQFFPQATRQSLLGPPPVGVPMNPSQFNLSGRNPQKQARTSSSTTPNRKDSSSQTMPVEDKSDPPEGSEEAAEPRMDTPEDQDLPPCPEDIAKEKRTPAPEPEPCEASELPAKRLRSSEEPTEKEPPGQLQVKAQPQARMTVPKQTQTPDLLPEALEAQVLPRFQPRVLQVQAQVQSQTQPRIPSTDTQVQPKLQKQAQTQTSPEHLVLQQKQVQPQLQQEAEPQKQVQPQVQPQAHSQGPRQVQLQQEAEPLKQVQPQVHTQAQPSVQPQEHPPAQVSVQPPEQTHEQPHTQPQVSLLAPEQTPVVVHVCGLEMPPDAVEAGGGMEKTLPEPVGTQVSMEEIQNESACGLDVGECENRAREMPGVWGAGGSLKVTILQSSDSRAFSTVPLTPVPRPSDSVSSTPAATSTPSKQALQFFCYICKASCSSQQEFQDHMSEPQHQQRLGEIQHMSQACLLSLLPVPRDVLETEDEEPPPRRWCNTCQLYYMGDLIQHRRTQDHKIAKQSLRPFCTVCNRYFKTPRKFVEHVKSQGHKDKAKELKSLEKEIAGQDEDHFITVDAVGCFEGDEEEEEDDEDEEEIEVEEELCKQVRSRDISREEWKGSETYSPNTAYGVDFLVPVMGYICRICHKFYHSNSGAQLSHCKSLGHFENLQKYKAAKNPSPTTRPVSRRCAINARNALTALFTSSGRPPSQPNTQDKTPSKVTARPSQPPLPRRSTRLKT

SEQ ID NO: 4018 - protein, 924 aa, Homo sapiens
MFSQQQQQQLQQQQQQLQQLQQQQLQQQQLQQQQLLQLQQLLQQSPPQAPLPMAVSRGLPPQQPQQPLLNLQGTNSASLLNGSMLQRALLLQQLQGLDQFAMPPATYDTAGLTMPTATLGNLRGYGMASPGLAAPSLTPPQLATPNLQQFFPQATRQSLLGPPPVGVPMNPSQFNLSGRNPQKQARTSSSTTPNRKDSSSQTMPVEDKSDPPEGSEEAAEPRMDTPEDQDLPPCPEDIAKEKRTPAPEPEPCEASELPAKRLRSSEEPTEKEPPGQLQVKAQPQARMTVPKQTQTPDLLPEALEAQVLPRFQPRVLQVQAQVQSQTQPRIPSTDTQVQPKLQKQAQTQTSPEHLVLQQKQVQPQLQQEAEPQKQVQPQVQPQAHSQGPRQVQLQQEAEPLKQVQPQVQPQAHSQPPRQVQLQLQKQVQTQTYPQVHTQAQPSVQPQEHPPAQVSVQPPEQTHEQPHTQPQVSLLAPEQTPVVVHVCGLEMPPDAVEAGGGMEKTLPEPVGTQVSMEEIQNESACGLDVGECENRAREMPGVWGAGGSLKVTILQSSDSRAFSTVPLTPVPRPSDSVSSTPAATSTPSKQALQFFCYICKASCSSQQEFQDHMSEPQHQQRLGEIQHMSQACLLSLLPVPRDVLETEDEEPPPRRWCNTCQLYYMGDLIQHRRTQDHKPPTPRRDVFAHVPVQGWSTARLVTDMIAKQSLRPFCTVCNRYFKTPRKFVEHVKSQGHKDKAKELKSLEKEIAGQDEDHFITVDAVGCFEGDEEEEEDDEDEEEIEVEEELCKQVRSRDISREEWKGSETYSPNTAYGVDFLVPVMGYICRICHKFYHSNSGAQLSHCKSLGHFENLQKYKAAKNPSPTTRPVSRRCAINARNALTALFTSSGRPPSQPNTQDKTPSKVTARPSQPPLPRRSTRLKT

SEQ ID NO: 4019 - protein, 797 aa, Homo sapiens
MPPATYDTAGLTMPTATLGNLRGYGMASPGLAAPSLTPPQLATPNLQQFFPQATRQSLLGPPPVGVPMNPSQFNLSGRNPQKQARTSSSTTPNRKDSSSQTMPVEDKSDPPEGSEEAAEPRMDTPEDQDLPPCPEDIAKEKRTPAPEPEPCEASELPAKRLRSSEEPTEKEPPGQLQVKAQPQARMTVPKQTQTPDLLPEALEAQVLPRFQPRVLQVQAQVQSQTQPRIPSTDTQVQPKLQKQAQTQTSPEHLVLQQKQVQPQLQQEAEPQKQVQPQVQPQAHSQGPRQVQLQQEAEPLKQVQPQVQPQAHSQPPRQVQLQLQKQVQTQTYPQVHTQAQPSVQPQEHPPAQVSVQPPEQTHEQPHTQPQVSLLAPEQTPVVVHVCGLEMPPDAVEAGGGMEKTLPEPVGTQVSMEEIQNESACGLDVGECENRAREMPGVWGAGGSLKVTILQSSDSRAFSTVPLTPVPRPSDSVSSTPAATSTPSKQALQFFCYICKASCSSQQEFQDHMSEPQHQQRLGEIQHMSQACLLSLLPVPRDVLETEDEEPPPRRWCNTCQLYYMGDLIQHRRTQDHKIAKQSLRPFCTVCNRYFKTPRKFVEHVKSQGHKDKAKELKSLEKEIAGQDEDHFITVDAVGCFEGDEEEEEDDEDEEEIEVEEELCKQVRSRDISREEWKGSETYSPNTAYGVDFLVPVMGYICRICHKFYHSNSGAQLSHCKSLGHFENLQKYKAAKNPSPTTRPVSRRCAINARNALTALFTSSGRPPSQPNTQDKTPSKVTARPSQPPLPRRSTRLKT

SEQ ID NO: 4020 - protein, 580 aa, Homo sapiens
MAQEVSEYLSQNPRVAAWVEALRCDGETDKHWRHRRDFLLRNAGDLAPAGGAASASTDEAADAESGTRNRQLQQLISFSMAWANHVFLGCRYPQKVMDKILSMAEGIKVTDAPTYTTRDELVAKVKKRGISSSNEGVEEPSKKRVIEGKNSSAVEQDHAKTSAKTERASAQQENSSTCIGSAIKSESGNSARSSGISSQNSSTSDGDRSVSSQSSSSVSSQVTTAGSGKASEAEAPDKHGSASFVSLLKSSVNSHMTQSTDSRQQSGSPKKSALEGSSASASQSSSEIEVPLLGSSGSSEVELPLLSSKPSSETASSGLTSKTSSEASVSSSVAKNSSSSGTSLLTPKSSSSTNTSLLTSKSTSQVAASLLASKSSSQTSGSLVSKSTSLASVSQLASKSSSQTSTSQLPSKSTSQSSESSVKFSCKLTNEDVKQKQPFFNRLYKTVAWKLVAVGGFSPNVNHGELLNAAIEALKATLDVFFVPLKELADLPQNKSSQESIVCELRCKSVYLGTGCGKSKENAKAVASREALKLFLKKKVVVKICKRKYRGSEIEDLVLLDEESRPVNLPPALKHPQELL

SEQ ID NO: 4021 - protein, 187 aa, Homo sapiens
MPGERPTDATVIPSAKRERKAITLDLKLEVLRRFEAGEKLSQIAKALDLAISTVATIRDSKEKIKASSQIATPLRASRLTRHRSAVMESMEQLLSLWLEDQSQPNATLSAAIVQEKAEFDDLQREHGEGSQTERFHASQGWLVRFKECHCLPHFKMNSAAPSNKDMYTEMLKSIIEEGEYTPQVSLT

SEQ ID NO: 4022 - protein, 103 aa, Homo sapiens
MALSTIVSQRKQIKRKAPRGFLKRVFKRKKPQLRLEKSGDLLVRFHPFSGWEWGTGEVHLNCLLFVHRLAEESRTNACASKCRVINKEHVLAAAKVILKKSRG

SEQ ID NO: 4023 - protein, 67 aa, Homo sapiens
MALSTIVSQRKQIKRKAPRGFLKRVFKRKKPQLRLEKSGDLLKSPGQTLVRVNVESLTRSMYWPQQR

SEQ ID NO: 4024 - protein, 88 aa, Homo sapiens
MALSTIVSQRKQIKRKAPRGFLKRVFKRKKPQLRLEKSGDLLVHLNCLLFVHRLAEESRTNACASKCRVINKEHVLAAAKVILKKSRG

SEQ ID NO: 4025 - protein, 131 aa, Homo sapiens
MADVVVGKDKGGEQRLISLPLSRIRVIMKSSPEVSSINQEALVLTAKATELFVQCLATYSYRHGSGKEKKVLTYSDLANTAQQSETFQFLADILPKKILASKYLKMLKEEKREEDEENDNDNESDHDEADS

SEQ ID NO: 4026 - protein, 956 aa, Homo sapiens
MLEELECGAPGARGAATAMDCKDRPAFPVKKLIQARLPFKRLNLVPKGKADDMSDDQGTSVQSKSPDLEASLDTLENNCHVGSDIDFRPKLVNGKGPLDNFLRNRIETSIGQSTVIIDLTEDSNEQPDSLVDHNKLNSEASPSREAINGQREDTGDQQGLLKAIQNDKLAFPGETLSDIPCKTEEEGVGCGGAGRRGDSQECSPRSCPELTSGPRMCPRKEQDSWSEAGGILFKGKVPMVVLQDILAVRPPQIKSLPATPQGKNMTPESEVLESFPEEDSVLSHSSLSSPSSTSSPEGPPAPPKQHSSTSPFPTSTPLRRITKKFVKGSTEKNKLRLQRDQERLGKQLKLRAEREEKEKLKEEAKRAKEEAKKKKEEEKELKEKERREKREKDEKEKAEKQRLKEERRKERQEALEAKLEEKRKKEEEKRLREEEKRIKAEKAEITRFFQKPKTPQAPKTLAGSCGKFAPFEIKEHMVLAPRRRTAFHPDLCSQLDQLLQQQSGEFSFLKDLKGRQPLRSGPTHVSTRNADIFNSDVVIVERGKGDGVPERRKFGRMKLLQFCENHRPAYWGTWNKKTALIRARDPWAQDTKLLDYEVDSDEEWEEEEPGESLSHSEGDDDDDMGEDEDEDDGFFVPHGYLSEDEGVTEECADPENHKVRQKLKAKEWDEFLAKGKRFRVLQPVKIGCVWAADRDCAGDDLKVLQQFAACFLETLPAQEEQTPKASKRERRDEQILAQLLPLLHGNVNGSKVIIREFQEHCRRGLLSNHTGSPRSPSTTYLHTPTPSEDAAIPSKSRLKRLISENSVYEKRPDFRMCWYVHPQVLQSFQQEHLPVPCQWSYVTSVPSAPKEDSGSVPSTGPSQGTPISLKRKSAGSMCITQFMKKRRHDGQIGAEDMDGFQADTEEEEEEEGDCMIVDVPDAAEVQAPCGAASGAGGGVGVDTGKATLTSSPLGAS

SEQ ID NO: 4027 - protein, 749 aa, Homo sapiens
MLEELECGAPGARGAATAMDCKDRPAFPVKKLIQARLPFKRLNLVPKGKADDMSDDQGTSVQSKSPDLEASLDTLENNCHVGSDIDFRPKLVNGKGPLDNFLRNRIETSIGQSTVIIDLTEDSNEQPDSLVDHNKLNSEASPSREAINGQREDTGDQQGLLKAIQNDKLAFPGETLSDIPCKTEEEGVGCGGAGRRGDSQECSPRSCPELTSGPRMCPRKEQDSWSEAGGILFKGKVPMVVLQDILAVRPPQIKSLPATPQGKNMTPESEVLESFPEEDSVLSHSSLSSPSSTSSPEGPPAPPKQHSSTSPFPTSTPLRRITKKFVKGSTEKNKLRLQRDQERLGKQLKLRAEREEKEKLKEEAKRAKEEAKKKKEEEKELKEKERREKREKDEKEKAEKQRLKEERRKERQEALEAKLEEKRKKEEEKRLREEEKRIKAEKAEITRFFQKPKTPQAPKTLAGSCGKFAPFEIKEHMVLAPRRRTAFHPDLCSQLDQLLQQQSGEFSFLKDLKGRQPLRSGPTHVSTRNADIFNSDVVIVERGKGDGVPERRKFGRMKLLQFCENHRPAYWGTWNKKTALIRARDPWAQDTKLLDYEVDSDEEWEEEEPGESLSHSEGDDDDDMGEDEDEDDGFFVPHGYLSEDEGVTEECADPENHKVRQKLKAKEWDEFLAKGKRFRVLQPVKIGCVWAADRDCAGDDLKVLQQFAAHWVHPESRGDVCRMLRVSSPQSRYLNRLNSCVKSTLSCFT

SEQ ID NO: 4028 - protein, 783 aa, Homo sapiens
MLEELECGAPGARGAATAMDCKDRPAFPVKKLIQARLPFKRLNLVPKGKADDMSDDQGTSVQSKSPDLEASLDTLENNCHVGSDIDFRPKLVNGKGPLDNFLRNRIETSIGQSTVIIDLTEDSNEQPDSLVDHNKLNSEASPSREAINGQREDTGDQQGLLKAIQNDKLAFPGETLSDIPCKTEEEGVGCGGAGRRGDSQECSPRSCPELTSGPRMCPRKEQDSWSEAGGILFKGKVPMVVLQDILAVRPPQIKSLPATPQGKNMTPESEVLESFPEEDSVLSHSSLSSPSSTSSPEGPPAPPKQHSSTSPFPTSTPLRRITKKFVKGSTEKNKLRLQRDQERLGKQLKLRAEREEKEKLKEEAKRAKEEAKKKKEEEKELKEKERREKREKDEKEKAEKQRLKEERRKERQEALEAKLEEKRKKEEEKRLREEEKRIKAEKAEITRFFQKPKTPQAPKTLAGSCGKFAPFEIKEHMVLAPRRRTAFHPDLCSQLDQLLQQQSGEFSFLKDLKGRQPLRSGPTHVSTRNADIFNSDVVIVERGKGDGVPERRKFGRMKLLQFCENHRPAYWGTWNKKTALIRARDPWAQDTKLLDYEVDSDEEWEEEEPGESLSHSEGDDDDDMGEDEDEDDGFFVPHGYLSEDEGVTEECADPENHKVRQKLKAKEWDEFLAKGKRFRVLQPVKIGCVWAADRDCAGDDLKVLQQFAACFLETLPAQEEQTPKASKRERRDEQILAQLLPLLHGNVNGSKVIIREFQEHCRRGLLSNHTGKATLTSSPLGAS

SEQ ID NO: 4029 - protein, 172 aa, Homo sapiens
MTSASTKVGEIFSAAGAAFTKLGELTMQLHPVADSSPAGAKWTETEIEMLRAAVKRFGDDLNHISCVIKERTVAQIKATVKRKVYEDSGIPLPAESPKKGPKKVASGVLSPPPAAPPPSSSSVPEAGGPPIKKQKADVTLSALNDSDANSDVVDIEGLGETPPAKKLNFDQA

SEQ ID NO: 4030 - protein, 192 aa, Homo sapiens
MTSASTKVGEIFSAAGAAFTKLGELTMQLHPVADSSPAGAKWTETEIEMLRAAVKRFGDDLNHISCVIKERTVAQIKATVKRKVYEDSGIPLPAESPKKGPKKVASGVLSPPPAAPPPSSSSVPEAGGPPIKKQKADVTLSALNDSDANSDVVDIEGLGETPPAKKLNFDQDSLTLDSGLLMTSADPPLLSC

SEQ ID NO: 4031 - protein, 138 aa, Homo sapiens
MTSASTKVGEIFSAAGAAFTKLGELTMQLHPVADSSPAGAQIKATVKRKVYEDSGIPLPAESPKKGPKKVASGVLSPPPAAPPPSSSSVPEAGGPPIKKQKADVTLSALNDSDANSDVVDIEGLGETPPAKKLNFDQA

SEQ ID NO: 4032 - protein, 101 aa, Homo sapiens
MASNKTTLQKMGKKQNGKSKKVEEAEPEEFVVEKVLDRRVVNGKVEYFLKWKGFTEKLAKKKMVQKENLYLTVNLMTANQRRKEMLLTNQEDLPEVLILKE

SEQ ID NO: 4033 - protein, 394 aa, Homo sapiens
MELSAVGERVFAAESIIKRRIRKGRIEYLVKWKGWAIKYSTWEPEENILDSRLIAAFEQKERERELYGPKKRGPKPKTFLLKPSASASSPKLHSSAAVHRLKKDIRRCHRMSRRPLPRPDPQGGSPGLRPPISPFSETVRIINRKVKPREPKRNRIILNLKVIDKGAGGGGAGQGAGALARPKVPSRNRVIGKSKKFSESVLRTQIRHMKFGAFALYKPPPAPLVAPSPGKAEASAPGPGLLLAAPAAPYDARSSGSSGCPSPTPQSSDPDDTPPKLLPETVSPSAPSWREPEVLDLSLPPESAATSKRAPPEVTAAAGPAPPTAPEPAGASSEPEAGDWRPEMSPCSNVVVTDVTSNLLTVTIKEFCNPEDFEKVAAGVAGAAGGGGSIGASK

SEQ ID NO: 4034 - protein, 412 aa, Homo sapiens
MELSAVGERVFAAESIIKRRIRKGRIEYLVKWKGWAIKYSTWEPEENILDSRLIAAFEQKERERELYGPKKRGPKPKTFLLKARAQAEALRISDVHFSVKPSASASSPKLHSSAAVHRLKKDIRRCHRMSRRPLPRPDPQGGSPGLRPPISPFSETVRIINRKVKPREPKRNRIILNLKVIDKGAGGGGAGQGAGALARPKVPSRNRVIGKSKKFSESVLRTQIRHMKFGAFALYKPPPAPLVAPSPGKAEASAPGPGLLLAAPAAPYDARSSGSSGCPSPTPQSSDPDDTPPKLLPETVSPSAPSWREPEVLDLSLPPESAATSKRAPPEVTAAAGPAPPTAPEPAGASSEPEAGDWRPEMSPCSNVVVTDVTSNLLTVTIKEFCNPEDFEKVAAGVAGAAGGGGSIGASK

SEQ ID NO: 4035 - protein, 389 aa, Homo sapiens
MELSAVGERVFAAEALLKRRIRKGRMEYLVKWKGWSQKYSTWEPEENILDARLLAAFEEREREMELYGPKKRGPKPKTFLLKAQAKAKAKTYEFRSDSARGIRIPYPGRSPQDLASTSRAREGLRNMGLSPPASSTSTSSTCRAEAPRDRDRDRDRDRERDRERERERERERERERERERGTSRVDDKPSSPGDSSKKRGPKPRKELPDPSQRPLGEPSAGLGEYLKGRKLDDTPSGAGKFPAGHSVIQLARRQDSDLVQCGVTSPSSAEATGKLAVDTFPARVIKHRAAFLEAKGQGALDPNGTRVRHGSGPPSSGGGLYRDMGAQGGRPSLIARIPVARILGDPEEESWSPSLTNLEKVVVTDVTSNFLTVTIKESNTDQGFFKEKR

SEQ ID NO: 4036 - protein, 822 aa, Homo sapiens
MKMKIQKKEKQLSNLKVLNHSPMSDASVNFDYKSPSPFDCSTDQEEKIEDVASHCLPQKDLYTAEEEAATLFPRKMTSHNGMEDSGGGGTGVKKKRKKKEPGDQEGAAKGSKDREPKPKRKREPKEPKEPRKAKEPKKAKEHKEPKQKDGAKKARKPREASGTKEAKEKRSCTDSAARTKSRKASKEQGPTPVEKKKKGKRKSETTVESLELDQGLTNPSLRSPEESTESTDSQKRRSGRQVKRRKYNEDLDFKVVDDDGETIAVLGAGRTSALSASTLAWQAEEPPEDDANIIEKILASKTVQEVHPGEPPFDLELFYVKYRNFSYLHCKWATMEELEKDPRIAQKIKRFRNKQAQMKHIFTEPDEDLFNPDYVEVDRILEVAHTKDAETGEEVTHYLVKWCSLPYEESTWELEEDVDPAKVKEFESLQVLPEIKHVERPASDSWQKLEKSREYKNSNQLREYQLEGMNWLLFNWYNRKNCILADEMGLGKTIQSITFLSEIFLRGIHGPFLIIAPLSTITNWEREFRTWTEMNAIVYHGSQISRQMIQQYEMVYRDAQGNPLSGVFKFHVVITTFEMILADCPDLKKIFWGRWKDILTHGRFKWHLNEKDMEMICRALLVYCVKHYKGDEKIKSFIWELITPTKDGQAQTLQNHSGLSAPVPRGRKGKKTKNQLLIPELKDADWLATCNPEVVLHDDGYKKHLKQHCNKVLLRVRMLYYLKAEILGEAAEKAFEGSPARELDVPLPDIDYMEIPVDWWDAEADKSLLIGVFKHGYERYNAMRADPALCFLEKVGMPDEKSLSAEQGVTDGTSDIPERQHR

SEQ ID NO: 4037 - protein, 373 aa, Homo sapiens
MCQSHMIGFCTSSVNEETETQGDQISCPNPTTLVFRTQISSLPSLQLSNLKVLNHSPMSDASVNFDYKSPSPFDCSTDQEEKIEDVASHCLPQKDLYTAEEEAATLFPRKMTSHNGMEDSGGGGTGVKKKRKKKEPGDQEGAAKGSKDREPKPKRKREPKEPKEPRKAKEPKKAKEHKEPKQKDGAKKARKPREASGTKEAKEKRSCTDSAARTKSRKASKEQGPTPVEKKKKGKRKSETTVESLELDQGLTNPSLRSPEESTESTDSQKRRSGRQVKRRKYNEDLDFKVVDDDGETIAVLGAGRTSALSASTLAWQAEEPPEDDANIIEKILASKTVQEVHPGEPPFDLELFYVKYRNLYVYLKYSLYLGFI

SEQ ID NO: 4038 - protein, 2715 aa, Homo sapiens
MKMKIQKKEKQLSNLKVLNHSPMSDASVNFDYKSPSPFDCSTDQEEKIEDVASHCLPQKDLYTAEEEAATLFPRKMTSHNGMEDSGGGGTGVKKKRKKKEPGDQEGAAKGSKDREPKPKRKREPKEPKEPRKAKEPKKAKEHKEPKQKDGAKKARKPREASGTKEAKEKRSCTDSAARTKSRKASKEQGPTPVEKKKKGKRKSETTVESLELDQGLTNPSLRSPEESTESTDSQKRRSGRQVKRRKYNEDLDFKVVDDDGETIAVLGAGRTSALSASTLAWQAEEPPEDDANIIEKILASKTVQEVHPGEPPFDLELFYVKYRNFSYLHCKWATMEELEKDPRIAQKIKRFRNKQAQMKHIFTEPDEDLFNPDYVEVDRILEVAHTKDAETGEEVTHYLVKWCSLPYEESTWELEEDVDPAKVKEFESLQVLPEIKHVERPASDSWQKLEKSREYKNSNQLREYQLEGMNWLLFNWYNRKNCILADEMGLGKTIQSITFLSEIFLRGIHGPFLIIAPLSTITNWEREFRTWTEMNAIVYHGSQISRQMIQQYEMVYRDAQGNPLSGVFKFHVVITTFEMILADCPELKKIHWSCVIIDEAHRLKNRNCKLLEGLKLMALEHKVLLTGTPLQNSVEELFSLLNFLEPSQFPSETAFLEEFGDLKTEEQVKKLQSILKPMMLRRLKDDVEKNLAPKQETIIEVELTNIQKKYYRAILEKNFSFLTKGANQHNMPNLINTMMELRKCCNHPYLINGAEEKILEDFRKTHSPDAPDFQLQAMIQAAGKLVLIDKLLPKLIAGGHKVLIFSQMVRCLDILEDYLIQRRYTYERIDGRVRGNLRQAAIDRFCKPDSDRFVFLLCTRAGGLGINLTAADTCIIFDSDWNPQNDLQAQARCHRIGQSKAVKVYRLITRNSYEREMFDKASLKLGLDKAVLQDINRKGGTNGVQQLSKMEVEDLLRKGAYGALMDEEDEGSKFCEEDIDQILQRRTHTITIQSEGKGSTFAKASFVASGNRTDISLDDPNFWQKWAKIAELDTEAKNEKESLVIDRPRVRKQTKHYNSFEEDELMEFSELDSDSDERPTRSRRLNDKARRYLRAECFRVEKNLLIFGWGRWKDILTHGRFKWHLNEKDMEMICRALLVYCVKHYKGDEKIKSFIWELITPTKDGQAQTLQNHSGLSAPVPRGRKGKKTKNQLLIPELKDADWLATCNPEVVLHDDGYKKHLKQHCNKVLLRVRMLYYLKAEILGEAAEKAFEGSPARELDVPLPDIDYMEIPVDWWDAEADKSLLIGVFKHGYERYNAMRADPALCFLEKVGMPDEKSLSAEQGVTDGTSDIPERGNTDKEDNAEDKVDGLQKQTESSSDGGDGVFSEKKDDSRAAQDGSDPDKSPWPVSSALTARLRRLVTVYQRCNRKELCRPEILGPGNQGYWVQEEMFRRTSEMDLINKEAQKRWTRREQADFYRTVSSFGVVYDQEKKTFDWTQFRIISRLDKKSDESLEQYFYSFVAMCRNVCRLPTWKDGGPPDTTIYVEPITEERAARTLYRIELLRKVREQVLKCPQLHERLQLCRPSLYLPVWWECGKHDRDLLIGTAKHGLNRTDCYIMNDPQLSFLDAYRNYAQHKRSGTQAPGNLCCLYQTNSKLYESLTYSQMSRTSESLENEPENLVRVESRDDHLSLPDVTCENFISKVQDVISINHDESLLPESLESMMYGKKVLSQEPSSFQESPSTNTESRKDVITISISKDGNCQSGGPEAEIASGPTFMGSLEAGGVAQANIKNGKHLLMSISKEGELCCSEAGQRPENIGQLEAKCLASPSLNPGNESGFVDMCSLSVCDSKRNLSSDQQLIDLLENKSLESKLILSQNHSDEEEEEEENEEENLAMAVGMGERPEVLHLTEPTTNISREKNQGFQDETKKGSLEVANQTPGLQRAFPAPAACQCHCKHMERWMHGLENDEFEIEKPKAYIPDLFKSKTNTIAMEGEPTAIPSQPFKVKHELLKEPWKESAEGQNVFPTYPLEGSELKSEDMDFENKDDYDRDGNCHSQDYPGKYSEEESKSSTSGITGDIGDELQEARAPTIAQLLQEKTLYSFSEWPKDRVIINRLDNICHVVLKGKWPSSQQYEPSGTLPTPVLTSSAGSRTSLSEPEAAEHSFSNGAALAAQIHKESFLAPVFTKDEQKHRRPYEFEVERDAKARGLEQFSATHGHTPIILNGWHGESAMDLSCSSEGSPGATSPFPVSASTPKIGAISSLQGALGMDLSGILQAGLIHPVTGQIVNGSLRRDDAATRRRRGRRKHVEGGMDLIFLKEQTLQAGILEVHEDPGQATLSTTHPEGPGPATSAPEPATAASSQAEKSIPSKSLLDWLRQQADYSLEVPGFGANFSDKPKQRRPRCKEPGKLDVSSLSGEERVPAIPKEPGLRGFLPENKFNHTLAEPILRDTGPRRRGRRPRSELLKAPSIVADSPSGMGPLFMNGLIAGMDLVGLQNMRNMPGIPLTGLVGFPAGFATMPTGEEVKSTLSMLPMMLPGMAAVPQMFGVGGLLSPPMATTCTSTAPASLSSTTKSGTAVTEKTAEDKPSSHDVKTDTLAEDKPGPGPFSDQSEPAITTSSPVAFNPFLIPGVSPGLIYPSMFLSPGMGMALPAMQQARHSEIVGLESQKRKKKKTKGDNPNSHPEPAPSCEREPSGDENCAEPSAPLPAEREHGAQAGEGALKDSNNDTN

SEQ ID NO: 4039 - protein, 149 aa, Homo sapiens
MKMKIQKKEKQLSNLKVLNHSPMSDASVNFDYKSPSPFDCSTDQEEKIEDVASHCLPQKDLYTAEEEAATLFPRKMTSHNGMEDSGGGGTGVKKKRKKKEPGDQEGAAKGSKDREPKPKRKREPKEPKEPRKAKEPKKAKEHKEPKQKD

SEQ ID NO: 4040 - protein, 525 aa, Homo sapiens
  MOD_RES (1)..(1): Any amino acid
XASKTVQEVHPGEPPFDLELFYVKYRNFSYLHCKWATMEELEKDPRIAQKIKRFRNKQAQMKHIFTEPDEDLFNPDYVEVDRILEVAHTKDAETGEEVTHYLVKWCSLPYEESTWELEEDVDPAKVKEFESLQVLPEIKHVERPASDSWQKLEKSREYKNSNQLREYQLEGMNWLLFNWYNRKNCILADEMGLGKTIQSITFLSEIFLRGIHGPFLIIAPLSTITNWEREFRTWTEMNAIVYHGSQISRQMIQQYEMVYRDAQGNPLSGVFKFHVVITTFEMILADCPELKKIHWGRWKDILTHGRFKWHLNEKDMEMICRALLVYCVKHYKGDEKIKSFIWELITPTKDGQAQTLQNHSGLSAPVPRGRKGKKTKNQLLIPELKDADWLATCNPEVVLHDDGYKKHLKQHCNKVLLRVRMLYYLKAEILGEAAEKAFEGSPARELDVPLPDIDYMEIPVDWWDAEADKSLLIGVFKHGYERYNAMRADPALCFLEKVGMPDEKSLSAEQGVTDGTSDIPERQHR

SEQ ID NO: 4041 - protein, 506 aa, Homo sapiens
MASGDLYEVERIVDKRKNKKGKWEYLIRWKGYGSTEDTWEPEHHLLHCEEFIDEFNGLHMSKDKRIKSGKQSSTSKLLRDSRGPSVEKLSHRPSDPGKSKGTSHKRKRINPPLAKPKKGYSGKPSSGGDRATKTVSYRTTPSGLQIMPLKKSQNGMENGDAGSEKDERHFGNGSHQPGLDLNDHVGEQDMGECDVNHATLAENGLGSALTNGGLNLHSPVKRKLEAEKDYVFDKRLRYSVRQNESNCRFRDIVVRKEEGFTHILLSSQTSDNNALTPEIMKEVRRALCNAATDDSKLLLLSAVGSVFCSGLDYSYLIGRLSSDRRKESTRIAEAIRDFVKAFIQFKKPIVVAINGPALGLGASILPLCDIVWASEKAWFQTPYATIRLTPAGCSSYTFPQILGVALANEMLFCGRKLTAQEACSRGLVSQVFWPTTFSQEVMLRVKEMASCSAVVLEESKCLVRSFLKSVLEDVNEKECLMLKQLWSSSKGLDSLFSYLQDKIYEV

SEQ ID NO: 4042 - protein, 554 aa, Homo sapiens
MASQEFEVEAIVDKRQDKNGNTQYLVRWKGYDKQDDTWEPEQHLMNCEKCVHDFNRRQTEKQKKLTWTTTSRIFSNNARRRTSRSTKANYSKNSPKTPVTDKHHRSKNRKLFAASKNVRRKAASILSDTKNMEIINSTIETLAPDSPFDHKTVSGFQKLEKLDPIAADQQDTVVFKVTEGKLLRDPLSRPGAEQTGIQNKTQIHPLMSQMSGSVTASMATGSATRKGIVVLIDPLAANGTTDMHTSVPRVKGGQRNITDDSRDQPFIKKMHFTIRLTESASTYRDIVVKKEDGFTQIVLSTRSTEKNALNTEVIKEIVNALNSAAADDSKLVLFSAAGSVFCCGLDFGYFVKHLRNNRNTASLEMVDTIKNFVNTFIQFKKPIVVSVNGPAIGLGASILPLCDLVWANEKAWFQTPYTTFGQSPDGCSSITFPKMMGKASANEMLIAGRKLTAREACAKGLVSQVFLTGTFTQEVMIQIKELASYNPIVLEECKALVRCNIKLELEQANERECEVLRKIWSSAQGIESMLKIPLLGYKAAFPPRKTQNDQRWCP

SEQ ID NO: 4043 - protein, 540 aa, Homo sapiens
MASQEFEVEAIVDKRQDKNGNTQYLVRWKGYDKQDDTWEPEQHLMNCEKCVHDFNRRQTEKQKKLTWTTTSRIFSNNARRRTSRSTKANYSKNSPKTPVTDKHHRSKNRKLFAASKNVRRKAASILSDTKNMEIINSTIETLAPDSPFDHKTVSGFQKLEKLDPIAADQQDTVVFKVTEGKLLRDPLSRPGAEQTGIQNKTQIHPLMSQMSGSVTASMATGSATRKGIVVLIDPLAANGTTDMHTSVPRVKGGQRNITDDSRDQPFIKKMHFTIRLTESASTYRDIVVKKEDGFTQIVLSTRSTEKNALNTEVIKEIVNALNSAAADDSKLVLFSAAGSVFCCGLDFGYFVKHLRNNRNTASLEMVDTIKNFVNTFIQFKKPIVVSVNGPAIGLGASILPLCDLVWANEKAWFQTPYTTFGQSPDGCSSITFPKMMGKASANEMLIAGRKLTAREACAKGLVSQVFLTGTFTQEVMIQIKELASYNPIVLEECKALVRCNIKLELEQANERECEVLRKIWSSAQGIESMLKYVENKIDEF

SEQ ID NO: 4044 - protein, 541 aa, Homo sapiens
MASQEFEVEAIVDKRQDKNGNTQYLVRWKGYDKQDDTWEPEQHLMNCEKCVHDFNRRQTEKQKKLTWTTTSRIFSNNARRRTSRSTKANYSKNSPKTPVTDKHHRSKNCKLFAASKNVRRKAASTLSDTKNMEIINSTIETLAPDSPFDHKKTVSGFQKLEKLDPIAADQQDTVVFKVTEGKLLRDPLSHPGAEQTGIQNKTQMHPLMSQMSGSVTASMATGSATRKGIVVLIDPLAANGTTDMHTSVPRVKGGQRNITDDSRGQPFIKKMHFTIRLTESAITYRDIVVKKEDGFTQIVLSTRSTEKNALNTEVIKEMVNALNSAAADDSKLVLFSAAGSVFCCGLDFGYFVRHLRNDRNTASLEMVDTIKNFVNTFIQFKKPIVVSVNGPAIGLGASILPLCDLVWANEKAWFQTPYTTFGQSPDGCSSITFPKMMGKASANEMLIAGRKLTAREACAKGLVSQVFLTGTFTQEVMIQIKELASYNAIVLEECKALVRCNIKLELEQANERECEVLRKIWSSAQGIESMLKYVENKIDEF

SEQ ID NO: 4045 - protein, 555 aa, Homo sapiens
MASQEFEVEAIVDKRQDKNGNTQYLVRWKGYDKQDDTWEPEQHLMNCEKCVHDFNRRQTEKQKKLTWTTTSRIFSNNARRRTSRSTKANYSKNSPKTPVTDKHHRSKNCKLFAASKNVRRKAASTLSDTKNMEIINSTIETLAPDSPFDHKKTVSGFQKLEKLDPIAADQQDTVVFKVTEGKLLRDPLSHPGAEQTGIQNKTQMHPLMSQMSGSVTASMATGSATRKGIVVLIDPLAANGTTDMHTSVPRVKGGQRNITDDSRGQPFIKKMHFTIRLTESAITYRDIVVKKEDGFTQIVLSTRSTEKNALNTEVIKEMVNALNSAAADDSKLVLFSAAGSVFCCGLDFGYFVRHLRNDRNTASLEMVDTIKNFVNTFIQFKKPIVVSVNGPAIGLGASILPLCDLVWANEKAWFQTPYTTFGQSPDGCSSITFPKMMGKASANEMLIAGRKLTAREACAKGLVSQVFLTGTFTQEVMIQIKELASYNAIVLEECKALVRCNIKLELEQANERECEVLRKIWSSAQGIESMLKIPLLGYKAAFPPRKTQNDQRWCP

SEQ ID NO: 4046 - protein, 140 aa, Homo sapiens
GPPEQSLLLTEAWSWASKKKQPHLFSGVIVGGHLWLLGFSPGAGGFCTTLPPSFLRVDDRATSSTTDSSRAPSSPRPPGSTSHCGISTRCTERCLCVLPLRTSQVPDVMAPQHDQEPKRRMYFIWLGWIPSDKPSQLTER

SEQ ID NO: 4047 - protein, 169 aa, Homo sapiens
PPEQSLLLTEAWSWASKKKQPHLFSGVIVGGHLWLLGFSPGAGGFCTTLPPSFLRVDDRATSSTTDSSRAPSSPRPPGSTSHCGISTRCTERCLCVLPLRTSQVPDVMAPQHDQEKFHDLAYSCLGKSFSMSNQDLYGYSTSSLALGLAWLSWETKKKNVLHLVGLDSL

SEQ ID NO: 4048 - protein, 188 aa, Homo sapiens
  MOD_RES (1)..(1): Any amino acid
XAQRGPGKAGLTGGRERLERGARAARTDQHQRIQEEERDLTGSGDISPPQHPSRHSFSPGAGGFCTTLPPSFLRVDDRATSSTTDSSRAPSSPRPPGSTSHCGISTRCTERCLCVLPLRTSQVPDVMAPQHDQEKFHDLAYSCLGKSFSMSNQDLYGYSTSSLALGLAWLSWETKKKNVLHLVGLDSL

SEQ ID NO: 4049 - protein, 156 aa, Homo sapiens
MFLTEDLITFNLRNFLLFQLWESSFSPGAGGFCTTLPPSFLRVDDRATSSTTDSSRAPSSPRPPGSTSHCGISTRCTERCLCVLPLRTSQVPDVMAPQHDQEKFHDLAYSCLGKSFSMSNQDLYGYSTSSLALGLAWLSWETKKKNVLHLVGLDSL

SEQ ID NO: 4050 - protein, 66 aa, Homo sapiens
  MOD_RES (1)..(1): Any amino acid
XQPQGPPEQSLLLTEAWSWASKKKQPHLFSGVIVGGHLWLLGPKRRMYFIWLGWIPSDKPSQLTER

SEQ ID NO: 4051 - protein, 1204 aa, Homo sapiens
MGDAKEAGAEGPPAGAAARGGLSLLSQGESEESSAQGSALFLGGNEVKSRAVVKYSSAPPRTAFARLEEKTDLKLPPANWLRESAKLGPAGTTILGNSKKSKPFSSFGMAYDFIDSVGNDVDVVSDSENIKKLLKIPYSKSHVSMAVHRIGRTLLLDELDIQELFMRSSQTGDWTWLKEFYQRLIDQKWQRKKKSKEHWYQKAILSKFLYYSINGDGAAQPVSSTAEQQESSSSDQTNDSEGASWPAPFEMPSSVSEDPSASSQGLKNDFVRNILWTFEDIHMLVGSNMPIFGGGRYPAVSLRLRDNNKPINVLTGIDYWLDNLICNVPELVMCFHVNGIVQKYEMIKTEEIPNLENSNFSTKVIKDIAQNILSFLKSNCTKEGHTYWLFKASGSDIVKLYDLTTLCEETEDKYQNPFTMPVAILLYKVACNMMMKKNQNKKHYGTIRTLLLNCLKLLDKSRHPQIIASANYMLSELFQLDEPKKEENSESPLNENSDESYSEEEEEMPDSDENGSYSTSSDPSDDSKAVAIIKSVGELSVPEKYKSIHQIRPSCAFPVCHDTEERCRLVLSYVLEGLKSVDSSIKKESDLPAADPSTPIPLKYEDESSRGGPEGLEKQMALFLDKMGSLQKGNYSSQSGMIPGSWQHKMKLQLILKSSKAYYVLSDAAMSLQKYGRALRYIKLALQSHDTYCCLCTNMLSEVLLFLSQYLTLCGDIQLMLAQNANNRAAHLEEFHYQTKEDQEILHSLHRESSCQGFAWATDLSTDLESQLSVSCKCYEAANEILQFSDLKSQNPEHYVQVLKRMGNIRNEIGVFYMNQAAALQSERLVSKSVSAAEQQLWKKSFSCFEKGIHNFESIEDATNAALLLCNTGRLMRICAQAHCGAGDELKREFSPEEGLYYNKAIDYYLKALRSLGTRDIHPAVWDSVNWELSTTYFTMATLQQDYAPLSRKAQEQIEKEVSEAMMKSLKYCDVDSVSARQPLCQYRAATIHHRLASMYHSCLRNQVGDEHLRKQHRVLADLHYSKAAKLFQLLKDAPCELLRVQLERVAFAEFQMTSQNSNVGKLKTLSGALDIMVRTEHAFQLIQKELIEEFGQPKSGDAAAAADASPSLNREEVMKLLSIFESRLSFLLLQSIKLLSSTKKKTSNNIEDDTILKTNKHIYSQLLRATANKTATLLERINVIVHLLGQLAAGSAASSNAVQ

SEQ ID NO: 4052 - protein, 1238 aa, Homo sapiens
MGDAKEAGAEGPPAGAAARGGLSLLSQGESEESSAQGSALFLGGNEVKSRAVVKYSSAPPRTAFARLEEKTDLKLPPANWLRESAKLGPAGTTILGNSKKSKPFSSFGMAYDFIDSVGNDVDVVSDSENIKKLLKIPYSKSHVSMAVHRIGRTLLLDELDIQELFMRSSQTGDWTWLKEFYQRLIDQKWQRKKKSKEHWYQKAILSKFLYYSINGDGAAQPVSSTAEQQESSSSDQTNDSEGASWPAPFEMPSSVSEDPSASSQGSEPLEPSYIVGHVASAPKEQNLITLFNDGEHSQGLKNDFVRNILWTFEDIHMLVGSNMPIFGGGRYPAVSLRLRDNNKPINVLTGIDYWLDNLICNVPELVMCFHVNGIVQKYEMIKTEEIPNLENSNFSTKVIKDIAQNILSFLKSNCTKEGHTYWLFKASGSDIVKLYDLTTLCEETEDKYQNPFTMPVAILLYKVACNMMMKKNQNKKHYGTIRTLLLNCLKLLDKSRHPQIIASANYMLSELFQLDEPKKEENSESPLNENSDESYSEEEEEMPDSDENGSYSTSSDPSDDSKAVAIIKSVGELSVPEKYKSIHQIRPSCAFPVCHDTEERCRLVLSYVLEGLKSVDSSIKKESDLPAADPSTPIPLKYEDESSRGGPEGLEKQMALFLDKMGSLQKGNYSSQSGMIPGSWQHKMKLQLILKSSKAYYVLSDAAMSLQKYGRALRYIKLALQSHDTYCCLCTNMLSEVLLFLSQYLTLCGDIQLMLAQNANNRAAHLEEFHYQTKEDQEILHSLHRESSCQGFAWATDLSTDLESQLSVSCKCYEAANEILQFSDLKSQNPEHYVQVLKRMGNIRNEIGVFYMNQAAALQSERLVSKSVSAAEQQLWKKSFSCFEKGIHNFESIEDATNAALLLCNTGRLMRICAQAHCGAGDELKREFSPEEGLYYNKAIDYYLKALRSLGTRDIHPAVWDSVNWELSTTYFTMATLQQDYAPLSRKAQEQIEKEVSEAMMKSLKYCDVDSVSARQPLCQYRAATIHHRLASMYHSCLRNQVGDEHLRKQHRVLADLHYSKAAKLFQLLKDAPCELLRVQLERVAFAEFQMTSQNSNVGKLKTLSGALDIMVRTEHAFQLIQKELIEEFGQPKSGDAAAAADASPSLNREEVMKLLSIFESRLSFLLLQSIKLLSSTKKKTSNNIEDDTILKTNKHIYSQLLRATANKTATLLERINVIVHLLGQLAAGSAASSNAVQ

SEQ ID NO: 4053 - protein, 317 aa, Homo sapiens
SIHQIRPSCAFPVCHDTEERCRLVLSYVLEGLKSVDSSIKKESDLPAADPSTPIPLKYEDESSRGGPEGLEKQMALFLDKMGSLQKGNYSSQSGMIPGSWQHKMKLQLILKSSKAYYVLSDAAMSLQKYGRALRYIKLALQSHDTYCCLCTNMLSEVLLFLSQYLTLCGDIQLMLAQNANNRAAHLEEFHYQTKEDQEILHSLHRESSCQGVPQAWTTWFTVGLCSLAHAYLSIQKRGRNIRVLIFALYLFIYFLRRSFALVAQAGVQWCNLGSLKPPPPGFKQFSCLSLPSSWNYRHAPPCPASPPWPPKVLGLQV

SEQ ID NO: 4054 - protein, 796 aa, Homo sapiens
MGDAKEAGAEGPPAGAAARGGLSLLSQGESEESSAQGSALFLGGNEVKSRAVVKYSSAPPRTAFARLEEKTDLKLPPANWLRESAKLGPAGTTILGNSKKSKPFSSFGMAYDFIDSVGNDVDVVSDSENIKKLLKIPYSKSHVSMAVHRIGRTLLLDELDIQELFMRSSQTGDWTWLKEFYQRLIDQKWQRKKKSKEHWYQKAILSKFLYYSINGDGAAQPVSSTAEQQESSSSDQTNDSEGASWPAPFEMPSSVSEDPSASSQGSEPLEPSYIVGHVASAPKEQNLITLFNDGEHSQGLKNDFVRNILWTFEDIHMLVGSNMPIFGGGRYPAVSLRLRDNNKPINVLTGIDYWLDNLICNVPELVMCFHVNGIVQKYEMIKTEEIPNLENSNFSTKVIKDIAQNILSFLKSNCTKEGHTYWLFKASGSDIVKLYDLTTLCEETEDKYQNPFTMPVAILLYKVACNMMMKKNQNKKHYGTIRTLLLNCLKLLDKSRHPQIIASANYMLSELFQLDEPKKEENSESPLNENSDESYSEEEEEMPDSDENGSYSTSSDPSDDSKAVAIIKSVGELSVPEKYKSIHQIRPSCAFPVCHDTEERCRLVLSYVLEGLKSVDSSIKKESDLPAADPSTPIPLKYEDESSRGGPEGLEKQMALFLDKMGSLQKGNYSSQSGMIPGSWQHKMKLQLILKSSKAYYVLSDAAMSLQKYGRALRYIKLALQSHDTYCCLCTNMLSEVLLFLSQYLTLCGDIQLMLAQNANNRAAHLEEFHYQTKEDQEILHSLHRESSCQVFRKGV

SEQ ID NO: 4055 - protein, 829 aa, Homo sapiens
MGDLKSGFEEVDGVRLGYLIIKGKQMFALSQVFTDLLKNIPRTTVHKRMDHLKVKKHHCDLEELRKLKAINSIAFHAAKCTLISREDVEALYTSCKTERVLKTKRRRVGRALATKAPPPERAAAASPRPGFWKDKHQLWRGLSGAARPLPISAQSQRPGAAAARPAAHLPQIFSKYPGSHYPEIVRSPCKPPLNYETAPLQGNYVAFPSDPAYFRSLLCSKHPAAAAAAAAAAAAAAAAGATCLERFHLVNGFCPPPHHHHHHHHHHHHHHHRAQPPQQSHHPPHHHRPQPHLGSFPESCSSDSESSSYSDHAANDSDFGSSLSSSSNSVSSEEEEEEGEEEEEEEEEEGGSGASDSSEVSSEEEDSSTESDSSSGSSQVSVQSIRFRRTSFCKPPSVQAQANFLYHLASAAAATKPAAFEDAGRLPDLKSSVKAESPAEWNLQSWAPKASPVYCPASLGSCFAEIRNDRVSEITFPHSEISNAVKRTDLTINCLAEGASSPSPKTNNAFPQQRILREARKCLQTTPTTHCADNNTIAARFLNNDSSGAEANSEKYSKILHCPEFATDLPSSQTDPEVNAAGAAATKAENPCTDTGDKTLPFLHNIKIKVEDSSANEEYEPHLFTNKLKCECNDTKGEFYSVTESKEEDALLTTAKEGFACPEKETPSLNPLAQSQGLSCTLGSPKPEDGEYKFGARVRKNYRTLVLGKRPVLQTPPVKPNLKSARSPRPTGKTETNEGTLDDFTVINRRKKVASNVASAVKRPFHFMANFPCPPSLIIGRDGDLWPAYSLNTTKDSQTPHKAHPIWKWQLGGSAIPLPPSHKFRKFNS

SEQ ID NO: 4056 - protein, 908 aa, Homo sapiens
MGDLKSGFEEVDGVRLGYLIIKGKQMFALSQVFTDLLKNIPRTTVHKRMDHLKVKKHHCDLEELRKLKAINSIAFHAAKCTLISREDVEALYTSCKTERVLKTKRRRVGRALATKAPPPERAAAASPRPGFWKDKHQLWRGLSGAARPLPISAQSQRPGAAAARPAAHLPQIFSKYPGSHYPEIVRSPCKPPLNYETAPLQGNYVAFPSDPAYFRSLLCSKHPAAAAAAAAAAAAAAAAAAAAAYYQVSAAGPQPKAAAGAGGPGSLSYRCKRKRGGAKDCLLAPHAGARRLLLLPRSYKAKAAAAAAAAAAAAAAAAGATCLERFHLVNGFCPPPHHHHHHHHHHHHHHHRAQPPQQSHHPPHHHRPQPHLGSFPESCSSDSESSSYSDHAANDSDFGSSLSSSSNSVSSEEEEEEGEEEEEEEEEEGGSGASDSSEVSSEEEDSSTESDSSSGSSQVSVQSIRFRRTSFCKPPSVQAQANFLYHLASAAAATKPAAFEDAGRLPDLKSSVKAESPAEWNLQSWAPKASPVYCPASLGSCFAEIRNDRVSEITFPHSEISNAVKRTDLTINCLAEGASSPSPKTNNAFPQQRILREARKCLQTTPTTHCADNNTIAARFLNNDSSGAEANSEKYSKILHCPEFATDLPSSQTDPEVNAAGAAATKAENPCTDTGDKTLPFLHNIKIKVEDSSANEEYEPHLFTNKLKCECNDTKGEFYSVTESKEEDALLTTAKEGFACPEKETPSLNPLAQSQGLSCTLGSPKPEDGEYKFGARVRKNYRTLVLGKRPVLQTPPVKPNLKSARSPRPTGKTETNEGTLDDFTVINRRKKVASNVASAVKRPFHFMANFPCPPSLIIGRDGDLWPAYSLNTTKDSQTPHKAHPIWKWQLGGSAIPLPPSHKFRKFNS

SEQ ID NO: 4057 - protein, 150 aa, Homo sapiens
MAASQCLCCSKFLFQRQNLACFLTNPHCGSLVNADGHGEVWTDWNNMSKFFQYGWRCTTNENTYSNRTLMGNWNQERYDLRNIVQPKPLPSQFGHYFETTYDTSYNNKMPLSTHRFKREPHWFPGHQPELDPPRYKCTEKSTYMNSYSKP

SEQ ID NO: 4058 - protein, 315 aa, Homo sapiens
MACAEFSFHVPSLEELAGVMQKGLKDNFADVQVSVVDCPDLTKEPFTFPVKGICGKTRIAEVGGVPYLLPLVNQKKVYDLNKIAKEIKLPGAFILGAGAGPFQTLGFNSEFMPVIQTESEHKPPVNGSYFAHVNPADGGCLLEKYSEKCHDFQCALLANLFASEGQPGKVIEVKAKRRTGPLNFVTCMRETLEKHYGNKPIGMGGTFIIQKGKVKSHIMPAEFSSCPLNSDEEVNKWLHFYEMKAPLVCLPVFVSRDPGFDLRLEHTHFFSRHGEGGHYHYDTTPDIVEYLGYFLPAEFLYRIDQPKETHSIGRD

SEQ ID NO: 4059 - protein, 315 aa, Homo sapiens; identical to SEQ ID NO: 4058

SEQ ID NO: 4060 - protein, 296 aa, Homo sapiens
MQKGLKDNFADVQVSVVDCPDLTKEPFTFPVKGICGKTRIAEVGGVPYLLPLVNQKKVYDLNKIAKEIKLPGAFILGAGAGPFQTLGFNSEFMPVIQTESEHKPPVNGSYFAHVNPADGGCLLEKYSEKCHDFQCALLANLFASEGQPGKVIEVKAKRRTGPLNFVTCMRETLEKHYGNKPIGMGGTFIIQKGKVKSHIMPAEFSSCPLNSDEEVNKWLHFYEMKAPLVCLPVFVSRDPGFDLRLEHTHFFSRHGEGGHYHYDTTPDIVEYLGYFLPAEFLYRIDQPKETHSIGRD

SEQ ID NO: 4061 - protein, 149 aa, Homo sapiens
MACAEFSFHVPSLEELAGVMQKGLKDNFADVQVSVVDCPDLTKEPFTFPVKGICGKTRIAEVGGVPYLLPLVNQKKVYDLNKIAKEIKLPGAFILGAGAGPFQTLGFNSEFMPVIQTESEHKPPVNGSYFAHVNPADGGCLLEKYSEKC

SEQ ID NO: 4062 - protein, 77 aa, Homo sapiens
MACAEFSFHVPSLEELAGVMQKGLKDNFADVQVSVVDCPDLTKEPFTFPVKGICGKTRIAEVGGVPYLLPLVNQKKV

SEQ ID NO: 4063 - protein, 171 aa, Homo sapiens
MACAEFSFHVPSLEELAGVMQKGLKDNFADVQVSVVDCPDLTKEPFTFPVKGICGKTRIAEVGGVPYLLPLVNQKKVYDLNKIAKEIKLPGAFILGAGAGPFQTLGFNSEFMPVIQTESEHKPPVNGSYFAHVNPADGGCLLEKYSEKCHDFQCALLANLFASEGQPGKVI

SEQ ID NO: 4064 - protein, 315 aa, Homo sapiens; identical to SEQ ID NO: 4058

SEQ ID NO: 4065 - protein, 265 aa, Homo sapiens
MACAEFSFHVPSLEELAGVMQKGLKDNFADVQVSVVDCPDLTKEPFTFPVKGICGKTRIAEVGGVPYLLPLVNQKKVYDLNKIAKEIKLPGAFILGAGAGPFQTLGFNSEFMPVIQTESEHKPPVNGSYFAHVNPADGGCLLEKYSEKCHDFQCALLANLFASEGQPGKPAEFSSCPLNSDEEVNKWLHFYEMKAPLVCLPVFVSRDPGFDLRLEHTHFFSRHGEGGHYHYDTTPDIVEYLGYFLPAEFLYRIDQPKETHSIGRD

SEQ ID NO: 4066 - protein, 96 aa, Homo sapiens
MACAEFSFHVPSLEELAGVMQKGLKDNFADVQVSVVDCPDLTKEPFTFPVKGICGKTRIAEVGGVPYLLPLVNQKKVYDLNKIAKEIKLPGAFILG

SEQ ID NO: 4067 - protein, 239 aa, Homo sapiens
MQKGLKDNFADVQVSVVDCPDLTKEPFTFPVKGICGKTRIAEVGGVPYLLPLVNQKKVYDLNKIAKEIKLPGAFILGAGAGPFQTLGFNSEFMPVIQTESEHKPPVNGSYFAHVNPADGGCLLEKYSEKCHDFQCALLANLFASEGQPGKVIEVKAKRRTGPLNFVTCMRETLEKHYGNKPIGMGGTFIIQKGKVKSHIMPAEFSSCPLNSDEEVNKWLHFYEMKAPLVCLPVFVSRDP

SEQ ID NO: 4068 - protein, 100 aa, Homo sapiens
MACAEFSFHVPSLEELAGVMQKGLKDNFADVQVSVVDCPDLTKEPFTFPVKGICGKTRIAEVGGVPYLLPLVNQKKVYDLNKIAKEIKLPGAFILGAGAG

SEQ ID NO: 4069 - protein, 296 aa, Homo sapiens; identical to SEQ ID NO: 4060

SEQ ID NO: 4070 - protein, 406 aa, Homo sapiens
MTQTLDTREDPLNLGGGGGGGCGCGWAHSASLSSWSSCHRRRPGAPAYNRPHRYSPKTEYGPPRKQPKQQHGPGFWFQPPVCSNWGCWGGPWRPPPPGFWKFPCPVQVFRVYGLHPLCFCCCSCWSGSWNPGWVKPPGRKKRWGRRGRGLRHHPRHSYPRSPPADVSTLPRPVKLYEWREPGMRAPPNTTQFIMNQIYEDMRQQEKVERQQEALRAQKATVSGEASPARSSGNDAPPGGSKETWGLQETLYGFVQNPSLAFSPNPEENQSLAPLLVEEEEEKKNDDEEEYDQEVCDAKEASEEEEEVEDEEEEVEDEEEEEVEEAEYVEEGEEELEEEELEEEEEVLEENEQRGEEFHLPLEMPLSIFVEAEEKRENFISCTFLNPEQIIPKVPQESLFMAQDFNC

SEQ ID NO: 4071 - protein, 64 aa, Homo sapiens
MPPRKKRRQPSQKAPLLFHQQPLEGPKHSCASTQLPITHTRQVPSKPIDHSTITSWVSPDFDTA

SEQ ID NO: 4072 - protein, 238 aa, Homo sapiens
MPPRKKRRQPSQKAPLLFHQQPLEGPKHSCASTQLPITHTRQVPSKPIDHSTITSWVSPDFDTAAGSLFPAYQKHQNRARHSSRKPTTSKFPHLTFESPQSSSSETLGIPLIRECPSESEKDVSRRPLVPVLSPQSCGNMSVQALQSLPYVFIPPDIQTPESSSVKEELIPQDQKENSLLSCTLHTGTPNSPEPGPVLVKDTPEDKYGIKVTWRRRQHLLAYLRERGKLSRSQFLVKS

SEQ ID NO: 4073 - protein, 132 aa, Homo sapiens
MPPRKKRRQPSQKAPLLFHQQPLEGPKHSCASTQLPITHTRQVPSKPIDHSTITSWVSPDFDTAAGSLFPAYQKHQNRARHSSRKPTTSKFPHLTFESPQSSSSETLGIPLIRECPSESEKDVSRRPLVPVL

SEQ ID NO: 4074 - protein, 105 aa, Homo sapiens
MPPRKKRRQPSQKAPLLFHQQPLEGPKHSCASTQLPITHTRQVPSKPIDHSTITSWVSPDFDTAAGSLFPAYQKHQNRARHSSRKPTTSKFPHLTFESPQSSSSE

SEQ ID NO: 4075 - protein, 1045 aa, Homo sapiens
MNLQAQPKAQNKRKRCLFGGQEPAPKEQPPPLQPPQQSIRVKEEQYLGHEGPGGAVSTSQPVELPPPSSLALLNSVVYGPERTSAAMLSQQVASVKWPNSVMAPGRGPERGGGGGVSDSSWQQQPGQPPPHSTWNCHSLSLYSATKGSPHPGVGVPTYYNHPEALKREKAGGPQLDRYVRPMMPQKVQLEVGRPQAPLNSFHAAKKPPNQSLPLQPFQLAFGHQVNRQVFRQGPPPPNPVAAFPPQKQQQQQQPQQQQQQQQAALPQMPLFENFYSMPQQPSQQPQDFGLQPAGPLGQSHLAHHSMAPYPFPPNPDMNPELRKALLQDSAPQPALPQVQIPFPRRSRRLSKEGILPPSALDGAGTQPGQEATGNLFLHHWPLQQPPPGSLGQPHPEALGFPLELRESQLLPDGERLAPNGREREAPAMGSEEGMRAVSTGDCGQVLRGGVIQSTRRRRRASQEANLLTLAQKAVELASLQNAKDGSGSEEKRKSVLASTTKCGVEFSEPSLATKRAREDSGMVPLIIPVSVPVRTVDPTEAAQAGGLDEDGKGPEQNPAEHKPSVIVTRRRSTRIPGTDAQAQAEDMNVKLEGEPSVRKPKQRPRPEPLIIPTKAGTFIAPPVYSNITPYQSHLRSPVRLADHPSERSFELPPYTPPPILSPVREGSGLYFNAIISTSTIPAPPPITPKSAHRTLLRTNSAEVTPPVLSVMGEATPVSIEPRINVGSRFQAEIPLMRDRALAAADPHKADLVWQPWEDLESSREKQRQVEDLLTAACSSIFPGAGTNQELALHCLHESRGDILETLNKLLLKKPLRPHNHPLATYHYTGSDQWKMAERKLFNKGIAIYKKDFFLVQKLIQTKTVAQCVEFYYTYKKQVKIGRNGTLTFGDVDTSDEKSAQEEVEVDIKTSQKFPRVPLPRRESPSEERLEPKREVKEPRKEGEEEVPEIQEKEEQEEGRERSRRAAAVKATQTLQANESASDILILRSHESNAPGSAGGQASEKPREGTGKSRRALPFSEKKKKTETFSKTQNQENTFPCKKCGR

SEQ ID NO: 4076 - protein, 1045 aa, Homo sapiens; identical to SEQ ID NO: 4075

SEQ ID NO: 4077 - protein, 66 aa, Homo sapiens
MNLQAQPKAQNKRKRCLFGGQEPAPKEQPPPLQPPQQSIRVKEEQYLGHEGPGGAVSTSQPVELPP

SEQ ID NO: 4078 - protein, 1045 aa, Homo sapiens; identical to SEQ ID NO: 4075

SEQ ID NO: 4079 - protein, 1019 aa, Homo sapiens
MNLQAQPKAQNKRKRCLFGGQEPAPKEQPPPLQPPQQSIRVKEEQYLGHEGPGGAVSTSQPVELPPPSSLALLNSVVYGPERTSAAMLSQQVASVKWPNSVMAPGRGPERGGGGGVSDSSWQQQPGQPPPHSTWNCHSLSLYSATKGSPHPGVGVPTYYNHPEALKREKAGGPQLDRYVRPMMPQKVQLEVGRPQAPLNSFHAAKKPPNQSLPLQPFQLAFGHQVNRQVFRQGPPPPNPVAAFPPQKQQQQQQPQQQQQQQQAALPQMPLFENFYSMPQQPSQQPQDFGLQPAGPLGQSHLAHHSMAPYPFPPNPDMNPELRKALLQDSAPQPALPQVQIPFPRRSRRLSKEGILPPSALDGAGTQPGQEATGNLFLHHWPLQQPPPGSLGQPHPEALGFPLELRESQLLPDGERLAPNGREREAPAMGSEEGMRAVSTGDCGQVLRGGVIQSTRRRRRASQEANLLTLAQKAVELASLQNAKDGSGSEEKRKSVLASTTKCGVEFSEPSLATKRAREDSGMVPLIIPVSVPVRTVDPTEAAQAGGLDEDGKGPEQNPAEHKPSVIVTRRRSTRIPGTDAQAQAEDMNVKLEGEPSVRKPKQRPRPEPLIIPTKAGTFIAPPVYSNITPYQSHLRSPVRLADHPSERSFELPPYTPPPILSPVREGSGLYFNAIISTSTIPAPPPITPKSAHRTLLRTNSAEVTPPVLSVMGEATPVSIEPRINVGSRFQAEIPLMRDRALAAADPHKADLVWQPWEDLESSREKQRQVEDLLTAACSSIFPGAGTNQELALHCLHESRGDILETLNKLLLKKPLRPHNHPLATYHYTGSDQWKMAERKLFNKGIAIYKKDFFLVQKLIQTKTVAQCVEFYYTYKKQVKIGRNGTLTFGDVDTSDEKSAQEEVEVDIKTSQKFPRVPLPRRESPSEERLEPKREVKEPRKEGEEEVPEIQEKEEQEEGRERSRRAAAVKATQTLQANESASDILILRSHESNAPGSAGGQASEKPREGTGKSRRALPFS

SEQ ID NO: 4080 - protein, 316 aa, Homo sapiens
MAAPEAPPLDRVFRTTWLSTECDSHPLPPSYRKFLFETQAADLAGGTTVAAGNLLNESEKDCGQDRRAPGVQPCRLVTMTSVVKTVYSLQPPSALSGGQPADTQTRATSKSLLPVRSKEVDVSKQLHSGGPENDVTKITKLRRENGQMKATDTATRRNVRKGYKPLSKQKSEEELKDKNQLLEAVNKQLHQKLTETQGELKDLTQKVELLEKFRDNCLAILESKGLDPALGSETLASRQESTTDHMDSMLLLETLQEELKLFNETAKKQMEELQALKVKLEMKEERVRFLEQQTLCNNQVNDLTTALKEMEQLLEM

SEQ ID NO: 4081 - protein, 286 aa, Homo sapiens
MAAPEAPPLDRVFRTTWLSTECDSHPLPPSYRKFLFETQAADLAGGTTVAAGNLLNESEKDCGQDRRAPGVQPCRLVTMTSVVKTVYSLQPPSALSGGQPADTQTRATSKSLLPVRSKEVDVSKQLHSGGPENDVTKITKLRRENGQMKATDTATRRNVRKGYKPLSKQKSEEELKDKNQLLEAVNKQLHQKLTETQGELKDLTQKVELLEKFRDNCLAILESKGLDPALGSETLASRQESTTDHMDSMLLLETLQEELKLFNETAKKQMEELQIAWMNHGILHQM

SEQ ID NO: 4082 - protein, 241 aa, Homo sapiens
MAAPEAPPLDRVFRTTWLSTECDSHPLPPSYRKFLFETQAADLAGGTTVAAGNLLNESEKDCGQDRRAPGVQPCRLVTMTSVVKTVYSLQPPSALSGGQPADTQTRATSKSLLPVRSKEVDVSKQLHSGGPENDVTKITKLRRENGQMKATDTATRRNVRKGYKPLSKQKSEEELKDKNQLLEAVNKQLHQKLTETQGELKDLTQKVELLEKFRDNCLAILESKGLDPVAVRNFARGAEAF

SEQ ID NO: 4083 - protein, 304 aa, Homo sapiens
MASETHNVKKRNFCNKIEDHFIDLPRKKISNFTNKNMKEVKKSPKQLAAYINRTVGQTVKSPDKLRKVIYRRKKVHHPFPNPCYRKKQSPGSGGCDMANKENELACAGHLPEKLHHDSRTYLVNSSDSGSSQTESPSSKYSGFFSEVSQDHETMAQVLFSRNMRLNVALTFWRKRSISELVAYLLRIEDLGVVVDCLPVLTNCLQEEKQYISLGCCVDLLPLVKSLLKSKFEEYVIVGLNWLQAVIKRWWSELSSKTEIINDGNIQILKQQLSGLWEQENHLTLVPGYTGNIAKDVDAYLLQLH

SEQ ID NO: 4084 - protein, 178 aa, Homo sapiens
MASETHNVKKRNFCNKIEDHFIDLPRKKISNFTNKNMKEVKKSPKQLAAYINRTVGQTVKSPDKLRKVIYRRKKVHHPFPNPCYRKKQSPGSGGCDMANKENELACAGHLPEKLHHDSRTYLVNSSDSGSSQTESPSSKYSGFFSEVSQDHETMAQVLFSRNMRLNVALTFWRKRSIS

SEQ ID NO: 4085 - protein, 39 aa, Homo sapiens
MASETHNVKKRNFCNKIEDHFIDLPRKKISNFTNKNMKE

SEQ ID NO: 4086 - protein, 74 aa, Homo sapiens
MASETHNVKKRNFCNKIEDHFIDLPRKKISNFTNKNMKEVKKSPKQLAAYINRTVGQTVKSPDKLRKVIYRRKK

SEQ ID NO: 4087 - protein, 177 aa, Homo sapiens
MASETHNVKKRNFCNKIEDHFIDLPRKKISNFTNKNMKEVKKSPKQLAAYINRTVGQTVKSPDKLRKVIYRRKKVHHPFPNPCYRKKQSPGSGGCDMANKENELACAGHLPEKLHHDSRTYLVNSSDSGSSQTESPSSKYSGFFSEVSQDHETMAQVLFSRNMRLNVALTFWRKRSI

SEQ ID NO: 4088 - protein, 458 aa, Homo sapiens
MITKTHKVDLGLPEKKKKKKVVKEPETRYSVLNNDDYFADVSPLRATSPSKSVAHGQAPEMPLVKKKKKKKKGVSTLCEEHVEPETTLPARRTEKSPSLRKQVFGHLEFLSGEKKNKKSPLAMSHASGVKTSPDPRQGEEETRVGKKLKKHKKEKKGAQDPTAFSVQDPWFCEAREARDVGDTCSVGKKDEEQAALGQKRKRKSPREHNGKVKKKKKIHQEGDALPGHSKPSRSMESSPRKGSKKKPVKVEAPEYIPISDDPKASAKKKMKSKKKVEQPVIEEPALKRKKKKKRKESGVAGDPWKEETDTDLEVVLEKKGNMDEAHIDQVRRKALQEEIDRESGKTEASETRKWTGTQFGQWDTAGFENEDQKLKFLRLMGGFKNLSPSFSRPASTIARPNMALGKKAADSLQQNLQRDYDRAMSWKYSRGAGLGFSTAPNKIFYIDRNASKSVKLED

SEQ ID NO: 4089 - protein, 172 aa, Homo sapiens; identical to SEQ ID NO: 4029

SEQ ID NO: 4090 - protein, 138 aa, Homo sapiens; identical to SEQ ID NO: 4031

SEQ ID NO: 4091 - protein, 184 aa, Homo sapiens
MDLQAAGAQAQGAAEPSRGPPLPSARGAPPSPEAGFATADHSSQERETEKAMDRLARGTQSIPNDSPARGEGTHSEEEGFAMDEEDSDGELNTWELSEGTNCPPKEQPGDLFNEDWDSELKADQGNPYDADDIQESISQELKPWVCCAPQGDMIYDPSWHHPPPLIPYYSKMVFETGQFDDAED

SEQ ID NO: 4092 - protein, 172 aa, Homo sapiens
MGGDAGDREPGPAARSLGEGQAGFATADHSSQERETEKAMDRLARGTQSIPNDSPARGEGTHSEEEGFAMDEEDSDGELNTWELSEGTNCPPKEQPGDLFNEDWDSELKADQGNPYDADDIQESISQELKPWVCCAPQGDMIYDPSWHHPPPLIPYYSKMVFETGQFDDAED

SEQ ID NO: 4093 - protein, 867 aa, Homo sapiens
MRSRSPPRPKWHSRDGSSQSDSGEEQSRGQWARRRRRARSWSPSSSASSSASPGRSQSPRAAAAALSQQQSLQERLRLREERKQQEELMKAFETPEEKRARRLAKKEAKERKKREKMGWGEEYMGYTNTDNPFGDNNLLGTFIWNKALEKKGISHLEEKELKERNKRIQEDNRLELQKVKQLRLEREREKAMREQELEMLQREKEAEHFKTWEEQEDNFHLQQAKLRSKIRIRDGRAKPIDLLAKYISAEDDDLAVEMHEPYTFLNGLTVADMEDLLEDIQVYMELEQGKNADFWRDMTTITEDEISKLRKLEASGKGPGERREGVNASVSSDVQSVFKGKTYNQLQVIFQGIEGKIRAGGPNLDMGYWESLLQQLRAHMARARLRERHQDVLRQKLYKLKQEQGVESEPLFPILKQEPQSPSRSLEPEDAAPTPPGPSSEGGPAEAEVDGATPTEGDGDGDGEGEGEGEAVLMEEDLIQQSLDDYDAGRYSPRLLTAHELPLDAHVLEPDEDLQRLQLSRQQLQVTGDASESAEDIFFRRAKEGMGQDEAQFSVEMPLTGKAYLWADKYRPRKPRFFNRVHTGFEWNKYNQTHYDFDNPPPKIVQGYKFNIFYPDLIDKRSTPEYFLEACADNKDFAILRFHAGPPYEDIAFKIVNREWEYSHRHGFRCQFANGIFQLWFHFKRYRYRRPGPCWRPIRHCRRDPLWTPTLCRDWPPTHPVLAGGVHFPAAGIPPPGLLTGPWSMRPVTPSFAHIRTVAPSHSPFSGQEGRGPHGCHSPGRSGPAGRLVLQHPTGTSPTEAKRKVPPGPPEGHPTSPVTSPRPPTAPPRHPASSGNSSVCFSKKTCRWEKKSFVLMELAYWQDRMFF

SEQ ID NO: 4094 - protein, 758 aa, Homo sapiens
MGRDTRSRSRSAGRRGRRRQSQSGSRSRSRSHGRRNRRRREDEGRRRRRRRSRERRSDSEEERWQRSGMRSRSPPRPKWHSRDGSSQSDSGEEQSRGQWARRRRRARSWSPSSSASSSASPGRSQSPRAAAAALSQQQSLQERLRLREERKQQEELMKAFETPEEKRARRLAKKEAKERKKREKMGWGEEYMGYTNTDNPFGDNNLLGTFIWNKALEKKGISHLEEKELKERNKRIQEDNRLELQKVKQLRLEREREKAMREQELEMLQREKEAEHFKTWEEQEDNFHLQQAKLRSKIRIRDGRAKPIDLLAKYISAEDDDLAVEMHEPYTFLNGLTVADMEDLLEDIQVYMELEQGKNADFWRDMTTITEDEISKLRKLEASGKGPGERREGVNASVSSDVQSVFKGKTYNQLQVIFQGIEGKIRAGGPNLDMGYWESLLQQLRAHMARARLRERHQDVLRQKLYKLKQEQGVESEPLFPILKQEPQSPSRSLEPEDAAPTPPGPSSEGGPAEAEVDGATPTEGDGDGDGEGEGEGEAVLMEEDLIQQSLDDYDAGRYSPRLLTAHELPLDAHVLEPDEDLQRLQLSRQQLQVTGDASESAEDIFFRRAKEGMGQDEAQFSVEMPLTGKAYLWADKYRPRKPRFFNRVHTGFEWNKYNQTHYDFDNPPPKIVQGYKFNIFYPDLIDKRSTPEYFLEACADNKDFAILRFHAGPPYEDIAFKIVNREWEYSHRHGFRCQFANGIFQLWFHFKRYRYRR

SEQ ID NO: 4095 - protein, 758 aa, Homo sapiens; identical to SEQ ID NO: 4094

SEQ ID NO: 4096 - protein, 263 aa, Homo sapiens
MGRDTRSRSRSAGRRGRRRQSQSGSRRGPSPFPRSVHQPRHLRTNPCAQGSWVKAGPPVKQLRLEREREKAMREQELEMLQREKEAEHFKTWEEQEDNFHLQQAKLRSKIRIRDGRAKPIDLLAKYISAEDDDLAVEMHEPYTFLNGLTVADMEDLLEDIQVYMELEQGKNADFWRDMTTITEDEISKLRKLEASGKGPGERREGVNASVSSDVQSVFKGKTYNQLQVIFQGIEGKIRAGGPNLDMGYWESLLQQLRAHMARA

SEQ ID NO: 4097 - protein, 106 aa, Homo sapiens
MEFDLGAALEPTSQKPGVGAGHGGDPKLSPHKVQGRSEAGAGPGPKQGHHSSSDSSSSSSDSDTDVKSHAAGSKQHESIPGKAKKPKVKKKEKGKKEKGKKKEAPH

SEQ ID NO: 4098 - protein, 180 aa, Homo sapiens
MAGVKYPGQDPVDLDIYQSSHMVDYQPYRKHKYSRVTPQEQAKLDAQLRDKEFYRPIPNPNPKLTDGYPAFKRPHMTAKDLGLPGFFPSQEHEATREDERKFTSTCHFTYPASHDLHLAQGDPNQVLQSADFPCLVDPKHQPAAEMAKGYLLLPGCPCLHCHIVKVPILNRWGPLMPFYQ

SEQ ID NO: 4099 - protein, 346 aa, Homo sapiens [sequence omitted]

SEQ ID NO: 4100 - protein, 259 aa, Homo sapiens
MRDRRGPLGTCLAQVQQAGGGDSDKLSCSLKKRMPEGPWPADAPSWMNKPVVDGNSQSEALSLEMRKDPSGAGLWLHSGGPVLPYVRESVRRNPASAATPSTAVGLFPAPTECFARVSCSGVEALGRRDWLGGGPRATDGHRGQCPKGEPRVSRLPRHQKVPEMGSFQDDPPSAFPKGLGSELEPACLHSILSATLHVYPEVLLSEETKRIFLDRLKPMFSKQTIEFKKMLKSTSDGLQITLGLLALQPFELANTLCHS

SEQ ID NO: 4101 - protein, 120 aa, Homo sapiens
MRDRRGPLGTCLAQVQQAGGGDSDKLSCSLKKRMPEGPWPADAPSWMNKPVVDGNSQSEALSLEMRKDPSGAGLWLHSGGPVLPYVRESVRRNPASAATPSTAVGLFPAPTECFARVSCS

SEQ ID NO: 4102 - protein, 109 aa, Homo sapiens
MRDRRGPLGTCLAQVQQAGGGDSDKLSCSLKKRMPEGPWPADAPSWMNKPVVDGNSQSEALSLEMRKDPSGAGLWLHSGGPVLPYVRESVRRNPASAATPSTAVGLFPA

SEQ ID NO: 4103 - protein, 796 aa, Homo sapiens
MAETKDVFGQEPHPVEDDLYKERTRKRRKSDRDQRFRAFPSMEQSALKEYEKLESRTRRVLSNTYQKLIQSVFLDDSIPNGVKYLINRLLALIEKPTVDPIYIALFGSTGAGKSSLINAIIQQAMFLPVSGESICTSCIVQVSSGCCVQYEAKIHLLSDQEWREELKNLTKLLHRTEELSREEADAWNRDEAVEEATWKLQMIYGNGAESKNYEELLRAKPKRKIPTSRVITLKAEEAEELSIKLDPYIRTQRRDWDGEAAEMRIWPLIKHVEVTLPKSDLIPEGVVLVDIPGTGDFNSKRDEMWKKTIDKCSVIWVISDIERVSGGQAHEDLLNESIKACQRGFCRDVALVVTKMDKLHLPEYLREERKGWQAIQSQREAVLERNEMIKLQRTRILKEKLKRKLPADFKVLEASDLVYTVSAQEYWQQALLTEEETEIPKLREYIRKSLLDKKKRTVTKYVTEAFGLLLLTDSFNSTQNLPNEHLHMSVLRRFAEEKVELLEKAIAQCFACMEQPLQEGVRTARTSYRCILRACLVRSKGNQGFHQTLKAVCLKNGIYASRTLARIDLNEALTQPVYDQIDPVFGSIFRTGKPTGSALMPHIDAFKQSLQEKMTEIGIRSGWKYDSCKKNFLIQEISAILGGLEDHILRRKRRIYESLTASVQSDLKLCYEEAAQITGKKACERMKDAIRRGVDRQVAEGMFERAQERMQHQFQQLKTGIVEKVKGSITTMLALASSQGDGLYKELADVGSEYKEMEKLHRSLREVAENARLRKGMQEFLLRASPSKAGPPGTSL

SEQ ID NO: 4104 - protein, 796 aa, Homo sapiens
MAETKDVFGQEPHPVEDDLYKERTRKRRKSDRDQRFRAFPSMEQSALKEYEKLESRTRRVLSNTYQKLIQSVFLDDSIPNGVKYLINRLLALIEKPTVDPIYIALFGSTGAGKSSLINAIIQQAMFLPVSGESICTSCIVQVSSGCCVQYEAKIHLLSDQEWREELKNLTKLLHRTEELSREEADAWNRDEAVEEATWKLQMIYGNGAESKNYEELLRAKPKRKIPTSRVITLKAEEAEELSIKLDPYIRTQRRDWDGEAAEMRIWPLIKHVEVTLPKSDLIPEGVVLVDIPGTGDFNSKRDEMWKKTIDKCSVIWVISDIERVSGGQAHEDLLNESIKACQRGFCRDVALVVTKMDKLHLPEYLRERKAGNQAIQSQREAVLERNEMIKLQRTRILKEKLKRKLPADFKVLEASDLVYTVSAQEYWQQALLTEEETEIPKLREYIRKSLLDKKKRTVTKYVTEAFGLLLLTDSFNSTQNLPNEHLHMSVLRRFAEEKVELLEKAIAQCFACMEQPLQEGVRTARTSYRCILRACLVRSKGNQGFHQTLKAVCLKNGIYASRTLARIDLNEALTQPVYDQIDPVFGSIFRTGKPTGSALMPHIDAFKQSLQEKMTEIGIRSGWKYDSCKKNFLIQEISAILGGLEDHILRRKRRIYESLTASVQSDLKLCYEEAAQITGKKACERMKDAIRRGVDRQVAEGMFERAQERMQHQFQQLKTGIVEKVKGSITTMLALASSQGDGLYKELADVGSEYKEMEKLHRSLREVAENARLRKGMQEFLLRASPSKAGPPGTSL

SEQ ID NO: 4105 - protein, 1332 aa, Homo sapiens
MTGEVGSEVHLEINDPNVISQEEADSPSDSGQGSYETIGPLSEGDSDEEIFVSKKLKNRKVLQDSDSETEDTNASPEKTTYDSAEEENKENLYAGKNTKIKRIYKTVADSDESYMEKSLYQENLEAQVKPCLELSLQSGNSTDFTTDRKSSKKHIHDKEGTAGKAKVKSKRRLEKEERKMEKIRQLKKKETKNQEDDVEQPFNDSGCLLVDKDLFETGLEDENNSPLEDEESLESIRAAVKNKVKKHKKKEPSLESGVHSFEEGSELSKGTTRKERKAARLSKEALKQLHSETQRLIRESALNLPYHMPENKTIHDFFKRKPRPTCHGNAMALLKSSKYQSSHHKEIIDTANTTEMNSDHHSKGSEQTTGAENEVETNALPVVSKETQIITGSDESCRKDLVKNEELEIQEKQKQSDIRPSPGDSSVLQQESNFLGNNHSEECQVGGLVAFEPHALEGEGPQNPEETDEKVEEPEQQNKSSAVGPPEKVRRFTLDRLKQLGVDVSIKPRLGADEDSFVILEPETNRELEALKQRFWKHANPAAKPRAGQTVNVNVIVKDMGTDGKEELKADVVPVTLAPKKLDGASHTKPGEKLQVLKAKLQEAMKLRRFEERQKRQALFKLDNEDGFEEEEEEEEEMTDESEEDGEEKVEKEEKEEELEEEEEKEEEEEEEGNQETAEFLLSSEEIETKDEKEMDKENNDGSSEIGKAVGFLSVPKSLSSDSTLLLFKDSSSKMGYFPTEEKSETDENSGKQPSKLDEDDSCSLLTKESSHNSSFELIGSTIPSYQPCNRQTGRGTSFFPTAGGFRSPSPGLFRASLVSSASKSSGKLSEPSLPIEDSQDLYNASPEPKTLFLGAGDFQFCLEDDTQSQLLDADGFLNVRNHRNQYQALKPRLPLASMDENAMDANMDELLDLCTGKFTSQAEKHLPRKSDKKENMEELLNLCSGKFTSQDASTPASSELNKQEKESSMGDPMEEALALCSGSFPTDKEEEDEEEEFGDFRLVSNDNEFDSDEDEHSDSGNDLALEDHEDDDEEELLKRSEKLKRQMRLRKYLEDEAEVSGSDVGSEDEYDGEEIDEYEEDVIDEVLPSDEELQSQIKKIHMKTMLDDDKRQLRLYQERYLADGDLHSDGPGRMRKFRWKNIDDASQMDLFHRDSDDDQTEEQLDESEARWRKERIEREQWLRDMAQQGKITAEEEEEIGEDSQFMILAKKVTAKALQKNASRPMVIQESKSLLRNPFEAIRPGSAQQVKTGSLLNQPKAVLQKLAALSDHNPSAPRNSRNFVFHTLSPVKAEAAKESSKSQKIPEKDSDWLTWSGAPIPGFFRLSFDPHG

SEQ ID NO: 4106 - protein, 1339 aa, Homo sapiens
MTGEVGSEVHLEINDPNVISQEEADSPSDSGQGSYETIGPLSEGDSDEEIFVSKKLKNRKVLQDSDSETEDTNASPEKTTYDSAEEENKENLYAGKNTKIKRIYKTVADSDESYMEKSLYQENLEAQVKPCLELSLQSGNSTDFTTDRKSSKKHIHDKEGTAGKAKVKSKRRLEKEERKMEKIRQLKKKETKNQEDDVEQPFNDSGCLLVDKDLFETGLEDENNSPLEDEESLESIRAAVKNKVKKHKKKEPSLESGVHSFEEGSELSKGTTRKERKAARLSKEALKQLHSETQRLIRESALNLPYHMPENKTIHDFFKRKPRPTCHGNAMALLKSSKYQSSHHKEIIDTANTTEMNSDHHSKGSEQTTGAENEVETNALPVVSKETQIITGSDESCRKDLVKNEELEIQEKQKQSDIRPSPGDSSVLQQESNFLGNNHSEECQVGGLVAFEPHALEGEGPQNPEETDEKVEEPEQQNKSSAVGPPEKVRRFTLDRLKQLGVDVSIKPRLGADEDSFVILEPETNRELEALKQRFWKHANPAAKPRAGQTVNVNVIVKDMGTDGKEELKADVVPVTLAPKKLDGASHTKPGEKLQVLKAKLQEAMKLRRFEERQKRQALFKLDNEDGFEEEEEEEEEMTDESEEDGEEKVEKEEKEEELEEEEEKEEEEEEEGNQETAEFLLSSEEIETKDEKEMDKENNDGSSEIGKAVGFLSVPKSLSSDSTLLLFKDSSSKMGYFPTEEKSETDENSGKQPSKLDEDDSCSLLTKESSHNSSFELIGSTIPSYQPCNRQTGRGTSFFPTAGGFRSPSPGLFRASLVSSASKSSGKLSEPSLPIEDSQDLYNASPEPKTLFLGAGDFQFCLEDDTQSQLLDADGFLNVRNHRNQYQALKPRLPLASMDENAMDANMDELLDLCTGKFTSQAEKHLPRKSDKKENMEELLNLCSGKFTSQDASTPASSELNKQEKESSMGDPMEEALALCSGSFPTDKEEEDEEEEFGDFRLVSNDNEFDSDEDEHSDSGNDLALEDHEDDDEEELLKRSEKLKRQMRLRKYLEDEAEVSGSDVGSEDEYDGEEIDEYEEDVIDEVLPSDEELQSQIKKIHMKTMLDDDKRQLRLYQERYLADGDLHSDGPGRMRKFRWKNIDDASQMDLFHRDSDDDQTEEQLDESEARWRKERIEREQWLRDMAQQGKITAEEEEEIGEDSQFMILAKKVTAKALQKNASRPMVIQESKSLLRNPFEAIRPGSAQQVKTGSLLNQPKAVLQKLAALSDHNPSAPRNSRNFVFHTLSPVKAEAAKESSKSQVKKRGPSFMTSPSPKHLKTDDSTSGLTRSIFKYLES

SEQ ID NO: 4107 - protein, 1275 aa, Homo sapiens
MTGEVGSEVHLEINDPNVISQEEADSPSDSGQGSYETIGPLSEGDSDEEIFVSKKLKNRKVLQDSDSETEDTNASPEKTTYDSAEEENKENLYAGKNTKIKRIYKTVADSDESYMEKSLYQENLEAQVKPCLELSLQSGNSTDFTTDRKSSKKHIHDKEGTAGKAKVKSKRRLEKEERKMEKIRQLKKKETKNQEDDVEQPFNDSGCLLVDKDLFETGLEDENNSPLEDEESLESIRAAVKNKVKKHKKKEPSLESGVHSFEEGSELSKGTTRKERKAARLSKEALKQLHSETQRLIRESALNLPYHMPENKTIHDFFKRKPRPTCHGNAMALLKSSKYQSSHHKEIIDTANTTEMNSDHHSKGSEQTTGAENEVETNALPVVSKETQIITGSDESCRKDLVKNEELEIQEKQKQSDIRPSPGDSSVLQQESNFLGNNHSEECQVGGLVAFEPHALEGEGPQNPEETDEKVEEPEQQNKSSAVGPPEKVRRFTLDRLKQLGVDVSIKPRLGADEDSFVILEPETNRGEKLQVLKAKLQEAMKLRRFEERQKRQALFKLDNEDGFEEEEEEEEEMTDESEEDGEEKVEKEEKEEELEEEEEKEEEEEEEGNQETAEFLLSSEEIETKDEKEMDKENNDGSSEIGKAVGFLSVPKSLSSDSTLLLFKDSSSKMGYFPTEEKSETDENSGKQPSKLDEDDSCSLLTKESSHNSSFELIGSTIPSYQPCNRQTGRGTSFFPTAGGFRSPSPGLFRASLVSSASKSSGKLSEPSLPIEDSQDLYNASPEPKTLFLGAGDFQFCLEDDTQSQLLDADGFLNVRNHRNQYQALKPRLPLASMDENAMDANMDELLDLCTGKFTSQAEKHLPRKSDKKENMEELLNLCSGKFTSQDASTPASSELNKQEKESSMGDPMEEALALCSGSFPTDKEEEDEEEEFGDFRLVSNDNEFDSDEDEHSDSGNDLALEDHEDDDEEELLKRSEKLKRQMRLRKYLEDEAEVSGSDVGSEDEYDGEEIDEYEEDVIDEVLPSDEELQSQIKKIHMKTMLDDDKRQLRLYQERYLADGDLHSDGPGRMRKFRWKNIDDASQMDLFHRDSDDDQTEEQLDESEARWRKERIEREQWLRDMAQQGKITAEEEEEIGEDSQFMILAKKVTAKALQKNASRPMVIQESKSLLRNPFEAIRPGSAQQVKTGSLLNQPKAVLQKLAALSDHNPSAPRNSRNFVFHTLSPVKAEAAKESSKSQVKKRGPSFMTSPSPKHLKTDDSTSGLTRSIFKYLES

SEQ ID NO: 4108 - protein, 658 aa, Homo sapiens
MTGEVGSEVHLEINDPNVISQEEADSPSDSGQGSYETIGPLSEGDSDEEIFVSKKLKNRKVLQDSDSETEDTNASPEKTTYDSAEEENKENLYAGKNTKIKRIYKTVADSDESYMEKSLYQENLEAQVKPCLELSLQSGNSTDFTTDRKSSKKHIHDKEGTAGKAKVKSKRRLEKEERKMEKIRQLKKKETKNQEDDVEQPFNDSGCLLVDKDLFETGLEDENNSPLEDEESLESIRAAVKNKVKKHKKKEPSLESGVHSFEEGSELSKGTTRKERKAARLSKEALKQLHSETQRLIRESALNLPYHMPENKTIHDFFKRKPRPTCHGNAMALLKSSKYQSSHHKEIIDTANTTEMNSDHHSKGSEQTTGAENEVETNALPVVSKETQIITGSDESCRKDLVKNEELEIQEKQKQSDIRPSPGDSSVLQQESNFLGNNHSEECQVGGLVAFEPHALEGEGPQNPEETDEKVEEPEQQNKSSAVGPPEKVRRFTLDRLKQLGVDVSIKPRLGADEDSFVILEPETNRELEALKQRFWKHANPAAKPRAGQTVNVNVIVKDMGTDGKEELKADVVPVTLAPKKLDGASHTKPGEKLQVLKAKLQEAMKLRRFEERQKRQALFKLDNEDGFEEEEEEEEEMTDESEEDGEEKKKKKKKKKN

SEQ ID NO: 4109 - protein, 1130 aa, Homo sapiens
MRCLAPRPAGSYLSEPQGSSQCATMELGPLEGGYLELLNSDADPLCLYHFYDQMDLAGEEEIELYSEPDTDTINCDQFSRLLCDMEGDEETREAYANIAELDQYVFQDSQLEGLSKDIFKHIGPDEVIGESMEMPAEVGQKSQKRPFPEELPADLKHWKPAEPPTVVTGSLLVRPVSDCSTLPCLPLPALFNQEPASGQMRLEKTDQIPMPFSSSSLSCLNLPEGPIQFVPTISTLPHGLWQISEAGTGVSSIFIYHGEVPQASQVPPPSGFTVHGLPTSPDRPGSTSPFAPSATDLPSMPEPALTSRANMTEHKTSPTQCPAAGEVSNKLPKWPEPVEQFYRSLQDTYGAEPAGPDGILVEVDLVQARLERSSSKSLERELATPDWAERQLAQGGLAEVLLAAKEHRRPRETRVIAVLGKAGQGKSYWAGAVSRAWACGRLPQYDFVFSVPCHCLNRPGDAYGLQDLLFSLGPQPLVAADEVFSHILKRPDRVLLILDGFEELEAQDGFLHSTCGPAPAEPCSLRGLLAGLFQKKLLRGCTLLLTARPRGRLVQSLSKADALFELSGFSMEQAQAYVMRYFESSGMTEHQDRALTLLRDRPLLLSHSHSPTLCRAVCQLSEALLELGEDAKLPSTLTGLYVGLLGRAALDSPPGALAELAKLAWELGRRHQSTLQEDQFPSADVRTWAMAKGLVQHPPRAAESELAFPSFLLQCFLGALWLALSGEIKDKELPQYLALTPRKKRPYDNWLEGVPRFLAGLIFQPPARCLGALLGPSAAASVDRKQKVLARYLKRLQPGTLRARQLLELLHCAHEAEEAGIWQHVVQELPGRLSFLGTRLTPPDAHVLGKALEAAGQDFSLDLRSTGICPSGLGSLVGLSCVTRFRAALSDTVALWESLQQHGETKLLQAAEEKFTIEPFKAKSLKDVEDLGKLVQTQRTRSSSEDTAGELPAVRDLKKLEFALGPVSGPQAFPKLVRILTAFSSLQHLDLDALSENKIGDEGVSQLSATFPQLKSLETLNLSQNNITDLGAYKLAEALPSLAASLLRLSLYNNCICDVGAESLARVLPDMVSLRVMDVQYNKFTAAGAQQLAASLRRCPHVETLAMWTPTIPFSVQEHLQQQDSRISLR

SEQ ID NO: 4110 - protein, 546 aa, Homo sapiens
MRCLAPRPAGSYLSEPQGSSQCATMELGPLEGGYLELLNSDADPLCLYHFYDQMDLAGEEEIELYSEPDTDTINCDQFSRLLCDMEGDEETREAYANIAELDQYVFQDSQLEGLSKDIFKHIGPDEVIGESMEMPAEVGQKSQKRPFPEELPADLKHWKPVPFSSSSLSCLNLPEGPIQFVPTISTLPHGLWQISEAGTGVSSIFIYHGEVPQASQVPPPSGFTVHGLPTSPDRPGSTSPFAPSATDLPSMPEPALTSRANMTEHKTSPTQCPAAGEVSNKLPKWPGLAWSPCLGLRPSLHRAALSDTVALWESLQQHGETKLLQAAEEKFTIEPFKAKSLKDVEDLGKLVQTQRTRSSSEDTAGELPAVRDLKKLEFALGPVSGPQAFPKLVRILTAFSSLQHLDLDALSENKIGDEGVSQLSATFPQLKSLETLNLSQNNITDLGAYKLAEALPSLAASLLRLSLYNNCICDVGAESLARVLPDMVSLRVMDVQYNKFTAAGAQQLAASLRRCPHVETLAMWTPTIPFSVQEHLQQQDSRISLR

SEQ ID NO: 4111 - protein, 884 aa, Homo sapiens
MRCLAPRPAGSYLSEPQGSSQCATMELGPLEGGYLELLNSDADPLCLYHFYDQMDLAGEEEIELYSEPDTDTINCDQFSRLLCDMEGDEETREAYANIAELDQYVFQDSQLEGLSKDIFIEHIGPDEVIGESMEMPAEVGQKSQKRPFPEELPADLKHWKPVPFSSSSLSCLNLPEGPIQFVPTISTLPHGLWQISEAGTGVSSIFIYHGEVPQASQVPPPSGFTVHGLPTSPDRPGSTSPFAPSATDLPSMPEPALTSRANMTEHKTSPTQCPAAGEVSNKLPKWPEPVEQFYRSLQDTYGAEPAGPDGILVEVDLVQARLERSSSKSLERELATPDWAERQLAQGGLAEVLLAAKEHRRPRETRVIAVLGKAGQGKSYWAGAVSRAWACGRLPQYDFVFSVPCHCLNRPGDAYGLQDLLFSLGPQPLVAADEVFSHILKRPDRVLLILDGFEELEAQDGFLHSTCGPAPAEPCSLRGLLAGLFQKKLLRGCTLLLTARPRGRLVQSLSKADALFELSGFSMEQAQAYVMRYFESSGMTEHQDRALTLLRDRPLLLSHSHSPTLCRAVCQLSEALLELGEDAKLPSTLTGLYVGLLGRAALDSPPGALAELAKLAWELGRRHQSTLQEDQFPSADVRTWAMAKGLVQHPPRAAESELAFPSFLLQCFLGALWLALSGEIKDKELPQYLALTPRKKRPYDNWLEGVPRFLAGLIFQPPARCLGALLGPSAAASVDRKQKVLARYLKRLQPGTLRARQLLELLHCAHEAEEAGIWQHVVQELPGRLSFLGTRLTPPDAHVLGKALEAAGQDFSLDLRSTGICPSGLGSLVGLSCVTRFRWGEGLGRDILVLGINCGLGAKPSALWGSFSMQSSRVGQNGFSPFLR

SEQ ID NO: 4112 - protein, 353 aa, Homo sapiens
MRCLAPRPAGSYLSEPQGSSQCATMELGPLEGGYLELLNSDADPLCLYHFYDQMDLAGEEEIELYSEPDTDTINCDQFSRLLCDMEGDEETREAYANIAELDQYVFQDSQLEGLSKDIFKHIGPDEVIGESMEMPAEVGQKSQKRPFPEELPADLKHWKPAEPPTVVTGSLLVRPVSDCSTLPCLPLPALFNQEPASGQMRLEKTDQIPMPFSSSSLSCLNLPEGPIQFVPTISTLPHGLWQISEAGTGVSSIFIYHGEVPQASQVPPPSGFTVHGLPTSPDRPGSTSPFAPSATDLPSMPEPALTSRANMTEHKTSPTQCPAAGEVSNKLPKWPGREVPRKTQLGSSLLFGT

SEQ ID NO: 4113 - protein, 1443 aa, Homo sapiens
MYAVYKQAHPPTGLEFSMYCNFFNNSERNLVVAGTSQLYVYRLNRDAEALTKNDRSTEGKAHREKLELAASFSFFGNVMSMASVQLAGAKRDALLLSFKDAKLSVVEYDPGTHDLKTLSLHYFEEPELRDGFVQNVHTPRVRVDPDGRCAAMLVYGTRLVVLPFRRESLAEEHEGLVGEGQRSSFLPSYIIDVRALDEKLLNIIDLQFLHGYYEPTLLILFEPNQTWPGRVAVRQDTCSIVAISLNITQKVHPVIWSLTSLPFDCTQALAVPKPIGGVVVFAVNSLLYLNQSVPPYGVALNSLTTGTTAFPLRTQEGVRITLDCAQATFISYDKMVISLKGGEIYVLTLITDGMRSVRAFHFDKAAASVLTTSMVTMEPGYLFLGSRLGNSLLLKYTEKLQEPPASAVREAADKEEPPSKKKRVDATAGWSAAGKSVPQDEVDEIEVYGSEAQSGTQLATYSFEVCDSILNIGPCANAAVGEPAFLSEEFQNSPEPDLEIVVCSGHGKNGALSVLQKSIRPQVVTTFELPGCYDMWTVIAPVRKEEEDNPKGEGTEQEPSTTPEADDDGRRHGFLILSREDSTMILQTGQEIMELDTSGFATQGPTVFAGNIGDNRYIVQVSPLGIRLLEGVNQLHFIPVDLGAPIVQCAVADPYVVIMSAEGHVTMFLLKSDSYGGRHHRLALHKPPLHHQSKVITLCLYRDLSGMFTTESRLGGARDELGGRSGPEAEGLGSETSPTVDDEEEMLYGDSGSLFSPSKEEARRSSQPPADRDPAPFRAEPTHWCLLVRENGTMEIYQLPDWRLVFLVKNFPVGQRVLVDSSFGQPTTQGEARREEATRQGELPLVKEVLLVALGSRQSRPYLLVHVDQELLIYEAFPHDSQLGQGNLKVRFKKVPHNINFREKKPKPSKKKAEGGGAEEGAGARGRVARFRYFEDIYGYSGVFICGPSPHWLLVTGRGALRLHPMAIDGPVDSFAPFHNVNCPRGFLYFNRQGELRISVLPAYLSYDAPWPVRKIPLRCTAHYVAYHVESKVYAVATSTNTPCARIPRMTGEEKEFETIERDERYIHPQQEAFSIQLISPVSWEAIPNARIELQEWEHVTCMKTVSLRSEETVSGLKGYVAAGTCLMQGEEVTCRGRILIMDVIEVVPEPGQPLTKNKFKVLYEKEQKGPVTALCHCNGHLVSAIGQKIFLWSLRASELTGMAFIDTQLYIHQMISVKNFILAADVMKSISLLRYQEESKTLSLVSRDAKPLEVYSVDFMVDNAQLGFLVSDRDRNLMVYMYLPEAKESFGGMRLLRRADFHVGAHVNTFWRTPCRGATEGLSKKSVVWENKHITWFATLDGGIGLLLPMQEKTYRRLLMLQNALTTMLPHHAGLNPRAFRMLHVDRRTLQNAVRNVLDGELLNRYLYLSTMERSELAKKIGTTPDIILDDLLETDRVTAHF

SEQ ID NO: 4114 - protein, 782 aa, Homo sapiens
MTSIIKLTTLSGVQEESALCYLLQVDEFRFLLDCGWDEHFSMDIIDSLRKHVHQIDAVLLSHPDPLHLGALPYAVGKLGLNCAIYATIPVYKMGQMFMYDLYQSRHNTEDFTLFTLDDVDAAFDKIQQLKFSQIVNLKGKGHGLSITPLPAGHMIGGTIWKIVKDGEEEIVYAVDFNHKREIHLNGCSLEMLSRPSLLITDSFNATYVQPRRKQRDEQLLTNVLETLRGDGNVLIAVDTAGRVLELAQLLDQIWRTKDAGLGVYSLALLNNVSYNVVEFSKSQVEWMSDKLMRCFEDKRNNPFQFRHLSLCHGLSDLARVPSPKVVLASQPDLECGFSRDLFIQWCQDPKNSIILTYRTTPGTLARFLIDNPSEKITEIELRKRVKLEGKELEEYLEKEKLKKEAAKKLEQSKEADIDSSDESDIEEDIDQPSAHKTKHDLMMKGEGSRKGSFFKQAKKSYPMFPAPEERIKWDEYGEIIKPEDFLVPELQATEEEKSKLESGLTNGDEPMDQDLSDVPTKCISTTESIEIKARVTYIDYEGRSDGDSIKKIINQMKPRQLIIVHGPPEASQDLAECCRAFGGKDIKVYMPKLHETVDATSETHIYQVRLKDSLVSSLQFCKAKDAELAWIDGVLDMRVSKVDTGVILEEGELKDDGEDSEMQVEAPSDSSVIAQQKAMKSLFGDDEKETGEESEIIPTLEPLPPHEVPGHQSVFMNEPRLSDFKQVLLREGIQAEFVGGVLVCNNQVAVRRTETGRIGLEGCLCQDFYRIRDLLYEQYAIV

SEQ ID NO: 4115 - protein, 80 aa, Homo sapiens
MTSIIKLTTLSGVQEESALCYLLQVDEFRFLLDCGWDEHFSMDIIDSLRKHVHQIDAVLLSHPDPLHLGALPYAVGKLGL

SEQ ID NO: 4116 - protein, 684 aa, Homo sapiens
MSAIPAEESDQLLIRPLGAGQEVGRSCIILEFKGRKIMLDCGIHPGLEGMDALPYIDLIDPAEIDLLLISHFHLDHCGALPWFLQKTSFKGRTFMTHATKAIYRWLLSDYVKVSNISADDMLYTETDLEESMDKIETINFHEVKEVAGIKFWCYHAGHVLGAAMFMIEIAGVKLLYTGDFSRQEDRHLMAAEIPNIKPDILIIESTYGTHIHEKREEREARFCNTVHDIVNRGGRGLIPVFALGRAQELLLILDEYWQNHPELHDIPIYYASSLAKKCMAVYQTYVNAMNDKIRKQININNPFVFKHISNLKSMDHFDDIGPSVVMASPGMMQSGLSRELFESWCTDKRNGVIIAGYCVEGTLAKHIMSEPEEITTMSGQKLPLKMSVDYISFSAHTDYQQTSEFIRALKPPHVILVHGEQNEMARLKAALIREYEDNDEVHIEVHNPRNTEAVTLNFRGEKLAKVMGFLADKKPEQGQRVSGILVKRNFNYHILSPCDLSNYTDLAMSTVKQTQAIPYTGPFNLLCYQLQKLTGDVEELEIQEKPALKVFKNITVIQEPGMVVLEWLANPSNDMYADTVTTVILEVQSNPKIRKGAVQKVSKKLEMHVYSKRLEIMLQDIFGEDCVSVKDDSILSVTVDGKTANLNLETRTVECEEGSEDDESLREMVELAAQRLYEALTPVH

SEQ ID NO: 4117 - protein, 546 aa, Homo sapiens
MSAIPAEESDQLLIRPLGAGQEVGRSCIILEFKGRKIMLDCGIHPGLEGMDALPYIDLIDPAEIDLLLISHFHLDHCGALPWFLQKTSFKGRTFMTHATKAIYRWLLSDYVKVSNISADDMLYTETDLEESMDKIETINFHEVKEVAGIKFWCYHAGHVLGAAMFMIEIAGVKLLYTGDFSRQEDRHLMAAEIPNIKPDILIIESTYGTHIHEKREEREARFCNTVHDIVNRGGRGLIPVFALGRAQELLLILDEYWQNHPELHDIPIYYASSLAKKCMAVYQTYVNAMNDKIRKQININNPFVFKHISNLKSMDHFDDIGPSVVMASPGMMQSGLSRELFESWCTDKRNGVIIAGYCVEGTLAKILVHGEQNEMARLKAALIREYEDNDEVHIEVHNPRNTEAVTLNFRGEKLAKVMGFLADKKPEQGQRVSGILVKRNFNYHILSPCDLSNYTDLAMSTVKQTQAIPYTGPFNLLCYQLQKLTGDVEELEIQEKPALKVFKNITVIQEPGMVVLEWLANPSNDMYADTVTTVILEVQSNPKIRK

SEQ ID NO: 4118 - protein, 406 aa, Homo sapiens [sequence omitted]

SEQ ID NO: 4119 - protein, 514 aa, Homo sapiens
MGRPESAGGGSRGPFEGGGRARRAGGIFLTLSILRTRDLPSGAMSEGVDLIDIYADEEFNQDPEFNNTDQIDLYDDVLTATSQPSDDRSSSTEPPPPVRQEPSPKPNNKTPAILYTYSGLRNRRAAVYVGSFSWWTTDQQLIQVIRSIGVYDVVELKFAENRANGQSKGYAEVVVASENSVHKLLELLPGKVLNGEKVDVRPATRQNLSQFEAQARKRECVRVPRGGIPPRAHSRDSSDSADGRATPSENLVPSSARVDKPPSVLPYFNRPPSALPLMGLPPPPIPPPPPLSSSFGVPPPPPGIHYQHLMPPPPRLPPHLAVPPPGAIPPALHLNPAFFPPPNATVGPPPDTYMKASAPYNHHGSRDSGPPPSTVSEAEFEDIMKRNRAISSSAISKAVSGASAGDYSDAIETLLTAIAVIKQSRVANDERCRVLISSLKDCLHGIEAKSYSVGASGSSSRKRHRSRERSPSRSRESSRRHRDLLHNEDRHDDYFQERNREHERHRDRERDRHH

SEQ ID NO: 4120 - protein, 471 aa, Homo sapiens
MSEGVDLIDIYADEEFNQDPEFNNTDQIDLYDDVLTATSQPSDDRSSSTEPPPPVRQEPSPKPNNKTPAILYTYSGLRNRRAAVYVGSFSWWTTDQQLIQVIRSIGVYDVVELKFAENRANGQSKGYAEVVVASENSVHKLLELLPGKVLNGEKVDVRPATRQNLSQFEAQARKRECVRVPRGGIPPRAHSRDSSDSADGRATPSENLVPSSARVDKPPSVLPYFNRPPSALPLMGLPPPPIPPPPPLSSSFGVPPPPPGIHYQHLMPPPPRLPPHLAVPPPGAIPPALHLNPAFFPPPNATVGPPPDTYMKASAPYNHHGSRDSGPPPSTVSEAEFEDIMKRNRAISSSAISKAVSGASAGDYSDAIETLLTAIAVIKQSRVANDERCRVLISSLKDCLHGIEAKSYSVGASGSSSRKRHRSRERSPSRSRESSRRHRDLLHNEDRHDDYFQERNREHERHRDRERDRHH

SEQ ID NO: 4121 - protein, 205 aa, Homo sapiens
MSEGVDLIDIYADEEFNQDPEFNNTDQIDLYDDVLTATSQPSDDRSSSTEPPPPVRQEPSPKPNNKTPAILYTYSGLRNRRAAVYVGSFSWWTTDQQLIQVIRSIGVYDVVELKFAENRANGQSKGYAEVVVASENSVHKLLELLPGKVLNGEKVDVRPATRQNLSQFEAQARKRIPPRAHSRDSSDSADGRATPSENLVPSSAR

SEQ ID NO: 4122 - protein, 462 aa, Homo sapiens
MSEGVDLIDIYADEEFNQDPEFNNTDQIDLYDDVLTATSQPSDDRSSSTEPPPPVRQEPSPKPNNKTPAILYTYSGLRNRRAAVYVGSFSWWTTDQQLIQVIRSIGVYDVVELKFAENRANGQSKGYAEVVVASENSVHKLLELLPGKVLNGEKVDVRPATRQNLSQFEAQARKRIPPRAHSRDSSDSADGRATPSENLVPSSARVDKPPSVLPYFNRPPSALPLMGLPPPPIPPPPPLSSSFGVPPPPPGIHYQHLMPPPPRLPPHLAVPPPGAIPPALHLNPAFFPPPNATVGPPPDTYMKASAPYNHHGSRDSGPPPSTVSEAEFEDIMKRNRAISSSAISKAVSGASAGDYSDAIETLLTAIAVIKQSRVANDERCRVLISSLKDCLHGIEAKSYSVGASGSSSRKRHRSRERSPSRSRESSRRHRDLLHNEDRHDDYFQERNREHERHRDRERDRHH

SEQ ID NO: 4123 - protein, 462 aa, Homo sapiens; identical to SEQ ID NO: 4122

SEQ ID NO: 4124 - protein, 144 aa, Homo sapiens
MSEGVDLIDIYADEEFNQDPEFNNTDQIDLYDDVLTATSQPSDDRSSSTEPPPPVRQEPSPKPNNKTPAILYTYSGLRNRRAAVYVGSFSWWTTDQQLIQVIRSIGVYDVVELKFAENRANGQSKGYAEVVVASENSVHKLLEL

SEQ ID NO: 4125 - protein, 146 aa, Homo sapiens
MSEGVDLIDIYADEEFNQDPEFNNTDQIDLYDDVLTATSQPSDDRSSSTEPPPPVRQEPSPKPNNKTPAILYTYSGLRNRRAAVYVGSFSWWTTDQQLIQVIRSIGVYDVVELKFAENRANGQSKGYAEVVVASENSVHKLLELLP

SEQ ID NO: 4126 - protein, 288 aa, Homo sapiens
MSEGVDLIDIYADEEFNQDPEFNNTDQIDLYDDVLTATSQPSDDRSSSTEPPPPVRQEPSPKPNNKTPAILYTYSGLRNRRAAVYVGSFSWWTTDQQLIQVIRSIGVYDVVELKFAENRANGQSKGYAEVVVASENSVHKLLELLPGKVLNGEKVDVRPATRQNLSQFEAQARKRIPPRAHSRDSSDSADGRATPSENLVPSSARVDKPPSVLPYFNRPPSALPLMGLPPPPIPPPPPLSSSFGVPPPPPGIHYQHLMPPPPRLPPHLAVPPPGAIPPALHLNPAFFP

SEQ ID NO: 4127 - protein, 431 aa, Homo sapiens
MYRTKVGLKDRQQLYKLIISQLLYDGYISIANGLINEIKPQSVCAPSEQLLHLIKLGMENDDTAVQYAIGRSDTVAPGTGIDLEFDADVQTMSPEASEYETCYVTSHKGPCRVATYSRDGQLIATGSADASIKILDTERMLAKSAMPIEVMMNETAQQNMENHPVIRTLYDHVDEVTCLAFHPTEQILASGSRDYTLKLFDYSKPSAKRAFKYIQEAEMLRSISFHPSGDFILVGTQHPTLRLYDINTFQCFVSCNPQDQHTDAICSVNYNSSANMYVTGSKDGCIKLWDGVSNRCITTFEKAHDGAEVCSAIFSKNSKYILSSGKDSVAKLWEISTGRTLVRYTGAGLSGRQVHRTQAVFNHTEDYVLLPDERTISLCCWDSRTAERRNLLSLGHNNIVRCIVHSPTNPGFMTCSDDFRARFWYRRSTTD

SEQ ID NO: 4128 - protein, 345 aa, Homo sapiens
MYRTKVGLKDRQQLYKLIISQLLYDGYISIANGLINEIKPQSVCAPSEQLLHLIKLGMENDDTAVQYAIGRSDTVAPGTGIDLEFDADVQTMSPEASEYETCYVTSHKGPCRVATYSRDGQLIATGSADASIKILDTERMLAKSAMPIEVMMNETAQQNMENHPVIRTLYDHVDEVTCLAFHPTEQILASGSRDYTLKLFDYSKPSAKRAFKYIQEAEMLRSISFHPSGDFILVGTQHPTLRLYDINTFQCFVSCNPQDQHTDAICSVNYNSSANMYVTGSKDGCIKLWDGVSNRCITTFEKAHDGAEVCSAIFSKNSKYILSSGKDSVAKLWEISTGRTLVRYT

SEQ ID NO: 4129 - protein, 418 aa, Homo sapiens
MYRLIISQLLYDGYISIANGLINEIKPQSVCAPSEQLLHLIKLGMENDDTAVQYAIGRSDTVAPGTGIDLEFDADVQTMSPEASEYETCYVTSHKGPCRVATYSRDGQLIATGSADASIKILDTERMLAKSAMPIEVMMNETAQQNMENHPVIRTLYDHVDEVTCLAFHPTEQILASGSRDYTLKLFDYSKPSAKRAFKYIQEAEMLRSISFHPSGDFILVGTQHPTLRLYDINTFQCFVSCNPQDQHTDAICSVNYNSSANMYVTGSKDGCIKLWDGVSNRCITTFEKAHDGAEVCSAIFSKNSKYILSSGKDSVAKLWEISTGRTLVRYTGAGLSGRQVHRTQAVFNHTEDYVLLPDERTISLCCWDSRTAERRNLLSLGHNNIVRCIVHSPTNPGFMTCSDDFRARFWYRRSTTD

SEQ ID NO: 4130 - protein, 142 aa, Homo sapiens
MYRTKVGLKDRQQLYKLIISQLLYDGYISIANGLINEIKPQSVCAPSEQLLHLIKLGMENDDTAVQYAIGRSDTVAPGTGIDLEFDADVQTMSPEASEYETCYVTSHKGPCRVATYSRDGQLIATGSADASIKILDTERMLA

SEQ ID NO: 4131 - protein, 345 aa, Homo sapiens; identical to SEQ ID NO: 4128

SEQ ID NO: 4132 - protein, 577 aa, Homo sapiens
MAGLTVRDPAVDRSLRSVFVGNIPYEATEEQLKDIFSEVGPVVSFRLVYDRETGKPKGYGFCEYQDQETALSAMRNLNGREFSGRALRVDNAASEKNKEELKSLGTGAPVIESPYGETISPEDAPESISKAVASLPPEQMFELMKQMKLCVQNSPQEARNMLLQNPQLAYALLQAQVVMRIVDPEIALKILHRQTNIPTLIAGNPQPVHGAGPGSGSNVSMNQQNPQAPQAQSLGGMHVNGAPPLMQASMQGGVPAPGQMPAAVTGPGPGSLAPGGGMQAQVGMPGSGPVSMERGQVPMQDPRAAMQRGSLPANVPTPRGLLGDAPNDPRGGTLLSVTGEVEPRGYLGPPHQGPPMHHVPGHESRGPPPHELRGGPLPEPRPLMAEPRGPMLDQRGPPLDGRGGRDPRGIDARGMEARAMEARGLDARGLEARAMEARAMEARAMEARAMEARAMEVRGMEARGMDTRGPVPGPRGPIPSGMQGPSPINMGAVVPQGSRQVPVMQGTGMQGASIQGGSQPGGFSPGQNQVTPQDHEKAALIMQVLQLTADQIAMLPPEQRQSILILKEQIQKSTGAP

SEQ ID NO: 4133 - protein, 553 aa, Homo sapiens
MAGLTVRDPAVDRSLRSVFVGNIPYEATEEQLKDIFSEVGPVVSFRLVYDRETGKPKGYGFCEYQDQETALSAMRNLNGREFSGRALRVDNAASEKNKEELKSLGTGAPVIESPYGETISPEDAPESISKAVASLPPEQMFELMKQMKLCVQNSPQEARNMLLQNPQLAYALLQAQVVMRIVDPEIALKILHRQTNIPTLIAGNPQAQSLGGMHVNGAPPLMQASMQGGVPAPGQMPAAVTGPGPGSLAPGGGMQAQVGMPGSGPVSMERGQVPMQDPRAAMQRGSLPANVPTPRGLLGDAPNDPRGGTLLSVTGEVEPRGYLGPPHQGPPMHHVPGHESRGPPPHELRGGPLPEPRPLMAEPRGPMLDQRGPPLDGRGGRDPRGIDARGMEARAMEARGLDARGLEARAMEARAMEARAMEARAMEARAMEVRGMEARGMDTRGPVPGPRGPIPSGMQGPSPINMGAVVPQGSRQVPVMQGTGMQGASIQGGSQPGGFSPGQNQVTPQDHEKAALIMQVLQLTADQIAMLPPEQRQSILILKEQIQKSTGAP

SEQ ID NO: 4134 - protein, 717 aa, Homo sapiens
MSGDGATEQAAEYVPEKVKKAEKKLEENPYDLDAWSILIREAQNQPIDKARKTYERLVAQFPSSGRFWKLYIEAEIKAKNYDKVEKLFQRCLMKVLHIDLWKCYLSYVRETKGKLPSYKEKMAQAYDFALDKIGMEIMSYQIWVDYINFLKGVEAVGSYAENQRITAVRRVYQRGCVNPMINIEQLWRDYNKYEEGINIHLAKKMIEDRSRDYMNARRVAKEYETVMKGLDRNAPSVPPQNTPQEAQQVDMWKKYIQWEKSNPLRTEDQTLITKRVMFAYEQCLLVLGHHPDIWYEAAQYLEQSSKLLAEKGDMNNAKLFSDEAANIYERAISTLLKKNMLLYFAYADYEESRMKYEKVHSIYNRLLAIEDIDPTLVYIQYMKFARRAEGIKSGRMIFKKAREDTRTRHHVYVTAALMEYYCSKDKSVAFKIFELGLKKYGDIPEYVLAYIDYLSHLNEDNNTRVLFERVLTSGSLPPEKSGEIWARFLAFESNIGDLASILKVEKRRFTAFKEEYEGKETALLVDRYKFMDLYPCSASELKALGYKDVSRAKLAAIIPDPVVAPSIVPVLKDEVDRKPEYPKPDTQQMIPFQPRHLAPPGLHPVPGGVFPVPPAAVVLMKLLPPPICFQGPFVQVDELMEIFRRCKIPNTVEEAVRIITGGAPELAVEGNGPVESNAVLTKAVKRPNEDSDEDEEKGAVVPPVHDIYRARQQKRIR

SEQ ID NO: 4135 - protein, 44 aa, Homo sapiens
MSGDGATEQAAEYVPEKVKKAEKKLEENPYDLDAWSILIREAQV

SEQ ID NO: 4136 - protein, 103 aa, Homo sapiens
MSGDGATEQAAEYVPEKVKKAEKKLEENPYDLDAWSILIREAQNQPIDKARKTYERLVAQFPSSGRFWKLYIEAEVTILFYFFLYQYCSIHCSDRKQVRNIAN

SEQ ID NO: 4137 - protein, 61 aa, Homo sapiens
MSGDGATEQAAEYVPEKVKKAEKKLEENPYDLDAWSILIREAQNQPIDKARKTYERLVAQF

SEQ ID NO: 4138 - protein, 650 aa, Homo sapiens
MTLMLGAQIKAKNYDKVEKLFQRCLMKVLHIDLWKCYLSYVRETKGKLPSYKEKMAQAYDFALDKIGMEIMSYQIWVDYINFLKGVEAVGSYAENQRITAVRRVYQRGCVNPMINIEQLWRDYNKYEEGINIHLAKKMIEDRSRDYMNARRVAKEYETVMKGLDRNAPSVPPQNTPQEAQQVDMWKKYIQWEKSNPLRTEDQTLITKRVMFAYEQCLLVLGHHPDIWYEAAQYLEQSSKLLAEKGDMNNAKLFSDEAANIYERAISTLLKKNMLLYFAYADYEESRMKYEKVHSIYNRLLAIEDIDPTLVYIQYMKFARRAEGIKSGRMIFKKAREDTRTRHHVYVTAALMEYYCSKDKSVAFKIFELGLKKYGDIPEYVLAYIDYLSHLNEDNNTRVLFERVLTSGSLPPEKSGEIWARFLAFESNIGDLASILKVEKRRFTAFKEEYEGKETALLVDRYKFMDLYPCSASELKALGYKDVSRAKLAAIIPDPVVAPSIVPVLKDEVDRKPEYPKPDTQQMIPFQPRHLAPPGLHPVPGGVFPVPPAAVVLMKLLPPPICFQGPFVQVDELMEIFRRCKIPNTVEEAVRIITGGAPELAVEGNGPVESNAVLTKAVKRPNEDSDEDEEKGAVVPPVHDIYRARQQKRIR

SEQ ID NO: 4139 - protein, 674 aa, Homo sapiens
MWHEARKHERKLRGMMVDYKKRAERRREYYEKIKKDPAQFLQVHGRACKVHLDSAVALAAESPVNMMPWQGDTNNMIDRFDVRAHLDHIPDYTPPLLTTISPEQESDERKCNYERYRGLVQNDFAGISEEQCLYQIYIDELYGGLQRPSEDEKKKLAEKKASIGYTYEDSTVAKVEKAAEKPEEEESAAEEESNSDEDEVIPDIDVEVDVDELNQEQVADLNKQATTYGMADGDFVRMLRKDKEEAEAIKHAKALEEEKAMYSGRRSRRQRREFREKRLRGRKISPPSYARRDSPTYDPYKRSPSESSSESRSRSRSPTPGREEKITFITSFGGSDEEAAAAAAAAAASGVTTGKPPAPPQPGGPAPGRNASARRRSSSSSSSSSASRTSSSRSSSRSSSRSRRGGGYYRSGRHARSRSRSWSRSRSRSRRYSRSRSRGRRHSGGGSRDGHRYSRSPARRGGYGPRRRSRSRSHSGDRYRRGGRGLRHHSSSRSRSSWSLSPSRSRSLTRSRSHSPSPSQSRSRSRSRSQSPSPSPAREKLTRPAASPAVGEKLKKTEPAAGKETGAAKPKLTPQEKLKLRMQKALNRQFKADKKAAQEKMIQQEHERQEREDELRAMARKIRMKERERREKEREEWERQYSRQSRSPSPRYSREYSSSRRRSRSRSRSPHYRH

SEQ ID NO: 4140 - protein, 594 aa, Homo sapiens
MWHEARKHERKLRGMMVDYKKRAERRREYYEKIKKDPAQFLQVHGRACKVHLDSAVALAAESPVNMMPWQGDTNNMIDRFDVRAHLDHIPDYTPPLLTTISPEQESDERKCNYERYRGLVQNDFAGISEEQCLYQIYIDELYGGLQRPSEDEKKKLAEKKASIGYTYEDSTVAKVEKAAEKPEEEESAAEEESNSDEDEVIPDIDVEVDVDELNQEQVADLNKQATTYGMADGDFVRMLRKDKEEAEAIKHAKALEEEKAMYSGRRSRRQRREFREKRLRGRKISPPSYARRDSPTYDPYKRSPSESSSESRSRSRSPTPGREEKITFITSFGGSDEEAAAAAAAAAASGVTTGKPPAPPQPGGPAPGRNASARRRSSSSSSSSSASRTSSSRSSSRSSSRSRRGGGYYRSGRHARSRSRSWSRSRSRSRRYSRSRSRGRRHSGGGSRDGHRYSRSPARRGGYGPRRRSRSRSHSGDRYRRGGRGLRHHSSSRSRSSWSLSPSRSRSLTRSRSHSPSPSQSRSRSRSRSQSPSPSPAREKLTRPAASPAVGEKLKKTEPAAGKETGAAKVTQADASGEAETEDAEGAEQAVQGG

SEQ ID NO: 4141 - protein, 612 aa, Homo sapiens
MWHEARKHERKLRGMMVDYKKRAERRREYYEKIKKDPAQFLQESDERKCNYERYRGLVQNDFAGISEEQCLYQIYIDELYGGLQRPSEDEKKKLAEKKASIGYTYEDSTVAKVEKAAEKPEEEESAAEEESNSDEDEVIPDIDVEVDVDELNQEQVADLNKQATTYGMADGDFVRMLRKDKEEAEAIKHAKALEEEKAMYSGRRSRRQRREFREKRLRGRKISPPSYARRDSPTYDPYKRSPSESSSESRSRSRSPTPGREEKITFITSFGGSDEEAAAAAAAAAASGVTTGKPPAPPQPGGPAPGRNASARRRSSSSSSSSSASRTSSSRSSSRSSSRSRRGGGYYRSGRHARSRSRSWSRSRSRSRRYSRSRSRGRRHSGGGSRDGHRYSRSPARRGGYGPRRRSRSRSHSGDRYRRGGRGLRHHSSSRSRSSWSLSPSRSRSLTRSRSHSPSPSQSRSRSRSRSQSPSPSPAREKLTRPAASPAVGEKLKKTEPAAGKETGAAKPKLTPQEKLKLRMQKALNRQFKADKKAAQEKMIQQEHERQEREDELRAMARKIRMKERERREKEREEWERQYSRQSRSPSPRYSREYSSSRRRSRSRSRSPHYRH

SEQ ID NO: 4142 - protein, 655 aa, Homo sapiens
MWHEARKHERKLRGMMVDYKKRAERRREYYEKIKKDPAQFLQVHGRACKVHLDSAVALAAESPVNMMPWQGDTNNMIDRFDVRAHLDHIPDYTPPLLTTISPEQESDERKCNYERYRGLVQNDFAGISEEQCLYQIYIDELYGGLQRPSEDEKKKLAEKKASIGYTYEDSTVAKVEKAAEKPEEEESAAEEESNSDEDEVIPDIDVEVDVDELNQEQVADLNKQATTYGMADGDFVRMLRKDKEEAEAIKHAKALEEEKAMYSGRRSRRQRREFREKRLRGRKISPPSYARRDSPTYDPYKRSPSESSSESRSRSRSPTPGREEKITFITSFGGSDEEAAAAAAAAAASGVTTGKPPAPPQPGGPAPGRNASARRRSSSSSSSSSASRTSSSRSSSRSSSRSRRGGGYYRSGRHARSRSRSWSRSRSRSRRYSRSRSRGRRHSGGGSRDGHRYSRSPARRGGYGPRRRSRSRSHSGDRYRRGGRGLRHHSSSRSRSSWSLSPSRSRSLTRSRSHSPSPSQSRSRSRSRSQSPSPSPAREKLTRPAASPAVGEKLKKTEPAAGKETGAAKVIKADKKAAQEKMIQQEHERQEREDELRAMARKIRMKERERREKEREEWERQYSRQSRSPSPRYSREYSSSRRRSRSRSRSPHYRH

SEQ ID NO: 4143 - protein, 413 aa, Homo sapiens
MSFRDLRNFTEMMRALGYPRHISMENFRTPNFGLVSEVLLWLVKRYEPQTDIPPDVDTEQDRVFFIKAIAQFMATKAHIKLNTKKLYQADGYAVKELLKITSVLYNAMKTKGMEGSEIVEEDVNKFKFDLGSKIADLKAARQLASEITSKGASLYDLLGMEVELREMRTEAIARPLEINETEKVMRIAIKEILTQVQKTKDLLNNVASDEANLEAKIEKRKLELERNRKRLETLQSVRPCFMDEYEKTEEELQKQYDTYLEKFQNLTYLEQQLEDHHRMEQERFEEAKNTLCLIQNKLKEEEKRLLKSGSNDDSDIDIQEDDESDSELEERRLPKPQTAMEMLMQGRPGKRIVGTMQGGDSDDNEDSEESEIDMEDDDDEDDDLEDESISLSPTKPNRRVRKSEPLDESDNDF

SEQ ID NO: 4144 - protein, 247 aa, Homo sapiens
MRTEAIARPLEINETEKVMRIAIKEILTQVQKTKDLLNNVASDEANLEAKIEKRKLELERNRKRLETLQSVRPCFMDEYEKTEEELQKQYDTYLEKFQNLTYLEQQLEDHHRMEQERFEEAKNTLCLIQNKLKEEEKRLLKSGSNDDSDIDIQEDDESDSELEERRLPKPQTAMEMLMQGRPGKRIVGTMQGGDSDDNEDSEESEIDMEDDDDEDDDLEDESISLSPTKPNRRVRKSEPLDESDNDF

SEQ ID NO: 4145 - protein, 191 aa, Homo sapiens
MDEYEKTEEELQKQYDTYLEKFQNLTYLEQQLEDHHRMEQERFEEAKNTLCLIQNKLKEEEKRLLKSGSNDDSDIDIQEDDESDSELEERRLPKPQTAMEMLMQGRPGKRIVGTMQGGDSDDNMEAAPALLGKCKTSSSKKQEDSEESEIDMEDDDDEDDDLEDESISLSPTKPNRRVRKSEPLDESDNDF

SEQ ID NO: 4146 - protein, 413 aa, Homo sapiens; identical to SEQ ID NO: 4143

SEQ ID NO: 4147 - protein, 371 aa, Homo sapiens
MAAAAAGLGGGGAGPGPEAGDFLARYRLVSNKLKKRFLRKPNVAEAGEQFGQLGRELRAQECLPYAAWCQLAVARCQQALFHGPGEALALTEAARLFLRQERDARQRLVCPAAYGEPLQAAASALGAAVRLHLELGQPAAAAALCLELAAALRDLGQPAAAAGHFQRAAQLQLPQLPLAALQALGEAASCQLLARDYTGALAVFTRMQRLAREHGSHPVQSLPPPPPPAPQPGPGATPALPAALLPPNSGSAAPSPAALGAFSDVLVRCEVSRVLLLLLLQPPPAKLLPEHAQTLEKYSWEAFDSHGQESSGQLPEELFLLLQSLVMATHEKDTEAIKSLQVEMWPLLTAEQNHLLHLVLQETISPSGQGV

SEQ ID NO: 4148 - protein, 371 aa, Homo sapiens; identical to SEQ ID NO: 4147

SEQ ID NO: 4149 - protein, 371 aa, Homo sapiens; identical to SEQ ID NO: 4147

SEQ ID NO: 4150 - protein, 833 aa, Homo sapiens
MSPEKQHREEDEVDSVLLSASKILNSSEGVKESGCSDTEYGCIAESENQIQPQSALKVLQQQLESFQALRMQTLQNVSMVQSEISEILNKSIIEVENPQFSSEKNLVFGTRIEKDLPTENQEENLSMEKSHHFEDSKTLHSVEEKLSGDSVNSLPQSVNVPSQIHSEDTLTLRTSTDNLSSNIIIHPSENSDILKNYNNFYRFLPTAPPNVMSQADTVILDKSKITVPFLKHGFCENLDDICHSIKQMKEELQKSHDGEVALTNELQTLQTDPDVHRNGKYDMSPIHQDKMNFIKEENLDGNLNEDIKSKRISELEALVKKLLPFRETVSKFHVHFCRKCKKLSKSEMHRGKKNEKNNKEIPITGKNITDLKFHSRVPRYTLSFLDQTKHEMKDKERQPFLVKQGSIISENEKTSKVNSVTEQCVAKIQYLQNYLKESVQIQKKVMELESENLNLKSKMKPLIFTTQSLIQKVETYEKQLKNLVEEKSTIQSKLSKTEEYSKECLKEFKKIISKYNVLQGQNKTLEEKNIQLSLEKQQMMEALDQLKSKEHKTQSDMAIVNNENNRMSIEMEAMKTNILLIQDEKEMLEKKTHQLLKEKSSLGNELKESQLEIIQLKEKERLAKTEQETLLQIIETVKDEKLNLETTLQESTAARQIMEREIENIQTYQSTAEENFLQEIKNAKSEASIYKNSLSEIGKECEMLSKMVMETKTDNQILKEELKKHSQENIKFENSISRLTEDKILLENYVRSIENERDTLEFEMRHLQREYLSLSDKICNQHNDPSKTTYISRREKFHFDNYTHEDTSSPQSRPLASDLKGYFKVKDRTLKHH

SEQ ID NO: 4151 - protein, 796 aa, Homo sapiens
MSPEKQHREEDEVDSVLLSASKILNSSEGVKESGCSDTEYGCIAESENQIQPQSALKVLQQQLESFQALRMQTLQNVSMPTENQEENLSMEKSHHFEDSKTLHSVEEKLSGDSVNSLPQSVNVPSQIHSEDTLTLRTSTDNLSSNIIIHPSENSDILKNYNNFYRFLPTAPPNVMSQADTVILDKSKITVPFLKHGFCENLDDICHSIKQMKEELQKSHDGEVALTNELQTLQTDPDVHRNGKYDMSPIHQDKMNFIKEENLDGNLNEDIKSKRISELEALVKKLLPFRETVSKFHVHFCRKCKKLSKSEMHRGKKNEKNNKEIPITGKNITDLKFHSRVPRYTLSFLDQTKHEMKDKERQPFLVKQGSIISENEKTSKVNSVTEQCVAKIQYLQNYLKESVQIQKKVMELESENLNLKSKMKPLIFTTQSLIQKVETYEKQLKNLVEEKSTIQSKLSKTEEYSKECLKEFKKIISKYNVLQGQNKTLEEKNIQLSLEKQQMMEALDQLKSKEHKTQSDMAIVNNENNRMSIEMEAMKTNILLIQDEKEMLEKKTHQLLKEKSSLGNELKESQLEIIQLKEKERLAKTEQETLLQIIETVKDEKLNLETTLQESTAARQIMEREIENIQTYQSTAEENFLQEIKNAKSEASIYKNSLSEIGKECEMLSKMVMETKTDNQILKEELKKHSQENIKFENSISRLTEDKILLENYVRSIENERDTLEFEMRHLQREYLSLSDKICNQHNDPSKTTYISRREKFHFDNYTHEDTSSPQSRPLASDLKGYFKVKDRTLKHH

SEQ ID NO: 4152 - protein, 241 aa, Homo sapiens
MAPVRRSAKWRPGGIEARGEGVSTVGYRNKNVRQKTWRPNHPQAFVGSVREGQGFAFRRKLKIQQSYKKLLRKEKKAQTSLESQFTDRYPDNLKHLYLAEEERHRKQARKVDHPLSEQVHQPLLEEQCSIDEPLFEDQCSFDQPQPEEQCIKTVNSFTIPKKNKKKTSNQKAQEEYEQIQAKRAAKKQEFERRKQEREEAQRQYKKKKMEVFKILNKKTKKGQPNLNVQMEYLLQKIQEKC

SEQ ID NO: 4153 - protein, 360 aa, Homo sapiens
MDTPLRRSRRLGGLRPESPESLTSVSRTRRALVEFESNPEETREPGSPPSVQRAGLGSPERPPKTSPGSPRLQQGAGLESPQGQPEPGAASPQRQQDLHLESPQRQPEYSPESPRCQPKPSEEAPKCSQDQGVLASELAQNKEELTPGAPQHQLPPVPGSPEPYPGQQAPGPEPSQPLLELTPRAPGSPRGQHEPSKPPPAGETVTGGFGAKKRKGSSSQAPASKKLNKEELPVIPKGKPKSGRVWKDRSKKRFSQMLQDKPLRTSWQRKMKERQERKLAKDFARHLEEEKERRRQEKKQRRAENLKRRLENERKAEVVQVIRNPAKLKRAKKKQLRSIEKRDTLALLQKQPPQQPAAKI

SEQ ID NO: 4154 - protein, 163 aa, Homo sapiens
MDTPLRRSRRLGGLRPESPESLTSVSRTRRALVEFESNPEETREPGSPPSVQRAGLGSPERPPKTSPGSPRLQQGAGLESPQGQPEPGAASPQRQQDLHLESPQNKEELTPGAPQHQLPPVPGSPEPYPGQQATSSWGDGDRRLRGKEAKRFFIPGPSVQEVE

SEQ ID NO: 4155 - protein, 104 aa, Homo sapiens
MLQDKPLRTSWQRKMKERQERKLAKDFARHLEEEKERRRQEKKQRRAENLKRRLENERKAEVVQVIRNPAKLKRAKKKQLRSIEKRDTLALLQKQPPQQPAAKI

SEQ ID NO: 4156 - protein, 272 aa, Homo sapiens
MEEEAIASLPGEETEDMDFLSGLELADLLDPRQPDWHLDPGLSSPGPLSSSGGGSDSGGLWRGDDDDEAAAAEMQRFSDLLQRLLNGIGGCSSSSDSGSAEKRRRKSPGGGGGGGSGNDNNQAATKSPRKAAAAAARLNRLKKKEYVMGLESRVRGLAAENQELRAENRELGKRVQALQEESRYLRAVLANETGLARLLSRLSGVGLRLTTSLFRDSPAGDHDYALPVGKQKQDLLEEDDSAGGVCLHVDKDKVSVEFCSACARKASSSLKM

SEQ ID NO: 4157 - protein, 354 aa, Homo sapiens
MRHSLTKLLAASGSNSPTRSESPEPAATCSLPSDLTRAAAGEEETAAAGSPGRKQQFGDEGELEAGRGSRGGVAVRAPSPEEMEEEAIASLPGEETEDMDFLSGLELADLLDPRQPDWHLDPGLSSPGPLSSSGGGSDSGGLWRGDDDDEAAAAEMQRFSDLLQRLLNGIGGCSSSSDSGSAEKRRRKSPGGGGGGGSGNDNNQAATKSPRKAAAAAARLNRLKKKEYVMGLESRVRGLAAENQELRAENRELGKRVQALQEESRYLRAVLANETGLARLLSRLSGVGLRLTTSLFRDSPAGDHDYALPVGKQKQDLLEEDDSAGGVCLHVDKDKVSVEFCSACARKASSSLKM

SEQ ID NO: 4158 - protein, 354 aa, Homo sapiens; identical to SEQ ID NO: 4157

SEQ ID NO: 4159 - protein, 271 aa, Homo sapiens
MEHGSIITQARREDALVLTKQGLVSKSSPKKPRGRNIFKALFCCFRAQHVGQSSSSTELAAYKEEANTIAKSDLLQCLQYQFYQIPGTCLLPEVTEEDQGRICVVIDLDETLVHSSFKPINNADFIVPIEIEGTTHQVYVLKRPYVDEFLRRMGELFECVLFTASLAKYADPVTDLLDRCGVFRARLFRESCVFHQGCYVKDLSRLGRDLRKTLILDNSPASYIFHPENAVPVQSWFDDMADTELLNLIPIFEELSGAEDVYTSLGQLRAP

SEQ ID NO: 4160 - protein, 276 aa, Homo sapiens
MDGPAIITQVTNPKEDEGRLPGAGEKASQCNVSLKKQRSRSILSSFFCCFRDYNVEAPPPSSPSVLPPLVEENGGLQKGDQRQVIPIPSPPAKYLLPEVTVLDYGKKCVVIDLDETLVHSSFKPISNADFIVPVEIDGTIHQVYVLKRPHVDEFLQRMGQLFECVLFTASLAKYADPVADLLDRWGVFRARLFRESCVFHRGNYVKDLSRLGRELSKVIIVDNSPASYIFHPENAVPVQSWFDDMTDTELLDLIPFFEGLSREDDVYSMLHRLCNR

SEQ ID NO: 4161 - protein, 265 aa, Homo sapiens
MDGPAIITQVTNPKEDEGRLPGAGEKASQCNVSLKKQRSRSILSSFFCCFRDYNVEAPPPSSPSVLPPLVEENGGLQKPPAKYLLPEVTVLDYGKKCVVIDLDETLVHSSFKPISNADFIVPVEIDGTIHQVYVLKRPHVDEFLQRMGQLFECVLFTASLAKYADPVADLLDRWGVFRARLFRESCVFHRGNYVKDLSRLGRELSKVIIVDNSPASYIFHPENAVPVQSWFDDMTDTELLDLIPFFEGLSREDDVYSMLHRLCNR

SEQ ID NO: 4162 - protein, 1173 aa, Homo sapiens
MSRGSIEIPLRDTDEVIELDFDQLPEGDEVISILKQEHTQLHIWIALALEYYKQGKTEEFVKLLEAARIDGNLDYRDHEKDQMTCLDTLAAYYVQQARKEKNKDNKKDLITQATLLYTMADKIIMYDQNHLLGRACFCLLEGDKMDQADAQFHFVLNQSPNNIPALLGKACISFNKKDYRGALAYYKKALRTNPGCPAEVRLGMGHCFVKLNKLEKARLAFSRALELNSKCVGALVGLAVLELNNKEADSIKNGVQLLSRAYTIDPSNPMVLNHLANHFFFKKDYSKVQHLALHAFHNTEVEAMQAESCYQLARSFHVQEDYDQAFQYYYQATQFASSSFVLPFFGLGQMYIYRGDKENASQCFEKVLKAYPNNYETMKILGSLYAASEDQEKRDIAKGHLKKVTEQYPDDVEAWIELAQILEQTDIQGALSAYGTATRILQEKVQADVPPEILNNVGALHFRLGNLGEAKKYFLASLDRAKAEAEHDEHYYNAISVTTSYNLARLYEAMCEFHEAEKLYKNILREHPNYVDCYLRLGAMARDKGNFYEASDWFKEALQINQDHPDAWSLIGNLHLAKQEWGPGQKKFERILKQPSTQSDTYSMLALGNVWLQTLHQPTRDREKEKRHQDRALAIYKQVLRNDAKNLYAANGIGAVLAHKGYFREARDVFAQVREATADISDVWLNLAHIYVEQKQYISAVQMYENCLRKFYKHQNTEVVLYLARALFKCGKLQECKQTLLKARHVAPSDTVLMFNVALVLQRLATSVLKDEKSNLKEVLNAVKELELAHRYFSYLSKVGDKMRFDLALAATEARQCSDLLSQAQYHVARARKQDEEERELRAKQEQEKELLRQKLLKEQEEKRLREKEEQKKLLEQRAQYVEKTKNILMFTGETEATKEKKRGGGGGRRSKKGGEFDEFVNDDTDDDLPISKKKKRRKGSGSEQEGEDEEGGERKKKKRRRHPKGEEGSDDDETENGPKPKKRRPPKAEKKKAPKPERLPPSMKGKIKSKAIISSSDDSSDEDKLKIADEGHPRNSNSNSDSDEDEQRKKCASSESDSDENQNKSGSEAGSPRRPRRQRSDQDSDSDQPSRKRRPSGSEQSDNESVQSGRSHSGVSENDSRPASPSAESDHESERGSDNEGSGQGSGNESEPEGSNNEASDRGSEHGSDDSD

SEQ ID NO: 4163 - protein, 1230 aa, Homo sapiens
MASASYHISNLLEKMTSSDKDFRFMATNDLMTELQKDSIKLDDDSERKVVKMILKLLEDKNGEVQNLAVKCLGPLVSKVKEYQVETIVDTLCTNMLSDKEQLRDISSIGLKTVIGELPPASSGSALAANVCKKITGRLTSAIAKQEDVSVQLEALDIMADMLSRQGGLLVNFHPSILTCLLPQLTSPRLAVRKRTIIALGHLVMSCGNIVFVDLIEHLLSELSKNDSMSTTRTYIQCIAAISRQAGHRIGEYLEKIIPLVVKFCNVDDDELREYCIQAFESFVRRCPKEVYPHVSTIINICLKYLTYDPNYNYDDEDEDENAMDADGGDDDDQGSDDEYSDDDDMSWKVRRAAAKCLDAVVSTRHEMLPEFYKTVSPALISRFKEREENVKADVFHAYLSLLKQTRPVQSWLCDPDAMEQGETPLTMLQSQVPNIVKALHKQMKEKSVKTRQCCFNMLTELVNVLPGALTQHIPVLVPGIIFSLNDKSSSSNLKIDALSCLYVILCNHSPQVFHPHVQALVPPVVACVGDPFYKITSEALLVTQQLVKVIRPLDQPSSFDATPYIKDLFTCTIKRLKAADIDQEVKERAISCMGQIICNLGDNLGSDLPNTLQIFLERLKNEITRLTTVKALTLIAGSPLKIDLRPVLGEGVPILASFLRKNQRALKLGTLSALDILIKNYSDSLTAAMIDAVLDELPPLISESDMHVSQMAISFLTTLAKVYPSSLSKISGSILNELIGLVRSPLLQGGALSAMLDFFQALVVTGTNNLGYMDLLRMLTGPVYSQSTALTHKQSYYSIAKCVAALTRACPKEGPAVVGQFIQDVKNSRSTDSIRLLALLSLGEVGHHIDLSGQLELKSVILEAFSSPSEEVKSAASYALGSISVGNLPEYLPFVLQEITSQPKRQYLLLHSLKEIISSASVVGLKPYVENIWALLLKHCECAEEGTRNVVAECLGKLTLIDPETLLPRLKGYLISGSSYARSSVVTAVKFTISDHPQPIDPLLKNCIGDFLKTLEDPDLNVRRVALVTFNSAAHNKPSLIRDLLDTVLPHLYNETKVRKELIREVEMGPFKHTVDDGLDIRKAAFECMYTLLDSCLDRLDIFEFLNHVEDGLKDHYDIKMLTFLMLVRLSTLCPSAVLQRLDRLVEPLRATCTTKVKANSVKQEFEKQDELKRSAMRAVAALLTIPEAEKSPLMSEFQSQISSNPELAAIFESIQKDSSSTNLESMDTS

SEQ ID NO: 4164 - protein, 402 aa, Homo sapiens
YELVSRQGGLLVNFHPSILTCLLPQLTSPRLAVRKRTIIALGHLVMSCGNIVFVDLIEHLLSELSKNDSMSTTRTYIQCIAAISRQAGHRIGEYLEKIIPLVVKFCNVDDDELREYCIQAFESFVRRCPKEVYPHVSTIINICLKYLTYDPNYNYDDEDEDENAMDADGGDDDDQGSDDEYSDDDDMSWKVRRAAAKCLDAVVSTRHEMLPEFYKTVSPALISRFKEREENVKADVFHAYLSLLKQTRPVQSWLCDPDAMEQGETPLTMLQSQVPNIVKALHKQMKEKSVKTRQCCFNMLTELVNVLPGALTQHIPVLVPGIIFSLNDKSSSSNLKIDALSCLYVILCNHSPQVFHPHVQALVPPVVACVGDPFYKITSEALLVTQQLVKAHHMPEAQWLRL

SEQ ID NO: 4165 - protein, 1230 aa, Homo sapiens; identical to SEQ ID NO: 4163

SEQ ID NO: 4166 - protein, 1119 aa, Homo sapiens
MSTAAFHISSLLEKMTSSDKDFRFMATSDLMSELQKDSIQLDEDSERKVVKMLLRLLEDKNGEVQNLAVKWLGVPLGAFHASLLHCLLPQLSSPRLAVRKRAVGALGHLAAACSTDLFVELADHLLDRLPGPRVPTSPTAIRTLIQCLGSVGRQAGHRLGAHLDRLVPLVEDFCNLDDDELRESCLQAFEAFLRKCPKEMGPHVPNVTSLCLQYIKHDPNYNYDSDEDEEQMETEDSEFSEQESEDEYSDDDDMSWKVRRAAAKCIAALISSRPDLLPDFHCTLAPVLIRRFKEREENVKADVFTAYIVLLRQTQPPKGWLEAMEEPTQTGSNLHMLRGQVPLVVKALQRQLKDRSVRARQGCFSLLTELAGVLPGSLAEHMPVLVSGIIFSLADRSSSSTIRMDALAFLQGLLGTEPAEAFHPHLPILLPPVMACVADSFYKIAAEALVVLQELVRALWPLHRPRMLDPEPYVGEMSAVTLARLRATDLDQEVKERAISCMGHLVGHLGDRLGDDLEPTLLLLLDRLRNEITRLPAIKALTLVAVSPLQLDLQPILAEALHILASFLRKNQRALRLATLAALDALAQSQGLSLPPSAVQAVLAELPALVNESDMHVAQLAVDFLATVTQAQPASLVEVSGPVLSELLRLLRSPLLPAGVLAAAEGFLQALVGTRPPCVDYAKLISLLTAPVYEQAVDGGPGLHKQVFHSLARCVAALSAACPQEAASTASRLVCDARSPHSSTGVKVLAFLSLAEVGQVAGPGHQRELKAVLLEALGSPSEDVRAAASYALGRVGAGSLPDFLPFLLEQIEAEPRRQYLLLHSLREALGAAQPDSLKPYAEDIWALLFQRCEGAEEGTRGVVAECIGKLVLVNPSFLLPRLRKQLAAGRPHTRSTVITAVKFLISDQPHPIDPLLKSFIAVHNKPSLVRDLLDDILPLLYQETKIRRDLIREVEMGPFKHTVDDGLDVRKAAFECMYSLLESCLGQLDICEFLNHVEDGLKDHYDIRMLTFIMVARLATLCPAPVLQRVDRLIEPLRATCTAKVKAGSVKQEFEKQDELKRSAMRAVAALLTIPEVGKSPIMADFSSQIRSNPELAALFESIQKDSASAPSTDSMELS

SEQ ID NO: 4167 - protein, 1236 aa, Homo sapiens
MSTAAFHISSLLEKMTSSDKDFRFMATSDLMSELQKDSIQLDEDSERKVVKMLLRLLEDKNGEVQNLAVKCLGPLVVKVKEYQVETIVDTLCTNMRSDKEQLRDIAGIGLKTVLSELPPAATGSGLATNVCRKITGQLTSAIAQQEDVAVQLEALDILSDMLSRLGVPLGAFHASLLHCLLPQLSSPRLAVRKRAVGALGHLAAACSTDLFVELADHLLDRLPGPRVPTSPTAIRTLIQCLGSVGRQAGHRLGAHLDRLVPLVEDFCNLDDDELRESCLQAFEAFLRKCPKEMGPHVPNVTSLCLQYIKHDPNYNYDSDEDEEQMETEDSEFSEQESEDEYSDDDDMSWKVRRAAAKCIAALISSRPDLLPDFHCTLAPVLIRRFKEREENVKADVFTAYIVLLRQTQPPKGWLEAMEEPTQTGSNLHMLRGQVPLVVKALQRQLKDRSVRARQGCFSLLTELAGVLPGSLAEHMPVLVSGIIFSLADRSSSSTIRMDALAFLQGLLGTEPAEAFHPHLPILLPPVMACVADSFYKIAAEALVVLQELVRALWPLHRPRMLDPEPYVGEMSAVTLARLRATDLDQEVKERAISCMGHLVGHLGDRLGDDLEPTLLLLLDRLRNEITRLPAIKALTLVAVSPLQLDLQPILAEALHILASFLRKNQRALRLATLAALDALAQSQGLSLPPSAVQAVLAELPALVNESDMHVAQLAVDFLATVTQAQPASLVEVSGPVLSELLRLLRSPLLPAGVLAAAEGFLQALVGTRPPCVDYAKLISLLTAPVYEQAVDGGPGLHKQVFHSLARCVAALSAACPQEAASTASRLVCDARSPHSSTGVKVLAFLSLAEVGQVAGPGHQRELKAVLLEALGSPSEDVRAAASYALGRVGAGSLPDFLPFLLEQIEAEPRRQYLLLHSLREALGAAQPDSLKPYAEDIWALLFQRCEGAEEGTRGVVAECIGKLVLVNPSFLLPRLRKQLAAGRPHTRSTVITAVKFLISDQPHPIDPLLKSFIGEFMESLQDPDLNVRRATLAFFNSAVHNKPSLVRDLLDDILPLLYQETKIRRDLIREVEMGPFKHTVDDGLDVRKAAFECMYSLLESCLGQLDICEFLNHVEDGLKDHYDIRMLTFIMVARLATLCPAPVLQRVDRLIEPLRATCTAKVKAGSVKQEFEKQDELKRSAMRAVAALLTIPEVGKSPIMADFSSQIRSNPELAALFESIQKDSASAPSTDSMELS

SEQ ID NO: 4168 - protein, 1486 aa, Homo sapiens
MAANVGSMFQYWKRFDLRRLQKELNSVASELSARQEESEHSHKHLIELRREFKKNVPEEIREMVAPVLKSFQAEVVALSKRSQEAEAAFLSVYKQLIEAPDPVPVFEAARSLDDRLQPPSFDPSGQPRRDLHTSWKRNPELLSPKEQREGTSPAGPTLTEGSRLPGIPGKALLTETLLQRNEAEKQKGLQEVQITLAARLGEAEEKIKVLHSALKATQAELLELRRKYDEEAASKADEVGLIMTNLEKANQRAEAAQREVESLREQLASVNSSIRLACCSPQGPSGDKVNFTLCSGPRLEAALASKDREILRLLKDVQHLQSSLQELEEASANQIADLERQLTAKSEAIEKLEEKLQAQSDYEEIKTELSILKAMKLASSTCSLPQGMAKPEDSLLIAKEAFFPTQKFLLEKPSLLASPEEDPSEDDSIKDSLGTEQSYPSPQQLPPPPGPEDPLSPSPGQPLLGPSLGPDGTRTFSLSPFPSLASGERLMMPPAAFKGEAGGLLVFPPAFYGAKPPTAPATPAPGPEPLGGPEPADGGGGGAAGPGAEEEQLDTAEIAFQVKEQLLKHNIGQRVFGHYVLGLSQGSVSEILARPKPWRKLTVKGKEPFIKMKQFLSDEQNVLALRTIQVRQRGSITPRIRTPETGSDDAIKSILEQAKKEIESQKGGEPKTSVAPLSIANGTTPASTSEDAIKSILEQARREMQAQQQALLEMEVAPRGRSVPPSPPERPSLATASQNGAPALVKQEEGSGGPAQAPLPVLSPAAFVQSIIRKVKSEIGDAGYFDHHWASDRGLLSRPYASVSPSLSSSSSSGYSGQPNGRAWPRGDEAPVPPEDEAAAGAEDEPPRTGELKAEGATAEAGARLPYYPAYVPRTLKPTVPPLTPEQYELYMYREVDTLELTRQVKEKLAKNGICQRIFGEKVLGLSQGSVSDMLSRPKPWSKLTQKGREPFIRMQLWLSDQLGQAVGQQPGASQASPTEPRSSPSPPPSPTEPEKSSQEPLSLSLESSKENQQPEGRSSSSLSGKMYSGSQAPGGIQEIVAMSPELDTYSITKRVKEVLTDNNLGQRLFGESILGLTQGSVSDLLSRPKPWHKLSLKGREPFVRMQLWLNDPHNVEKLRDMKKLEKKAYLKRRYGLISTGSDSESPATRSECPSPCLQPQDLSLLQIKKPRVVLAPEEKEALRKAYQLEPYPSQQTIELLSFQLNLKTNTVINWFHNYRSRMRREMLVEGTQDEPDLDPSGGPGILPPGHSHPDPTPQSPDSETEDQKPTVKELELQEGPEENSTPLTTQDKAQVRIKQEQMEEDAEEEAGSQPQDSGELDKGQGPPKEEHPDPPGNDGLPKVAPGPLLPGGSTPDCPSLHPQQESEAGERLHPDPLSFKSASESSRCSLEVSLNSPSAASSPGLMMSVSPVPSSSAPISPSPPGAPPAKVPSASPTADMAGALHPSAKVNPNLQRRHEKMANLNNIIYRVERAANREEALEWEF

SEQ ID NO: 4169 - protein, 124 aa, Homo sapiens
MVAPVLKSFQAEVVALSKRSQEAEAAFLSVYKQLIEAPDPVPVFEAARSLDDRLQPPSFDPSGQPRRDLHTSWKRNPELLSPKEQREGTSPAGPTLTEGSRLPGIPGKALLTETLLQRNEAEKQ

SEQ ID NO: 4170 - protein, 908 aa, Homo sapiens
MKSSVAQIKPSSGHDRRENLNSYQRNSSPEDRYEEQERSPRDRDYFDYSRSDYEHSRRGRSYDSSMESRNRDREKRRERERDTDRKRSRKSPSPGRRNPETSVTQSSSAQDEPATKKKKDELDPLLTRTGGAYIPPAKLRMMQEQITDKNSLAYQRMSWEALKKSINGLINKVNISNISIIIQELLQENIVRDRGLLSRSVLQAQSASPIFTHVYAALVAIINSKFPQIGELILKRLILNFRKGYRRNDKQLCLTASKFVAHLINQNVAHEVLCLEMLTLLLERPTDDSVEVAIGFLKECGLKLTQVSPRGINAIFERLRNILHESEIDKRVQYMIEVMFAVRKDGFKDHPIILEGLDLVEEDDQFTHMLPLEDDYNPEDVLNVFKMDPNFMENEEKYKAIKKEILDEGDTDSNTDQDAGSSEEDEEEEEEEGEEDEEGQKVTIHDKTEINLVSFRRTIYLAIQSSLDFEECAHKLLKMEFPESQTKELCNMILDCCAQQRTYEKFFGLLAGRFCMLKKEYMESFEGIFKEQYDTIHRLETNKLRNVAKMFAHLLYTDSLPWSVLECIKLSEETTTSSSRIFVKIFFQELCEYMGLPKLNARLKDETLQPFFEGLLPRDNPRNTRFAINFFTSIGLGGLTDELREHLKNTPKVIVAQKPDVEQNKSSPSSSSSASSSSESDSSDSDSDSSDSSSESSSEESDSSSISSHSSASANDVRKKGHGKTRSKEVDKLIRNQQTNDRKQKERRQEHGHQETRTERERRSEKHRDQNSSGSNWRDPITKYTSDKDVPSERNNYSRVANDRDQEMHIDLENKHGDPKKKRGERRNSFSENEKHTHRIKDSENFRRKDRSKSKEMNRKHSGSRSDEDRYQNGAERRWEKSSRYSEQSRESKKNQDRRREKSPAKQK

SEQ ID NO: 4171 - protein, 745 aa, Homo sapiens
MKSSVAQIKPSSGHDRRENLNSYQRNSSPEDRYEEQERSPRDRDYFDYSRSDYEHSRRGRSYDSSMESRNRDREKRRERERDTDRKRSRKSPSPGRRNPETSVTQSSSAQDEPATKKKKDELDPLLTRTGGAYIPPAKLRMMQEQITDKNSLAYQRMSWEALKKSINGLINKVNISNISIIIQELLQENIVRGRGLLSRSVLQAQSASPIFTHVYAALVAIINSKFPQIGELILKRLILNFRKGYRRNDKQLCLTASKFVAHLINQNVAHEVLCLEMLTLLLERPTDDSVEVAIGFLKECGLKLTQVSPRGINAIFERLRNILHESEIDKRVQYMIEVMFAVRKDGFKDHPIILEGLDLVEEDDQFTHMLPLEDDYNPEDVLNVFKMDPNFMENEEKYKAIKKEILDEGDTDSNTDQDAGSSEEDEEEEEEEGEEDEEGQKVTIHDKTEINLVSFRRTIYLAIQSSLDFEECAHKLLKMEFPESQTKELCNMILDCCAQQRTYEKFFGLLAGRFCMLKKEYMESFEGIFKEQYDTIHRLETNKLRNVAKMFAHLLYTDSLPWSVLECIKLSEETTTSSSRIFVKIFFQELCEYMGLPKLNARLKDETLQPFFEGLLPRDNPRNTRFAINFFTSIGLGGLTDELREHLKNTPKVIVAQKPDVEQNKSSPSSSSSASSSSESDSSDSDSDSSDSSSESSSEESDSSSISSHSSASANDVRKKGHGKTRSKEVDKLIRNQQTNDRKQK

SEQ ID NO: 4172 - protein, 908 aa, Homo sapiens
MKSSVAQIKPSSGHDRRENLNSYQRNSSPEDRYEEQERSPRDRDYFDYSRSDYEHSRRGRSYDSSMESRNRDREKRRERERDTDRKRSRKSPSPGRRNPETSVTQSSSAQDEPATKKKKDELDPLLTRTGGAYIPPAKLRMMQEQITDKNSLAYQRMSWEALKKSINGLINKVNISNISIIIQELLQENIVRGRGLLSRSVLQAQSASPIFTHVYAALVAIINSKFPQIGELILKRLILNFRKGYRRNDKQLCLTASKFVAHLINQNVAHEVLCLEMLTLLLERPTDDSVEVAIGFLKECGLKLTQVSPRGINAIFERLRNILHESEIDKRVQYMIEVMFAVRKDGFKDHPIILEGLDLVEEDDQFTHMLPLEDDYNPEDVLNVFKMDPNFMENEEKYKAIKKEILDEGDTDSNTDQDAGSSEEDEEEEEEEGEEDEEGQKVTIHDKTEINLVSFRRTIYLAIQSSLDFEECAHKLLKMEFPESQTKELCNMILDCCAQQRTYEKFFGLLAGRFCMLKKEYMESFEGIFKEQYDTIHRLETNKLRNVAKMFAHLLYTDSLPWSVLECIKLSEETTTSSSRIFVKIFFQELCEYMGLPKLNARLKDETLQPFFEGLLPRDNPRNTRFAINFFTSIGLGGLTDELREHLKNTPKVIVAQKPDVEQNKSSPSSSSSASSSSESDSSDSDSDSSDSSSESSSEESDSSSISSHSSASANDVRKKGHGKTRSKEVDKLIRNQQTNDRKQKERRQEHGHQETRTERERRSEKHRDQNSSGSNWRDPITKYTSDKDVPSERNNYSRVANDRDQEMHIDLENKHGDPKKKRGERRNSFSENEKHTHRIKDSENFRRKDRSKSKEMNRKHSGSRSDEDRYQNGAERRWEKSSRYSEQSRESKKNQDRRREKSPAKQK

SEQ ID NO: 4173 - protein, 472 aa, Homo sapiens
MSNIYIQEPPTNGKVLLKTTAGDIDIELWSKEAPKACRNFIQLCLEAYYDNTIFHRVVPGFIVQGGDPTGTGSGGESIYGAPFKDEFHSRLRFNRRGLVAMANAGSHDNGSQFFFTLGRADELNNKHTIFGKVTGDTVYNMLRLSEVDIDDDERPHNPHKIKSCEVLFNPFDDIIPREIKRLKKEKPEEEVKKLKPKGTKNFSLLSFGEEAEEEEEEVNRVSQSMKGKSKSSHDLLKDDPHLSSVPVVESEKGDAPDLVDDGEDESAEHDEYIDGDEKNLMRERIAKKLKKDTSANVKSAGEGEVEKKSVSRSEELRKEARQLKRELLAAKQKKVENAAKQAEKRSEEEEAPPDGAVAEYRREKQKYEALRKQQSKKGTSREDQTLALLNQFKSKLTQAIAETPENDIPETEVEDDEGWMSHVLQFEDKSRKVKDASMQDSDTFEIYDPRNPVNKRRREESKKLMREKKERR

SEQ ID NO: 4174 - protein, 390 aa, Homo sapiens
MSNIYIQEPPTNGKVLLKTTAGDIDIELWSKEAPKACRNFIQLCLEAYYDNTIFHRVVPGFIVQGGDPTGTGSGGESIYGAPFKDEFHSRLRFNRRGLVAMANAGSHDNGSQFFFTLGRADELNNKHTIFGKVTGDTVYNMLRLSEVDIDDDERPHNPHKIKSCEVLFNPFDDIIPREIKRLKKEKPEEEVKKLKPKGTKNFSLLSFGEEAEEEEEEVNRVSQSMKGKSKSSHDLLKDDPHLSSVPVVESEKGDAPDLVDDGEDESAEHDEYIDGDEKNLMRERIAKKLKKDTSANVKSAGEGEVEKKSVSRSEELRKEARQLKRELLAAKQKKVENAAKQAEKRSEEEEAPPDGAVAEYRREKQKYEALRKQQSKKGTSREDQEITKSS

SEQ ID NO: 4175 - protein, 656 aa, Homo sapiens
MEGDGSDPEPPDAGEDSKSENGENAPIYCICRKPDINCFMIGCDNCNEWFHGDCIRITEKMAKAIREWYCRECREKDPKLEIRYRHKKSRERDGNERDSSEPRDEGGGRKRPVPDPDLQRRAGSGTGVGAMLARGSASPHKSSPQPLVATPSQHHQQQQQQIKRSARMCGECEACRRTEDCGHCDFCRDMKKFGGPNKIRQKCRLRQCQLRARESYKYFPSSLSPVTPSESLPRPRRPLPTQQQPQPSQKLGRIREDEGAVASSTVKEPPEATATPEPLSDEDLPLDPDLYQDFCAGAFDDHGLPWMSDTEESPFLDPALRKRAVKVKHVKRREKKSEKKKEERYKRHRQKQKHKDKWKHPERADAKDPASLPQCLGPGCVRPAQPSSKYCSDDCGMKLAANRIYEILPQRIQQWQQSPCIAEEHGKKLLERIRREQQSARTRLQEMERRFHELEAIILRAKQQAVREDEESNEGDSDDTDLQIFCVSCGHPINPRVALRHMERCYAKYESQTSFGSMYPTRIEGATRLFCDVYNPQSKTYCKRLQVLCPEHSRDPKVPADEVCGCPLVRDVFELTGDFCRLPKRQCNRHYCWEKLRRAEVDLERVRVWYKLDELFEQERNVRTAMTNRAGLLALMLHQTIQHDPLTTDLRSSADR

SEQ ID NO: 4176 - protein, 660 aa, Homo sapiens
MEGDGSDPEPPDAGEDSKSENGENAPIYCICRKPDINCFMIGCDNCNEWFHGDCIRITEKMAKAIREWYCRECREKDPKLEIRYRHKKSRERDGNERDSSEPRDEGGGRKRPVPDPDLQRRAGSGTGVGAMLARGSASPHKSSPQPLVATPSQHHQQQQQQIKRSARMCGECEACRRTEDCGHCDFCRDMKKFGGPNKIRQKCRLRQCQLRARESYKYFPSSLSPVTPSESLPRPRRPLPTQQQPQPSQKLGRIREDEGAVASSTVKEPPEATATPEPLSDEDLPLDPDLYQDFCAGAFDDHGLPWMSDTEESPFLDPALRKRAVKVKHVKRREKKSEKKVMERKEERYKRHRQKQKHKDKWKHPERADAKDPASLPQCLGPGCVRPAQPSSKYCSDDCGMKLAANRIYEILPQRIQQWQQSPCIAEEHGKKLLERIRREQQSARTRLQEMERRFHELEAIILRAKQQAVREDEESNEGDSDDTDLQIFCVSCGHPINPRVALRHMERCYAKYESQTSFGSMYPTRIEGATRLFCDVYNPQSKTYCKRLQVLCPEHSRDPKVPADEVCGCPLVRDVFELTGDFCRLPKRQCNRHYCWEKLRRAEVDLERVRVWYKLDELFEQERNVRTAMTNRAGLLALMLHQTIQHDPLTTDLRSSADR

SEQ ID NO: 4177 - protein, 277 aa, Homo sapiens
MSLCEDMLLCNYRKCRIKLSGYAWVTACSHIFCDQHGSGEFSRSPAICPACNSTLSGKLDIVRTELSPSEEYKAMVLAGLRPEIVLDISSRALAFWTYQVHQERLYQEYNFSKAEGHLKQMEKIYTQQIQSKDVELTSMKGEVTSMKKVLEEYKKKFSDISEKLMERNRQYQKLQGLYDSLRLRNITIANHEGTLEPSMIAQSGVLGFPLGNNSKFPLDNTPVRNRGDGDGDFQFRPFFAGSPTAPEPSNSFFSFVSPSRELEQQQVSSRAFKVKRI

SEQ ID NO: 4178 - protein, 277 aa, Homo sapiens; identical to SEQ ID NO: 4177

SEQ ID NO: 4179 - protein, 277 aa, Homo sapiens; identical to SEQ ID NO: 4177

SEQ ID NO: 4180 - protein, 277 aa, Homo sapiens; identical to SEQ ID NO: 4177

SEQ ID NO: 4181 - protein, 277 aa, Homo sapiens; identical to SEQ ID NO: 4177

SEQ ID NO: 4182 - protein, 277 aa, Homo sapiens; identical to SEQ ID NO: 4177

SEQ ID NO: 4183 - protein, 4 aa, Homo sapiens
MSLC

SEQ ID NO: 4184 - protein, 154 aa, Homo sapiens
MSLCEDMLLCNYRKCRIKLSGYAWVTACSHIFCDQHGSGEFSRSPAICPACNSTLSGKLDIVRTELSPSEEYKAMVLAGLRPEIVLDISSRALAFWTYQVHQERLYQEYNFSKAEGHLKQMEKIYTQQIQSKDVELTSMKGEVTSMKKVLEEYK

SEQ ID NO: 4185 - protein, 372 aa, Homo sapiens
MELEGQWWRGQLAADIHQALRYKELKLPSYKGQSPQLSLRRYFADLIAIVSNRFTLCPSARHLAVYLLDLFMDRYDISIQQLHLVALSCLLLASKFEEKEDSVPKLEQLNSLGCMTNMNLVLTKQNLLHMELLLLETFQWNLCLPTAAHFIEYYLSEAVHETDLHDGWPMICLEKTKLYMAKYADYFLEVSLQVAAACVASSRIILRLSPTWPTRLHRLTAYSWDFLVQCIERLLIAHDNDVKEANKQRGQAGPQSAQLSVFQTASQPSRPVHFQQPQYLHQTHQTSLQYRHPTSEQPSCQQIVSTTHTSSYTLQTCPAGFQTSVQGLGHMQTGVGMSLAIPVEVKPCLSVSYNRSYQINEHYPCITPCFER

SEQ ID NO: 4186 - protein, 371 aa, Homo sapiens
MELEGQWWRGQLAADIHQALRYKELKLPSYKGQSPQLSLRRYFADLIAIVSNRFTLCPSARHLAVYLLDLFMDRYDISIQQLHLVALSCLLLASKFEEKEDSVPKLEQLNSLGCMTNMNLVLTKQNLLHMELLLLETFQWNLCLPTAAHFIEYYLSEAVHETDLHDGWPMICLEKTKLYMAKYADYFLEVSLQAAACVASSRIILRLSPTWPTRLHRLTAYSWDFLVQCIERLLIAHDNDVKEANKQRGQAGPQSAQLSVFQTASQPSRPVHFQQPQYLHQTHQTSLQYRHPTSEQPSCQQIVSTTHTSSYTLQTCPAGFQTSVQGLGHMQTGVGMSLAIPVEVKPCLSVSYNRSYQINEHYPCITPCFER

SEQ ID NO: 4187 - protein, 383 aa, Homo sapiens
MELEGQWWRGQLAADIHQALRYKELKLPSYKGQSPQLSLRRYFADLIAIVSNRFTLCPSARHLAVYLLDLFMDRYDISIQQLHLVALSCLLLASKFEEKEDSVPKLEQLNSLGCMTNMNLVLTKQNLLHMELLLLETFQWNLCLPTAAHFIEYYLSEAVHETDLHDGWPMICLEKTKLYMAKYADYFLEVSLQDYAFLNYAPSLVAAACVASSRIILRLSPTWPTRLHRLTAYSWDFLVQCIERLLIAHDNDVKEANKQRGQAGPQSAQLSVFQTASQPSRPVHFQQPQYLHQTHQTSLQYRHPTSEQPSCQQIVSTTHTSSYTLQTCPAGFQTSVQGLGHMQTGVGMSLAIPVEVKPCLSVSYNRSYQINEHYPCITPCFER

SEQ ID NO: 4188 - protein, 372 aa, Homo sapiens; identical to SEQ ID NO: 4185

SEQ ID NO: 4189 - protein, 1481 aa, Homo sapiens
MPNSERHGGKKDGSGGASGTLQPSSGGGSSNSRERHRLVSKHKRHKSKHSKDMGLVTPEAASLGTVIKPLVEYDDISSDSDTFSDDMAFKLDRRENDERRGSDRSDRLHKHRHHQHRRSRDLLKAKQTEKEKSQEVSSKSGSMKDRISGSSKRSNEETDDYGKAQVAKSSSKESRSSKLHKEKTRKERELKSGHKDRSKSHRKRETPKSYKTVDSPKRRSRSPHRKWSDSSKQDDSPSGASYGQDYDLSPSRSHTSSNYDSYKKSPGSTSRRQSVSPPYKEPSAYQSSTRSPSPYSRRQRSVSPYSRRRSSSYERSGSYSGRSPSPYGRRRSSSPFLSKRSLSRSPLPSRKSMKSRSRSPAYSRHSSSHSKKKRSSSRSRHSSISPVRLPLNSSLGAELSRKKKERAAAAAAAKMDGKESKGSPVFLPRKENSSVEAKDSGLESKKLPRSVKLEKSAPDTELVNVTHLNTEVKNSSDTGKVKLDENSEKHLVKDLKAQGTRDSKPIALKEEIVTPKETETSEKETPPPLPTIASPPPPLPTTTPPPQTPPLPPLPPIPALPQQPPLPPSQPAFSQVPASSTSTLPPSTHSKTSAVSSQANSQPPVQVSVKTQVSVTAAIPHLKTSTLPPLPLPPLLPGDDDMDSPKETLPSKPVKKEKEQRTRHLLTDLPLPPELPGGDLSPPDSPEPKAITPPQQPYKKRPKICCPRYGERRQTESDWGKRCVDKFDIIGIIGEGTYGQVYKAKDKDTGELVALKKVRLDNEKEGFPITAIREIKILRQLIHRSVVNMKEIVTDKQDALDFKKDKGAFYLVFEYMDHDLMGLLESGLVHFSEDHIKSFMKQLMEGLEYCHKKNFLHRDIKCSNILLNNSGQIKLADFGLARLYNSEESRPYTNKVITLWYRPPELLLGEERYTPAIDVWSCGCILGELFTKKPIFQANLELAQLELISRLCGSPCPAVWPDVIKLPYFNTMKPKKQYRRRLREEFSFIPSAALDLLDHMLTLDPSKRCTAEQTLQSDFLKDVELSKMAPPDLPHWQDCHELWSKKRRRQRQSGVVVEEPPPSKTSRKETTSGTSTEPVKNSSPAPPQPAPGKVESGAGDAIGLADITQQLNQSELAVLLNLLQSQTDLSIPQMAQLLNIHSNPEMQQQLEALNQSISALTEATSQQQDSETMAPEESLKEAPSAPVILPSAEQTTLEASSTPADMQNILAVLLSQLMKTQEPAGSLEENNSDKNSGPQGPRRTPTMPQEEAAEKRPPEPPGPPPPPPPPPLVEGDLSSAPQELNPAVTAALLQLLSQPEAEPPGHLPHEHQALRPMEYSTRPRPNRTYGNTDGPETGFSAIDTDERNSGPALTESLVQTLVKNRTFSGSLSHLGESSSYQGTGSVQFPGDQDLRFARVPLALHPVVGQPFLKAEGSSNSVVHAETKLQNYGELGPGTTGASSSGAGLHWGGPTQSSAYGKLYRGPTRVPPRGGRGRGVPY

SEQ ID NO: 4190 - protein, 1490 aa, Homo sapiens
MPNSERHGGKKDGSGGASGTLQPSSGGGSSNSRERHRLVSKHKRHKSKHSKDMGLVTPEAASLGTVIKPLVEYDDISSDSDTFSDDMAFKLDRRENDERRGSDRSDRLHKHRHHQHRRSRDLLKAKQTEKEKSQEVSSKSGSMKDRISGSSKRSNEETDDYGKAQVAKSSSKESRSSKLHKEKTRKERELKSGHKDRSKSHRKRETPKSYKTVDSPKRRSRSPHRKWSDSSKQDDSPSGASYGQDYDLSPSRSHTSSNYDSYKKSPGSTSRRQSVSPPYKEPSAYQSSTRSPSPYSRRQRSVSPYSRRRSSSYERSGSYSGRSPSPYGRRRSSSPFLSKRSLSRSPLPSRKSMKSRSRSPAYSRHSSSHSKKKRSSSRSRHSSISPVRLPLNSSLGAELSRKKKERAAAAAAAKMDGKESKGSPVFLPRKENSSVEAKDSGLESKKLPRSVKLEKSAPDTELVNVTHLNTEVKNSSDTGKVKLDENSEKHLVKDLKAQGTRDSKPIALKEEIVTPKETETSEKETPPPLPTIASPPPPLPTTTPPPQTPPLPPLPPIPALPQQPPLPPSQPAFSQVPASSTSTLPPSTHSKTSAVSSQANSQPPVQVSVKTQVSVTAAIPHLKTSTLPPLPLPPLLPGDDDMDSPKETLPSKPVKKEKEQRTRHLLTDLPLPPELPGGDLSPPDSPEPKAITPPQQPYKKRPKICCPRYGERRQTESDWGKRCVDKFDIIGIIGEGTYGQVYKAKDKDTGELVALKKVRLDNEKEGFPITAIREIKILRQLIHRSVVNMKEIVTDKQDALDFKKDKGAFYLVFEYMDHDLMGLLESGLVHFSEDHIKSFMKQLMEGLEYCHKKNFLHRDIKCSNILLNNSGQIKLADFGLARLYNSEESRPYTNKVITLWYRPPELLLGEERYTPAIDVWSCGCILGELFTKKPIFQANLELAQLELISRLCGSPCPAVWPDVIKLPYFNTMKPKKQYRRRLREEFSFIPSAALDLLDHMLTLDPSKRCTAEQTLQSDFLKDVELSKMAPPDLPHWQDCHELWSKKRRRQRQSGVVVEEPPPSKTSRKETTSGTSTEPVKNSSPAPPQPAPGKVESGAGDAIGLADITQQLNQSELAVLLNLLQSQTDLSIPQMAQLLNIHSNPEMQQQLEALNQSISALTEATSQQQDSETMAPEESLKEAPSAPVILPSAEQTTLEASSTPADMQNILAVLLSQLMKTQEPAGSLEENNSDKNSGPQGPRRTPTMPQEEAAACPPHILPPEKRPPEPPGPPPPPPPPPLVEGDLSSAPQELNPAVTAALLQLLSQPEAEPPGHLPHEHQALRPMEYSTRPRPNRTYGNTDGPETGFSAIDTDERNSGPALTESLVQTLVKNRTFSGSLSHLGESSSYQGTGSVQFPGDQDLRFARVPLALHPVVGQPFLKAEGSSNSVVHAETKLQNYGELGPGTTGASSSGAGLHWGGPTQSSAYGKLYRGPTRVPPRGGRGRGVPY

SEQ ID NO: 4191 - protein, 1512 aa, Homo sapiens
MPSSSDTALGGGGGLSWAEKKLEERRKRRRFLSPQQPPLLLPLLQPQLLQPPPPPPPLLFLAAPGTAAAAAAAAAASSSCFSPGPPLEVKRLARGKRRAGGRQKRRRGPRAGQEAEKRRVFSLPQPQQDGGGGASSGGGVTPLVEYEDVSSQSEQGLLLGGASAATAATAAGGTGGSGGSPASSSGTQRRGEGSERRPRRDRRSSSGRSKERHREHRRRDGQRGGSEASKSRSRHSHSGEERAEVAKSGSSSSSGGRRKSASATSSSSSSRKDRDSKAHRSRTKSSKEPPSAYKEPPKAYREDKTEPKAYRRRRSLSPLGGRDDSPVSHRASQSLRSRKSPSPAGGGSSPYSRRLPRSPSPYSRRRSPSYSRHSSYERGGDVSPSPYSSSSWRRSRSPYSPVLRRSGKSRSRSPYSSRHSRSRSRHRLSRSRSRHSSISPSTLTLKSSLAAELNKNKKARAAEAARAAEAAKAAEATKAAEAAAKAAKASNTSTPTKGNTETSASASQTNHVKDVKKIKIEHAPSPSSGGTLKNDKAKTKPPLQVTKVENNLIVDKATKKAVIVGKESKSAATKEESVSLKEKTKPLTPSIGAKEKEQHVALVTSTLPPLPLPPMLPEDKEADSLRGNISVKAVKKEVEKKLRCLLADLPLPPELPGGDDLSKSPEEKKTATQLHSKRRPKICGPRYGETKEKDIDWGKRCVDKFDIIGIIGEGTYGQVYKARDKDTGEMVALKKVRLDNEKEGFPITAIREIKILRQLTHQSIINMKEIVTDKEDALDFKKDKGAFYLVFEYMDHDLMGLLESGLVHFNENHIKSFMRQLMEGLDYCHKKNFLHRDIKCSNILLNNRGQIKLADFGLARLYSSEESRPYTNKVITLWYRPPELLLGEERYTPAIDVWSCGCILGELFTKKPIFQANQELAQLELISRICGSPCPAVWPDVIKLPYFNTMKPKKQYRRKLREEFVFIPAAALDLFDYMLALDPSKRCTAEQALQCEFLRDVEPSKMPPPDLPLWQDCHELWSKKRRRQKQMGMTDDVSTIKAPRKDLSLGLDDSRTNTPQGVLPSSQLKSQGSSNVAPVKTGPGQHLNHSELAILLNLLQSKTSVNMADFVQVLNIKVNSETQQQLNKINLPAGILATGEKQTDPSTPQQESSKPLGGIQPSSQTIQPKVETDAAQAAVQSAFAVLLTQLIKAQQSKQKDVLLEERENGSGHEASLQLRPPPEPSTPVSGQDDLIQHQDMRILELTPEPDRPRILPPDQRPPEPPEPPPVTEEDLDYRTENQHVPTTSSSLTDPHAGVKAALLQLLAQHQPQDDPKREGGIDYQAGDTYVSTSDYKDNFGSSSFSSAPYVSNDGLGSSSAPPLERRSFIGNSDIQSLDNYSTASSHSGGPPQPSAFSESFPSSVAGYGDIYLNAGPMLFSGDKDHRFEYSHGPIAVLANSSDPSTGPESTHPLPAKMHNYNYGGNLQENPSGPSLMHGQTWTSPAQGPGYSQGYRGHISTSTGRGRGRGLPY

SEQ ID NO: 4192 - protein, 1452 aa, Homo sapiens
MPSSSDTALGGGGGLSWAEKKLEERRKRRRFLSPQQPPLLLPLLQPQLLQPPPPPPPLLFLAAPGTAAAAAAAAAASSSCFSPGPPLEVKRLARGKRRAGGRQKRRRGPRAGQEAEKRRVFSLPQPQQDGGGGASSGGGVTPLVEYEDVSSQSEQGLLLGGASAATAATAAGGTGGSGGSPASSSGTQRRGEGSERRPRRDRRSSSGRSKERHREHRRRDGQRGGSEASKSRSRHSHSGEERAEVAKSGSSSSSGGRRKSASATSSSSSSRKDRDSKAHRSRTKSSKEPPSAYKEPPKAYREDKTEPKAYRRRRSLSPLGGRDDSPVSHRASQSLRSRKSPSPAGGGSSPYSRRLPRSPSPYSRRRSPSYSRHSSYERGGDVSPSPYSSSSWRRSRSPYSPVLRRSGKSRSRSPYSSRHSRSRSRHRLSRSRSRHSSISPSTLTLKSSLAAELNKNKKARAAEAARAAEAAKAAEATKAAEAAAKAAKASNTSTPTKGNTETSASASQTNHVKDVKKIKIEHAPSPSSGGTLKNDKAKTKPPLQVTKVENNLIVDKATKKAVIVGKESKSAATKEESVSLKEKTKPLTPSIGAKEKEQHVALVTSTLPPLPLPPMLPEDKEADSLRGNISVKAVKKEVEKKLRCLLADLPLPPELPGGDDLSKSPEEKKTATQLHSKRRPKICGPRYGETKEKDIDWGKRCVDKFDIIGIIGEGTYGQVYKARDKDTGEMVALKKVRLDNEKEGFPITAIREIKILRQLTHQSIINMKEIVTDKEDALDFKKDKGAFYLVFEYMDHDLMGLLESGLVHFNENHIKSFMRQLMEGLDYCHKKNFLHRDIKCSNILLNNRGQIKLADFGLARLYSSEESRPYTNKVITLWYRPPELLLGEERYTPAIDVWSCGCILGELFTKKPIFQANQELAQLELISRICGSPCPAVWPDVIKLPYFNTMKPKKQYRRKLREEFVFIPAAALDLFDYMLALDPSKRCTAEQALQCEFLRDVEPSKMPPPDLPLWQDCHELWSKKRRRQKQMGMTDDVSTIKAPRKDLSLGLDDSRTNTPQGVLPSSQLKSQGSSNVAPGEKQTDPSTPQQESSKPLGGIQPSSQTIQPKVETDAAQAAVQSAFAVLLTQLIKAQQSKQKDVLLEERENGSGHEASLQLRPPPEPSTPVSGQDDLIQHQDMRILELTPEPDRPRILPPDQRPPEPPEPPPVTEEDLDYRTENQHVPTTSSSLTDPHAGVKAALLQLLAQHQPQDDPKREGGIDYQAGDTYVSTSDYKDNFGSSSFSSAPYVSNDGLGSSSAPPLERRSFIGNSDIQSLDNYSTASSHSGGPPQPSAFSESFPSSVAGYGDIYLNAGPMLFSGDKDHRFEYSHGPIAVLANSSDPSTGPESTHPLPAKMHNYNYGGNLQENPSGPSLMHGQTWTSPAQGPGYSQGYRGHISTSTGRGRGRGLPY

SEQ ID NO: 4193 - protein, 589 aa, Homo sapiens
MTGLLKRKFDQLDEDNSSVSSSSSSSGCQSRSCSPSSSVSRAWDSEEEGPWDQMPLPDRDFCGPRSFTPLSILKRARRERPGRVAFDGITVFYFPRCQGFTSVPSRGGCTLGMALRHSACRRFSLAEFAQEQARARHEKLRQRLKEEKLEMLQWKLSAAGVPQAEAGLPPVVDAIDDASVEEDLAVAVAGGRLEEVSFLQPYPARRRRALLRASGVRRIDREEKRELQALRQSREDCGCHCDRICDPETCSCSLAGIKCQMDHTAFPCGCCREGCENPMGRVEFNQARVQTHFIHTLTRLQLEQEAESFRELEAPAQGSPPSPGEEALVPTFPLAKPPMNNELGDNSCSSDMTDSSTASSSASGTSEAPDCPTHPGLPGPGFQPGVDDDSLARILSFSDSDFGGEEEEEEEGSVGNLDNLSCFHPADIFGTSDPGGLASWTHSYSGCSFTSGVLDENANLDASCFLNGGLEGSREGSLPGTSVPPSMDAGRSSSVDLSLSSCDSFELLQALPDYSLGPHYTSQKVSDSLDNIEAPHFPLPGLSPPGDASSCFLESLMGFSEPAAEALDPFIDSQFEDTVPASLMEPVPV

SEQ ID NO: 4194 - protein, 247 aa, Homo sapiens
RRRCRTRRARGGWTDGCRAERTESRRRGRPRPGRGSRRCPPRASGLQAVCPQTPEHVRHHHDWAVEEEEGSVGNLDNLSCFHPADIFGTSDPGGLASWTHSYSGCSFTSGVLDENANLDASCFLNGGLEGSREGSLPGTSVPPSMDAGRSSSVDLSLSSCDSFELLQALPDYSLGPHYTSQKVSDSLDNIEAPHFPLPGLSPPGDASSCFLESLMGFSEPAAEALDPFIDSQFEDTVPASLMEPVPV

SEQ ID NO: 4195 - protein, 589 aa, Homo sapiens; identical to SEQ ID NO: 4193

SEQ ID NO: 4196 - protein, 543 aa, Homo sapiens
MDAFTGSGLKRKFDDVDVGSSVSNSDDEISSSDSADSCDSLNPPTTASFTPTSILKRQKQLRRKNVRFDQVTVYYFARRQGFTSVPSQGGSSLGMAQRHNSVRSYTLCEFAQEQEVNHREILREHLKEEKLHAKKMKLTKNGTVESVEADGLTLDDVSDEDIDVENVEVDDYFFLQPLPTKRRRALLRASGVHRIDAEEKQELRAIRLSREECGCDCRLYCDPEACACSQAGIKCQVDRMSFPCGCSRDGCGNMAGRIEFNPIRVRTHYLHTIMKLELESKRQVSRPAAPDEEPSPTASCSLTGAQGSETQDFQEFIAENETAVMHLQSAEELERLKAEEDSSGSSASLDSSIESLGVCILEEPLAVPEELCPGLTAPILIQAQLPPGSSVLCFTENSDHPTASTVNSPSYLNSGPLVYYQVEQRPVLGVKGEPGTEEGSASFPKEKDLNVFSLPVTSLVACSSTDPAALCKSEVGKTPTLEALLPEDCNPEEPENEDFHPSWSPSSLPFRTDNEEGCGMVKTSQQNEDRPPEDSSLELPLAV

SEQ ID NO: 4197 - protein, 58 aa, Homo sapiens
MDAFTGSGLKRKFDDVDVGSSVSNSDDEISSSDSADSCDSLNPPTTASFTPTSILKRQ

SEQ ID NO: 4198 - protein, 114 aa, Homo sapiens
MDAFTGSGLKRKFDDVDVGSSVSNSDDEISSSDSADSCDSLNPPTTASFTPTSILKRQKQLRRKNVRFDQVTVYYFARRQGFTSVPSQGGSSLGMAQRHNSVRSYTLCEFAQEQ

SEQ ID NO: 4199 - protein, 86 aa, Homo sapiens
MDAFTGSGLKRKFDDVDVGSSVSNSDDEISSSDSADSCDSLNPPTTASFTPTSILKRQKQLRRKNVRFDQVTVYYFARRQGFTSVP

SEQ ID NO: 4200 - protein, 585 aa, Homo sapiens
MSGILKRKFEEVDGSSPCSSVRESDDEVSSSESADSGDSVNPSTSSHFTPSSILKREKRLRTKNVHFSCVTVYYFTRRQGFTSVPSQGGSTLGMSSRHNSVRQYTLGEFAREQERLHREMLREHLREEKLNSLKLKMTKNGTVESEEASTLTLDDISDDDIDLDNTEVDEYFFLQPLPTKKRRALLRASGVKKIDVEEKHELRAIRLSREDCGCDCRVFCDPDTCTCSLAGIKCQVDRMSFPCGCTKEGCSNTAGRIEFNPIRVRTHFLHTIMKLELEKNREQQIPTLNGCHSEISAHSSSMGPVAHSVEYSIADSFEIETEPQAAVLHLQSAEELDCQGEEEEEEEDGSSFCSGVTDSSTQSLAPSESDEEEEEEEEEEEEEDDDDDKGDGFVEGLGTHAEVVPLPSVLCYSDGTAVHESHAKNASFYANSSTLYYQIDSHIPGTPNQISENYSERDTVKNGTLSLVPYTMTPEQFVDYARQAEEAYGASHYPAANPSVIVCCSSSENDSGVPCNSLYPEHRSNHPQVEFHSYLKGPSQEGFVSALNGDSHISEHPAENSLSLAEKSILHEECIKSPVVETVPV

SEQ ID NO: 4201 - protein, 585 aa, Homo sapiens; identical to SEQ ID NO: 4200

SEQ ID NO: 4202 - protein, 617 aa, Homo sapiens
MKCALFLRVKILQRVCRSRYIVHAGTCDSTAAMSGILKRKFEEVDGSSPCSSVRESDDEVSSSESADSGDSVNPSTSSHFTPSSILKREKRLRTKNVHFSCVTVYYFTRRQGFTSVPSQGGSTLGMSSRHNSVRQYTLGEFAREQERLHREMLREHLREEKLNSLKLKMTKNGTVESEEASTLTLDDISDDDIDLDNTEVDEYFFLQPLPTKKRRALLRASGVKKIDVEEKHELRAIRLSREDCGCDCRVFCDPDTCTCSLAGIKCQVDRMSFPCGCTKEGCSNTAGRIEFNPIRVRTHFLHTIMKLELEKNREQQIPTLNGCHSEISAHSSSMGPVAHSVEYSIADSFEIETEPQAAVLHLQSAEELDCQGEEEEEEEDGSSFCSGVTDSSTQSLAPSESDEEEEEEEEEEEEEDDDDDKGDGFVEGLGTHAEVVPLPSVLCYSDGTAVHESHAKNASFYANSSTLYYQIDSHIPGTPNQISENYSERDTVKNGTLSLVPYTMTPEQFVDYARQAEEAYGASHYPAANPSVIVCCSSSENDSGVPCNSLYPEHRSNHPQVEFHSYLKGPSQEGFVSALNGDSHISEHPAENSLSLAEKSILHEECIKSPVVETVPV

SEQ ID NO: 4203 - protein, 138 aa, Homo sapiens
MSGILKRKFEEVDGSSPCSSVRESDDEVSSSESADSGDSVNPSTSSHFTPSSILKREKRLRTKNVHFSCVTVYYFTRRQGFTSVPSQGGSTLGMSSRHNSVRQYTLGEFAREQERLHREMLREHLREEKLNSLKLKMT

SEQ ID NO: 4204 - protein, 437 aa, Homo sapiens
MSGILKRKFEEVDGSSPCSSVRESDDEVSSSESADSGDSVNPSTSSHFTPSSILKREKRLRTKNVHFSCVTVYYFTRRQGFTSVPSQGGSTLGMSSRHNSVRQYTLGEFAREQERLHREMLREHLREEKLNSLKLKMTKNGTVESEEASTLTLDDISDDDIDLDNTEVDEYFFLQPLPTKKRRALLRASGVKKIDVEEKHELRAIRLSREDCGCDCRVFCDPDTCTCSLAGIKCQVDRMSFPCGCTKEGCSNTAGRIEFNPIRVRTHFLHTIMKLELEKNREQQIPTLNGCHSEISAHSSSMGPVAHSVEYSIADSFEIETEPQAAVLHLQSAEELDCQGEEEEEEEDGSSFCSGVTDSSTQSLAPSESDEEEEEEEEEEEEEDDDDDKGDGFVEGLGTHAEVVPLPSVLCYSDGTAVHESHAKNASFYANSSTLYY

SEQ ID NO: 4205 - protein, 522 aa, Homo sapiens
TCDSTAAMSGILKRKFEEVDGSSPCSSVRESDDEVSSSESADSGDSVNPSTSSHFTPSSILKREKRLRTKNVHFSCVTVYYFTRRQGFTSVPSQGGSTLGMSSRHNSVRQYTLGEFAREQERLHREMLREHLREEKLNSLKLKMTKNGTVESEEASTLTLDDISDDDIDLDNTEVDEYFFLQPLPTKKRRALLRASGVKKIDVEEKHELRAIRLSREDCGCDCRVFCDPDTCTCSLAGIKCQVDRMSFPCGCTKEGCSNTAGRIEFNPIRVRTHFLHTIMKLELEKNREQQIPTLNGCHSEISAHSSSMGPVAHSVEYSIADSFEIETEPQAAVLHLQSAEELDCQGEEEEEEEDGSSFCSGVTDSSTQSLAPSESDEEEEEEEEEEEEEDDDDDKGDGFVEGLGTHAEVVPLPSVLCYSDGTAVHESHAKNASFYANSSTLYYQNDSGVPCNSLYPEHRSNHPQVEFHSYLKGPSQEGFVSALNGDSHISEHPAENSLSLAEKSILHEECIKSPVVETVPV

SEQ ID NO: 4206 - protein, 708 aa, Homo sapiens
MAVPAALIPPTQLVPPQPPISTSASSSGTTTSTSSATSSPAPSIGPPASSGPTLFRPEPIASAAAAAATVTSTGGGGGGGGGGSGGGGGSSGNGGGGGGGGGGSNCNPNLAAASNGSGGGGGGISAGGGVASSTPINASTGSSSSSSSSSSSSSSSSSSSSSSSSCGPLPGKPVYSTPSPVENTPQNNECKMVDLRGAKVASFTVEGCELICLPQAFDLFLKHLVGGLHTVYTKLKRLEITPVVCNVEQVRILRGLGAIQPGVNRCKLISRKDFETLYNDCTNASSRPGRPPKRTQSVTSPENSHIMPHSVPGLMSPGIIPPTGLTAAAAAAAAATNAAIAEAMKVKKIKLEAMSNYHASNNQHGADSENGDMNSSVGLELPFMMMPHPLIPVSLPPASVTMAMSQMNHLSTIANMAAAAQVQSPPSRVETSVIKERVPDSPSPAPSLEEGRRPGSHPSSHRSSSVSSSPARTESSSDRIPVHQNGLSMNQMLMGLSPNVLPGPKEGDLAGHDMGHESKRMHIEKDETPLSTPTARDSLDKLSLTGHGQPLPPGFPSPFLFPDGLSSIETLLTNIQGLLKVAIDNARAQEKQVQLEKTELKMDFLRERELRETLEKQLAMEQKNRAIVQKRLKKEKKAKRKLQEALEFETKRREQAEQTLKQAASTDSLRVLNDSLTPEIEADRSGGRTDAERTIQDGRLYLKTTVMY

SEQ ID NO: 4207 - protein, 560 aa, Homo sapiens
MAVPAALIPPTQLVPPQPPISTSASSSGTTTSTSSATSSPAPSIGPPASSGPTLFRPEPIASAAAAAATVTSTGGGGGGGGGGSGGGGGSSGNGGGGGGGGGGSNCNPNLAAASNGSGGGGGGISAGGGVASSTPINASTGSSSSSSSSSSSSSSSSSSSSSSSSCGPLPGKPVYSTPSPVENTPQNNECKMVDLRGAKVASFTVEGCELICLPQAFDLFLKHLVGGLHTVYTKLKRLEITPVVCNVEQVRILRGLGAIQPGVNRCKLISRKDFETLYNDCTNASSRPGRPPKRTQSVTSPENSHIMPHSVPGLMSPGIIPPTGLTAAAAAAAAATNAAIAEAMKVKKIKLEAMSNYHASNNQHGADSENGDMNSSVDETPLSTPTARDSLDKLSLTGHGQPLPPGFPSPFLFPDGLSSIETLLTNIQGLLKVAIDNARAQEKQVQLEKTELKMDFLRERELRETLEKQLAMEQKNRAIVQKRLKKEKKAKRKLQEALEFETKRREQAEQTLKQAASTDSLRVLNDSLTPEIEADRSGGRTDAERTIQDGRLYLKTTVMY

SEQ ID NO: 4208 - protein, 506 aa, Homo sapiens
MAVPAALIPPTQLVPPQPPISTSASSSGTTTSTSSATSSPAPSIGPPASSGPTLFRPEPIASAAAAAATVTSTGGGGGGGGGGSGGGGGSSGNGGGGGGGGGGSNCNPNLAAASNGSGGGGGGISAGGGVASSTPINASTGSSSSSSSSSSSSSSSSSSSSSSSSCGPLPGKPVYSTPSPVENTPQNNECKMVDLRGAKVASFTVEGCELICLPQAFDLFLKHLVGGLHTVYTKLKRLEITPVVCNVEQVRILRGLGAIQPGVNRCKLISRKDFETLYNDCTNASSRPGRPPKRTQSVTSPENSHIMPHSVPGLMSPGIIPPTDETPLSTPTARDSLDKLSLTGHGQPLPPGFPSPFLFPDGLSSIETLLTNIQGLLKVAIDNARAQEKQVQLEKTELKMDFLRERELRETLEKQLAMEQKNRAIVQKRLKKEKKAKRKLQEALEFETKRREQAEQTLKQAASTDSLRVLNDSLTPEIEADRSGGRTDAERTIQDGRLYLKTTVMY

SEQ ID NO: 4209 - protein, 760 aa, Homo sapiens
MAVPAALIPPTQLVPPQPPISTSASSSGTTTSTSSATSSPAPSIGPPASSGPTLFRPEPIASAAAAAATVTSTGGGGGGGGGGSGGGGGSSGNGGGGGGGGGGSNCNPNLAAASNGSGGGGGGISAGGGVASSTPINASTGSSSSSSSSSSSSSSSSSSSSSSSSCGPLPGKPVYSTPSPVENTPQNNECKMVDLRGAKVASFTVEGCELICLPQAFDLFLKHLVGGLHTVYTKLKRLEITPVVCNVEQVRILRGLGAIQPGVNRCKLISRKDFETLYNDCTNASSRPGRPPKRTQSVTSPENSHIMPHSVPGLMSPGIIPPTGLTAAAAAAAAATNAAIAEAMKVKKIKLEAMSNYHASNNQHGADSENGDMNSSVGSSDGSWDKETLPSSPSQGPQASITHPRMPGARSLPLSHPLNHLQQSHLLPNGLELPFMMMPHPLIPVSLPPASVTMAMSQMNHLSTIANMAAAAQVQSPPSRVETSVIKERVPDSPSPAPSLEEGRRPGSHPSSHRSSSVSSSPARTESSSDRIPVHQNGLSMNQMLMGLSPNVLPGPKEGDLAGHDMGHESKRMHIEKDETPLSTPTARDSLDKLSLTGHGQPLPPGFPSPFLFPDGLSSIETLLTNIQGLLKVAIDNARAQEKQVQLEKTELKMDFLRERELRETLEKQLAMEQKNRAIVQKRLKKEKKAKRKLQEALEFETKRREQAEQTLKQAASTDSLRVLNDSLTPEIEADRSGGRTDAERTIQDGRLYLKTTVMY

SEQ ID NO: 4210 - protein, 760 aa, Homo sapiens
MAVPAALIPPTQLVPPQPPISTSASSSGTTTSTSSATSSPAPSIGPPASSGPTLFRPEPIASAAAAAATVTSTGGGGGGGGGGSGGGGGSSGNGGGGGGGGGGSNCNPNLAAASNGSGGGGGGISAGGGVASSTPINASTGSSSSSSSSSSSSSSSSSSSSSSSSCGPLPGKPVYSTPSPVENTPQNNECKMVDLRGAKVASFTVEGCELICLPQAFDLFLKHLVGGLHTVYTKLKRLEITPVVCNVEQVRILRGLGAIQPGVNRCKLISRKDFETLYNDCTNASSRPGRPPKRTQSVTSPENSHIMPHSVPGLMSPGIIPPTGLTAAAAAAAAATNAAIAEAMKVKKIKLEAMSNYHASNNQHGADSENGDMNSSVGSSDGSWDKETLPSSPSQGPQASITHPRMPGARSLPLSHPLNHLQQSHLLPNGLELPFMMMPHPLIPVSLPPASVTMAMSQMNHLSTIANMAAAAQVQSPPSRVETSVIKERVPDSPSPAPSLEEGRRPGSHPSSHRSSSVSSSPARTESSSDRIPVHQNGLSMNQMLMGLSPNVLPGPKEGDLAGHDMGHESKRMHIEKDETPLSTPTARDSLDKLSLTGHGQPLPPGFPSPFLFPDGLSSIETLLTNIQGLLKVAIDNARAQEKQVQLEKTELKMDFLRERELRETLEKQLAMEQKNRAIVQKRLKKEKKAKRKLQEALEFETKRREQAEQTLKQAASTDSLRVLNDSLTPEIEADRSGGRTDAERTIQAARLYIKTVCMY

SEQ ID NO: 4211 - protein, 599 aa, Homo sapiens
MAVSASPVISATSSGAGVPGGLFRAEPLYSTPREPPRLTPNMINSFVVNNHSNSAGGGGRGNTNTNECRMVDMHGMKVASFLMDGQELICLPQVFDLFLKHLVGGLHTVYTKLKRLDISPVVCTVEQVRILRGLGAIQPGVNRCKLITRKDFETLFTDCTNARRKRQMTRKQAVNSSRPGRPPKRSLGVLQENARLLTHAVPGLLSPGLITPTGITAAAMAEAMKLQKMKLMAMNTLQGNGSQNGTESEPDDLNSNTGGSESSWDKDKMQSPFAAPGPQHGIAHAALAGQPGIGGAPTLNPLQQNHLLTNRLDLPFMMMPHPLLPVSLPPASVAMAMNQMNHLNTIANMAAAAQIHSPLSRAGTSVIKERIPESPSPAPSLEENHRPGSQTSSHTSSSVSSSPSQMDHHLERMEEVPVQIPIMKSPLDKIQLTPGQALPAGFPGPFIFADSLSSVETLLTNIQGLLKVALDNARIQEKQIQQEKKELRLELYREREIRENLERQLAVELQSRTTMQKRLKKEKKTKRKLQEALEFESKRREQVEQALKQATTSDSGLRMLKDTGIPDIEIENNGTPHDSAAMQGGNYYCLEMAQQLYSA

SEQ ID NO: 4212 - protein, 599 aa, Homo sapiens; identical to SEQ ID NO: 4211

SEQ ID NO: 4213 - protein, 571 aa, Homo sapiens
MAVSASPVISATSSGAGVPGGLFRAEPLYSTPREPPRLTPNMINSFVVNNHSNSAGGGGRGNTNTNECRMVDMHGMKVASFLMDGQELICLPQVFDLFLKHLVGGLHTVYTKLKRLDISPVVCTVEQVRILRGLGAIQPGVNRCKLITRKDFETLFTDCTNASSRPGRPPKRSLGVLQENARLLTHAVPGLLSPGLITPTGITAAAMAEAMKLQKMKLMAMNTLQGNGSQNGTESEPDDLNSNTGGSESSWDKDKMQSPFAAPGPQHGIAHAALAGQPGIGGAPTLNPLQQNHLLTNRLDLPFMMMPHPLLPVSLPPASVAMAMNQMNHLNTIANMAAAAQIHSPLSRAGTSVIKERIPESPSPAPSLEENHRPGSQTSSHTSSSVSSSPSQMDHHLERMEEVPVQIPIMKSPLDKIQLTPGQALPAGFPGPFIFADSLSSVETLLTNIQGLLKVALDNARIQEKQIQQEKKELRLELYREREIRENLERQLAVELQSRTTMQKRLKKEKKTKRKLQEALEFESKRREQVEQALKQATTSDSGLRMLKDTGIPDIEIENNGTPHDSAAMQA

SEQ ID NO: 4214 - protein, 432 aa, Homo sapiens
MAQNQFFNSSRPGRPPKRSLGVLQENARLLTHAVPGLLSPGLITPTGITAAAMAEAMKLQKMKLMAMNTLQGNGSQNGTESEPDDLNSNTGGSESSWDKDKMQSPFAAPGPQHGIAHAALAGQPGIGGAPTLNPLQQNHLLTNRLDLPFMMMPHPLLPVSLPPASVAMAMNQMNHLNTIANMAAAAQIHSPLSRAGTSVIKERIPESPSPAPSLEENHRPGSQTSSHTSSSVSSSPSQMDHHLERMEEVPVQIPIMKSPLDKIQLTPGQALPAGFPGPFIFADSLSSVETLLTNIQGLLKVALDNARIQEKQIQQEKKELRLELYREREIRENLERQLAVELQSRTTMQKRLKKEKKTKRKLQEALEFESKRREQVEQALKQATTSDSGLRMLKDTGIPDIEIENNGTPHDSAAMQGGNYYCLEMAQQLYSA

SEQ ID NO: 4215 - protein, 432 aa, Homo sapiens
MTRKQAVNSSRPGRPPKRSLGVLQENARLLTHAVPGLLSPGLITPTGITAAAMAEAMKLQKMKLMAMNTLQGNGSQNGTESEPDDLNSNTGGSESSWDKDKMQSPFAAPGPQHGIAHAALAGQPGIGGAPTLNPLQQNHLLTNRLDLPFMMMPHPLLPVSLPPASVAMAMNQMNHLNTIANMAAAAQIHSPLSRAGTSVIKERIPESPSPAPSLEENHRPGSQTSSHTSSSVSSSPSQMDHHLERMEEVPVQIPIMKSPLDKIQLTPGQALPAGFPGPFIFADSLSSVETLLTNIQGLLKVALDNARIQEKQIQQEKKELRLELYREREIRENLERQLAVELQSRTTMQKRLKKEKKTKRKLQEALEFESKRREQVEQALKQATTSDSGLRMLKDTGIPDIEIENNGTPHDSAAMQGGNYYCLEMAQQLYSA

SEQ ID NO: 4216 - protein, 380 aa, Homo sapiens
MAEAMKLQKMKLMAMNTLQGNGSQNGTESEPDDLNSNTGGSESSWDKDKMQSPFAAPGPQHGIAHAALAGQPGIGGAPTLNPLQQNHLLTNRLDLPFMMMPHPLLPVSLPPASVAMAMNQMNHLNTIANMAAAAQIHSPLSRAGTSVIKERIPESPSPAPSLEENHRPGSQTSSHTSSSVSSSPSQMDHHLERMEEVPVQIPIMKSPLDKIQLTPGQALPAGFPGPFIFADSLSSVETLLTNIQGLLKVALDNARIQEKQIQQEKKELRLELYREREIRENLERQLAVELQSRTTMQKRLKKEKKTKRKLQEALEFESKRREQVEQALKQATTSDSGLRMLKDTGIPDIEIENNGTPHDSAAMQGGNYYCLEMAQQLYSA

SEQ ID NO: 4217 - protein, 597 aa, Homo sapiens
MQWPPPWRRSPLVSATPPPGPTRGLLCPRRVSEAGDSSTEGARTGHRHYVTPAESAMEGRSQPLPSLRPASPTNAPAHGRGSDCTAKEPPLANVCRQNYGAAQDPVEPAGRRSASHVTGSSLGKAEVACGRRWRWAELLADTSWSPAGRATEMKVKMLSRNPDNYVRETKLDLQRVPRNYDPALHPFEVPREYIRALNATKLERVFAKPFLASLDGHRDGVNCLAKHPEKLATVLSGACDGEVRIWNLTQRNCIRTIQAHEGFVRGICTRFCGTSFFTVGDDKTVKQWKMDGPGYGDEEEPLHTILGKTVYTGIDHHWKEAVFATCGQQVDIWDEQRTNPICSMTWGFDSISSVKFNPIETFLLGSCASDRNIVLYDMRQATPLKKVILDMRTNTICWNPMEAFIFTAANEDYNLYTFDMRALDTPVMVHMDHVSAVLDVDYSPTGKEFVSASFDKSIRIFPVDKSRSREVYHTKRMQHVICVKWTSDSKYIMCGSDEMNIRLWKANASEKLGVLTSREKAAKDYNQKLKEKFQHYPHIKRIARHRHLPKSIYSQIQEQRIMKEARRRKEVNRIKHSKPGSVPLVSEKKKHVVAVVK

SEQ ID NO: 4218 - protein, 96 aa, Homo sapiens
MKVKMLSRNPDNYVRETKLDLQRVPRNYDPALHPFEVPREYIRALNATKLERVFAKPFLASLDGHRDGVNCLAKHPEKLATVLSGACDGELNMIKL

SEQ ID NO: 4219 - protein, 860 aa, Homo sapiens
MSRGGSYPHLLWDVRKRSLGLEDPSRLRSRYLGRREFIQRLKLEATLNVHDGCVNTICWNDTGEYILSGSDDTKLVISNPYSRKVLTTIRSGHRANIFSAKFLPCTNDKQIVSCSGDGVIFYTNVEQDAETNRQCQFTCHYGTTYEIMTVPNDPYTFLSCGEDGTVRWFDTRIKTSCTKEDCKDDILINCRRAATSVAICPPIPYYLAVGCSDSSVRIYDRRMLGTRATGNYAGRGTTGMVARFIPSHLNNKSCRVTSLCYSEDGQEILVSYSSDYIYLFDPKDDTARELKTPSAEERREELRQPPVKRLRLRGDWSDTGPRARPESERERDGEQSPNVSLMQRMSDMLSRWFEEASEVAQSNRGRGRSRPRGGTSQSDISTLPTVPSSPDLEVSETAMEVDTPAEQFLQPSTSSTMSAQAHSTSSPTESPHSTPLLSSPDSEQRQSVEASGHHTHHQSDNNNEKLSPKPGTGEPVLSLHYSTEGTTTSTIKLNFTDEWSSIASSSRGIGSHCKSEGQEESFVPQSSVQPPEGDSETKAPEESSEDVTKYQEGVSAENPVENHINITQSDKFTAKPLDSNSGERNDLNLDRSCGVPEESASSEKAKEPETSDQTSTESATNENNTNPEPQFQTEATGPSAHEETSTRDSALQDTDDSDDDPVLIPGARYRAGPGDRRSAVARIQEFFRRRKERKEMEELDTLNIRRPLVKMVYKGHRNSRTMIKEANFWGANFVMSGSDCGHIFIWDRHTAEHLMLLEADNHVVNCLQPHPFDPILASSGIDYDIKIWSPLEESRIFNRKLADEVITRNELMLEETRNTITVPASFMLRMLASLNHIRADRLEGDRSEGSGQENENEDEE

SEQ ID NO: 4220 - protein, 951 aa, Homo sapiens
MSRGGSYPHLLWDVRKRSLGLEDPSRLRSRYLGRREFIQRLKLEATLNVHDGCVNTICWNDTGEYILSGSDDTKLVISNPYSRKVLTTIRSGHRANIFSAKFLPCTNDKQIVSCSGDGVIFYTNVEQDAETNRQCQFTCHYGTTYEIMTVPNDPYTFLSCGEDGTVRWFDTRIKTSCTKEDCKDDILINCRRAATSVAICPPIPYYLAVGCSDSSVRIYDRRMLGTRATGNYAGRGTTGMVARFIPSHLNNKSCRVTSLCYSEDGQEILVSYSSDYIYLFDPKDDTARELKTPSAEERREELRQPPVKRLRLRGDWSDTGPRARPESERERDGEQSPNVSLMQRMSDMLSRWFEEASEVAQSNRGRGRSRPRGGTSQSDISTLPTVPSSPDLEVSETAMEVDTPAEQFLQPSTSSTMSAQAHSTSSPTESPHSTPLLSSPDSEQRQSVEASGHHTHHQSEFLRGPEIALLRKRLQQLRLKKAEQQRQQELAAHTQQQPSTSDQSSHEGSSQDPHASDSPSSVVNKQLGSMSLDEQQDNNNEKLSPKPGTGEPVLSLHYSTEGTTTSTIKLNFTDEWSSIASSSRGIGSHCKSEGQEESFVPQSSVQPPEGDSETKAPEESSEDVTKYQEGVSAENPVENHINITQSDKFTAKPLDSNSGERNDLNLDRSCGVPEESASSEKAKEPETSDQTSTESATNENNTNPEPQFQTEATGPSAHEETSTRDSALQDTDDSDDDPVLIPGARYRAGPGDRFNIRGTTIGDRIMRRSAVARIQEFFRRRKERKEMEELDTLNIRRPLVKMVYKGHRNSRTMIKEANFWGANFVMSGSDCGHIFIWDRHTAEHLMLLEADNHVVNCLQPHPFDPILASSGIDYDIKIWSPLEESRIFNRKLADEVITRNELMLEETRNTITVPASFMLRMLASLNHIRADRLEGDRSEGSGQENENEDEE

SEQ ID NO: 4221 - protein, 880 aa, Homo sapiens
MSRGGSYPHLLWDVRKRSLGLEDPSRLRSRYLGRREFIQRLKLEATLNVHDGCVNTICWNDTGEYILSGSDDTKLVISNPYSRKVLTTIRSGHRANIFSAKFLPCTNDKQIVSCSGDGVIFYTNVEQDAETNRQCQFTCHYGTTYEIMTVPNDPYTFLSCGEDGTVRWFDTRIKTSCTKEDCKDDILINCRRAATSVAICPPIPYYLAVGCSDSSVRIYDRRMLGTRATGNYAGRGTTGMVARFIPSHLNNKSCRVTSLCYSEDGQEILVSYSSDYIYLFDPKDDTARELKTPSAEERREELRQPPVKRLRLRGDWSDTGPRARPESERERDGEQSPNVSLMQRMSDMLSRWFEEASEVAQSNRGRGRSRPRGGTSQSDISTLPTVPSSPDLEVSETAMEVDTPAEQFLQPSTSSTMSAQAHSTSSPTESPHSTPLLSSPDSEQRQSVEASGHHTHHQSDSPSSVVNKQLGSMSLDEQQDNNNEKLSPKPGTGEPVLSLHYSTEGTTTSTIKLNFTDEWSSIASSSRGIGSHCKSEGQEESFVPQSSVQPPEGDSETKAPEESSEDVTKYQEGVSAENPVENHINITQSDKFTAKPLDSNSGERNDLNLDRSCGVPEESASSEKAKEPETSDQTSTESATNENNTNPEPQFQTEATGPSAHEETSTRDSALQDTDDSDDDPVLIPGARYRAGPGDRRSAVARIQEFFRRRKERKEMEELDTLNIRRPLVKMVYKGHRNSRTMIKEANFWGANFVMSGSDCGHIFIWDRHTAEHLMLLEADNHVVNCLQPHPFDPILASSGIDYDIKIWSPLEESRIFNRKLADEVITRNELMLEETRNTITVPASFMLRMLASLNHIRADRLEGDRSEGSGQENENEDEE

SEQ ID NO: 4222 - protein, 920 aa, Homo sapiens
MSRGGSYPHLLWDVRKRSLGLEDPSRLRSRYLGRREFIQRLKLEATLNVHDGCVLTTIRSGHRANIFSAKFLPCTNDKQIVSCSGDGVIFYTNVEQDAETNRQCQFTCHYGTTYEIMTVPNDPYTFLSCGEDGTVRWFDTRIKTSCTKEDCKDDILINCRRAATSVAICPPIPYYLAVGCSDSSVRIYDRRMLGTRATGNYAGRGTTGMVARFIPSHLNNKSCRVTSLCYSEDGQEILVSYSSDYIYLFDPKDDTARELKTPSAEERREELRQPPVKRLRLRGDWSDTGPRARPESERERDGEQSPNVSLMQRMSDMLSRWFEEASEVAQSNRGRGRSRPRGGTSQSDISTLPTVPSSPDLEVSETAMEVDTPAEQFLQPSTSSTMSAQAHSTSSPTESPHSTPLLSSPDSEQRQSVEASGHHTHHQSEFLRGPEIALLRKRLQQLRLKKAEQQRQQELAAHTQQQPSTSDQSSHEGSSQDPHASDSPSSVVNKQLGSMSLDEQQDNNNEKLSPKPGTGEPVLSLHYSTEGTTTSTIKLNFTDEWSSIASSSRGIGSHCKSEGQEESFVPQSSVQPPEGDSETKAPEESSEDVTKYQEGVSAENPVENHINITQSDKFTAKPLDSNSGERNDLNLDRSCGVPEESASSEKAKEPETSDQTSTESATNENNTNPEPQFQTEATGPSAHEETSTRDSALQDTDDSDDDPVLIPGARYRAGPGDRFNIRGTTIGDRIMRRSAVARIQEFFRRRKERKEMEELDTLNIRRPLVKMVYKGHRNSRTMIKEANFWGANFVMSGSDCGHIFIWDRHTAEHLMLLEADNHVVNCLQPHPFDPILASSGIDYDIKIWSPLEESRIFNRKLADEVITRNELMLEETRNTITVPASFMLRMLASLNHIRADRLEGDRSEGSGQENENEDEE

SEQ ID NO: 4223 - protein, 507 aa, Homo sapiens
MEDSEALGFEHMGLDPRLLQAVTDLGWSRPTLIQEKAIPLALEGKDLLARARTGSGKTAAYAIPMLQLLLHRKATGPVVEQAVRGLVLVPTKELARQAQSMIQQLATYCARDVRVANVSAAEDSVSQRAVLMEKPDVVVGTPSRILSHLQQDSLKLRDSLELLVVDEADLLFSFGFEEELKSLLCHLPRIYQAFLMSATFNEDVQALKELILHNPVTLKLQESQLPGPDQLQQFQVVCETEEDKFLLLYALLKLSLIRGKSLLFVNTLERSYRLRLFLEQFSIPTCVLNGELPLRSRASDPEAGVARGIDFHHVSAVLNFDLPPTPEAYIHRAGRTARANNPGIVLTFVLPTEQFHLGKIEELLSGENRGPILLPYQFRMEEIEGFRYRCRDAMRSVTKQAIREARLKEIKEELLHSEKLKTYFEDNPRDLQLLRHDLPLHPAVVKPHLGHVPDYLVPPALRGLVRPHKKRKKLSSSCRKAKRAKSQNPLRSFKHKGKKFRPTAKPS

SEQ ID NO: 4224 - protein, 796 aa, Homo sapiens
MVLAQRRRGGCEKLRAGPQAVLASGSGFCDNMLADLGLIGTIGEDDEVPVEPESDSGDEEEEGPIVLGRRQKALGKNRSADFNPDFVFTEKEGTYDGSWALADVMSQLKKKRAATTLDEKIEKVRKKRKTEDKEAKSGKLEKEKEAKEGSEPKEQEDLQENDEEGSEDEASETDYSSADENILTKADTLKVKDRKKKKKKGQEAGGFFEDASQYDENLSFQDMNLSRPLLKAITAMGFKQPTPIQKACIPVGLLGKDICACAATGTGKTAAFALPVLERLIYKPRQAPVTRVLVLVPTRELGIQVHSVTRQLAQFCNITTCLAVGGLDVKSQEAALRAAPDILIATPGRLIDHLHNCPSFHLSSIEVLILDEADRMLDEYFEEQMKEIIRMCSHHRQTMLFSATMTDEVKDLASVSLKNPVRIFVNSNTDVAPFLRQEFIRIRPNREGDREAIVAALLTRTFTDHVMLFTQTKKQAHRMHILLGLMGLQVGELHGNLSQTQRLEALRRFKDEQIDILVATDVAARGLDIEGVKTVINFTMPNTIKHYVHRVGRTARAGRAGRSVSLVGEDERKMLKEIVKAAKAPVKARILPQDVILKFRDKIEKMEKDVYAVLQLEAEEKEMQQSEAQINTAKRLLEKGKEAVVQEPERSWFQTKEERKKEKIAKALQEFDLALRGKKKRKKFMKDAKKKGEMTAEERSQFEILKAQMFAERLAKRNRRAKRARAMPEEEPVRGPAKKQKQGKKSVFDEELTNTSKKALKQYRAGPSFEERKQLGLPHQRRGGNFKSKSRYKRRK

SEQ ID NO: 4225 - protein, 136 aa, Homo sapiens
MVLAQRRRGGCEKLRAGPQAVLASGSGFCDNMLADLGLIGTIGEDDEVPVEPESDSGDEEEEGPIVLGRRQKALGKNRSADFNPDFVFTEKEGTYDGSWALADVMSQLKKKRAATTLDEKIEKVRKKRKKKKKKKK

SEQ ID NO: 4226 - protein, 585 aa, Homo sapiens
MAPDLASQRHSESFPSVNSRPNVILPGREGRREGLPPGGGTRGSLVPTRPVPPSPAPLGTSPYSWSRSGPGRGGGAGSSRVPRGVPGPAVCAPGSLLHHASPTQTMAAADGSLFDNPRTFSRRPPAQASRQAKATKRKYQASSEAPPAKRRNETSFLPAKKTSVKETQRTFKGNAQKMFSPKKHSVSTSDRNQEERQCIKTSSLFKNNPDIPELHRPVVKQVQEKVFTSAAFHELGLHPHLISTINTVLKMSSMTSVQKQSIPVLLEGRDALVRSQTGSGKTLAYCIPVVQSLQAMESKIQRSDGPYALVLVPTRELALQSFDTVQKLLKPFTWIVPGVLMGGEKRKSEKARLRKGINILISTPGRLVDHIKSTKNIHFSRLRWLVFDEADRILDLGFEKDITVILNAVNAECQKRQNVLLSATLTEGVTRLADISLHDPVSISVLDKSHDQLNPKDKAVQEVCPPPAGDKLDSFAIPESLKQHVTVVPSKLRLVCLAAFILQKCKFEEDQKMVVFFSSCELVEFHYSLFLQTLLSSSGAPASGQLPSASMRLKFLRLHGGMEQEERTAVFQEFSHSRRGVLLCT

SEQ ID NO: 4227 - protein, 778 aa, Homo sapiens
MAPDLASQRHSESFPSVNSRPNVILPGREGRREGLPPGGGTRGSLVPTRPVPPSPAPLGTSPYSWSRSGPGRGGGAGSSRVPRGVPGPAVCAPGSLLHHASPTQTMAAADGSLFDNPRTFSRRPPAQASRQAKATKRKYQASSEAPPAKRRNETSFLPAKKTSVKETQRTFKGNAQKMFSPKKHSVSTSDRNQEERQCIKTSSLFKNNPDIPELHRPVVKQVQEKVFTSAAFHELGLHPHLISTINTVLKMSSMTSVQKQSIPVLLEGRDALVRSQTGSGKTLAYCIPVVQSLQAMESKIQRSDGPYALVLVPTRELALQSFDTVQKLLKPFTWIVPGVLMGGEKRKSEKARLRKGINILISTPGRLVDHIKSTKNIHFSRLRWLVFDEADRILDLGFEKDITVILNAVNAECQKRQNVLLSATLTEGVTRLADISLHDPVSISVLDKSHDQLNPKDKAVQEVCPPPAGDKLDSFAIPESLKQHVTVVPSKLRLVCLAAFILQKCKFEEDQKMVVFFSSCELVEFHYSLFLQTLLSSSGAPASGQLPSASMRLKFLRLHGGMEQEERTAVFQEFSHSRRGVLLCTDVAARGLDLPQVTWIVQNTSTGLEEPPGLAAMGAACSFWLLRRQNMSTRWLLTKSTLQSFIQAYATYPRELKHIFHVRSLHLGHVAKSFGLRDAPRNLSALTRKKRKAHVKRPDLHKKTQSKHSLAEILRSEYSSGMEADIAKVKKQNAPGEPGGRPLQHSLQPTPCFGRGKTLKWRKTQKGVQRDSKTSQKV

SEQ ID NO: 4228 - protein, 775 aa, Homo sapiens
MAPDLASQRHSESFPSVNSRPNVILPGREGRREGLPPGGGTRGSLVPTRPVPPSPAPLGTSPYSWSRSGPGRGGGAGSSRVPRGVPGPAVCAPGSLLHHASPTQTMAAADGSLFDNPRTFSRRPPAQASRQAKATKRKYQASSEAPPAKRRNETSFLPAKKTSVKETQRTFKGNAQKMFSPKKHSVSTSDRNQEERQCIKTSSLFKNNPDIPELHRPVVKQVQEKVFTSAAFHELGLHPHLISTINTVLKMSSMTSVQKQSIPVLLEGRDALVRSQTGSGKTLAYCIPVVQSLQAMESKIQRSDGPYALVLVPTRELALQSFDTVQKLLKPFTWIVPGVLMGGEKRKSEKARLRKGINILISTPGRLVDHIKSTKNIHFSRLRWLVFDEADRILDLGFEKDITVILNAVNAECQKRQNVLLSATLTEGVTRLADISLHDPVSISVLDKSHDQLNPKDKAVQEVCPPPAGDKLDSFAIPESLKQHVTVVPSKLRLVCLAAFILQKCKFEEDQKMVVFFSSCELVEFHYSLFLQTLLSSSGAPASGQLPSASMRLKFLRLHGGMEQEERTAVFQEFSHSRRGVLLCTDVAARGLDLPQVTWIVQYNAPSSPAEYIHRIGRTARIGCHGSSLLILAPSEAEYVNSLASHKINVSEIKMEDILCVLTRDDCFKGKRWGAQKSHAVGPQEIRERATVLQTVFEDYVHSSERRVSWAKKVWSLETPVLTASLPALFSFSSAVLHPSLRHLPQGAEAHLPRPIPPPWACGEELRTKRCPQES

SEQ ID NO: 4229 - protein, 851 aa, Homo sapiens
MAPDLASQRHSESFPSVNSRPNVILPGREGRREGLPPGGGTRGSLVPTRPVPPSPAPLGTSPYSWSRSGPGRGGGAGSSRVPRGVPGPAVCAPGSLLHHASPTQTMAAADGSLFDNPRTFSRRPPAQASRQAKATKRKYQASSEAPPAKRRNETSFLPAKKTSVKETQRTFKGNAQKMFSPKKHSVSTSDRNQEERQCIKTSSLFKNNPDIPELHRPVVKQVQEKVFTSAAFHELGLHPHLISTINTVLKMSSMTSVQKQSIPVLLEGRDALVRSQTGSGKTLAYCIPVVQSLQAMESKIQRSDGPYALVLVPTRELALQSFDTVQKLLKPFTWIVPGVLMGGEKRKSEKARLRKGINILISTPGRLVDHIKSTKNIHFSRLRWLVFDEADRILDLGFEKDITVILNAVNAECQKRQNVLLSATLTEGVTRLADISLHDPVSISVLDKSHDQLNPKDKAVQEVCPPPAGDKLDSFAIPESLKQHVTVVPSKLRLVCLAAFILQKCKFEEDQKMVVFFSSCELVEFHYSLFLQTLLSSSGAPASGQLPSASMRLKFLRLHGGMEQEERTAVFQEFSHSRRGVLLCTDVAARGLDLPQVTWIVQYNAPSSPAEYIHRIGRTARIGCHGSSLLILAPSEAEYVNSLASHKINVSEIKMEDILCVLTRDDCFKGKRWGAQKSHAVGPQEIRERATVLQTVFEDYVHSSERRVSWAKKALQSFIQAYATYPRELKHIFHVRSLHLGHVAKSFGLRDAPRNLSALTRKKRKAHVKRPDLHKKTQSKHSLAEILRSEYSSGMEADIAKVKKQNAPGEPGGRPLQHSLQPTPCFGRGKTLKWRKTQKGVQRDSKTSQKV

SEQ ID NO: 4230 - protein, 722 aa, Homo sapiens
MQAKATKRKYQASSEAPPAKRRNETSFLPAKKTSVKETQRTFKGNAQKMFSPKKHSVSTSDRNQEERQCIKTSSLFKNNPDIPELHRPVVKQVQEKVFTSAAFHELGLHPHLISTINTVLKMSSMTSVQKQSIPVLLEGRDALVRSQTGSGKTLAYCIPVVQSLQAMESKIQRSDGPYALVLVPTRELALQSFDTVQKLLKPFTWIVPGVLMGGEKRKSEKARLRKGINILISTPGRLVDHIKSTKNIHFSRLRWLVFDEADRILDLGFEKDITVILNAVNAECQKRQNVLLSATLTEGVTRLADISLHDPVSISVLDKSHDQLNPKDKAVQEVCPPPAGDKLDSFAIPESLKQHVTVVPSKLRLVCLAAFILQKCKFEEDQKMVVFFSSCELVEFHYSLFLQTLLSSSGAPASGQLPSASMRLKFLRLHGGMEQEERTAVFQEFSHSRRGVLLCTDVAARGLDLPQVTWIVQYNAPSSPAEYIHRIGRTARIGCHGSSLLILAPSEAEYVNSLASHKINVSEIKMEDILCVLTRDDCFKGKRWGAQKSHAVGPQEIRERATVLQTVFEDYVHSSERRVSWAKKALQSFIQAYATYPRELKHIFHVRSLHLGHVAKSFGLRDAPRNLSALTRKKRKAHVKRPDLHKKTQSKHSLAEILRSEYSSGMEADIAKVKKQNAPGEPGGRPLQHSLQPTPCFGRGKTLKWRKTQKGVQRDSKTSQKV

SEQ ID NO: 4231 - protein, 160 aa, Homo sapiens [sequence omitted]

SEQ ID NO: 4232 - protein, 427 aa, Homo sapiens
MAEQDVENDLLDYDEEEEPQAPQESTPAPPKKDIKGSYVSIHSSGFRDFLLKPELLRAIVDCGFEHPSEVQHECIPQAILGMDVLCQAKSGMGKTAVFVLATLQQIEPVNGQVTVLVMCHTRELAFQISKEYERFSKYMPSVKVSVFFGGLSIKKDEEVLKKNCPHVVVGTPGRILALVRNRSFSLKNVKHFVLDECDKMLEQLDMRRDVQEIFRLTPHEKQCMMFSATLSKDIRPVCRKFMQDPMEVFVDDETKLTLHGLQQYYVKLKDSEKNRKLFDLLDVLEFNQVIIFVKSVQRCMALAQLLVEQNFPAIAIHRGMAQEERLSRYQQFKDFQRRILVATNLFGRGMDIERVNIVFNYDMPEDSDTYLHRVARAGRFGTKGLAITFVSDENDAKILNDVQDRFEVNVAELPEEIDISTYIEQSR

SEQ ID NO: 4233 - protein, 322 aa, Homo sapiens
MAEQDVENDLLDYDEEEEPQAPQESTPAPPKKDIKGSYVSIHSSGFRDFLLKPELLRAIVDCGFEHPSEVQHECIPQAILGMDVLCQAKSGMGKTAVFVLATLQQIEPVNGQVTVLVMCHTRELAFQISKEYERFSKYMPSVKVSVFFGGLSIKKDEEVLKKNCPHVVVGTPGRILALVRNRSFSLKNVKHFVLDECDKMLEQLDMRRDVQEIFRLTPHEKQCMMFSATLSKDIRPVCRKFMQDPMEVFVDDETKLTLHGLQQYYVKLKDSEKNRKLFDLLDVLEFNQPVTLSAVQGFPAADPGGHQSVWPGDGHRASQHRL

SEQ ID NO: 4234 - protein, 470 aa, Homo sapiens
MAYGAPSPTWSLSVRPNRPRGGLGPFGEVQVILLPPSSWDYSIMAEQDVENDLLDYDEEEEPQAPQESTPAPPKKDIKGSYVSIHSSGFRDFLLKPELLRAIVDCGFEHPSEVQHECIPQAILGMDVLCQAKSGMGKTAVFVLATLQQIEPVNGQVTVLVMCHTRELAFQISKEYERFSKYMPSVKVSVFFGGLSIKKDEEVLKKNCPHVVVGTPGRILALVRNRSFSLKNVKHFVLDECDKMLEQLDMRRDVQEIFRLTPHEKQCMMFSATLSKDIRPVCRKFMQDPMEVFVDDETKLTLHGLQQYYVKLKDSEKNRKLFDLLDVLEFNQVIIFVKSVQRCMALAQLLVEQNFPAIAIHRGMAQEERLSRYQQFKDFQRRILVATNLFGRGMDIERVNIVFNYDMPEDSDTYLHRVARAGRFGTKGLAITFVSDENDAKILNDVQDRFEVNVAELPEEIDISTYIEQSR

SEQ ID NO: 4235 - protein, 267 aa, Homo sapiens
MAEQDVENDLLDYDEEEEPQAPQESTPAPPKKDIKGSYVSIHSSGFRDFLLKPELLRAIVDCGFEHPSEVQHECIPQAILGMDVLCQAKSGMGKTAVFVLATLQQIEPVNGQVTVLVMCHTRELAFQISKEYERFSKYMPSVKVSVFFGGLSIKKDEEVLKKNCPHVVVGTPGRILALVRNRSFSLKNVKHFVLDECDKMLEQLDMRRDVQEIFRLTPHEKQCMMFSATLSKDIRPVCRKFMQDVLWEVSHKGVAHWKVLGRRDAQR

SEQ ID NO: 4236 - protein, 1031 aa, Homo sapiens
MGRESRHYRKRSASRGRSGSRSRSRSPSDKRSKRGDDRRSRSRDRDRRRERSRSRDKRRSRSRDRKRLRRSRSRERDRSRERRRSRSRDRRRSRSRSRGRRSRSSSPGNKSKKTENRSRSKEKTDGGESSKEKKKDKDDKEDEKEKDAGNFDQNKLEEEMRKRKERVEKWREEQRKKAMENIGELKKEIEEMKQGKKWSLEDDDDDEDDPAEAEKEGNEMEGEELDPLDAYMEEVKEEVKKFNMRSVKGGGGNEKKSGPTVTKVVTVVTTKKAVVDSDKKKGELMENDQDAMEYSSEEEEVDLQTALTGYQTKQRKLLEPVDHGKIEYEPFRKNFYVEVPELAKMSQEEVNVFRLEMEGITVKGKGCPKPIKSWVQCGISMKILNSLKKHGYEKPTPIQTQAIPAIMSGRDLIGIAKTGSGKTIAFLLPMFRHIMDQRSLEEGEGPIAVIMTPTRELALQITKECKKFSKTLGLRVVCVYGGTGISEQIAELKRGAEIIVCTPGRMIDMLAANSGRVTNLRRVTYVVLDEADRMFDMGFEPQVMRIVDNVRPDRQTVMFSATFPRAMEALARRILSKPIEVQVGGRSVVCSDVEQQVIVIEEEKKFLKLLELLGHYQESGSVIIFVDKQEHADGLLKDLMRASYPCMSLHGGIDQYDRDSIINDFKNGTCKLLVATSVAARGLDVKHLILVVNYSCPNHYEDYVHRAGRTGRAGNKGYAYTFITEDQARYAGDIIKALELSGTAVPPDLEKLWSDFKDQQKAEGKIIKKSSGFSGKGFKFDETEQALANERKKLQKAALGLQDSDDEDAAVDIDEQIESMFNSKKRVKDMAAPGTSSVPAPTAGNAEKLEIAKRLALRINAQKNLGIESQDVMQQATNAILRGGTILAPTVSAKTIAEQLAEKINAKLNYVPLEKQEEERQDGGQNESFKRYEEELEINDFPQTARWKVTSKEALQRISEYSEAAITIRGTYFPPGKEPKEGERKIYLAIESANELAVQKAKAEITRLIKEELIRLQNSYQPTNKGRYKVL

SEQ ID NO: 4237 - protein, 1032 aa, Homo sapiens
MGRESRHYRKRSASRGRSGSRSRSRSPSDKRSKRGDDRRSRSRDRDRRRERSRSRDKRRSRSRDRKRLRRSRSRERDRSRERRRSRSRDRRRSRSRSRGRRSRSSSPGNKSKKTENRSRSKEKTDGGESSKEKKKDKDDKEDEKEKDAGNFDQNKLEEEMRKRKERVEKWREEQRKKAMENIGELKKEIEEMKQGKKWSLEDDDDDEDDPAEAEKEGNEMEGEELDPLDAYMEEVKEEVKKFNMRSVKGGGGNEKKSGPTVTKVVTVVTTKKAVVDSDKKKGELMENDQDAMEYSSEEEEVDLQTALTGYQTKQRKLLEPVDHGKIEYEPFRKNFYVEVPELAKMSQEEVNVFRLEMEGITVKGKGCPKPIKSWVQCGISMKILNSLKKHGYEKPTPIQTQAIPAIMSGRDLIGIAKTGSGKTIAFLLPMFRHIMDQRSLEEGEGPIAVIMTPTRELALQITKECKKFSKTLGLRVVCVYGGTGISEQIAELKRGAEIIVCTPGRMIDMLAANSGRVTNLRRVTYVVLDEADRMFDMGFEPQVMRIVDNVRPDRQTVMFSATFPRAMEALARRILSKPIEVQVGGRSVVCSDVEQQVIVIEEEKKFLKLLELLGHYQESGSVIIFVDKQEHADGLLKDLMRASYPCMSLHGGIDQYDRDSIINDFKNGTCKLLVATSVAARGLDVKHLILVVNYSCPNHYEDYVHRAGRTGRAGNKGYAYTFITEDQARYAGDIIKALELSGTAVPPDLEKLWSDFKDQQKAEGKIIKKSSGFSGKGFKFDETEQALANERKKLQKAALGLQDSDDEDAAVDIDEQIESMFNSKKRVKDMAAPGTSSVPAPTAGNAEKLEIAKRLALRINAQKNLGIESQVDVMQQATNAILRGGTILAPTVSAKTIAEQLAEKINAKLNYVPLEKQEEERQDGGQNESFKRYEEELEINDFPQTARWKVTSKEALQRISEYSEAAITIRGTYFPPGKEPKEGERKIYLAIESANELAVQKAKAEITRLIKEELIRLQNSYQPTNKGRYKVL

SEQ ID NO: 4238 - protein, 259 aa, Homo sapiens
MGRESRHYRKRSASRGRSGSRSRSRSPSDKRSKRGDDRRSRSRDRDRRRERSRSRDKRRSRSRDRKRLRRSRSRERDRSRERRRSRSRDRRRSRSRSRGRRSRSSSPGNKSKKTENRSRSKEKTDGGESSKEKKKDKDDKEDEKEKDAGNFDQNKLEEEMRKRKERVEKWREEQRKKAMENIGELKKEIEEMKQGKKWSLEDDDDDEDDPAEAEKEGNEMEGEELDPLDAYMEEVKEEVKKFNMRSVKAVSKKKKKKKK

SEQ ID NO: 4239 - protein, 406 aa, Homo sapiens
MAAPEEHDSPTEASQPIVEEEETKTFKDLGVTDVLCEACDQLGWTKPTKIQIEAIPLALQGRDIIGLAETGSGKTGAFALPILNALLETPQRLFALVLTPTRELAFQISEQFEALGSSIGVQSAVIVGGIDSMSQSLALAKKPHIIIATPGRLIDHLENTKGFNLRALKYLVMDEADRILNMDFETEVDKILKVIPRDRKTFLFSATMTKKVQKLQRAALKNPVKCAVSSKYQTVEKLQQYYIFIPSKFKSKRLGSLNKFKAKARSILLATDVASRGLDIPHVDVVVNFDIPTHSKDYIHRVGRTARAGRSGKAITFVTQYDVELFQRIEHLIGKKLPGFPTQDDEVMMLTERVAEAQRFARMELREHGEKKKRSREDAGDNDDTEGAIGVRNKVAGGKMKKRKGR

SEQ ID NO: 4240 - protein, 455 aa, Homo sapiens
MAAPEEHDSPTEASQPIVEEEETKTFKDLGVTDVLCEACDQLGWTKPTKIQIEAIPLALQGRDIIGLAETGSGKTGAFALPILNALLETPQRLFALVLTPTRELAFQISEQFEALGSSIGVQSAVIVGGIDSMSQSLALAKKPHIIIATPGRLIDHLENTKGFNLRALKYLVMDEADRILNMDFETEVDKILKVIPRDRKTFLFSATMTKKVQKLQRAALKNPVKCAVSSKYQTVEKLQQYYIFIPSKFKDTYLVYILNELAGNSFMIFCSTCNNTQRTALLLRNLGFTAIPLHGQMSQSKRLGSLNKFKAKARSILLATDVASRGLDIPHVDVVVNFDIPTHSKDYIHRVGRTARAGRSGKAITFVTQYDVELFQRIEHLIGKKLPGFPTQDDEVMMLTERVAEAQRFARMELREHGEKKKRSREDAGDNDDTEGAIGVRNKVAGGKMKKRKGR

SEQ ID NO: 4241 - protein, 737 aa, Homo sapiens
MPGKLLWGDIMELEAPLEESESQKKERQKSDRRKSRHHYDSDEKSETRENGVTDDLDAPKAKKSKMKEKLNGDTEEGFNRLSDEFSKSHKSRRKDLPNGDIDEYEKKSKRVSSLDTSTHKSSDNKLEETLTREQKEGAFSNFPISEETIKLLKGRGVTYLFPIQVKTFGPVYEGKDLIAQARTGTGKTFSFAIPLIERLQRNQETIKKSRSPKVLVLAPTRELANQVAKDFKDITRKLSVACFYGGTSYQSQINHIRNGIDILVGTPGRIKDHLQSGRLDLSKLRHVVLDEVDQMLDLGFAEQVEDIIHESYKTDSEDNPQTLLFSATCPQWVYKVAKKYMKSRYEQVDLVGKMTQKAATTVEHLAIQCHWSQRPAVIGDVLQVYSGSEGRAIIFCETKKNVTEMAMNPHIKQNAQCLHGDIAQSQREITLKGFREGSFKVLVATNVAARGLDIPEVDLVIQSSPPQDVESYIHRSGRTGRAGRTGICICFYQPRERGQLRYVEQKAGITFKRVGVPSTMDLVKSKSMDAIRSLASVSYAAVDFFRPSAQRLIEEKGAVDALAAALAHISGASSFEPRSLITSDKGFVTMTLESLEEIQDVSCAWKELNRKLSSNAVSQITRMCLLKGNMGVCFDVPTTESERLQAEWHDSDWILSVPAKLPEIEEYYDGNTSSNSRQRSGWSSGRSGRSGRSGGRSGGRSGRQSRQGSRSGSRQDGRRRSGNRNRSRSGGHKRSFD

SEQ ID NO: 4242 - protein, 711 aa, Homo sapiens
MPGKLLWGDIMELEAPLEESESQKKERQKSDRRKSRHHYDSDEKSETRENGVTDDLDAPKAKKSKMKEKLNGDTEEGFNRLSDEFSKSHKSRRKDLPNGDIDEYEKKSKRVSSLDTSTHKSSDNKLEETLTREQKEGAFSNFPISEETIKLLKGRGVTYLFPIQVKTFGPVYEGKDLIAQARTGTGKTFSFAIPLIERLQRNQETIKKSRSPKVLVLAPTRELANQVAKDFKDITRKLSVACFYGGTSYQSQINHIRNGIDILVGTPGRIKDHLQSGRLDLSKLRHVVLDEVDQMLDLGFAEQVEDIIHESYKTDSEDNPQTLLFSATCPQWVYKVAKKYMKSRYEQVDLVGKMTQKAATTVEHLAIQCHWSQRPAVIGDVLQVYSGSEGRAIIFCETKKNVTEMAMNPHIKQNAQCLHGDIAQSQREITLKGFREGSFKVLVATNVAARGLDIPEVDLVIQSSPPQDVESYIHRSGRTGRAGRTGICICFYQPRERGQLRYVEQKAGITFKRVGVPSTMDLVKSKSMDAIRSLASVSYAAVDFFRPSAQRLIEEKGAVDALAAALAHISGASSFEPRSLITSDKGFVTMTLESLEEIQDVSCAWKELNRKLSSNAVSQITRMCLLKGNMGVCFDVPTTESERLQAEWHDSDWILSVPAKLPEIEEYYDGNTSSNSRQSRQGSRSGSRQDGRRRSGNRNRSRSGGHKRSFD

SEQ ID NO: 4243 - protein, 666 aa, Homo sapiens
MALFYVARYPGPDAAAAAGPEGAEAGAHGRARALLERLQSRARERQQQREPAQTEAAASTEPATRRRRRPRRRRRVNDAEPGSPEAPQGKRRKADGEDAGAESNEEAPGEPSAGSSEEAPGEPSAGSSEEAPGERSTSASAEAAPDGPALEEAAGPLVPGLVLGGFGKRKAPKVQPFLPRWLAEPNCVRRNVTEDLVPIEDIPDVHPDLQKQLRAHGISSYFPVQAAVIPALLESAACGFLVGRGGYRPSDLCVSAPTGSGKTLAFVIPVVQALLSRVVCHIRALVVLPTKELAQQVSKVFNIYTDATPLRVSLVTGQKSLAKEQESLVQKTADGYRCLADIVVATPGRLVDHIDQTPGFSLQQLRFLIIDEADRMIDSMHQSWLPRVVAAAFQSEDPADPCALLQRRQAQAVTAASTCCPQMPLQKLLFSATLTQNPEKLQQLGLHQPRLFSTGLAHRGLEDTDGDGDSGKYAFPVGLTHHYVPCSLSSKPLVVLHLVLEMGFSRVLCFTNSRENSHRLFLLVQAFGGVDVAEFSSRYGPGQRRMILKQFEQGKIQLLISTDATARGIDVQGVELVVNYDAPQYLRTYVHRVGRTARAGKTGQAFTLLLKVQERRFLRMLTEAGAPELQRHELSSKLLQPLVPRYEEALSQLEESVKEERKQRAA

SEQ ID NO: 4244 - protein, 631 aa, Homo sapiens
MSHWAPEWKRAEANPRDLGASWDVRGSRGSGWSGPFGHQGPRAAGSREPPLCFKIKNNMVGVVIGYSGSKIKDLQHSTNTKIQIINGESEAKVRIFGNREMKAKAKAAIETLIRKQESYNSESSVDNAASQTPIGRNLGRNDIVGEAEPLSNWDRIRAAVVECEKRKWADLPPVKKNFYIESKATSCMSEMQVINWRKENFNITCDDLKSGEKRLIPKPTCRFKDAFQQYPDLLKSIIRVGIVKPTPIQSQAWPIILQGIDLIVVAQTGTGKTLSYLMPGFIHLDSQPISREQRNGPGMLVLTPTRELALHVEAECSKYSYKGLKSICIYGGRNRNGQIEDISKGVDIIIATPGRLNDLQMNNSVNLRSITYLVIDEADKMLDMEFEPQIRKILLDVRPDRQTVMTSATWPDTVRQLALSYLKDPMIVYVGNLNLVAVNTVKQNIIVTTEKEKRALTQEFVENMSPNDKVIMFVSQKHIADDLSSDFNIQGISAESLHGNSEQSDQERAVEDFKSGNIKILITTDIVSRGLDLNDVTHVYNYDFPRNIDVYVHRVGYIGRTGKTGTSVTLITQRDSKMAGELIKILDRANQSVPEDLVVMAEQYKLNQQKRHRETRSRKPGQRRKEFYFLS

SEQ ID NO: 4245 - protein, 547 aa, Homo sapiens
MEDSEALGFEHMGLDPRLLQAVTDLGWSRPTLIQEKAIPLALEGKDLLARARTGSGKTAAYAIPMLQLLLHRKATGPVVEQAVRGLVLVPTKELARQAQSMIQQLATYCARDVRVANVSAAEDSVSQRAVLMEKPDVVVGTPSRILSHLQQDSLKLRDSLELLVVDEADLLFSFGFEEELKSLLCHLPRIYQAFLMSATFNEDVQALKELILHNPVTLKLQESQLPGPDQLQQFQVVCETEEDKFLLLYALLKLSLIRGKSLLFVNTLERSYRLRLFLEQFSIPTCVLNGELPLRSRCHIISQFNQGFYDCVIATDAEVLGAPVKGKRRGRGPKGDKASDPEAGVARGIDFHHVSAVLNFDLPPTPEAYIHRAGRTARANNPGIVLTFVLPTEQFHLGKIEELLSGENRGPILLPYQFRMEEIEGFRYRCRDAMRSVTKQAIREARLKEIKEELLHSEKLKTYFEDNPRDLQLLRHDLPLHPAVVKPHLGHVPDYLVPPALRGLVRPHKKRKKLSSSCRKAKRAKSQNPLRSFKHKGKKFRPTAKPS

SEQ ID NO: 4246 - protein, 703 aa, Homo sapiens
MAAPVGPVKFWRPGTEGPGVSISEERQSLAENSGTTVVYNPYAALSIEQQRQKLPVFKLRNHILYLIENYQTVVIVGETGCGKSTQIPQYLAEAGWTAEGRVVGVTQPRRVAAVTVAGRVAEERGAVLGHEVGYCIRFDDCTDQLATRIKFLTDGMLVREMMVDPLLTKYSVIMLDEAHERTLYTDIAIGLLKKIQKKRGDLRLIVASATLDADKFRDFFNQNETSDPARDTCVILTVEGRTFPVDIFYLQSPVPDYIKSTVETVVKIHQTEGDGDVLAFLTGQEEVETVVSMLIEQARALARTGMKRHLRVLPMYAGLPSFEQMKVFERVSRSVRKVIVATNVAETSITISGIVYVIDCGFVKLRAYNPRTAIECLVVVPVSQASANQRAGRGGRSRSGKCYRLYTEEAFDKLPQSTVPEMQRSNLAPVILQLKALGIDNVLRFHFMSPPPAQSMVQALELLYALGGLDKDCRLTEPLGMRIAEFPLNPMFAKMLLESGNFGCSQEILSIAAMMQIQNIFVVPPNQKSHAIRVHRKFAVEEGDHLTMLNIYEAFIKHNKDSKWCQEHFLNYKGLVRAATVREQLKKLLVKFQVPRKSSEGDPDLVLRCIVSGFFANAARFHSTGAYRTIRDDHELHIHPASVLYAEKPPRWVIYNEVIQTSKYYMRDVTAIESAWLLELAPHFYQQGTHLSLKAKRAKVQDP

SEQ ID NO: 4247 - protein, 183 aa, Homo sapiens
MLLESGNFGCSQEILSIAAMMQIQNIFVVPPNQKSHAHNKDSKWCQEHFLNYKGLVRAATVREQLKKLLVKFQVPRKSSEGDPDLVLRCIVSGFFANAARFHSTGAYRTIRDDHELHIHPASVLYAEKPPRWVIYNEVIQTSKYYMRDVTAIESAWLLELAPHFYQQGTHLSLKAKRAKVQDP

SEQ ID NO: 4248 - protein, 672 aa, Homo sapiens
MAAPVGPVKFWRPGTEGPGVSISEERQSLAENSGTTVVYNPYAALSIEQQRQKLPVFKYLAEAGWTAEGRVVGVTQPRRVAAVTVAGRVAEERGAVLGHEVGYCIRFDDCTDQLATRIKFLTDGMLVREMMVDPLLTKYSVIMLDEAHERTLYTDIAIGLLKKIQKKRGDLRLIVASATLDADKFRDFFNQNETSDPARDTCVILTVEGRTFPVDIFYLQSPVPDYIKSTVETVVKIHQTEGDGDVLAFLTGQEEVETVVSMLIEQARALARTGMKRHLRVLPMYAGLPSFEQMKVFERVSRSVRKVIVATNVAETSITISGIVYVIDCGFVKLRAYNPRTAIECLVVVPVSQASANQRAGRGGRSRSGKCYRLYTEEAFDKLPQSTVPEMQRSNLAPVILQLKALGIDNVLRFHFMSPPPAQSMVQALELLYALGGLDKDCRLTEPLGMRIAEFPLNPMFAKMLLESGNFGCSQEILSIAAMMQIQNIFVVPPNQKSHAIRVHRKFAVEEGDHLTMLNIYEAFIKHNKDSKWCQEHFLNYKGLVRAATVREQLKKLLVKFQVPRKSSEGDPDLVLRCIVSGFFANAARFHSTGAYRTIRDDHELHIHPASVLYAEKPPRWVIYNEVIQTSKYYMRDVTAIESAWLLELAPHFYQQGTHLSLKAKRAKVQDP

SEQ ID NO: 4249 - protein, 717 aa, Homo sapiens
MTSQPLRLAEEYGPSPGESELAVNPFDGLPFSSRYYELLKQRQALPIWAARFTFLEQLESNPTGVVLVSGEPGSGKSTQIPQWCAEFALARGFQKGQVTVTQPYPLAARSLALRVADEMDLTLGHEVGYSIPQEDCTGPNTLLRFCWDRLLLQEVASTRGTGAWGVLVLDEAQERSVASDSLQGLLQDARLEKLPGDLRVVVVTDPALEPKLRAFWGNPPIVHIPREPGERPSPIYWDTIPPDRVEAACQAVLELCRKELPGDVLVFLPSEEEISLCCESLSREVESLLLQGLPPRVLPLHPDCGRAVQAVYEDMDARKVVVTHWLADFSFSLPSIQHVIDSGLELRSVYNPRIRAEFQVLRPISKCQAEARRLRARGFPPGSCLCLYPKSFLELEAPPLPQPRVCEENLSSLVLLLKRRQIAEPGECHFLDQPAPEALMQALEDLDYLAALDDDGDLSDLGVILSEFPLAPELAKALLASCEFDCVDEMLTLAAMLTAAPGFTRPPLSAEEAALRRALEHTDGDHSSLIQVYEAFIQSGADEAWCQARGLNWAALCQAHKLRGELLELMQRIELPLSLPAFGSEQNRRDLQKALVSGYFLKVARDTDGTGNYLLLTHKHVAQLSSYCCYRSRRAPARPPPWVLYHNFTISKDNCLSIVSEIQPQMLVELAPPYFLSNLPPSESRDLLNQLREGMADSTAGSKSSSAQEFRDPCVLQ

SEQ ID NO: 4250 - protein, 717 aa, Homo sapiens; identical to SEQ ID NO: 4249

SEQ ID NO: 4251 - protein, 326 aa, Homo sapiens
MALSGSTPAPCWEEDECLDYYGMLSLHRMFEVVGGQLTECELELLAFLLDEAPGAAGGLARARSGLELLLELERRGQCDESNLRLLGQLLRVLARHDLLPHLARKRRRPVSPERYSYGTSSSSKRTEGSCRRRRQSSSSANSQQGQWETGSPPTKRQRRSRGRPSGGARRRRRGAPAAPQQQSEPARPSSEGKVTCDIRLRVRAEYCEHGPALEQGVASRRPQALARQLDVFGQATAVLRSRDLGSVVCDIKFSELSYLDAFWGDYLSGALLQALRGVFLTEALREAVGREAVRLLVSVDEADYEAGRRRLLLMEEEGGRRPTEAS

SEQ ID NO: 4252 - protein, 326 aa, Homo sapiens; identical to SEQ ID NO: 4251

SEQ ID NO: 4253 - protein, 544 aa, Homo sapiens
MRVAVAGCCHGELDKIYETLALAERRGPGPVDLLLCCGDFQAVRNEADLRCMAVPPKYRHMQTFYRYYSGEKKAPVLTLFIGGNHEASNHLQELPYGGWVAPNIYYLGLAGVVKYRGVRIGGISGIFKSHDYRKGHFECPPYNSSTIRSIYHVRNIEVYKLKQLKQPIDIFLSHDWPRSIYHYGNKKQLLKTKSFFRQEVENNTLGSPAASELLEHLKPTYWFSAHLHVKFAALMQHQAKDKGQTARATKFLALDKCLPHRDFLQILEIEHDPSAPDYLEYDIEWLTILRATDDLINVTGRLWNMPENNGLHARWDYSATEEGMKEVLEKLNHDLKVPCNFSVTAACYDPSKPQTQMQLIHRINPQTTEFCAQLGIIDINVRLQKSKEEHHVCGEYEEQDDVESNDSGEDQSEYNTDTSALSSINPDEIMLDEEEDEDSIVSAHSGMNTPSVEPSDQASEFSASFSDVRILPGSMIVSSDDTVDSTIDREGKPGGTVESGNGEDLTKVPLKRLSDEHEPEQRKKIKRRNQAIYAAVDDDDDDAA

SEQ ID NO: 4254 - protein, 310 aa, Homo sapiens [sequence omitted]

SEQ ID NO: 4255 - protein, 550 aa, Homo sapiens
MDHHVSTIKPRRIQNQNVIHRLERRRISSGKAGTHWHQVRVFHQNVFPNFTVVNVEKPPCFLRKFSPDGRYFIAFSSDQTSLEIYEYQGCQAAEDLLQGYEGEILSNGNDQRSVNIRGRLFERFFVLLHITNVAANGEHLNRECSLFTDDCRCVIVGSAAYLPDEPHPPFFEVYRNSESVTPNPRSPLEDYSLHIIDLHTGRLCDTRTFKCDKVVLSHNQGLYLYKNILAILSVQQQTIHVFQVTPEGTFIDVRTIGRFCYEDDLLTVSAVFPEVQRDSQTGMANPFRDPFINSLKHRLLVYLWRRAEQDGSAMAKRRFFQYFDQLRQLRMWKMQLLDENHLFIKYTSEDVVTLRVTDPSQASFFVVYNMVTTEVIAVFENTSDELLELFENFCDLFRNATLHSEVQFPCSASSNNFARQIQRRFKDTIINAKYGGHTEAVRRLLGQLPISAQSYSGSPYLDLSLFSYDDKWVSVMERPKTCGDHPIRFYARDSGLLKFEIQAGLLGRPINHTVRRLVAFTFHPFEPFAISVQRTNAEYVVNFHMRHCCT

SEQ ID NO: 4256 - protein, 561 aa, Homo sapiens
MVGQILKRDVIMDHHVSTIKPRRIQNQNVIHRLERRRISSGKAGTHWHQVRVFHQNVFPNFTVVNVEKPPCFLRKFSPDGRYFIAFSSDQTSLEIYEYQGCQAAEDLLQGYEGEILSNGNDQRSVNIRGRLFERFFVLLHITNVAANGEHLNRECSLFTDDCRCVIVGSAAYLPDEPHPPFFEVYRNSESVTPNPRSPLEDYSLHIIDLHTGRLCDTRTFKCDKVVLSHNQGLYLYKNILAILSVQQQTIHVFQVTPEGTFIDVRTIGRFCYEDDLLTVSAVFPEVQRDSQTGMANPFRDPFINSLKHRLLVYLWRRAEQDGSAMAKRRFFQYFDQLRQLRMWKMQLLDENHLFIKYTSEDVVTLRVTDPSQASFFVVYNMVTTEVIAVFENTSDELLELFENFCDLFRNATLHSEVQFPCSASSNNFARQIQRRFKDTIINAKYGGHTEAVRRLLGQLPISAQSYSGSPYLDLSLFSYDDKWVSVMERPKTCGDHPIRFYARDSGLLKFEIQAGLLGRPINHTVRRLVAFTFHPFEPFAISVQRTNAEYVVNFHMRHCCT

SEQ ID NO: 4257 - protein, 561 aa, Homo sapiens; identical to SEQ ID NO: 4256

SEQ ID NO: 4258 - protein, 1863 aa, Homo sapiens
MIEDKGPRVADYFVVAGLTDVSKPLEEEIHFNDACHKVAKPKEPITDVSVIIKSLGEEVPQDYICIDVTPTGLSADLNNGSLVGPQIYLCYRRGRDKPPLTDLGVLYDWKERLKQGCEIIQSTPYGRPANISGSTSSQRIYITYRRASENMTQNTLAVTDICIIIPSKGESPPHTFCKVDKNLNNSMWGSAVYLCYKKSVAKTNTVSYKAGLICRYPQEDYESFSLPESVPLFCLPMGATIECWPSNSKYPLPVFSTFVLTGASAEKVYGAAIQFYEPYSEENLTEKQRLLLGLTSADGKSDSSKTIHTNKCICLLSHWPFFDAFRKFLTFLYRYSISGPHVLPIEKHISHFMHKVPFPSPQRPRILVQLSPHDNLILSQPVSSPLPLSGGKFSTLLQNLGPENAVTLLVFAVTEHKILIHSLRPSVLTSVTEALVSMIFPFHWPCPYVPLCPLALADVLSAPCPFIVGIDSRYFDLYDPPPDVSCVDVDTNTISQIGDKKNVAWKILPKKPCKNLMNTLNNLHQQLAKLQQRPRDDGLMDLAINDYDFNSGKRLHMIDLEIQEAFLFFMASILKGYRSYLRPITQAPSETATDAASLFALQAFLRSRDRSHQKFYNMMTKTQMFIRFIEECSFVSDKDASLAFFDDCVDKVDMDKSGEVRLIELDESFKSEHTVFVTPPEIPHLPNGEEPPLQYSYNGFPVLRNNLFERPEGFLQAKKNKLPSKSSSPNSPLPMFRRTKQEIKSAHKIAKRYSSIPQMWSRCLLRHCYGLWFICLPAYVKVCHSKVRALKTAYDVLKKMQSKKMDPPDEVCYRILMQLCGQYDQPVLAVRVLFEMQKAGIDPNAITYGYYNKAVLESTWPSRSRSGYFLWTKVRNVVLGVTQFKRALKKHAHLSQTTLSGGQSDLGYNSLSKDEVRRGDTSTEDIQEEKDKKGSDCSSLSESESTKGSADCLPKLSYQNSSSIVRLTGTSNNSAGKISGESMESTPELLLISSLEDTNETRNIQSRCFRKRHKSDNETNLQQQVVWGNRNRNLSGGVLMGFMLNRINQEATPGDIVEKLGADAKILSNVISKSTRPNTLDIGKPPLRSKRDSLEKESSDDDTPFDGSNYLADKVDSPVIFDLEDLDSETDVSKAGCVATQNPKRIQRMNSSFSVKPFEKTDVATGFDPLSLLVAETEQQQKEEEEEDEDDSKSISTPSARRDLAEEIVMYMNNMSSPLTSRTPSIDLQRACDDKLNKKSPPLVKACRRSSLPPNSPKPVRLTKSKSYTKSEEKPRDRLWSSPAFSPTCPFREESQDTLTHSSPSFNLDTLLVPKLDVLRNSMFTAGKGVAEKASKWYSRFTMYTTSSKDQSSDRTSLSSVGAQDSESTSLTDEDVCHELEGPISSQETSATSGTKRIDLSRISLESSASLEGSLSKFALPGKSEVTSSFNASNTNIFQNYAMEVLISSCSRCRTCDCLVHDEEIMAGWTADDSNLNTTCPFCGNIFLPFLNIEIRDLRRPGRYFLKSSPSTENMHFPSSISSQTRQSCISTSASGLDTSALSVQGNFDLNSKSKLQENFCTRSIQIPANRSKTAMSKCPIFPMARSISTSGPLDKEDTGRQKLISTGSLPATLQGATDSLGLEWHLPSPDPVTVPYLSPLVVWKELESLLENEGDHAITVADFVDHHPIVFWNLVWYFRRLDLPSNLPGLILSSEHCNKYSKIPRHCMSEDSKYVLIQMLWDNMKLHQDPGQPLYILWNAHTQKYPMVHLLQKSDNSFNQELLKSMVKSIKMNDVYGPMSQILETLNKCPHFKRQRSLYREILFLSLVALGRENIDIDAFDKEYKMAYDRLTPSQVKSTHNCDRPPSTGVMECRKTFGEPYL

SEQ ID NO: 4259 - protein, 1906 aa, Homo sapiens
MIEDKGPRVADYFVVAGLTDVSKPLEEEIHFNDACHKVAKPKEPITDVSVIIKSLGEEVPQDYICIDVTPTGLSADLNNGSLVGPQIYLCYRRGRDKPPLTDLGVLYDWKERLKQGCEIIQSTPYGRPANISGSTSSQRIYITYRRASENMTQNTLAVTDICIIIPSKGESPPHTFCKVDKNLNNSMWGSAVYLCYKKSVAKTNTVSYKAGLICRYPQEDYESFSLPESVPLFCLPMGATIECWPSNSKYPLPVFSTFVLTGASAEKVYGAAIQFYEPYSEENLTEKQRLLLGLTSADGKSDSSKTIHTNKCICLLSHWPFFDAFRKFLTFLYRYSISGPHVLPIEKHISHFMHKVPFPSPQRPRILVQLSPHDNLILSQPVSSPLPLSGGKFSTLLQNLGPENAVTLLVFAVTEHKILIHSLRPSVLTSVTEALVSMIFPFHWPCPYVPLCPLALADVLSAPCPFIVGIDSRYFDLYDPPPDVSCVDVDTNTISQIGDKKNVAWKILPKKPCKNLMNTLNNLHQQLAKLQQRPRDDGLMDLAINDYDFNSGKRLHMIDLEIQEAFLFFMASILKGYRSYLRPITQAPSETATDAASLFALQAFLRSRDRSHQKFYNMMTKTQMFIRFIEECSFVSDKDASLAFFDDCVDKVDMDKSGEVRLIELDESFKSEHTVFVTPPEIPHLPNGEEPPLQYSYNGFPVLRNNLFERPEGFLQAKKNKLPSKSSSPNSPLPMFRRTKQEIKSAHKIAKRYSSIPQMWSRCLLRHCYGLWFICLPAYVKVCHSKVRALKTAYDVLKKMQSKKMDPPDEVCYRILMQLCGQYDQPVLAVRVLFEMQKAGIDPNAITYGYYNKAVLESTWPSRSRSGYFLWTKVRNVVLGVTQFKRALKKHAHLSQTTLSDGSDLDAVSHGSMDSGHGTHTVEQAPFNTGLIKVYATDDRSSTGGQSDLGYNSLSKDEVRRGDTSTEDIQEEKDKKGSDCSSLSESESTKGSADCLPKLSYQNSSSIVRLTGTSNNSAGKISGESMESTPELLLISSLEDTNETRNIQSRCFRKRHKSDNETNLQQQVVWGNRNRNLSGGVLMGFMLNRINQEATPGDIVEKLGADAKILSNVISKSTRPNTLDIGKPPLRSKRDSLEKESSDDDTPFDGSNYLADKVDSPVIFDLEDLDSETDVSKAGCVATQNPKRIQRMNSSFSVKPFEKTDVATGFDPLSLLVAETEQQQKEEEEEDEDDSKSISTPSARRDLAEEIVMYMNNMSSPLTSRTPSIDLQRACDDKLNKKSPPLVKACRRSSLPPNSPKPVRLTKSKSYTKSEEKPRDRLWSSPAFSPTCPFREESQDTLTHSSPSFNLDTLLVPKLDVLRNSMFTAGKGVAEKASKWYSRFTMYTTSSKDQSSDRTSLSSVGAQDSESTSLTDEDVCHELEGPISSQETSATSGTKRIDLSRISLESSASLEGSLSKFALPGKSEVTSSFNASNTNIFQNYAMEVLISSCSRCRTCDCLVHDEEIMAGWTADDSNLNTTCPFCGNIFLPFLNIEIRDLRRPGRYFLKSSPSTENMHFPSSISSQTRQSCISTSASGLDTSALSVQGNFDLNSKSKLQENFCTRSIQIPANRSKTAMSKCPIFPMARSISTSGPLDKEDTGRQKLISTGSLPATLQGATDSLGLEWHLPSPDPVTVPYLSPLVVWKELESLLENEGDHAITVADFVDHHPIVFWNLVWYFRRLDLPSNLPGLILSSEHCNKYSKIPRHCMSEDSKYVLIQMLWDNMKLHQDPGQPLYILWNAHTQKYPMVHLLQKSDNSFNQELLKSMVKSIKMNDVYGPMSQILETLNKCPHFKRQRSLYREILFLSLVALGRENIDIDAFDKEYKMAYDRLTPSQVKSTHNCDRPPSTGVMECRKTFGEPYL

SEQ ID NO: 4260 - protein, 33 aa, Homo sapiens
IIKYLLLYSFLCVLIKCQDSFKIYCFPCYPFYN

SEQ ID NO: 4261 - protein, 329 aa, Homo sapiens
MGATGDAEQPRGPSGAERGGLELGDAGAAGQLVLTNPWNIMIKHRQVQRRGRRSQMTTSFTDPAISMDLLRAVLQPSINEEIQTVFNKYMKFFQKAALNVRDNVGEEVDAEQLIQEACRSCLEQAKLLFSDGEKVIPRLTHELPGIKRGRQAEEECAHRGSPLPKKRKGRPPGHILSSDRAAAGMVWKPKSCEPIRREGPKWDPARLNESTTFVLGSRANKALGMGGTRGRIYIKHPHLFKYAADPQDKHWLAEQHHMRATGGKMAYLLIEEDIRDLAASDDYRGCLDLKLEELKSFVLPSWMVEKMRKYMETLRTENEHRAVEAPPQT

SEQ ID NO: 4262 - protein, 756 aa, Homo sapiens
MVVTRSARAKASIQAASAESSGQKSFAANGIQAHPESSTGSDARTTAESQTTGKQSLIPRTPKARKRKSRTTGSLPKGTEPSTDGETSEAESNYSVSEHHDTILRVTRRRQILIACSPVSSVRKKPKVTPTKESYTEEIVSEAESHVSGISRIVLPTEKTTGARRSKAKSLTDPSQESHTEAISDAETSSSDISFSGIATRRTRSMQRKLKAQTEKKDSKIVPGNEKQIVGTPVNSEDSDTRQTSHLQARSLSEINKPNFYNNDFDDDFSHRSSENILTVHEQANVESLKETKQNCKDLDEDANGITDEGKEINEKSSQLKNLSELQDTSLQQLVSQRHSTPQNKNAVSVHSNLNSEAVMKSLTQTFATVEVGRWNNNKKSPIKASDLTKFGDCGGSDDEEESTVISVSEDMNSEGNVDFECDTKLYTSAPNTSQGKDNSVLLVLSSDESQQSENSENEEDTLCFVENSGQRESLSGDTGSLSCDNALFVIDTTPGMSADKNFYLEEEDKASEVAIEEEKEEEEDEKSEEDSSDHDENEDEFSDEEDFLNSTKAKLLKLTSSSIDPGLSIKQLGGLYINFNADKLQSNKRTLTQIKEKKKNELLQKAVITPDFEKNHCVPPYSESKYQLQKKRRKERQKTAGDGWFGMKAPEMTNELKNDLKALKMRASMDPKRFYKKNDRDGFPKYFQIGTIVDNPADFYHSRIPKKQRKRTIVEELLADSEFRRYNRRKYSEIMAEKAANAAGKKFRKKKKFRN

SEQ ID NO: 4263 - protein, 339 aa, Homo sapiens
MLPSAVAAHAGAYWDVVASSALLNLPAAPGFGNLGKSFLIENLLRVGGAPTPRLQPPAPHDPATALATAGAQLRPLPASPVPLKLCPAAEQVSPAGAPYGTRWAFQVLSPSADSARLPGRAPGDRDCTFQPSAPAPSKPFLLSTPPFYSACCGGSCRRPASSTAFPREESMLPLLTQDSNSKARRGILRRAVFSEDQRKALEKMFQKQKYISKTDRKKLAINLGLKESQVKIWFQNRRMKWRNSKEKEVLSNRCIQEVGLQEDPLSRSALGFPSPCPSIWDVPQQHSSPRWRENSPEPSERLIQESSGAPPPEANSLQGALYLCSEEEAGSKGVLTGAV

SEQ ID NO: 4264 - protein, 377 aa, Homo sapiens
MQHYGVNGYSLHAMNSLSAMYNLHQQAAQQAQHAPDYRPSVHALTLAERLADIILEARYGSQHRKQRRSRTAFTAQQLEALEKTFQKTHYPDVVMRERLAMCTNLPEARVQVWFKNRRAKFRKKQRSLQKEQLQKQKEAEGSHGEGKAEAPTPDTQLDTEQPPRLPGSDPPAELHLSLSEQSASESAPEDQPDREEDPRAGAEDPKAEKSPGADSKGLGCKRGSPKADSPGSLTITPVAPGGGLLGPSHSYSSSPLSLFRLQEQFRQHMAATNNLVHYSSFEVGGPAPAAAAAAAAVPYLGVNMAPLGSLHCQSYYQSLSAAAAAHQGVWGSPLLPAPPAGLAPASATLNSKTTSIENLRLRAKQHAASLGLDTLPN

SEQ ID NO: 4265 - protein, 382 aa, Homo sapiens
MQHYGVNGYSLHAMNSLSAMYNLHQQAAQQAQHAPDYRPSVHALTLAERLAGCTFQDIILEARYGSQHRKQRRSRTAFTAQQLEALEKTFQKTHYPDVVMRERLAMCTNLPEARVQVWFKNRRAKFRKKQRSLQKEQLQKQKEAEGSHGEGKAEAPTPDTQLDTEQPPRLPGSDPPAELHLSLSEQSASESAPEDQPDREEDPRAGAEDPKAEKSPGADSKGLGCKRGSPKADSPGSLTITPVAPGGGLLGPSHSYSSSPLSLFRLQEQFRQHMAATNNLVHYSSFEVGGPAPAAAAAAAAVPYLGVNMAPLGSLHCQSYYQSLSAAAAAHQGVWGSPLLPAPPAGLAPASATLNSKTTSIENLRLRAKQHAASLGLDTLPN

SEQ ID NO: 4266 - protein, 476 aa, Homo sapiens
METPGASASSLLLPAASRPPRKREAGEAGAATSKQRVLDEEEYIEGLQTVIQRDFFPDVEKLQAQKEYLEAEENGDLERMRQIAIKFGSALGKMSREPPPPYVTPATFETPEVHAGTGVVGNKPRPRGRGLEDGEAGEEEEKEPLPSLDVFLSRYTSEDNASFQEIMEVAKERSRARHAWLYQAEEEFEKRQKDNLELPSAEHQAIESSQASVETWKYKAKNSLMYYPEGVPDEEQLFKKPRQVVHKNTRFLRDPFSQALSRCQLQQAAALNAQHKQGKVGPDGKELIPQESPRVGGFGFVATPSPAPGVNESPMMTWGEVENTPLRVEGSETPYVDRTPGPAFKILEPGRRERLGLKMANEAAAKNRAKKQEALRRVTENLASLTPKGLSPAMSPALQRLVSRTASKYTDRALRASYTPSPARSTHLKTPASGLQTPTSTPAPGSATRTPLTQDPASITDNLLQLPARRKASDFF

SEQ ID NO: 4267 - protein, 248 aa, Homo sapiens
  MOD_RES (1)..(1): Any amino acid
XCSTWSFLAPLPQQFHLKILFLPLTPLRLLLLSAQVLIVVPFREAALRVVQLFISLLEGDSKKKIIVSNKKRFQGEYGSDPEERPPNLKRPEDYEAVFVGNIDDHFRIGVAILQRSIRLYAPFYSSDILIASPLGLRTIIGGEGEKKRDFDFLSSIELLIIDQADIYLMQNWEHVLHLMNHMNLLPLDSHGVDFSRVRMWSLNNWSKYYRQTLLFGALQDAQINSVFNKYCVNMQGQVGSRLVSSVSS

SEQ ID NO: 4268 - protein, 756 aa, Homo sapiens
MGKRGSRSQSQLLNTLTKKQKKHLRDFGEEHPFYDRVSRKEAKPQICQLSESSDSSDSESDSESEPQQVSGYHRLLATLKNVSEEEEEDEEEEEEEDSIVDDAEMNDEDGGSDVSVEEEMAAESTESPENVALSADPEGKEDGEEPPGTSQTSPEEFTDAKHESLFSLETNFLEEESGDNSSLKASQDPFLQHVNKELKEKAIQAVATNPKTTHELKWPILGQLFFSSKFQKLETFKPPKDIDLKSLHLQKPLESTWTKTNSQFLSGPQKSSSPFTPLQKELFLIMNSYRDLFYPERTALKNGEEIRHVYCLHVINHILKANAQVLGNNSRRRSQKFGVGDDDDFRDQGLTRPKVLIVVPFREAALRVVQLFISLLEGDSKKKIIVSNKKRFQGEYGSDPEERPPNLKRPEDYEAVFVGNIDDHFRIGVAILQRSIRLYAPFYSSDILIASPLGLRTIIGGEGEKKRDFDFLSSIELLIIDQADIYLMQNWEHVLHLMNHMNLLPLDSHGVDFSRVRMWSLNNWSKYYRQTLLFGALQDAQINSVFNKYCVNMQGQVAVRNVPMTGSISHVLVQLPHVFQRMEAENLASVIDARFNFFVNKILPQYRDAVMSHTLIYIPSYFDFVRLRNYFKKEELNFTHICEYTQKSGVSRARHFFLQGEKQFLLFTERFHFYKRYTIKGIRNLIFYELPTYPHFYSEICNMLRATNRGEEATWTCTVLYSKYDAQRLAAVVGVERAAQMLQSNKNVHLFITGEK

SEQ ID NO: 4269 - protein, 313 aa, Homo sapiens
MPKVKSGAIGRRRGRQEQRRELKSAGGLMFNTGIGQHILKNPLIINSIIDKAALRPTDVVLEVGPGTGNMTVKLLEKAKKVVACELDPRLVAELHKRVQGTPVASKLQVLVGDVLKTDLPFFDTCVANLPYQISSPFVFKLLLHRPFFRCAILMFQREFALRLVAKPGDKLYCRLSINTQLLARVDHLMKVGKNNFRPPPKVESSVVRIEPKNPPPPINFQEWDGLVRITFVRKNKTLSAAFKSSAVQQLLEKNYRIHCSVHNIIIPEDFSIADKIQQILTSTGFSDKRARSMDIDDFIRLLHGFNAEGIHFS

SEQ ID NO: 4270 - protein, 1572 aa, Homo sapiens
MADRGCPLEAAPLPAEVRESLAELELELSEGDITQKGYEKKRAKLLARYIPLIQGIDPSLQAENRIPGPSQTTAAAPKQQKSRPTASRDERFRSDVHTEAVQAALAKYKERKMPMPSKRRSVLVHSSVETYTPPDTSSASEDEGSLRRPGRLTSTPLQSHSSVEPWLDRVIQGSSTSSSASSTSSHPGGRPTTAPSAAATPGAAATTALAGLEAHTHIADLHSAPPDVTTGLVEHSYFERPQVASVRSVPRGCSGSMLETADGVPVNSRVSSKIQQLLNTLKRPKRPPLKEFFVDDFEELLEVQQPDPNQPKPEGSETSVLRGEPLTAGVPRPPSLLATLQRWGTTQPKSPCLTALDTTGKAVYTLTYGKLWSRSLKLAYTLLNKLTSKNEPLLKPGDRVALVFPNSDPVMFMVAFYGCLLAELVPVPIEVPLTRKDAGSQQVGFLLGSCGVFLALTTDACQKGLPKAQTGEVAAFKGWPPLSWLVIDGKHLAKPPKDWHPLAQDTGTGTAYIEYKTSKEGSTVGVTVSHASLLAQCRALTQACGYSEAETLTNVLDFKRDAGLWHGVLTSVMNRMHVVSVPYALMKANPLSWIQKVCFYKARAALVKSRDMHWSLLAQRGQRDVSLSSLRMLIVADGANPWSISSCDAFLNVFQSRGLRPEVICPCASSPEALTVAIRRPPDLGGPPPRKAVLSMNGLSYGVIRVDTEEKLSVLTVQDVGQVMPGANVCVVKLEGTPYLCKTDEVGEICVSSSATGTAYYGLLGITKNVFEAVPVTTGGAPIFDRPFTRTGLLGFIGPDNLVFIVGKLDGLMVTGVRRHNADDVVATALAVEPMKFVYRGRIAVFSVTVLHDDRIVLVAEQRPDASEEDSFQWMSRVLQAIDSIHQVGVYCLALVPANTLPKAPLGGIHISETKQRFLEGTLHPCNVLMCPHTCVTNLPKPRQKQPEVGPASMIVGNLVAGKRIAQASGRELAHLEDSDQARKFLFLADVLQWRAHTTPDHPLFLLLNAKGTVTSTATCVQLHKRAERVAAALMEKGRLSVGDHVALVYPPGVDLIAAFYGCLYCGCVPVTVRPPHPQNLGTTLPTVKMIVEVSKSACVLTTQAVTRLLRSKEAAAAVDIRTWPTILDTDDIPKKKIASVFRPPSPDVLAYLDFSVSTTGILAGVKMSHAATSALCRSIKLQCELYPSRQIAICLDPYCGLGFALWCLCSVYSGHQSVLVPPLELESNVSLWLSAVSQYKARVTFCSYSVMEMCTKGLGAQTGVLRMKGVNLSCVRTCMVVAEERPRIALTQSFSKLFKDLGLPARAVSTTFGCRVNVAICLQGTAGPDPTTVYVDMRALRHDRVRLVERGSPHSLPLMESGKILPGVKVIIAHTETKGPLGDSHLGEIWVSSPHNATGYYTVYGEEALHADHFSARLSFGDTQTIWARTGYLGFLRRTELTDASGGRHDALYVVGSLDETLELRGMRYHPIDIETSVIRAHRSIAECAVFTWTNLLVVVVELDGLEQDALDLVALVTNVVLEEHYLVVGVVVIVDPGVIPINSRGEKQRMHLRDGFLADQLDPIYVAYNM

SEQ ID NO: 4271 - protein, 797 aa, Homo sapiens
MADRGCPLEAAPLPAEVRESLAELELELSEGDITQKGYEKKRAKLLARYIPLIQGIDPSLQAENRIPGPSQTTAAAPKQQKSRPTASRDERFRSDVHTEAVQAALAKYKERKMPMPSKRRSVLVHSSVETYTPPDTSSASEDEGSLRRPGRLTSTPLQSHSSVEPWLDRVIQGSSTSSSASSTSSHPGGRPTTAPSAAATPGAAATTALAGLEAHTHIGVPVNSRVSSKIQQLLNTLKRPKRPPLKEFFVDDFEELLEVQQPDPNQPKPEGSETSVLRGEPLTAGVPRPPSLLATLQRWGTTQPKSPCLTALDTTGKAVYTLTYGKLWSRSLKLAYTLLNKLTSKNEPLLKPGDRVALVFPNSDPVMFMVAFYGCLLAELVPVPIEVPLTRKDAGSQQVGFLLGSCGVFLALTTDACQKGLPKAQTGEVAAFKGWPPLSWLVIDGKHLAKPPKDWHPLAQDTGTGTAYIEYKTSKEGSTVGVTVSHASLLAQCRALTQACGYSEAETLTNVLDFKRDAGLWHGVLTSVMNRMHVVSVPYALMKANPLSWIQKVCFYKARAALVKSRDMHWSLLAQRGQRDVSLSSLRMLIVADGANPWSISSCDAFLNVFQSRGLRPEVICPCASSPEALTVAIRRPPDLGGPPPRKAVLSMNGLSYGVIRVDTEEKLSVLTVQDVGQVMPGANVCVVKLEGTPYLCKTDEVGEICVSSSATGTAYYGLLGITKNVFEAVPVTTGGAPIFDRPFTRTGLLGFIGPDNLVFIVGKLDGLMVTGVRRHNADDVVATALAVEPMKFVYRG

SEQ ID NO: 4272 - protein, 1567 aa, Homo sapiens
MADRGCPLEAAPLPAEVRESLAELELELSEGDITQKGYEKKRAKLLARYIPLIQGIDPSLQAENRIPGPSQTTAAAPKQQKSRPTASRDERFRSDVHTEAVQAALAKYKERKMPMPSKRRSVLVHSSVETYTPPDTSSASEDEGSLRRPGRLTSTPLQSHSSVEPWLDRVIQGSSTSSSASSTSSHPGGRPTTAPSAAATPGAAATTALAGLEAHTHIDLHSAPPDVTTGLVEHSYFERPQVASVRSVPRGCSGSMLETADGVPVNSRVSSKIQQLLNTLKRPKRPPLKEFFVDDFEELLEDPNQPKPEGSETSVLRGEPLTAGVPRPPSLLATLQRWGTTQPKSPCLTALDTTGKAVYTLTYGKLWSRSLKLAYTLLNKLTSKNEPLLKPGDRVALVFPNSDPVMFMVAFYGCLLAELVPVPIEVPLTRKDAGSQQVGFLLGSCGVFLALTTDACQKGLPKAQTGEVAAFKGWPPLSWLVIDGKHLAKPPKDWHPLAQDTGTGTAYIEYKTSKEGSTVGVTVSHASLLAQCRALTQACGYSEAETLTNVLDFKRDAGLWHGVLTSVMNRMHVVSVPYALMKANPLSWIQKVCFYKARAALVKSRDMHWSLLAQRGQRDVSLSSLRMLIVADGANPWSISSCDAFLNVFQSRGLRPEVICPCASSPEALTVAIRRPPDLGGPPPRKAVLSMNGLSYGVIRVDTEEKLSVLTVQDVGQVMPGANVCVVKLEGTPYLCKTDEVGEICVSSSATGTAYYGLLGITKNVFEAVPVTTGGAPIFDRPFTRTGLLGFIGPDNLVFIVGKLDGLMVTGVRRHNADDVVATALAVEPMKFVYRGRIAVFSVTVLHDDRIVLVAEQRPDASEEDSFQWMSRVLQAIDSIHQVGVYCLALVPANTLPKAPLGGIHISETKQRFLEGTLHPCNVLMCPHTCVTNLPKPRQKQPEVGPASMIVGNLVAGKRIAQASGRELAHLEDSDQARKFLFLADVLQWRAHTTPDHPLFLLLNAKGTVTSTATCVQLHKRAERVAAALMEKGRLSVGDHVALVYPPGVDLIAAFYGCLYCGCVPVTVRPPHPQNLGTTLPTVKMIVEVSKSACVLTTQAVTRLLRSKEAAAAVDIRTWPTILDTDDIPKKKIASVFRPPSPDVLAYLDFSVSTTGILAGVKMSHAATSALCRSIKLQCELYPSRQIAICLDPYCGLGFALWCLCSVYSGHQSVLVPPLELESNVSLWLSAVSQYKARVTFCSYSVMEMCTKGLGAQTGVLRMKGVNLSCVRTCMVVAEERPRIALTQSFSKLFKDLGLPARAVSTTFGCRVNVAICLQGTAGPDPTTVYVDMRALRHDRVRLVERGSPHSLPLMESGKILPGVKVIIAHTETKGPLGDSHLGEIWVSSPHNATGYYTVYGEEALHADHFSARLSFGDTQTIWARTGYLGFLRRTELTDASGGRHDALYVVGSLDETLELRGMRYHPIDIETSVIRAHRSIAECAVFTWTNLLVVVVELDGLEQDALDLVALVTNVVLEEHYLVVGVVVIVDPGVIPINSRGEKQRMHLRDGFLADQLDPIYVAYNM

SEQ ID NO: 4273 - protein, 1571 aa, Homo sapiens
MADRGCPLEAAPLPAEVRESLAELELELSEGDITQKGYEKKRAKLLARYIPLIQGIDPSLQAENRIPGPSQTTAAAPKQQKSRPTASRDERFRSDVHTEAVQAALAKYKERKMPMPSKRRSVLVHSSVETYTPPDTSSASEDEGSLRRPGRLTSTPLQSHSSVEPWLDRVIQGSSTSSSASSTSSHPGGRPTTAPSAAATPGAAATTALAGLEAHTHIDLHSAPPDVTTGLVEHSYFERPQVASVRSVPRGCSGSMLETADGVPVNSRVSSKIQQLLNTLKRPKRPPLKEFFVDDFEELLEVQQPDPNQPKPEGSETSVLRGEPLTAGVPRPPSLLATLQRWGTTQPKSPCLTALDTTGKAVYTLTYGKLWSRSLKLAYTLLNKLTSKNEPLLKPGDRVALVFPNSDPVMFMVAFYGCLLAELVPVPIEVPLTRKDAGSQQVGFLLGSCGVFLALTTDACQKGLPKAQTGEVAAFKGWPPLSWLVIDGKHLAKPPKDWHPLAQDTGTGTAYIEYKTSKEGSTVGVTVSHASLLAQCRALTQACGYSEAETLTNVLDFKRDAGLWHGVLTSVMNRMHVVSVPYALMKANPLSWIQKVCFYKARAALVKSRDMHWSLLAQRGQRDVSLSSLRMLIVADGANPWSISSCDAFLNVFQSRGLRPEVICPCASSPEALTVAIRRPPDLGGPPPRKAVLSMNGLSYGVIRVDTEEKLSVLTVQDVGQVMPGANVCVVKLEGTPYLCKTDEVGEICVSSSATGTAYYGLLGITKNVFEAVPVTTGGAPIFDRPFTRTGLLGFIGPDNLVFIVGKLDGLMVTGVRRHNADDVVATALAVEPMKFVYRGRIAVFSVTVLHDDRIVLVAEQRPDASEEDSFQWMSRVLQAIDSIHQVGVYCLALVPANTLPKAPLGGIHISETKQRFLEGTLHPCNVLMCPHTCVTNLPKPRQKQPEVGPASMIVGNLVAGKRIAQASGRELAHLEDSDQARKFLFLADVLQWRAHTTPDHPLFLLLNAKGTVTSTATCVQLHKRAERVAAALMEKGRLSVGDHVALVYPPGVDLIAAFYGCLYCGCVPVTVRPPHPQNLGTTLPTVKMIVEVSKSACVLTTQAVTRLLRSKEAAAAVDIRTWPTILDTDDIPKKKIASVFRPPSPDVLAYLDFSVSTTGILAGVKMSHAATSALCRSIKLQCELYPSRQIAICLDPYCGLGFALWCLCSVYSGHQSVLVPPLELESNVSLWLSAVSQYKARVTFCSYSVMEMCTKGLGAQTGVLRMKGVNLSCVRTCMVVAEERPRIALTQSFSKLFKDLGLPARAVSTTFGCRVNVAICLQGTAGPDPTTVYVDMRALRHDRVRLVERGSPHSLPLMESGKILPGVKVIIAHTETKGPLGDSHLGEIWVSSPHNATGYYTVYGEEALHADHFSARLSFGDTQTIWARTGYLGFLRRTELTDASGGRHDALYVVGSLDETLELRGMRYHPIDIETSVIRAHRSIAECAVFTWTNLLVVVVELDGLEQDALDLVALVTNVVLEEHYLVVGVVVIVDPGVIPINSRGEKQRMHLRDGFLADQLDPIYVAYNM

SEQ ID NO: 4274 - protein, 1110 aa, Homo sapiens
MADRGCPLEAAPLPAEVRESLAELELELSEDVHTEAVQAALAKYKERKMPMPSKRRSVLVHSSVETYTPPDTSSASEDEGSLRRPGRLTSTPLQSHSSVEPWLDRVIQGSSTSSSASSTSSHPGGRPTTAPSAAATPGAAATTALAGLEAHTHIDLHSAPPDVTTGLVEHSYFERPQVASVRSVPRGCSGSMLETADGVPVNSRVSSKIQQLLNTLKRPKRPPLKEFFVDDFEELLEVQQPDPNQPKPEGSETSVLRGEPLTAGVPRPPSLLATLQRWGTTQPKSPCLTALDTTGKAVYTLTYGKLWSRSLKLAYTLLNKLTSKNEPLLKPGDRVALVFPNSDPVMFMVAFYGCLLAELVPVPIEVPLTRKDAGSQQVGFLLGSCGVFLALTTDACQKGLPKAQTGEVAAFKGWPPLSWLVIDGKHLAKPPKDWHPLAQDTGTGTAYIEYKTSKEGSTVGVTVSHASLLAQCRALTQACGYSEAETLTNVLDFKRDAGLWHGVLTSVMNRMHVVSVPYALMKANPLSWIQKVCFYKARAALVKSRDMHWSLLAQRGQRDVSLSSLRMLIVADGANPWSISSCDAFLNVFQSRGLRPEVICPCASSPEALTVAIRRPPDLGGPPPRKAVLSMNGLSYGVIRVDTEEKLSVLTVQDVGQVMPGANVCVVKLEGTPYLCKTDEVGEICVSSSATGTAYYGLLGITKNVFEAVPVTTGGAPIFDRPFTRTGLLGFIGPDNLVFIVGKLDGLMVTGVRRHNADDVVATALAVEPMKFVYRGRIAVFSVTVLHDDRIVLVAEQRPDASEEDSFQWMSRVLQAIDSIHQVGVYCLALVPANTLPKAPLGGIHISETKQRFLEGTLHPCNVLMCPHTCVTNLPKPRQKQPEVGPASMIVGNLVAGKRIAQASGRELAHLEDSDQARKFLFLADVLQWRAHTTPDHPLFLLLNAKGTVTSTATCVQLHKRAERVAAALMEKGRLSVGDHVALVYPPGVDLIAAFYGCLYCGCVPVTVRPPHPQNLGTTLPTVKMIVEVSKSACVLTTQAVTRLLRSKEAAAAVDIRTWPTILDTDDIPKKKIASVFRPPSPDVLAYLDFSVSTTGILAGVKAGRGGSRL

SEQ ID NO: 4275 - protein, 841 aa, Homo sapiens
MADRGCPLEAAPLPAEVRESLAELELELSEGDITQKGYEKKRAKLLARYIPLIQGIDPSLQAENRIPGPSQTTAAAPKQQKSRPTASRDERFRSDVHTEAVQAALAKYKERKMPMPSKRRSVLVHSSVETYTPPDTSSASEDEGSLRRPGRLTSTPLQSHSSVEPWLDRVIQGSSTSSSASSTSSHPGGRPTTAPSAAATPGAAATTALAGLEAHTHIDLHSAPPDVTTGLVEHSYFERPQVASVRSVPRGCSGSMLETADGVPVNSRVSSKIQQLLNTLKRPKRPPLKEFFVDDFEELLEVQQPDPNQPKPEGSETSVLRGEPLTAGVPRPPSLLATLQRWGTTQPKSPCLTALDTTGKAVYTLTYGKLWSRSLKLAYTLLNKLTSKNEPLLKPGDRVALVFPNSDPVMFMVAFYGCLLAELVPVPIEVPLTRKDAGSQQVGFLLGSCGVFLALTTDACQKGLPKAQTGEVAAFKGWPPLSWLVIDGKHLAKPPKDWHPLAQDTGTGTAYIEYKTSKEGSTVGVTVSHASLLAQCRALTQACGYSEAETLTNVLDFKRDAGLWHGVLTSVMNRMHVVSVPYALMKANPLSWIQKVCFYKARAALVKSRDMHWSLLAQRGQRDVSLSSLRMLIVADGANPWSISSCDAFLNVFQSRGLRPEVICPCASSPEALTVAIRRPPDLGGPPPRKAVLSMNGLSYGVIRVDTEEKLSVLTVQDVGQVMPGANVCVVKLEGTPYLCKTDEVGEICVSSSATGTAYYGLLGITKNVFEAVPVTTGGAPIFDRPFTRTGLLGFIGPDNLVFIVGKLDGLMVTGVRRHNADDVVATALAVEPMKFVYRGR

SEQ ID NO: 4276 - protein, 889 aa, Homo sapiens
MADRGCPLEAAPLPAEVRESLAELELELSEGDITQKGYEKKRAKLLARYIPLIQGIDPSLQAENRIPGPSQTTAAAPKQQKSRPTASRDERFRSDVHTEAVQAALAKYKERKMPMPSKRRSVLVHSSVETYTPPDTSSASEDEGSLRRPGRLTSTPLQSHSSVEPWLDRVIQGSSTSSSASSTSSHPGGRPTTAPSAAATPGAAATTALAGLEAHTHIDLHSAPPDVTTGLVEHSYFERPQVASVRSVPRGCSGSMLETADGVPVNSRVSSKIQQLLNTLKRPKRPPLKEFFVDDFEELLEVQQPDPNQPKPEGSETSVLRGEPLTAGVPRPPSLLATLQRWGTTQPKSPCLTALDTTGKAVYTLTYGKLWSRSLKLAYTLLNKLTSKNEPLLKPGDRVALVFPNSDPVMFMVAFYGCLLAELVPVPIEVPLTRKDAGSQQVGFLLGSCGVFLALTTDACQKGLPKAQTGEVAAFKGWPPLSWLVIDGKHLAKPPKDWHPLAQDTGTGTAYIEYKTSKEGSTVGVTVSHASLLAQCRALTQACGYSEAETLTNVLDFKRDAGLWHGVLTSVMNRMHVVSVPYALMKANPLSWIQKVCFYKARAALVKSRDMHWSLLAQRGQRDVSLSSLRMLIVADGANPWSISSCDAFLNVFQSRGLRPEVICPCASSPEALTVAIRRPPDLGGPPPRKAVLSMNGLSYGVIRVDTEEKLSVLTVQDVGQVMPGANVCVVKLEGTPYLCKTDEVGEICVSSSATGTAYYGLLGITKNVFEAVPVTTGGAPIFDRPFTRTGLLGFIGPDNLVFIVGKLDGLMVTGVRRHNADDVVATALAVEPMKFVYRGRIAVFSVTVLHDDRIVLVAEQRPDASEEDSFQWMSRVLQVGAPARPMVR

SEQ ID NO: 4277 - protein, 798 aa, Homo sapiens
MADRGCPLEAAPLPAEVRESLAELELELSEGDITQKGYEKKRAKLLARYIPLIQGIDPSLQAENRIPGPSQTTAAAPKQQKSRPTASRDERFRSDVHTEAVQAALAKYKERKMPMPSKRRSVLVHSSVETYTPPDTSSASEDEGSLRRPGRLTSTPLQSHSSVEPWLDRVIQGSSTSSSASSTSSHPGGRPTTAPSAAATPGAAATTALAGLEAHTHIGVPVNSRVSSKIQQLLNTLKRPKRPPLKEFFVDDFEELLEVQQPDPNQPKPEGSETSVLRGEPLTAGVPRPPSLLATLQRWGTTQPKSPCLTALDTTGKAVYTLTYGKLWSRSLKLAYTLLNKLTSKNEPLLKPGDRVALVFPNSDPVMFMVAFYGCLLAELVPVPIEVPLTRKDAGSQQVGFLLGSCGVFLALTTDACQKGLPKAQTGEVAAFKGWPPLSWLVIDGKHLAKPPKDWHPLAQDTGTGTAYIEYKTSKEGSTVGVTVSHASLLAQCRALTQACGYSEAETLTNVLDFKRDAGLWHGVLTSVMNRMHVVSVPYALMKANPLSWIQKVCFYKARAALVKSRDMHWSLLAQRGQRDVSLSSLRMLIVADGANPWSISSCDAFLNVFQSRGLRPEVICPCASSPEALTVAIRRPPDLGGPPPRKAVLSMNGLSYGVIRVDTEEKLSVLTVQDVGQVMPGANVCVVKLEGTPYLCKTDEVGEICVSSSATGTAYYGLLGITKNVFEAVPVTTGGAPIFDRPFTRTGLLGFIGPDNLVFIVGKLDGLMVTGVRRHNADDVVATALAVEPMKFVYRGR

SEQ ID NO: 4278 - protein, 504 aa, Homo sapiens
MERSQCGSRDRGVSGRPHLAPGLVVAAPPPPSPALPVPSGMQVPPAFLRPPSLFLRAAAAAAAAAAATSGSGGCPPAPGLESGVGAVGCGYPRTPKCARCRNHGVVSALKGHKRFCRWRDCACAKCTLIAERQRVMAAQVALRRQQAQEESEARGLQRLLCSGLSWPPGGRASGGGGRAENPQSTGGPAAGAALGLGALRQASGSATPAFEVFQQDYPEEKQEQKESKCESCQNGQEELISKSHQLYLGSSSRSNGVIGKQSIGSSISEYSNKPDSILSPHPGEQSGGEESPRSLSSSDLESGNESEWVKDLTATKASLPTVSSRPRDPLDILTKIFPNYRRSRLEGILRFCKGDVVQAIEQVLNGKEHKPDNRNLANSEELENTAFQRASSFSLAGIGFGTLGNKSAFSPLQTTSASYGGDSSLYGVNPRVGISPLRLAYSSAGRGLSGFMSPYLTPGLVPTLPFRPALDYAFSGMIRDSSYLSSKDSITCGRLYFRPNQDNP

SEQ ID NO: 4279 - protein, 542 aa, Homo sapiens
MELRSELPSVPGAATAAAATATGPPVASVASVAAAAAAAASLPVSVAGGLLRGPPLLLRAAEKYPRTPKCARCRNHGVVSALKGHKRYCRWKDCLCAKCTLIAERQRVMAAQVALRRQQAQEENEARELQLLYGTAEGLALAAANGIIPPRPAYEVFGSVCAADGGGPGAGAPAGTGGGAAGAGGSEAKLQKFDLFPKTLLQAGRPGSPLPPPVKPLSPDGADSGPGTSSPEVRPGSGSENGDGESFSGSPLARASKEAGGSCPGSAGPGGGGEEDSPGSASPLGSESGSEADKEEGEAAPAPGLGGGSGPRQRTPLDILTRVFPGHRRGVLELVLQGCGGDVVQAIEQVLNHHRGGLAAGLGPAAPPDKAAVGAAAAADDAWPSRVDAAAAAAAAAGGPGLPAPLQAGPAAPPHHRPLLAGAMAPGALGSLSSRSAFSPLQPNASHFGADAGAYPLGAPLGLSPLRLAYSAAAAHSRGLAFMAPYSTAGLVPTLGFRPPMDYAFSDLMRDRSAAAAAAVHKEPTYGGGLYGPMVNGAPEKQ

SEQ ID NO: 4280 - protein, 542 aa, Homo sapiens; identical to SEQ ID NO: 4279

SEQ ID NO: 4281 - protein, 342 aa, Homo sapiens
MADKMVRTPKCSRCRNHGFLVPVKGHAGKCRWKQCLCEKCYLISERQKIMAAQKVLKTQAAEEEQEAALCAQGPKQASGAAAAAPAPVPVPAASLRPLSPGTPSGDADPGPEGRAAACFFEQPPRGRNPGPRALQPVLGGRSHVEPSERAAVAMPSLAGPPFGAEAAGSGYPGPLDLRRPMRTVPGPLFTDFVRPLNINPDRALGPEYPGGSSMHPYCPFPLGYLDAPPGVPLQQGFRHVSRSQYQGGGLVSEPGGDFQPSYYLPPPPPPLPPLPPLPPQPQFLPPGYLSALHFLPPPPPPPPPSSFSLTVLFDTDKENTDDQDAEVLSGEPSQPSSQEQSD

SEQ ID NO: 4282 - protein, 143 aa, Homo sapiens
MPSLAGPPFGAEAAGSGYPGPLDLRRPMRTVPGPLFTDFVRPLNINPDRALGPEYPGGSSMHPYCPFPLGYLDAPPGVPLQQGFRHVSRSQYQGGGLVSEPGGDFQPSYYLPPPPPPLPPLPPLPPPATATTTSIIFLTDRPV

SEQ ID NO: 4283 - protein, 367 aa, Homo sapiens
MEPSDMPAGYHCPLDSAPWDETRDPQSTELIPRRAISRSPTCARCRNHGVTAHLKGHKRLCLFQACECHKCVLILERRRVMAAQVALRRQQEAQLKKHLMRRGEASPKAPNHFRKGTTQPQVPSGKENIAPQPQTPHGAVLLAPTPPGKNSCGPLLLSHPPEASPLSWTPVPPGPWVPGHWLPPGFSMPPPVVCRLLYQEPAVSLPPFPGFDPGTSLQLPTHGPFTTCPGSHPVLTAPLSGEPQGPPSQPRTHSTLILQPCGTPDPLQLQPQASGASCLARTSGPSEWQLQQEAAEALVGLKDSSQAPRVTPSVPPNPAWISLLHPCGPPAPAGGRGFQPVGPCLRPSPAPSVALHIGRLGSISLLS

SEQ ID NO: 4284 - protein, 467 aa, Homo sapiens
MATGADVRDILELGGPEGDAASGTISKKDIINPDKKKSKKSSETLTFKRPEGMHREVYALLYSDKKDAPPLLPSDTGQGYRTVKAKLGSKKVRPWKWMPFTNPARKDGAMFFHWRRAAEEGKDYPFARFNKTVQVPVYSEQEYQLYLHDDAWTKAETDHLFDLSRRFDLRFVVIHDRYDHQQFKKRSVEDLKERYYHICAKLANVRAVPGTDLKIPVFDAGHERRRKEQLERLYNRTPEQVAEEEYLLQELRKIEARKKEREKRSQDLQKLITAADTTAEQRRTERKAPKKKLPQKKEAEKPAVPETAGIKFPDFKSAGVTLRSQRMKLPSSVGQKKIKALEQMLLELGVELSPTPTEELVHMFNELRSDLVLLYELKQACANCEYELQMLRHRHEALARAGVLGGPATPASGPGPASAEPAVTEPGLGPDPKDTIIDVVGAPLTPNSRKRRESASSSSSVKKAKKP

SEQ ID NO: 4285 - protein, 467 aa, Homo sapiens; identical to SEQ ID NO: 4284

SEQ ID NO: 4286 - protein, 285 aa, Homo sapiens
MATGADVRDILELGGPEGDAASGTISKKDIINPDKKKSKKSSETLTFKRPEGMHREVYALLYSDKNKGSCLLSRMQEDLKSFAPGHDFLAIGDAPPLLPSDTGQGYRTVKAKLGSKKVRPWKWMPFTNPARKDGAMFFHWRRAAEEGKDYPFARFNKTVQVPVYSEQEYQLYLHDDAWTKAETDHLFDLSRRFDLRFVVIHDRYDHQQFKKRSVEDLKERYYHICAKLANVRAVPGTDLKIPVFDAGHERRRKEQLERLYNRTPEQVAEEEYLLQELRKIEARKK

SEQ ID NO: 4287 - protein, 467 aa, Homo sapiens; identical to SEQ ID NO: 4284

SEQ ID NO: 4288 - protein, 132 aa, Homo sapiens
IINPDKKKSKKSSETLTFKRPEGMHREVYALLYSDKKDAPPLLPSDTGQGYRTVKAKLGSKKVRPWKWMPFTNPARKDGAMFFHWRRAAEEGKDYPFARFNKEYQLYLHDDAWTKAETDHLFDLSRRFDLRF

SEQ ID NO: 4289 - protein, 151 aa, Homo sapiens
MATGADVRDILELGGPEGDAASGTISKKDIINPDKKKSKKSSETLTFKRPEGMHREVYALLYSDKNKGSCLLSRMQEDLKSFAPGHDFLAIGDAPPLLPSDTGQGYRTVKAKLGSKKVRPWKWMPFTNPARKDGAMFFHWRRAAEEGKDYP

SEQ ID NO: 4290 - protein, 285 aa, Homo sapiens; identical to SEQ ID NO: 4286

SEQ ID NO: 4291 - protein, 237 aa, Homo sapiens
MATGADVRDILELGGPEGDAASGTISKKDIINPDKKKSKKSSETLTFKRPEGMHREVYALLYSDKKDAPPLLPSDTGQGYRTVKAKLGSKKVRPWKWMPFTNPARKDGAMFFHWRRAAEEGKDYPFARFNKTVQVPVYSEQEYQLYLHDDAWTKAETDHLFDLSRRFDLRFVVIHDRYDHQQFKKRSVEDLKERYYHICAKLANVRAVPGTDLKIPVFDAGHERRRKEQLERLYNRT

SEQ ID NO: 4292 - protein, 302 aa, Homo sapiens
MATGADVRDILELGGPEGDAASGTISKKDIINPDKKKSKKSSETLTFKRPEGMHREVYALLYSDKKDAPPLLPSDTGQGYRTVKAKLGSKKVRPWKWMPFTNPARKDGAMFFHWRRAAEEGKDYPFARFNKTVQVPVYSEQEYQLYLHDDAWTKAETDHLFDLSRRFDLRFVVIHDRYDHQQFKKRSVEDLKERYYHICAKLANVRAVPGTDLKIPVFDAGHERRRKEQLERLYNRTPEQVAEEEYLLQELRKIEARKKEREKRSQDLQKLITAADTTAEQRRTERKAPKKKLPQKKEAEKP

SEQ ID NO: 4293 - protein, 253 aa, Homo sapiens
MAASGESGTSGGGGSTEEAFMTFYSEVKQIEKRDSVLTSKNQIERLTRPGSSYFNLNPFEVLQIDPEVTDEEIKKRFRQLSILVHPDKNQDDADRAQKAFEAVDKAYKLLLDQEQKKRALDVIQAGKEYVEHTVKERKKQLKKEGKPTIVEEDDPELFKQAVYKQTMKLFAELEIKRKEREAKEMHERKRQREEEIEAQEKAKREREWQKNFEESRDGRVDSWRNFQANTKGKKEKKNRTFLRPPKVKMEQRE

SEQ ID NO: 4294 - protein, 485 aa, Homo sapiens
MKGWSLPACGPLQGRLAGWLAVRAGLLAAPAAVHSPAEVHGSPPASLCPRPSVKFRPGLTAMALPTPSDSTLPAEARGRGRRRRLVWTPSQSEALRACFERNPYPGIATRERLAQAIGIPEPRVQIWFQNERSRQLRQHRRESRPWPGRRGPPEGRRKRTAVTGSQTALLLRAFEKDRFPGIAAREELARETGLPESRIQIWFQNRRARHPGQGGRAPAQAGGLCSAAPGGGHPAPSWVAFAHTGAWGTGLPAPHVPCAPGALPQGAFVSQAARAAPALQPSQAAPAEGVSQPAPARGDFAYAAPAPPDGALSHPQAPRWPPHPGKSREDRDPQRDGLPGPCAVAQPGPAQAGPQGQGVLAPPTSQGSPWWGWGRGPQVAGAAWEPQAGAAPPPQPAPPDASASARQGQMQGIPAPSQALQEPAPWSALPCGLLLDELLASPEFLQQAQPLLETEAPGELEASEEAASLEAPLSEEEYRALLEEL

SEQ ID NO: 4295 - protein, 424 aa, Homo sapiens
MALPTPSDSTLPAEARGRGRRRRLVWTPSQSEALRACFERNPYPGIATRERLAQAIGIPEPRVQIWFQNERSRQLRQHRRESRPWPGRRGPPEGRRKRTAVTGSQTALLLRAFEKDRFPGIAAREELARETGLPESRIQIWFQNRRARHPGQGGRAPAQAGGLCSAAPGGGHPAPSWVAFAHTGAWGTGLPAPHVPCAPGALPQGAFVSQAARAAPALQPSQAAPAEGVSQPAPARGDFAYAAPAPPDGALSHPQAPRWPPHPGKSREDRDPQRDGLPGPCAVAQPGPAQAGPQGQGVLAPPTSQGSPWWGWGRGPQVAGAAWEPQAGAAPPPQPAPPDASASARQGQMQGIPAPSQALQEPAPWSALPCGLLLDELLASPEFLQQAQPLLETEAPGELEASEEAASLEAPLSEEEYRALLEEL

SEQ ID NO: 4296 - protein, 485 aa, Homo sapiens; identical to SEQ ID NO: 4294

SEQ ID NO: 4297 - protein, 424 aa, Homo sapiens; identical to SEQ ID NO: 4295

SEQ ID NO: 4298 - protein, 483 aa, Homo sapiens
MKGWSLPACGPLQGRLAGWLAVRAGLLAAPAAVHSPAEVHGSPPASLCPRPSVKFRPGLTAMALPTPSDSTLPAEARGRGRRRRLVWTPSQSEALRACFERNPYPGIATRERLAQAIGIPEPRVQIWFQNERSRQLRQHRRESRPWPGRRGPPEGRRKRTAVTGSQTALLLRAFEKDRFPGIAAREELARETGLPESRIQIWFQNRRARHPGQGGRAPAQAGGLCSAAPGGGHPAPSWVAFAHTGAWGTGLPAPHVPCAPGALPQGAFVSQAARAAPALQPSQAAPAEGVSQPAPARGDFAYAAPAPPDGALSHPQAPRWPPHPGKSREDRDPQRDGLPGPCAVAQPGPAQAGPQGQGVLAPPTSQGSPWWGWGRGPQVAGAAWEPQAGEAPPPQPAPPDASARQGQMQGIPAPSQALQEPAPWSALPCGLLLDELLASPEFLQQAQPLLETEAPGELEASEEAASLEAPLSEEEYRALLEEL

SEQ ID NO: 4299 - protein, 422 aa, Homo sapiens
MALPTPSDSTLPAEARGRGRRRRLVWTPSQSEALRACFERNPYPGIATRERLAQAIGIPEPRVQIWFQNERSRQLRQHRRESRPWPGRRGPPEGRRKRTAVTGSQTALLLRAFEKDRFPGIAAREELARETGLPESRIQIWFQNRRARHPGQGGRAPAQAGGLCSAAPGGGHPAPSWVAFAHTGAWGTGLPAPHVPCAPGALPQGAFVSQAARAAPALQPSQAAPAEGVSQPAPARGDFAYAAPAPPDGALSHPQAPRWPPHPGKSREDRDPQRDGLPGPCAVAQPGPAQAGPQGQGVLAPPTSQGSPWWGWGRGPQVAGAAWEPQAGEAPPPQPAPPDASARQGQMQGIPAPSQALQEPAPWSALPCGLLLDELLASPEFLQQAQPLLETEAPGELEASEEAASLEAPLSEEEYRALLEEL

SEQ ID NO: 4300 - protein, 485 aa, Homo sapiens; identical to SEQ ID NO: 4294

SEQ ID NO: 4301 - protein, 424 aa, Homo sapiens; identical to SEQ ID NO: 4295

SEQ ID NO: 4302 - protein, 424 aa, Homo sapiens; identical to SEQ ID NO: 4295

SEQ ID NO: 4303 - protein, 485 aa, Homo sapiens; identical to SEQ ID NO: 4294

SEQ ID NO: 4304 - protein, 485 aa, Homo sapiens; identical to SEQ ID NO: 4294

SEQ ID NO: 4305 - protein, 424 aa, Homo sapiens; identical to SEQ ID NO: 4295

SEQ ID NO: 4306 - protein, 424 aa, Homo sapiens; identical to SEQ ID NO: 4295

SEQ ID NO: 4307 - protein, 472 aa, Homo sapiens
MNGYGSPYLYMGGPVSQPPRAPLQRTPKCARCRNHGVLSWLKGHKRYCRFKDCTCEKCILIIERQRVMAAQVALRRQQANESLESLIPDSLRALPGPPPPGDAVAAPQPPPASQPSQPQPPRPAAELAAAAALRWTAEPQPGALQAQLAKPDLTEERLGDGKSADNTEVFSDKDTDQRSSPDVAKSKGCFTPESPEIVSVEEGGYAVQKNGGNPESRPDSPKCHAEQNHLLIEGPSGTVSLPFSLKANRPPLEVLKKIFPNQKPTVLELILKGCGGDLVSAVEVLLSSRSSVTGAERTSAEPESLALPSNGHIFEHTLSSYPISSSKWSVGSAFRVPDTLRFSADSSNVVPSPLAGPLQPPFPQPPRYPLMLRNTLARSQSSPFLPNDVTLWNTMTLQQQYQLRSQYVSPFPSNSTSVFRSSPVLPARATEDPRISIPDDGCPFVSKQSIYTEDDYDERSDSSDSRTLNTSS

SEQ ID NO: 4308 - protein, 112 aa, Homo sapiens
MHTRKRLTQLFCFPDLTEERLGDGKSADNTEVFSDKDTDQRSSPDVAKSKGCFTPESPEIVSVEEGGYAVQKNGGNPESRPDSPKCHAEQNHLLIEGPSGTVSLPFSLKANR

SEQ ID NO: 4309 - protein, 566 aa, Homo sapiens
MALSVPGYSPGFRKPPEVVRLRRKRARSRGAAASPPRELTEPAARRAALVAGLPLRPFPAAGGRGGGSGGGPAAARRNPFARLDNRPRVAAEPPDGPAREQPEAPVPFLDSNQENDLLWEEKFPERTTVTELPQTSHVSFSEPDIPSSKSTELPVDWSIKTRLLFTSSQPFTWADHLKAQEEAQGLVQHCRATEVTLPKSIQDPKLSSELRCTFQQSLIYWLHPALSWLPLFPRIGADRKMAGKTSPWSNDATLQHVLMSDWSVSFTSLYNLLKTKLCPYFYVCTYQFTVLFRAAGLAGSDLITALISPTTRGLREAMRNEGIEFSLPLIKESGHKKETASGTSLGYGEEQAISDEDEEESFSWLEEMGVQDKIKKPDILSIKLRKEKHEVQMDHRPESVVLVKGINTFTLLNFLINSKSLVATSGPQAGLPPTLLSPVAFRGATMQMLKARSVNVKTQALSGYRDQFSLEITGPIMPHSLHSLTMLLKSSQSGSFSAVLYPHEPTAVFNICLQMDKVLDMEVVHKELTNCGLHPNTLEQLSQIPLLGKSSLRNVVLRDYIYNWRS

SEQ ID NO: 4310 - protein, 205 aa, Homo sapiens
MPSKKKKYNARFPPARIKKIMQTDEEIGKVAAAVPVIISRALELFLESLLKKACQVTQSRNAKTMTTSHLKQCIELEQQFDFLKDLVASVPDMQGDGEDNHMDGDKGARRGRKPGSGGRKNGGMGTKSKDKKLSGTDSEQEDESEDTDTDGEEETSQPPPQASHPSAHFQSPPTPFLPFASTLPLPPAPPGPSAPDEEDEEDYDS

SEQ ID NO: 4311 - protein, 249 aa, Homo sapiens
MNPSPSKIRINLEDNVQYVSMRKALKVKRPRFDVSLVYLTRKFMDLVRSAPGGILDLNKVATKLGVRKRRVYDITNVLDGIDLVEKKSKNHIRWIGSDLSNFGAVPQQKKLQEELSDLSAMEDALDELIKDCAQQLFELTDDKENERLAYVTYQDIHSIQAFHEQIVIAVKAPAETRLDVPAPREDSITVHIRSTNGPIDVYLCEVEQGQTSNKRSEGVGTSSSESTHPEGPEEEENPQQSEELLEVSN

SEQ ID NO: 4312 - protein, 133 aa, Homo sapiens
MSQQRPARKLPSLLLDPTEETVRRRCRDPINVEGLLPSKIRINLEDNVQYVSMRKALKVKRPRFDVSLVYLTRKFMDLVRSAPGGILDLNKVATKLGVRKRRVYDITNVLDGIDLVEKKSKNHIRWMTLSQCT

SEQ ID NO: 4313 - protein, 281 aa, Homo sapiens
MSQQRPARKLPSLLLDPTEETVRRRCRDPINVEGLLPSKIRINLEDNVQYVSMRKALKVKRPRFDVSLVYLTRKFMDLVRSAPGGILDLNKVATKLGVRKRRVYDITNVLDGIDLVEKKSKNHIRWIGSDLSNFGAVPQQKKLQEELSDLSAMEDALDELIKDCAQQLFELTDDKENERLAYVTYQDIHSIQAFHEQIVIAVKAPAETRLDVPAPREDSITVHIRSTNGPIDVYLCEVEQGQTSNKRSEGVGTSSSESTHPEGPEEEENPQQSEELLEVSN

SEQ ID NO: 4314 - protein, 206 aa, Homo sapiens
MDLVRSAPGGILDLNKVATKLGVRKRRVYDITNVLDGIDLVEKKSKNHIRWIGSDLSNFGAVPQQKKLQEELSDLSAMEDALDELIKDCAQQLFELTDDKENERLAYVTYQDIHSIQAFHEQIVIAVKAPAETRLDVPAPREDSITVHIRSTNGPIDVYLCEVEQGQTSNKRSEGVGTSSSESTHPEGPEEEENPQQSEELLEVSN

SEQ ID NO: 4315 - protein, 206 aa, Homo sapiens; identical to SEQ ID NO: 4314

SEQ ID NO: 4316 - protein, 619 aa, Homo sapiens
MAAVVQQNDLVFEFASNVMEDERQLGDPAIFPAVIVEHVPGADILNSYAGLACVEEPNDMITESSLDVAEEEIIDDDDDDITLTVEASCHDGDETIETIEAAEALLNMDSPGPMLDEKRINNNIFSSPEDDMVVAPVTHVSVTLDGIPEVMETQQVQEKYADSPGASSPEQPKRKKGRKTKPPRPDSPATTPNISVKKKNKDGKGNTIYLWEFLLALLQDKATCPKYIKWTQREKGIFKLVDSKAVSRLWGKHKNKPDMNYETMGRALRYYYQRGILAKVEGQRLVYQFKEMPKDLIYINDEDPSSSIESSDPSLSSSATSNRNQTSRSRVSSSPGVKGGATTVLKPGNSKAAKPKDPVEVAQPSEVLRTVQPTQSPYPTQLFRTVHVVQPVQAVPEGEAARTSTMQDETLNSSVQSIRTIQAPTQVPVVVSPRNQQLHTVTLQTVPLTTVIASTDPSAGTGSQKFILQAIPSSQPMTVLKENVMLQSQKAGSPPSIVLGPAQVQQVLTSNVQTICNGTVSVASSPSFSATAPVVTFSPRSSQLVAHPPGTVITSVIKTQETKTLTQEVEKKESEDHLKENTEKTEQQPQPYVMVVSSSNGFTSQVAMKQNELLEPNSF

SEQ ID NO: 4317 - protein, 361 aa, Homo sapiens
MNYETMGRALRYYYQRGILAKVEGQRLVYQFKEMPKDLIYINDEDPSSSIESSDPSLSSSATSNRNQTSRSRVSSSPGVKGGATTVLKPGNSKAAKPKDPVEVAQPSEVLRTVQPTQSPYPTQLFRTVHVVQPVQAVPEGEAARTSTMQDETLNSSVQSIRTIQAPTQVPVVVSPRNQQLHTVTLQTVPLTTVIASTDPSAGTGSQKFILQAIPSSQPMTVLKENVMLQSQKAGSPPSIVLGPAQVQQVLTSNVQTICNGTVSVASSPSFSATAPVVTFSPRSSQLVAHPPGTVITSVIKTQETKTLTQEVEKKESEDHLKENTEKTEQQPQPYVMVVSSSNGFTSQVAMKQNELLEPNSF

SEQ ID NO: 4318 - protein, 24 aa, Homo sapiens
MAAVVQQNDLVFEFASNVMEDERQ

SEQ ID NO: 4319 - protein, 595 aa, Homo sapiens
MAAVVQQNDLVFEFASNVMEDERQLGDPAIFPAVIVEHVPGADILNSYAGLACVEEPNDMITESSLDVAEEEIIDDDDDDITLTVEASCHDGDETIETIEAAEALLNMDSPGPMLDEKRINGIPEVMETQQVQEKYADSPGASSPEQPKRKKGRKTKPPRPDSPATTPNISVKKKNKDGKGNTIYLWEFLLALLQDKATCPKYIKWTQREKGIFKLVDSKAVSRLWGKHKNKPDMNYETMGRALRYYYQRGILAKVEGQRLVYQFKEMPKDLIYINDEDPSSSIESSDPSLSSSATSNRNQTSRSRVSSSPGVKGGATTVLKPGNSKAAKPKDPVEVAQPSEVLRTVQPTQSPYPTQLFRTVHVVQPVQAVPEGEAARTSTMQDETLNSSVQSIRTIQAPTQVPVVVSPRNQQLHTVTLQTVPLTTVIASTDPSAGTGSQKFILQAIPSSQPMTVLKENVMLQSQKAGSPPSIVLGPAQVQQVLTSNVQTICNGTVSVASSPSFSATAPVVTFSPRSSQLVAHPPGTVITSVIKTQETKTLTQEVEKKESEDHLKENTEKTEQQPQPYVMVVSSSNGFTSQVAMKQNELLEPNSF

SEQ ID NO: 4320 - protein, 591 aa, Homo sapiens
MFGIQESIQRSGSSMKEEPLGSGMNAVRTWMQGAGVLDANTAAQSGVGLARAHFEKQPPSNLRKSNFFHFVLALYDRQGQPVEIERTAFVGFVEKEKEANSEKTNNGIHYRLQLLYSNGIRTEQDFYVRLIDSMTKQAIVYEGQDKNPEMCRVLLTHEIMCSRCCDKKSCGNRNETPSDPVIIDRFFLKFFLKCNQNCLKNAGNPRDMRRFQVVVSTTVNVDGHVLAVSDNMFVHNNSKHGRRARRLDPSEGTPSYLEHATPCIKAISPSEGWTTGGATVIIIGDNFFDGLQVIFGTMLVWSELITPHAIRVQTPPRHIPGVVEVTLSYKSKQFCKGTPGRFIYTALNEPTIDYGFQRLQKVIPRHPGDPERLPKEVILKRAADLVEALYGMPHNNQEIILKRAADIAEALYSVPRNHNQLPALANTSVHAGMMGVNSFSGQLAVNVSEASQATNQGFTRNSSSVSPHGYVPSTTPQQTNYNSVTTSMNGYGSAAMSNLGGSPTFLNGSAANSPYAIVPSSPTMASSTSLPSNCSSSSGIFSFSPANMVSAVKQKSAFAPVVRPQTSPPPTCTSTNGNSLQAISGMIVPPM

SEQ ID NO: 4321 - protein, 591 aa, Homo sapiens; identical to SEQ ID NO: 4320

SEQ ID NO: 4322 - protein, 560 aa, Homo sapiens
MFGIQESIQRSGSSMKEEPLGSGMNAVRTWMQGAGVLDANTAAQSGVGLARAHFEKQPPSNLRKSNFFHFVLALYDRQGQPVEIERTAFVGFVEKEKEANSEKTNNGIHYRLQLLYSNGIRTEQDFYVRLIDSMTKQAIVYEGQDKNPEMCRVLLTHEIMCRFFLKFFLKCNQNCLKNAGNPRDMRRFQVVVSTTVNVDGHVLAVSDNMFVHNNSKHGRRARRLDPSEATPCIKAISPSEGWTTGGATVIIIGDNFFDGLQVIFGTMLVWSELITPHAIRVQTPPRHIPGVVEVTLSYKSKQFCKGTPGRFIYTALNEPTIDYGFQRLQKVIPRHPGDPERLPKEVILKRAADLVEALYGMPHNNQEIILKRAADIAEALYSVPRNHNQLPALANTSVHAGMMGVNSFSGQLAVNVSEASQATNQGFTRNSSSVSPHGYVPSTTPQQTNYNSVTTSMNGYGSAAMSNLGGSPTFLNGSAANSPYAIVPSSPTMASSTSLPSNCSSSSGIFSFSPANMVSAVKQKSAFAPVVRPQTSPPPTCTSTNGNSLQAISGMIVPPM

SEQ ID NO: 4323 - protein, 1501 aa, Homo sapiens
MCKMAIIPDWLRSHPHTRKFTHSRPHSSPCRVYSRNGSPNKFRSSSTTAVANPTLSSLDVKRILFQKITDRGDELQKAFQLLDTGQNLTVSKSELRRIITDFLMPLTREQFQDVLAQIPLSTSGTVPYLAFLSRFGGIDLYINGIKRGGGNEMNCCRTLRELEIQVGEKVFKNIKTVMKAFELIDVNKTGLVRPQELRRVLETFCMKLRDEEYEKFSKHYNIHKDTAVDYNVFLKNLSINNDLNLRYCMGNQEVSLENQQAKNSKKERLLGSASSEDIWRNYSLDEIERNFCLQLSKSYEKVEKALSAGDPCKGGYVSFNYLKIVLDTFVYQIPRRIFIQLMKRFGLKATTKINWKQFLTSFHEPQGLQVSSKGPLTKRNSINSRNESHKENIITKLFRHTEDHSASLKKALLIINTKPDGPITREEFRYILNCMAVKLSDSEFKELMQMLDPGDTGVVNTSMFIDLIEENCRMRKTSPCTDAKTPFLLAWDSVEEIVHDTITRNLQAFYNMLRSYDLGDTGRIGRNNFKKIMHVFCPFLTNAHFIKLCSKIQDIGSGRILYKKLLACIGIDGPPTVSPVLVPKDQLLSEHLQKDEQQQPDLSERTKLTEDKTTLTKKMTTEEVIEKFKKCIQQQDPAFKKRFLDFSKEPNGKINVHDFKKVLEDTGMPMDDDQYALLTTKIGFEKEGMSYLDFAAGFEDPPMRGPETTPPQPPTPSKSYVNSHFITAEECLKLFPRRLKESFRDPYSAFFKTDADRDGIINMHDLHRLLLHLLLNLKDDEFERFLGLLGLRLSVTLNFREFQNLCEKRPWRTDEAPQRLIRPKQKVADSELACEQAHQYLVTKAKNRWSDLSKNFLETDNEGNGILRRRDIKNALYGFDIPLTPREFEKLWARYDTEGKGHITYQEFLQKLGINYSPAVHRPCAEDYFNFMGHFTKPQQLQEEMKELQQSTEKAVAARDKLMDRHQDISKAFTKTDQSKTNYISICKMQEVLEECGCSLTEGELTHLLNSWGVSRHDNAINYLDFLRAVENSKSTGAQPKEKEESMPINFATLNPQEAVRKIQEVVESSQLALSTAFSALDKEDTGFVKATEFGQVLKDFCYKLTDNQYHYFLRKLRIHLTPYINWKYFLQNFSCFLEETADEWAEKMPKGPPPTSPKATADRDILARLHKAVTSHYHAITQEFENFDTMKTNTISREEFRAICNRRVQILTDEQFDRLWNEMPVNAKGRLKYPDFLSRFSSETAATPMATGDSAVAQRGSSVPDVSEGTRSALSLPTQELRPGSKSQSHPCTPASTTVIPGTPPLQNCDPIESRLRKRIQGCWRQLLKECKEKDVARQGDINASDFLALVEKFNLDISKEECQQLIIKYDLKSNGKFAYCDFIQSCVLLLKAKESSLMHRMKIQNAHKMKEAGAETPSFYSALLRIQPKIVHCWRPMRRTFKSYDEAGTGLLSVADFRTVLRQYSINLSEEEFFHILEYYDKTLSSKISYNDFLRAFLQ

SEQ ID NO: 4324 - protein, 243 aa, Homo sapiens [sequence omitted]

SEQ ID NO: 4325 - protein, 1349 aa, Homo sapiens
MNCCRTLRELEIQVGEKVFKNIKTVMKAFELIDVNKTGLVRPQELRRVLETFCMKLRDEEYEKFSKHYNIHKDTAVDYNVFLKNLSINNDLNLRYCMGNQEVSLENQQAKNSKKERLLGSASSEDIWRNYSLDEIERNFCLQLSKSYEKVEKALSAGDPCKGGYVSFNYLKIVLDTFVYQIPRRIFIQLMKRFGLKATTKINWKQFLTSFHEPQGLQVSSKGPLTKRNSINSRNESHKENIITKLFRHTEDHSASLKKALLIINTKPDGPITREEFRYILNCMAVKLSDSEFKELMQMLDPGDTGVVNTSMFIDLIEENCRMRKTSPCTDAKTPFLLAWDSVEEIVHDTITRNLQAFYNMLRSYDLGDTGRIGRNNFKKIMHVFCPFLTNAHFIKLCSKIQDIGSGRILYKKLLACIGIDGPPTVSPVLVPKDQLLSEHLQKDEQQQPDLSERTKLTEDKTTLTKKMTTEEVIEKFKKCIQQQDPAFKKRFLDFSKEPNGKINVHDFKKVLEDTGMPMDDDQYALLTTKIGFEKEGMSYLDFAAGFEDPPMRGPETTPPQPPTPSKSYVNSHFITAEECLKLFPRRLKESFRDPYSAFFKTDADRDGIINMHDLHRLLLHLLLNLKDDEFERFLGLLGLRLSVTLNFREFQNLCEKRPWRTDEAPQRLIRPKQKVADSELACEQAHQYLVTKAKNRWSDLSKNFLETDNEGNGILRRRDIKNALYGFDIPLTPREFEKLWARYDTEGKGHITYQEFLQKLGINYSPAVHRPCAEDYFNFMGHFTKPQQLQEEMKELQQSTEKAVAARDKLMDRHQDISKAFTKTDQSKTNYISICKMQEVLEECGCSLTEGELTHLLNSWGVSRHDNAINYLDFLRAVENSKSTGAQPKEKEESMPINFATLNPQEAVRKIQEVVESSQLALSTAFSALDKEDTGFVKATEFGQVLKDFCYKLTDNQYHYFLRKLRIHLTPYINWKYFLQNFSCFLEETADEWAEKMPKGPPPTSPKATADRDILARLHKAVTSHYHAITQEFENFDTMKTNTISREEFRAICNRRVQILTDEQFDRLWNEMPVNAKGRLKYPDFLSRFSSETAATPMATGDSAVAQRGSSVPDVSEGTRSALSLPTQELRPGSKSQSHPCTPASTTVIPGTPPLQNCDPIESRLRKRIQGCWRQLLKECKEKDVARQGDINASDFLALVEKFNLDISKEECQQLIIKYDLKSNGKFAYCDFIQSCVLLLKAKESSLMHRMKIQNAHKMKEAGAETPSFYSALLRIQPKIVHCWRPMRRTFKSYDEAGTGLLSVADFRTVLRQYSINLSEEEFFHILEYYDKTLSSKISYNDFLRAFLQ

SEQ ID NO: 4326 - protein, 260 aa, Homo sapiens
MNSAAGFSHLDRRERVLKLGESFEKQPRCAFHTVRYDFKPASIDTSSEGYLEVGEGEQVTITLPNIEGSTPPVTVFKGSKKPYLKECILIINHDTGECRLEKLSSNITVKKTRVEGSSKIQYRKEQQQQQMWNSARTPNLVKHSPSEDKMSPASPIDDIERELKAEASLMDQMSSCDSSSDSKSSSSSSSEDSSSDSEDEDCKSSTSDTGNCVSGHPTMTQYRIPDIDASHNRFRDNSGLLMNTLRNDLQLSESGSDSDD

SEQ ID NO: 4327 - protein, 263 aa, Homo sapiens
MNSAAGFSHLDRRERVLKLGESFEKQPRCAFHTVRYDFKPASIDTSSEGYLEVGEGEQVTITLPNIEGSTPPVTVFKGSKKPYLKECILIINHDTGECRLEKLSSNITVKKTRVEGSSKIQYRKEQQQQQMWNSARTPNLVKHSPSEDKMSPASPIDDIERELKAEASLMDQMSSCDSSSDSKSSSSSSSEDSSSDSEDEDCKSSTSDTGNCVSGHPTMTQYRIPDIDASHNRFRDNSGLLMNTLNNLSSHSFSSLYDPLLSH

SEQ ID NO: 4328 - protein, 83 aa, Homo sapiens
MGRRKSKRKPPPKKKMTGTLETQFTCPFCNHEKSCDVKMDRARNTGVISCTVCLEEFQTPITYLSEPVDVYSDWIDACEAANQ

SEQ ID NO: 4329 - protein, 101 aa, Homo sapiens
MVVSKMNKDAQMRAAINQKLIETGERERLKELLRAKLIECGWKDQLKAHCKEVIKEKGLEHVTVDDLVAEITPKGRALVPDSVKKELLQRIRTFLAQHASL

SEQ ID NO: 4330 - protein, 96 aa, Homo sapiens
MNKDAQMRAAINQKLIETGERERLKELLRAKLIECGWKDQLKAHCKEVIKEKGLEHVTVDDLVAEITPKGRALVPDSVKKELLQRIRTFLAQHASL

SEQ ID NO: 4331 - protein, 161 aa, Homo sapiens
MAEPTGLLEMSELPGDSSVPQVGTASGVSDVLRGAVGGGVRVQEAREGPVAEAARSMARMPGPVPGPIPSSVPGLASAPDPHQQLAFLEINRQLLFREYLDGSSMIPVRLLRDFEERRRLFVEGCKAREAAFDADPPQMDFAAVAFTVALTASEALSPLAD

SEQ ID NO: 4332 - protein, 851 aa, Homo sapiens
MSSKQEIMSDQRFRRVAKDPRFWEMPEKDRKVKIDKRFRAMFHDKKFKLNYAVDKRGRPISHSTTEDLKRFYDLSDSDSNLSGEDSKALSQKKIKKKKTQTKKEIDSKNLVEKKKETKKANHKGSENKTDLDNSIGIKKMKTSCKFKIDSNISPKKDSKEFTQKNKKEKKNIVQHTTDSSLEEKQRTLDSGTSEIVKSPRIECSKTRREMQSVVQLIMTRDSDGYENSTDGEMCDKDALEEDSESVSEIGSDEESENEITSVGRASGDDDGSEDDEEEDEDEEEDEDEDSEDDDKSDSGPDLARGKGNIETSSEDEDDTADLFPEESGFEHAWRELDKDAPRADEITRRLAVCNMDWDRLKAKDLLALFNSFKPKGGVIFSVKIYPSEFGKERMKEEQVQGPVELLSIPEDAPEKDWTSREKLRDYQFKRLKYYYAVVDCDSPETASKIYEDCDGLEFESSCSFIDLRFIPDDITFDDEPKDVASEVNLTAYKPKYFTSAAMGTSTVEITWDETDHERITMLNRKFKKEELLDMDFQAYLASSSEDEEEIEEELQGDDGVNVEEDGKTKKSQKDDEEQIAKYRQLLQVIQEKEKKGKENDMEMEIKWVPGLKESAEEMVKNKLEGKDKLTPWEQFLEKKKEKKRLKRKQKALAEEASEEELPSDVDLNDPYFAEEVKQIGINKKSVKSAKDGTSPEEEIEIERQKAEMALLMMDEDEDSKKHFNYNKIVEHQNLSKKKKKQLMKKKELIEDDFEVNVNDARFQAMYTSHLFNLDPSDPNFKKTKAMEKILEEKARQRERKEQELTQAIKKKESEIEKESQRKSIDPALSMLIKSIKTKTEQFQARKKQKVK

SEQ ID NO: 4333 - protein, 110 aa, Homo sapiens
MSSKQEIMSDQRFRRVAKDPRFWEMPEKDRKVKIDKRFRAMFHDKKFKLNYAVDKRGRPISHSTTEDLKRFYDLSDSDSNLSGEDSKALSQKKIKKKKTQTKKKKKKKKK

SEQ ID NO: 4334 - protein, 361 aa, Homo sapiens
MHCSCLAEGIPANPGNWISGLAFPDWAYKAESSPGSRQIQLWHFILELLQKEEFRHVIAWQQGEYGEFVIKDPDEVARLWGRRKCKPQMNYDKLSRALRYYYNKRILHKTKGKRFTYKFNFSKLIVVNYPLWEVRAPPSPHLLLGAPALCRPALVPVGVQSELLHSMLFAHQAMVEQLTGQQTPRGPPETSGDKKGSSSSVYRLGSAPGPCRLGLCCHLGSVQGELPGVASFTPPLPPPLPSNWTCLSGPFLPPLPSEQQLPGAFKPDILLPGPRSLPGAWHFPGLPLLAGLGQGAGERLWLLSLRPEGLEVKPAPMMEAKGGLDPREVFCPETRRLKTGEESLTSPNLENLKAVWPLDPP

SEQ ID NO: 4335 - protein, 165 aa, Homo sapiens
MSQATKRKHVVKEVLGEHIVPSDQQQIVRVLRTPGNNLHEVETAQGQRFLVSMPSKYRKNIWIKRGDFLIVDPIEEGEKVKAEISFVLCKDHVRSLQKEGFWPEAFSEVAEKHNNRNRQTQPELPAEPQLSGEESSSEDDSDLFVNTNRRQYHESEEESEEEEAA

SEQ ID NO: 4336 - protein, 165 aa, Homo sapiens; identical to SEQ ID NO: 4335

SEQ ID NO: 4337 - protein, 78 aa, Homo sapiens
MSQATKRKHVVKEVLGEHIVPSDQQQIVRVLRTPGNNLHEVETAQGQRFLVSMPSKYRKNIWIKRGDFLIVDPIEEGE

SEQ ID NO: 4338 - protein, 165 aa, Homo sapiens; identical to SEQ ID NO: 4335

SEQ ID NO: 4339 - protein, 146 aa, Homo sapiens
MSQATKRKHVVKEVLGEHIVPSDQQQIVRVLRTPGNNLHEVETAQGQRFLVSMPSKYRKNIWIKRGDFLIVDPIEEGEKVKAEISFVLCKDHVRSLQKEGFWPEAFSEVAEKHNNRNRQTQPELPAEPQLSGEESSSEDDSDLFVN

SEQ ID NO: 4340 - protein, 114 aa, Homo sapiens
MSQATKRKHVVKEVLGEHIVPSDQQQIVRVLRTPGNNLHEVETAQGQRFLVSMPSKYRKNIWIKRGDFLIVDPIEEGEKVKAEISFVLCKDHVRSLQKEGFWPEAFSEVAEKHN

SEQ ID NO: 4341 - protein, 113 aa, Homo sapiens
MSQATKRKHVVKEVLGEHIVPSDQQQIVRVLRTPGNNLHEVETAQGQRFLVSMPSKYRKNIWIKRGDFLIVDPIEEGEKVKAEISFVLCKDHVRSLQKEGFWPEAFSEVAEKH

SEQ ID NO: 4342 - protein, 165 aa, Homo sapiens; identical to SEQ ID NO: 4335

SEQ ID NO: 4343 - protein, 409 aa, Homo sapiens
MEGESTSAVLSGFVLGALAFQHLNTDSDTEGFLLGEVKGEAKNSITDSQMDDVEVVYTIDIQKYIPCYQLFSFYNSSGEVNEQALKKILSNVKKNVVGWYKFRRHSDQIMTFRERLLHKNLQEHFSNQDLVFLLLTPSIITESCSTHRLEHSLYKPQKGLFHRVPLVVANLGMSEQLGYKTVSGSCMSTGFSRAVQTHSSKFFEEDGSLKEVHKINEMYASLQEELKSICKKVEDSEQAVDKLVKDVNRLKREIEKRRGAQIQAAREKNIQKDPQENIFLCQALRTFFPNSEFLHSCVMSLKNRHVSKSSCNYNHHLDVVDNLTLMVEHTDIPEASPASTPQIIKHKALDLDDRWQFKRSRLLDTQDKRSKADTGSSNQDKASKMSSPETDEEIEKMKGFGEYSRSPTF

SEQ ID NO: 4344 - protein, 360 aa, Homo sapiens
MDDVEVVYTIDIQKYIPCYQLFSFYNSSGEVNEQALKKILSNVKKNVVGWYKFRRHSDQIMTFRERLLHKNLQEHFSNQDLVFLLLTPSIITESCSTHRLEHSLYKPQKGLFHRVPLVVANLGMSEQLGYKTVSGSCMSTGFSRAVQTHSSKFFEEDGSLKEVHKINEMYASLQEELKSICKKVEDSEQAVDKLVKDVNRLKREIEKRRGAQIQAAREKNIQKDPQENIFLCQALRTFFPNSEFLHSCVMSLKNRHVSKSSCNYNHHLDVVDNLTLMVEHTDIPEASPASTPQIIKHKALDLDDRWQFKRSRLLDTQDKRSKADTGSSNQDKASKMSSPETDEEIEKMKGFGEYSRSPTF

SEQ ID NO: 4345 - protein, 110 aa, Homo sapiens
MDDVEVVYTIDIQKYIPCYQLFSFYNSSGEVNEQALKKILSNVKKNVVGWYKFRRHSDQIMTFRERLLHKNLQEHFSNQDLVFLLLTPSIITESCSTHRLEHSLYKPQKG

SEQ ID NO: 4346 - protein, 445 aa, Homo sapiens
MSELTKELMELVWGTKSSPGLSDTIFCRWTQGFVFSESEGSALEQFEGGPCAVIAPVQAFLLKKLLFSSEKSSWRDCSEEEQKELLCHTLCDILESACCDHSGSYCLVSWLRGKTTEETASISGSPAESSCQVEHSSALAVEELGFERFHALIQKRSFRSLPELKDAVLDQYSMWGNKFGVLLFLYSVLLTKGIENIKNEIEDASEPLIDPVYGHGSQSLINLLLTGHAVSNVWDGDRECSGMKLLGIHEQAAVGFLTLMEALRYCKVGSYLKSPKFPIWIVGSETHLTVFFAKDMALVAPEAPSEQARRVFQTYDPEDNGFIPDSLLEDVMKALDLVSDPEYINLMKNKLDPEGLGIILLGPFLQEFFPDQGSSGPESFTVYHYNGLKQSNYNEKVMYVEGTAVVMGFEDPMLQTDDTPIKRCLQTKWPYIELLWTTDRSPSLN

SEQ ID NO: 4347 - protein, 150 aa, Homo sapiens
MALVAPEAPSEQARRVFQTYDPEDNGFIPDSLLEDVMKALDLVSDPEYINLMKNKLDPEGLGIILLGPFLQEFFPDQGSSGPESFTVYHYNGLKQSNYNEKVMYVEGTAVVMGFEDPMLQTDDTPIKRCLQTKWPYIELLWTTDRSPSLN

SEQ ID NO: 4348 - protein, 150 aa, Homo sapiens; identical to SEQ ID NO: 4347

SEQ ID NO: 4349 - protein, 182 aa, Homo sapiens
LPELKDAVLDQYSMWGNKFGVLLFLYSVLLTKGIENIKNEIEDASEPLIDPVYGHGSQSLINLLLTGHAVSNVWDGDRECSGMKLLGIHEQAAVGFLTLMEALRYCKVGSYLKSPKFPIWIVGSETHLTVFFAKDMALVAPEAPSEQARRVFQTYDPEDNGFIPDSLLEDVMKALDLVSDPE

SEQ ID NO: 4350 - protein, 164 aa, Homo sapiens
MKRFPAKKRSFRSLPELKDAVLDQYSMWGNKFGVLLFLYSVLLTKGIENIKNEIEDASEPLIDPVYGHGSQSLINLLLTGHAVSNVWDGDRECSGMKLLGIHEQAAVGFLTLMEALRYCKVGSYLKSPKFPIWIVGSETHLTVFFAKDMALVAPEAPSEQARRV

SEQ ID NO: 4351 - protein, 254 aa, Homo sapiens
MDGGDDGNLIIKKRFVSEAELDERRKRRQEEWEKVRKPEDPEECPEEVYDPRSLYERLQEQKDRKQQEYEEQFKFKNMVRGLDEDETNFLDEVSRQQELIEKQRREEELKELKEYRNNLKKVGISQENKKEVEKKLTVKPIETKNKFSQAKLLAGAVKHKSSESGNSVKRLKPDPEPDDKNQEPSSCKSLGNTSLSGPSIHCPSAAVCIGILPGLGAYSGSSDSESSSDSEGTINATGKIVSSIFRTNTFLEAP

SEQ ID NO: 4352 - protein, 254 aa, Homo sapiens; identical to SEQ ID NO: 4351

SEQ ID NO: 4353 - protein, 81 aa, Homo sapiens
MDGGDDGNLIIKKRFVSEAELDERRKRRQEEWEKVRKPEDPEECPEEVYDPRSLYERLQEQKDRKQQEYEEQFKFSKQFDP

SEQ ID NO: 4354 - protein, 538 aa, Homo sapiens
MRHVQAEPSPSSEPEAGPSQPPVRQGALQGGLLMGYSPAGGATSPGVYQVSIFSPPAGTSEPHRALKRQAPSTEGPRELKRGPGLGAREGLPPEEPSTVGLLGPEGPGLGLGVASQHFSHRGLCVVEQRSSVTSSWTSGAWSPPCPPSNASCNTLHTRDWASPDPGGQGSLGESPGPAPPGQLHTLDTDLHSLAQIGGKSPVAGVGNGGSLWPRESPGTANGHSPEHTPPGPGPPGPCPTKRRLLPAGEAPDVSSEEEGPAPRRRRGSLGHPTAANSSDAKATPFWSHLLPGPKEPVLDPTDCGPMGRRLKGARRLKLSPLRSLRKGPGLLSPPSASPVPTPAVSRTLLGNFEESLLRGRFAPSGHIEGFTAEIGASGSYCPQHVTLPVTVTFFDVSEQNAPAPFLGIVDLNPLGRKGYSVPKVGTVQVTLFNPNQTVVKMFLVTFDFSDMPAAHMTFLRHRLFLVPVGEEGNANPTHRLLCYLLHLRFRSSRSGRLSLHGDIRLLFSRRSLELDTGLPYELQAVTEAPHNPRYSPLP

SEQ ID NO: 4355 - protein, 442 aa, Homo sapiens
MRHVQAEPSPSSEPEAGPSQPPVRQGALQGGLLMGYSPAGGATSPGVYQVSIFSPPAGTSEPHRALKRQAPSTEGPRELKRGPGLGAREGLPPEEPSTVGLLGPEGPGLGLGVASQHFSHRGLCVVEQRSSVTSSWTSGAWSPPCPPSNASCNTLHTRDWASPDPGGQGSLGESPGPAPPGQLHTLDTDLHSLAQIGGKSPVAGVGNGGSLWPRESPGTANGHSPEHTPPGPGPPGPCPTKRRLLPAGEAPDVSSEEEGPAPRRRRGSLGHPTAANSSDAKATPFWSHLLPGPKEPVLDPTDCGPMGRRLKGARRLKLSPLRSLRKGPGLLSPPSASPVPTPAVSRTLLGNFEESLLRGRFAPSGHIEGFTAEIGASGSYCPQHVTLPVTVTFFDVSEQNAPAPFLGIVDLNPLGRKGYSVPKVGTVQVTLFNPNPFTSPTL

SEQ ID NO: 4356 - protein, 538 aa, Homo sapiens; identical to SEQ ID NO: 4354

SEQ ID NO: 4357 - protein, 538 aa, Homo sapiens; identical to SEQ ID NO: 4354

SEQ ID NO: 4358 - protein, 233 aa, Homo sapiens
MGRRLKGARRLKLSPLRSLRKGPGLLSPPSASPVPTPAVSRTLLGNFEESLLRGRFAPSGHIEGFTAEIGASGSYCPQHVTLPVTVTFFDVSEQNAPAPFLGIVDLNPLGRKGYSVPKVGTVQVTLFNPNQTVVKMFLVTFDFSDMPAAHMTFLRHRLFLVPVGEEGNANPTHRLLCYLLHLRFRSSRSGRLSLHGDIRLLFSRRSLELDTGLPYELQAVTEAPHNPRYSPLP

SEQ ID NO: 4359 - protein, 112 aa, Homo sapiens
MEAYEQVQKGPLKLKGVAELGVTKRKKKKKDKDKAKLLEAMGTSKKNEEEKRRGLDKRTPAQAAFEKMQEKRQMERILKKASKTHKQRVEDFNRHLDTLTEHYDIPKVSWTK

SEQ ID NO: 4360 - protein, 212 aa, Homo sapiens
MEPAVGGPGPLIVNNKQPQPPPPPPPAAAQPPPGAPRAAAGLLPGGKAREFNRNQRKDSEGYSESPDLEFEYADTDKWAAELSELYSYTEGPEFLMNRKCFEEDFRIHVTDKKWTELDTNQHRTHAMRLLDGLEVTAREKRLKVARAILYVAQGTFGECSSEAEVQSWMRYNIFLLLEVGTFNALVELLNMEIEHCCVRPAVSALAGGQAQD

SEQ ID NO: 4361 - protein, 837 aa, Homo sapiens
MEPAVGGPGPLIVNNKQPQPPPPPPPAAAQPPPGAPRAAAGLLPGGKAREFNRNQRKDSEGYSESPDLEFEYADTDKWAAELSELYSYTEGPEFLMNRKCFEEDFRIHVTDKKWTELDTNQHRTHAMRLLDGLEVTAREKRLKVARAILYVAQGTFGECSSEAEVQSWMRYNIFLLLEVGTFNALVELLNMEIDNSAACSSAVRKPAISLADSTDLRVLLNIMYLIVETVHQECEGDKAEWRTMRQTFRAELGSPLYNNEPFAIMLFGMVTKFCSGHAPHFPMKKVLLLLWKTVLCTLGGFEELQSMKAEKRSILGLPPLPEDSIKVIRNMRAASPPASASDLIEQQQKRGRREHKALIKQDNLDAFNERDPYKADDSREEEEENDDDNSLEGETFPLERDEVMPPPLQHPQTDRLTCPKGLPWAPKVREKDIEMFLESSRSKFIGYTLGSDTNTVVGLPRPIHESIKTLKQHKYTSIAEVQAQMEEEYLRSPLSGGEEEVEQVPAETLYQGLLPSLPQYMIALLKILLAAAPTSKAKTDSINILADVLPEEMPTTVLQSMKLGVDVNRHKEVIVKAISAVLLLLLKHFKLNHVYQFEYMAQHLVFANCIPLILKFFNQNIMSYITAKNSISVLDYPHCVVHELPELTAESLEAGDSNQFCWRNLFSCINLLRILNKLTKWKHSRTMMLVVFKSAPILKRALKVKQAMMQLYVLKLLKVQTKYLGRQWRKSNMKTMSAIYQKVRHRLNDDWAYGNDLDARPWDFQAEECALRANIERFNARRYDRAHSNPDFLPVDNCLQSVLGQRVDLPEDFQMNYDLWLEREVFSKPISWEELLQ

SEQ ID NO: 4362 - protein, 742 aa, Homo sapiens
MNRKCFEEDFRIHVTDKKWTELDTNQHRTHAMRLLDGLEVTAREKRLKVARAILYVAQGTFGECSSEAEVQSWMRYNIFLLLEVGTFNALVELLNMEIDNSAACSSAVRKPAISLADSTDLRVLLNIMYLIVETVHQECEGDKAEWRTMRQTFRAELGSPLYNNEPFAIMLFGMVTKFCSGHAPHFPMKKVLLLLWKTVLCTLGGFEELQSMKAEKRSILGLPPLPEDSIKVIRNMRAASPPASASDLIEQQQKRGRREHKALIKQDNLDAFNERDPYKADDSREEEEENDDDNSLEGETFPLERDEVMPPPLQHPQTDRLTCPKGLPWAPKVREKDIEMFLESSRSKFIGYTLGSDTNTVVGLPRPIHESIKTLKQHKYTSIAEVQAQMEEEYLRSPLSGGEEEVEQVPAETLYQGLLPSLPQYMIALLKILLAAAPTSKAKTDSINILADVLPEEMPTTVLQSMKLGVDVNRHKEVIVKAISAVLLLLLKHFKLNHVYQFEYMAQHLVFANCIPLILKFFNQNIMSYITAKNSISVLDYPHCVVHELPELTAESLEAGDSNQFCWRNLFSCINLLRILNKLTKWKHSRTMMLVVFKSAPILKRALKVKQAMMQLYVLKLLKVQTKYLGRQWRKSNMKTMSAIYQKVRHRLNDDWAYGNDLDARPWDFQAEECALRANIERFNARRYDRAHSNPDFLPVDNCLQSVLGQRVDLPEDFQMNYDLWLEREVFSKPISWEELLQ

SEQ ID NO: 4363 - protein, 260 aa, Homo sapiens
MKSNIDKKFSAHYDAVEAELKSSTVGLVTLNDMKAKQEALVKEREKQLAKKEQSKELQMKLEKLREKERKKEAKRKISSLSFTLEEEEEGGEEEEEAAMYEEEMEREEITTKKRKLGKNPDVDTSFLPDRDREEEENRLREELRQEWEAKQEKIKSEEIEITFSYWDGSGHRRTVKMRKGNTMQQFLQKALEILRKDFSELRSAGVEQLMYIKEDLIIPHHHSFYDFIVTKARGKSGPLFNFDVHDDVRLLSDATVEKDE

SEQ ID NO: 4364 - protein, 339 aa, Homo sapiens
MAQYKGAASEAGRAMHLMKKREKQREQMEQMKQRIAEENIMKSNIDKKFSAHYDAVEAELKSSTVGLVTLNDMKAKQEALVKEREKQLAKKEQSKELQMKLEKLREKERKKEAKRKISSLSFTLEEEEEGGEEEEEAAMYEEEMEREEITTKKRKLGKNPDVDTSFLPDRDREEEENRLREELRQEWEAKQEKIKSEEIEITFSYWDGSGHRRTVKMRKGNTMQQFLQKALEILRKDFSELRSAGVEQLMYIKEDLIIPHHHSFYDFIVTKARGKSGPLFNFDVHDDVRLLSDATVEKDESHAGKVVLRSWYEKNKHIFPASRWEPYDPEKKWDKYTIR

SEQ ID NO: 4365 - protein, 398 aa, Homo sapiens
MVTLITEKLQSQSLDDLTCKAEAGPLQYSAETLNKSGRLFPLELNDQSPWKVFSGGPPVRSQAATGPDFSFLPGLSAAAHTMGLQWQPQSPRPGAGLGAASTVDPSESTGSSTAPPTKRHCRSLSEPEELVRCRSPWRPGSSKVWTPVSKRRCDSGGSATRQGSPGAVLPRSAVWSTGPTSPATPRPSSASGGFVDSSEGSAGSGPLWCSAESCLPSTRRRPSLSQERLAGAGTPLPWASSSPTSTPALGGRRGLLRCRSQPCVLSGKRSRRKRRREEDARWTRPSLDFLKMTQTLKNSKSLCSLNYEDDDEDDTPVKTVLSSPCDSRGLPGITMPGCSQRGLRTSPVHPNLWASRESVTSDGSRRSSGDPRDGDSVGEEGVFPRARWELDLEQIENN

SEQ ID NO: 4366 - protein, 398 aa, Homo sapiens; identical to SEQ ID NO: 4365

SEQ ID NO: 4367 - protein, 108 aa, Homo sapiens
MVTLITEKLQSQSLDDLTCKAEAGPLQYSAETLNKSGRLFPLELNDQSPWKVFSGGPPVRSQAATGPDFSFLPGLSAAAHTMGLQWQPQSPRPGAGLGAASTVDPSES

SEQ ID NO: 4368 - protein, 398 aa, Homo sapiens; identical to SEQ ID NO: 4365

SEQ ID NO: 4369 - protein, 238 aa, Homo sapiens
MASRWQNMGTSVRRRSLQHQEQLEDSKELQPVVSHQETSVGALGSLCRQFQRRLPLRAVNLNLRAGPSWKRLETPEPGQQGLQAAARSAKSALGAVSQRIQESCQSGTKWLVETQVKARRRKRGAQKGSGSPTHSLSQKSTRLSGAAPAHSAADPWEKEHHRLSVRMGSHAHPLRRSRREAAFRSPYSSTEPLCSPSESDSDLEPVGAGIQHLQKLSQELDEAIMAEESGDIVSLIHD

SEQ ID NO: 4370 - protein, 248 aa, Homo sapiens
MASRWQNMGTSVRRRSLQHQEQLEDSKELQPVVSHQETSVGALGSLCRQFQRRLPLRAVNLNLRAGPSWKRLETPEPGQQGLQAAARSAKSALGAVSQRIQESCQSGTKWLVETQVKARRRKRGAQKGSGSPTHSLSQKSTRLSGAAPAHSAADPWEKEHHRLSVRMGSHAHPLRRSRREAAFRSPYSSTEPLCSPSESDSDLEPVGAGIQHLQKLSQELDEAIMAEERKQALSDRQGFILKDVYASP

SEQ ID NO: 4371 - protein, 238 aa, Homo sapiens; identical to SEQ ID NO: 4369

SEQ ID NO: 4372 - protein, 605 aa, Homo sapiens
MSNESCLPYYTAHSYSSMSAFKTSMGDLQRQLYNRGEYNIFKYAPMFESNFIQINKKGEVIDVHNRVRMVTVGIVCTSPILPLPDVMVLAQPTKICEQHVRWGRFAKGRGRRPVKTLELTRLLPLKFVKISIHDHEKQQLRLKLATGRTFYLQLCPSSDTREDLFCYWEKLVYLLRPPVESYCSTPTLLSGDAPPEDNKSLVAAELHREGDQSETGLYKPCDVSAATSSAYAGGEGIQHASHGTASAASPSTSTPGAAEGGAARTAGGMAVAGTATGPRTDVAIAGAAMSPATGAMSIATTKSAGPGQVTTALAGAAIKNPGENESSKSMAGAANISSEGISLALVGAASTSLEGTSTSMAGAASLSQDSSLSAAFAGSITTSKCAAERTEGPAVGPLISTLQSEGYMSERDGSQKVSQPSAEVWNENKERREKKDRHPSRKSSHHRKAGESHRRRAGDKNQKASSHRSASGHKNTRDDKKEKGYSNVRGKRHGSSRKSSTHSSTKKESRTTQELGKNQSASSTGALQKKASKISSFLRSLRATPGSKTRVTSHDREVDIVAKMVEKQNIEAKVEKAQGGQELEMISGTMTSEKTEMIVFETKSI

SEQ ID NO: 4373 - protein, 1017 aa, Homo sapiens
MMSEGKPPDKKRPRRSLSISKNKKKASNSIISCFNNAPPAKLACPVCSKMVPRYDLNRHLDEMCANNDFVQVDPGQVGLINSNVSMVDLTSVTLEDVTPKKSPPPKTNLTPGQSDSAKREVKQKISPYFKSNDVVCKNQDELRNRSVKVICLGSLASKLSRKYVKAKKSIDKDEEFAGSSPQSSKSTVVKSLIDNSSEIEDEDQILENSSQKENVFKCDSLKEECIPEHMVRGSKIMEAESQKATRECEKSALTPGFSDNAIMLFSPDFTLRNTLKSTSEDSLVKQECIKEVVEKREACHCEEVKMTVASEAKIQLSDSEAKSHSSADDASAWSNIQEAPLQDDSCLNNDIPHSIPLEQGSSCNGPGQTTGHPYYLRSFLVVLKTVLENEDDMLLFDEQEKGIVTKFYQLSATGQKLYVRLFQRKLSWIKMTKLEYEEIALDLTPVIEELTNAGFLQTESELQELSEVLELLSAPELKSLAKTFHLVNPNGQKQQLVDAFLKLAKQRSVCTWGKNKPGIGAVILKRAKALAGQSVRICKGPRAVFSRILLLFSLTDSMEDEDAACGGQGQLSTVLLVNLGRMEFPSYTINRKTHIFQDRDDLIRYAAATHMLSDISSAMANGNWEEAKELAQCAKRDWNRLKNHPSLRCHEDLPLFLRCFTVGWIYTRILSRFVEILQRLHMYEEAVRELESLLSQRIYCPDSRGRWWDRLALNLHQHLKRLEPTIKCITEGLADPEVRTGHRLSLYQRAVRLRESPSCKKFKHLFQQLPEMAVQDVKHVTITGRLCPQRGMCKSVFVMEAGEAADPTTVLCSVEELALAHYRRSGFDQGIHGEGSTFSTLYGLLLWDIIFMDGIPDVFRNACQAFPLDLCTDSFFTSRRPALEARLQLIHDAPEESLRAWVAATWHEQEGRVASLVSWDRFTSLQQAQDLVSCLGGPVLSGVCRHLAADFRHCRGGLPDLVVWNSQSRHFKLVEVKGPNDRLSHKQMIWLAELQKLGAEVEVCHVVAVGAKSQSLS

SEQ ID NO: 4374 - protein, 533 aa, Homo sapiens
MMSEGKPPDKKRPRRSLSISKNKKKASNSIISCFNNAPPAKLACPVCSKMVPRYDLNRHLDEMCANNDFVQVDPGQVGLINSNVSMVDLTSVTLEDVTPKKSPPPKTNLTPGQSDSAKREVKQKISPYFKSNDVVCKNQDELRNRSVKVICLGSLASKLSRKYVKAKKSIDKDEEFAGSSPQSSKSTVVKSLIDNSSEIEDEDQILENSSQKENVFKCDSLKEECIPEHMVRGSKIMEAESQKATRECEKSALTPGFSDNAIMLFSPDFTLRNTLKSTSEDSLVKQECIKEVVEKREACHCEEVKMTVASEAKIQLSDSEAKSHSSADDASAWSNIQEAPLQDDSCLNNDIPHSIPLEQGSSCNGPGQTTGHPYYLRSFLVVLKTVLENEDDMLLFDEQEKGIVTKFYQLSATGQKLYVRLFQRKLSWIKMTKLEYEEIALDLTPVIEELTNAGFLQTESELQELSEVLELLSAPELKSLAKTFHLVNPNGQKQQLVDAFLKLAKQRSVCTWGKNKPGIGAVILKRFCWLLLQ

SEQ ID NO: 4375 - protein, 572 aa, Homo sapiens
MAELVQGQSAPVGMKAEGFVDALHRVRQIAAKIDSIPHLNNSTPLVDPSVYGYGVQKRPLDDGVGNQLGALVHQRTVITEEFKVPDKMVGFIIGRGGEQISRIQAESGCKIQIASESSGIPERPCVLTGTPESIEQAKRLLGQIVDRCRNGPGFHNDIDSNSTIQEILIPASKVGLVIGRGGETIKQLQERTGVKMVMIQDGPLPTGADKPLRITGDAFKVQQAREMVLEIIREKDQADFRGVRGDFNSRMGGGSIEVSVPRFAVGIVIGRNGEMIKKIQNDAGVRIQFKPDDGISPERAAQVMGPPDRCQHAAHIISELILTAQERDGFGGLAAARGRGRGRGDWSVGAPGGVQEITYTVPADKCGLVIGKGGENIKSINQQSGAHVELQRNPPPNSDPNLRRFTIRGVPQQIEVARQLIDEKVGGTNLGAPGAFGQSPFSQPPAPPHQNTFPPRSSGCFPNMAAKVNGNPHSTPVSGPPAFLTQGWGSTYQAWQQPTQQVPSQQSQPQSSQPNYSKAWEDYYKKQSHAASAAPQASSPPDYTMAWAEYYRQQVAFYGQTLGQAQAHSQEQ

SEQ ID NO: 4376 - protein, 308 aa, Homo sapiens
MKAEGFVDALHRVRQIAAKIDSIPHLNNSTPLVDPSVYGYGVQKRPLDDGVGNQLGALVHQRTVITEEFKVPDKMVGFIIGRGGEQISRIQAESGCKIQIASESSGIPERPCVLTGTPESIEQAKRLLGQIVDRCRNGPGFHNDIDSNSTIQEILIPASKVGLVIGRGGETIKQLQERTGVKMVMIQDGPLPTGADKPLRITGDAFKVQQAREMVLEIIREKDQADFRGVRGDFNSRMGGGSIEVSVPRFAVGIVIGRNGEMIKKIQNDAGVRIQFKPDDGISPEYYRQQVAFYGQTLGQAQAHSQDE

SEQ ID NO: 4377 - protein, 261 aa, Homo sapiens
MPPIGNQLGALVHQRTVITEEFKVPDKMVGFIIGRGGEQISRIQAESGCKIQIASESSGIPERPCVLTGTPESIEQAKRLLGQIVDRCRNGPGFHNDIDSNSTIQEILIPASKVGLVIGRGGETIKQLQERTGVKMVMIQDGPLPTGADKPLRITGDAFKVQQAREMVLEIIREKDQADFRGVRGDFNSRMGGGSIEVSVPRFAVGIVIGRNGEMIKKIQNDAGVRIQFKPDDGISPEYYRQQVAFYGQTLGQAQAHSQEQ

SEQ ID NO: 4378 - protein, 198 aa, Homo sapiens
MGKQKKTRKYATMKRMLSLRDQRLKEKDRLKPKKKEKKDPSALKEREVPQHPSCLFFQYNTQLGPPYHILVDTNFINFSIKAKLDLVQSMMDCLYAKCIPCITDCVMAEIEKLGQKYRVALRIAKDPRFERLPCTHKGTYADDCLVQRVTQHKCYIVATVDRDLKRRIRKIPGVPIMYISNHRYNIERMPDDYGAPRF

SEQ ID NO: 4379 - protein, 166 aa, Homo sapiens
MAAYPESCVDTTVLDFVADLSLASPRRPLLCDFAPGVSLGDPALALREGRPRRMARFEEGDPEEEECEVDQGDGEEEEEEERGRGVSLLGRPKRKRVITYAQRQAANIRERKRMFNLNEAFDQLRRKVPTFAYEKRLSRIETLRLAIVYISFMTELLESCEKKESG

SEQ ID NO: 4380 - protein, 759 aa, Homo sapiens
MISSTSVYGLKMQWTPEHAQWPEQHFDITSTTRSPAHKVEAYRGHLQRTYQYAWANDDISALTASNLLKKYAEKYSGILEGPVDRPVLSNYSDTPSGLVNGRKNESEPWQPSLNSEAVYPMNCVPDVITASKAGVSSALPPADVSASIGSSPGVASNLTEPSYSSSTCGSHTVPSLHAGLPSQEYAPGYNGSYLHSTYSSQPAPALPSPHPSPLHSSGLLQPPPPPPPPPALVPGYNGTSNLSSYSYPSASYPPQTAVGSGYSPGGAPPPPSAYLPSGIPAPTPLPPTTVPGYTYQGHGLTPIAPSALTNSSASSLKRKAFYMAGQGDMDSSYGNYSYGQQRSTQSPMYRMPDNSISNTNRGNGFDRSAETSSLAFKPTKQLMSSEQQRKFSSQSSRALTPPSYSTAKNSLGSRSSESFGKYTSPVMSEHGDEHRQLLSHPMQGPGLRAATSSNHSVDEQLKNTDTHLIDLVTNEIITQGPPVDWNDIAGLDLVKAVIKEEVLWPVLRSDAFSGLTALPRSILLFGPRGTGKTLLGRCIASQLGATFFKIAGSGLVAKWLGEAEKIIHASFLVARCRQPSVIFVSDIDMLLSSQVNEEHSPVSRMRTEFLMQLDTVLTSAEDQIVVICATSKPEEIDESLRRYFMKRLLIPLPDSTARHQIIVQLLSQHNYCLNDKEFALLVQRTEGFSGLDVAHLCQEAVVGPLHAMPATDLSAIMPSQLRPVTYQDFENAFCKIQPSISQKELDMYVEWNKMFGCSQ

SEQ ID NO: 4381 - protein, 349 aa, Homo sapiens
METPPVNTIGEKDTSQPQQEWEKNLRENLDSVIQIRQQPRDPPTETLELEVSPDPASQILEHTQGAEKLVAELEGDSHKSHGSTSQMPEALQASDLWYCPDGSFVKKIVIRGHGLDKPKLGSCCRVLALGFPFGSGPPEGWTELTMGVGPWREETWGELIEKCLESMCQGEEAELQLPGHSGPPVRLTLASFTQGRDSWELETSEKEALAREERARGTELFRAGNPEGAARCYGRALRLLLTLPPPGPPERTVLHANLAACQLLLGQPQLAAQSCDRVLEREPGHLKALYRRGVAQAALGNLEKATADLKKVLAIDPKNRAAQEELGKVVIQGKNQDAGLAQGLRKMFG

SEQ ID NO: 4382 - protein, 349 aa, Homo sapiens; identical to SEQ ID NO: 4381

SEQ ID NO: 4383 - protein, 349 aa, Homo sapiens; identical to SEQ ID NO: 4381

SEQ ID NO: 4384 - protein, 716 aa, Homo sapiens
MPLPEPSEQEGESVKAGQEPSPKPGTDVIPAAPRKPREFSKLVLLTASDQDEDGVGSKPQEVHCVLSLEMAGPATLASTLQILPVEEQGGVVQPALEMPEQKCSKLDAAAPQSLEFLRTPFGGRLLVLESFLYKQEKAVGDKVYWKCRQHAELGCRGRAITRGLRATVMRGHCHAPDEQGLEARRQREKLPSLALPEGLGEPQGPEGPGGRVEEPLEGVGPWQCPEEPEPTPGLVLSKPALEEEEAPRALSLLSLPPKKRSILGLGQARPLEFLRTCYGGSFLVHESFLYKREKAVGDKVYWTCRDHALHGCRSRAITQGQRVTVMRGHCHQPDMEGLEARRQQEKAVETLQAGQDGPGSQVDTLLRGVDSLLYRRGPGPLTLTRPRPRKRAKVEDQELPTQPEAPDEHQDMDADPGGPEFLKTPLGGSFLVYESFLYRREKAAGEKVYWTCRDQARMGCRSRAITQGRRVTVMRGHCHPPDLGGLEALRQREKRPNTAQRGSPGGPEFLKTPLGGSFLVYESFLYRREKAAGEKVYWTCRDQARMGCRSRAITQGRRVMVMRRHCHPPDLGGLEALRQREHFPNLAQWDSPDPLRPLEFLRTSLGGRFLVHESFLYRKEKAAGEKVYWMCRDQARLGCRSRAITQGHRIMVMRSHCHQPDLAGLEALRQRERLPTTAQQEDPEKIQVQLCFKTCSPESQQIYGDIKDVRLDGESQ

SEQ ID NO: 4385 - protein, 328 aa, Homo sapiens
MPQATSPPLWPLSLHGGKGILWARHSHPPGPPSHHIQDSGRCSLPLPQSPGVTPLPARLSGATPLSPIRLLSSFVPRGPRVIPLTNQARRTLHASLGGCWGRTSDAADTASLKAWQGGPEFLKTPLGGSFLVYESFLYRREKAAGEKVYWTCRDQARMGCRSRAITQGRRVMVMRRHCHPPDLGGLEALRQREHFPNLAQWDSPDPLRPLEFLRTSLGGRFLVHESFLYRKEKAAGEKVYWMCRDQARLGCRSRAITQGHRIMVMRSHCHQPDLAGLEALRQRERLPTTAQQEDPEKIQVQLCFKTCSPESQQIYGDIKDVRLDGESQ

SEQ ID NO: 4386 - protein, 765 aa, Homo sapiens
MPLPEPSEQEGESVKAGQEPSPKPGTDVIPAAPRKPREFSKLVLLTASDQDEDGVGSKPQEVHCVLSLEMAGPATLASTLQILPVEEQGGVVQPALEMPEQKCSKLDAAAPQSLEFLRTPFGGRLLVLESFLYKQEKAVGDKVYWKCRQHAELGCRGRAITRGLRATVMRGHCHAPDEQGLEARRQREKLPSLALPEGLGEPQGPEGPGGRVEEPLEGVGPWQCPEEPEPTPGLVLSKPALEEEEAPRALSLLSLPPKKRSILGLGQARPLEFLRTCYGGSFLVHESFLYKREKAVGDKVYWTCRDHALHGCRSRAITQGQRVTVMRGHCHQPDMEGLEARRQQEKAVETLQAGQDGPGSQVDTLLRGVDSLLYRRGPGPLTLTRPRPRKRAKVEDQELPTQPEAPDEHQDMDADPGGPEFLKTPLGGSFLVYESFLYRREKAAGEKVYWTCRDQARMGCRSRAITQGRRVTVMRGHCHPPDLGGLEALRQREKRPNTAQRGSPGAGLSFQWLFRILQLLGHAPVLLCPSGSSCLPSLPAPHGPCPALSIPLEGGPEFLKTPLGGSFLVYESFLYRREKAAGEKVYWTCRDQARMGCRSRAITQGRRVMVMRRHCHPPDLGGLEALRQREHFPNLAQWDSPDPLRPLEFLRTSLGGRFLVHESFLYRKEKAAGEKVYWMCRDQARLGCRSRAITQGHRIMVMRSHCHQPDLAGLEALRQRERLPTTAQQEDPEKIQVQLCFKTCSPESQQIYGDIKDVRLDGESQ

SEQ ID NO: 4387 - protein, 715 aa, Homo sapiens
MPLPEPSEQEGESVKAGQEPSPKPGTDVIPAAPRKPREFSKLVLLTASDQDEDGVGSKPQEVHCVLSLEMAGPATLASTLQILPVEEQGGVVQPALEMPEQKCSKLDAAPQSLEFLRTPFGGRLLVLESFLYKQEKAVGDKVYWKCRQHAELGCRGRAITRGLRATVMRGHCHAPDEQGLEARRQREKLPSLALPEGLGEPQGPEGPGGRVEEPLEGVGPWQCPEEPEPTPGLVLSKPALEEEEAPRALSLLSLPPKKRSILGLGQARPLEFLRTCYGGSFLVHESFLYKREKAVGDKVYWTCRDHALHGCRSRAITQGQRVTVMRGHCHQPDMEGLEARRQQEKAVETLQAGQDGPGSQVDTLLRGVDSLLYRRGPGPLTLTRPRPRKRAKVEDQELPTQPEAPDEHQDMDADPGGPEFLKTPLGGSFLVYESFLYRREKAAGEKVYWTCRDQARMGCRSRAITQGRRVTVMRGHCHPPDLGGLEALRQREKRPNTAQRGSPGGPEFLKTPLGGSFLVYESFLYRREKAAGEKVYWTCRDQARMGCRSRAITQGRRVMVMRRHCHPPDLGGLEALRQREHFPNLAQWDSPDPLRPLEFLRTSLGGRFLVHESFLYRKEKAAGEKVYWMCRDQARLGCRSRAITQGHRIMVMRSHCHQPDLAGLEALRQRERLPTTAQQEDPEKIQVQLCFKTCSPESQQIYGDIKDVRLDGESQ

SEQ ID NO: 4388 - protein, 325 aa, Homo sapiens
MPRPGRNTYSDQKPPYSYISLTAMAIQSSPEKMLPLSEIYKFIMDRFPYYRENTQRWQNSLRHNLSFNDCFIKIPRRPDQPGKGSFWALHPSCGDMFENGSFLRRRKRFKVLKSDHLAPSKPADAAQYLQQQAKLRLSALAASGTHLPQMPAAAYNLGGVAQPSGFKHPFAIENIIAREYKMPGGLAFSAMQPVPAAYPLPNQLTTMGSSLGTGWPHVYGSAGMIDSATPISMASGDYSAYGVPLKPLCHAAGQTLPAIPVPIKPTPAAVPALPALPAPIPTLLSNSPPSLSPTSSQTATSQSSPATPSETLTSPASALHSVAVH

SEQ ID NO: 4389 - protein, 432 aa, Homo sapiens
MPRPGKSSYSDQKPPYSYISLTAMAIQHSAEKMLPLSDIYKFIMERFPYYREHTQRWQNSLRHNLSFNDCFIKIPRRPDQPGKGSFWALHPDCGDMFENGSFLRRRKRFKVLRADHTHLHAGSTKSAPGAGPGGHLHPHHHHHPHHHHHHHAAAHHHHHHHPPQPPPPPPPPPPHMVHYFHQQPPTAPQPPPHLPSQPPQQPPQQSQPQQPSHPGKMQEAAAVAAAAAAAAAAAVGSVGRLSQFPPYGLGSAAAAAAAAAASTSGFKHPFAIENIIGRDYKGVLQAGGLPLASVMHHLGYPVPGQLGNVVSSVWPHVGVMDSVAAAAAAAAAAGVPVGPEYGAFGVPVKSLCHSASQSLPAMPVPIKPTPALPPVSALQPGLTVPAASQQPPAPSTVCSAAAASPVASLLEPTAPTSAESKGGSLHSVLVHS

SEQ ID NO: 4390 - protein, 416 aa, Homo sapiens
MNLPRAERPRSTPQRSLRDSDGEDGKIDVLGEEEDEDEVEDEEEEARQQFLEQSLQPGLQVARWGGVALPREHIEGGGGPSDPSEFGTKFRAPPRSAAASEDARQPAKPPYSYIALITMAILQNPHKRLTLSGICAFISGRFPYYRRKFPAWQNSIRHNLSLNDCFVKIPREPGHPGKGNYWSLDPASQDMFDNGSFLRRRKRFKRHQLTPGAHLPHPFPLPAAHAALHNPHPGPLLGAPAPPQPVPGAYPNTAPGRRPYALLHPHPLRYLLLSARVYAGAPKKAEGADLATPAPFPCCSPHLVLSLGRRARVWRRHREADASLSALRVLCKGSGERVQGLRRVCPRPRGATATCSSDHQACCIPKPLPLCCKCPPPLLLGQFCSNSSSIRRTAPTAALPPRARCWAGTCRPRRRC

SEQ ID NO: 4391 - protein, 416 aa, Homo sapiens
MNLPRAERPRSTPQRSLRDSDGEDGKIDVLGEEEDEDEVEDEEEEARQQFLEQSLQPGLQVARWGGVALPREHIEGGGGPSDPSEFGTKFRAPPRSAAASEDARQPAKPPYSYIALITMAILQNPHKRLTLSGICAFISGRFPYYRRKFPAWQNSIRHNLSLNDCFVKIPREPGHPGKGNYWSLDPASQDMFDNGSFLRRRKRFKRHQLTPGAHLPHPFPLPAAHAALHNPHPGPLLGAPAPPQPVPGAYPNTAPGRCPYALLHPHPLRYLLLSAPVYAGAPKKAEGADLATPAPFPCCSPHLVLSLGRRARVWRRHREADASLSALRVLCKGSGERVQGLRRVCPRPRGATATCSSDHQACCIPKPLPLCCKCPPPLLLGQFCSNSSSIRRTAPTAALPPRARCWAGTCRPRRRC

SEQ ID NO: 4392 - protein, 417 aa, Homo sapiens
MNLPRAERLRSTPQRSLRDSDGEDGKIDVLGEEEDEDEVEDEEEAASQQFLEQSLQPGLQVARWGGVALPREHIEGGGGPSDPSEFGTKFRAPPRSAAASEDARQPAKPPYSYIALITMAILQNPHKRLTLSGICAFISGRFPYYRRKFPAWQNSIRHNLSLNDCFVKIPREPGHPGKGNYWSLDPASQDMFDNGSFLRRRKRFKRHQLTPGAHLPHPFPLPAAHAALHNPHPGPLLGAPAPPQPVPGAYPNTAPGRRPYALLHPHPLRYLLLSAPVYAGAPKKAEGAALATPAPFPCCSPHLVLSLGRRARVWRRHREADASLSALRVLCKGSGERVQGLRRVCPRPRGATATCSSDHQACCIPRPLPLCCKCPPPPLLGQFCSNSSSIRRRTAPTAALPPRARCWAGTCRPRRPC

SEQ ID NO: 4393 - protein, 379 aa, Homo sapiens
MSSAPEKQQPPHGGGGGGGGGGGAAMDPASSGPSKAKKTNAGIRRPEKPPYSYIALIVMAIQSSPTKRLTLSEIYQFLQSRFPFFRGSYQGWKNSVRHNLSLNECFIKLPKGLGRPGKGHYWTIDPASEFMFEEGSFRRRPRGFRRKCQALKPMYSMMNGLGFNHLPDTYGFQGSAGGLSCPPNSLALEGGLGMMNGHLPGNVDGMALPSHSVPHLPSNGGHSYMGGCGGAAAGEYPHHDSSVPASPLLPTGAGGVMEPHAVYSGSAAAWPPSASAALNSGASYIKQQPLSPCNPAANPLSGSLSTHSLEQPYLHQNSHNAPAELQGIPRYHSQSPSMCDRKEFVFSFNAMASSSMHSAGGGSYYHQQVTYQDIKPCVM

SEQ ID NO: 4394 - protein, 254 aa, Homo sapiens
PALPSTLPHRPAPSTRPGPCPRCLPSRMGPCSGSRLGPPEAESPSQPPKRRKKRYLRHDKPPYTYLAMIALVIQAAPSRRLKLAQIIRQVQAVFPFFREDYEGWKDSIRHNLSSNRCFRKVPKDPAKPQAKGNFWAVDVSLIPAEALRLQNTALCRRWQNGGARGAFAKDLGPYVLHGRPYRPPSPPPPPSEGFSIKSLLGGSGEGAPWPGLAPQSSPVPAGTGNSGEEAVPTPPPPSGGSCPPPTCLSTLPMW

SEQ ID NO: 4395 - protein, 365 aa, Homo sapiens
MGPCSGSRLGPPEAESPSQPPKRRKKRYLRHDKPPYTYLAMIALVIQAAPSRRLKLAQIIRQVQAVFPFFREDYEGWKDSIRHNLSSNRCFRKVPKDPAKPQAKGNFWAVDVSLIPAEALRLQNTALCRRWQNGGARGAFAKDLGPYVLHGRPYRPPSPPPPPSEGFSIKSLLGGSGEGAPWPGLAPQSSPVPAGTGNSGEEAVPTPPLPSSERPLWPLCPLPGPTRVEGETVQGGAIGPSTLSPEPRAWPLHLLQGTAVPGGRSSGGHRASLWGQLPTSYLPIYTPNVVMPLAPPPTSCPQCPSTSPAYWGVAPETRGPPGLLCDLDALFQGVPPNKSIYDVWVSHPRDLAAPGPGWLLSWCSL

SEQ ID NO: 4396 - protein, 318 aa, Homo sapiens
MATYCDDLGPSSAPPGQAQATAHPPGYEPGDLGAVGGGPLLWVNAPALSPKSYASGPGPAPPYAAPSYGAPGPLLGAPGGLAGADLAWLSLSGQQELLRLVRPPYSYSALIAMAIQSAPLRKLTLSQIYQYVAGNFPFYKRSKAGWQNSIRHNLSLNDCFKKVPRDEDDPGKGNYWTLDPNCEKMFDNGNFRRKRKRRAEASAAVRSGARSVGGAEAPALEPPSAACLDLQASPSPSAPEAATCFSGFASAMSALAGGLGTFPGGLAGDFSFGRRPPTVATHAPQTLNPSPGFAPGHQTAAAGFRLSHLLYSREGTEV

SEQ ID NO: 4397 - protein, 574 aa, Homo sapiens
MASDLESSLTSIDWLPQLTLRATIEKLGSASQAGPPGSSRKCSPGSPTDPNATLSKDEAAVHQDGKPRYSYATLITYAINSSPAKKMTLSEIYRWICDNFPYYKNAGIGWKNSIRHNLSLNKCFRKVPRPRDDPGKGSYWTIDTCPDISRKRRHPPDDDLSQDSPEQEASKSPRGGVAGSGEASLPPEGNPQMSLQSPTSIASYSQGTGSVDGGAVAAGASGRESAEGPPPLYNTNHDFKFSYSEINFQDLSWSFRNLYKSMLEKSSSSSQHGFSSLLGDIPPSNNYYMYQQQQPPPPQQQQQQQQPPQPPPQQSQPQQQQAPAQGPSAVGGAPPLHTPSTDGCTPPGGKQAGAEGYGPPPVMAMHPPPLQHGGYHPHQHHPHSHPAQQPPPPQPQAQGQAPINNTGFAFPSDWCSNIDSLKESFKMVNRLNWSSIEQSQFSELMESLRQAEQKNWTLDQHHIANLCDSLNHFLTQTGHVPPQGGTHRPPAPARIADSCALTSGKQESAMSQVNSYGHPQAPHLYPGPSPMYPIPTQDSAGYNRPAHHMVPRPSVPPPGANEEIPDDFDWDLIT

SEQ ID NO: 4398 - protein, 526 aa, Homo sapiens
MASDLESSLTSIDWLPQLTLRATIEKLGSASQAGPPGSSRKCSPGSPTDPNATLSKDEAAVHQDGKPRYSYATLITYAINSSPAKKMTLSEIYRWICDNFPYYKNAGIGWKNSIRHNLSLNKCFRKVPRPRDDPGKGSYWTIDTCPDISRKRRHPPDDDLSQDSPEQEASKSPRGGVAGSGEASLPPEGNPQMSLQSPTSIASYSQGTGSVDGGAVAAGASGRESAEGPPPLYNTNHDFKFSYSEINFQDLSWSFRNLYKSMLEKSSSSSQHGFSSLLGDIPPSNNYYMYQQQQPPPPQQQQQQQQPPQPPPQQSQPQQQQAPAQGPSAVGGAPPLHTPSTDGCTPPGGKQAGAEGYGPPPVMAMHPPPLQHGGYHPHQHHPHSHPAQQPPPPQPQAQGQAPINNTGFAFPSDWCSNIDSLKESFKMVNRLNWSSIEQSQFSELMESLRQAEQKNWTLDQHHIANLCDSLNHFLTQTGHVPPQGGTHRPPAPARIADSCALTSGKQESAMSQGTAPSQLPWRWRLC

SEQ ID NO: 4399 - protein, 622 aa, Homo sapiens
MGLYGQACPSVTSLRMTSELESSLTSMDWLPQLTMRAAIQKSDATQNAHGTGISKKNALLDPNTTLDQEEVQQHKDGKPPYSYASLITFAINSSPKKKMTLSEIYQWICDNFPYYREAGSGWKNSIRHNLSLNKCFLKVPRSKDDPGKGSYWAIDTNPKEDVLPTRPKKRARSVERASTPYSIDSDSLGMECIISGSASPTLAINTVTNKVTLYNTDQDGSDSPRSSLNNSLSDQSLASVNLNSVGSVHSYTPVTSHPESVSQSLTPQQQPQYNLPERDKQLLFSEYNFEDLSASFRSLYKSVFEQSLSQQGLMNIPSESSQQSHTSCTYQHSPSSTVSTHPHSNQSSLSNSHGSGLNTTGSNSVAQVSLSHPQMHTQPSPHPPHRPHGLPQHPQRSPHPAPHPQQHSQLQSPHPQHPSPHQHIQHHPNHQHQTLTHQAPPPPQQVSCNSGVSNDWYATLDMLKESCRIASSVNWSDVDLSQFQGLMESMRQADLKNWSLDQVQFADLCSSLNQFFTQTGLIHSQSNVQQNVCHGAMHPTKPSQHIGTGNLYIDSRQNLPPSVMPPPGYPHIPQALSTPGTTMAGHHRAMNQQHMMPSQAFQMRRSLPPDDIQDDFDWDSIV

SEQ ID NO: 4400 - protein, 588 aa, Homo sapiens
MGLYGQACPSVTSLRMTSELESSLTSMDWLPQLTMRAAIQKSDATQNAHGTGISKKNALLDPNTTLDQEEVQQHKDGKPPYSYASLITFAINSSPKKKMTLSEIYQWICDNFPYYREAGSGWKNSIRHNLSLNKCFLKVPRSKDDPGKGSYWAIDTNPKEDVLPTRPKKRARSVERVTLYNTDQDGSDSPRSSLNNSLSDQSLASVNLNSVGSVHSYTPVTSHPESVSQSLTPQQQPQYNLPERDKQLLFSEYNFEDLSASFRSLYKSVFEQSLSQQGLMNIPSESSQQSHTSCTYQHSPSSTVSTHPHSNQSSLSNSHGSGLNTTGSNSVAQVSLSHPQMHTQPSPHPPHRPHGLPQHPQRSPHPAPHPQQHSQLQSPHPQHPSPHQHIQHHPNHQHQTLTHQAPPPPQQVSCNSGVSNDWYATLDMLKESCRIASSVNWSDVDLSQFQGLMESMRQADLKNWSLDQVQFADLCSSLNQFFTQTGLIHSQSNVQQNVCHGAMHPTKPSQHIGTGNLYIDSRQNLPPSVMPPPGYPHIPQALSTPGTTMAGHHRAMNQQHMMPSQAFQMRRSLPPDDIQDDFDWDSIV

SEQ ID NO: 4401 - protein, 136 aa, Homo sapiens
MESMRQADLKNWSLDQVQFADLCSSLNQFFTQTGLIHSQSNVQQNVCHGAMHPTKPSQHIGTGNLYIDSRQNLPPSVMPPPGYPHIPQALSTPGTTMAGHHRAMNQQHMMPSQAFQMRRSLPPDDIQDDFDWDSIV

SEQ ID NO: 4402 - protein, 622 aa, Homo sapiens; identical to SEQ ID NO: 4399

SEQ ID NO: 4403 - protein, 622 aa, Homo sapiens; identical to SEQ ID NO: 4399

SEQ ID NO: 4404 - protein, 87 aa, Homo sapiens
MECIISGSASPTLAINTVTNKVTLYNTDQDGSDSPRSSLNNSLSDQSLASVNLNSVGSVHSYTPVTSHPESVSQSLTPQQQPQYNLP

SEQ ID NO: 4405 - protein, 382 aa, Homo sapiens
MGLYGQACPSVTSLRMTSELESSLTSMDWLPQLTMRAAIQKSDATQNAHGTGISKKNALLDPNTTLDQEEVQQHKDGKPPYSYASLITFAINSSPKKKMTLSEIYQWICDNFPYYREAGSGWKNSIRHNLSLNKCFLKVPRSKDDPGKGSYWAIDTNPKEDVLPTRPKKRARSVERVTLYNTDQDGSDSPRSSLNNSLSDQSLASVNLNSVGSVHSYTPVTSHPESVSQSLTPQQQPQYNLPERDKQLLFSEYNFEDLSASFRSLYKSVFEQSLSQQGLMNIPSESSQQSHTSCTYQHSPSSTVSTHPHSNQSSLSNSHGSGLNTTGSNSVAQVSLSHPQMHTQPSPHPPHRPHGLPQHPQRSPHPAPHPQQHSQLQSPHPQ

SEQ ID NO: 4406 - protein, 125 aa, Homo sapiens
ATQNAHGTGISKKNALLDPNTTLDQEEVQQHKDGKPPYSYASLITFAINSSPKKKMTLSEIYQWICDNFPYYREAGSGWKNSIRHNLSLNKCFLKVPRSKDDPGKVGFIFLKQLNSSVCHLSCLN

SEQ ID NO: 4407 - protein, 622 aa, Homo sapiens; identical to SEQ ID NO: 4399

SEQ ID NO: 4408 - protein, 340 aa, Homo sapiens
MMCHPLDQLATRTQKKSATSKPPYSFSLLIYMAIEHSPNKCLPVKEIYSWILDHFPYFATAPTGWKNSVRHNLSLNKCFQKVERSHGKVNGKGSLWCVDPEYKPNLIQALKKQPFSSASSQNGSLSPHYLSSVIKQNQVRNLKESDIDAAAAMMLLNTSIEQGILECEKPLPLKTALQKKRSYGNAFHHPSAVRLQESDSLATSIDPKEDHNYSASSMAAQRCASRSSVSSLSSVDEVYEFIPKNSHVGSDGSEGFHSEEDTDVDYEDDPLGDSGYASQPCAKISEKGQSGKKMRKQTCQEIDEELKEAAGSLLHLAGIRTCLGSLISTAKTQNQKQRKK

SEQ ID NO: 4409 - protein, 431 aa, Homo sapiens
MGPVIGMTPDKRAETPGAEKIAGLSQIYKMGSLPEAVDAARPKATLVDSESADDELTNLNWLHESTNLLTNFSLGSEGLPIVSPLYDIEGDDVPSFGPACYQNPEKKSATSKPPYSFSLLIYMAIEHSPNKCLPVKEIYSWILDHFPYFATAPTGWKNSVRHNLSLNKCFQKVERSHGKVNGKGSLWCVDPEYKPNLIQALKKQPFSSASSQNGSLSPHYLSSVIKQNQVRNLKESDIDAAAAMMLLNTSIEQGILECEKPLPLKTALQKKRSYGNAFHHPSAVRLQESDSLATSIDPKEDHNYSASSMAAQRCASRSSVSSLSSVDEVYEFIPKNSHVGSDGSEGFHSEEDTDVDYEDDPLGDSGYASQPCAKISEKGQSGKKMRKQTCQEIDEELKEAAGSLLHLAGIRTCLGSLISTAKTQNQKQRKK

SEQ ID NO: 4410 - protein, 246 aa, Homo sapiens
MGPVIGMTPDKRAETPGAEKIAGLSQIYKMGSLPEAVDAARPKATLVDSESADDELTNLNWLHESTNLLTNFSLGSEGLPIVSPLYDIEGDDVPSFGPACYQNPEKKSATSKPPYSFSLLIYMAIEHSPNKCLPVKEIYSWILDHFPYFATAPTGWKNSVRHNLSLNKCFQKVERSHGKVNGKGSLWCVDPEYKPNLIQALKKQPFSSASSQNGSLSPHYLSSVIKQNQVRNLKESDIDAAAAMML

SEQ ID NO: 4411 - protein, 292 aa, Homo sapiens
MGNELFLAFTTSHLPLAEQKLARYKLRIVKPPKLPLEKKPNPDKDGPDYEPNLWMWVNPNIVYPPGKLEVSGRRKREDLTSTLPSSQPPQKEEDASCSEAAGVESLSQSSSKRSPPRKRFAFSPSTWELTEEEEAEDQEDSSSMALPSPHKRAPLQSRRLRQASSQAGRLWSRPPLNYFHLIALALRNSSPCGLNVQQIYSFTRKHFPFFRTAPEGWKNTVRHNLCFRDSFEKVPVSMQGGASTRPRSCLWKLTEEGHRRFAEEARALASTRLESIQQCMSQPDVMPFLFDL

SEQ ID NO: 4412 - protein, 311 aa, Homo sapiens
MDLKLKDCEFWYSLHGQVPGLLDWDMRNELFLPCTTDQCSLAEQILAKYRVGVMKPPEMPQKRRPSPDGDGPPCEPNLWMWVDPNILCPLGSQEAPKPSGKEDLTNISPFPQPPQKDEGSNCSEDKVVESLPSSSSEQSPLQKQGIHSPSDFELTEEEAEEPDDNSLQSPEMKCYQSQKLWQINNQEKSWQRPPLNCSHLIALALRNNPHCGLSVQEIYNFTRQHFPFFWTAPDGWKSTIHYNLCFLDSFEKVPDSLKDEDNARPRSCLWKLTKEGHRRFWEETRVLAFAQRERIQECMSQPELLTSLFDL

SEQ ID NO: 4413 - protein, 330 aa, Homo sapiens
MQQQPLPGPGAPTTEPTKPPYSYIALIAMAIQSSPGQRATLSGIYRYIMGRFAFYRHNRPGWQNSIRHNLSLNECFVKVPRDDRKPGKGSYWTLDPDCHDMFEHGSFLRRRRRFTRQTGAEGTRGPAKARRGPLRATSQDPGVPNATTGRQCSFPPELPDPKGLSFGGLVGAMPASMCPATTDGRPRPPMEPKEISTPKPACPGELPVATSSSSCPAFGFPAGFSEAESFNKAPTPVLSPESGIGSSYQCRLQALNFCMGADPGLEHLLASAAPSPAPPTPPGSLRAPLPLPTDHKEPWVAGGFPVQGGSGYPLGLTPCLYRTPGMFFFE

SEQ ID NO: 4414 - protein, 318 aa, Homo sapiens
MNRFGTRLVGATATSSPPPKARSNENLDKIDMSLDDIIKLNRKEGKKQNFPRLNRRLLQQSGAQQFRMRVRWGIQQNSGFGKTSLNRRGRVMPGKRRPNGVITGLAARKTTGIRKGISPMNRPPLSDKNIEQYFPVLKRKANLLRQNEGQRKPVAVLKRPSQLSRKNNIPANFTRSGNKLNHQKDTRQATFLFRRGLKVQAQLNTEQLLDDVVAKRTRQWRTSTTNGGILTVSIDNPGAVQCPVTQKPRLTRTAVPSFLTKREQSDVKKVPKGVPLQFDINSVGKQTGMTLNERFGILKEQRATLTYNKGGSRFVTVG

SEQ ID NO: 4415 - protein, 227 aa, Homo sapiens
MPGKRRPNGVITGLAARKTTGIRKGISPMNRPPLSDKNIEQYFPVLKRKANLLRQNEGQRKPVAVLKRPSQLSRKNNIPANFTRSGNKLNHQKDTRQATFLFRRGLKVQAQLNTEQLLDDVVAKRTRQWRTSTTNGGILTVSIDNPGAVQCPVTQKPRLTRTAVPSFLTKREQSDVKKVPKGVPLQFDINSVGKQTGMTLNERFGILKEQRATLTYNKGGSRFVTVG

SEQ ID NO: 4416 - protein, 292 aa, Homo sapiens
MEPSVIMGNDIIKLNRKEGKKQNFPRLNRRLLQQSGAQQFRMRVRWGIQQNSGFGKTSLNRRGRVMPGKRRPNGVITGLAARKTTGIRKGISPMNRPPLSDKNIEQYFPVLKRKANLLRQNEGQRKPVAVLKRPSQLSRKNNIPANFTRSGNKLNHQKDTRQATFLFRRGLKVQAQLNTEQLLDDVVAKRTRQWRTSTTNGGILTVSIDNPGAVQCPVTQKPRLTRTAVPSFLTKREQSDVKKVPKGVPLQFDINSVGKQTGMTLNERFGILKEQRATLTYNKGGSRFVTVG

SEQ ID NO: 4417 - protein, 278 aa, Homo sapiens
MGKGNEDPDLHCSSIQCSTDQPPFQQISFTEKGSDEKKPFKEKGKTAFSHSSEKHIQRQGSEPNPNKENSEETKLKAGNSTAGSEPESSSYRENCRKRKMSSKDSCQDTAGNCPEKECSLSLNKKSRSSTPVHNSEIQETCDAHHRGRSRACTGRSKRHRSRALGVQTPSIRKSLVTSVRAMSEAVYQDLAQVWAQQIHSPLTCEQLTLLTRLRGPLCAQVQTLYSMATQAAYVFPAESWLVPATLPGPGESALDREAHPFPGQEITETVSGSDEAKL

SEQ ID NO: 4418 - protein, 279 aa, Homo sapiens
MGKGNEDPDLHCSSIQCSTDQPPFQQISFTEKGSDEKKPFKEKGKTAFSHSSEKHIQRQAGSEPNPNKENSEETKLKAGNSTAGSEPESSSYRENCRKRKMSSKDSCQDTAGNCPEKECSLSLNKKSRSSTPVHNSEIQETCDAHHRGRSRACTGRSKRHRSRALGVQTPSIRKSLVTSVRAMSEAVYQDLAQVWAQQIHSPLTCEQLTLLTRLRGPLCAQVQTLYSMATQAAYVFPAESWLVPATLPGPGESALDREAHPFPGQEITETVSGSDEAKL

SEQ ID NO: 4419 - protein, 847 aa, Homo sapiens
MGKKGKVGKSRRDKFYHLAKETGYRSRSAFKLIQLNRRFQFLQKARALLDLCAAPGGWLQVAAKFMPVSSLIVGVDLVPIKPLPNVVTLQQDITTERCRQALRKELKTWKVDVVLNDGAPNVGASWVHDAYSQAHLTLMALRLACDFLARGGSFITKVFRSRDYQPLLWIFQQLFRRVQATKPQASRHESAEIFVVCQGFLAPDKVDSKFFDPKFAFKEVEVQAKTVTELVTKKKPKAEGYAEGDLTLYHRTSVTDFLRAANPVDFLSKASEIMVDDEELAQHPATTEDIRVCCQDIRVLGRKELRSLLNWRTKLRRYVAKKLKEQAKALDISLSSGEEDEGDEEDSTAGTTKQPSKEEEEEEEEEQLNQTLAEMKAQEVAELKRKKKKLLREQRKQRERVELKMDLPGVSIADEGETGMFSLSTIRGHQLLEEVTQGDMSAADTFLSDLPRDDIYVSDVEDDGDDTSLDSDLDPEELAGVRGHQGLRDQKRMRLTEVQDDKEEEEEENPLLVPLEEKAVLQEEQANLWFSKGSFAGIEDDADEALEISQAQLLFENRRKGRQQQQKQQLPQTPPSCLKTEIMSPLYQDEAPKGTEASSGTEAATGLEGEEKDGISDSDSSTSSEEEESWEPLRGKKRSRGPKSDDDGFEIVPIEDPAKHRILDPEGLALGAVIASSKKAKRDLIDNSFNRYTFNEDEGELPEWFVQEEKQHRIRQLPVGKKEVEHYRKRWREINARPIKKVAEAKARKKRRMLKRLEQTRKKAEAVVNTVDISEREKVAQLRSLYKKAGLGKEKRHVTYVVAKKGVGRKVRRPAGVRGHFKVVDSRMKKDQRAQQRKEQKKKHKRK

SEQ ID NO: 4420 - protein, 476 aa, Homo sapiens
MADSKEGVLPLTAASTAPISFGFTRTSARRRLADSGDGAGPSPEEKDFLKTVEGRELQSVKPQEAPKELVIPLIQNGHRRQPPARPPGPSTDTGALADGVVSQAVKELIAESKKSLEERENAGVDPTLAIPMIQKGCTPSGEGADSEPRAETVPEEANYEAVPVEAYGLAMLRGMGWKPGEGIGRTFNQVVKPRVNSLRPKGLGLGANLTEAQALTPTGPSRMPRPDEEQEKDKEDQPQGLVPGGAVVVLSGPHRGLYGKVEGLDPDNVRAMVRLAVGSRVVTVSEYYLRPVSQQEFDKNTLDLRQQNGTASSRKTLWNQELYIQQDNSERKRKHLPDRQDGPAAKSEKAAPRSQHWLHRDLRVRFVDNMYKGGQYYNTKMIIEDVLSPDTCVCRTDEGRVLEGLREDMLETLVPKAEGDRVMVVLGPQTGRVGHLLSRDRARSRALVQLPRENQVVELHYDAICQYMGPSDTDDD

SEQ ID NO: 4421 - protein, 931 aa, Homo sapiens
MAARDSDSEEDLVSYGTGLEPLEEGERPKKPIPLQDQTVRDEKGRYKRFHGAFSGGFSAGYFNTVGSKEGWTPSTFVSSRQNRADKSVLGPEDFMDEEDLSEFGIAPKAIVTTDDFASKTKDRIREKARQLAAATAPIPGATLLDDLITPAKLSVGFELLRKMGWKEGQGVGPRVKRRPRRQKPDPGVKIYGCALPPGSSEGSEGEDDDYLPDNVTFAPKDVTPVDFTPKDNVHGLAYKGLDPHQALFGTSGEHFNLFSGGSERAGDLGEIGLNKGRKLGISGQAFGVGALEEEDDDIYATETLSKYDTVLKDEEPGDGLYGWTAPRQYKNQKESEKDLRYVGKILDGFSLASKPLSSKKIYPPPELPRDYRPVHYFRPMVAATSENSHLLQVLSESAGKATPDPGTHSKHQLNASKRAELLGETPIQGSATSVLEFLSQKDKERIKEMKQATDLKAAQLKARSLAQNAQSSRAQLSPAAAAGHCSWNMALGGGTATLKASNFKPFAKDPEKQKRYDEFLVHMKQGQKDALERCLDPSMTEWERGRERDEFARAALLYASSHSTLSSRFTHAKEEDDSDQVEVPRDQENDVGDKQSAVKMKMFGKLTRDTFEWHPDKLLCKRFNVPDPYPDSTLVGLPRVKRDKYSVFNFLTLPETASLPTTQASSEKVSQHRGPDKSRKPSRWDTSKHEKKEDSISEFLSLARSKAEPPKQQSSPLVNKEEEHAPELSANQTVNKDVDAQAEGEGSRPSMDLFRAIFASSSDEKSSSSEDEQGDSEDDQAGSGEANFQSSQDTDLGETSSVAHALVPAPQEPPPSFPIQKMQIDEREEFGPRLPPVFCPNARQTLEVPQKEKHKKNKDKHKAKKEHRRKKEKKKKHRKHKHKGKQKNKKPEKSSSSESSDSSDSQSDEETADVSPQELLRRLKSLPLRRQ

SEQ ID NO: 4422 - protein, 327 aa, Homo sapiens
MPALLERPKLSNAMARALHRHIMMERERKRQEEEEVDKMMEQKMKEEQERRKKKEMEERMSLEETKEQILKLEEKLLALQEEKHQLFLQLKKVLHEEEKRRRKEQSDLTTLTSAAYQQSLTVHTGTHLLSMQGSPGGHNRPGTLMAADRAKQMFGPQVLTTRHYVGSAAAFAGTPEHGQFQGSPGGAYGTAQPPPHYGPTQPAYSPSQQLRAPSAFPAVQYLSQPQPQPYAVHGHFQPTQTGFLQPGGALSLQKQMEHANQQTGFSDSSSLRPMHPQALHPAPGLLASPQLPVQMQPAGKSGFAATSQPGPRLPFIQHSQNPRFYHK

SEQ ID NO: 4423 - protein, 327 aa, Homo sapiens; identical to SEQ ID NO: 4422

SEQ ID NO: 4424 - protein, 327 aa, Homo sapiens; identical to SEQ ID NO: 4422

SEQ ID NO: 4425 - protein, 303 aa, Homo sapiens
MPALLERPKLSNAMARALHRHIMMERERKRQEEEEVDKMMEQKMKEEQERRKKKEMEERMSLEETKEQILKLEEKLLALQEEKHQLFLQLKKVLHEEEKRRRKEQSDLTTLTSAAYQQSLTVHTGTHLLSMQGSPGGHNRPGTLMAADRAKQMFGPQVLTTRHYVGSAAAFAGTPEHGQFQGSPGGAYGTAQPPPHYGPTQPAYSPSQQLRAPSAFPAVQYLSQPQPQPYAVHGHFQPTQTGFLQPGGALSLQKQMEHANQQTGFSDSSSLRPMHPQALHPAPGLLASPQLPVQMQPAGKTAP

SEQ ID NO: 4426 - protein, 661 aa, Homo sapiens
MSKRLRSSEVCADCSGPDPSWASVNRGTFLCDECCSVHRSLGRHISQVRHLKHTPWPPTLLQMVETLYNNGANSIWEHSLLDPASIMSGRRKANPQDKVHPNKAEFIRAKYQMLAFVHRLPCRDDDSVTAKDLSKQLHSSVRTGNLETCLRLLSLGAQANFFHPEKGNTPLHVASKAGQILQAELLAVYGADPGTQDSSGKTPVDYARQGGHHELAERLVEIQYELTDRLAFYLCGRKPDHKNGQHFIIPQMADSSLDLSELAKAAKKKLQSLSNHLFEELAMDVYDEVDRRETDAVWLATQNHSALVTETTVVPFLPVNPEYSSTRNQGRQKLARFNAHEFATLVIDILSDAKRRQQGSSLSGSKDNVELILKTINNQHSVESQDNDQPDYDSVASDEDTDLETTASKTNRQKSLDSDLSDGPVTVQEFMEVKNALVASEAKIQQLMKIGRSALVTSSSSLPSFPSTLSWSRDESARRASRLEKQNSTPESDYDNTPNDMEPDGMGSSRKGRQRSMVWPGDGLVPDTAEPHVAPSPTLPSTEDVIRKTEQITKNIQELLRAAQENKHDSYIPCSERIHVAVTEMAALFPKKPKSDMVRTSLRLLTSSAYRLQSECKKTLPGDPGSPTDVQLVTQQVIQCAYDIAKAAKQLVTITTKENNN

SEQ ID NO: 4427 - protein, 649 aa, Homo sapiens
MSKRLRSSEVCADCSGPDPSWASVNRGTFLCDECCSVHRSLGRHISQVRHLKHTPWPPTLLQMVETLYNNGANSIWEHSLLDPASIMSGRRKANPQDKVHPNKAEFIRAKYQMLAFVHRLPCRDDDSVTAKDLSKQLHSSVRTGNLETCLRLLSLGAQANFFHPEKGNTPLHVASKAGQILQAELLAVYGADPGTQDSSGKTPVDYARQGGHHELAERLVEIQYELTDRLAFYLCGRKPDHKNGQHFIIPQMADSSLDLSELAKAAKKKLQSLSNHLFEELAMDVYDEVDRRETDAVWLATQNHSALVTETTVVPFLPVNPEYSSTRNQGQPKKSLDSDLSDGPVTVQEFMEVKNALVASEAKIQQLMKVNNNLSDELRIMQKKLQTLQSENSNLRKQATTNVYQVQTGSEYTDTSNHSSLKRRPSARGSRPMSMYETGSGQKPYLPMGEASRPEESRMRLQPFPAHASRLEKQNSTPESDYDNTPNDMEPDGMGSSRKGRQRSMVWPGDGLVPDTAEPHVAPSPTLPSTEDVIRKTEQITKNIQELLRAAQENKHDSYIPCSERIHVAVTEMAALFPKKPKSDMVRTSLRLLTSSAYRLQSECKKTLPGDPGSPTDVQLVTQQVIQCAYDIAKAAKQLVTITTKENNN

SEQ ID NO: 4428 - protein, 681 aa, Homo sapiens [sequence omitted]

SEQ ID NO: 4429 - protein, 759 aa, Homo sapiens
MSKRLRSSEVCADCSGPDPSWASVNRGTFLCDECCSVHRSLGRHISQVRHLKHTPWPPTLLQMVETLYNNGANSIWEHSLLDPASIMSGRRKANPQDKVHPNKAEFIRAKYQMLAFVHRLPCRDDDSVTAKDLSKQLHSSVRTGNLETCLRLLSLGAQANFFHPEKGNTPLHVASKAGQILQAELLAVYGADPGTQDSSGKTPVDYARQGGHHELAERLVEIQYELTDRLAFYLCGRKPDHKNGQHFIIPQMADSSLDLSELAKAAKKKLQSLSNHLFEELAMDVYDEVDRRETDAVWLATQNHSALVTETTVVPFLPVNPEYSSTRNQGRQKLARFNAHEFATLVIDILSDAKRRQQGSSLSGSKDNVELILKTINNQHSVESQDNDQPDYDSVASDEDTDLETTASKTNRQKSLDSDLSDGPVTVQEFMEVKNALVASEAKIQQLMKVNNNLSDELRIMQKKLQTLQSENSNLRKQATTNVYQVQTGSEYTDTSNHSSLKRRPSARGSRPMSMYETGSGQKPYLPMGEASRPEESRMRLQPFPAHIGRSALVTSSSSLPSFPSTLSWSRDESARRASRLEKQNSTPESDYDNTPNDMEPDGMGSSRKGRQRSMVWPGDGLVPDTAEPHVAPSPTLPSTEDVIRKTEQITKNIQELLRAAQENKHDSYIPCSERIHVAVTEMAALFPKKPKSDMVRTSLRLLTSSAYRLQSECKKTLPGDPGSPTDVQLVTQQVIQCAYDIAKAAKQLVTITTKENNN

SEQ ID NO: 4430 - protein, 646 aa, Homo sapiens
MSKRLRSSEVCADCSGPDPSWASVNRGTFLCDECCSVHRSLGRHISQVRHLKHTPWPPTLLQMVETLYNNGANSIWEHSLLDPASIMSGRRKANPQDKVHPNKAEFIRAKYQMLAFVHRLPCRDDDSVTAKDLSKQLHSSVRTGNLETCLRLLSLGAQANFFHPEKGNTPLHVASKAGQILQAELLAVYGADPGTQDSSGKTPVDYARQGGHHELAERLVEIQYELTDRLAFYLCGRKPDHKNGQHFIIPQMADSSLDLSELAKAAKKKLQSLSNHLFEELAMDVYDEVDRRETDAVWLATQNHSALVTETTVVPFLPVNPEYSSTRNQGRQKLARFNAHEFATLVIDILSDAKRRQQGSSLSGSKDNVELILKTINNQHSVESQDNDQPDYDSVASDEDTDLETTASKTNRQKSLDSDLSDGPVTVQEFMEVKNALVASEAKIQQLMKVNNNLSDELRIMQKKASRLEKQNSTPESDYDNTPNDMEPDGMGSSRKGRQRSMVWPGDGLVPDTAEPHVAPSPTLPSTEDVIRKTEQITKNIQELLRAAQENKHDSYIPCSERIHVAVTEMAALFPKKPKSDMVRTSLRLLTSSAYRLQSECKKTLPGDPGSPTDVQLVTQQVIQCAYDIAKAAKQLVTITTKENNN

SEQ ID NO: 4431 - protein, 709 aa, Homo sapiens
MSKRLRSSEVCADCSGPDPSWASVNRGTFLCDECCSVHRSLGRHISQVRHLKHTPWPPTLLQMVETLYNNGANSIWEHSLLDPASIMSGRRKANPQDKVHPNKAEFIRAKYQMLAFVHRLPCRDDDSVTAKDLSKQLHSSVRTGNLETCLRLLSLGAQANFFHPEKGNTPLHVASKAGQILQAELLAVYGADPGTQDSSGKTPVDYARQGGHHELAERLVEIQYELTDRLAFYLCGRKPDHKNGQHFIIPQMADSSLDLSELAKAAKKKLQSLSNHLFEELAMDVYDEVDRRETDAVWLATQNHSALVTETTVVPFLPVNPEYSSTRNQGRQKLARFNAHEFATLVIDILSDAKRRQQGSSLSGSKDNVELILKTINNQHSVESQDNDQPDYDSVASDEDTDLETTASKTNRQKLQTLQSENSNLRKQATTNVYQVQTGSEYTDTSNHSSLKRRPSARGSRPMSMYETGSGQKPYLPMGEASRPEESRMRLQPFPAHIGRSALVTSSSSLPSFPSTLSWSRDESARRASRLEKQNSTPESDYDNTPNDMEPDGMGSSRKGRQRSMVWPGDGLVPDTAEPHVAPSPTLPSTEDVIRKTEQITKNIQELLRAAQENKHDSYIPCSERIHVAVTEMAALFPKKPKSDMVRTSLRLLTSSAYRLQSECKKTLPGDPGSPTDVQLVTQQVIQCAYDIAKAAKQLVTITTKENNN

SEQ ID NO: 4432 - protein, 729 aa, Homo sapiens
MSKRLRSSEVCADCSGPDPSWASVNRGTFLCDECCSVHRSLGRHISQVRHLKHTPWPPTLLQMVETLYNNGANSIWEHSLLDPASIMSGRRKANPQDKVHPNKAEFIRAKYQMLAFVHRLPCRDDDSVTAKDLSKQLHSSVRTGNLETCLRLLSLGAQANFFHPEKGNTPLHVASKAGQILQAELLAVYGADPGTQDSSGKTPVDYARQGGHHELAERLVEIQYELTDRLAFYLCGRKPDHKNGQHFIIPQMADSSLDLSELAKAAKKKLQSLSNHLFEELAMDVYDEVDRRETDAVWLATQNHSALVTETTVVPFLPVNPEYSSTRNQGRQKLARFNAHEFATLVIDILSDAKRRQQGSSLSGSKDNVELILKTINNQHSVESQDNDQPDYDSVASDEDTDLETTASKTNRQKSLDSDLSDGPVTVQEFMEVKNALVASEAKIQQLMKVNNNLSDELRIMQKKLQTLQSENSNLRKQATTNVYQVQTGSEYTDTSNHSSLKRRPSARGSRPMSMYETGSGQKPYLPMGEASRPEESRMRLQPFPAHASRLEKQNSTPESDYDNTPNDMEPDGMGSSRKGRQRSMVWPGDGLVPDTAEPHVAPSPTLPSTEDVIRKTEQITKNIQELLRAAQENKHDSYIPCSERIHVAVTEMAALFPKKPKSDMVRTSLRLLTSSAYRLQSECKKTLPGDPGSPTDVQLVTQQVIQCAYDIAKAAKQLVTITTKENNN

SEQ ID NO: 4433 - protein, 681 aa, Homo sapiens
MSKRLRSSEVCADCSGPDPSWASVNRGTFLCDECCSVHRSLGRHISQVRHLKHTPWPPTLLQMVETLYNNGANSIWEHSLLDPASIMSGRRKANPQDKVHPNKAEFIRAKYQMLAFVHRLPCRDDDSVTAKDLSKQLHSSVRTGNLETCLRLLSLGAQANFFHPEKGNTPLHVASKAGQILQAELLAVYGADPGTQDSSGKTPVDYARQGGHHELAERLVEIQYELTDRLAFYLCGRKPDHKNGQHFIIPQMADRRLSLDLSELAKAAKKKLQSLSNHLFEELAMDVYDEVDRRETDAVWLATQNHSALVTETTVVPFLPVNPEYSSTRNQGRQKLARFNAHEFATLVIDILSDAKRRQQGSSLSGSKDNVELILKTINNQHSVESQDNDQPDYDSVASDEDTDLETTASKTNRQKLQTLQSENSNLRKQATTNVYQVQTGSEYTDTSNHSSLKRRPSARGSRPMSMYETGSGQKPYLPMGEASRPEESRMRLQPFPAHASRLEKQNSTPESDYDNTPNDMEPDGMGSSRKGRQRSMVWPGDGLVPDTAEPHVAPSPTLPSTEDVIRKTEQITKNIQELLRAAQENKHDSYIPCSERIHVAVTEMAALFPKKPKSDMVRTSLRLLTSSAYRLQSECKKTLPGDPGSPTDVQLVTQQVIQCAYDIAKAAKQLVTITTKENNN

SEQ ID NO: 4434 - protein, 601 aa, Homo sapiens
MVETLYNNGANSIWEHSLLDPASIMSGRRKANPQDKVHPNKAEFIRAKYQMLAFVHRLPCRDDDSVTAKDLSKQLHSSVRTGNLETCLRLLSLGAQANFFHPEKGNTPLHVASKAGQILQAELLAVYGADPGTQDSSGKTPVDYARQGGHHELAERLVEIQYELTDRLAFYLCGRKPDHKNGQHFIIPQMADSSLDLSELAKAAKKKLQSLSNHLFEELAMDVYDEVDRRETDAVWLATQNHSALVTETTVVPFLPVNPEYSSTRNQGRQKLARFNAHEFATLVIDILSDAKRRQQGSSLSGSKDNVELILKTINNQHSVESQDNDQPDYDSVASDEDTDLETTASKTNRQKSLDSDLSDGPVTVQEFMEVKNALVASEAKIQQLMKVNNNLSDELRIMQKKLQTLQSENSNLRKQATTNVYQVQTGSEYTDTSNHSSLKRRPSARGSRPMSMYETGSGQKPYLPMGEASRPEESRMRLQPFPAHASRLEKQNSTPESDYDNTPNDMEPDGMGSSRKGRQRSMVWPGDGLVPDTAEPHVAPSPTLPSTEDVIRKTEQITKNIQELLRAAQENKHDSYIPCSERIHVAVTEMAALFPKETQV

SEQ ID NO: 4435 - protein, 471 aa, Homo sapiens
MSKRLRSSEVCADCSGPDPSWASVNRGTFLCDECCSVHRSLGRHISQVRHLKHTPWPPTLLQMVETLYNNGANSIWEHSLLDPASIMSGRRKANPQDKVHPNKAEFIRAKYQMLAFVHRLPCRDDDSVTAKDLSKQLHSSVRTGNLETCLRLLSLGAQANFFHPEKGNTPLHVASKAGQILQAELLAVYGADPGTQDSSGKTPVDYARQGGHHELAERLVEIQYELTDRLAFYLCGRKPDHKNGQHFIIPQMADSSLDLSELAKAAKKKLQSLSNHLFEELAMDVYDEVDRRETDAVWLATQNHSALVTETTVVPFLPVNPEYSSTRNQGRQKLARFNAHEFATLVIDILSDAKRRQQGSSLSGSKDNVELILKTINNQHSVESQDNDQPDYDSVASDEDTDLETTASKTNRQKSLDSDLSDGPVTVQEFMEVKNALVASEAKIQQLMKVNNNLSDELRIMQKKLLGKDAN

SEQ ID NO: 4436 - protein, 631 aa, Homo sapiens
MSKRLRSSEVCADCSGPDPSWASVNRGTFLCDECCSVHRSLGRHISQVRHLKHTPWPPTLLQMVETLYNNGANSIWEHSLLDPASIMSGRRKANPQDKVHPNKAEFIRAKYQMLAFVHRLPCRDDDSVTAKDLSKQLHSSVRTGNLETCLRLLSLGAQANFFHPEKGNTPLHVASKAGQILQAELLAVYGADPGTQDSSGKTPVDYARQGGHHELAERLVEIQYELTDRLAFYLCGRKPDHKNGQHFIIPQMADSSLDLSELAKAAKKKLQSLSNHLFEELAMDVYDEVDRRETDAVWLATQNHSALVTETTVVPFLPVNPEYSSTRNQGRQKLARFNAHEFATLVIDILSDAKRRQQGSSLSGSKDNVELILKTINNQHSVESQDNDQPDYDSVASDEDTDLETTASKTNRQKSLDSDLSDGPVTVQEFMEVKNALVASEAKIQQLMKASRLEKQNSTPESDYDNTPNDMEPDGMGSSRKGRQRSMVWPGDGLVPDTAEPHVAPSPTLPSTEDVIRKTEQITKNIQELLRAAQENKHDSYIPCSERIHVAVTEMAALFPKKPKSDMVRTSLRLLTSSAYRLQSECKKTLPGDPGSPTDVQLVTQQVIQCAYDIAKAAKQLVTITTKENNN

SEQ ID NO: 4437 - protein, 410 aa, Homo sapiens
MSLVDLGKRLLEAARKGQDDEVRTLMANGAPFTTDWLGTSPLHLAAQYGHYSTAEVLLRAGVSRDARTKVDRTPLHMAAADGHAHIVELLVRNGADVNAKDMLKMTALHWATERHHRDVVELLIKYGADVHAFSKFDKSAFDIALEKNNAEILVILQEAMQNQVNVNPERANPVTDPVSMAAPFIFTSGEVVNLASLISSTNTKTTSANTEEIIEGNSVDSSIQQVMGSGGQRVITIVTDGVPLGNIQTSIPTGGIGQPFIVTVQDGQQVLTVPAGKVAEETVIKEEEEEKLPLTKKPRIGEKTNSVEESKEGNERELLQQQLQEANRRAQEYRHQLLKKEQEAEQYRLKLEAIARQQPNGVDFTMVEEVAEVDAVVVTEGELEERETKVTGSAGTTEPHTRVSMATVSS

SEQ ID NO: 4438 - protein, 410 aa, Homo sapiens; identical to SEQ ID NO: 4437

SEQ ID NO: 4439 - protein, 448 aa, Homo sapiens
MSLVDLGKRLLEAARKGQDDEVRTLMANGAPFTTDWLGTSPLHLAAQYGHYSTAEVLLRAGVSRDARTKVDRTPLHMAAADGHAHIVELLVRNGADVNAKDMLKMTALHWATERHHRDVVELLIKYGADVHAFSKFDKSAFDIALEKNNAEILVILQEAMQNQVNVNPERANPVTDPVSMAAPFIFTSGEVVNLASLISSTNTKTTSGDPHASTVQFSNSTTSVLATLAALAEASVPLSNSHRATANTEEIIEGNSVDSSIQQVMGSGGQRVITIVTDGVPLGNIQTSIPTGGIGQPFIVTVQDGQQVLTVPAGKVAEETVIKEEEEEKLPLTKKPRIGEKTNSVEESKEGNERELLQQQLQEANRRAQEYRHQLLKKEQEAEQYRLKLEAIARQQPNGVDFTMVEEVAEVDAVVVTEGELEERETKVTGSAGTTEPHTRVSMATVSS

SEQ ID NO: 4440 - protein, 395 aa, Homo sapiens
MSLVDLGKRLLEAARKGQDDEVRTLMANGAPFTTDWFSKLRVSCGYIGDNCKLGTSPLHLAAQYGHYSTAEVLLRAGVSRDARTKVDRTPLHMAAADGHAHIVELLVRNGADVNAKDMLKMTALHWATERHHRDVVELLIKYGADVHAFSKFDKSAFDIALEKNNAEILVILQEAMQNQVNVNPERANPVTDPVSMAAPFIFTSGEVVNLASLISSTNTKTTSGDPHASTVQFSNSTTSVLATLAALAEASVPLSNSHRATANTEETVIKEEEEEKLPLTKKPRIGEKTNSVEESKEGNERELLQQQLQEANRRAQEYRHQLLKKEQEAEQYRLKLEAIARQQPNGVDFTMVEEVAEVDAVVVTEGELEERETKVTGSAGTTEPHTRVSMATVSS

SEQ ID NO: 4441 - protein, 608 aa, Homo sapiens
MTEEACRTRSQKRALERDPTEDDVESKKIKMERGLLASDLNTDGDMRVTPEPGAGPTQGLLRATEATAMAMGRGEGLVGDGPVDMRTSHSDMKSERRPPSPDVIVLSDNEQPSSPRVNGLTTVALKETSTEALMKSSPEERERMIKQLKEELRLEEAKLVLLKKLRQSQIQKEATAQKPTGSVGSTVTTPPPLVRGTQNIPAGKPSLQTSSARMPGSVIPPPLVRGGQQASSKLGPQASSQVVMPPLVRGAQQIHSIRQHSSTGPPPLLLAPRASVPSVQIQGQRIIQQGLIRVANVPNTSLLVNIPQPTPASLKGTTATSAQANSTPTSVASVVTSAESPASRQAAAKLALRKQLEKTLLEIPPPKPPAPEMNFLPSAANNEFIYLVGLEEVVQNLLETQGRMSAATVLSREPYMCAQCKTDFTCRWREEKSGAIMCENCMTTNQKKALKVEHTSRLKAAFVKALQQEQEIEQRLLQQGTAPAQAKAEPTAAPHPVLKQASSQLSRGSATTPRGVLHTFSPSPKLQNSASATALVSRTGRHSERTVSAGKGSATSNWKKTPLSTGGTLAFVSPSLAVHKSSSAVDRQREYLLDMIPPRSIPQSATWK

SEQ ID NO: 4442 - protein, 633 aa, Homo sapiens
MTEEACRTRSQKRALERDPTEDDVESKKIKMERGLLASDLNTDGDMRVTPEPGAGPTQGLLRATEATAMAMGRGEGLVGDGPVDMRTSHSDMKSERRPPSPDVIVLSDNEQPSSPRVNGLTTVALKETSTEALMKSSPEERERMIKQLKEELRLEEAKLVLLKKLRQSQIQKEATAQKPTGSVGSTVTTPPPLVRGTQNIPAGKPSLQTSSARMPGSVIPPPLVRGGQQASSKLGPQASSQVVMPPLVRGAQQIHSIRQHSSTGPPPLLLAPRASVPSVQIQGQRIIQQGLIRVANVPNTSLLVNIPQPTPASLKGTTATSAQANSTPTSVASVVTSAESPASRQAAAKLALRKQLEKTLLEIPPPKPPAPEMNFLPSAANNEFIYLVGLEEVVQNLLETQGRMSAATVLSREPYMCAQCKTDFTCRWREEKSGAIMCENCMTTNQKKALKVEHTSRLKAAFVKALQQEQEIEQRLLQQGTAPAQAKAEPTAAPHPVLKQVIKPRRKLAFRSGEARDWSNGAVLQASSQLSRGSATTPRGVLHTFSPSPKLQNSASATALVSRTGRHSERTVSAGKGSATSNWKKTPLSTGGTLAFVSPSLAVHKSSSAVDRQREYLLDMIPPRSIPQSATWK

SEQ ID NO: 4443 - protein, 633 aa, Homo sapiens; identical to SEQ ID NO: 4442

SEQ ID NO: 4444 - protein, 177 aa, Homo sapiens
MTEEACRTRSQKRALERDPTEDDVESKKIKMERGLLASDLNTDGDMRVTPEPGAGPTQGLLRATEATAMAMGRGEGLVGDGPVDMRTSHSDMKSERRPPSPDVIVLSDNEQPSSPRVNGLTTVALKETSTEALMKSSPEERERMIKQLKEELRLEEAKLVLLKKLRQSQIQKEATAQ

SEQ ID NO: 4445 - protein, 126 aa, Homo sapiens
MTEEACRTRSQKRALERDPTEDDVESKKIKMERGLLASDLNTDGDMRVTPEPGAGPTQGLLRATEATAMAMGRGEGLVGDGPVDMRTSHSDMKSERRPPSPDVIVLSDNEQPSSPRVNGLTTVALK

SEQ ID NO: 4446 - protein, 436 aa, Homo sapiens
MIKQLKEELRLEEAKLVLLKKLRQSQIQKEATAQKTSSARMPGSVIPPPLVRGGQQASSKLGPQASSQVVMPPLVRGAQQIHSIRQHSSTGPPPLLLAPRASVPSVQIQGQRIIQQGLIRVANVPNTSLLVNIPQPTPASLKGTTATSAQANSTPTSVASVVTSAESPASRQAAAKLALRKQLEKTLLEIPPPKPPAPEMNFLPSAANNEFIYLVGLEEVVQNLLETQAGRMSAATVLSREPYMCAQCKTDFTCRWREEKSGAIMCENCMTTNQKKALKVEHTSRLKAAFVKALQQEQEIEQRLLQQGTAPAQAKAEPTAAPHPVLKQASSQLSRGSATTPRGVLHTFSPSPKLQNSASATALVSRTGRHSERTVSAGKGSATSNWKKTPLSTGGTLAFVSPSLAVHKSSSAVDRQREYLLDMIPPRSIPQSATWK

SEQ ID NO: 4447 - protein, 139 aa, Homo sapiens
MTEEACRTRSQKRALERDPTEDDVESKKIKMERGLLASDLNTDGDMRVTPEPGAGPTQGLLRATEATAMAMGRGEGLVGDGPVDMRTSHSDMKSERRPPSPDVIVLSDNEQPSSPRVNGLTTVALKETSTEALMKSSPE

SEQ ID NO: 4448 - protein, 93 aa, Homo sapiens
MTEEACRTRSQKRALERDPTEDDVESKKIKMERGLLASDLNTDGDMRVTPEPGAGPTQGLLRATEATAMAMGRGEGLVGDGPVDMRTSHSDMK

SEQ ID NO: 4449 - protein, 18 aa, Homo sapiens
MSLWPWPTGRTSTPYPEA

SEQ ID NO: 4450 - protein, 168 aa, Homo sapiens
MTEEACRTRSQKRALERDPTEDDVESKKIKMERGLLASDLNTDGDMRVTPEPGAGPTQGLLRATEATAMAMGRGEGLVGDGPVDMRTSHSDMKSERRPPSPDVIVLSDNEQPSSPRVNGLTTVALKETSTEALMKSSPEERERMIKQLKEELRLEEAKLVLLKKLRQS

SEQ ID NO: 4451 - protein, 262 aa, Homo sapiens [sequence omitted]

SEQ ID NO: 4452 - protein, 593 aa, Homo sapiens
MDRMTEDALRLNLLKRSLDPADERDDVLAKRLKMEGHEAMERLKMLALLKRKDLANLEVPHELPTKQDGSGVKGYEEKLNGNLRPHGDNRTAGRPGKENINDEPVDMSARRSEPERGRLTPSPDIIVLSDNEASSPRSSSRMEERLKAANLEMFKGKGIEERQQLIKQLRDELRLEEARLVLLKKLRQSQLQKENVVQKTPVVQNAASIVQPSPAHVGQQGLSKLPSRPGAQGVEPQNLRTLQGHSVIRSATNTTLPHMLMSQRVIAPNPAQLQGQRGPPKPGLVRTTTPNMNPAINYQPQSSSSVPCQRTTSSAIYMNLASHIQPGTVNRVSSPLPSPSAMTDAANSQAAAKLALRKQLEKTLLEIPPPKPPAPLLHFLPSAANSEFIYMVGLEEVVQSVIDSQGKSCASLLRVEPFVCAQCRTDFTPHWKQEKNGKILCEQCMTSNQKKALKAEHTNRLKNAFVKALQQEQEIEQRLQQQAALSPTTAPAVSSVSKQETIMRHHTLRQAPQPQSSLQRGIPTSARSMLSNFAQAPQLSVPGGLLGMPGVNIAYLNTGIGGHKGPSLADRQREYLLDMIPPRSISQSISGQK

SEQ ID NO: 4453 - protein, 474 aa, Homo sapiens
MAQHDFVPAWLNFSTPQSAKSPTATFEKHGEHLPRGEGRFGVSRRRHNSSDGFFNNGPLRTAGDSWHQPSLFRHDSVDSGVSKGAYAGITGNPSGWHSSSRGHDGMSQRSGGGTGNHRHWNGSFHSRKGCAFQEKPPMEIREEKKEDKVEKLQFEEEDFPSLNPEAGKQHQPCRPIGTPSGVWENPPSAKQPSKMLVIKKVSKEDPAAAFSAAFTSPGSHHANGNKLSSVVPSVYKNLVPKPVPPPSKPNAWKANRMEHKSGSLSSSRESAFTSPISVTKPVVLASGAALSSPKESPSSTTPPIEISSSRLTKLTRRTTDRKSEFLKTLKDDRNGDFSENRDCDKLEDLEDNSTPEPKENGEEGCHQNGLALPVVEEGEVLSHSLEAEHRLLKAMGWQEYPENDENCLPLTEDELKEFHMKTEQLRRNGFGKNGFLQSRSSSLFSPWRSTCKAEFEDSDTETSSSETSDDDAWK

SEQ ID NO: 4454 - protein, 474 aa, Homo sapiens; identical to SEQ ID NO: 4453

SEQ ID NO: 4455 - protein, 815 aa, Homo sapiens
MFRKARRVNVRKRNDSEEEERERDEEQEPPPLLPPPGTGEEAGPGGGDRAPGGESLLGPGPSPPSALTPGLGAEAGGGFPGGAEPGNGLKPRKRPRENKEVPRASLLSFQDEEEENEEVFKVKKSSYSKKIVKLLKKEYKEDLEKSKIKTELNSSAESEQPLDKTGHVKDTNQEDGVIISEHGEDEMDMESEKEEEKPKTGGAFSNALSSLNVLRPGEIPDAAFIHAARKKRQMARELGDFTPHDNEPGKGRLVREDENDASDDEDDDEKRRIVFSVKEKSQRQKIAEEIGIEGSDDDALVTGEQDEELSRWEQEQIRKGINIPQVQASQPAEVNMYYQNTYQTMPYGSSYGIPYSYTAYGSSDAKSQKTDNTVPFKTPSNEMTPVTIDLVKKQLKDRLDSMKELHKTNRQQHEKHLQSRVDSTRAIERLEGSSGGIGERYKFLQEMRGYVQDLLECFSEKVPLINELESAIHQLYKQRASRLVQRRQDDIKDESSEFSSHSNKALMAPNLDSFGRDRALYQEHAKRRIAEREARRTRRRQAREQTGKMADHLEGLSSDDEETSTDITNFNLEKDRISKESGKVFEDVLESFYSIDCIKSQFEAWRSKYYTSYKDAYIGLCLPKLFNPLIRLQLLTWTPLEAKCRDFENMLWFESLLFYGCEEREQEKDDVDVALLPTIVEKVILPKLTVIAENMWDPFSTTQTSRMVGITLKLINGYPSVVNAENKNTQVYLKALLLRMRRTLDDDVFMPLYPKNVLENKNSGPYLFFQRQFWSSVKVIKPPFQRGSCPIPRRKECCSERPRRIWTDRPCVVFS

SEQ ID NO: 4456 - protein, 917 aa, Homo sapiens
MFRKARRVNVRKRNDSEEEERERDEEQEPPPLLPPPGTGEEAGPGGGDRAPGGESLLGPGPSPPSALTPGLGAEAGGGFPGGAEPGNGLKPRKRPRENKEVPRASLLSFQDEEEENEEVFKVKKSSYSKKIVKLLKKEYKEDLEKSKIKTELNSSAESEQPLDKTGHVKDTNQEDGVIISEHGEDEMDMESEKEEEKPKTGGAFSNALSSLNVLRPGEIPDAAFIHAARKKRQMARELGDFTPHDNEPGKGRLVREDENDASDDEDDDEKRRIVFSVKEKSQRQKIAEEIGIEGSDDDALVTGEQDEELSRWEQEQIRKGINIPQVQASQPAEVNMYYQNTYQTMPYGSSYGIPYSYTAYGSSDAKSQKTDNTVPFKTPSNEMTPVTIDLVKKQLKDRLDSMKELHKTNRQQHEKHLQSRVDSTRAIERLEGSSGGIGERYKFLQEMRGYVQDLLECFSEKVPLINELESAIHQLYKQRASRLVQRRQDDIKDESSEFSSHSNKALMAPNLDSFGRDRALYQEHAKRRIAEREARRTRRRQAREQTGKMADHLEGLSSDDEETSTDITNFNLEKDRISKESGKVFEDVLESFYSIDCIKSQFEAWRSKYYTSYKDAYIGLCLPKLFNPLIRLQLLTWTPLEAKCRDFENMLWFESLLFYGCEEREQEKDDVDVALLPTIVEKVILPKLTVIAENMWDPFSTTQTSRMVGITLKLINGYPSVVNAENKNTQVYLKALLLRMRRTLDDDVFMPLYPKNVLENKNSGPYLFFQRQFWSSVKLLGNFLQWYGIFSNKTLQELSIDGLLNRYILMAFQNSEYGDDSIKKAQNVINCFPKQWFMNLKGERTISQLENFCRYLVHLADTIYRNSIGCSDVEKRNARENIKQIVKLLASVRALDHAMSVASDHNVKEFKSLIEGK

SEQ ID NO: 4457 - protein, 781 aa, Homo sapiens
MAHRPKRTFRQRAADSSDSDGAEESPAEPGAPRELPVPGSAEEEPPSGGGRAQVAGLPHRVRGPRGRGRVWASSRRATKAAPRADEGSESRTLDVSTDEEDKIHHSSESKDDQGLSSDSSSSLGEKELSSTVKIPDAAFIQAARRKRELARAQDDYISLDVQHTSSISGMKRESEDDPESEPDDHEKRIPFTLRPQTLRQRMAEESISRNEETSEESQEDEKQDTWEQQQMRKAVKIIEERDIDLSCGNGSSKVKKFDTSISFPPVNLEIIKKQLNTRLTLLQETHRSHLREYEKYVQDVKSSKSTIQNLESSSNQALNCKFYKSMKIYVENLIDCLNEKIINIQEIESSMHALLLKQAMTFMKRRQDELKHESTYLQQLSRKDETSTSGNFSVDEKTQWILEEIESRRTKRRQARVLSGNCNHQEGTSSDDELPSAEMIDFQKSQGDILQKQKKVFEEVQDDFCNIQNILLKFQQWREKFPDSYYEAFISLCIPKLLNPLIRVQLIDWNPLKLESTGLKEMPWFKSVEEFMDSSVEDSKKESSSDKKVLSAIINKTIIPRLTDFVEFLWDPLSTSQTTSLITHCRVILEEHSTCENEVSKSRQDLLKSIVSRMKKAVEDDVFIPLYPKSAVENKTSPHSKFQERQFWSGLKLFRNILLWNGLLTDDTLQELGLGKLLNRYLIIALLNATPGPDVVKKCNQVAACLPEKWFENSAMRTSIPQLENFIQFLLQSAHKLSRSEFRDEVEEIILILVKIKALNQAESFIGEHHLDHLKSLIKED

SEQ ID NO: 4458 - protein, 743 aa, Homo sapiens
MAHRPKRTFRQRAADSSDSDGAEESPAEPGAPRELPVPGSAEEEPPSGGGRAQVAGLPHRVRGPRGRGRVWASSRRATKAAPRADEGSESRTLDVSTDEEDKIHHSSESKDDQGLSSDSSSSLGEKELSSTVKIPDAAFIQAARRKRELARAQDDYISLDVQHTSSISVSRNEETSEESQEDEKQDTWEQQQMRKAVKIIEERDIDLSCGNGSSKVKKFDTSISFPPVNLEIIKKQLNTRLTLLQETHRSHLREYEKYVQDVKSSKSTIQNLESSSNQALNCKFYKSMKIYVENLIDCLNEKIINIQEIESSMHALLLKQAMTFMKRRQDELKHESTYLQQLSRKDETSTSGNFSVDEKTQWILEEIESRRTKRRQARVLSGNCNHQEGTSSDDELPSAEMIDFQKSQGDILQKQKKVFEEVQDDFCNIQNILLKFQQWREKFPDSYYEAFISLCIPKLLNPLIRVQLIDWNPLKLESTGLKEMPWFKSVEEFMDSSVEDSKKESSSDKKVLSAIINKTIIPRLTDFVEFLWDPLSTSQTTSLITHCRVILEEHSTCENEVSKSRQDLLKSIVSRMKKAVEDDVFIPLYPKSAVENKTSPHSKFQERQFWSGLKLFRNILLWNGLLTDDTLQELGLGKLLNRYLIIALLNATPGPDVVKKCNQVAACLPEKWFENSAMRTSIPQLENFIQFLLQSAHKLSRSEFRDEVEEIILILVKIKALNQAESFIGEHHLDHLKSLIKED

SEQ ID NO: 4459 - protein, 254 aa, Homo sapiens
MAHRPKRTFRQRAADSSDSDGAEESPAEPGAPRELPVPGSAEEEPPSGGGRAQVAGLPHRVRGPRGRGRVWASSRRATKAAPRADEGSESRTLDVSTDEEDKIHHSSESKDDQGLSSDSSSSLGEKELSSTVKIPDAAFIQAARRKRELARAQDDYISLDVQHTSSISGMKRESEDDPESEPDDHEKRIPFTLRPQTLRQRMAEESISRNEETSEESQEDEKQDTWEQQQMRKAVKIIEINITTGNSPLTPEGV

SEQ ID NO: 4460 - protein, 167 aa, Homo sapiens
MSEWMKKGPLEWQDYIYKEVRVTASEKNEYKGWVLTTDPVSANIVLVNFLEDGSMSVTGIMGHAVQTVETMNEGDHRVREKLMHLFTSGDCKAYSPEDLEERKNSLKKWLEKNHIPITEQGDAPRTLCVAGVLTIDPPYGPENCSSSNEIILSRVQDLIEGHLTASQ

SEQ ID NO: 4461 - protein, 111 aa, Homo sapiens
MSEWMKKGPLEWQDYIYKEVRVTASEKNEYKGWVLTTDPVSAKVLLSPRLECSGEISALCNLHLAGSSDSPALASRVAGTTGICHHVWLIFVFFVETGLRHVAQYCPCELP

SEQ ID NO: 4462 - protein, 109 aa, Homo sapiens
MAYQLYRNTTLGNSLQESLDELIQSQQITPQLALQVLLQFDKAINAALAQRVRNRVNFRGSLNTYRFCDNVWTFVLNDVEFREVTELIKVDKVKIVACDGKNTGSNTTE

SEQ ID NO: 4463 - protein, 109 aa, Homo sapiens; identical to SEQ ID NO: 4462

SEQ ID NO: 4464 - protein, 109 aa, Homo sapiens; identical to SEQ ID NO: 4462

SEQ ID NO: 4465 - protein, 439 aa, Homo sapiens
MADPDVLTEVPAALKRLAKYVIRGFYGIEHALALDILIRNSCVKEEDMLELLKFDRKQLRSVLNNLKGDKFIKCRMRVETAADGKTTRHNYYFINYRTLVNVVKYKLDHMRRRIETDERDSTNRASFKCPVCSSTFTDLEANQLFDPMTGTFRCTFCHTEVEEDESAMPKKDARTLLARFNEQIEPIYALLRETEDVNLAYEILEPEPTEIPALKQSKDHAATTAGAASLAGGHHREAWATKGPSYEDLYTQNVVINMDDQEDLHRASLEGKSAKERPIWLRESTVQGAYGSEDMKEGGIDMDAFQEREEGHAGPDDNEEVMRALLIHEKKTSSAMAGSVGAAAPVTAANGSDSESETSESDDDSPPRPAAVAVHKREEDEEEDDEFEEVADDPIVMVAGRPFSYSEVSQRPELVAQMTPEEKEAYIAMGQRMFEDLFE

SEQ ID NO: 4466 - protein, 49 aa, Homo sapiens
MADPDVLTEVPAALKRLAKYVIRGFYGIEHALALDILIRNSCVKEEDML

SEQ ID NO: 4467 - protein, 122 aa, Homo sapiens
MADPDVLTEVPAALKRLAKYVIRGFYGIEHALALDILIRNSCVKEEDMLELLKFDRKQLRSVLNNLKGDKFIKCRMRVETAADGKTTRHNYYFINYRTLVNVVKYKLDHMRRRIETDERDST

SEQ ID NO: 4468 - protein, 395 aa, Homo sapiens
MDEEPERTKRWEGGYERTWEILKEDESGSLKATIEDILFKAKRKRVFEHHGQVRLGMMRHLYVVVDGSRTMEDQDLKPNRLTCTLKLLEYFVEEYFDQNPISQIGIIVTKSKRAEKLTELSGNPRKHITSLKEAVDMTCHGEPSLYNSLSMAMQTLKHMPGHTSREVLIIFSSLTTCDPSNIYDLIKTLKAAKIRVSVIGLSAEVRVCTVLARETGGTYHVILDESHYKELLTHHLSPPPASSSSECSLIRMGFPQHTIASLSDQDAKPSFSMAHLDGNTEPGLTLGGYFCPQCRAKYCELPVECKICGLTLVSAPHLARSYHHLFPLDAFQEIPLEEYNGERFCYGCQGELKDQHVYVCAVCQNVFCVDCDVFVHDSLHCCPGCIHKIPAPSGV

SEQ ID NO: 4469 - protein, 338 aa, Homo sapiens
MRHLYVVVDGSRTMEDQDLKPNRLTCTLKLLEYFVEEYFDQNPISQIGIIVTKSKRAEKLTELSGNPRKHITSLKEAVDMTCHGEPSLYNSLSMAMQTLKHMPGHTSREVLIIFSSLTTCDPSNIYDLIKTLKAAKIRVSVIGLSAEVRVCTVLARETGGTYHVILDESHYKELLTHHLSPPPASSSSECSLIRMGFPQHTIASLSDQDAKPSFSMAHLDGNTEPGLTLGGYFCPQCRAKYCELPVECKICGLTLVSAPHLARSYHHLFPLDAFQEIPLEEYNGERFCYGCQGELKDQHVYVCAVCQNVFCVDCDVFVHDSLHCCPGCIHKIPAPSGV

SEQ ID NO: 4470 - protein, 395 aa, Homo sapiens; identical to SEQ ID NO: 4468

SEQ ID NO: 4471 - protein, 267 aa, Homo sapiens
MVLGNSHLFMNRSNKLAVIASHIQESRFLYPGKNGRLGDFFGDPGNPPEFNPSGSKDGKYELLTSANEVIVEEIKDLMTKSDIKGQHTETLLAGSLAKALCYIHRMNKEVKDNQEMKSRILVIKAAEDSALQYMNFMNVIFAAQKQNILIDACVLDSDSGLLQQACDITGGLYLKVPQMPSLLQYLLWVFLPDQDQRSQLILPPPVHVDYRAACFCHRNLIEIGYVCSVCLSIFCNFSPICTTCETAFKISLPPVLKAKKKKLKVSA

SEQ ID NO: 4472 - protein, 258 aa, Homo sapiens [sequence omitted]

SEQ ID NO: 4473 - protein, 308 aa, Homo sapiens
MVSDEDELNLLVIVVDANPIWWGKQALKESQFTLSKCIDAVMVLGNSHLFMNRSNKLAVIASHIQESRFLYPGKNGRLGDFFGDPGNPPEFNPSGSKDGKYELLTSANEVIVEEIKDLMTKSDIKGQHTETLLAGSLAKALCYIHRMNKEVKDNQEMKSRILVIKAAEDSALQYMNFMNVIFAAQKQNILIDACVLDSDSGLLQQACDITGGLYLKVPQMPSLLQYLLWVFLPDQDQRSQLILPPPVHVDYRAACFCHRNLIEIGYVCSVCLSIFCNFSPICTTCETAFKISLPPVLKAKKKKLKVSA

SEQ ID NO: 4474 - protein, 2109 aa, Homo sapiens
MDALESLLDEVALEGLDGLCLPALWSRLETRVPPFPLPLEPCTQEFLWRALATHPGISFYEEPRERPDLQLQDRYEEIDLETGILESRRDPVALEDVYPIHMILENKDGIQGSCRYFKERKNITNDIRTKSLQPRCTMVEAFDRWGKKLIIVASQAMRYRALIGQEGDPDLKLPDFSYCILERLGRSRWQGELQRDLHTTAFKVDAGKLHYHRKILNKNGLITMQSHVIRLPTGAQQHSILLLLNRFHVDRRSKYDILMEKLSVMLSTRTNHIETLGKLREELGLCERTFKRLYQYMLNAGLAKVVSLRLQEIHPECGPCKTKKGTDVMVRCLKLLKEFKRNDHDDDEDEEVISKTVPPVDIVFERDMLTQTYDLIERRGTKGISQAEIRVAMNVGKLEARMLCRLLQRFKVVKGFMEDEGRQRTTKYISCVFAEESDLSRQYQREKARSELLTTVSLASMQEESLLPEGEDTFLSESDSEEERSSSKRRGRGSQKDTRASANLRPKTQPHHSTPTKGGWKVVNLHPLKKQPPSFPGAAEERACQSLASRDSLLDTSSVSEPNVSFVSHCADSNSGDIAVIEEVRMENPKESSSSLKTGRHSSGQDKPHETYRLLKRRNLIIEAVTNLRLIESLFTIQKMIMDQEKQEGVSTKCCKKSIVRLVRNLSEEGLLRLYRTTVIQDGIKKKVDLVVHPSMDQNDPLVRSAIEQVRFRISNSSTANRVKTSQPPVPQGEAEEDSQGKEGPSGSGDSQLSASSRSESGRMKKSDNKMGITPLRNYHPIVVPGLGRSLGFLPKMPRLRVVHMFLWYLIYGHPASNTVEKPSFISERRTIKQESGRAGVRPSSSGSAWEACSEAPSKGSQDGVTWEAEVELATETVYVDDASWMRYIPPIPVHRDFGFGWALVSDILLCLPLSIFIQIVQVSYKVDNLEEFLNDPLKKHTLIRFLPRPIRQQLLYKRRYIFSVVENLQRLCYMGLLQFGPTEKFQDKDQVFIFLKKNAVIVDTTICDPHYNLARSSRPFERRLYVLNSMQDVENYWFDLQCVCLNTPLGVVRCPRVRKNSSTDQGSDEEGSLQKEQESAMDKHNLERKCAMLEYTTGSREVVDEGLIPGDGLGAAGLDSSFYGHLKRNWIWTSYIINQAKKENTAAENGLTVRLQTFLSKRPMPLSARGNSRLNIWGEARVGSELCAGWEEQFEVDREPSLDRNRRVRGGKSQKRKRLKKDPGKKIKRKKKGEFPGEKSKRLRYHDEADQSALQRMTRLRVTWSMQEDGLLVLCRIASNVLNTKVKGPFVTWQVVRDILHATFEESLDKTSHSVGRRARYIVKNPQAYLNYKVCLAEVYQDKALVGDFMNRRGDYDDPKVCANEFKEFVEKLKEKFSSALRNSNLEIPDTLQELFARYRVLAIGDEKDQTRKEDELNSVDDIHFLVLQNLIQSTLALSDSQMKSYQSFQTFRLYREYKDHVLVKAFMECQKRSLVNRRRVNHTLGPKKNRALPFVPMSYQLSQTYYRIFTWRFPSTICTESFQFLDRMRAAGKLDQPDRFSFKDQDNNEPTNDMVAFSLDGPGGNCVAVLTLFSLGLISVDVRIPEQIIVVDSSMVENEVIKSLGKDGSLEDDEDEEDDLDEGVGGKRRSMEVKPAQASHTNYLLMRGYYSPGIVSTRNLNPNDSIVVNSCQMKFQLRCTPVPARLRPAAAPLEELTMGTSCLPDTFTKLINPQENTCSLEEFVLQLELSGYSPEDLTAALEILEAIIATGCFGIDKEELRRRFSALEKAGGGRTRTFADCIQALLEQHQVLEVGGNTARLVAMGSAWPWLLHSVRLKDREDADIQREDPQARPLEGSSSEDSPPEGQAPPSHSPRGTKRRASWASENGETDAEGTQMTPAKRPALQDSNLAPSLGPGAEDGAEAQAPSPPPALEDTAAAGAAQEDQEGVGEFSSPGQEQLSGQAQPPEGSEDPRGFTESFGAANISQAARERDCESVCFIGRPWRVVDGHLNLPVCKGMMEAMLYHIMTRPGIPESSLLRHYQGVLQPVAVLELLQGLESLGCIRKRWLRKPRPVSLFSTPVVEEVEVPSSLDESPMAFYEPTLDCTLRLGRVFPHEVNWNKWIHL

SEQ ID NO: 4475 - protein, 1687 aa, Homo sapiens
MDALESLLDEVALEGLDGLCLPALWSRLETRVPPFPLPLEPCTQEFLWRALATHPGISFYEEPRERPDLQLQDRYEEIDLETGILESRRDPVALEDVYPIHMILENKDGIQGSCRYFKERKNITNDIRTKSLQPRCTMVEAFDRWGKKLIICLPGHAVQGLDRPGGGSRPEAARLLLLHPGTARPVQQGELQRDLHTTAFKVDAGKLHYHRKILNKNGLITMQSHVIRLPTGAQQHSILLLLNRFHVDRRSKYDILMEKLSVMLSTRTNHIETLGKLREELGLCERTFKRLYQYMLNAGLAKVVSLRLQEIHPECGPCKTKKGTDVMVRCLKLLKEFKRNDHDDDEDEEVISKTVPPVDIVFERDMLTQTYDLIERRGTKGISQAEIRVAMNVGKLEARMLCRLLQRFKVVKGFMEDEGRQRTTKYISCVFAEESDLSRQYQREKARSELLTTVSLASMQEESLLPEGEDTFLSESDSEEERSSSKRRGRGSQKDTRASANLRPKTQPHHSTPTKGGWKVVNLHPLKKQPPSFPGAAEERACQSLASRDSLLDTSSVSEPNVSFVSHCADSNSGDIAVIEEVRMENPKESSSSLKTGRHSSGQDKPHETYRLLKRRNLIIEAVTNLRLIESLFTIQKMIMDQEKQEGVSTKCCKKSIVRLVRNLSEEGLLRLYRTTVIQDGIKKKVDLVVHPSMDQNDPLVRSAIEQVRFRISNSSTANRVKTSQPPVPQGEAEEDSQGKEGPSGSGDSQLSASSRSESGRMKKSDNKMGITPLRNYHPIVVPGLGRSLGFLPKMPRLRVVHMFLWYLIYGHPASNTVEKPSFISERRTIKQESGRAGVRPSSSGSAWEACSEAPSKGSQDGVTWEAEVELATETVYVDDASWMRYIPPIPVHRDFGFGWALVSDILLCLPLSIFIQIVQVSYKVDNLEEFLNDPLKKHTLIRFLPRPIRQQLLYKRRYIFSVVENLQRLCYMGLLQFGPTEKFQDKDQVFIFLKKNAVIVDTTICDPHYNLARSSRPFERRLYVLNSMQDVENYWFDLQCVCLNTPLGVVRCPRVRKNSSTDQGSDEEGSLQKEQESAMDKHNLERKCAMLEYTTGSREVVDEGLIPGDGLGAGSIPASTDTSSATGSGPATSSTRPKRRTLPQRMDTVRLQTFLSKRPMPLSARGNSRLNIWGEARVGSELCAGWEEQFEVDREPSLDRNRRVRGGKSQKRKRLKKDPGKKIKRKKKGEFPGEKSKRLRYHDEADQSALQRMTRLRVTWSMQEDGLLVLCRIASNVLNTKVKGPFVTWQVVRDILHATFEESLDKTSHSVGRRARYIVKNPQAYLNYKVCLAEVYQDKALVGDFMNRRGDYDDPKVCANEFKEFVEKLKEKFSSALRNSNLEIPDTLQELFARYRVLAIGDEKDQTRKEDELNSVDDIHFLVLQNLIQSTLALSDSQMKSYQSFQTFRLYREYKDHVLVKAFMECQKRSLVNRRRVNHTLGPKKNRALPFVPMSYQLSQTYYRIFTWRFPSTICTESFQFLDRMRAAGKLDQPDRFSFKDQDNNEPTNDMVAFSLDGPGGNCVAVLTLFSLGLISVDVRIPEQIIVVDSSMVENEVIKSLGKDGSLEDDEDEEDDLDEGVGGKRRSMEVKPAQASHTNYLLMRGYYSPGIVSTRNLNPNDSIVVNSCQMKFQLRCTPVPARLRPA

SEQ ID NO: 4476 - protein, 911 aa, Homo sapiens
MDTCGVGYVALGEAGPVGNMTVVDSPGQEVLNQLDVKTSSEMTSAEASVEMSLPTPLPGFEDSPDQRRLPPEQESLSRLEQPDLSSEMSKVSKPRASKPGRKRGGRTRKGPKRPQQPNPPSAPLVPGLLDQSNPLSTPMPKKRGRKSKAELLLLKLSKDLDRPESQSPKRPPEDFETPSGERPRRRAAQVALLYLQELAEELSTALPAPVSCPEGPKVSSPTKPKKIRQPAACPGGEEVDGAPRDEDFFLQVEAEDVEESEGPSESSSEPEPVVPRSTPRGSTSGKQKPHCRGMAPNGLPNHIMAPVWKCLHLTKDFREQKHSYWEFAEWIPLAWKWHLLSELEAAPYLPQEEKSPLFSVQREGLPEDGTLYRINRFSSITAHPERWDVSFFTGGPLWALDWCPVPEGAGASQYVALFSSPDMNETHPLSQLHSGPGLLQLWGLGTLQQESCPGNRAHFVYGIACDNGCIWDLKFCPSGAWELPGTPRKAPLLPRLGLLALACSDGKVLLFSLPHPEALLAQQPPDAVKPAIYKVQCVATLQVGSMQATDPSECGQCLSLAWMPTRPHQHLAAGYYNGMVVFWNLPTNSPLQRIRLSDGSLKLYPFQCFLAHDQAVRTLQWCKANSHFLVSAGSDRKIKFWDLRRPYEPINSIKRFLSTELAWLLPYNGVTVAQDNCYASYGLCGIHYIDAGYLGFKAYFTAPRKGTVWSLSGSDWLGTIAAGDISGELIAAILPDMALNPINVKRPVERRFPIYKADLIPYQDSPEGPDHSSASSGVPNPPKARTYTETVNHHYLLFQDTDLGSFHDLLRREPMLRMQEGEGHSQLCLDRLQLEAIHKVRFSPNLDSYGWLVSGGQSGLVRIHFVRGLASPLGHRMQLESRAHFNAMFQPSSPTRRPGFSPTSHRLLPTP

SEQ ID NO: 4477 - protein, 911 aa, Homo sapiens; identical to SEQ ID NO: 4476

SEQ ID NO: 4478 - protein, 74 aa, Homo sapiens
MDTCGVGYVALGEAGPVGNMTVVDSPGQEVLNQLDVKTSSEMTSAEASVEMSLPTPLPGFEDSPDQRRLPPEQE

SEQ ID NO: 4479 - protein, 135 aa, Homo sapiens
MDTCGVGYVALGEAGPVGNMTVVDSPGQEVLNQLDVKTSSEMTSAEASVEMSLPTPLPGFEDSPDQRRLPPEQESLSRLEQPDLSSEMSKVSKPRASKPGRKRGGRTRKGPKRPQQPNPPSAPLVPGLLDQSNPL

SEQ ID NO: 4480 - protein, 886 aa, Homo sapiens
MSGFSPELIDYLEGKISFEEFERRREERKTREKKSLQEKGKLSAEENPDDSEVPSSSGINSTKSQDKDVNEGETSDGVRKSVHKVFASMLGENEDDEEEEEEEEEEEEEEETPEQPTAGDVFVLEMVLNRETKKMMKEKRPRSKLPRALRGLMGEANIRFARGEREEAILMCMEIIRQAPLAYEPFSTLAMIYEDQGDMEKSLQFELIAAHLNPSDTEEWVRLAEMSLEQDNIKQAIFCYTKALKYEPTNVRYLWERSSLYEQMGDHKMAMDGYRRILNLLSPSDGERFMQLARDMAKSYYEANDVTSAINIIDEAFSKHQGLVSMEDVNIAAELYISNKQYDKALEIITDFSGIVLEKKTSEEGTSEENKAPENVTCTIPDGVPIDITVKLMVCLVHLNILEPLNPLLTTLVEQNPEDMGDLYLDVAEAFLDVGEYNSALPLLSALVCSERYNLAVVWLRHAECLKALGYMERAAESYGKVVDLAPLHLDARISLSTLQQQLGQPEKALEALEPMYDPDTLAQDANAAQQELKLLLHRSTLLFSQGKMYGYVDTLLTMLAMLLKVAMNRAQVCLISSSKSGERHLYLIKVSRDKISDSNDQESANCDAKAIFAVLTSVLTKDDWWNLLLKAIYSLCDLSRFQEAELLVDSSLEYYSFYDDRQKRKELEYFGLSAAILDKNFRKAYNYIRIMVMENVNKPQLWNIFNQVTMHSQDVRHHRFCLRLMLKNPENHALCVLNGHNAFVSGSFKHALGQYVQAFRTHPDEPLYSFCIGLTFIHMASQKYVLRRHALIVQGFSFLNRYLSLRGPCQESFYNLGRGLHQLGLIHLAIHYYQKALELPPLVVEGIELDQLDLRRDIAYNLSLIYQSSGNTGMAQTLLYTYCSI

SEQ ID NO: 4481 - protein, 413 aa, Homo sapiens
MSGFSPELIDYLEGKISFEEFERRREERKTREKKSLQEKGKLSAEENPDDSEVPSSSGINSTKSQDKDVNEGETSDGVRKSVHKVFASMLGENEDDEEEEEEEEEEEEEEETPEQPTAGDVFVLEMVLNRETKKMMKEKRPRSKLPRALRGLMGEANIRFARGEREEAILMCMEIIRQAPLAYEPFSTLAMIYEDQGDMEKSLQFELIAAHLNPSDTEEWVRLAEMSLEQDNIKQAIFCYTKALKYEPTNVRYLWERSSLYEQMGDHKMAMDGYRRILNLLSPSDGERFMQLARDMAKSYYEANDVTSAINIIDEAFSKHQGLVSMEDVNIAAELYISNKQYDKALEIITDFSGIVLEKKTSEEGTSEENKAPENVTCTIPDGVPIDITVKLMVCLVHLNILEPLNVCNKICT

SEQ ID NO: 4482 - protein, 822 aa, Homo sapiens
MNTADQARVGPADDGPAPSGEEEGEGGGEAGGKEPAADAAPGPSAAFRLMVTRREPAVKLQYAVSGLEPLAWSEDHRVSVSTARSIAVLELICDVHNPGQDLVIHRTSVPAPLNSCLLKVGSKTEVAECKEKFAASKDPTVSQTFMLDRVFNPEGKALPPMRGFKYTSWSPMGCDANGRCLLAALTMDNRLTIQANLNRLQWVQLVDLTEIYGERLYETSYRLSKNEAPEGNLGDFAEFQRRHSMQTPVRMEWSGICTTQQVKHNNECRDVGSVLLAVLFENGNIAVWQFQLPFVGKESISSCNTIESGITSPSVLFWWEYEHNNRKMSGLIVGSAFGPIKILPVNLKAVKGYFTLRQPVILWKEMDQLPVHSIKCVPLYHPYQKCSCSLVVAARGSYVFWCLLLISKAGLNVHNSHVTGLHSLPIVSMTADKQNGTVYTCSSDGKVRQLIPIFTDVALKFEHQLIKLSDVFGSVRTHGIAVSPCGAYLAIITTEGMINGLHPVNKNYQVQFVTLKTFEEAAAQLLESSVQNLFKQVDLIDLVRWKILKDKHIPQFLQEALEKKIESSGVTYFWRFKLFLLRILYQSMQKTPSEALWKPTHEDSKILLVDSPGMGNADDEQQEEGTSSKQVVKQGLQERSKEGDVEEPTDDSLPTTGDAGGREPMEEKLLEIQGKIEAVEMHLTREHMKRVLGEVYLHTWITENTSIPTRGLCNFLMSDEEYDDRTARVLIGHISKKMNKQTFPEHCSLCKEILPFTDRKQAVCSNGHIWLRCFLTYQSCQSLIYRRCLLHDSIARHPAPEDPDWIKRLLQSPCPFCDSPVF

SEQ ID NO: 4483 - protein, 457 aa, Homo sapiens
MAAEAADLGLGAAVPVELRRERRMVCVEYPGVVRDVAKMLPTLGGEEGVSRIYADPTKRLELYFRPKDPYCHPVCANRFSTSSLLLRIRKRTRRQKGVLGTEAHSEVTFDMEILGIISTIYKFQGMSDFQYLAVHTEAGGKHTSMYDKVLMLRPEKEAFFHQELPLYIPPPIFSRLDAPVDYFYRPETQHREGYNNPPISGENLIGLSRARRPHNAIFVNFEDEEVPKHLWIRFGYDPRKNPDAKIYQVLDFRIRCGMKHGYAPSDLPVKAKRSTYNYSLPITVKKTSSQLVTMHDLKQGLGPSGTSGARKPASSKYKLKVSLQTLRDSVYIFREGALPPYRQMFYQLCDLNVEELQKIIHRNDGAENSCTERDGWCLPKTSDELRDTMSLMIRQTIRSKRPALFSSSAKADGGKEQLTYESGEDEEDEEEEEEEEEDFKPSDGSENEMETEILDYV

SEQ ID NO: 4484 - protein, 277 aa, Homo sapiens
MLRPEKEAFFHQELPLYIPPPIFSRLDAPVDYFYRPETQHREGYNNPPISGENLIGLSRARRPHNAIFVNFEDEEVPKQPLEAAAQTWRRVCTNPVDRKVEEELRKLFDIRPIWSRNAVKANISVHPDKLKVLLPFIAYYMITGPWRSLWIRFGYDPRKNPDAKIYQVLDFRIRCGMKHGYAPSDLPVKAKRSTYNYSLPITVKKTSSQLVTMHDLKQGLGPSGTSGARKPASSKYKLKVSLQTTSGEEVVTSLREVWHQQLHVVVLLEPFGSLGPH

SEQ ID NO: 4485 - protein, 412 aa, Homo sapiens
MSDFQYLAVHTEAGGKHTSMYDKVLMLRPEKEAFFHQELPLYIPPPIFSRLDAPVDYFYRPETQHREGYNNPPISGENLIGLSRARRPHNAIFVNFEDEEVPKQPLEAAAQTWRRVCTNPVDRKVEEELRKLFDIRPIWSRNAVKANISVHPDKLKVLLPFIAYYMITGPWRSLWIRFGYDPRKNPDAKIYQVLDFRIRCGMKHGYAPSDLPVKAKRSTYNYSLPITVKKTSSQLVTMHDLKQGLGPSGTSGARKPASSKYKLKVSLQTLRVRTRVQSPRAVCVGDIWRRGGDKSQGSLAPAAACGCPSRALWEPGPPLSHVTTPGMIGIGHTQEDRARAGHVGCSCGRSLTGSRFRQCGCPAGVGGFQSCSHIQAPASRSTALGEAEKGASRTVESPAEGVGGRDECSRDG

SEQ ID NO: 4486 - protein, 519 aa, Homo sapiens
MAAEAADLGLGAAVPVELRRERRMVCVEYPGVVRDVAKMLPTLGGEEGVSRIYADPTKRLELYFRPKDPYCHPVCANRFSTSSLLLRIRKRTRRQKGVLGTEAHSEVTFDMEILGIISTIYKFQGMSDFQYLAVHTEAGGKHTSMYDKVLMLRPEKEAFFHQELPLYIPPPIFSRLDAPVDYFYRPETQHREGYNNPPISGENLIGLSRARRPHNAIFVNFEDEEVPKQPLEAAAQTWRRVCTNPVDRKVEEELRKLFDIRPIWSRNAVKANISVHPDKLKVLLPFIAYYMITGPWRSLWIRFGYDPRKNPDAKIYQVLDFRIRCGMKHGYAPSDLPVKAKRSTYNYSLPITVKKTSSQLVTMHDLKQGLGPSGTSGARKPASSKYKLKDSVYIFREGALPPYRQMFYQLCDLNVEELQKIIHRNDGAENSCTERDGWCLPKTSDELRDTMSLMIRQTIRSKRPALFSSSAKADGGKEQLTYESGEDEEDEEEEEEEEEDFKPSDGSENEMETEILDYV

SEQ ID NO: 4487 - protein, 510 aa, Homo sapiens
MAAEAADLGLGAAVPVELRRERRMVCVEYPGVVRDVAKMLPTLGGEEGVSRIYADPPKDPYCHPVCANRFSTSSLLLRIRKRTRRQKGVLGTEAHSEVTFDMEILGIISTIYKFQGMSDFQYLAVHTEAGGKHTSMYDKVLMLRPEKEAFFHQELPLYIPPPIFSRLDAPVDYFYRPETQHREGYNNPPISGENLIGLSRARRPHNAIFVNFEDEEVPKQPLEAAAQTWRRVCTNPVDRKVEEELRKLFDIRPIWSRNAVKANISVHPDKLKVLLPFIAYYMITGPWRSLWIRFGYDPRKNPDAKIYQVLDFRIRCGMKHGYAPSDLPVKAKRSTYNYSLPITVKKTSSQLVTMHDLKQGLGPSGTSGARKPASSKYKLKDSVYIFREGALPPYRQMFYQLCDLNVEELQKIIHRNDGAENSCTERDGWCLPKTSDELRDTMSLMIRQTIRSKRPALFSSSAKADGGKEQLTYESGEDEEDEEEEEEEEEDFKPSDGSENEMETEILDYV

SEQ ID NO: 4488 - protein, 526 aa, Homo sapiens
MAAEAADLGLGAAVPVELRRERRMVCVEYPGVVRDVAKMLPTLGGEEGVSRIYADPTKRLELYFRPKDPYCHPVCANRFSTSSLLLRIRKRTRRQKGVLGTEAHSEVTFDMEILGIISTIYKFQGMSDFQYLAVHTEAGGKHTSMYDKVLMLRPEKEAFFHQELPLYIPPPIFSRLDAPVDYFYRPETQHREGYNNPPISGENLIGLSRARRPHNAIFVNFEDEEVPKQPLEAAAQTWRRVCTNPVDRKVEEELRKLFDIRPIWSRNAVKANISVHPDKLKVLLPFIAYYMITGPWRSLWIRFGYDPRKNPDAKIYQVLDFRIRCGMKHGYAPSDLPVKAKRSTYNYSLPITVKKTSSQLVTMHDLKQGLGPSGTSGARKPASSKYKLKVSLQTLRDSVYIFREGALPPYRQMFYQLCDLNVEELQKIIHRNDGAENSCTERDGWCLPKTSDELRDTMSLMIRQTIRSKRPALFSSSAKADGGKEQLTYESGEDEEDEEEEEEEEEDFKPSDGSENEMETEILDYV

SEQ ID NO: 4489 - protein, 198 aa, Homo sapiens
  MOD_RES (1)..(1): Any amino acid
XPLEAAAQTWRRVCTNPVDRKVEEELRKLFDIRPIWSRNAVKANISVHPDKLKVLLPFIAYYMITGPWRSLWIRFGYDPRKNPDAKIYQVLDFRIRCGMKHGYAPSDLPVKAKRSTYNYSLPITVKKTSSQLVTMHDLKQGLGPSGTSGARKPASSKYKLKVSLQTSGEEVVTSLREVWHQQLHVVVLLEPFGSLGPH

SEQ ID NO: 4490 - protein, 90 aa, Homo sapiens
  MOD_RES (1)..(1): Any amino acid
XIRCGMKHGYAPSDLPVKAKRSTYNYSLPITVKKTSSQLVTMHDLKQGLGPSGTSGARKPASSKYKLKVGAPGGQEWRGGLPSWGRAPCG

SEQ ID NO: 4491 - protein, 224 aa, Homo sapiens
MSDFQYLAVHTEAGGKHTSMYDKVLMLRPEKEAFFHQELPLYIPPPIFSRLDAPVDYFYRPETQHREGYNNPPISGENLIGLSRARRPHNAIFVNFEDEEVPKQPLEAAAQTWRRVCTNPVDRKVEEELRKLFDIRPIWSRNAVKANISVHPDKLKVLLPFIAYYMITGPWRSLWIRFGYDPRKNPDAKIYQVLDFRIRCGMKHGYAPSDLPVKAKRSTYNYSL

SEQ ID NO: 4492 - protein, 244 aa, Homo sapiens
MTRAIYADPTKRLELYFRPKDPYCHPVCANRFSTSSLLLRIRKRTRRQKGVLGTEAHSEVTFDMEILGIISTIYKFQGMSDFQYLAVHTEAGGKHTSMYDKVLMLRPEKEAFFHQELPLYIPPPIFSRLDAPVDYFYRPETQHREGYNNPPISGENLIGLSRARRPHNAIFVNFEDEEVPKQPLEAAAQTWRRVCTNPVDRKVEEELRKLFDIRPIWSRNAVKANISVHPDKLKVLLPFIAYYM

SEQ ID NO: 4493 - protein, 515 aa, Homo sapiens
MGSLSSRVLRQPRPALAQQAQGARAGGSARRPDTGDDAAGHGFCYCAGSHKRKRSSGSFCYCHPDSETDEDEEEGDEQQRLLNTPRRKKLKSTSKYIYQTLFLNGENSDIKICALGEEWSLHKIYLCQSGYFSSMFSGSWKESSMNIIELEIPDQNIDVEALQVAFGSLYRDDVLIKPSRVVAILAAACLLQLDGLIQQCGETMKETVNVKTVCGYYTSAGTYGLDSVKKKCLEWLLNNLMTHQNVELFKELSINVMKQLIGSSNLFVMQVEMDIYTALKKWMFLQLVPSWNGSLKQLLTETDVWFSKQRKDFEGMAFLETEQGKPFVSVFRHLRLQYIISDLASARIIEQDAVVPSEWLSSVYKQQWFAMLRAEQDSEVGPQEINKEELEGNSMRCGRKLAKDGEYCWRWTGFNFGFDLLVTYTNRYIIFKRNTLNQPCSGSVSLQPRRSIAFRLRLASFDSSGKLICSRTTGYQILTLEKDQEQVVMNLDSRLLIFPLYICCNFLYISPEKKN

SEQ ID NO: 4494 - protein, 436 aa, Homo sapiens
MEPDDFDSEDKEILSWDINDVKLPQNVKKTDWFQEWPDSYAKHIYSSEDKNAQRHLSSWAMRNTNNHNSRILKKSCLGVVVCGRDCLAEEGRKIYLRPAICDKARQKQQRKRCPNCDGPLKLIPCRGHGGFPVTNFWRHDGRFIFFQSKGEHDHPKPETKLEAEARRAMKKVNTAPSSVSLSLKGSTETRSLPGETQSQGSLPLTWSFQEGVQLPGSYSGHLIANTPQQNSLNDCFSFSKSYGLGGITDLTDQTSTVDPMKLYEKRKLSSSRTYSSGDLLPPSASGVYSDHGDLQAWSKNAALGRNHLADNCYSNYPFPLTSWPCSFSPSQNSSEPFYQQLPLEPPAAKTGCPPLWPNPAGNLYEEKVHVDFNSYVQSPAYHSPQEDPFLFTYASHPHQQYSLPSKSSKWDFEEEMTYLGLDHCNNDMLLNLCPLR

SEQ ID NO: 4495 - protein, 506 aa, Homo sapiens
MPAAAVQEAVGVCSYGMQLSWDINDPQMPQELALFDQFREWPDGYVRFIYSSDEKKAQRHLSGWAMRNTNNHNGHILKKSCLGVVVCTQACTLPDGSRLQLRPAICDKARLKQQKKACPNCHSALELIPCRGHSGYPVTNFWRLDGNAIFFQAKGVHDHPRPESKSETEARRSAIKRQMASFYQPQKKRIRESEAEENQDSSGHFSNIPPLENPEDFDIVTETSFPIPGQPCPSFPKSDVYKATCDLATFQGDKMPPFQKYSSPRIYLPRPPCSYELANPGYTNSSPYPTLYKDSTSIPNDTDWVHLNTLQCNVNSYSSYERSFDFTNKQHGWKPALGKPSLVERTNHGQFQAMATRPYYNPELPCRYLTTPPPGAPALQTVITTTTKVSYQAYQPPAMKYSDSVREVKSLSSCNYAPEDTGMSVYPEPWGPPVTVTRAASPSGPPPMKIAGDCRAIRPTVAIPHEPVSSRTDEAETWDVCLSGLGSAVSYSDRVGPFFTYNNEDF

SEQ ID NO: 4496 - protein, 620 aa, Homo sapiens
MAEARTSLSAHCRGPLATGLHPDLDLPGRSLATPAPSCYLLGSEPSSGLGLQPETHLPEGSLKRCCVLGLPPTSPASSSPCASSDVTSIIRSSQTSLVTCVNGLRSPPLTGDLGGPSKRARPGPASTDSHEGSLQLEACRKASFLKQEPADEFSELFGPHQQGLPPPYPLSQLPPGPSLGGLGLGLAGRVVAGRQACRWVDCCAAYEQQEELVRHIEKSHIDQRKGEDFTCFWAGCVRRYKPFNARYKLLIHMRVHSGEKPNKCMFEGCSKAFSRLENLKIHLRSHTGEKPYLCQHPGCQKAFSNSSDRAKHQRTHLDTKPYACQIPGCSKRYTDPSSLRKHVKAHSAKEQQVRKKLHAGPDTEADVLTECLVLQQLHTSTQLAASDGKGGCGLGQELLPGVYPGSITPHNGLASGLLPPAHDVPSRHHPLDATTSSHHHLSPLPMAESTRDGLGPGLLSPIVSPLKGLGPPPLPPSSQSHSPGGQPFPTLPSKPSYPPFQSPPPPPLPSPQGYQGSFHSIQSCFPYGDCYRMAEPAAGGDGLVGETHGFNPLRPNGYHSLSTPLPATGYEALAEASCPTALPQQPSEDVVSSGPEDCGFFPNGAFDHCLGHIPSIYTDT

SEQ ID NO: 4497 - protein, 553 aa, Homo sapiens
MAAVSLRLGDLVWGKLGRYPPWPGKIVNPPKDLKKPRGKKCFFVKFFGTEDHAWIKVEQLKPYHAHKEEMIKINKGKRFQQAVDAVEEFLRRAKGKDQTSSHNSSDDKNRRNSSEERSRPNSGDEKRKLSLSEGKVKKNMGEGKKRVSSGSSERGSKSPLKRAQEQSPRKRGRPPKDEKDLTIPESSTVKGMMAGPMAAFKWQPTASEPVKDADPHFHHFLLSQTEKPAVCYQAITKKLKICEEETGSTSIQAADSTAVNGSITPTDKKIGFLGLGLMGSGIVSNLLKMGHTVTVWNRTAEKCDLFIQEGARLGRTPAEVVSTCDITFACVSDPKAAKDLVLGPSGVLQGIRPGKCYVDMSTVDADTVTELAQVIVSRGGRFLEAPVSGNQQLSNDGMLVILAAGDRGLYEDCSSCFQAMGKTSFFLGEVGNAAKMMLIVNMVQGSFMATIAEGLTLAHVTGQSQQTLLDILNQGQLASIFLDQKCQNILQGNFKPDFYLKYIQKDLRLAIALGDAVNHPTPMAAAANEVYKRAKALDQSDNDMSAVYRAYIH

SEQ ID NO: 4498 - protein, 536 aa, Homo sapiens
MAAVSLRLGDLVWGKLGRYPPWPGKIVNPPKDLKKPRGKKCFFVKFFGTEDHAWIKVEQLKPYHAHKEEMIKINKGKRFQQAVDAVEEFLRRAKGKDQTSSHNSSDDKNRRNSSEERSRPNSGDEKRKLSLSEGKVKKNMGEGKKRVSSGSSERGSKSPLKRAQEQSPRKRGRPPKDEKDLTIPESSTVKGMMAGPMAAFKWQPTASEPVKDADPHFHHFLLSQTEKETGSTSIQAADSTAVNGSITPTDKKIGFLGLGLMGSGIVSNLLKMGHTVTVWNRTAEKCDLFIQEGARLGRTPAEVVSTCDITFACVSDPKAAKDLVLGPSGVLQGIRPGKCYVDMSTVDADTVTELAQVIVSRGGRFLEAPVSGNQQLSNDGMLVILAAGDRGLYEDCSSCFQAMGKTSFFLGEVGNAAKMMLIVNMVQGSFMATIAEGLTLAHVTGQSQQTLLDILNQGQLASIFLDQKCQNILQGNFKPDFYLKYIQKDLRLAIALGDAVNHPTPMAAAANEVYKRAKALDQSDNDMSAVYRAYIH

SEQ ID NO: 4499 - protein, 472 aa, Homo sapiens
MAAVSLRLGDLVWGKLGRYPPWPGKIVNPPKDLKKPRGKKCFFVKFFGTEDHAWIKVEQLKPYHAHKEEMIKINKGKRFQQAVDAVEEFLRRAKGKDQDLTIPESSTVKGMMAGPMAAFKWQPTASEPVKDADPHFHHFLLSQTEKPAVCYQAITKKLKICEEETGSTSIQAADSTAVNGSITPTDKKIGFLGLGLMGSGIVSNLLKMGHTVTVWNRTAEKCDLFIQEGARLGRTPAEVVSTCDITFACVSDPKAAKDLVLGPSGVLQGIRPGKCYVDMSTVDADTVTELAQVIVSRGGRFLEAPVSGNQQLSNDGMLVILAAGDRGLYEDCSSCFQAMGKTSFFLGEVGNAAKMMLIVNMVQGSFMATIAEGLTLAHVTGQSQQTLLDILNQGQLASIFLDQKCQNILQGNFKPDFYLKYIQKDLRLAIALGDAVNHPTPMAAAANEVYKRAKALDQSDNDMSAVYRAYIH

SEQ ID NO: 4500 - protein, 2240 aa, Homo sapiens
MLPCKKRRTTVTESLQHKGNQEENNVDLESAVKPESDQVKDLSSVSLSWDPSHGRVAGFEVQSLQDAGNQLGMEDTSLSSGMLTQNTNVPILEGVDVAISQGITLPSLESFHPLNIHIGKGKLHATGSKRGKKMTLRPGPVTQEDRCDHLTLKEPFSGEPSEEVKEEGGKPQMNSEGEIPSLPSGSQSAKPVSQPRKSTQPDVCASPQEKPLRTLFHQPEEEIEDGGLFIPMEEQDNEESEKRRKKKKGTKRKRDGRGQEGTLAYDLKLDDMLDRTLEDGAKQHNLTAVNVRNILHEVITNEHVVAMMKAAISETEDMPMFEPKMTRSKLKEVVEKGVVIPTWNISPIKKANEIKPPQFVDIHLEEDDSSDEEYQPDDEEEDETAEESLLESDVESTASSPRGAKKSRLRQSSEMTETDEESGILSEAEKVTTPAIRHISAEVVPMGPPPPPKPKQTRDSTFMEKLHAVDEELASSPVCMDSFQPMDDSLIAFRTRSKMPLKDVPLGQLEAELQAPDITPDMYDPNTADDEDWKMWLGGLMNDDVGNEDEADDDDDPEYNFLEDLDEPDTEDFRTDRAVRITKKEVNELMEELFETFQDEMGFSNMEDDGPEEEECVAEPRPNFNTPQALRFEEPLANLLNEQHRTVKELFEQLKMKKSSAKQLQEVEKVKPQSEKVHQTLILDPAQRKRLQQQMQQHVQLLTQIHLLATCNPNLNPEATTTRIFLKELGTFAQSSIALHHQYNPKFQTLFQPCNLMGAMQLIEDFSTHVSIDCSPHKTVKKTANEFPCLPKQVAWILATSKVFMYPELLPVCSLKAKNPQDKIVFTKAEDNLLALGLKHFEGTEFPNPLISKYLLTCKTAHQLTVRIKNLNMNRAPDNIIKFYKKTKQLPVLGKCCEEIQPHQWKPPIEREEHRLPFWLKASLPSIQEELRHMADGAREVGNMTGTTEINSDRSLEKDNLELGSESRYPLLLPKGVVLKLKPVATRFPRKAWRQKRSSVLKPLLIQPSPSLQPSFNPGKTPARSTHSEAPPSKMVLRIPHPIQPATVLQTVPGVPPLGVSGGESFESPAALPAVPPEARTSFPLSESQTLLSSAPVPKVMLPSLAPSKFRKPYVRRRPSKRRGVKASPCMKPAPVIHHPASVIFTVPATTVKIVSLGGGCNMIQPVNAAVAQSPQTIPITTLLVNPTSFPCPLNQSLVASSVSPLIVSGNSVNLPIPSTPEDKAHVNVDIACAVADGENAFQGLEPKLEPQELSPLSATVFPKVEHSPGPPLADAECQEGLSENSACRWTVVKTEEGRQALEPLPQGIQESLNNPTPGDLEEIVKMEPEEAREEISGSPERDICDDIKVEHAVELDTGAPSEELSSAGEVTKQTVLQKEEERSQPTKTPSSSQEPPDEGTSGTDVNKGSSKNALSSMDPEVRLSSPPGKPEDSSSVDGQSVGTPVGPETGGEKNGPEEEEEEDFDDLTQDEEDEMSSASEESVLSVPELQETMEKLTWLASERRMSQEGESEEENSQEENSEPEEEEEEEAEGMESLQKEDEMTDEAVGDSAEKPPTFASPETAPEVETSRTPPGESIKAAGKGRNNHRARNKRGSRARASKDTSKLLLLYDEDILERDPLREQKDLAFAQAYLTRVREALQHIPGKYEDFLQVIYEFESSTQRRTAVDLYKSLQILLQDWPQLLKDFAAFLLPEQALACGLFEEQQAFEKSRKFLRQLEICFAENPSHHQKIIKVLQGCADCLPQEITELKTQMWQLLKGHDHLQDEFSIFFDHLRPAASRMGDFEEINWTEEKEYEFDGFEEVALPDVEEEEEPPKIPTASKNKRKKEIGVQNHDKETEWPDGAKDCACSCHEGGPDSKLKKSKRRSCSHCSSKVCDSKSYKSKEPHELVGSSPHREASPMPGAKEAGQGKDMMEEEAPEERESTEATQSRTVRTTRKGEMPVSGLAVGSTLPSPREVTVTERLLLDGPPPHSPETPQFPPTTGAVLYTVKRNQVGPEVRSCPKASPRLQKEREGQKAVSESEALMLVWDASETEKLPGTVEPPASFLSPVSSKTRDAGRRHVSGKPDTQERWLPSSRARVKTRDRTCPVHESPSGIDTSETSPKAPRGGLAKDSGTQAKGPEGEQQPKAAEATVCANNSKVSSTGEKVVLWTREADRVILTMCQEQGAQPQTFNIISQQLGNKTPAEVSHRFRELMQLFHTACEASSEDEDDATSTSNADQLSDHGDLLSEEELDE

SEQ ID NO: 4501 - protein, 1529 aa, Homo sapiens
MLPCKKRRTTVTESLQHKGNQEENNVDLESAVKPESDQVKDLSSVSLSWDPSHGRVAGFEVQSLQDAGNQLGMEDTSLSSGMLTQNTNVPILEGVDVAISQGITLPSLESFHPLNIHIGKGKLHATGSKRGKKMTLRPGPVTQEDRCDHLTLKEPFSGEPSEEVKEEGGKPQMNSEGEIPSLPSGSQSAKPVSQPRKSTQPDVCASPQEKPLRTLFHQPEEEIEDGGLFIPMEEQDNEESEKRRKKKKGTKRKRDGRGQEGTLAYDLKLDDMLDRTLEDGAKQHNLTAVNVRNILHEVITNEHVVAMMKAAISETEDMPMFEPKMTRSKLKEVVEKGVVIPTWNISPIKKANEIKPPQFVDIHLEEDDSSDEEYQPDDEEEDETAEESLLESDVESTASSPRGAKKSRLRQSSEMTETDEESGILSEAEKVTTPAIRHISAEVVPMGPPPPPKPKQTRDSTFMEKLHAVDEELASSPVCMDSFQPMDDSLIAFRTRSKMPLKDVPLGQLEAELQAPDITPDMYDPNTADDEDWKMWLGGLMNDDVGNEDEADDDDDPEYNFLEDLDEPDTEDFRTDRAVRITKKEVNELMEELFETFQDEMGFSNMEDDGPEEEECVAEPRPNFNTPQALRFEEPLANLLNEQHRTVKELFEQLKMKKSSAKQLQEVEKVKPQSEKVHQTLILDPAQRKRLQQQMQQHVQLLTQIHLLATCNPNLNPEATTTRIFLKELGTFAQSSIALHHQYNPKFQTLFQPCNLMGAMQLIEDFSTHVSIDCSPHKTVKKTANEFPCLPKQVAWILATSKVFMYPELLPVCSLKAKNPQDKIVFTKAEDNLLALGLKHFEGTEFPNPLISKYLLTCKTAHQLTVRIKNLNMNRAPDNIIKFYKKTKQLPVLGKCCEEIQPHQWKPPIEREEHRLPFWLKASLPSIQEELRHMADGAREVGNMTGTTEINSDRSLEKDNLELGSESRYPLLLPKGVVLKLKPVATRFPRKAWRQKRSSVLKPLLIQPSPSLQPSFNPGKTPARSTHSEAPPSKMVLRIPHPIQPATVLQTVPGVPPLGVSGGESFESPAALPAVPPEARTSFPLSESQTLLSSAPVPKVMLPSLAPSKFRKPYVRRRPSKRRGVKASPCMKPAPVIHHPASVIFTVPATTVKIVSLGGGCNMIQPVNAAVAQSPQTIPITTLLVNPTSFPCPLNQSLVASSVSPLIVSGNSVNLPIPSTPEDKAHVNVDIACAVADGENAFQGLEPKLEPQELSPLSATVFPKVEHSPGPPLADAECQEGLSENSACRWTVVKTEEGRQALEPLPQGIQESLNNPTPGDLEEIVKMEPEEAREEISGSPERDICDDIKVEHAVELDTGAPSEELSSAGEVTKQTVLQKEEERSQPTKTPSSSQEPPDEGTSGTDVNKGSSKNALSSMDPEVRLSSPPGKPEDSSSVDGQSVGTPVGPETGGEKNGPEEEEEEDFDDLTQDEEDEMSSASEESVLSVPELQVRAGEYSQVFRGLSNMYHLLICHLLACCTMDSPKIICI

SEQ ID NO: 4502 - protein, 241 aa, Homo sapiens
MYDPNTADDEDWKMWLGGLMNDDVGNEDEADDDDDPEYNFLEDLDEPDTEDFRTDRAVRITKKEVNELMEELFETFQDEMGFSNMEDDGPEEEECVAEPRPNFNTPQALRFEEPLANLLNEQHRTVKELFEQLKMKKSSAKQLQEVEKVKPQSEKVHQTLILDPAQRKRLQQQMQQKELGTFAQSSIALHHQYNPKFQTLFQPCNLMGAMQLIEDFSTHVSIDCSPHKTVKKTGRRQMCQL

SEQ ID NO: 4503 - protein, 2241 aa, Homo sapiens
MLPCKKRRTTVTESLQHKGNQEENNVDLESAVKPESDQVKDLSSVSLSWDPSHGRVAGFEVQSLQDAGNQLGMEDTSLSSGMLTQNTNVPILEGVDVAISQGITLPSLESFHPLNIHIGKGKLHATGSKRGKKMTLRPGPVTQEDRCDHLTLKEPFSGEPSEEVKEEGGKPQMNSEGEIPSLPSGSQSAKPVSQPRKSTQPDVCASPQEKPLRTLFHQPEEEIEDGGLFIPMEEQDNEESEKRRKKKKGTKRKRDGRGQEGTLAYDLKLDDMLDRTLEDGAKQHNLTAVNVRNILHEVITNEHVVAMMKAAISETEDMPMFEPKMTRSKLKEVVEKGVVIPTWNISPIKKANEIKPPQFVDIHLEEDDSSDEEYQPDDEEEDETAEESLLESDVESTASSPRGAKKSRLRQSSEMTETDEESGILSEAEKVTTPAIRHISAEVVPMGPPPPPKPKQTRDSTFMEKLHAVDEELASSPVCMDSFQPMDDSLIAFRTRSKMPLKDVPLGQLEAELQAPDITPDMYDPNTADDEDWKMWLGGLMNDDVGNEDEADDDDDPEYNFLEDLDEPDTEDFRTDRAVRITKKEVNELMEELFETFQDEMGFSNMEDDGPEEEECVAEPRPNFNTPQALRFEEPLANLLNEQHRTVKELFEQLKMKKSSAKQLQEVEKVKPQSEKVHQTLILDPAQRKRLQQQMQQHVQLLTQIHLLATCNPNLNPEATTTRIFLKELGTFAQSSIALHHQYNPKFQTLFQPCNLMGAMQLIEDFSTHVSIDCSPHKTVKKTANEFPCLPKQVAWILATSKVFMYPELLPVCSLKAKNPQDKIVFTKAEDNLLALGLKHFEGTEFPNPLISKYLLTCKTAHQLTVRIKNLNMNRAPDNIIKFYKKTKQLPVLGKCCEEIQPHQWKPPIEREEHRLPFWLKASLPSIQEELRHMADGAREVGNMTGTTEINSDRSLEKDNLELGSESRYPLLLPKGVVLKLKPVATRFPRKAWRQKRSSVLKPLLIQPSPSLQPSFNPGKTPARSTHSEAPPSKMVLRIPHPIQPATVLQTVPGVPPLGVSGGESFESPAALPAVPPEARTSFPLSESQTLLSSAPVPKVMLPSLAPSKFRKPYVRRRPSKRRGVKASPCMKPAPVIHHPASVIFTVPATTVKIVSLGGGCNMIQPVNAAVAQSPQTIPITTLLVNPTSFPCPLNQSLVASSVSPLIVSGNSVNLPIPSTPEDKAHVNVDIACAVADGENAFQGLEPKLEPQELSPLSATVFPKVEHSPGPPLADAECQEGLSENSACRWTVVKTEEGRQALEPLPQGIQESLNNPTPGDLEEIVKMEPEEAREEISGSPERDICDDIKVEHAVELDTGAPSEELSSAGEVTKQTVLQKEEERSQPTKTPSSSQEPPDEGTSGTDVNKGSSKNALSSMDPEVRLSSPPGKPEDSSSVDGQSVGTPVGPETGGEKNGPEEEEEEDFDDLTQDEEDEMSSASEESVLSVPELQETMEKLTWLASERRMSQEGESEEENSQEENSEPEEEEEEEAEGMESLQKEDEMTDEAVGDSAEKPPTFASPETAPEVETSRTPPGESIKAAGKGRNNHRARNKRGSRARASKDTSKLLLLYDEDILERDPLREQKDLAFAQAYLTRVREALQHIPGKYEDFLQVIYEFESSTQRRTAVDLYKSLQILLQDWPQLLKDFAAFLLPEQALACGLFEEQQAFEKSRKFLRQLEICFAENPSHHQKIIKVLQGCADCLPQEITELKTQMWQLLKGHDHLQDEFSIFFDHLRPAASRMGDFEEINWTEEKEYEFDGFEEVALPDVEEEEEPPKIPTASKNKRKKEIGVQNHDKETEWPDGAKDCACSCHEGGPDSKLKKSKRRSCSHCSSKVCDSKSYKSKEPHELVGSSPHREASPMPGAKEAGQGKDMMEEEAPEERESTEATQSRTVRTTRKGEMPVSAGLAVGSTLPSPREVTVTERLLLDGPPPHSPETPQFPPTTGAVLYTVKRNQVGPEVRSCPKASPRLQKEREGQKAVSESEALMLVWDASETEKLPGTVEPPASFLSPVSSKTRDAGRRHVSGKPDTQERWLPSSRARVKTRDRTCPVHESPSGIDTSETSPKAPRGGLAKDSGTQAKGPEGEQQPKAAEATVCANNSKVSSTGEKVVLWTREADRVILTMCQEQGAQPQTFNIISQQLGNKTPAEVSHRFRELMQLFHTACEASSEDEDDATSTSNADQLSDHGDLLSEEELDE

SEQ ID NO: 4504 - protein, 2240 aa, Homo sapiens; identical to SEQ ID NO: 4500

SEQ ID NO: 4505 - protein, 970 aa, Homo sapiens
MLPCKKRRTTVTESLQHKGNQEENNVDLESAVKPESDQVKDLSSVSLSWDPSHGRVAGFEVQSLQDAGNQLGMEDTSLSSGMLTQNTNVPILEGVDVAISQGITLPSLESFHPLNIHIGKGKLHATGSKRGKKMTLRPGPVTQEDRCDHLTLKEPFSGEPSEEVKEEGGKPQMNSEGEIPSLPSGSQSAKPVSQPRKSTQPDVCASPQEKPLRTLFHQPEEEIEDGGLFIPMEEQDNEESEKRRKKKKGTKRKRDGRGQEGTLAYDLKLDDMLDRTLEDGAKQHNLTAVNVRNILHEVITNEHVVAMMKAAISETEDMPMFEPKMTRSKLKEVVEKGVVIPTWNISPIKKANEIKPPQFVDIHLEEDDSSDEEYQPDDEEEDETAEESLLESDVESTASSPRGAKKSRLRQSSEMTETDEESGILSEAEKVTTPAIRHISAEVVPMGPPPPPKPKQTRDSTFMEKLHAVDEELASSPVCMDSFQPMDDSLIAFRTRSKMPLKDVPLGQLEAELQAPDITPDMYDPNTADDEDWKMWLGGLMNDDVGNEDEADDDDDPEYNFLEDLDEPDTEDFRTDRAVRITKKEVNELMEELFETFQDEMGFSNMEDDGPEEEECVAEPRPNFNTPQALRFEEPLANLLNEQHRTVKELFEQLKMKKSSAKQLQEVEKVKPQSEKVHQTLILDPAQRKRLQQQMQQHVQLLTQIHLLATCNPNLNPEATTTRIFLKELGTFAQSSIALHHQYNPKFQTLFQPCNLMGAMQLIEDFSTHVSIDCSPHKTVKKTANEFPCLPKQVAWILATSKVFMYPELLPVCSLKAKNPQDKIVFTKAEDNLLALGLKHFEGTEFPNPLISKYLLTCKTAHQLTVRIKNLNMNRAPDNIIKFYKKTKQLPVLGKCCEEIQPHQWKPPIEREEHRLPFWLKASLPSIQEELRHMADGARQSYRRKRRGVSQLKPLHLLKSPLMKEPQGQM

SEQ ID NO: 4506 - protein, 205 aa, Homo sapiens
MAAAAGGAASRRGAGRPCPFSIEHILSSLPERSLPARAACPPQPAGRQSPAKPEEPGAPEAAPCACCCCCGPRAAPCGPPEAAAGLGARLAWPLRLGPAVPLSLGAPAGGSGALPGAVGPGSQRRTRRHRTIFSEEQLQALEALFVQNQYPDVSTRERLAGRIRLREERVEVWFKNRRAKWRHQKRASASARLLPGVKKSPKGSC

SEQ ID NO: 4507 - protein, 607 aa, Homo sapiens
MWMNSILPIFLFRSVRLLKNDPVNLQKFSYTSEDEAWKTYLENPLTAATKAMMRVNGDDDSVAALSFLYDYYMGPKEKRILSSSTGGRNDQGKRYYHGMEYETDLTPLESPTHLMKFLTENVSGTPEYPDLLKKNNLMSLEGALPTPGKAAPLPAGPSKLEAGSVDSYLLPTTDMYDNGSLNSLFESIHGVPPTQRWQPDSTFKDDPQESMLFPDILKTSPEPPCPEDYPSLKSDFEYTLGSPKAIHIKSGESPMAYLNKGQFYPVTLRTPAGGKGLALSSNKVKSVVMVVFDNEKVPVEQLRFWKHWHSRQPTAKQRVIDVADCKENFNTVEHIEEVAYNALSFVWNVNEEAKVFIGVNCLSTDFSSQKGVKGVPLNLQIDTYDCGLGTERLVHRAVCQIKIFCDKGAERKMRDDERKQFRRKVKCPDSSNSGVKGCLLSGFRGNETTYLRPETDLETPPVLFIPNVHFSSLQRSGGAAPSAGPSSSNRLPLKRTCSPFTEEFEPLPSKQAKEGDLQRVLLYVRRETEEVFDALMLKTPDLKGLRNAISEKYGFPEENIYKVYKKCKRGILVNMDNNIIQHYSNHVAFLLDMGELDGKIQIILKEL

SEQ ID NO: 4508 - protein, 509 aa, Homo sapiens
MEYETDLTPLESPTHLMKFLTENVSGTPEYPDLLKKNNLMSLEGALPTPGKAAPLPAGPSKLEAGSVDSYLLPTTDMYDNGSLNSLFESIHGVPPTQRWQPDSTFKDDPQESMLFPDILKTSPEPPCPEDYPSLKSDFEYTLGSPKAIHIKSGESPMAYLNKGQFYPVTLRTPAGGKGLALSSNKVKSVVMVVFDNEKVPVEQLRFWKHWHSRQPTAKQRVIDVADCKENFNTVEHIEEVAYNALSFVWNVNEEAKVFIGVNCLSTDFSSQKGVKGVPLNLQIDTYDCGLGTERLVHRAVCQIKIFCDKGAERKMRDDERKQFRRKVKCPDSSNSGVKGCLLSGFRGNETTYLRPETDLETPPVLFIPNVHFSSLQRSGGAAPSAGPSSSNRLPLKRTCSPFTEEFEPLPSKQAKEGDLQRVLLYVRRETEEVFDALMLKTPDLKGLRNAISEKYGFPEENIYKVYKKCKRGILVNMDNNIIQHYSNHVAFLLDMGELDGKIQIILKEL

SEQ ID NO: 4509 - protein, 626 aa, Homo sapiens
MSNELDFRSVRLLKNDPVNLQKFSYTSEDEAWKTYLENPLTAATKAMMRVNGDDDSVAALSFLYDYYMGPKEKRILSSSTGGRNDQGKRYYHGMEYETDLTPLESPTHLMKFLTENVSGTPEYPDLLKKNNLMSLEGALPTPGKAAPLPAGPSKLEAGSVDSYLLPTTDMYDNGSLNSLFESIHGVPPTQRWQPDSTFKDDPQESMLFPDILKTSPEPPCPEDYPSLKSDFEYTLGSPKAIHIKSGESPMAYLNKGQFYPVTLRTPAGGKGLALSSNKVKSVVMVVFDNEKVPVEQLRFWKHWHSRQPTAKQRVIDVADCKENFNTVEHIEEVAYNALSFVWNVNEEAKVFIGVNCLSTDFSSQKGVKGVPLNLQIDTYDCGLGTERLVHRAVCQIKIFCDKGAERKMRDDERKQFRRKVKCPDSSNSGVKGCLLSGFRGNETTYLRPETDLETPPVLFIPNVHFSSLQRSGGAAPSAGPSSSNRLPLKRTCSPFTEEFEPLPSKQAKEGDLQRVLLYVRRETEEVFDALMLKTPDLKGLRNAISEKYGFPEENIYKVYKKCKRGETSLLHPRLSRHPPPDCLECSHPVTQVRNMGFGDGFWRQRDLDSNPSPTTVNSLHFTVNSE

SEQ ID NO: 4510 - protein, 556 aa, Homo sapiens
MMRVNGDDDSVAALSFLYDYYMGPKEKRILSSSTGGRNDQGKRYYHGMEYETDLTPLESPTHLMKFLTENVSGTPEYPDLLKKNNLMSLEGALPTPGKAAPLPAGPSKLEAGSVDSYLLPTTDMYDNGSLNSLFESIHGVPPTQRWQPDSTFKDDPQESMLFPDILKTSPEPPCPEDYPSLKSDFEYTLGSPKAIHIKSGESPMAYLNKGQFYPVTLRTPAGGKGLALSSNKVKSVVMVVFDNEKVPVEQLRFWKHWHSRQPTAKQRVIDVADCKENFNTVEHIEEVAYNALSFVWNVNEEAKVFIGVNCLSTDFSSQKGVKGVPLNLQIDTYDCGLGTERLVHRAVCQIKIFCDKGAERKMRDDERKQFRRKVKCPDSSNSGVKGCLLSGFRGNETTYLRPETDLETPPVLFIPNVHFSSLQRSGGAAPSAGPSSSNRLPLKRTCSPFTEEFEPLPSKQAKEGDLQRVLLYVRRETEEVFDALMLKTPDLKGLRNAISEKYGFPEENIYKVYKKCKRGILVNMDNNIIQHYSNHVAFLLDMGELDGKIQIILKEL

SEQ ID NO: 4511 - protein, 602 aa, Homo sapiens
MSNELDFRSVRLLKNDPVNLQKFSYTSEDEAWKTYLENPLTAATKAMMRVNGDDDSVAALSFLYDYYMGPKEKRILSSSTGGRNDQGKRYYHGMEYETDLTPLESPTHLMKFLTENVSGTPEYPDLLKKNNLMSLEGALPTPGKAAPLPAGPSKLEAGSVDSYLLPTTDMYDNGSLNSLFESIHGVPPTQRWQPDSTFKDDPQESMLFPDILKTSPEPPCPEDYPSLKSDFEYTLGSPKAIHIKSGESPMAYLNKGQFYPVTLRTPAGGKGLALSSNKVKSVVMVVFDNEKVPVEQLRFWKHWHSRQPTAKQRVIDVADCKENFNTVEHIEEVAYNALSFVWNVNEEAKVFIGVNCLSTDFSSQKGVKGVPLNLQIDTYDCGLGTERLVHRAVCQIKIFCDKGAERKMRDDERKQFRRKVKCPDSSNSGVKGCLLSGFRGNETTYLRPETDLETPPVLFIPNVHFSSLQRSGGAAPSAGPSSSNRLPLKRTCSPFTEEFEPLPSKQAKEGDLQRVLLYVRRETEEVFDALMLKTPDLKGLRNAISEKYGFPEENIYKVYKKCKRGILVNMDNNIIQHYSNHVAFLLDMGELDGKIQIILKEL

SEQ ID NO: 4512 - protein, 264 aa, Homo sapiens
MPRSFLVDSLVLREAGEKKAPEGSPPPLFPYAVPPPHALHGLSPGACHARKAGLLCVCPLCVTASQLHGPPGPPALPLLKASFPPFGSQYCHAPLGRQHSAVSPGVAHGPAAAAAAAALYQTSYPLPDPRQFHCISVDSSSNQLPSSKRMRTAFTSTQLLELEREFASNMYLSRLRRIEIATYLNLSEKQVKIWFQNRRVKHKKEGKGSNHRGGGGGGAGGGGSAPQGCKCASLSSAKCSEDDDELPMSPSSSGKDDRDLTVTP

SEQ ID NO: 4513 - protein, 304 aa, Homo sapiens
MSRSFYVDSLIIKDTSRPAPSLPEPHPGPDFFIPLGMPPPLVMSVSGPGCPSRKSGAFCVCPLCVTSHLHSSRGSVGAGSGGAGAGVTGAGGSGVAGAAGALPLLKGQFSSAPGDAQFCPRVNHAHHHHHPPQHHHHHHQPQQPGSAAAAAAAAAAAAAAAALGHPQHHAPVCTATTYNVADPRRFHCLTMGGSDASQVPNGKRMRTAFTSTQLLELEREFSSNMYLSRLRRIEIATYLNLSEKQVKIWFQNRRVKHKKEGKGTQRNSHAGCKCVGSQVHYARSEDEDSLSPASANDDKEISPL

SEQ ID NO: 4514 - protein, 949 aa, Homo sapiens
MAQVAVSTLPVEEESSSETRMVVTFLVSALESMCKELAKSKAEVACIAVYETDVFVVGTERGCAFVNARTDFQKDFAKYCVAEGLCEVKPPCPVNGMQVHSGETEILRKAVEDYFCFCYGKALGTTVMVPVPYEKMLRDQSAVVVQGLPEGVAFQHPENYDLATLKWILENKAGISFIINRPFLGPESQLGGPGMVTDAERSIVSPSESCGPINVKTEPMEDSGISLKAEAVSVKKESEDPNYYQYNMQGSHPSSTSNEVIEMELPMEDSTPLVPSEEPNEDPEAEVKIEGNTNSSSVTNSAAGVEDLNIVQVTVPDNEKERLSSIEKIKQLREQVNDLFSRKFGEAIGVDFPVKVPYRKITFNPGCVVIDGMPPGVVFKAPGYLEISSMRRILEAAEFIKFTVIRPLPGLELSNVGKRKIDQEGRVFQEKWERAYFFVEVQNIPTCLICKQSMSVSKEYNLRRHYQTNHSKHYDQYMERMRDEKLHELKKGLRKYLLGLSDTECPEQKQVFAHPSPTQKSPVQPVEDLAGNLWEKLREKIRSFVAYSIAIDEITDINNTTQLAIFIRGVDENFDVSEELLDTVPMTGTKSGNEIFSRVEKSLKKFCIDWSKLVSVASTGTPAMVDANNGLVTKLKSRVATFCKGAELKSICCIIHPESLCAQKLKMDHVMDVVVKSVNWICSRGLNHSEFTTLLYELDSQYGSLLYYTEIKWLSRGLVLKRFFESLEEIDSFMSSRGKPLPQLSSIDWIRDLAFLVDMTMHLNALNISLQGHSQIVTQMYDLIRAFLAKLCLWETHLTRNNLAHFPTLKLASRNESDGLNYIPKIAELKTEFQKRLSDFKLYESELTLFSSPFSTKIDSVHEELQMEVIDLQCNTVLKTKYDKVGIPEFYKYLWGSYPKYKHHCAKILSMFGSTYICEQLFSIMKLSKTKYCSQLKDSQWDSVLHIAT

SEQ ID NO: 4515 - protein, 496 aa, Homo sapiens
MSVSKEYNLRRHYQTNHSKHYDQYMERMRDEKLHELKKGLRKYLLGLSDTECPEQKQVFAHPSPTQKSPVQPVEDLAGNLWEKLREKIRSFVAYSIAIDEITDINNTTQLAIFIRGVDENFDVSEELLDTVPMTGTKSGNEIFSRVEKSLKKFCIDWSKLVSVASTGTPAMVDANNGLVTKLKSRVATFCKGAELKSICCIIHPESLCAQKLKMDHVMDVVVKSVNWICSRGLNHSEFTTLLYELDSQYGSLLYYTEIKWLSRGLVLKRFFESLEEIDSFMSSRGKPLPQLSSIDWIRDLAFLVDMTMHLNALNISLQGHSQIVTQMYDLIRAFLAKLCLWETHLTRNNLAHFPTLKLASRNESDGLNYIPKIAELKTEFQKRLSDFKLYESELTLFSSPFSTKIDSVHEELQMEVIDLQCNTVLKTKYDKVGIPEFYKYLWGSYPKYKHHCAKILSMFGSTYICEQLFSIMKLSKTKYCSQLKDSQWDSVLHIAT

SEQ ID NO: 4516 - protein, 226 aa, Homo sapiens
MAQVAVSTLPVEEESSSETRMVVTFLVSALESMCKELAKSKAEVACIAVYETDVFVVGTERGCAFVNARTDFQKDFAKYCVAEGLCEVKPPCPVNGMQVHSGETEILRKAVEDYFCFCYGKALGTTVMVPVPYEKMLRDQSAVVVQGLPEGVAFQHPENYDLATLKWILENKAGISFIINRPFLGPESQLGGPGMVTDAERSIVSPSERHFTESRSCLSQERIRRS

SEQ ID NO: 4517 - protein, 949 aa, Homo sapiens
MAQVAVSTLPVEEESSSETRMVVTFLVSALESMCKELAKSKAEVACIAVYETDVFVVGTERGCAFVNARTDFQKDFAKYCVAEGLCEVKPPCPVNGMQVHSGETEILRKAVEDYFCFCYGKALGTTVMVPVPYEKMLRDQSAVVVQGLPEGVAFQHPENYDLATLKWILENKAGISFIINRPFLGPESQLGGPGMVTDAERSIVSPSESCGPINVKTEPMEDSGISLKAEAVSVKKESEDPNYYQYNMQGSHPSSTSNEVIEMELPMEDSTPLVPSEEPNEDPEAEVKIEGNTNSSSVTNSAAGVEDLNIVQVTVPDNEKERLSSIEKIKQLREQVNDLFSRKFGEAIGVDFPVKVPYRKITFNPGCVVIDGMPPGVVFKAPGYLEISSMRRILEAAEFIKFTVIRPLPGLELSNVGKRKIDQEGRVFQEKWERAYFFVEVQNIPTCLICKQSMSVSKEYNLRRHYQTNHSKHYDQYTERMRDEKLHELKKGLRKYLLGSSDTECPEQKQVFANPSPTQKSPVQPVEDLAGNLWEKLREKIRSFVAYSIAIDEITDINNTTQLAIFIRGVDENFDVSEELLDTVPMTGTKSGNEIFLRVEKSLKKFCINWSRLVSVASTGTPAMVDANNGLVTKLKSRVATFCKGAELKSICCIIHPESLCAQKLKMDHVMDVVVKSVNWICSRGLNHSEFTTLLYELDSQYGSLLYYTEIKWLSRGLVLKRFFESLEEIDSFMSSRGKPLPQLSSIDWIRDLAFLVDMTMHLNALNISLQGHSQIVTQMYDLIRAFLAKLCLWETHLTRNNLAHFPTLKLVSRNESDGLNYIPKIAELKTEFQKRLSDFKLYESELTLFSSPFSTKIDSVHEELQMEVIDLQCNTVLKTKYDKVGIPEFYKYLWGSYPKYKHHCAKILSMFGSTYICEQLFSIMKLSKTKYCSQLKDSQWDSVLHIAT

SEQ ID NO: 4518 - protein, 364 aa, Homo sapiens
MTGTKSGNEIFLRVEKSLKKFCINWSRLVSVASTGTPAMVDANNGLVTKLKSRVATFCKGAELKSICCIIHPESLCAQKLKMDHVMDVVVKSVNWICSRGLNHSEFTTLLYELDSQYGSLLYYTEIKWLSRGLVLKRFFESLEEIDSFMSSRGKPLPQLSSIDWIRDLAFLVDMTMHLNALNISLQGHSQIVTQMYDLIRAFLAKLCLWETHLTRNNLAHFPTLKLVSRNESDGLNYIPKIAELKTEFQKRLSDFKLYESELTLFSSPFSTKIDSVHEELQMEVIDLQCNTVLKTKYDKVGIPEFYKYLWGSYPKYKHHCAKILSMFGSTYICEQLFSIMKLSKTKYCSQLKDSQWDSVLHIAT

SEQ ID NO: 4519 - protein, 496 aa, Homo sapiens [sequence omitted]

SEQ ID NO: 4520 - protein, 226 aa, Homo sapiens; identical to SEQ ID NO: 4516

SEQ ID NO: 4521 - protein, 255 aa, Homo sapiens
MEQALTGEAQSRWPRRGGSGAMAEAPGPSGESRGHSATQLPAEKTVGGPSRGCSSSVLRVSQLVLQAISTHKGLTLAALKKELRNAGYEVRRKSGRHEAPRGQAKATLLRVSGSDAAGYFRVWKVPKPRRKPGRARQEEGTRAPWRTPAAPRSSRRRRQPLRKAARKAREVWRRNARAKAKANARARRTRRARPRAKEPPCARAKEEAGATAADEGRGQAVKEDTTPRSGKDKRRSSKPREEKQEPKKPAQRTIQ

SEQ ID NO: 4522 - protein, 213 aa, Homo sapiens
MSVELEEALPVTTAEGMAKKVTKAGGSAALSPSKKRKNSKKKNQPGKYSQLVVETIRRLGERNGSSLAKIYTEAKKVPWFDQQNGRTYLKYSIKALVQNDTLLQVKGTGANGSFKLNRKKLEGGGERRGAPAAATAPAPTAHKAKKAAPGAAGSRRADKKPARGQKPEQRSHKKGAGAKKDKGGKAKKTAAAGGKKVKKAAKPSVPKVPKGRK

SEQ ID NO: 4523 - protein, 488 aa, Homo sapiens
MFAAGLAPFYASNFSLWSAAYCSSAGPGGCSFPLDPAAVKKPSFCIADILHAGVGDLGAAPEGLAGASAAALTAHLGSVHPHASFQAAARSPLRPTPVVAPSEVPAGFPQRLSPLSAAYHHHHPQQQQQQQQPQQQQPPPPPRAGALQPPASGTRVVPNPHHSGSAPAPSSKDLKFGIDRILSAEFDPKVKEGNTLRDLTSLLTGGRPAGVHLSGLQPSAGQFFASLDPINEASAILSPLNSNPRNSVQHQFQDTFPGPYAVLTKDTMPQTYKRKRSWSRAVFSNLQRKGLEKRFEIQKYVTKPDRKQLAAMLGLTDAQVKVWFQNRRMKWRHSKEAQAQKDKDKEAGEKPSGGAPAADGEQDERSPSRSEGEAESESSDSESLDMAPSDTERTEGSERSLHQTTVIKAPVTGALITASSAGSGGSSGGGGNSFSFSSASSLSSSSTSAGCASSLGGGGASELLPATQPTASSAPKSPEPAQGALGCL

SEQ ID NO: 4524 - protein, 371 aa, Homo sapiens
MSSRGGKKKSTKTSRSAKAGVIFPVGRMLRYIKKGHPKYRIGVGAPVYMAAVLEYLTAEILELAGNAARDNKKGRVTPRHILLAVANDEELNQLLKGVTIASGGVLPNIHPELLAKKRGSKGKLEAIITPPPAKKAKSPSQKKPVSKKAGGKKGARKSKKQGEVSKAASADSTTEGTPADGFTVLSTKSLFLGQKLNLIHSEISNLAGFEVEAIINPTNADIDLKDDLGNTLEKKGGKEFVEAVLELRKKNGPLEVAGAAVSAGHGLPAKFVIHCNSPVWGADKCEELLEKTVKNCLALADDKKLKSIAFPSIGSGRNGFPKQTAAQLILKAISSYFVSTMSSSIKTVYFVLFDSESIGIYVQEMAKLDAN

SEQ ID NO: 4525 - protein, 115 aa, Homo sapiens
MPRRRRRRGSSGAGGRGRTCSRTVRAELSFSVSQVERSLREGHYAQRLSRTAPVYLAAVIEYLTAKVPELAGNEAQNSGERNITPLLLDMVVHNDRLLSTLFNTTTISQVAPGED

SEQ ID NO: 4526 - protein, 115 aa, Homo sapiens
MPRRRRRRGSSGAGGRGRTCSRTVRAELSFSVSQVERSLREGHYAQRLSRTAPVYLAAVIEYLTAKVLELAGNEAQNSGERNITPLLLDMVVHNDRLLSTLFNTTTISQVAPGED

SEQ ID NO: 4527 - protein, 115 aa, Homo sapiens; identical to SEQ ID NO: 4526

SEQ ID NO: 4528 - protein, 151 aa, Homo sapiens
MSGRGKQGGKVRAKAKSRSSRAGLQFPVGRVHRLLRKGNYAERVGAGAPVYLAAVLEYLTAEILELAGNAARDNKKTRIIPRHLQLAIRNDEELNKLLGKVTIAQGGVLPNIQAVLLPICEHSGPSSGKIPSDRAELGAGSVCGHIFQKVE

SEQ ID NO: 4529 - protein, 129 aa, Homo sapiens
MSGRGKQGGKVRAKAKSRSSRAGLQFPVGRVHRLLRKGNYAERVGAGAPVYLAAVLEYLTAEILELAGNAARDNKKTRIIPRHLQLAIRNDEELNKLLGKVTIAQGGVLPNIQAVLLPKKTESQKTKSK

SEQ ID NO: 4530 - protein, 129 aa, Homo sapiens; identical to SEQ ID NO: 4529

SEQ ID NO: 4531 - protein, 114 aa, Homo sapiens
MAGGKAGKDSGKAKAKAVSRSQRAGLQFPVGRIHRHLKTRTTSHGRVGATAAVYSAAILEYLTAEVLELAGNASKDLKVKRITPRHLQLAIRGDEELDSLIKATIAGGEKRRCS

SEQ ID NO: 4532 - protein, 128 aa, Homo sapiens
MAGGKAGKDSGKAKAKAVSRSQRAGLQFPVGRIHRHLKTRTTSHGRVGATAAVYSAAILEYLTAEVLELAGNASKDLKVKRITPRHLQLAIRGDEELDSLIKATIAGGGVIPHIHKSLIGKKGQQKTA

SEQ ID NO: 4533 - protein, 90 aa, Homo sapiens
MAGGKAGKDSGKAKAKAVSRSQRAGLQVLELAGNASKDLKVKRITPRHLQLAIRGDEELDSLIKATIAGGGVIPHIHKSLIGKKGQQKTA

SEQ ID NO: 4534 - protein, 102 aa, Homo sapiens
MFPVGRIHRHLKTRTTSHGRVGATAAVYSAAILEYLTAEVLELAGNASKDLKVKRITPRHLQLAIRGDEELDSLIKATIAGGGVIPHIHKSLIGKKGQQKTA

SEQ ID NO: 4535 - protein, 66 aa, Homo sapiens
MAGGKAGKDSGKAKAKAVSRSQRAGLQFPVGRIHRHLKTRTTSHGRVGATAAVYSAAILEYLTAEV

SEQ ID NO: 4536 - protein, 369 aa, Homo sapiens
MSSRGGKKKSTKTSRSAKAGVIFPVGRMLRYIKKGHPKYRIGVGAPVYMAAVLEYLTAEILELAGNAARDNKKGRVTPRHILLAVANDEELNQLLKGVTIASGGVLPNIHPELLAKKRGSKGKLEAIITPPPAKKAKSPSQKKPVSKKAGGKKGARKSKKKQGEVSKAASADSTTEGTPADGFTVLSTKSLFLGQKLQVVQADIASIDSDAVVHPTNTDFYIGGEVGNTLEKKGGKEFVEAVLELRKKNGPLEVAGAAVSAGHGLPAKFVIHCNSPVWGADKCEELLEKTVKNCLALADDKKLKSIAFPSIGSGRNGFPKQTAAQLILKAISSYFVSTMSSSIKTVYFVLFDSESIGIYVQEMAKLDAN

SEQ ID NO: 4537 - protein, 200 aa, Homo sapiens
MSSRGGKKKSTKTSRSAKAGVIFPVGRMLRYIKKGHPKYRIGVGAPVYMAAVLEYLTGNTLEKKGGKEFVEAVLELRKKNGPLEVAGAAVSAGHGLPAKFVIHCNSPVWGADKCEELLEKTVKNCLALADDKKLKSIAFPSIGSGRNGFPKQTAAQLILKAISSYFVSTMSSSIKTVYFVLFDSESIGIYVQEMAKLDAN

SEQ ID NO: 4538 - protein, 372 aa, Homo sapiens
MSSRGGKKKSTKTSRSAKAGVIFPVGRMLRYIKKGHPKYRIGVGAPVYMAAVLEYLTAEILELAGNAARDNKKGRVTPRHILLAVANDEELNQLLKGVTIASGGVLPNIHPELLAKKRGSKGKLEAIITPPPAKKAKSPSQKKPVSKKAGGKKGARKSKKKQGEVSKAASADSTTEGTPADGFTVLSTKSLFLGQKLNLIHSEISNLAGFEVEAIINPTNADIDLKDDLGNTLEKKGGKEFVEAVLELRKKNGPLEVAGAAVSAGHGLPAKFVIHCNSPVWGADKCEELLEKTVKNCLALADDKKLKSIAFPSIGSGRNGFPKQTAAQLILKAISSYFVSTMSSSIKTVYFVLFDSESIGIYVQEMAKLDAN

SEQ ID NO: 4539 - protein, 372 aa, Homo sapiens; identical to SEQ ID NO: 4538

SEQ ID NO: 4540 - protein, 372 aa, Homo sapiens
MSGRSGKKKMSKLSRSARAGVIFPVGRLMRYLKKGTFKYRISVGAPVYMAAVIEYLAAEILELAGNAARDNKKARIAPRHILLAVANDEELNQLLKGVTIASGGVLPRIHPELLAKKRGTKGKSETILSPPPEKRGRKATSGKKGGKKSKAAKPRTSKKSKPKDSDKEGTSNSTSEDGPGDGFTILSSKSLVLGQKLSLTQSDISHIGSMRVEGIVHPTTAEIDLKEDIGKALEKAGGKEFLETVKELRKSQGPLEVAEAAVSQSSGLAAKFVIHCHIPQWGSDKCEEQLEETIKNCLSAAEDKKLKSVAFPPFPSGRNCFPKQTAAQVTLKAISAHFDDSSASSLKNVYFLLFDSESIGIYVQEMAKLDAK

SEQ ID NO: 4541 - protein, 243 aa, Homo sapiens [sequence omitted]

SEQ ID NO: 4542 - protein, 243 aa, Homo sapiens [sequence omitted]

SEQ ID NO: 4543 - protein, 128 aa, Homo sapiens
MAGGKAGKDSGKAKTKAVSRSQRAGLQFPVGRIHRHLKSRTTSHGRVGATAAVYSAAILEYLTAEVLELAGNASKDLKVKRITPRHLQLAIRGDEELDSLIKATIAGGGVIPHIHKSLIGKKGQQKTV

SEQ ID NO: 4544 - protein, 257 aa, Homo sapiens
MKCHAGSLSANLPALKVTGWSRCVASRQPITVGVCGPKRPLWPSSEKPFNFHTLAKLHDIGLGNDFLDMTLKAQQQKQKSHATIPKCPPLPWSPTVTLCSCYLMAAASAMAEASSETTSEEGQSIQEPKEANSTKAQKQKRRGCRGSRRRHANRRGDSFGDSFTPYFPRVLKQVHQGLSLSQEAVSVMDSMIHDILDRIATEAGQLAHYTKRVTITSRDIQMAVRLLLPGKMGKLAEAQGTNAALRTSLCAIWQQRK

SEQ ID NO: 4545 - protein, 154 aa, Homo sapiens
MAAASAMAEASSETTSEEGQSIQEPKEANSTKAQKQKRRGCRGSRRRHANRRGDSFGDSFTPYFPRVLKQVHQGLSLSQEAVSVMDSMIHDILDRIATEAGQLAHYTKRVTITSRDIQMAVRLLLPGKMGKLAEAQGTNAALRTSLCAIWQQRK

SEQ ID NO: 4546 - protein, 175 aa, Homo sapiens
MLRTEVPRLPRSTTAIVWSCHLMATASAMAGPSSETTSEEQLITQEPKEANSTTSQKQSKQRKRGRHGPRRCHSNCRGDSFATYFRRVLKQVHQGLSLSREAVSVMDSLVHDILDRIATEAGRLARSTKRQTITAWETRMAVRLLLPGQMGKLAESEGTKAVLRTSLYAIQQQRK

SEQ ID NO: 4547 - protein, 135 aa, Homo sapiens
MARTKQTARKSTGGKAPRKQLATKAARKSTPSTCGVKPHRYRPGTVALREIRRYQKSTELLIRKLPFQRLVREIAQDFNTDLRFQSAAVGALQEASEAYLVGLLEDTNLCAIHAKRVTIMPKDIQLARRIRGERA

SEQ ID NO: 4548 - protein, 120 aa, Homo sapiens
MTSLAQQLQRLALPQSDASLLSRDEVASLLFDPKEAATIDRDTAFAIGCTGLEELLGIDPSFEQFEAPLFSQLAKTLERSVQTKAVNKQLDENISLFLIHLSPYFLLKPAQKCLEWLIHR

SEQ ID NO: 4549 - protein, 2063 aa, Homo sapiens
MTSLAQQLQRLALPQSDASLLSRDEVASLLFDPKEAATIDRDTAFAIGCTGLEELLGIDPSFEQFEAPLFSQLAKTLERSVQTKAVNKQLDENISLFLIHLSPYFLLKPAQKCLEWLIHRFHIHLYNQDSLIACVLPYHETRIFVRVIQLLKINNSKHRWFWLLPVKQSGVPLAKGTLITHCYKDLGFMDFICSLVTKSVKVFAEYPGSSAQLRVLLAFYASTIVSALVAAEDVSDNIIAKLFPYIQKGLKSSLPDYRAATYMIICQISVKVTMENTFVNSLASQIIKTLTKIPSLIKDGLSCLIVLLQRQKPESLGKKPFPHLCNVPDLITILHGISETYDVSPLLHYMLPHLVVSIIHHVTGEETEGMDGQIYKRHLEAILTKISLKNNLDHLLASLLFEEYISYSSQEEMDSNKVSLLNEQFLPLIRLLESKYPRTLDVVLEEHLKEIADLKKQELFHQFVSLSTSGGKYQFLADSDTSLMLSLNHPLAPVRILAMNHLKKIMKTSKEGVDESFIKEAVLARLGDDNIDVVLSAISAFEIFKEHFSSEVTISNLLNLFQRAELSKNGEWYEVLKIAADILIKEEILSENDQLSNQVVVCLLPFMVINNDDTESAEMKIAIYLSKSGICSLHPLLRGWEEALENVIKSTKPGKLIGVANQKMIELLADNINLGDPSSMLKMVEDLISVGEEESFNLKQKVTFHVILSVLVSCCSSLKETHFPFAIRVFSLLQKKIKKLESVITAVEIPSEWHIELMLDRGIPVELWAHYVEELNSTQRVAVEDSVFLVFSLKKFIYALKAPKSFPKGDIWWNPEQLKEDSRDYLHLLIGLFEMMLNGADAVHFRVLMKLFIKVHLEDVFQLFKFCSVLWTYGSSLSNPLNCSVKTVLQTQALYVGCAMLSSQKTQCKHQLASISSPVVTSLLINLGSPVKEVRRAAIQCLQALSGVASPFYLIIDHLISKAEEITSDAAYVIQDLATLFEELQREKKLKSHQKLSETLKNLLSCVYSCPSYIAKDLMKVLQGVNGEITKPFFAAISDEKVQQKLLRMLFDLLVNCKNSHCAQTVSSVFKGISVNAEQVRIELEPPDKAKPLGTVQQKRRQKMQQKKSQDLESVQEVGGSYWQRVTLILELLQHKKKLRSPQILVPTLFNLLSRCLEPLPQEQGNMEYTKQLILSCLLNICQKLSPDGGKIPKDILDEEKFNVELIVQCIRLSEMPQTHHHALLLLGTVAGIFPDKVLHNIMSIFTFMGANVMRLDDTYSFQVINKTVKMVIPALIQSDSGDSIEVSRNVEEIVVKIISVFVDALPHVPEHRRLPILVQLVDTLGAEKFLWILLILLFEQYVTKTVLAAAYGEKDAILEADTEFWFSVCCEFSVQHQIQSLMNILQYLLKLPEEKEETIPKAVSFNKSESQEEMLQVFNVETHTSKQLRHFKFLSVSFMSQLLSSNNFLKKVVESGGPEILKGLEERLLETVLGYISAVAQSMERNADKLTVKFWRALLSKAYDLLDKVNALLPTETFIPVIRGLVGNPLPSVRRKALDLLNNKLQQNISWKKTIVTRFLKLVPDLLAIVQRKKKEGEEEQAINRQTALYTLKLLCKNFGAENPDPFVPVLNTAVKLIAPERKEEKNVLGSALLCIAEVTSTLEALAIPQLPSLMPSLLTTMKNTSELVSSEVYLLSALAALQKVVETLPHFISPYLEGILSQVIHLEKITSEMGSASQANIRLTSLKKTLATTLAPRVLLPAIKKTYKQIEKNWKNHMGPFMSILQEHIGVMKKEELTSHQSQLTAFFLEALDFRAQHSENDLEEVGKTENCIIDCLVAMVVKLSEVTFRPLFFKLFDWAKTEDAPKDRLLTFYNLADCIAEKLKGLFTLFAGHLVKPFADTLNQVNISKTDEAFFDSENDPEKCCLLLQFILNCLYKIFLFDTQHFISKERAEALMMPLVDQLENRLGGEEKFQERVTKHLIPCIAQFSVAMADDSLWKPLNYQILLKTRDSSPKVRFAALITVLALAEKLKENYIVLLPESIPFLAELMEDECEEVEHQCQKTIQQLETVLGEPLQSYF

SEQ ID NO: 4550 - protein, 2144 aa, Homo sapiens
MTSLAQQLQRLALPQSDASLLSRDEVASLLFDPKEAATIDRDTAFAIGCTGLEELLGIDPSFEQFEAPLFSQLAKTLERSVQTKAVNKQLDENISLFLIHLSPYFLLKPAQKCLEWLIHRFHIHLYNQDSLIACVLPYHETRIFVRVIQLLKINNSKHRWFWLLPVKQSGVPLAKGTLITHCYKDLGFMDFICSLVTKSVKVFAEYPGSSAQLRVLLAFYASTIVSALVAAEDVSDNIIAKLFPYIQKGLKSSLPDYRAATYMIICQISVKVTMENTFVNSLASQIIKTLTKIPSLIKDGLSCLIVLLQRQKPESLGKKPFPHLCNVPDLITILHGISETYDVSPLLHYMLPHLVVSIIHHVTGEETEGMDGQIYKRHLEAILTKISLKNNLDHLLASLLFEEYISYSSQEEMDSNKVSLLNEQFLPLIRLLESKYPRTLDVVLEEHLKEIADLKKQELFHQFVSLSTSGGKYQFLADSDTSLMLSLNHPLAPVRILAMNHLKKIMKTSKEGVDESFIKEAVLARLGDDNIDVVLSAISAFEIFKEHFSSEVTISNLLNLFQRAELSKNGEWYEVLKIAADILIKEEILSENDQLSNQVVVCLLPFMVINNDDTESAEMKIAIYLSKSGICSLHPLLRGWEEALENVIKSTKPGKLIGVANQKMIELLADNINLGDPSSMLKMVEDLISVGEEESFNLKQKVTFHVILSVLVSCCSSLKETHFPFAIRVFSLLQKKIKKLESVITAVEIPSEWHIELMLDRGIPVELWAHYVEELNSTQRVAVEDSVFLVFSLKKFIYALKAPKSFPKGDIWWNPEQLKEDSRDYLHLLIGLFEMMLNGADAVHFRVLMKLFIKVHLEDVFQLFKFCSVLWTYGSSLSNPLNCSVKTVLQTQALYVGCAMLSSQKTQCKHQLASISSPVVTSLLINLGSPVKEVRRAAIQCLQALSGVASPFYLIIDHLISKAEEITSDAAYVIQDLATLFEELQREKKLKSHQKLSETLKNLLSCVYSCPSYIAKDLMKVLQGVNGEMVLSQLLPMAEQLLEKIQKEPTAVLKDEAMVLHLTLGKYNEFSVSLLNEDPKSLDIFIKAVHTTKELYAGMPTIQITALEKITKPFFAAISDEKVQQKLLRMLFDLLVNCKNSHCAQTVSSVFKGISVNAEQVRIELEPPDKAKPLGTVQQKRRQKMQQKKSQDLESVQEVGGSYWQRVTLILELLQHKKKLRSPQILVPTLFNLLSRCLEPLPQEQGNMEYTKQLILSCLLNICQKLSPDGGKIPKDILDEEKFNVELIVQCIRLSEMPQTHHHALLLLGTVAGIFPDKVLHNIMSIFTFMGANVMRLDDTYSFQVINKTVKMVIPALIQSDSGDSIEVSRNVEEIVVKIISVFVDALPHVPEHRRLPILVQLVDTLGAEKFLWILLILLFEQYVTKTVLAAAYGEKDAILEADTEFWFSVCCEFSVQHQIQSLMNILQYLLKLPEEKEETIPKAVSFNKSESQEEMLQVFNVETHTSKQLRHFKFLSVSFMSQLLSSNNFLKKVVESGGPEILKGLEERLLETVLGYISAVAQSMERNADKLTVKFWRALLSKAYDLLDKVNALLPTETFIPVIRGLVGNPLPSVRRKALDLLNNKLQQNISWKKTIVTRFLKLVPDLLAIVQRKKKEGEEEQAINRQTALYTLKLLCKNFGAENPDPFVPVLNTAVKLIAPERKEEKNVLGSALLCIAEVTSTLEALAIPQLPSLMPSLLTTMKNTSELVSSEVYLLSALAALQKVVETLPHFISPYLEGILSQVIHLEKITSEMGSASQANIRLTSLKKTLATTLAPRVLLPAIKKTYKQIEKNWKNHMGPFMSILQEHIGVMKKEELTSHQSQLTAFFLEALDFRAQHSENDLEEVGKTENCIIDCLVAMVVKLSEVTFRPLFFKLFDWAKTEDAPKDRLLTFYNLADCIAEKLKGLFTLFAGHLVKPFADTLNQVNISKTDEAFFDSENDPEKCCLLLQFILNCLYKIFLFDTQHFISKERAEALMMPLVDQLENRLGGEEKFQERVTKHLIPCIAQFSVAMADDSLWKPLNYQILLKTRDSSPKVRFAALITVLALAEKLKENYIVLLPESIPFLAELMEDECEEVEHQCQKTIQQLETVLGEPLQSYF

SEQ ID NO: 4551 - protein, 76 aa, Homo sapiens
MAETDPKTVQDLTSVVQTLLQQMQDKFQTMSDQIIGRIDDMSSRIDDLEKNIADLMTQAGVEELESENKIPATQKS

SEQ ID NO: 4552 - protein, 596 aa, Homo sapiens
MEALLSTPINPNNFPAKLWRLVNSPRYRSIRWDGRGEGLLIDQPLFEAELLSPPGPGGGGGTAGAGAEPELFKTTSFTSFIRQLNLYGFRKVVLGGPGGGKPAGNGPLHHFHNPHFRRDQPQLLVHLKRLTSANKAKLAAGLEVPCRPPNRFQRLLITSASAATAPLQHQQPPPPAGPRPEPHGPVAVGQFHRSFRRDSLSPYSCVSTPSHDHSTYPLKGLDRTPVPHRIWQNSLGMHPGQVETSPTFSDKGVPFPVLQRFPTEVTYTLQPSTTSVHVQQGPQTMVSSSQKYSNYTPSAQYSQAYYPTAVLQCCSPTHMDALSSCVTPNASSYAHCNYFQNPSMQSSYPVEFLPSNWPCSTTDENTKTEVNLEAVFQIVDELHSSPKLEMVKVEPVENQCPTSPSYRGQHILANSNNSNPCSASQASQLEPLTPVGSDIMSFVVGTEQAVACSLPQSPEYIYTIHTAQPVENSTIQESAAIQQAHVKLKEHLNHNPSPSSVVFVQEGPPFSTHQVDANIKCQTSSRENILPSEQMGFLISEMGPASKPSEDTGLATPARYREHRSNSQQGKSPDLHLLVDVACKQERFPKEEELKE

SEQ ID NO: 4553 - protein, 496 aa, Homo sapiens
GGIENGVGELGSGGEAPARRGDGGAALHPHQPQQLPRQAVAPGEQPALPLHPLGRPRRGAAYRSAALRGRAAQPPAGPRPEPHGPVAVGQFHRSFRRDSLSPYSCVSTPSHDHSTYPLKGLDRTPVPHRIWQNSLGMHPGQVETSPTFSDKGVPFPVLQRFPTEVTYTLQPSTTSVHVQQGPQTMVSSSQKYSNYTPSAQYSQAYYPTAVLQCCSPTHMDALSSCVTPNASSYAHCNYFQNPSMQSSYPVEFLPSNWPCSTTDENTKTEVNLEAVFQIVDELHSSPKLEMVKVEPVENQCPTSPSYRGQHILANSNNSNPCSASQASQLEPLTPVGSDIMSFVVGTEQAVACSLPQSPEYIYTIHTAQPVENSTIQESAAIQQAHVKLKEHLNHNPSPSSVVFVQEGPPFSTHQVDANIKCQTSSRENILPSEQMGFLISEMGPASKPSEDTGLATPARYREHRSNSQQGKSPDLHLLVDVACKQERFPKEEELKE

SEQ ID NO: 4554 - protein, 1087 aa, Homo sapiens
MARSSPYLRQLQGPLLPPRDLVEEDDDYLNDDVEEDEESVFIDAEELCSGGVKAGSLPGCLRVSICDENTQETCKVFGRFPITGAWWRVKVQVKPVVGSRSYQYQVQGFPSYFLQSDMSPPNQKHICALFLKECEVSSDDVNKFLTWVKEVSNYKNLNFENLRETLRTFHKETGRKDQKQPTQNGQEELFLDNEMSLPLENTIPFRNVMTALQFPKIMEFLPVLLPRHFKWIIGSGSKEMLKEIEEILGTHPWKLGFSKITYREWKLLRCEASWIAFCQCESLLQLMTDLEKNALIMYSRLKQICREDGHTYVEVNDLTLTLSNHMSFHAASESLKFLKDIGVVTYEKSCVFPYDLYHAERAIAFSICDLMKKPPWHLCVDVEKVLASIHTTKPENSSDDALNESKPDEVRLENPVDVVDTQDNGDHIWTNGENEINAEISEVQLDQDQVEVPLDRDQVAALEMICSNPVTVISGKGGCGKTTIVSRLFKHIEQLEEREVKKACEDFEQDQNASEEWITFTEQSQLEADKAIEVLLTAPTGKAAGLLRQKTGLHAYTLCQVNYSFYSWTQTMMTTNKPWKFSSVRVLVVDEGSLVSVGIFKSVLNLLCEHSKLSKLIILGDIRQLPSIEPGNLLKDLFETLKSRNCAIELKTNHRAESQLIVDNATRISRRQFPKFDAELNISDNPTLPISIQDKTFIFVRLPEEDASSQSSKTNHHSCLYSAVKTLLQENNLQNAKTSQFIAFRRQDCDLINDCCCKHYTGHLTKDHQSRLVFGIGDKICCTRNAYLSDLLPENISGSQQNNDLDASSEDFSGTLPDFAKNKRDFESNVRLCNGEIFFITNDVTDVTFGKRRSLTINNMAGLEVTVDFKKLMKYCRIKHAWARTIHTFQGSEEQTVVYVVGKAGRQHWQHVYTAVTRGRCRVYVIAEESQLRNAIMKNSFPRKTRLKHFLQSKLSSSGAPPADFPSPRKSSGDSGGPSTPSASPLPVVTDHAMTNDVTWSEASSPDERTLTFAERWQLSSPDGVDTDDDLPKSRASKRTCGVNDDESPSKIFMVGESPQVSSRLQNLRLNNLIPRQLFKPTDNQET

SEQ ID NO: 4555 - protein, 1087 aa, Homo sapiens; identical to SEQ ID NO: 4554

SEQ ID NO: 4556 - protein, 1009 aa, Homo sapiens
MSWMFKRDPVWKYLQTVQYGVHGNFPRLSYPTFFPRFEFQDVIPPDDFLTSDEEVDSVLFGSLRGHVVGLRYYTGVVNNNEMVALQRDPNNPYDKNAIKVNNVNGNQVGHLKKELAGALAYIMDNKLAQIEGVVPFGANNAFTMPLHMTFWGKEENRKAVSDQLKKHGFKLGPAPKTLGFNLESGWGSGRAGPSYSMPVHAAVQMTTEQLKTEFDKLFEDLKEDDKTHEMEPAEAIETPLLPHQKQALAWMVSRENSKELPPFWEQRNDLYYNTITNFSEKDRPENVHGGILADDMGLGKTLTAIAVILTNFHDGRPLPIERVKKNLLKKEYNVNDDSMKLGGNNTSEKADGLSKDASRCSEQPSISDIKEKSKFRMSELSSSRPKRRKTAVQYIESSDSEEIETSELPQKMKGKLKNVQSETKGRAKAGSSKVIEDVAFACALTSSVPTTKKKMLKKGACAVEGSKKTDVEERPRTTLIICPLSVLSNWIDQFGQHIKSDVHLNFYVYYGPDRIREPALLSKQDIVLTTYNILTHDYGTKGDSPLHSIRWLRVILDEGHAIRNPNAQQTKAVLDLESERRWVLTGTPIQNSLKDLWSLLSFLKLKPFIDREWWHRTIQRPVTMGDEGGLRRLQSLIKNITLRRTKTSKIKGKPVLELPERKVFIQHITLSDEERKIYQSVKNEGRATIGRYFNEGTVLAHYADVLGLLLRLRQICCHTYLLTNAVSSNGPSGNDTPEELRKKLIRKMKLILSSGSDEECAICLDSLTVPVITHCAHVFCKPCICQVIQNEQPHAKCPLCRNDIHEDNLLECPPEELARDSEKKSDMEWTSSSKINALMHALTDLRKKNPNIKSLVVSQFTTFLSLIEIPLKASGFVFTRLDGSMAQKKRVESIQCFQNTEAGSPTIMLLSLKAGGVGLNLSAASRVFLMDPAWNPAAEDQCFDRCHRLGQKQEVIITKFIVKDSVEENMLKIQNKKRELAAGAFGTKKPNADEMKQAKINEIRTLIDL

SEQ ID NO: 4557 - protein, 1009 aa, Homo sapiens; identical to SEQ ID NO: 4556

SEQ ID NO: 4558 - protein, 392 aa, Homo sapiens
MFKRDPVWKYLQTVQYGVHGNFPRLSYPTFFPRFEFQDVIPPDDFLTSDEEVDSVLFGSLRGHVVGLRYYTGVVNNNEMVALQRDPNNPYDKNAIKVNNVNGNQVGHLKKELAGALAYIMDNKLAQIEGVVPFGANNAFTMPLHMTFWGKEENRKAVSDQLKKHGFKLGPAPKTLGFNLESGWGSGRAGPSYSMPVHAAVQMTTEQLKTEFDKLFEDLKEDDKTHEMEPAEAIETPLLPHQKQALAWMVSRENSKELPPFWEQRNDLYYNTITNFSEKDRPENVHGGILADDMGLGKTLTAIAVILTNFHDGRPLPIERVKKNLLKKEYNVNDDSMKLGGNNTSEKADGLSKDASRCSEQPSISDIKEKSKFRMSELSSSRPKSQKKKKKRE

SEQ ID NO: 4559 - protein, 457 aa, Homo sapiens
MFKRDPVWKYLQTVQYGVHGNFPRLSYPTFFPRFEFQDVIPPDDFLTSDEEVDSVLFGSLRGHVVGLRYYTGVVNNNEMVALQRDPNNPYDKNAIKVNNVNGNQVGHLKKELAGALAYIMDNKLAQIEGVVPFGANNAFTMPLHMTFWGKEENRKAVSDQLKKHGFKLGPAPKTLGFNLESGWGSGRAGPSYSMPVHAAVQMTTEQLKTEFDKLFEDLKEDDKTHEMEPAEAIETPLLPHQKQALAWMVSRENSKELPPFWEQRNDLYYNTITNFSEKDRPENVHGGILADDMGLGKTLTAIAVILTNFHDGRPLPIERVKKNLLKKEYNVNDDSMKLGGNNTSEKADGLSKDASRCSEQPSISDIKEKSKFRMSELSSSRPKRRKTAVQYIESSDSEEIETSELPQKMKGKLKNVQSETKGRAKAGSSKVIEDVAFACALTSSVPTTKKKMLKKVK

SEQ ID NO: 4560 - protein, 1009 aa, Homo sapiens; identical to SEQ ID NO: 4556

SEQ ID NO: 4561 - protein, 327 aa, Homo sapiens
MSDKLKERKVSRLSPNGTCALVVEASDSPTRHLGGPMAGKCPHGTLSVEESRVRTPVSHKVIEKRRRDRINRCLNELGKTVPMALAKQGEPQEALAQIRSRVRSLVLSSATVPDQQALGRCEGPFLLLQSSGKLEKAEILEMTVQYLRALHSADFPRGREKAELLAEFANYFHYGYHECMKNLVHYLTTVERMETKDTKYARILAFLQSKARLGAEPAFPPLGSLPEPDFSYQLHPAGPEFAGHSPGEAAVFPQGSGAGPFPWPPGAARSPALPYLPSAPVPLASPAQQHSPFLTPVQGLDRHYLNLIGHAHPNALNLHTPQHPPVL

SEQ ID NO: 4562 - protein, 241 aa, Homo sapiens
MSDKLKERKRTPVSHKVIEKRRRDRINRCLNELGKTVPMALAKQSSGKLEKAEILEMTVQYLRALHSADFPRGREKELLAEFANYFHYGYHECMKNLVHYLTTVERMETKDTKYARILAFLQSKARLGAEPAFPPLGSLPEPDFSYQLHPAGPEFAGHSPGEAAVFPQGSGAGPFPWPPGAARSPALPYLPSAPVPLASPAQQHSPFLTPVQGLDRHYLNLIGHAHPNALNLHTPQHPPVL

SEQ ID NO: 4563 - protein, 242 aa, Homo sapiens
MSDKLKERKRTPVSHKVIEKRRRDRINRCLNELGKTVPMALAKQSSGKLEKAEILEMTVQYLRALHSADFPRGREKAELLAEFANYFHYGYHECMKNLVHYLTTVERMETKDTKYARILAFLQSKARLGAEPAFPPLGSLPEPDFSYQLHPAGPEFAGHSPGEAAVFPQGSGAGPFPWPPGAARSPALPYLPSAPVPLASPAQQHSPFLTPVQGLDRHYLNLIGHAHPNALNLHTPQHPPVL

SEQ ID NO: 4564 - protein, 676 aa, Homo sapiens
MPHAFKPGDLVFAKMKGYPHWPARIDDIADGAVKPPPNKYPIFFFGTHETAFLGPKDLFPYDKCKDKYGKPNKRKGFNEGLWEIQNNPHASYSAPPPVSSSDSEAPEANPADGSDADEDDEDRGVMAVTAVTATAASDRMESDSDSDKSSDNSGLKRKTPALKMSVSKRARKASSDLDQASVSPSEEENSESSSESEKTSDQDFTPEKKAAVRAPRRGPLGGRKKKKAPSASDSDSKADSDGAKPEPVAMARSASSSSSSSSSSDSDVSVKKPPRGRKPAEKPLPKPRGRKPKPERPPSSSSSDSDSDEVDRISEWKRRDEARRRELEARRRREQEEELRRLREQEKEEKERRRERADRGEAERGSGGSSGDELREDDEPVKKRGRKGRGRGPPSSSDSEPEAELEREAKKSAKKPQSSSTEPARKPGQKEKRVRPEEKQQAKPVKVERTRKRSEGFSMDRKVEKKKEPSVEEKLQKLHSEIKFALKVDSPDVKRCLNALEELGTLQVTSQILQKNTDVVATLKKIRRYKANKDVMEKAAEVYTRLKSRVLGPKIEAVQKVNKAGMEKEKAEEKLAGEELAGEELAGEEAPQEKAEDKPSTDLSAPVNGEATSQKGESAEDKEHEEGRDSEEGPRCGSSEDLHDSVREGPDLDRPGSDRQERERARGDSEALDEES

SEQ ID NO: 4565 - protein, 507 aa, Homo sapiens
MKGYPHWPARIDDIADGAVKPPPNKYPIFFFGTHETAFLGPKDLFPYDKCKDKYGKPNKRKGFNEGLWEIQNNPHASYSAPPPVSSSDSEAPEANPADGSDADEDDEDRGVMAVTAVTATAASDRMESDSDSDKSSDNSGLKRKTPALKMSVSKRARKASSDLDQASVSPSEEENSESSSESEKTSDQDFTPEKKAAVRAPRRGPLGGRKKKKAPSASDSDSKADSDGAKPEPVAMARSASSSSSSSSSSDSDVSVKKPPRGRKPAEKPLPKPRGRKPKPERPPSSSSSDSDSDEVDRISEWKRRDEARRRELEARRRREQEEELRRLREQEKEEKERRRERADRGEAERGSGGSSGDELREDDEPVKKRGRKGRGRGPPSSSDSEPEAELEREAKKSAKKPQSSSTEPARKPGQKEKRVRPEEKQQAKLECNGVISAHCNLRLPGSSDSPASALPSSWDYRHPPPRLANFCCFSRHGVSSCWPGWSRSPDPVICPPQPPKVLGLQV

SEQ ID NO: 4566 - protein, 553 aa, Homo sapiens
MATDTSQGELVHPKALPLIVGAQLIHADKLGEKVEDSTMPIRRTVNSTRETPPKSKLAEGEEEKPEPDISSEESVSTVEEQENETPPATSSEAEQPKGEPENEEKEENKSSEETKKDEKDQSKEKEKKVKKTIPSWATLSASQLARAQKQTPMASSPRPKMDAILTEAIKACFQKSGASVVAIRKYIIHKYPSLELERRGYLLKQALKRELNRGVIKQVKGKGASGSFVVVQKSRKTPQKSRNRKNRSSAVDPEPQVKLEDVLPLAFTRLCEPKEASYSLIRKYVSQYYPKLRVDIRPQLLKNALQRAVERGQLEQITGKGASGTFQLKKSGEKPLLGGSLMEYAILSAIAAMNEPKTCSTTALKKYVLENHPGTNSNYQMHLLKKTLQKCEKNGWMEQISGKGFSGTFQLCFPYYPSPGVLFPKKEPDDSRDEDEDEDESSEEDSEDEEPPPKRRLQKKTPAKSPGKAASVKQRGSKPAPKVSAAQRGKARPLPKKAPPKAKTPAKKTRPSSTVIKKPSGGSSKKPATSARKEVKLPGKGKSTMKKSFRVKK

SEQ ID NO: 4567 - protein, 133 aa, Homo sapiens
MATDTSQGELVHPKALPLIVGAQLIHADKLGEKVEDSTMPIRRTVNSTRETPPKSKLAEGEEEKPEPDISSEESVSTVEEQENETPPATSSEAEQPKGEPENEEKEENKSSEETKKERADSIHSTLFIIGQNS

SEQ ID NO: 4568 - protein, 401 aa, Homo sapiens
MASSPRPKMDAILTEAIKACFQKSGASVVAIRKYIIHKYPSLELERRGYLLKQALKRELNRGVIKQVKGKGASGSFVVVQKSRKTPQKSRNRKNRSSAVDPEPQVKLEDVLPLAFTRLCEPKEASYSLIRKYVSQYYPKLRVDIRPQLLKNALQRAVERGQLEQITGKGASGTFQLKKSGEKPLLGGSLMEYAILSAIAAMNEPKTCSTTALKKYVLENHPGTNSNYQMHLLKKTLQKCEKNGWMEQISGKGFSGTFQLCFPYYPSPGVLFPKKEPDDSRDEDEDEDESSEEDSEDEEPPPKRRLQKKTPAKSPGKAASVKQRGSKPAPKVSAAQRGKARPLPKKAPPKAKTPAKKTRPSSTVIKKPSGGSSKKPATSARKEVKLPGKGKSTMKKSFRVKK

SEQ ID NO: 4569 - protein, 515 aa, Homo sapiens
MPIRRTVNSTRETPPKSKLAEGEEEKPEPDISSEESVSTVEEQENETPPATSSEAEQPKGEPENEEKEENKSSEETKKDEKDQSKEKEKKVKKTIPSWATLSASQLARAQKQTPMASSPRPKMDAILTEAIKACFQKSGASVVAIRKYIIHKYPSLELERRGYLLKQALKRELNRGVIKQVKGKGASGSFVVVQKSRKTPQKSRNRKNRSSAVDPEPQVKLEDVLPLAFTRLCEPKEASYSLIRKYVSQYYPKLRVDIRPQLLKNALQRAVERGQLEQITGKGASGTFQLKKSGEKPLLGGSLMEYAILSAIAAMNEPKTCSTTALKKYVLENHPGTNSNYQMHLLKKTLQKCEKNGWMEQISGKGFSGTFQLCFPYYPSPGVLFPKKEPDDSRDEDEDEDESSEEDSEDEEPPPKRRLQKKTPAKSPGKAASVKQRGSKPAPKVSAAQRGKARPLPKKAPPKAKTPAKKTRPSSTVIKKPSGGSSKKPATSARKEVKLPGKGKSTMKKSFRVKK

SEQ ID NO: 4570 - protein, 76 aa, Homo sapiens
MATDTSQGELVHPKALPLIVGAQLIHADKLGEKVEDSTMPIRRTVNSTRETPPKSKLAEGEEEKPEPDISSEESVS

SEQ ID NO: 4571 - protein, 124 aa, Homo sapiens
MATDTSQGELVHPKALPLIVGAQLIHADKLGEKVEDSTMPIRRTVNSTRETPPKSKLAEGEEEKPEPDISSEESVSTVEEQENETPPATSSEAEQPKGEPENEEKEENKSSEETKKDEKDQSKE

SEQ ID NO: 4572 - protein, 40 aa, Homo sapiens
MPIRRTVNSTRETPPKSKLAEGEEEKPEPDISSEESVSTV

SEQ ID NO: 4573 - protein, 253 aa, Homo sapiens
KKDEKDQSKEKEKKVKKTIPSWATLSASQLARAQKQTPMASSPRPKMDAILTEAIKACFQKSGASVVAIRKYIIHKYPSLELERRGYLLKQALKRELNRGVIKQNRSSAVDPEPQVKLEDVLPLAFTRLCEPKEASYSLIRKYVSQYYPKLRVDIRPQLLKNALQRAVERGQLEQITGKGASGTFQLKKSGEKPLLGGSLMEYAILSAIAAMNEPKTCSTTALKKYVLENHPGTNSNYQMHLLKKTLQKCEKN

SEQ ID NO: 4574 - protein, 278 aa, Homo sapiens
MPIRRTVNSTRETPPKSKLAEGEEEKPEPDISSEESVSTVEEQENETPPATSSEAEQPKGEPENEEKEENKSSEETKKDEKDQSKEKEKKVKKTIPSWATLSASQLARAQKQTPMASSPRPKMDAILTEAIKACFQKSGASVVAIRKYIIHKYPSLELERRGYLLKQALKRELNRGVIKQVKGKGASGSFVVVQKSRKTPQKSRNRKNRSSAVDPEPQVKLEDVLPLAFTRLCEPKEASYSLIRKYVSQYYPKLRVDIRPQLLKNALQRAVERGQLEQ

SEQ ID NO: 4575 - protein, 45 aa, Homo sapiens
MPIRRTVNSTRETPPKSKLAEGEEEKPEPDISSEESVSTVEEQEN

SEQ ID NO: 4576 - protein, 327 aa, Homo sapiens
MATDTSQGELVHPKALPLIVGAQLIHADKLGEKVEDSTMPIRRTVNSTRETPPKSKLAEGEEEKPEPDISSEESVSTVEEQENETPPATSSEAEQPKGEPENEEKEENKSSEETKKDEKDQSKEKEKKVKKTIPSWATLSASQLARAQKQTPMASSPRPKMDAILTEAIKACFQKSGASVVAIRKYIIHKYPSLELERRGYLLKQALKRELNRGVIKQVKGKGASGSFVVVQKSRKTPQKSRNRKNRSSAVDPEPQVKLEDVLPLAFTRLCEPKEASYSLIRKYVSQYYPKLRVDIRPQLLKNALQRAVERGQLEQITGKGASGTFQ

SEQ ID NO: 4577 - protein, 19 aa, Homo sapiens
MPIRRTVNSTRETPPKSKL

SEQ ID NO: 4578 - protein, 305 aa, Homo sapiens
MENSQLCKLFIGGLNVQTSESGLRGHFEAFGTLTDCVVVVNPQTKRSRCFGFVTYSNVEEADAAMAASPHAVDGNTVELKRAVSREDSARPGAHAKVKKLFVGGLKGDVAEGDLIEHFSQFGTVEKAEIIADKQSGKKRGFGFVYFQNHDAADKAAVVKFHPIQGHRVEVKKAVPKEDIYSGGGGGGSRSSRGGRGGRGRGGGRDQNGLSKGGGGGYNSYGGYGGGGGGGYNAYGGGGGGSSYGGSDYGNGFGGFGSYSQHQSSYGPMKSGGGGGGGGSSWGGRSNSGPYRGGYGGGGGYGGSSF

SEQ ID NO: 4579 - protein, 196 aa, Homo sapiens
MASNVTNKTDPLFSSSFDLDYDFQRDYYDRMYSYPARVPPPPPIARAVVPSKRQRVSGNTSRRGKSGFNSKSGQRGSSKSGKLKGDDLQAIKKELTQIKQKVDSLLENLEKIEKEQSKQAVEMKNDKSEEEQSSSSVKKDETNVKMESEGGADDSAEEGDLLDDDDNEDRGDDQVKTTGKERKRWWRGAQGHMECL

SEQ ID NO: 4580 - protein, 306 aa, Homo sapiens
MASNVTNKTDPRSMNSRVFIGNLNTLVVKKSDVEAIFSKYGKIVGCSVHKGFAFVQYVNERNARAAVAGEDGRMIAGQVLDINLAAEPKVNRGKAGVKRSAAEMYGSVTEHPSPSPLLSSSFDLDYDFQRDYYDRMYSYPARVPPPPPIARAVVPSKRQRVSGNTSRRGKSGFNSKSGQRGSSKSGKLKGDDLQAIKKELTQIKQKVDSLLENLEKIEKEQSKQAVEMKNDKSEEEQSSSSVKKDETNVKMESEGGADDSAEEGDLLDDDDNEDRGDDQLELIKDDEKEAEEGEDDRDSANGEDDS

SEQ ID NO: 4581 - protein, 102 aa, Homo sapiens
MASNVTNKTDPRSMNSRVFIGNLNTLVVKKSDVEAIFSKKDETNVKMESEGGADDSAEEGDLLDDDDNEDRGDDQLELIKDDEKEAEEGEDDRDSANGEDDS

SEQ ID NO: 4582 - protein, 306 aa, Homo sapiens; identical to SEQ ID NO: 4580

SEQ ID NO: 4583 - protein, 293 aa, Homo sapiens
MASNVTNKTDPRSMNSRVFIGNLNTLVVKKSDVEAIFSKYGKIVGCSVHKGFAFVQYVNERNARAAVAGEDGRMIAGQVLDINLAAEPKVNRGKAGVKRSAAEMYGSSFDLDYDFQRDYYDRMYSYPARVPPPPPIARAVVPSKRQRVSGNTSRRGKSGFNSKSGQRGSSKSGKLKGDDLQAIKKELTQIKQKVDSLLENLEKIEKEQSKQAVEMKNDKSEEEQSSSSVKKDETNVKMESEGGADDSAEEGDLLDDDDNEDRGDDQLELIKDDEKEAEEGEDDRDSANGEDDS

SEQ ID NO: 4584 - protein, 303 aa, Homo sapiens [sequence omitted]

SEQ ID NO: 4585 - protein, 293 aa, Homo sapiens; identical to SEQ ID NO: 4583

SEQ ID NO: 4586 - protein, 147 aa, Homo sapiens
MASNVTNKTDPRSMNSRVFIGNLNTLVVKKSDVEAIFSKYGKIVGCSVHKGFAFVQYVNERNARAAVAGEDGRMIAGQVLDINLAAEPKVNRGKAGVKRSAAEMYGSVTEHPSPSPLLSVYQETLHEGAKVASILRVDSGDLPSLES

SEQ ID NO: 4587 - protein, 293 aa, Homo sapiens; identical to SEQ ID NO: 4583

SEQ ID NO: 4588 - protein, 262 aa, Homo sapiens
MASNVTNKTDPRSMNSRVFIGNLNTLVVKKSDVEAIFSKYGKIVGCSVHKGFAFVQYVNERNARAAVAGEDGRMIAGQVLDINLAAEPKVNRGKAGVKRSAAEMYGSSFDLDYDFQRDYYDRMYSYPARVPPPPPIARAVVPSKRQRVSGNTSRRGKSGFNSKSGQRGSSKSGKLKGDDLQAIKKELTQIKQKVDSLLENLEKIEKEQSKQAVEMKNDKSEEEQSSSSVKKDETNVKMESEGGADDSAEEGDLLDDDDNEDR

SEQ ID NO: 4589 - protein, 306 aa, Homo sapiens; identical to SEQ ID NO: 4580

SEQ ID NO: 4590 - protein, 126 aa, Homo sapiens
MASNVTNKTDPRSMNSRVFIGNLNTLVVKKSDVEAIFSKYGKIVGCSVHKGFAFVQYVNERNARAAVAGEDGRMIAGQVLDINLAAEPKVNRGKAGVKRSAAEMYGSSFDLDYDFQRDYYDRMYSY

SEQ ID NO: 4591 - protein, 293 aa, Homo sapiens; identical to SEQ ID NO: 4583

SEQ ID NO: 4592 - protein, 175 aa, Homo sapiens
MASNVTNKTDPRSMNSRVFIGNLNTLVVKKSDVEAIFSKYGKIVGCSVHKGFAFVQYVNERNARAAVAGEDGRMIAGQVLDINLAAEPKVNRGKAGVKRSAAEMYGSVTEHPSPSPLLSSSFDLDYDFQRDYYDRMYSYPARVPPPPPIARAVVPSKRQRVSGNTSRRGKSGFNS

SEQ ID NO: 4593 - protein, 117 aa, Homo sapiens
MASNVTNKTDPRSMNSRVFIGNLNTLVVKKSDVEAIFSKYGKIVGCSVHKGFAFVQYVNERNARAAVAGEDGRMIAGQVLDINLAAEPKVNRGKAGVKRSAAEMYGSSFDLDYDFQR

SEQ ID NO: 4594 - protein, 187 aa, Homo sapiens
MASNVTNKTDPRSMNSRVFIGNLNTLVVKKSDVEAIFSKYGKIVGCSVHKGFAFVQYVNERNARAAVAGEDGRMIAGQVLDINLAAEPKVNRGKAGVKRSAAEMYGSVTEHPSPSPLLSSSFDLDYDFQRDYYDRMYSYPARVPPPPPIARAVVPSKRQRVSGNTSRRGKSGFNSKSGQRGSSKSGK

SEQ ID NO: 4595 - protein, 250 aa, Homo sapiens
MASNVTNKTDPRSMNSRVFIGNLNTLVVKKSDVEAIFSKYGKIVGCSVHKGFAFVQYVNERNARAAVAGEDGRMIAGQVLDINLAAEPKVNRGKAGVKRSAAEMYGSSFDLDYDFQRDYYDRMYSYPARVPPPPPIARAIKKELTQIKQKVDSLLENLEKIEKEQSKQAVEMKNDKSEEEQSSSSVKKDETNVKMESEGGADDSAEEGDLLDDDDNEDRGDDQLELIKDDEKEAEEGEDDRDSANGEDDS

SEQ ID NO: 4596 - protein, 121 aa, Homo sapiens
MASNVTNKTDPRSMNSRVFIGNLNTLVVKKSDVEAIFSKYGKIVGCSVHKGFAFVQYVNERNARAAVAGEDGRMIAGQVLDINLAAEPKVNRGKAGVKRSAAEMYGSSFDLDYDFQRDYYD

SEQ ID NO: 4597 - protein, 226 aa, Homo sapiens
MASNVTNKTDPRSMNSRVFIGNLNTLVVKKSDVEAIFSNSSFDLDYDFQRDYYDRMYSYPARVPPPPPIARAVVPSKRQRVSGNTSRRGKSGFNSKSGQRGSSKSGKLKGDDLQAIKKELTQIKQKVDSLLENLEKIEKEQSKQAVEMKNDKSEEEQSSSSVKKDETNVKMESEGGADDSAEEGDLLDDDDNEDRGDDQLELIKDDEKEAEEGEDDRDSANGEDDS

SEQ ID NO: 4598 - protein, 293 aa, Homo sapiens; identical to SEQ ID NO: 4583

SEQ ID NO: 4599 - protein, 306 aa, Homo sapiens; identical to SEQ ID NO: 4580

SEQ ID NO: 4600 - protein, 66 aa, Homo sapiens
MASNVTNKTDPRSMNSRVFIGNLNTLVVKKSDVEAIFSKYGKIVGCSVHKGFAFVQYVNERNARAA

SEQ ID NO: 4601 - protein, 147 aa, Homo sapiens; identical to SEQ ID NO: 4586

SEQ ID NO: 4602 - protein, 54 aa, Homo sapiens
MASNVTNKTDPRSMNSRVFIGNLNTLVVKKSDVEAIFSKYGKIVGCSVHKGFAF

SEQ ID NO: 4603 - protein, 293 aa, Homo sapiens
MASNVTNKMDPHSMNSRVFIGNLNTLVVKKSDVEAIFSKYGKIAGCSVHKGFAFVQYDKEKNARAAVAGEDGRMIASQVVDINLAAEPKVNRGNAGVKRSAAEMYGSSFDLDYGFQRDYYDGMYSFPARVPPPPPIALAVVPSKRQRLSGNTSRRGKSGFNSKSGKRGSSKSGKLKGDDLQAIKQELTQIKQKVDSLLENLEKIEKEQSKQEVEVKNAKSEEEQSSSSMKKDETHVKMESEGGAEDSAEEGDPLDDDVNEDQGDDQLELIKDDEKEAEEGEDDRDSTNGQDDS

SEQ ID NO: 4604 - protein, 346 aa, Homo sapiens
MDWVMKHNGPNDASDGTVRLRGLPFGCSKEEIVQFFQGLEIVPNGITLTMDYQGRSTGEAFVQFASKEIAENALGKHKERIGHRYIEIFRSSRSEIKGFYDPPRRLLGQRPGPYDRPIGGRGGYYGAGRGSMYDRMRRGGDGYDGGYGGFDDYGGYNNYGYGNDGFDDRMRDGRGMGGHGYGGAGDASSGFHGGHFVHMRGLPFRATENDIANFFSPLNPIRVHIDIGADGRATGEADVEFVTHEDAVAAMSKDKNNMQHRYIELFLNSTPGGGSGMGGSGMGGYGRDGMDNQGGYGSVGRMGMGNNYSGGYGTPDGLGGYGRGGGGSGGYYGQGGMSGGGWRGMY

SEQ ID NO: 4605 - protein, 331 aa, Homo sapiens
MDWVMKHNGPNDASDGTVRLRGLPFGCSKEEIVQFFQGLEIVPNGITLTMDYQGRSTGEAFVQFASKEIAENALGKHKERIGHRYIEIFRSSRSEIKGFYDPPRRLLGQRPGPYDRPIGGRGGYYGAGRGSYGGFDDYGGYNNYGYGNDGFDDRMRDGRGMGGHGYGGAGDASSGFHGGHFVHMRGLPFRATENDIANFFSPLNPIRVHIDIGADGRATGEADVEFVTHEDAVAAMSKDKNNMQHRYIELFLNSTPGGGSGMGGSGMGGYGRDGMDNQGGYGSVGRMGMGNNYSGGYGTPDGLGGYGRGGGGSGGYYGQGGMSGGGWRGMY

SEQ ID NO: 4606 - protein, 238 aa, Homo sapiens
MDWVMKHNGPNDASDGTVRLRGLPFGCSKEEIVQFFQGYGGFDDYGGYNNYGYGNDGFDDRMRDGRGMGGHGYGGAGDASSGFHGGHFVHMRGLPFRATENDIANFFSPLNPIRVHIDIGADGRATGEADVEFVTHEDAVAAMSKDKNNMQHRYIELFLNSTPGGGSGMGGSGMGGYGRDGMDNQGGYGSVGRMGMGNNYSGGYGTPDGLGGYGRGGGGSGGYYGQGGMSGGGWRGMY

SEQ ID NO: 4607 - protein, 463 aa, Homo sapiens
METEQPEETFPNTETNGEFGKRPAEDMEEEQAFKRSRNTDEMVELRILLQSKNAGAVIGKGGKNIKALRTDYNASVSVPDSSGPERILSISADIETIGEILKKIIPTLEEGLQLPSPTATSQLPLESDAVECLNYQHYKGSDFDCELRLLIHQSLAGGIIGVKGAKIKELRENTQTTIKLFQECCPHSTDRVVLIGGKPDRVVECIKIILDLISESPIKGRAQPYDPNFYDETYDYGGFTMMFDDRRGRPVGFPMRGRGGFDRMPPGRGGRPMPPSRRDYDDMSPRRGPPPPPPGRGGRGGSRARNLPLPPPPPPRGGDLMAYDRRGRPGDRYDGMVGFSADETWDSAIDTWSPSEWQMAYEPQGGSGYDYSYAGGRGSYGDLGGPIITTQVTIPKDLAGSIIGKGGQRIKQIRHESGASIKIDEPLEGSEDRIITITGTQDQIQNAQYLLQNSVKQYSGKFF

SEQ ID NO: 4608 - protein, 463 aa, Homo sapiens; identical to SEQ ID NO: 4607

SEQ ID NO: 4609 - protein, 306 aa, Homo sapiens
MQYNASVSVPDSSGPERILSISADIETIGEILKKIIPTLEEGLQLPSPTATSQLPLESDAVECLNYQHYKGSDFDCELRLLIHQSLAGGIIGVKGAKIKELRENTQTTIKLFQECCPHSTDRVVLIGGKPDRVVECIKIILDLISESPIKGRAQPYDPNFYDETYDYGGFTMMFDDRRGRPVGFPMRGRGGFDRMPPGRGGRPMPPSRRDYDDMSPRRGPPPPPPGRGGRGGSRARNLPLPPPPPPRGGDLMAYDRRGRPGDRYDGMVGFSADETWDSAIDTWSPSEWQMAYEPQVEYHSCSCVYQ

SEQ ID NO: 4610 - protein, 459 aa, Homo sapiens
METEQPEETFPNTETNGEFGKRPAEDMEEEQAFKRSRNTDEMVELRILLQSKNAGAVIGKGGKNIKALRTDYYLVFVVFDSILSISADIETIGEILKKIIPTLEEGLQLPSPTATSQLPLESDAVECLNYQHYKGSDFDCELRLLIHQSLAGGIIGVKGAKIKELRENTQTTIKLFQECCPHSTDRVVLIGGKPDRVVECIKIILDLISESPIKGRAQPYDPNFYDETYDYGGFTMMFDDRRGRPVGFPMRGRGGFDRMPPGRGGRPMPPSRRDYDDMSPRRGPPPPPPGRGGRGGSRARNLPLPPPPPPRGGDLMAYDRRGRPGDRYDGMVGFSADETWDSAIDTWSPSEWQMAYEPQGGSGYDYSYAGGRGSYGDLGGPIITTQVTIPKDLAGSIIGKGGQRIKQIRHESGASIKIDEPLEGSEDRIITITGTQDQIQNAQYLLQNSVKQYADVEGF

SEQ ID NO: 4611 - protein, 464 aa, Homo sapiens
METEQPEETFPNTETNGEFGKRPAEDMEEEQAFKRSRNTDEMVELRILLQSKNAGAVIGKGGKNIKALRTDYNASVSVPDSSGPERILSISADIETIGEILKKIIPTLEEGLQLPSPTATSQLPLESDAVECLNYQHYKGSDFDCELRLLIHQSLAGGIIGVKGAKIKELRENTQTTIKLFQECCPHSTDRVVLIGGKPDRVVECIKIILDLISESPIKGRAQPYDPNFYDETYDYGGFTMMFDDRRGRPVGFPMRGRGGFDRMPPGRGGRPMPPSRRDYDDMSPRRGPPPPPPGRGGRGGSRARNLPLPPPPPPRGGDLMAYDRRGRPGDRYDGMVGFSADETWDSAIDTWSPSEWQMAYEPQGGSGYDYSYAGGRGSYGDLGGPIITTQVTIPKDLAGSIIGKGGQRIKQIRHESGASIKIDEPLEGSEDRIITITGTQDQIQNAQYLLQNSVKQYADVEGF

SEQ ID NO: 4612 - protein, 463 aa, Homo sapiens; identical to SEQ ID NO: 4607

SEQ ID NO: 4613 - protein, 464 aa, Homo sapiens; identical to SEQ ID NO: 4611

SEQ ID NO: 4614 - protein, 464 aa, Homo sapiens; identical to SEQ ID NO: 4611

SEQ ID NO: 4615 - protein, 428 aa, Homo sapiens
METEQPEETFPNTETNGEFGKRPAEDMEEEQAFKRSRNTDEMVELRILLQSKNIKALRTDYNASVSVPDSSGPERILSISADIETIGEILKKIIPTLEEYQHYKGSDFDCELRLLIHQSLAGGIIGVKGAKIKELRENTQTTIKLFQECCPHSTDRVVLIGGKPDRVVECIKIILDLISESPIKGRAQPYDPNFYDETYDYGGFTMMFDDRRGRPVGFPMRGRGGFDRMPPGRGGRPMPPSRRDYDDMSPRRGPPPPPPGRGGRGGSRARNLPLPPPPPPRGGDLMAYDRRGRPGDRYDGMVGFSADETWDSAIDTWSPSEWQMAYEPQGGSGYDYSYAGGRGSYGDLGGPIITTQVTIPKDLAGSIIGKGGQRIKQIRHESGASIKIDEPLEGSEDRIITITGTQDQIQNAQYLLQNSVKQYSGKFF

SEQ ID NO: 4616 - protein, 379 aa, Homo sapiens
METEQPEETFPNTETNGEFGKRPAEDMEEEQAFKRSRNTDEMVELRILLQSKNAGAVIGKGGKNIKALRTDYNASVSVPDSSGPERILSISADIETIGEILKKIIPTLEEYQHYKGSDFDCELRLLIHQSLAGGIIGVKGAKIKELRENTQTTIKLFQECCPHSTDRVVLIGGKPDRVVECIKIILDLISESPIKGRAQPYDPNFYDETYDYGGFTMMFDDRRGRPVGFPMRGRGGFDRMPPGRGGRPMPPSRRDYDDMSPRRGPPPPPPGRGGRGGSRARNLPLPPPPPPRGGDLMAYDRRGRPGDRYDGMVGFSADETWDSAIDTWSPSEWQMAYEPQGGSGYDYSYAGGRGSYGDLGGPIITTQVTIPKDLAGSII

SEQ ID NO: 4617 - protein, 589 aa, Homo sapiens
MSRRLLPRAEKRRRRLEQRQQPDEQRRRSGAMVKMAAAGGGGGGGRYYGGGSEGGRAPKRLKTDNAGDQHGGGGGGGGGAGAAGGGGGGENYDDPHKTPASPVVHIRGLIDGVVEADLVEALQEFGPISYVVVMPKKRQALVEFEDVLGACNAVNYAADNQIYIAGHPAFVNYSTSQKISRPGDSDDSRSVNSVLLFTILNPIYSITTDVLYTICNPCGPVQRIVIFRKNGVQAMVEFDSVQSAQRAKASLNGADIYSGCCTLKIEYAKPTRLNVFKNDQDTWDYTNPNLSGQGDPGSNPNKRQRQPPLLGDHPAEYGGPHGGYHSHYHDEGYGPPPPHYEGRRMGPPVGGHRRGPSRYGPQYGHPPPPPPPPEYGPHADSPVLMVYGLDQSKMNCDRVFNVFCLYGNVEKVKFMKSKPGAAMVEMADGYAVDRAITHLNNNFMFGQKLNVCVSKQPAIMPGQSYGLEDGSCSYKDFSESRNNRFSTPEQAAKNRIQHPSNVLHFFNAPLEVTEENFFEICDELGVKRPSSVKVFSGKSERSSSGLLEWESKSDALETLGFLNHYQMKNPNGPYPYTLKLCFSTAQHAS

SEQ ID NO: 4618 - protein, 456 aa, Homo sapiens
MPKKRQALVEFEDVLGACNAVNYAADNQIYIAGHPAFVNYSTSQKISRPGDSDDSRSVNSVLLFTILNPIYSITTDVLYTICNPCGPVQRIVIFRKNGVQAMVEFDSVQSAQRAKASLNGADIYSGCCTLKIEYAKPTRLNVFKNDQDTWDYTNPNLSGQGDPGSNPNKRQRQPPLLGDHPAEYGGPHGGYHSHYHDEGYGPPPPHYEGRRMGPPVGGHRRGPSRYGPQYGHPPPPPPPPEYGPHADSPVLMVYGLDQSKMNCDRVFNVFCLYGNVEKVKFMKSKPGAAMVEMADGYAVDRAITHLNNNFMFGQKLNVCVSKQPAIMPGQSYGLEDGSCSYKDFSESRNNRFSTPEQAAKNRIQHPSNVLHFFNAPLEVTEENFFEICDELGVKRPSSVKVFSGKSERSSSGLLEWESKSDALETLGFLNHYQMKNPNGPYPYTLKLCFSTAQHAS

SEQ ID NO: 4619 - protein, 456 aa, Homo sapiens; identical to SEQ ID NO: 4618

SEQ ID NO: 4620 - protein, 179 aa, Homo sapiens
MPKKRQALVEFEDVLGACNAVNYAADNQIYIAGHPAFVNYSTSQKISRPGDSDDSRSVNSVLLFTILNPIYSITTDVLYTICNPCGPVQRIVIFRKNGVQAMVEFDSVQSAQRAKASLNGADIYSGCCTLKIEYAKPTRLNVFKNDQDTWDYTNPNLSGQGSQCMFDGTPSFRTVLTHC

SEQ ID NO: 4621 - protein, 240 aa, Homo sapiens
MVKMAAAGGGGGGGRYYGGGSEGGRAPASPVVHIRGLIDGVVEADLVEALQEFGPISYVVVMPKKRQALVEFEDVLGACNAVNYAADNQIYIAGHPAFVNYSTSQKISRPGDSDDSRSVNSVLLFTILNPIYSITTDVLYTICNPCGPVQRIVIFRKNGVQAMVEFDSVQSAQRAKASLNGADIYSGCCTLKIEYAKPTRLNVFKNDQDTWDYTNPNLSGQGSQCMFDGTPSFRTVLTHC

SEQ ID NO: 4622 - protein, 282 aa, Homo sapiens [sequence omitted]

SEQ ID NO: 4623 - protein, 508 aa, Homo sapiens
MSSSSSSPRETYEEDREYESQAKRLKTEEGEIDYSAEEGENRREATPRGGGDGGGGGRSFSQPEAGGSHHKVSVSPVVHVRGLCESVVEADLVEALEKFGTICYVMMMPFKRQALVEFENIDSAKECVTFAADEPVYIAGQQAFFNYSTSKRITRPGNTDDPSGGNKVLLLSIQNPLYPITVDVLYTVCNPVGKVQRIVIFKRNGIQAMPTRLNVIRNDNDSWDYTKPYLGRRDRGKGRQRQAILGEHPSSFRHDGYGSHGPLLPLPSRYRMGSRDTPELVAYPLPQASSSYMHGGNPSGSVVMVSGLHQLKMNCSRVFNLFCLYGNIEKVKFMKTIPGTALVEMGDEYAVERAVTHLNNVKLFGKRLNVCVSKQHSVVPSQIFELEDGTSSYKDFAMSKNNRFTSAGQASKNIIQPPSCVLHYYNVPLCVTEETFTKLCNDHEVLTFIKYKVFDAKPSAKTLSGLLEWECKTDAVEALTALNHYQIRVPNGSNPYTLKLCFSTSSHL

SEQ ID NO: 4624 - protein, 508 aa, Homo sapiens
MSSSSSSPRETYEEDREYESQAKRLKTEEGEIDYSAEEGENRREATPRGGGDGGGGGRSFSQPEAGGSHHKVSVSPVVHVRGLCESVVEADLVEALEKFGTICYVMMMPFKRQALVEFENIDSAKECVTFAADEPVYIAGQQAFFNYSTSKRITRPGNTDDPSGGNKVLLLSIQNPLYPITVDVLYTVCNPVGKVQRIVIFKRNGIQAMVDRLNVIRNDNDSWDYTKPYLGRRDRGKGRQRQAILGEHPSSFRHDGYGSHGPLLPLPSRYRMGSRDTPELVAYPLPQASSSYMHGGNPSGSVVMVSGLHQLKMNCSRVFNLFCLYGNIEKVKFMKTIPGTALVEMGDEYAVERAVTHLNNVKLFGKRLNVCVSKQHSVVPSQIFELEDGTSSYKDFAMSKNNRFTSAGQASKNIIQPPSCVLHYYNVPLCVTEETFTKLCNDHEVLTFIKYKVFDAKPSAKTLSGLLEWECKTDAVEALTALNHYQIRVPNGSNPYTLKLCFSTSSHL

SEQ ID NO: 4625 - protein, 537 aa, Homo sapiens
MLARETYEEDREYESQAKRLKTEEGEIDYSAEEGENRREATPRGGGDGGGGGRSFSQPEAGGSHHKVSVSPVVHVRGLCESVVEADLVEALEKFGTICYVMMMPFKRQALVEFENIDSAKECVTFAADEPVYIAGQQAFFNYSTSKRITRPGNTDDPSGGNKVLLLSIQNPLYPITVDVLYTVCNPVGKVQRIVIFKRNGIQAMVEFESVLCAQKAKAALNGADIYAGCCTLKIEYARPTRLNVIRNDNDSWDYTKPYLGRRDRGKGRQRQAILGEHPSSFRHDGYGSHGPLLPLPSRYRMGSRDTPELVAYPLPQASSSYMHGGNPSGSVVMVSGLHQLKMNCSRVFNLFCLYGNIEKVKFMKTIPGTALVEMGDEYAVERAVTHLNNVKLFGKRLNVCVSKQHSVVPSQIFELEDGTSSYKDFAMSKNNRFTSAGQASKNIIQPPSCVLHYYNVPLCVTEETFTKLCNDHEVLTFIKYKVFDAKPSAKTLSGLLEWECKTDAVEALTALNHYQIRVPNGSNPYTLKLCFSTSSHL

SEQ ID NO: 4626 - protein, 275 aa, Homo sapiens
MLARETYEEDREYESQAKRLKTEEGEIDYSAEEGENRREATPRGGGDGGGGGRSFSQPEAGGSHHKVSVSPVVHVRGLCESVVEADLVEALEKFGTICYVMMMPFKRQALVEFENIDSAKECVTFAADEPVYIAGQQAFFNYSTSKRITRPGNTDDPSGGNKVLLLSIQNPLYPITVDVLYTVCNPVGKVQRIVIFKRNGIQAMVEFESVLCAQKAKAALNGADIYAGCCTLKIEYARPTRLNVIRNDNDSWDYTKPYLGRRGRYFIHFRMYLIC

SEQ ID NO: 4627 - protein, 542 aa, Homo sapiens
MSSSSSSPRETYEEDREYESQAKRLKTEEGEIDYSAEEGENRREATPRGGGDGGGGGRSFSQPEAGGSHHKVSVSPVVHVRGLCESVVEADLVEALEKFGTICYVMMMPFKRQALVEFENIDSAKECVTFAADEPVYIAGQQAFFNYSTSKRITRPGNTDDPSGGNKVLLLSIQNPLYPITVDVLYTVCNPVGKVQRIVIFKRNGIQAMLMFESVLCAQKAKAALNGADIYAGCCTLKIEYARPTRLNVIRNDNDSWDYTKPYLGRRDRGKGRQRQAILGEHPSSFRHDGYGSHGPLLPLPSRYRMGSRDTPELVAYPLPQASSSYMHGGNPSGSVVMVSGLHQLKMNCSRVFNLFCLYGNIEKVKFMKTIPGTALVEMGDEYAVERAVTHLNNVKLFGKRLNVCVSKQHSVVPSQIFELEDGTSSYKDFAMSKNNRFTSAGQASKNIIQPPSCVLHYYNVPLCVTEETFTKLCNDHEVLTFIKYKVFDAKPSAKTLSGLLEWECKTDAVEALTALNHYQIRVPNGSNPYTLKLCFSTSSHL

SEQ ID NO: 4628 - protein, 747 aa, Homo sapiens
MEVKRLKVTELRSELQRRGLDSRGLKVDLAQRLQEALDAEMLEDEAGGGGAGPGGACKAEPRPVAASGGGPGGDEEEDEEEEEEDEEALLEDEDEEPPPAQALGQAAQPPPEPPEAAAMEAAAEPDASEKPAEATAGSGGVNGGEEQGLGKREEDEPEERSGDETPGSEVPGDKAAEEQGDDQDSEKSKPAGSDGERRGVKRQRDEKDEHGRAYYEFREEAYHSRSKSPLPPEEEAKDEEEDQTLVNLDTYTSDLHFQVSKDRYGGQPLFSEKFPTLWSGARSTYGVTKGKVCFEAKVTQNLPMKEGCTEVSLLRVGWSVDFSRPQLGEDEFSYGFDGRGLKAENGQFEEFGQTFGENDVIGCFANFETEEVELSFSKNGEDLGVAFWISKDSLADRALLPHVLCKNCVVELNFGQKEEPFFPPPEEFVFIHAVPVEERVRTAVPPKTIEECEVILMVGLPGSGKTQWALKYAKENPEKRYNVLGAETVLNQMRMKGLEEPEMDPKSRDLLVQQASQCLSKLVQIASRTKRNFILDQCNVYNSGQRRKLLLFKTFSRKVVVVVPNEEDWKKRLELRKEVEGDDVPESIMLEMKANFSLPEKCDYMDEVTYGELEKEEAQPIVTKYKEEARKLLPPSEKRTNRRNNRNKRNRQNRSRGQGYVGGQRRGYDNRAYGQQYWGQPGNRGGYRNFYDRYRGDYDRFYGRDYEYNRYRDYYRQYNRDWQSYYYHHPQDRDRYYRNYYGYQGYR

SEQ ID NO: 4629 - protein, 186 aa, Homo sapiens
MGKEIQLKPKANVSSYVHFLLNYRNKFKEQQPNTYVGFKEFSRKCSEKWRSISKHEKAKYEALAKLDKARYQEEMMNYVGKRKKRRKRDPQEPRRPPSSFLLFCQDHYAQLKRENPNWSVVQVAKATGKMWSTATDLEKHPYEQRVALLRAKYFEELELYRKQCNARKKYRMSARNRCRGKRVRQS

SEQ ID NO: 4630 - protein, 186 aa, Homo sapiens; identical to SEQ ID NO: 4629

SEQ ID NO: 4631 - protein, 90 aa, Homo sapiens
MPKRKAKGDAKGDKAKVKDEPQRRSARLSAKPAPPKPEPRPKKASAKKGEKLPKGRKGKADAGKDGNNPAKNRDASTLQSQKAEGTGDAK

SEQ ID NO: 4632 - protein, 90 aa, Homo sapiens; identical to SEQ ID NO: 4631

SEQ ID NO: 4633 - protein, 282 aa, Homo sapiens
MPKRKAAGQGDMRQEPKRRSARLSAMLVPVTPEVKPKRTSSSRKMKTKSDMMEENIDTSAQAVAETKQEAVVEEDYNENAKNGEAKITEAPASEKEIVEVKEENIEDATEKGGEKKEAVAAEVKNEEEDQKEDEEDQNEEKGEAGKEDKDEKGEEDGKEDKNGNEKGEDAKEKEDGKKGEDGKGNGEDGKEKGEDEKEEEDRKETGDGKENEDGKEKGDKKEGKDVKVKEDEKEREDGKEDEGGNEEEAGKEKEDLKEEEEGKEEDEIKEDDGKKEEPQSIV

SEQ ID NO: 4634 - protein, 161 aa, Homo sapiens
MPKRKPKRRSARLSAMLVPVTPEVKPKRTSSSRKMKTKSDMMEENIDTSAQAVAETKQEAVVEEDYNENAKNGEAKITEAPASEKEIVEVKEENIEDATEKGGEKKEAVAAEVKNEEEDQKEDEEDQNEEKGEAGKEDKDEKGEEDGKEDKNGNEKGEDAK

SEQ ID NO: 4635 - protein, 148 aa, Homo sapiens
MPKRKAAGQGDMRQEPKRRSARLSAMLVPVTPEVKPKRTSSSRKMKTKSDMMEENIDTSAQAVAETKQEAVVEEDYNENAKNGEAKITEAPASEKEIVEVKEENIEDATEKGGEKKEAVAAEVKNEEEDQKEDEEDQNEEKGEAGKED

SEQ ID NO: 4636 - protein, 102 aa, Homo sapiens
MPKRKAAGQGDMRQEPKRRSARLSAMLVPVTPEVKPKRTSSSRKMKTKSDMMEENIDTSAQAVAETKQEAVVEEDYNENAKNGEAKITEAPASEKEIVEVKE

SEQ ID NO: 4637 - protein, 201 aa, Homo sapiens
MPKRKMLVPVTPEVKPKRTSSSRKMKTKSDMMEENIDTSAQAVAETKQEAVVEEDYNENAKNGEAKITEAPASEKEIVEVKEENIEDATEKGGEKKEAVAAEVKNEEEDQKEDEEDQNEEKGEAGKEDKDEKGEEDGKEDKNGNEKGEDAKEKEDGKKGEDGKGNGEDGKEKGEDEKEEEDRKETGDGKENEDGKEKGDKK

SEQ ID NO: 4638 - protein, 89 aa, Homo sapiens
MPKRKAAGQGDMRQEPKRRSARLSAMLVPVTPEVKPKRTSSSRKMKTKSDMMEENIDTSAQAVAETKQEAVVEEDYNENAKNGEAKITE

SEQ ID NO: 4639 - protein, 690 aa, Homo sapiens
MNLRSVFTVEQQRILQRYYENGMTNQSKNCFQLILQCAQETKLDFSVVRTWVGNKRRKMSSKNSESGTATTGTSLSAPDITVRNVVNIARPSSQQSSWTSANNDVIVTGIYSPASSSSRQGTNKHTDTQITEAHKIPIQKTATKNDTEFQLHIPVQRQVAHCKNASLLLGEKTIILSRQTSVLNAGNSVFNHAKKNYGNSSVQASEMTVPQKPSVCHRPCKIEPVGIQRSYKPEHTGPALHNLCGQKPTIRDPYCRTQNLEIREVFSLAVSDYPQRILGGNAPQKPSSAEGNCLSIAMETGDAEDEYAREEELASMRAQIPSYSRFYESGSSLRAENQSTTLPGPGRNMPNSQMVNIRDMSDNVLYQNRNYHLTPRTSLHTASSTMYSNTNPLRSNFSPHFASSNQLRLSQNQNNYQISGNLTVPWITGCSRKRALQDRTQFSDRDLATLKKYWDNGMTSLGSVCREKIEAVATELNVDCEIVRTWIGNRRRKYRLMGIEVPPPRGGPADFSEQPESGSLSALTPGEEAGPEVGEDNDRNDEVSICLSEGSSQEEPNEVVPNDARAHKEEDHHAVTTDNVKIEIIDDEESDMISNSEVEQVNSFLDYKNEEVKFIENELEIQKQKYFKLQTFVRSLILAMKADDKEQQQALLSDLPPELEEMDFNHASLEPDDTSFSVSSLSEKNVSESL

SEQ ID NO: 4640 - protein, 632 aa, Homo sapiens
MSSKNSESGTATTGTSLSAPDITVRNVVNIARPSSQQSSWTSANNDVIVTGIYSPASSSSRQGTNKHTDTQITEAHKIPIQKTATKNDTEFQLHIPVQRQVAHCKNASLLLGEKTIILSRQTSVLNAGNSVFNHAKKNYGNSSVQASEMTVPQKPSVCHRPCKIEPVGIQRSYKPEHTGPALHNLCGQKPTIRDPYCRTQNLEIREVFSLAVSDYPQRILGGNAPQKPSSAEGNCLSIAMETGDAEDEYAREEELASMRAQIPSYSRFYESGSSLRAENQSTTLPGPGRNMPNSQMVNIRDMSDNVLYQNRNYHLTPRTSLHTASSTMYSNTNPLRSNFSPHFASSNQLRLSQNQNNYQISGNLTVPWITGCSRKRALQDRTQFSDRDLATLKKYWDNGMTSLGSVCREKIEAVATELNVDCEIVRTWIGNRRRKYRLMGIEVPPPRGGPADFSEQPESGSLSALTPGEEAGPEVGEDNDRNDEVSICLSEGSSQEEPNEVVPNDARAHKEEDHHAVTTDNVKIEIIDDEESDMISNSEVEQVNSFLDYKNEEVKFIENELEIQKQKYFKLQTFVRSLILAMKADDKEQQQALLSDLPPELEEMDFNHASLEPDDTSFSVSSLSEKNVSESL

SEQ ID NO: 4641 - protein, 207 aa, Homo sapiens
MSSKNSESGTATTGTSLSAPDITVRNVVNIARPSSQQSSWTSANNDVIVTGIYSPASSSSRQGTNKHTDTQITEAHKIPIQKTATKNDTEFQLHIPVQRQVAHCKNASLLLGEKTIILSRQTSVLNAGNSVFNHAKKNYGNSSVQASEMTVPQKPSVCHRPCKIEPVGIQRSYKPEHTGPALHNLCGQKPTIRDPYCRTQNLEIREV

SEQ ID NO: 4642 - protein, 690 aa, Homo sapiens; identical to SEQ ID NO: 4639

SEQ ID NO: 4643 - protein, 556 aa, Homo sapiens
MAREKEMQEFTRSFFRGRPDLSTLTHSIVRRRYLAHSGRSHLEPEEKQALKRLVEEELLKMQVDEAASREDKLDLTKKGKRPPTPCSDPERKRFRFNSESESGSEASSPDYFGPPAKNGVAAEVSPAKEENPRRASKAVEESSDEERQRDLPAQRGEESSEEEEKGYKGKTRKKPVVKKQAPGKASVSRKQAREESEESEAEPVQRTAKKVEGNKGTKSLKESEQESEEEILAQKKEQREEEVEEEEKEEDEEKGDWKPRTRSNGRRKSAREERSCKQKSQAKRLLGDSDSEEEQKEAASSGDDSGRDREPPVQRKSEDRTQLKGGKRLSGSSEDEEDSGKGEPTAKGSRKMARLGSTSGEESDLEREVSDSEAGGGPQGERKNRSSKKSSRKGRTRSSSSSSDGSPEAKGGKAGSGRRGEDHPAVMRLKRYIRACGAHRNYKKLLGSCCSHKERLSILRAELEALGMKGTPSLGKCRALKEQREEAAEVASLDVANIISGSGRPRRRTAWNPLGEAAPPGELYRRTLDSDEERPRPAPPDWSHMRGIISSDGESN

SEQ ID NO: 4644 - protein, 243 aa, Homo sapiens
MAREKEMQEFTRSFFRGRPDLSTLTHSIVRRRYLAHSGRSHLEPEEKQALKRLVEEELLKMQVDEAASREDKLDLTKKGKRPPTPCSDPERKRFRFNSESAGSGRRGEDHPAVMRLKRYIRACGAHRNYKKLLGSCCSHKERLSILRAELEALGMKGTPSLGKCRALKEQREEAAEVASLDVANIISGSGRPRRRTAWNPLGEAAPPGELYRRTLDSDEERPRPAPPDWSHMRGIISSDGESN

SEQ ID NO: 4645 - protein, 453 aa, Homo sapiens
MERAPPDGPLNASGALAGEAAAAGGARGFSAAWTAVLAALMALLIVATVLGNALVMLAFVADSSLRTQNNFFLLNLAISDFLVGAFCIPLYVPYVLTGRWTFGRGLCKLWLVVDYLLCTSSAFNIVLISYDRFLSVTRAVSYRAQQGDTRRAVRKMLLVWVLAFLLYGPAILSWEYLSGGSSIPEGHCYAEFFYNWYFLITASTLEFFTPFLSVTFFNLSIYLNIQRRTRLRLDGAREAAGPEPPPEAQPSPPPPPGCWGCWQKGHGEAMPLHRYGVGEAAVGAEAGEATLGGGGGGGSVASPTSSSGSSSRGTERPRSLKRGSKPSASSASLEKRMKMVSQSFTQRFRLSRDRKVAKSLAVIVSIFGLCWAPYTLLMIIRAACHGHCVPDYWYETSFWLLWANSAVNPVLYPLCHHSFRRAFTKLLCPQKLKIQPHSSLEHCWKKMKKKTCL

SEQ ID NO: 4646 - protein, 445 aa, Homo sapiens
MERAPPDGPLNASGALAGEAAAAGGARGFSAAWTAVLAALMALLIVATVLGNALVMLAFVADSSLRTQNNFFLLNLAISDFLVGAFCIPLYVPYVLTGRWTFGRGLCKLWLVVDYLLCTSSAFNIVLISYDRFLSVTRAVSYRAQQGDTRRAVRKMLLVWVLAFLLYGPAILSWEYLSGGSSIPEGHCYAEFFYNWYFLITASTLEFFTPFLSVTFFNLSIYLNIQRRTRLRLDGAREAAGPEPPPEAQPSPPPPPGCWGCWQKGHGEAMPLHRYGVGEAAVGAEAGEATLGGGGGGGSVASPTSSSGSSSRGTERPRSLKRGSKPSASSASLEKRMKMVSQSFTQRFRLSRDRKVAKSLAVIVSIFGLCWAPYTLLMIIRAACHGHCVPDYWYETSFWLLWANSAVNPVLYPLCHHSFRRAFTKLLCPQKLKIQPHSSLEHCWK

SEQ ID NO: 4647 - protein, 415 aa, Homo sapiens
MERAPPDGPLNASGALAGEAAAAGGARGFSAAWTAVLAALMALLIVATVLGNALVMLAFVADSSLRTQNNFFLLNLAISDFLVGAFCIPLYVPYVLTGRWTFGRGLCKLWLVVDYLLCTSSAFNIVLISYDRFLSVTRAVSYRAQQGDTRRAVRKMLLVWVLAFLLYGPAILSWEYLSGGSSIPEGHCYAEFFYNWYFLITASTLEFFTPFLSVTFFNLSIYLNIQRRTRLRLKGHGEAMPLHRYGVGEAAVGAEAGEATLGGGGGGGSVASPTSSSGSSSRGTERPRSLKRGSKPSASSASLEKRMKMVSQSFTQRFRLSRDRKVAKSLAVIVSIFGLCWAPYTLLMIIRAACHGHCVPDYWYETSFWLLWANSAVNPVLYPLCHHSFRRAFTKLLCPQKLKIQPHSSLEHCWK

SEQ ID NO: 4648 - protein, 131 aa, Homo sapiens
MSGRGKQGGKARAKSKSRSSRAGLQFPVGRIHRLLRKGNYAERIGAGAPVYLAAVLEYLTAEILELAGNASRDNKKTRIIPRHLQLAIRNDEELNKLLGGVTIAQGGVLPNIQAVLLPKKTESHHHKAQSK

SEQ ID NO: 4649 - protein, 130 aa, Homo sapiens
MSGRGKQGGKARAKAKTRSSRAGLQFPVGRVHRLLRKGNYAERVGAGAPVYLAAVLEYLTAEILELAGNAARDNKKTRIIPRHLQLAIRNDEELNKLLGKVTIAQGGVLPNIQAVLLPKKTESHHKAKGK

SEQ ID NO: 4650 - protein, 128 aa, Homo sapiens
MSGRGKQGGKARAKAKTRSSRAGLQFPVGRVHRLLRKGNYAERVGAGAPVYLAAVLEYLTAEILELAGNAARDNKKTRIIPRHLQLAIRNDEELNKLLGKVTIAQGGVLPNIQAVLLPKKTESHHKAK

SEQ ID NO: 4651 - protein, 126 aa, Homo sapiens [sequence omitted]

SEQ ID NO: 4652 - protein, 126 aa, Homo sapiens [sequence omitted]

SEQ ID NO: 4653 - protein, 126 aa, Homo sapiens
MPEPAKSAPAPKKGSKKAVTKAQKKDGKKRKRSRKESYSVYVYKVLKQVHPDTGISSKAMGIMNSFVNDIFERIAGEASRLAHYNKRSTITSREIQTAVRLLLPGELAKHAVSEGTKAVTKYTSAK

SEQ ID NO: 4654 - protein, 126 aa, Homo sapiens; identical to SEQ ID NO: 4653

SEQ ID NO: 4655 - protein, 130 aa, Homo sapiens
MSGRGKQGGKARAKAKSRSSRAGLQFPVGRVHRLLRKGNYAERVGAGAPVYMAAVLEYLTAEILELAGNAARDNKKTRIIPRHLQLAIRNDEELNKLLGKVTIAQGGVLPNIQAVLLPKKTESHHKAKGK

SEQ ID NO: 4656 - protein, 130 aa, Homo sapiens; identical to SEQ ID NO: 4655

SEQ ID NO: 4657 - protein, 130 aa, Homo sapiens
MSGRGKQGGKARAKAKSRSSRAGLQFPVGRVHRLLRKGNYAERVGAGAPVYLAAVLEYLTAEILELAGNAARDNKKTRIIPRHLQLAVRNDEELNKLLGGVTIAQGGVLPNIQAVLLPKKTESHKPGKNK

SEQ ID NO: 4658 - protein, 126 aa, Homo sapiens
MPDPAKSAPAPKKGSKKAVTKVQKKDGKKRKRSRKESYSVYVYKVLKQVHPDTGISSKAMGIMNSFVNDIFERIAGEASRLAHYNKRSTITSREIQTAVRLLLPGELAKHAVSEGTKAVTKYTSSK

SEQ ID NO: 4659 - protein, 166 aa, Homo sapiens
MPDPAKSAPAPKKGSKKAVTKVQKKDGKKRKRSRKESYSVYVYKVLKQVHPDTGISSKAMGIMNSFVNDIFERIAGEASRLAHYNKRSTITSREIQTAVRLLLPGELAKHAVSEGTKAVTKYTSSNPRNLSPTKPGGSEDRQPPPSQLSAIPPFCLVLRAGIAGQV

SEQ ID NO: 4660 - protein, 134 aa, Homo sapiens
MPDPAKSAPAPKKGSKKAVTKVQKKDGKKRKRSRKESYSVYVYKVLKQVHPDTGISSKAMGIMNSFVNDIFERIAGEASRLAHYNKRSTITSREIQTAVRLLLPGELAKHAVSEGTKAVTKYTSSKLIGPILWK

SEQ ID NO: 4661 - protein, 136 aa, Homo sapiens
MARTKQTARKSTGGKAPRKQLATKAARKSAPATGGVKKPHRYRPGTVALREIRRYQKSTELLIRKLPFQRLVREIAQEFKTDLRFQSSAVMALQEAREAYLVGLFEDTNLCAIHAKRVTIMPKDIQLVSRIRGERA

SEQ ID NO: 4662 - protein, 130 aa, Homo sapiens
MSGRGKQGGKARAKAKSRSSRAGLQFPVGRVHRLLRKGNYSERVGAGAPVYLAAVLEYLTAEILELAGNAARDNKKTRIIPRHLQLAIRNDEELNKLLGRVTIAQGGVLPNIQAVLLPKKTESHHKAKGK

SEQ ID NO: 4663 - protein, 126 aa, Homo sapiens
MPDPSKSAPAPKKGSKKAVTKAQKKDGKKRKRGRKESYSIYVYKVLKQVHPDTGISSKAMGIMNSFVNDIFERIASEASRLAHYNKRSTITSREVQTAVRLLLPGELAKHAVSEGTKAVTKYTSSK

SEQ ID NO: 4664 - protein, 517 aa, Homo sapiens
MPPPGKVPRKENLWLQCEWGSCSFVCSTMEKFFEHVTQHLQQHLHGSGEEEEEEEEDDPLEEEFSCLWQECGFCSLDSSADLIRHVYFHCYHTKLKQWGLQALQSQADLGPCILDFQSRNVIPDIPDHFLCLWEHCENSFDNPEWFYRHVEAHSLCCEYEAVGKDNPVVLCGWKGCTCTFKDRSKLREHLRSHTQEKVVACPTCGGMFANNTKFLDHIRRQTSLDQQHFQCSHCSKRFATERLLRDHMRNHVNHYKCPLCDMTCPLPSSLRNHMRFRHSEDRPFKCDCCDYSCKNLIDLQKHLDTHSEEPAYRCDFENCTFSARSLCSIKSHYRKVHEGDSEPRYKCHVCDKCFTRGNNLTVHLRKKHQFKWPSGHPRFRYKEHEDGYMRLQLVRYESVELTQQLLRQPQEGSGLGTSLNESSLQGIILETVPGEPGRKEEEEEGKGSEGTALSASQDNPSSVIHVVNQTNAQGQQEIVYYVLSEAPGEPPPAPEPPSGGIMEKLQGIAEEPEIQMV

SEQ ID NO: 4665 - protein, 419 aa, Homo sapiens
MPPPGKVPRKENLWLQCEWGSCSFVCSTMEKFFEHVTQHLQQHLHGSGEEEEEEEEDDPLEEEFSCLWQECGFCSLDSSADLIRHVYFHCYHTKLKQWGLQALQSQADLGPCILDFQSRNVIPDIPDHFLCLWEHCENSFDNPEWFYRHVEAHSLCCEYEAVGKDNPVVLCGWKGCTCTFKDRSKLREHLRSHTQEKVVACPTCGGMFANNTKFLDHIRRQTSLDQQHFQCSHCSKRFATERLLRDHMRNHVNHYKCPLCDMTCPLPSSLRNHMRFRHSEDRPFKCDCCDYSCKNLIDLQKHLDTHSEEPAYRCDFENCTFSARSLCSIKSHYRKVHEGDSEPRYKCHVCDKCFTRGNNLTVHLRKKHQFKWPSGHPRFRLGHFCIPLPGFAALYAPTSPGTRNMKMAICGCSWFATRV
